United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 178

SEQ ID NO: 7428255 - DNA, 22 bp, Homo sapiens
tagaaagtaaatcagttttatt

SEQ ID NO: 7428256 - DNA, 22 bp, Homo sapiens
tagaaagtaaatcagttttatt

SEQ ID NO: 7428257 - DNA, 22 bp, Homo sapiens
tagaaagtactaaatttaactg

SEQ ID NO: 7428258 - DNA, 22 bp, Homo sapiens
tagaaagtaaatcagttttatt

SEQ ID NO: 7428259 - DNA, 22 bp, Homo sapiens
tagaaagtaaatcagttttatt

SEQ ID NO: 7428260 - DNA, 22 bp, Homo sapiens
tagaaaggcaatcattcttgga

SEQ ID NO: 7428261 - DNA, 22 bp, Homo sapiens
tagaaaggctgctgccaaccca

SEQ ID NO: 7428262 - DNA, 22 bp, Homo sapiens
tagaaaggcaatcattcttgga

SEQ ID NO: 7428263 - DNA, 22 bp, Homo sapiens
tagaaaggcaatcattcttgga

SEQ ID NO: 7428264 - DNA, 22 bp, Homo sapiens
tagaaaggctgctgccaaccca

SEQ ID NO: 7428265 - DNA, 22 bp, Homo sapiens
tagaaaggctgctgccaaccca

SEQ ID NO: 7428266 - DNA, 22 bp, Homo sapiens
tagaaagtaaacacgaagtctc

SEQ ID NO: 7428267 - DNA, 22 bp, Homo sapiens
tagaaagtaaacacgaagtctc

SEQ ID NO: 7428268 - DNA, 22 bp, Homo sapiens
tagaaagtaaatcagttttatt

SEQ ID NO: 7428269 - DNA, 22 bp, Homo sapiens
tagaaagtaaatcagttttatt

SEQ ID NO: 7428270 - DNA, 22 bp, Homo sapiens
tagaaaggatattgagatgaat

SEQ ID NO: 7428271 - DNA, 22 bp, Homo sapiens
tagaaaggaagctacttagggg

SEQ ID NO: 7428272 - DNA, 22 bp, Homo sapiens
tagaaaggagcattttagacta

SEQ ID NO: 7428273 - DNA, 22 bp, Homo sapiens
tagaaaggagcattttagacta

SEQ ID NO: 7428274 - DNA, 22 bp, Homo sapiens
tagaaaggcaagcgtgaaatat

SEQ ID NO: 7428275 - DNA, 22 bp, Homo sapiens
tagaaaggcaagcgtgaaatat

SEQ ID NO: 7428276 - DNA, 22 bp, Homo sapiens
tagaaaggcaagcgtgaaatat

SEQ ID NO: 7428277 - DNA, 22 bp, Homo sapiens
tagaaaggatattgagatgaat

SEQ ID NO: 7428278 - DNA, 22 bp, Homo sapiens
tagaaaggatattgagatgaat

SEQ ID NO: 7428279 - DNA, 22 bp, Homo sapiens
tagaaaggagcattttagacta

SEQ ID NO: 7428280 - DNA, 22 bp, Homo sapiens
tagaaagctggaggaattcttt

SEQ ID NO: 7428281 - DNA, 22 bp, Homo sapiens
tagaaaggaacaggtcagcgtt

SEQ ID NO: 7428282 - DNA, 22 bp, Homo sapiens
tagaaaggaacaggtcagcgtt

SEQ ID NO: 7428283 - DNA, 22 bp, Homo sapiens
tagaaaggaacaggtcagcgtt

SEQ ID NO: 7428284 - DNA, 22 bp, Homo sapiens
tagaaaggaagctacttagggg

SEQ ID NO: 7428285 - DNA, 22 bp, Homo sapiens
tagaaagcttggggtgtttaaa

SEQ ID NO: 7428286 - DNA, 22 bp, Homo sapiens
tagaaagctgagtaatacattt

SEQ ID NO: 7428287 - DNA, 22 bp, Homo sapiens
tagaaagctgagtaatacattt

SEQ ID NO: 7428288 - DNA, 22 bp, Homo sapiens
tagaaagctgagtaatacattt

SEQ ID NO: 7428289 - DNA, 22 bp, Homo sapiens
tagaaagcgttaaatctacaga

SEQ ID NO: 7428290 - DNA, 22 bp, Homo sapiens
tagaaagcgttaaatctacaga

SEQ ID NO: 7428291 - DNA, 22 bp, Homo sapiens
tagaaagcgttaaatctacaga

SEQ ID NO: 7428292 - DNA, 22 bp, Homo sapiens
tagaaagaacttcatgtaaaac

SEQ ID NO: 7428293 - DNA, 22 bp, Homo sapiens
tagaaagaacttcatgtaaaac

SEQ ID NO: 7428294 - DNA, 22 bp, Homo sapiens
tagaaagaacttcatgtaaaac

SEQ ID NO: 7428295 - DNA, 22 bp, Homo sapiens
tagaaagaacttcatgtaaaac

SEQ ID NO: 7428296 - DNA, 22 bp, Homo sapiens
tagaaagaacttcatgtaaaac

SEQ ID NO: 7428297 - DNA, 22 bp, Homo sapiens
tagaaatgcccagattctgcta

SEQ ID NO: 7428298 - DNA, 22 bp, Homo sapiens
tagaaatgcccagattctgcta

SEQ ID NO: 7428299 - DNA, 22 bp, Homo sapiens
tagaaatgcccagattctgcta

SEQ ID NO: 7428300 - DNA, 22 bp, Homo sapiens
tagaaatgcagtgtactgtgtc

SEQ ID NO: 7428301 - DNA, 22 bp, Homo sapiens
tagaaatgcagtgtactgtgtc

SEQ ID NO: 7428302 - DNA, 22 bp, Homo sapiens
tagaaatggagaacagattaat

SEQ ID NO: 7428303 - DNA, 22 bp, Homo sapiens
tagaaatgcccagattctgcta

SEQ ID NO: 7428304 - DNA, 22 bp, Homo sapiens
tagaaatggagaacagattaat

SEQ ID NO: 7428305 - DNA, 22 bp, Homo sapiens
tagaaatggagaacagattaat

SEQ ID NO: 7428306 - DNA, 22 bp, Homo sapiens
tagaaatgcccagattctgcta

SEQ ID NO: 7428307 - DNA, 22 bp, Homo sapiens
tagaaatgcccagattctgcta

SEQ ID NO: 7428308 - DNA, 22 bp, Homo sapiens
tagaaatgcagtgtactgtgtc

SEQ ID NO: 7428309 - DNA, 22 bp, Homo sapiens
tagaaatgcagtgtactgtgtc

SEQ ID NO: 7428310 - DNA, 22 bp, Homo sapiens
tagaaatgcagtgtactgtgtc

SEQ ID NO: 7428311 - DNA, 22 bp, Homo sapiens
tagaaatgcagtgtactgtgtc

SEQ ID NO: 7428312 - DNA, 22 bp, Homo sapiens
tagaaatgattttgatgcttca

SEQ ID NO: 7428313 - DNA, 22 bp, Homo sapiens
tagaaatgattttgatgcttca

SEQ ID NO: 7428314 - DNA, 22 bp, Homo sapiens
tagaaatgattttgatgcttca

SEQ ID NO: 7428315 - DNA, 22 bp, Homo sapiens
tagaaatgattttgatgcttca

SEQ ID NO: 7428316 - DNA, 22 bp, Homo sapiens
tagaaatgattggttgagctct

SEQ ID NO: 7428317 - DNA, 22 bp, Homo sapiens
tagaaatgattggttgagctct

SEQ ID NO: 7428318 - DNA, 22 bp, Homo sapiens
tagaaatgattgagctgtaata

SEQ ID NO: 7428319 - DNA, 22 bp, Homo sapiens
tagaaatgattggttgagctct

SEQ ID NO: 7428320 - DNA, 22 bp, Homo sapiens
tagaaatgattggttgagctct

SEQ ID NO: 7428321 - DNA, 22 bp, Homo sapiens
tagaaatgagccatggtagagc

SEQ ID NO: 7428322 - DNA, 22 bp, Homo sapiens
tagaaatgagccatggtagagc

SEQ ID NO: 7428323 - DNA, 22 bp, Homo sapiens
tagaaatgagccatggtagagc

SEQ ID NO: 7428324 - DNA, 22 bp, Homo sapiens
tagaaatgattgagctgtaata

SEQ ID NO: 7428325 - DNA, 22 bp, Homo sapiens
tagaaatgagccatggtagagc

SEQ ID NO: 7428326 - DNA, 22 bp, Homo sapiens
tagaaatgaatgtttaaaagtc

SEQ ID NO: 7428327 - DNA, 22 bp, Homo sapiens
tagaaatgaatgtttaaaagtc

SEQ ID NO: 7428328 - DNA, 22 bp, Homo sapiens
tagaaatcttgttactatgtgt

SEQ ID NO: 7428329 - DNA, 22 bp, Homo sapiens
tagaaatcttgttactatgtgt

SEQ ID NO: 7428330 - DNA, 22 bp, Homo sapiens
tagaaatcttgttactatgtgt

SEQ ID NO: 7428331 - DNA, 22 bp, Homo sapiens
tagaaatgaatgtttaaaagtc

SEQ ID NO: 7428332 - DNA, 22 bp, Homo sapiens
tagaaatgaatgtttaaaagtc

SEQ ID NO: 7428333 - DNA, 22 bp, Homo sapiens
tagaaagtggttgagagtttag

SEQ ID NO: 7428334 - DNA, 22 bp, Homo sapiens
tagaaagtggttgagagtttag

SEQ ID NO: 7428335 - DNA, 22 bp, Homo sapiens
tagaaagtgaaggttaattaat

SEQ ID NO: 7428336 - DNA, 22 bp, Homo sapiens
tagaaagtgaaggttaattaat

SEQ ID NO: 7428337 - DNA, 22 bp, Homo sapiens
tagaaagtgaaggttaattaat

SEQ ID NO: 7428338 - DNA, 22 bp, Homo sapiens
tagaaagtgaaggttaattaat

SEQ ID NO: 7428339 - DNA, 22 bp, Homo sapiens
tagaaataaatctgcagctggg

SEQ ID NO: 7428340 - DNA, 22 bp, Homo sapiens
tagaaagtggttgagagtttag

SEQ ID NO: 7428341 - DNA, 22 bp, Homo sapiens
tagaaagtggttgagagtttag

SEQ ID NO: 7428342 - DNA, 22 bp, Homo sapiens
tagaaatcacaaaccagtagtt

SEQ ID NO: 7428343 - DNA, 22 bp, Homo sapiens
tagaaataaatctgcagctggg

SEQ ID NO: 7428344 - DNA, 22 bp, Homo sapiens
tagaaatcacaaaccagtagtt

SEQ ID NO: 7428345 - DNA, 22 bp, Homo sapiens
tagaaatcacagaaaatcaggg

SEQ ID NO: 7428346 - DNA, 22 bp, Homo sapiens
tagaaatcacagaaaatcaggg

SEQ ID NO: 7428347 - DNA, 22 bp, Homo sapiens
tagaaagtggttgagagtttag

SEQ ID NO: 7428348 - DNA, 22 bp, Homo sapiens
tagaaataaatctgcagctggg

SEQ ID NO: 7428349 - DNA, 22 bp, Homo sapiens
tagaaatcagcaggcatatgta

SEQ ID NO: 7428350 - DNA, 22 bp, Homo sapiens
tagaaatcagcaggcatatgta

SEQ ID NO: 7428351 - DNA, 22 bp, Homo sapiens
tagaaatcagcaggcatatgta

SEQ ID NO: 7428352 - DNA, 20 bp, Homo sapiens
tagaaatcttataaaagact

SEQ ID NO: 7428353 - DNA, 20 bp, Homo sapiens
tagaaatcttataaaagact

SEQ ID NO: 7428354 - DNA, 20 bp, Homo sapiens
tagaaatcttataaaagact

SEQ ID NO: 7428355 - DNA, 22 bp, Homo sapiens
tagaaatctacttagactttct

SEQ ID NO: 7428356 - DNA, 22 bp, Homo sapiens
tagaaatccccagtctcatagt

SEQ ID NO: 7428357 - DNA, 22 bp, Homo sapiens
tagaaatctacttagactttct

SEQ ID NO: 7428358 - DNA, 22 bp, Homo sapiens
tagaaatccccagtctcatagt

SEQ ID NO: 7428359 - DNA, 22 bp, Homo sapiens
tagaaatccccagtctcatagt

SEQ ID NO: 7428360 - DNA, 22 bp, Homo sapiens
tagaaatcatttagaagtattg

SEQ ID NO: 7428361 - DNA, 22 bp, Homo sapiens
tagaaatcatttagaagtattg

SEQ ID NO: 7428362 - DNA, 17 bp, Homo sapiens
tagaaatcatagggttg

SEQ ID NO: 7428363 - DNA, 22 bp, Homo sapiens
tagaaatcaggtttttagaaag

SEQ ID NO: 7428364 - DNA, 22 bp, Homo sapiens
tagaaatcaggtttttagaaag

SEQ ID NO: 7428365 - DNA, 22 bp, Homo sapiens
tagaaatcaggtttttagaaag

SEQ ID NO: 7428366 - DNA, 21 bp, Homo sapiens
tagaaatcagctggtgcctct

SEQ ID NO: 7428367 - DNA, 22 bp, Homo sapiens
tacttttctataggtttgaaat

SEQ ID NO: 7428368 - DNA, 22 bp, Homo sapiens
tacttttcctggaaccactgct

SEQ ID NO: 7428369 - DNA, 22 bp, Homo sapiens
tacttttctataggtttgaaat

SEQ ID NO: 7428370 - DNA, 22 bp, Homo sapiens
tacttttccagggctggctgag

SEQ ID NO: 7428371 - DNA, 22 bp, Homo sapiens
tacttttcctggaaccactgct

SEQ ID NO: 7428372 - DNA, 22 bp, Homo sapiens
tacttttcaagcagctggttat

SEQ ID NO: 7428373 - DNA, 22 bp, Homo sapiens
tacttttcacccagcccgcttc

SEQ ID NO: 7428374 - DNA, 22 bp, Homo sapiens
tacttttcataatgaagcagca

SEQ ID NO: 7428375 - DNA, 22 bp, Homo sapiens
tacttttatgtgatgaaatctg

SEQ ID NO: 7428376 - DNA, 22 bp, Homo sapiens
tacttttatgtgatgaaatctg

SEQ ID NO: 7428377 - DNA, 22 bp, Homo sapiens
tacttttatgtgatgaaatctg

SEQ ID NO: 7428378 - DNA, 22 bp, Homo sapiens
tacttttagcctatttgattct

SEQ ID NO: 7428379 - DNA, 22 bp, Homo sapiens
tacttttagcctatttgattct

SEQ ID NO: 7428380 - DNA, 22 bp, Homo sapiens
tacttttagcctatttgattct

SEQ ID NO: 7428381 - DNA, 22 bp, Homo sapiens
tacttttatgtgatgaaatctg

SEQ ID NO: 7428382 - DNA, 22 bp, Homo sapiens
tacttttatgtgatgaaatctg

SEQ ID NO: 7428383 - DNA, 22 bp, Homo sapiens
tacttttattattgcccctcca

SEQ ID NO: 7428384 - DNA, 22 bp, Homo sapiens
tacttttatgtgatgaaatctg

SEQ ID NO: 7428385 - DNA, 22 bp, Homo sapiens
tactttttatgataagaactga

SEQ ID NO: 7428386 - DNA, 22 bp, Homo sapiens
tactttttatgataagaactga

SEQ ID NO: 7428387 - DNA, 22 bp, Homo sapiens
tactttttatgataagaactga

SEQ ID NO: 7428388 - DNA, 22 bp, Homo sapiens
tactttttatgataagaactga

SEQ ID NO: 7428389 - DNA, 22 bp, Homo sapiens
tactttttatgataagaactga

SEQ ID NO: 7428390 - DNA, 22 bp, Homo sapiens
tactttttatgataagaactga

SEQ ID NO: 7428391 - DNA, 22 bp, Homo sapiens
tactttttatgataagaactga

SEQ ID NO: 7428392 - DNA, 22 bp, Homo sapiens
tactttttatgataagaactga

SEQ ID NO: 7428393 - DNA, 22 bp, Homo sapiens
tactttttatgataagaactga

SEQ ID NO: 7428394 - DNA, 22 bp, Homo sapiens
tactttttagcacagtgtgtgc

SEQ ID NO: 7428395 - DNA, 22 bp, Homo sapiens
tactttttatgataagaactga

SEQ ID NO: 7428396 - DNA, 22 bp, Homo sapiens
tactttttagcacagtgtgtgc

SEQ ID NO: 7428397 - DNA, 22 bp, Homo sapiens
tactttttagcacagtgtgtgc

SEQ ID NO: 7428398 - DNA, 22 bp, Homo sapiens
tactttttagcacagtgtgtgc

SEQ ID NO: 7428399 - DNA, 22 bp, Homo sapiens
tactttttagcacagtgtgtgc

SEQ ID NO: 7428400 - DNA, 22 bp, Homo sapiens
tactttttagcacagtgtgtgc

SEQ ID NO: 7428401 - DNA, 22 bp, Homo sapiens
tacttttctttgtcatgcatct

SEQ ID NO: 7428402 - DNA, 22 bp, Homo sapiens
tacttttctttgtcatgcatct

SEQ ID NO: 7428403 - DNA, 22 bp, Homo sapiens
tacttttctgtgtggcagtcac

SEQ ID NO: 7428404 - DNA, 22 bp, Homo sapiens
tacttttctttgtcatgcatct

SEQ ID NO: 7428405 - DNA, 22 bp, Homo sapiens
tagaaaagccccagctggaggg

SEQ ID NO: 7428406 - DNA, 22 bp, Homo sapiens
tagaaaagataacattctgtgc

SEQ ID NO: 7428407 - DNA, 22 bp, Homo sapiens
tagaaaagataacattctgtgc

SEQ ID NO: 7428408 - DNA, 22 bp, Homo sapiens
tagaaaagataacattctgtgc

SEQ ID NO: 7428409 - DNA, 22 bp, Homo sapiens
tagaaaagataacattctgtgc

SEQ ID NO: 7428410 - DNA, 22 bp, Homo sapiens
tagaaaagataacattctgtgc

SEQ ID NO: 7428411 - DNA, 22 bp, Homo sapiens
tagaaaagataacattctgtgc

SEQ ID NO: 7428412 - DNA, 22 bp, Homo sapiens
tagaaaagataacattctgtgc

SEQ ID NO: 7428413 - DNA, 22 bp, Homo sapiens
tagaaaagaattttatttgata

SEQ ID NO: 7428414 - DNA, 22 bp, Homo sapiens
tagaaaagaattttatttgata

SEQ ID NO: 7428415 - DNA, 22 bp, Homo sapiens
tagaaaagaattttatttgata

SEQ ID NO: 7428416 - DNA, 22 bp, Homo sapiens
tagaaaagaagtctggccggga

SEQ ID NO: 7428417 - DNA, 22 bp, Homo sapiens
tagaaaagaagtctggccggga

SEQ ID NO: 7428418 - DNA, 22 bp, Homo sapiens
tagaaaagaattttatttgata

SEQ ID NO: 7428419 - DNA, 22 bp, Homo sapiens
tagaaaagaattttatttgata

SEQ ID NO: 7428420 - DNA, 22 bp, Homo sapiens
tagaaaagaattttatttgata

SEQ ID NO: 7428421 - DNA, 22 bp, Homo sapiens
tagaaaagataacattctgtgc

SEQ ID NO: 7428422 - DNA, 22 bp, Homo sapiens
tagaaaagataacattctgtgc

SEQ ID NO: 7428423 - DNA, 22 bp, Homo sapiens
tagaaaactaatacatgcttga

SEQ ID NO: 7428424 - DNA, 22 bp, Homo sapiens
tagaaaactaatacatgcttga

SEQ ID NO: 7428425 - DNA, 22 bp, Homo sapiens
tagaaaactaatacatgcttga

SEQ ID NO: 7428426 - DNA, 22 bp, Homo sapiens
tagaaaactaatacatgcttga

SEQ ID NO: 7428427 - DNA, 22 bp, Homo sapiens
tagaaaactaatacatgcttga

SEQ ID NO: 7428428 - DNA, 22 bp, Homo sapiens
tagaaaactaatacatgcttga

SEQ ID NO: 7428429 - DNA, 22 bp, Homo sapiens
tagaaaactaatacatgcttga

SEQ ID NO: 7428430 - DNA, 22 bp, Homo sapiens
tagaaaactaatacatgcttga

SEQ ID NO: 7428431 - DNA, 22 bp, Homo sapiens
tactttttgtctctttgaatgt

SEQ ID NO: 7428432 - DNA, 22 bp, Homo sapiens
tactttttgtctctttgaatgt

SEQ ID NO: 7428433 - DNA, 22 bp, Homo sapiens
tactttttgtctctttgaatgt

SEQ ID NO: 7428434 - DNA, 22 bp, Homo sapiens
tactttttgtctctttgaatgt

SEQ ID NO: 7428435 - DNA, 22 bp, Homo sapiens
tactttttgtctctttgaatgt

SEQ ID NO: 7428436 - DNA, 22 bp, Homo sapiens
tactttttgtctctttgaatgt

SEQ ID NO: 7428437 - DNA, 22 bp, Homo sapiens
tactttttgtctctttgaatgt

SEQ ID NO: 7428438 - DNA, 22 bp, Homo sapiens
tactttttgtctctttgaatgt

SEQ ID NO: 7428439 - DNA, 19 bp, Homo sapiens
tactttttcaggacagagt

SEQ ID NO: 7428440 - DNA, 19 bp, Homo sapiens
tactttttcaggacagagt

SEQ ID NO: 7428441 - DNA, 22 bp, Homo sapiens
taccaaagaatattttaaatag

SEQ ID NO: 7428442 - DNA, 22 bp, Homo sapiens
taccaaagaatattttaaatag

SEQ ID NO: 7428443 - DNA, 22 bp, Homo sapiens
taccaaagatacataaatgtga

SEQ ID NO: 7428444 - DNA, 22 bp, Homo sapiens
tactttgaattaaatatttcag

SEQ ID NO: 7428445 - DNA, 22 bp, Homo sapiens
tactttgacgccggtgggaata

SEQ ID NO: 7428446 - DNA, 22 bp, Homo sapiens
tactttgaccaccatctgatta

SEQ ID NO: 7428447 - DNA, 22 bp, Homo sapiens
tactttgaccaccatctgatta

SEQ ID NO: 7428448 - DNA, 22 bp, Homo sapiens
taccaaaagcttgtttcataca

SEQ ID NO: 7428449 - DNA, 22 bp, Homo sapiens
taccaaaagcttgtttcataca

SEQ ID NO: 7428450 - DNA, 22 bp, Homo sapiens
taccaaagaatattttaaatag

SEQ ID NO: 7428451 - DNA, 22 bp, Homo sapiens
taccaaaaccaagccattatct

SEQ ID NO: 7428452 - DNA, 22 bp, Homo sapiens
taccaaaagcttgtttcataca

SEQ ID NO: 7428453 - DNA, 22 bp, Homo sapiens
taccaaaagcttgtttcataca

SEQ ID NO: 7428454 - DNA, 22 bp, Homo sapiens
taccaaaagcttgtttcataca

SEQ ID NO: 7428455 - DNA, 22 bp, Homo sapiens
taccaaaagcttgtttcataca

SEQ ID NO: 7428456 - DNA, 22 bp, Homo sapiens
tacattttctaggggaccaaga

SEQ ID NO: 7428457 - DNA, 22 bp, Homo sapiens
tacattttctaggggaccaaga

SEQ ID NO: 7428458 - DNA, 22 bp, Homo sapiens
tacattttctaggggaccaaga

SEQ ID NO: 7428459 - DNA, 22 bp, Homo sapiens
tacatttgttatagaaatgaag

SEQ ID NO: 7428460 - DNA, 22 bp, Homo sapiens
tacatttgttatagaaatgaag

SEQ ID NO: 7428461 - DNA, 22 bp, Homo sapiens
tacatttgttatagaaatgaag

SEQ ID NO: 7428462 - DNA, 22 bp, Homo sapiens
tacatttgttatagaaatgaag

SEQ ID NO: 7428463 - DNA, 22 bp, Homo sapiens
tacatttgttatagaaatgaag

SEQ ID NO: 7428464 - DNA, 22 bp, Homo sapiens
tacatttgttatagaaatgaag

SEQ ID NO: 7428465 - DNA, 19 bp, Homo sapiens
tacatttgtgtacacttgt

SEQ ID NO: 7428466 - DNA, 19 bp, Homo sapiens
tacatttgtgtacacttgt

SEQ ID NO: 7428467 - DNA, 19 bp, Homo sapiens
tacatttgtgtacacttgt

SEQ ID NO: 7428468 - DNA, 22 bp, Homo sapiens
tacatttgggacaataagagaa

SEQ ID NO: 7428469 - DNA, 22 bp, Homo sapiens
tacatttgggacaataagagaa

SEQ ID NO: 7428470 - DNA, 22 bp, Homo sapiens
tacatttgggacaataagagaa

SEQ ID NO: 7428471 - DNA, 22 bp, Homo sapiens
tacattttctaggggaccaaga

SEQ ID NO: 7428472 - DNA, 22 bp, Homo sapiens
tacattttctaggggaccaaga

SEQ ID NO: 7428473 - DNA, 22 bp, Homo sapiens
taccaaaaagtgagccccagag

SEQ ID NO: 7428474 - DNA, 22 bp, Homo sapiens
tacattttctaggggaccaaga

SEQ ID NO: 7428475 - DNA, 22 bp, Homo sapiens
tacattttctaggggaccaaga

SEQ ID NO: 7428476 - DNA, 22 bp, Homo sapiens
taccaaaaccaagccattatct

SEQ ID NO: 7428477 - DNA, 22 bp, Homo sapiens
taccaaaaccaagccattatct

SEQ ID NO: 7428478 - DNA, 22 bp, Homo sapiens
taccaaaaccaagccattatct

SEQ ID NO: 7428479 - DNA, 22 bp, Homo sapiens
taccaaaaccaagccattatct

SEQ ID NO: 7428480 - DNA, 22 bp, Homo sapiens
taccaaaaccaagccattatct

SEQ ID NO: 7428481 - DNA, 22 bp, Homo sapiens
tactttgtggagattaaaaata

SEQ ID NO: 7428482 - DNA, 22 bp, Homo sapiens
tactttgtggagattaaaaata

SEQ ID NO: 7428483 - DNA, 22 bp, Homo sapiens
tactttgtggagattaaaaata

SEQ ID NO: 7428484 - DNA, 22 bp, Homo sapiens
tactttgtggagattaaaaata

SEQ ID NO: 7428485 - DNA, 22 bp, Homo sapiens
tactttgtcattctaaccttcc

SEQ ID NO: 7428486 - DNA, 22 bp, Homo sapiens
tactttgtcattctaaccttcc

SEQ ID NO: 7428487 - DNA, 22 bp, Homo sapiens
tactttggttgaatatgtaatg

SEQ ID NO: 7428488 - DNA, 22 bp, Homo sapiens
tactttggtatcaaactaaaac

SEQ ID NO: 7428489 - DNA, 22 bp, Homo sapiens
tactttgtcatgctaagagtga

SEQ ID NO: 7428490 - DNA, 22 bp, Homo sapiens
tactttgtcatgctaagagtga

SEQ ID NO: 7428491 - DNA, 22 bp, Homo sapiens
tactttgtcattctaaccttcc

SEQ ID NO: 7428492 - DNA, 22 bp, Homo sapiens
tactttggttgaatatgtaatg

SEQ ID NO: 7428493 - DNA, 22 bp, Homo sapiens
tactttggttgaatatgtaatg

SEQ ID NO: 7428494 - DNA, 22 bp, Homo sapiens
tacttttagcctatttgattct

SEQ ID NO: 7428495 - DNA, 22 bp, Homo sapiens
tacttttagcctatttgattct

SEQ ID NO: 7428496 - DNA, 22 bp, Homo sapiens
tacttttagcctatttgattct

SEQ ID NO: 7428497 - DNA, 22 bp, Homo sapiens
tacttttagcctatttgattct

SEQ ID NO: 7428498 - DNA, 22 bp, Homo sapiens
tacttttagcctatttgattct

SEQ ID NO: 7428499 - DNA, 22 bp, Homo sapiens
tacttttagcctatttgattct

SEQ ID NO: 7428500 - DNA, 22 bp, Homo sapiens
tacttttaaaattcacaggtat

SEQ ID NO: 7428501 - DNA, 22 bp, Homo sapiens
tacttttaaaattcacaggtat

SEQ ID NO: 7428502 - DNA, 22 bp, Homo sapiens
tacttttaaaattcacaggtat

SEQ ID NO: 7428503 - DNA, 22 bp, Homo sapiens
tacttttaaaattcacaggtat

SEQ ID NO: 7428504 - DNA, 22 bp, Homo sapiens
tactttgtggagattaaaaata

SEQ ID NO: 7428505 - DNA, 22 bp, Homo sapiens
tactttgcagcttgataaaatg

SEQ ID NO: 7428506 - DNA, 21 bp, Homo sapiens
tactttgcaatgtatctcctt

SEQ ID NO: 7428507 - DNA, 22 bp, Homo sapiens
tactttgcagcttgataaaatg

SEQ ID NO: 7428508 - DNA, 22 bp, Homo sapiens
tactttggatccttacaatagc

SEQ ID NO: 7428509 - DNA, 22 bp, Homo sapiens
tactttggatccttacaatagc

SEQ ID NO: 7428510 - DNA, 22 bp, Homo sapiens
tactttggatccttacaatagc

SEQ ID NO: 7428511 - DNA, 22 bp, Homo sapiens
tactttggaagagttcatacag

SEQ ID NO: 7428512 - DNA, 22 bp, Homo sapiens
tactttggaagagttcatacag

SEQ ID NO: 7428513 - DNA, 22 bp, Homo sapiens
tactttggggacaatatggaat

SEQ ID NO: 7428514 - DNA, 22 bp, Homo sapiens
tactttggggacaatatggaat

SEQ ID NO: 7428515 - DNA, 22 bp, Homo sapiens
tactttggggacaatatggaat

SEQ ID NO: 7428516 - DNA, 22 bp, Homo sapiens
tactttggaagagttcatacag

SEQ ID NO: 7428517 - DNA, 22 bp, Homo sapiens
tactttggggacaatatggaat

SEQ ID NO: 7428518 - DNA, 22 bp, Homo sapiens
tactttggatccttacaatagc

SEQ ID NO: 7428519 - DNA, 22 bp, Homo sapiens
tactttggttaatgaaatgtga

SEQ ID NO: 7428520 - DNA, 22 bp, Homo sapiens
tactttggttaatgaaatgtga

SEQ ID NO: 7428521 - DNA, 22 bp, Homo sapiens
tactttggggacaatatggaat

SEQ ID NO: 7428522 - DNA, 22 bp, Homo sapiens
tactttggtatcaaactaaaac

SEQ ID NO: 7428523 - DNA, 22 bp, Homo sapiens
tactttggtatcaaactaaaac

SEQ ID NO: 7428524 - DNA, 22 bp, Homo sapiens
tactttggtatcaaactaaaac

SEQ ID NO: 7428525 - DNA, 22 bp, Homo sapiens
tactttgggtttagaataaact

SEQ ID NO: 7428526 - DNA, 22 bp, Homo sapiens
tactttgggtttagaataaact

SEQ ID NO: 7428527 - DNA, 22 bp, Homo sapiens
tactttgggtttagaataaact

SEQ ID NO: 7428528 - DNA, 22 bp, Homo sapiens
tactttgggtttagaataaact

SEQ ID NO: 7428529 - DNA, 22 bp, Homo sapiens
tagaaacccaggatttgtattt

SEQ ID NO: 7428530 - DNA, 22 bp, Homo sapiens
tagaaacccaggatttgtattt

SEQ ID NO: 7428531 - DNA, 22 bp, Homo sapiens
tagaaaccatctcactgctcag

SEQ ID NO: 7428532 - DNA, 22 bp, Homo sapiens
tagaaaccatctcactgctcag

SEQ ID NO: 7428533 - DNA, 22 bp, Homo sapiens
tagaaacattcagttgcagtcc

SEQ ID NO: 7428534 - DNA, 22 bp, Homo sapiens
tagaaacattcagttgcagtcc

SEQ ID NO: 7428535 - DNA, 22 bp, Homo sapiens
tagaaacattcagttgcagtcc

SEQ ID NO: 7428536 - DNA, 22 bp, Homo sapiens
tagaaacattcagttgcagtcc

SEQ ID NO: 7428537 - DNA, 22 bp, Homo sapiens
tagaaacccatgtttattcagt

SEQ ID NO: 7428538 - DNA, 22 bp, Homo sapiens
tagaaaccctgccttagtagct

SEQ ID NO: 7428539 - DNA, 22 bp, Homo sapiens
tagaaacctcagggaaatcttt

SEQ ID NO: 7428540 - DNA, 22 bp, Homo sapiens
tagaaactagattgatagcgga

SEQ ID NO: 7428541 - DNA, 22 bp, Homo sapiens
tagaaactcacgttatcattgc

SEQ ID NO: 7428542 - DNA, 22 bp, Homo sapiens
tagaaactcacgttatcattgc

SEQ ID NO: 7428543 - DNA, 22 bp, Homo sapiens
tagaaactcacgttatcattgc

SEQ ID NO: 7428544 - DNA, 22 bp, Homo sapiens
tagaaactcaggatactcttcc

SEQ ID NO: 7428545 - DNA, 22 bp, Homo sapiens
tagaaagaaattcagattggct

SEQ ID NO: 7428546 - DNA, 22 bp, Homo sapiens
tagaaagaaattcagattggct

SEQ ID NO: 7428547 - DNA, 22 bp, Homo sapiens
tagaaagaaattcagattggct

SEQ ID NO: 7428548 - DNA, 22 bp, Homo sapiens
tagaaactgatagtcttgtgct

SEQ ID NO: 7428549 - DNA, 22 bp, Homo sapiens
tagaaactctcacgagtgaaac

SEQ ID NO: 7428550 - DNA, 22 bp, Homo sapiens
tagaaactgatagtcttgtgct

SEQ ID NO: 7428551 - DNA, 22 bp, Homo sapiens
tagaaactgatagtcttgtgct

SEQ ID NO: 7428552 - DNA, 22 bp, Homo sapiens
tagaaacatcagctaaccaaaa

SEQ ID NO: 7428553 - DNA, 22 bp, Homo sapiens
tagaaacatcagctaaccaaaa

SEQ ID NO: 7428554 - DNA, 22 bp, Homo sapiens
tagaaacatcagctaaccaaaa

SEQ ID NO: 7428555 - DNA, 22 bp, Homo sapiens
tagaaacatgagagaaactctt

SEQ ID NO: 7428556 - DNA, 22 bp, Homo sapiens
tagaaacatgagagaaactctt

SEQ ID NO: 7428557 - DNA, 22 bp, Homo sapiens
tagaaacatgagagaaactctt

SEQ ID NO: 7428558 - DNA, 22 bp, Homo sapiens
tagaaacatatgtttgagacat

SEQ ID NO: 7428559 - DNA, 22 bp, Homo sapiens
tagaaacatatgtttgagacat

SEQ ID NO: 7428560 - DNA, 22 bp, Homo sapiens
tagaaacatatgtttgagacat

SEQ ID NO: 7428561 - DNA, 22 bp, Homo sapiens
tagaaacatatgtttgagacat

SEQ ID NO: 7428562 - DNA, 22 bp, Homo sapiens
tagaaacatcagctaaccaaaa

SEQ ID NO: 7428563 - DNA, 22 bp, Homo sapiens
tagaaacatcagctaaccaaaa

SEQ ID NO: 7428564 - DNA, 22 bp, Homo sapiens
tagaaacatcagctaaccaaaa

SEQ ID NO: 7428565 - DNA, 22 bp, Homo sapiens
tagaaacatcagctaaccaaaa

SEQ ID NO: 7428566 - DNA, 22 bp, Homo sapiens
tagaaacatcagctaaccaaaa

SEQ ID NO: 7428567 - DNA, 22 bp, Homo sapiens
tagaaacatcagctaaccaaaa

SEQ ID NO: 7428568 - DNA, 22 bp, Homo sapiens
tagaaacattcagttgcagtcc

SEQ ID NO: 7428569 - DNA, 22 bp, Homo sapiens
tagaaacattcagttgcagtcc

SEQ ID NO: 7428570 - DNA, 22 bp, Homo sapiens
tagaaacattcagttgcagtcc

SEQ ID NO: 7428571 - DNA, 22 bp, Homo sapiens
tagaaacattcagttgcagtcc

SEQ ID NO: 7428572 - DNA, 22 bp, Homo sapiens
tagaaacattcagttgcagtcc

SEQ ID NO: 7428573 - DNA, 22 bp, Homo sapiens
tagaaacattcagttgcagtcc

SEQ ID NO: 7428574 - DNA, 22 bp, Homo sapiens
tagaaacattcagttgcagtcc

SEQ ID NO: 7428575 - DNA, 22 bp, Homo sapiens
tagaaacatgttctgttctgtt

SEQ ID NO: 7428576 - DNA, 22 bp, Homo sapiens
tagaaacatgttctgttctgtt

SEQ ID NO: 7428577 - DNA, 22 bp, Homo sapiens
tagaaacatgttctgttctgtt

SEQ ID NO: 7428578 - DNA, 22 bp, Homo sapiens
tagaaacatgttctgttctgtt

SEQ ID NO: 7428579 - DNA, 22 bp, Homo sapiens
tagaaacatgttctgttctgtt

SEQ ID NO: 7428580 - DNA, 22 bp, Homo sapiens
tagaaacatgagagaaactctt

SEQ ID NO: 7428581 - DNA, 22 bp, Homo sapiens
tagaaacatgttctgttctgtt

SEQ ID NO: 7428582 - DNA, 22 bp, Homo sapiens
tagaaacatgttctgttctgtt

SEQ ID NO: 7428583 - DNA, 22 bp, Homo sapiens
tagaaacatgttctgttctgtt

SEQ ID NO: 7428584 - DNA, 22 bp, Homo sapiens
tagaaacatgttctgttctgtt

SEQ ID NO: 7428585 - DNA, 22 bp, Homo sapiens
tagaaacatgagagaaactctt

SEQ ID NO: 7428586 - DNA, 22 bp, Homo sapiens
tagaaacatgagagaaactctt

SEQ ID NO: 7428587 - DNA, 22 bp, Homo sapiens
tagaaacatgagagaaactctt

SEQ ID NO: 7428588 - DNA, 22 bp, Homo sapiens
tagaaacatgagagaaactctt

SEQ ID NO: 7428589 - DNA, 22 bp, Homo sapiens
tagaaacatgagagaaactctt

SEQ ID NO: 7428590 - DNA, 22 bp, Homo sapiens
tagaaacagatgtttttgaaga

SEQ ID NO: 7428591 - DNA, 22 bp, Homo sapiens
tagaaacagatgtttttgaaga

SEQ ID NO: 7428592 - DNA, 22 bp, Homo sapiens
tagaaacagatgtttttgaaga

SEQ ID NO: 7428593 - DNA, 22 bp, Homo sapiens
tagaaacagatgtttttgaaga

SEQ ID NO: 7428594 - DNA, 22 bp, Homo sapiens
tagaaacagatgtttttgaaga

SEQ ID NO: 7428595 - DNA, 22 bp, Homo sapiens
tagaaacagatgtttttgaaga

SEQ ID NO: 7428596 - DNA, 22 bp, Homo sapiens
tagaaacagagcaggtggccca

SEQ ID NO: 7428597 - DNA, 22 bp, Homo sapiens
tagaaacagatgtttttgaaga

SEQ ID NO: 7428598 - DNA, 22 bp, Homo sapiens
tagaaacagatgtttttgaaga

SEQ ID NO: 7428599 - DNA, 22 bp, Homo sapiens
tagaaacagatgtttttgaaga

SEQ ID NO: 7428600 - DNA, 22 bp, Homo sapiens
tagaaacagagcaggtggccca

SEQ ID NO: 7428601 - DNA, 22 bp, Homo sapiens
tagaaacagagcaggtggccca

SEQ ID NO: 7428602 - DNA, 22 bp, Homo sapiens
tagaaacagagcaggtggccca

SEQ ID NO: 7428603 - DNA, 22 bp, Homo sapiens
tagaaacagagagatatgcccc

SEQ ID NO: 7428604 - DNA, 22 bp, Homo sapiens
tagaaacagagagatatgcccc

SEQ ID NO: 7428605 - DNA, 22 bp, Homo sapiens
tagaaacagagagatatgcccc

SEQ ID NO: 7428606 - DNA, 22 bp, Homo sapiens
tagaaacagagagatatgcccc

SEQ ID NO: 7428607 - DNA, 22 bp, Homo sapiens
tagaaacagagagatatgcccc

SEQ ID NO: 7428608 - DNA, 22 bp, Homo sapiens
tagaaacagagagatatgcccc

SEQ ID NO: 7428609 - DNA, 22 bp, Homo sapiens
tagaaacagaatatgagtgaga

SEQ ID NO: 7428610 - DNA, 22 bp, Homo sapiens
tagaaacatataggatggcagg

SEQ ID NO: 7428611 - DNA, 22 bp, Homo sapiens
tagaaacatataggatggcagg

SEQ ID NO: 7428612 - DNA, 22 bp, Homo sapiens
tagaaacatataggatggcagg

SEQ ID NO: 7428613 - DNA, 22 bp, Homo sapiens
tagaaacatataggatggcagg

SEQ ID NO: 7428614 - DNA, 22 bp, Homo sapiens
tagaaacatataggatggcagg

SEQ ID NO: 7428615 - DNA, 22 bp, Homo sapiens
tagaaacatatgtttgagacat

SEQ ID NO: 7428616 - DNA, 22 bp, Homo sapiens
tagaaacatatgtttgagacat

SEQ ID NO: 7428617 - DNA, 22 bp, Homo sapiens
tagaaacatatgtttgagacat

SEQ ID NO: 7428618 - DNA, 22 bp, Homo sapiens
tagaaacatataggatggcagg

SEQ ID NO: 7428619 - DNA, 22 bp, Homo sapiens
tagaaacatataggatggcagg

SEQ ID NO: 7428620 - DNA, 22 bp, Homo sapiens
tagaaacagcatatattagccc

SEQ ID NO: 7428621 - DNA, 22 bp, Homo sapiens
tagaaacagcatatattagccc

SEQ ID NO: 7428622 - DNA, 22 bp, Homo sapiens
tagaaacagcatatattagccc

SEQ ID NO: 7428623 - DNA, 22 bp, Homo sapiens
tagaaacagcatatattagccc

SEQ ID NO: 7428624 - DNA, 22 bp, Homo sapiens
tagaaacagcatatattagccc

SEQ ID NO: 7428625 - DNA, 22 bp, Homo sapiens
tagaaacagcatatattagccc

SEQ ID NO: 7428626 - DNA, 22 bp, Homo sapiens
tagaaacagcatatattagccc

SEQ ID NO: 7428627 - DNA, 22 bp, Homo sapiens
tagaaacagcatatattagccc

SEQ ID NO: 7428628 - DNA, 22 bp, Homo sapiens
tagaaacagcatatattagccc

SEQ ID NO: 7428629 - DNA, 22 bp, Homo sapiens
tagaaacagcatatattagccc

SEQ ID NO: 7428630 - DNA, 22 bp, Homo sapiens
tagaaacaatgacatgcttgta

SEQ ID NO: 7428631 - DNA, 22 bp, Homo sapiens
tagaaacaatgacatgcttgta

SEQ ID NO: 7428632 - DNA, 22 bp, Homo sapiens
tagaaacaatgacatgcttgta

SEQ ID NO: 7428633 - DNA, 22 bp, Homo sapiens
tagaaacaatgacatgcttgta

SEQ ID NO: 7428634 - DNA, 22 bp, Homo sapiens
tagaaacaagtttctctttggg

SEQ ID NO: 7428635 - DNA, 22 bp, Homo sapiens
tagaaaagaagtctggccggga

SEQ ID NO: 7428636 - DNA, 22 bp, Homo sapiens
tagaaaagccccagctggaggg

SEQ ID NO: 7428637 - DNA, 22 bp, Homo sapiens
tagaaaagataacattctgtgc

SEQ ID NO: 7428638 - DNA, 22 bp, Homo sapiens
tagaaaagccccagctggaggg

SEQ ID NO: 7428639 - DNA, 22 bp, Homo sapiens
tagaaaagccccagctggaggg

SEQ ID NO: 7428640 - DNA, 22 bp, Homo sapiens
tagaaaagccccagctggaggg

SEQ ID NO: 7428641 - DNA, 22 bp, Homo sapiens
tagaaacacagagagacccatg

SEQ ID NO: 7428642 - DNA, 22 bp, Homo sapiens
tagaaacacagagagacccatg

SEQ ID NO: 7428643 - DNA, 22 bp, Homo sapiens
tagaaacacagagagacccatg

SEQ ID NO: 7428644 - DNA, 22 bp, Homo sapiens
tagaaacacagagagacccatg

SEQ ID NO: 7428645 - DNA, 22 bp, Homo sapiens
tagaaacacagagagacccatg

SEQ ID NO: 7428646 - DNA, 22 bp, Homo sapiens
tagaaacaatgacatgcttgta

SEQ ID NO: 7428647 - DNA, 22 bp, Homo sapiens
tagaaacaatgacatgcttgta

SEQ ID NO: 7428648 - DNA, 22 bp, Homo sapiens
tagaaacaatgacatgcttgta

SEQ ID NO: 7428649 - DNA, 22 bp, Homo sapiens
tagaaacagaatatgagtgaga

SEQ ID NO: 7428650 - DNA, 22 bp, Homo sapiens
tagaaacagaatatgagtgaga

SEQ ID NO: 7428651 - DNA, 22 bp, Homo sapiens
tagaaacagaaaactgtaatag

SEQ ID NO: 7428652 - DNA, 22 bp, Homo sapiens
tagaaacagaatatgagtgaga

SEQ ID NO: 7428653 - DNA, 22 bp, Homo sapiens
tagaaacagaatatgagtgaga

SEQ ID NO: 7428654 - DNA, 22 bp, Homo sapiens
tagaaacagaatatgagtgaga

SEQ ID NO: 7428655 - DNA, 22 bp, Homo sapiens
tagaaacagaatatgagtgaga

SEQ ID NO: 7428656 - DNA, 22 bp, Homo sapiens
tagaaacagaatatgagtgaga

SEQ ID NO: 7428657 - DNA, 22 bp, Homo sapiens
tagaaacagaatatgagtgaga

SEQ ID NO: 7428658 - DNA, 22 bp, Homo sapiens
tagaaacagaatatgagtgaga

SEQ ID NO: 7428659 - DNA, 22 bp, Homo sapiens
tagaaacacagatctggtgtca

SEQ ID NO: 7428660 - DNA, 22 bp, Homo sapiens
tagaaacacagatctggtgtca

SEQ ID NO: 7428661 - DNA, 22 bp, Homo sapiens
tagaaacacagatctggtgtca

SEQ ID NO: 7428662 - DNA, 22 bp, Homo sapiens
tagaaacacagagagacccatg

SEQ ID NO: 7428663 - DNA, 22 bp, Homo sapiens
tagaaacacagatctggtgtca

SEQ ID NO: 7428664 - DNA, 22 bp, Homo sapiens
tagaaacacagatctggtgtca

SEQ ID NO: 7428665 - DNA, 22 bp, Homo sapiens
tagaaacacagatctggtgtca

SEQ ID NO: 7428666 - DNA, 22 bp, Homo sapiens
tagaaacagaaaactgtaatag

SEQ ID NO: 7428667 - DNA, 22 bp, Homo sapiens
tagaaacagaaaactgtaatag

SEQ ID NO: 7428668 - DNA, 22 bp, Homo sapiens
tagaaacagaaaactgtaatag

SEQ ID NO: 7428669 - DNA, 22 bp, Homo sapiens
tagaaacagaaaactgtaatag

SEQ ID NO: 7428670 - DNA, 22 bp, Homo sapiens
tagaaacagaaaactgtaatag

SEQ ID NO: 7428671 - DNA, 22 bp, Homo sapiens
tagaaacagaaaactgtaatag

SEQ ID NO: 7428672 - DNA, 22 bp, Homo sapiens
tagaaacagaaaactgtaatag

SEQ ID NO: 7428673 - DNA, 22 bp, Homo sapiens
tagccttttgggaagggctatt

SEQ ID NO: 7428674 - DNA, 22 bp, Homo sapiens
tagcctctctcctccacaacct

SEQ ID NO: 7428675 - DNA, 22 bp, Homo sapiens
tagccgggtgtggtggaactcc

SEQ ID NO: 7428676 - DNA, 22 bp, Homo sapiens
tagccgggtgtggtggaactcc

SEQ ID NO: 7428677 - DNA, 22 bp, Homo sapiens
tagctcctggtgagcctactct

SEQ ID NO: 7428678 - DNA, 22 bp, Homo sapiens
tagctctagcactggataatcc

SEQ ID NO: 7428679 - DNA, 22 bp, Homo sapiens
tagctcctggtgagcctactct

SEQ ID NO: 7428680 - DNA, 22 bp, Homo sapiens
tagccttttgggaagggctatt

SEQ ID NO: 7428681 - DNA, 22 bp, Homo sapiens
tagcgaggtgtttctaggactg

SEQ ID NO: 7428682 - DNA, 22 bp, Homo sapiens
tagctctctctatatgagtgac

SEQ ID NO: 7428683 - DNA, 22 bp, Homo sapiens
tagctctgacatttgcaattac

SEQ ID NO: 7428684 - DNA, 22 bp, Homo sapiens
tagctctgaggccatctccggt

SEQ ID NO: 7428685 - DNA, 22 bp, Homo sapiens
tagctctgcaatgaagcccagg

SEQ ID NO: 7428686 - DNA, 22 bp, Homo sapiens
tagctctgcaatgaagcccagg

SEQ ID NO: 7428687 - DNA, 22 bp, Homo sapiens
tagctctgctggaaggagtcag

SEQ ID NO: 7428688 - DNA, 22 bp, Homo sapiens
tagctctgctggaaggagtcag

SEQ ID NO: 7428689 - DNA, 22 bp, Homo sapiens
tagctctgccaaatggaggctg

SEQ ID NO: 7428690 - DNA, 22 bp, Homo sapiens
tagctctggagtcttctcagaa

SEQ ID NO: 7428691 - DNA, 22 bp, Homo sapiens
tagctctggagtcttctcagaa

SEQ ID NO: 7428692 - DNA, 22 bp, Homo sapiens
tagctctggagtcttctcagaa

SEQ ID NO: 7428693 - DNA, 22 bp, Homo sapiens
tagctctgtggatctttttaag

SEQ ID NO: 7428694 - DNA, 22 bp, Homo sapiens
tagctctgtcacctggcaaagt

SEQ ID NO: 7428695 - DNA, 22 bp, Homo sapiens
tagctctgtgctctggatctgt

SEQ ID NO: 7428696 - DNA, 22 bp, Homo sapiens
tagctcttcaatcactgtctcc

SEQ ID NO: 7428697 - DNA, 22 bp, Homo sapiens
tagctcttaggtgcgtggctct

SEQ ID NO: 7428698 - DNA, 22 bp, Homo sapiens
tagctcttaagtctgtgataga

SEQ ID NO: 7428699 - DNA, 22 bp, Homo sapiens
tagctcttaccaggtggccatg

SEQ ID NO: 7428700 - DNA, 22 bp, Homo sapiens
tagctcttcacctctaggcact

SEQ ID NO: 7428701 - DNA, 22 bp, Homo sapiens
tagctcttcaatcactgtctcc

SEQ ID NO: 7428702 - DNA, 22 bp, Homo sapiens
tagctgaatgtgaccttaaaga

SEQ ID NO: 7428703 - DNA, 22 bp, Homo sapiens
tagctgttcaagttcctggaaa

SEQ ID NO: 7428704 - DNA, 22 bp, Homo sapiens
tagctgttcccagctctgtgta

SEQ ID NO: 7428705 - DNA, 22 bp, Homo sapiens
tagctgttgcaataaacagttc

SEQ ID NO: 7428706 - DNA, 22 bp, Homo sapiens
tagctgttggcttacatctgtt

SEQ ID NO: 7428707 - DNA, 22 bp, Homo sapiens
tagctgttgcaataaacagttc

SEQ ID NO: 7428708 - DNA, 22 bp, Homo sapiens
tagctttaatgagttggtaaga

SEQ ID NO: 7428709 - DNA, 22 bp, Homo sapiens
tagctttaatgagttggtaaga

SEQ ID NO: 7428710 - DNA, 22 bp, Homo sapiens
tagctttaatgagttggtaaga

SEQ ID NO: 7428711 - DNA, 22 bp, Homo sapiens
tagcttaaaccaatctgaataa

SEQ ID NO: 7428712 - DNA, 21 bp, Homo sapiens
tagctttaatattcccacatt

SEQ ID NO: 7428713 - DNA, 22 bp, Homo sapiens
tagctgtttgaagtatttttct

SEQ ID NO: 7428714 - DNA, 22 bp, Homo sapiens
tagctgttttttgtgaggaaat

SEQ ID NO: 7428715 - DNA, 22 bp, Homo sapiens
tagcttaaaatctctagattct

SEQ ID NO: 7428716 - DNA, 22 bp, Homo sapiens
tagctgaataatgcgtctgcag

SEQ ID NO: 7428717 - DNA, 22 bp, Homo sapiens
tagctgaatgccttggattttt

SEQ ID NO: 7428718 - DNA, 22 bp, Homo sapiens
tagctgaatgccttggattttt

SEQ ID NO: 7428719 - DNA, 22 bp, Homo sapiens
tagctgaagggcatttaataaa

SEQ ID NO: 7428720 - DNA, 22 bp, Homo sapiens
tagctgaagagggtattgtagg

SEQ ID NO: 7428721 - DNA, 22 bp, Homo sapiens
tagctcttttaatccttaggac

SEQ ID NO: 7428722 - DNA, 22 bp, Homo sapiens
tagctgaagagggtattgtagg

SEQ ID NO: 7428723 - DNA, 22 bp, Homo sapiens
tagctcttttataggaactctg

SEQ ID NO: 7428724 - DNA, 22 bp, Homo sapiens
tagctcttttaatccttaggac

SEQ ID NO: 7428725 - DNA, 22 bp, Homo sapiens
tagctctttgtacaagtagatg

SEQ ID NO: 7428726 - DNA, 22 bp, Homo sapiens
tagctctttgagattggttctt

SEQ ID NO: 7428727 - DNA, 22 bp, Homo sapiens
tagctcttgtgttttacatata

SEQ ID NO: 7428728 - DNA, 22 bp, Homo sapiens
tagctcttggaacgtgttaatt

SEQ ID NO: 7428729 - DNA, 22 bp, Homo sapiens
tagctcttgccatctgtcttat

SEQ ID NO: 7428730 - DNA, 22 bp, Homo sapiens
tagctcttgccagatcctcgat

SEQ ID NO: 7428731 - DNA, 18 bp, Homo sapiens
tagctcttgttggtccat

SEQ ID NO: 7428732 - DNA, 22 bp, Homo sapiens
tagctcttgtgttttacatata

SEQ ID NO: 7428733 - DNA, 22 bp, Homo sapiens
tagctctttattaaggcccaga

SEQ ID NO: 7428734 - DNA, 22 bp, Homo sapiens
tagctcttcaggtgcctttcac

SEQ ID NO: 7428735 - DNA, 22 bp, Homo sapiens
tagctcttgatgctggcaggac

SEQ ID NO: 7428736 - DNA, 22 bp, Homo sapiens
tagctcttgccagatcctcgat

SEQ ID NO: 7428737 - DNA, 22 bp, Homo sapiens
tagctcttctaatggtaaagag

SEQ ID NO: 7428738 - DNA, 22 bp, Homo sapiens
tagctcttcatttcatctgatt

SEQ ID NO: 7428739 - DNA, 22 bp, Homo sapiens
tagccccagctactcggaagct

SEQ ID NO: 7428740 - DNA, 22 bp, Homo sapiens
tagcccctgcctttgaacctgg

SEQ ID NO: 7428741 - DNA, 22 bp, Homo sapiens
tagcccctgcctttgaacctgg

SEQ ID NO: 7428742 - DNA, 22 bp, Homo sapiens
tagcccatgcagctctgtcatt

SEQ ID NO: 7428743 - DNA, 22 bp, Homo sapiens
tagcccatggactggtcagctg

SEQ ID NO: 7428744 - DNA, 22 bp, Homo sapiens
tagcccatggactggtcagctg

SEQ ID NO: 7428745 - DNA, 17 bp, Homo sapiens
tagcccatggctgccag

SEQ ID NO: 7428746 - DNA, 17 bp, Homo sapiens
tagcccatggctgccag

SEQ ID NO: 7428747 - DNA, 22 bp, Homo sapiens
tagcccatgcagctctgtcatt

SEQ ID NO: 7428748 - DNA, 22 bp, Homo sapiens
tagcccatgtgcgtgttggggg

SEQ ID NO: 7428749 - DNA, 22 bp, Homo sapiens
tagcccatgtgcgtgttggggg

SEQ ID NO: 7428750 - DNA, 22 bp, Homo sapiens
tagcccattacctttggattgg

SEQ ID NO: 7428751 - DNA, 22 bp, Homo sapiens
tagcccattacctttggattgg

SEQ ID NO: 7428752 - DNA, 23 bp, Homo sapiens
tagcccattgtgcttgtggtttt

SEQ ID NO: 7428753 - DNA, 23 bp, Homo sapiens
tagcccattgtgcttgtggtttt

SEQ ID NO: 7428754 - DNA, 22 bp, Homo sapiens
tagcccatttgttggaagcatg

SEQ ID NO: 7428755 - DNA, 22 bp, Homo sapiens
tagcccatttgttggaagcatg

SEQ ID NO: 7428756 - DNA, 22 bp, Homo sapiens
tagcccctgcctttgaacctgg

SEQ ID NO: 7428757 - DNA, 22 bp, Homo sapiens
tagccccagctactcggaagct

SEQ ID NO: 7428758 - DNA, 22 bp, Homo sapiens
tagcccctgcctttgaacctgg

SEQ ID NO: 7428759 - DNA, 22 bp, Homo sapiens
tagcccctgcctttgaacctgg

SEQ ID NO: 7428760 - DNA, 22 bp, Homo sapiens
tagcccctgcctttgaacctgg

SEQ ID NO: 7428761 - DNA, 22 bp, Homo sapiens
tagccctctccagcgaggtctg

SEQ ID NO: 7428762 - DNA, 22 bp, Homo sapiens
tagccctcatctgctcaaaagg

SEQ ID NO: 7428763 - DNA, 22 bp, Homo sapiens
tagccctcagcttggagcgtgg

SEQ ID NO: 7428764 - DNA, 22 bp, Homo sapiens
tagccctcagcttggagcgtgg

SEQ ID NO: 7428765 - DNA, 22 bp, Homo sapiens
tagccctctttaatccttccct

SEQ ID NO: 7428766 - DNA, 22 bp, Homo sapiens
tagccctctccagcgaggtctg

SEQ ID NO: 7428767 - DNA, 21 bp, Homo sapiens
tagccctctctgtctgtgtac

SEQ ID NO: 7428768 - DNA, 22 bp, Homo sapiens
tagccctggagcagggaaatac

SEQ ID NO: 7428769 - DNA, 19 bp, Homo sapiens
tagccctggccatcatgag

SEQ ID NO: 7428770 - DNA, 19 bp, Homo sapiens
tagccctggccatcatgag

SEQ ID NO: 7428771 - DNA, 22 bp, Homo sapiens
tagccctgctgtgatgtgaagt

SEQ ID NO: 7428772 - DNA, 22 bp, Homo sapiens
tagcccgggcaccagatggatc

SEQ ID NO: 7428773 - DNA, 19 bp, Homo sapiens
tagccctggccatcatgag

SEQ ID NO: 7428774 - DNA, 19 bp, Homo sapiens
tagccctggccatcatgag

SEQ ID NO: 7428775 - DNA, 19 bp, Homo sapiens
tagccctggccatcatgag

SEQ ID NO: 7428776 - DNA, 21 bp, Homo sapiens
tagcccttctccacctcgccc

SEQ ID NO: 7428777 - DNA, 22 bp, Homo sapiens
tagccctgtccttggcctgtgc

SEQ ID NO: 7428778 - DNA, 19 bp, Homo sapiens
tagccctggccatcatgag

SEQ ID NO: 7428779 - DNA, 22 bp, Homo sapiens
tagccctgtccttggcctgtgc

SEQ ID NO: 7428780 - DNA, 22 bp, Homo sapiens
tagccctgtccttggcctgtgc

SEQ ID NO: 7428781 - DNA, 21 bp, Homo sapiens
tagcccttctccacctcgccc

SEQ ID NO: 7428782 - DNA, 22 bp, Homo sapiens
tagcccttttctgagcccacat

SEQ ID NO: 7428783 - DNA, 22 bp, Homo sapiens
tagcccttttctgagcccacat

SEQ ID NO: 7428784 - DNA, 22 bp, Homo sapiens
tagccgcttaattatttggtga

SEQ ID NO: 7428785 - DNA, 22 bp, Homo sapiens
tagcccaggctggagggcagtg

SEQ ID NO: 7428786 - DNA, 22 bp, Homo sapiens
tagcccaggctggagggcagtg

SEQ ID NO: 7428787 - DNA, 22 bp, Homo sapiens
tagcccaggctggagggcagtg

SEQ ID NO: 7428788 - DNA, 22 bp, Homo sapiens
tagcccaggagaattgtctttc

SEQ ID NO: 7428789 - DNA, 22 bp, Homo sapiens
tagcccaggctggagggcagtg

SEQ ID NO: 7428790 - DNA, 22 bp, Homo sapiens
tagcccaggagaattgtctttc

SEQ ID NO: 7428791 - DNA, 22 bp, Homo sapiens
tagcccagcttggcctatttct

SEQ ID NO: 7428792 - DNA, 22 bp, Homo sapiens
tagcccagctcaaatgaccggt

SEQ ID NO: 7428793 - DNA, 22 bp, Homo sapiens
tagcccagctcaaatgaccggt

SEQ ID NO: 7428794 - DNA, 22 bp, Homo sapiens
tagcccagctaactcggtgagc

SEQ ID NO: 7428795 - DNA, 22 bp, Homo sapiens
tagcccaggctggagtgcaggg

SEQ ID NO: 7428796 - DNA, 22 bp, Homo sapiens
tagcccaggctgtagtgcagtg

SEQ ID NO: 7428797 - DNA, 22 bp, Homo sapiens
tagcccaggctggagtgcaggg

SEQ ID NO: 7428798 - DNA, 22 bp, Homo sapiens
tagcccaggctggagtgcaggg

SEQ ID NO: 7428799 - DNA, 22 bp, Homo sapiens
tagcccaggctggagtgcaggg

SEQ ID NO: 7428800 - DNA, 22 bp, Homo sapiens
tagcccaggctggagtgcaggg

SEQ ID NO: 7428801 - DNA, 22 bp, Homo sapiens
tagcccaggctgtagtgcagtg

SEQ ID NO: 7428802 - DNA, 22 bp, Homo sapiens
tagcccaggctgtagtgcagtg

SEQ ID NO: 7428803 - DNA, 22 bp, Homo sapiens
tagcccaggctgtagtgcagtg

SEQ ID NO: 7428804 - DNA, 22 bp, Homo sapiens
tagcccaggctgtagtgcagtg

SEQ ID NO: 7428805 - DNA, 22 bp, Homo sapiens
tagcccatatgaaatgatttgg

SEQ ID NO: 7428806 - DNA, 22 bp, Homo sapiens
tagcccatatgaaatgatttgg

SEQ ID NO: 7428807 - DNA, 22 bp, Homo sapiens
tagcccatatggtgcctttgtg

SEQ ID NO: 7428808 - DNA, 22 bp, Homo sapiens
tagcccatatggtgcctttgtg

SEQ ID NO: 7428809 - DNA, 22 bp, Homo sapiens
tagcccatgatggtggaaggca

SEQ ID NO: 7428810 - DNA, 22 bp, Homo sapiens
tagcccatgatggtggaaggca

SEQ ID NO: 7428811 - DNA, 22 bp, Homo sapiens
tagcccagcatgagcagagctg

SEQ ID NO: 7428812 - DNA, 22 bp, Homo sapiens
tagcccagctaactcggtgagc

SEQ ID NO: 7428813 - DNA, 22 bp, Homo sapiens
tagcccagcatgagcagagctg

SEQ ID NO: 7428814 - DNA, 22 bp, Homo sapiens
tagcccagcatgagcagagctg

SEQ ID NO: 7428815 - DNA, 22 bp, Homo sapiens
tagcccagcatgagcagagctg

SEQ ID NO: 7428816 - DNA, 22 bp, Homo sapiens
tagcccagcatgagcagagctg

SEQ ID NO: 7428817 - DNA, 22 bp, Homo sapiens
tagcccagcatgagcagagctg

SEQ ID NO: 7428818 - DNA, 22 bp, Homo sapiens
tagcagctcctaaacagtggtg

SEQ ID NO: 7428819 - DNA, 22 bp, Homo sapiens
tagcagctccatttctctggca

SEQ ID NO: 7428820 - DNA, 22 bp, Homo sapiens
tagcagctccatttctctggca

SEQ ID NO: 7428821 - DNA, 22 bp, Homo sapiens
tagcagctccatttctctggca

SEQ ID NO: 7428822 - DNA, 22 bp, Homo sapiens
tagcagctccatttctctggca

SEQ ID NO: 7428823 - DNA, 22 bp, Homo sapiens
tagcagctcactaactctgcgt

SEQ ID NO: 7428824 - DNA, 22 bp, Homo sapiens
tagcagctcactaactctgcgt

SEQ ID NO: 7428825 - DNA, 22 bp, Homo sapiens
tagcagctcactaactctgcgt

SEQ ID NO: 7428826 - DNA, 22 bp, Homo sapiens
tagcagctcactaactctgcgt

SEQ ID NO: 7428827 - DNA, 22 bp, Homo sapiens
tagcagctcactaactctgcgt

SEQ ID NO: 7428828 - DNA, 22 bp, Homo sapiens
tagcagctcacagcctcccatt

SEQ ID NO: 7428829 - DNA, 22 bp, Homo sapiens
tagcagctcacagcctcccatt

SEQ ID NO: 7428830 - DNA, 22 bp, Homo sapiens
tagcagctcacagcctcccatt

SEQ ID NO: 7428831 - DNA, 22 bp, Homo sapiens
tagcagctatgccattttgaca

SEQ ID NO: 7428832 - DNA, 22 bp, Homo sapiens
tagcagctatgccattttgaca

SEQ ID NO: 7428833 - DNA, 22 bp, Homo sapiens
tagcagctatgccattttgaca

SEQ ID NO: 7428834 - DNA, 22 bp, Homo sapiens
tagcagagtatcttgcaaatta

SEQ ID NO: 7428835 - DNA, 22 bp, Homo sapiens
tagcagagtatcttgcaaatta

SEQ ID NO: 7428836 - DNA, 22 bp, Homo sapiens
tagcagagtagtgcctccagat

SEQ ID NO: 7428837 - DNA, 22 bp, Homo sapiens
tagcagagtagtgcctccagat

SEQ ID NO: 7428838 - DNA, 22 bp, Homo sapiens
tagcagagtgattggccatgag

SEQ ID NO: 7428839 - DNA, 22 bp, Homo sapiens
tagcagagtgattggccatgag

SEQ ID NO: 7428840 - DNA, 22 bp, Homo sapiens
tagcagagtgattggccatgag

SEQ ID NO: 7428841 - DNA, 22 bp, Homo sapiens
tagcagcaggggaaacagctgt

SEQ ID NO: 7428842 - DNA, 22 bp, Homo sapiens
tagcagcagtggtgtatttaga

SEQ ID NO: 7428843 - DNA, 22 bp, Homo sapiens
tagcagcagtggtgtatttaga

SEQ ID NO: 7428844 - DNA, 17 bp, Homo sapiens
tagcagcagtaattgtg

SEQ ID NO: 7428845 - DNA, 17 bp, Homo sapiens
tagcagcagtaattgtg

SEQ ID NO: 7428846 - DNA, 17 bp, Homo sapiens
tagcagcagtaattgtg

SEQ ID NO: 7428847 - DNA, 17 bp, Homo sapiens
tagcagcagtaattgtg

SEQ ID NO: 7428848 - DNA, 17 bp, Homo sapiens
tagcagcagtaattgtg

SEQ ID NO: 7428849 - DNA, 22 bp, Homo sapiens
tagcagagtaatactttggagc

SEQ ID NO: 7428850 - DNA, 22 bp, Homo sapiens
tagcagagtaatactttggagc

SEQ ID NO: 7428851 - DNA, 22 bp, Homo sapiens
tagcagagtagtgcctccagat

SEQ ID NO: 7428852 - DNA, 22 bp, Homo sapiens
tagcagagtaatactttggagc

SEQ ID NO: 7428853 - DNA, 22 bp, Homo sapiens
tagcagagtaatactttggagc

SEQ ID NO: 7428854 - DNA, 22 bp, Homo sapiens
tagcagagtaatactttggagc

SEQ ID NO: 7428855 - DNA, 22 bp, Homo sapiens
tagcagagtaatactttggagc

SEQ ID NO: 7428856 - DNA, 22 bp, Homo sapiens
tagcagaggtaagtgtggcaat

SEQ ID NO: 7428857 - DNA, 22 bp, Homo sapiens
tagcagaggtaagtgtggcaat

SEQ ID NO: 7428858 - DNA, 22 bp, Homo sapiens
tagcagaggtaagtgtggcaat

SEQ ID NO: 7428859 - DNA, 22 bp, Homo sapiens
tagcagaggtaagtgtggcaat

SEQ ID NO: 7428860 - DNA, 22 bp, Homo sapiens
tagcagagggtagtgccggggc

SEQ ID NO: 7428861 - DNA, 22 bp, Homo sapiens
tagcagagggtagtgccggggc

SEQ ID NO: 7428862 - DNA, 22 bp, Homo sapiens
tagcagagggtagtgccggggc

SEQ ID NO: 7428863 - DNA, 22 bp, Homo sapiens
tagcagctacctggctaagagt

SEQ ID NO: 7428864 - DNA, 22 bp, Homo sapiens
tagcagctacctggctaagagt

SEQ ID NO: 7428865 - DNA, 22 bp, Homo sapiens
tagcagcccagtttctggccaa

SEQ ID NO: 7428866 - DNA, 22 bp, Homo sapiens
tagcagcatttttgtagagtat

SEQ ID NO: 7428867 - DNA, 22 bp, Homo sapiens
tagcagcatttttgtagagtat

SEQ ID NO: 7428868 - DNA, 23 bp, Homo sapiens
tagcagcatttttagcctctgtc

SEQ ID NO: 7428869 - DNA, 22 bp, Homo sapiens
tagcagcatttttgtagagtat

SEQ ID NO: 7428870 - DNA, 22 bp, Homo sapiens
tagcagcatttttgtagagtat

SEQ ID NO: 7428871 - DNA, 22 bp, Homo sapiens
tagcagcatttttgtagagtat

SEQ ID NO: 7428872 - DNA, 22 bp, Homo sapiens
tagcagcatttttgtagagtat

SEQ ID NO: 7428873 - DNA, 22 bp, Homo sapiens
tagcagcatcctgtggtgatgg

SEQ ID NO: 7428874 - DNA, 22 bp, Homo sapiens
tagcagcatcctgtggtgatgg

SEQ ID NO: 7428875 - DNA, 22 bp, Homo sapiens
tagcagcatgtaagtgagtaga

SEQ ID NO: 7428876 - DNA, 22 bp, Homo sapiens
tagcagcatcctgtggtgatgg

SEQ ID NO: 7428877 - DNA, 22 bp, Homo sapiens
tagcagcatgtaagtgagtaga

SEQ ID NO: 7428878 - DNA, 22 bp, Homo sapiens
tagcagcatgtaagtgagtaga

SEQ ID NO: 7428879 - DNA, 22 bp, Homo sapiens
tagcagcatgtaagtgagtaga

SEQ ID NO: 7428880 - DNA, 22 bp, Homo sapiens
tagcagcatgtaagtgagtaga

SEQ ID NO: 7428881 - DNA, 23 bp, Homo sapiens
tagcagcatttttagcctctgtc

SEQ ID NO: 7428882 - DNA, 23 bp, Homo sapiens
tagcagcatttttagcctctgtc

SEQ ID NO: 7428883 - DNA, 23 bp, Homo sapiens
tagcagcatttttagcctctgtc

SEQ ID NO: 7428884 - DNA, 23 bp, Homo sapiens
tagcagcatttttagcctctgtc

SEQ ID NO: 7428885 - DNA, 22 bp, Homo sapiens
tagcagcatgtaagtgagtaga

SEQ ID NO: 7428886 - DNA, 22 bp, Homo sapiens
tagcagcattaattccatttgc

SEQ ID NO: 7428887 - DNA, 19 bp, Homo sapiens
tagcagagatgactccagc

SEQ ID NO: 7428888 - DNA, 19 bp, Homo sapiens
tagcagagatgactccagc

SEQ ID NO: 7428889 - DNA, 19 bp, Homo sapiens
tagcagagatgactccagc

SEQ ID NO: 7428890 - DNA, 21 bp, Homo sapiens
tagcagagatcattttctcct

SEQ ID NO: 7428891 - DNA, 21 bp, Homo sapiens
tagcagagatcattttctcct

SEQ ID NO: 7428892 - DNA, 22 bp, Homo sapiens
tagcagagatatgggcatagat

SEQ ID NO: 7428893 - DNA, 22 bp, Homo sapiens
tagcagagatatgggcatagat

SEQ ID NO: 7428894 - DNA, 21 bp, Homo sapiens
tagcagagatcattttctcct

SEQ ID NO: 7428895 - DNA, 19 bp, Homo sapiens
tagcagagatgactccagc

SEQ ID NO: 7428896 - DNA, 19 bp, Homo sapiens
tagcagagatgactccagc

SEQ ID NO: 7428897 - DNA, 22 bp, Homo sapiens
tagcagagcacatcttcattct

SEQ ID NO: 7428898 - DNA, 22 bp, Homo sapiens
tagcagagcacatcttcattct

SEQ ID NO: 7428899 - DNA, 19 bp, Homo sapiens
tagcagagatgactccagc

SEQ ID NO: 7428900 - DNA, 22 bp, Homo sapiens
tagcagagctgcaatatagacc

SEQ ID NO: 7428901 - DNA, 22 bp, Homo sapiens
tagcagagctgcaatatagacc

SEQ ID NO: 7428902 - DNA, 22 bp, Homo sapiens
tagcagagcgggtgcgaggcgg

SEQ ID NO: 7428903 - DNA, 22 bp, Homo sapiens
tagcagagcgggtgcgaggcgg

SEQ ID NO: 7428904 - DNA, 22 bp, Homo sapiens
tagcagagcgggtgcgaggcgg

SEQ ID NO: 7428905 - DNA, 22 bp, Homo sapiens
tagcagagcgggtgcgaggcgg

SEQ ID NO: 7428906 - DNA, 22 bp, Homo sapiens
tagcagagcagggatcagagcc

SEQ ID NO: 7428907 - DNA, 22 bp, Homo sapiens
tagcagagcagggatcagagcc

SEQ ID NO: 7428908 - DNA, 22 bp, Homo sapiens
tagcagagcacatcttcattct

SEQ ID NO: 7428909 - DNA, 22 bp, Homo sapiens
tagcagagcagggatcagagcc

SEQ ID NO: 7428910 - DNA, 22 bp, Homo sapiens
tagcagagcagggatcagagcc

SEQ ID NO: 7428911 - DNA, 22 bp, Homo sapiens
tagcagagcagggatcagagcc

SEQ ID NO: 7428912 - DNA, 22 bp, Homo sapiens
tagcagaggctactgctccttg

SEQ ID NO: 7428913 - DNA, 22 bp, Homo sapiens
tagcagaggctactgctccttg

SEQ ID NO: 7428914 - DNA, 22 bp, Homo sapiens
tagcagaggcaaggatgtgaat

SEQ ID NO: 7428915 - DNA, 22 bp, Homo sapiens
tagcagaggcaaggatgtgaat

SEQ ID NO: 7428916 - DNA, 22 bp, Homo sapiens
tagcagaggcaaggatgtgaat

SEQ ID NO: 7428917 - DNA, 22 bp, Homo sapiens
tagcagaggcaaggatgtgaat

SEQ ID NO: 7428918 - DNA, 22 bp, Homo sapiens
tagcagaggcaaggatgtgaat

SEQ ID NO: 7428919 - DNA, 22 bp, Homo sapiens
tagcagaggctgtctgacttaa

SEQ ID NO: 7428920 - DNA, 22 bp, Homo sapiens
tagcagaggctactgctccttg

SEQ ID NO: 7428921 - DNA, 22 bp, Homo sapiens
tagcagaggctgtctgacttaa

SEQ ID NO: 7428922 - DNA, 22 bp, Homo sapiens
tagcagaggctgtctgacttaa

SEQ ID NO: 7428923 - DNA, 22 bp, Homo sapiens
tagcagaggctgtctgacttaa

SEQ ID NO: 7428924 - DNA, 22 bp, Homo sapiens
tagcagaggaaaagagaacatt

SEQ ID NO: 7428925 - DNA, 22 bp, Homo sapiens
tagcagaggaaaagagaacatt

SEQ ID NO: 7428926 - DNA, 22 bp, Homo sapiens
tagcagaggaaaagagaacatt

SEQ ID NO: 7428927 - DNA, 22 bp, Homo sapiens
tagcagagctgggactagatta

SEQ ID NO: 7428928 - DNA, 22 bp, Homo sapiens
tagcagagctgggactagatta

SEQ ID NO: 7428929 - DNA, 22 bp, Homo sapiens
tagcagagctgcaatatagacc

SEQ ID NO: 7428930 - DNA, 22 bp, Homo sapiens
tagcagagctgcaatatagacc

SEQ ID NO: 7428931 - DNA, 22 bp, Homo sapiens
tagcagaggaaatccagagtaa

SEQ ID NO: 7428932 - DNA, 22 bp, Homo sapiens
tagcagaggaaatccagagtaa

SEQ ID NO: 7428933 - DNA, 22 bp, Homo sapiens
tagcagaggaaatccagagtaa

SEQ ID NO: 7428934 - DNA, 22 bp, Homo sapiens
tagcagaggaaaagagaacatt

SEQ ID NO: 7428935 - DNA, 22 bp, Homo sapiens
tagcagagaggggacagtggca

SEQ ID NO: 7428936 - DNA, 22 bp, Homo sapiens
tagcagagaggggacagtggca

SEQ ID NO: 7428937 - DNA, 22 bp, Homo sapiens
tagcagagaggggacagtggca

SEQ ID NO: 7428938 - DNA, 22 bp, Homo sapiens
tagcagagaggtttcagctaat

SEQ ID NO: 7428939 - DNA, 22 bp, Homo sapiens
tagcagagaggggacagtggca

SEQ ID NO: 7428940 - DNA, 21 bp, Homo sapiens
tagcagagagttaacttctcc

SEQ ID NO: 7428941 - DNA, 21 bp, Homo sapiens
tagcagagagttaacttctcc

SEQ ID NO: 7428942 - DNA, 22 bp, Homo sapiens
tagcagagatatgggcatagat

SEQ ID NO: 7428943 - DNA, 22 bp, Homo sapiens
tagcagagatatgggcatagat

SEQ ID NO: 7428944 - DNA, 21 bp, Homo sapiens
tagcagagagttaacttctcc

SEQ ID NO: 7428945 - DNA, 22 bp, Homo sapiens
tagcagagaggtttcagctaat

SEQ ID NO: 7428946 - DNA, 22 bp, Homo sapiens
tagcagagaggtttcagctaat

SEQ ID NO: 7428947 - DNA, 22 bp, Homo sapiens
tagcagaagtcaccccgccact

SEQ ID NO: 7428948 - DNA, 22 bp, Homo sapiens
tagcagaagttccaatgcatat

SEQ ID NO: 7428949 - DNA, 22 bp, Homo sapiens
tagcagaagttccaatgcatat

SEQ ID NO: 7428950 - DNA, 22 bp, Homo sapiens
tagcagaagttccaatgcatat

SEQ ID NO: 7428951 - DNA, 22 bp, Homo sapiens
tagcagaagaacaacatgatct

SEQ ID NO: 7428952 - DNA, 22 bp, Homo sapiens
tagcagaagaacaacatgatct

SEQ ID NO: 7428953 - DNA, 22 bp, Homo sapiens
tagcagaagttgcaaactaggg

SEQ ID NO: 7428954 - DNA, 22 bp, Homo sapiens
tagcagagaggggacagtggca

SEQ ID NO: 7428955 - DNA, 22 bp, Homo sapiens
tagcagagaggggacagtggca

SEQ ID NO: 7428956 - DNA, 22 bp, Homo sapiens
tagcagaagttgcaaactaggg

SEQ ID NO: 7428957 - DNA, 22 bp, Homo sapiens
tagcagaagttgcaaactaggg

SEQ ID NO: 7428958 - DNA, 22 bp, Homo sapiens
tagcagaagttgcaaactaggg

SEQ ID NO: 7428959 - DNA, 22 bp, Homo sapiens
tagcagaagttccaatgcatat

SEQ ID NO: 7428960 - DNA, 22 bp, Homo sapiens
tagcagaagaaattcagagttg

SEQ ID NO: 7428961 - DNA, 22 bp, Homo sapiens
tagcagaagaaattcagagttg

SEQ ID NO: 7428962 - DNA, 22 bp, Homo sapiens
tagcagaagaaattcagagttg

SEQ ID NO: 7428963 - DNA, 22 bp, Homo sapiens
tagcagaaccagtcagtgagcc

SEQ ID NO: 7428964 - DNA, 22 bp, Homo sapiens
tagcagaaccagtcagtgagcc

SEQ ID NO: 7428965 - DNA, 22 bp, Homo sapiens
tagcagaaccagtcagtgagcc

SEQ ID NO: 7428966 - DNA, 22 bp, Homo sapiens
tagcagaaccagtcagtgagcc

SEQ ID NO: 7428967 - DNA, 22 bp, Homo sapiens
tagagtaacacaaacgaattgg

SEQ ID NO: 7428968 - DNA, 22 bp, Homo sapiens
tagagtaacacaaacgaattgg

SEQ ID NO: 7428969 - DNA, 22 bp, Homo sapiens
tagagtaacacaaacgaattgg

SEQ ID NO: 7428970 - DNA, 22 bp, Homo sapiens
tagcagaaccagtcagtgagcc

SEQ ID NO: 7428971 - DNA, 22 bp, Homo sapiens
tagaggttggccttagaaagat

SEQ ID NO: 7428972 - DNA, 22 bp, Homo sapiens
tagagtaaatagtatgagaaag

SEQ ID NO: 7428973 - DNA, 22 bp, Homo sapiens
tagaggtgttgttgatatagaa

SEQ ID NO: 7428974 - DNA, 20 bp, Homo sapiens
tagaggtgggatttgggttt

SEQ ID NO: 7428975 - DNA, 22 bp, Homo sapiens
tagaggtgagccatcaaggggc

SEQ ID NO: 7428976 - DNA, 22 bp, Homo sapiens
tagaggtgtcactttgggaagt

SEQ ID NO: 7428977 - DNA, 22 bp, Homo sapiens
tagaggtgttcattctctccat

SEQ ID NO: 7428978 - DNA, 22 bp, Homo sapiens
tagaggtgttcattctctccat

SEQ ID NO: 7428979 - DNA, 22 bp, Homo sapiens
tagaggtgttgacgccaaggta

SEQ ID NO: 7428980 - DNA, 22 bp, Homo sapiens
tagaggtgttgacgccaaggta

SEQ ID NO: 7428981 - DNA, 22 bp, Homo sapiens
tagaggtgttcattctctccat

SEQ ID NO: 7428982 - DNA, 22 bp, Homo sapiens
tagaggtgttgttgatatagaa

SEQ ID NO: 7428983 - DNA, 22 bp, Homo sapiens
tagaggtgttgttgatatagaa

SEQ ID NO: 7428984 - DNA, 22 bp, Homo sapiens
tagaggtgttgacgccaaggta

SEQ ID NO: 7428985 - DNA, 18 bp, Homo sapiens
tagaggggaagaccttta

SEQ ID NO: 7428986 - DNA, 22 bp, Homo sapiens
tagaggggaaaatgcgtattaa

SEQ ID NO: 7428987 - DNA, 22 bp, Homo sapiens
tagaggggaatctgcctcctct

SEQ ID NO: 7428988 - DNA, 22 bp, Homo sapiens
tagaggggaatctgcctcctct

SEQ ID NO: 7428989 - DNA, 22 bp, Homo sapiens
tagaggggaatctgcctcctct

SEQ ID NO: 7428990 - DNA, 18 bp, Homo sapiens
tagagggggcctgggcat

SEQ ID NO: 7428991 - DNA, 20 bp, Homo sapiens
tagaggggacaatcattgcc

SEQ ID NO: 7428992 - DNA, 20 bp, Homo sapiens
tagaggggacaatcattgcc

SEQ ID NO: 7428993 - DNA, 18 bp, Homo sapiens
tagaggggaagaccttta

SEQ ID NO: 7428994 - DNA, 22 bp, Homo sapiens
tagaggggaatctgcctcctct

SEQ ID NO: 7428995 - DNA, 22 bp, Homo sapiens
tagagggttattaggacagaag

SEQ ID NO: 7428996 - DNA, 22 bp, Homo sapiens
tagaggtactcccctcaaagtt

SEQ ID NO: 7428997 - DNA, 18 bp, Homo sapiens
tagagggggcctgggcat

SEQ ID NO: 7428998 - DNA, 18 bp, Homo sapiens
tagagggggcctgggcat

SEQ ID NO: 7428999 - DNA, 22 bp, Homo sapiens
tagagggttattaggacagaag

SEQ ID NO: 7429000 - DNA, 22 bp, Homo sapiens
tagagggttattaggacagaag

SEQ ID NO: 7429001 - DNA, 22 bp, Homo sapiens
tagaggtagagttacattagtc

SEQ ID NO: 7429002 - DNA, 22 bp, Homo sapiens
tagaggtagatggtcagccaat

SEQ ID NO: 7429003 - DNA, 22 bp, Homo sapiens
tagaggtagcaacaggactaga

SEQ ID NO: 7429004 - DNA, 22 bp, Homo sapiens
tagaggtgacactgagaccata

SEQ ID NO: 7429005 - DNA, 22 bp, Homo sapiens
tagaggtgacactgagaccata

SEQ ID NO: 7429006 - DNA, 22 bp, Homo sapiens
tagaggtgacactgagaccata

SEQ ID NO: 7429007 - DNA, 22 bp, Homo sapiens
tagaggtgagacttcagtgaca

SEQ ID NO: 7429008 - DNA, 22 bp, Homo sapiens
tagaggtgagacttcagtgaca

SEQ ID NO: 7429009 - DNA, 22 bp, Homo sapiens
tagaggtgagacttcagtgaca

SEQ ID NO: 7429010 - DNA, 22 bp, Homo sapiens
tagaggtataccaaaaaggcat

SEQ ID NO: 7429011 - DNA, 22 bp, Homo sapiens
tagaggtatttttgatggtcat

SEQ ID NO: 7429012 - DNA, 22 bp, Homo sapiens
tagaggtgacactgagaccata

SEQ ID NO: 7429013 - DNA, 22 bp, Homo sapiens
tagaggtagcaacaggactaga

SEQ ID NO: 7429014 - DNA, 22 bp, Homo sapiens
tagaggtgagatattttatttt

SEQ ID NO: 7429015 - DNA, 22 bp, Homo sapiens
tagaggtgagatattttatttt

SEQ ID NO: 7429016 - DNA, 22 bp, Homo sapiens
tagaggtgagaggaactttgga

SEQ ID NO: 7429017 - DNA, 22 bp, Homo sapiens
tagaggtgagaggaactttgga

SEQ ID NO: 7429018 - DNA, 22 bp, Homo sapiens
tagaggtgagatattttatttt

SEQ ID NO: 7429019 - DNA, 22 bp, Homo sapiens
tagaggtgagattgtggtgctg

SEQ ID NO: 7429020 - DNA, 22 bp, Homo sapiens
tagaggtgagccatcaaggggc

SEQ ID NO: 7429021 - DNA, 22 bp, Homo sapiens
tagaggtgagccatcaaggggc

SEQ ID NO: 7429022 - DNA, 22 bp, Homo sapiens
taggaaaatatctcttattggg

SEQ ID NO: 7429023 - DNA, 22 bp, Homo sapiens
taggaaaagtctagattgatga

SEQ ID NO: 7429024 - DNA, 22 bp, Homo sapiens
taggaaaatatctcttattggg

SEQ ID NO: 7429025 - DNA, 22 bp, Homo sapiens
taggaaaatatctcttattggg

SEQ ID NO: 7429026 - DNA, 22 bp, Homo sapiens
taggaaacaaacctgcctcttc

SEQ ID NO: 7429027 - DNA, 22 bp, Homo sapiens
taggaaacaaacctgcctcttc

SEQ ID NO: 7429028 - DNA, 22 bp, Homo sapiens
taggaaacaaagcttagcagga

SEQ ID NO: 7429029 - DNA, 22 bp, Homo sapiens
taggaaacaaagtaatgcaact

SEQ ID NO: 7429030 - DNA, 22 bp, Homo sapiens
taggaaacaaagtggatgaaat

SEQ ID NO: 7429031 - DNA, 22 bp, Homo sapiens
taggaaacaaagtggatgaaat

SEQ ID NO: 7429032 - DNA, 22 bp, Homo sapiens
taggaaacatttgaagaggatt

SEQ ID NO: 7429033 - DNA, 22 bp, Homo sapiens
taggaaacatttgaagaggatt

SEQ ID NO: 7429034 - DNA, 22 bp, Homo sapiens
taggaaacatttgaagaggatt

SEQ ID NO: 7429035 - DNA, 22 bp, Homo sapiens
taggaaacagtgcatatatagt

SEQ ID NO: 7429036 - DNA, 22 bp, Homo sapiens
taggaaaccaatcttttgggag

SEQ ID NO: 7429037 - DNA, 22 bp, Homo sapiens
taggaaactaatacagtctgga

SEQ ID NO: 7429038 - DNA, 22 bp, Homo sapiens
taggacaggtgaggggctgtgg

SEQ ID NO: 7429039 - DNA, 22 bp, Homo sapiens
taggacaggtgaggggctgtgg

SEQ ID NO: 7429040 - DNA, 22 bp, Homo sapiens
taggaaactcaaagggaagtgg

SEQ ID NO: 7429041 - DNA, 22 bp, Homo sapiens
taggagggggaacaaggcatac

SEQ ID NO: 7429042 - DNA, 22 bp, Homo sapiens
taggagggggaacaaggcatac

SEQ ID NO: 7429043 - DNA, 22 bp, Homo sapiens
taggagggccctgaaaatggca

SEQ ID NO: 7429044 - DNA, 22 bp, Homo sapiens
taggacagtttactttggttac

SEQ ID NO: 7429045 - DNA, 22 bp, Homo sapiens
taggagggggaacaaggcatac

SEQ ID NO: 7429046 - DNA, 22 bp, Homo sapiens
taggagggggaacaaggcatac

SEQ ID NO: 7429047 - DNA, 22 bp, Homo sapiens
taggagggttagagggaaatat

SEQ ID NO: 7429048 - DNA, 22 bp, Homo sapiens
taggagggttagagggaaatat

SEQ ID NO: 7429049 - DNA, 22 bp, Homo sapiens
taggagggttagagggaaatat

SEQ ID NO: 7429050 - DNA, 22 bp, Homo sapiens
taggacagtggagataaccaga

SEQ ID NO: 7429051 - DNA, 22 bp, Homo sapiens
taggacagtggagataaccaga

SEQ ID NO: 7429052 - DNA, 22 bp, Homo sapiens
taggacagtttactttggttac

SEQ ID NO: 7429053 - DNA, 22 bp, Homo sapiens
taggacagttatgggttttatt

SEQ ID NO: 7429054 - DNA, 22 bp, Homo sapiens
taggacagttatgggttttatt

SEQ ID NO: 7429055 - DNA, 22 bp, Homo sapiens
taggacagtggagataaccaga

SEQ ID NO: 7429056 - DNA, 22 bp, Homo sapiens
taggacagtagctggtgcacag

SEQ ID NO: 7429057 - DNA, 22 bp, Homo sapiens
taggacagtagctggtgcacag

SEQ ID NO: 7429058 - DNA, 22 bp, Homo sapiens
taggacagtagctggtgcacag

SEQ ID NO: 7429059 - DNA, 22 bp, Homo sapiens
taggacagtagctggtgcacag

SEQ ID NO: 7429060 - DNA, 22 bp, Homo sapiens
taggatgactgatagtgattcc

SEQ ID NO: 7429061 - DNA, 22 bp, Homo sapiens
taggatgaggggtggccaagta

SEQ ID NO: 7429062 - DNA, 22 bp, Homo sapiens
taggatgactgatagtgattcc

SEQ ID NO: 7429063 - DNA, 22 bp, Homo sapiens
taggatgacaccaccaagacct

SEQ ID NO: 7429064 - DNA, 22 bp, Homo sapiens
taggatgaagtagttatacagc

SEQ ID NO: 7429065 - DNA, 22 bp, Homo sapiens
taggatgacacagcaagtatag

SEQ ID NO: 7429066 - DNA, 20 bp, Homo sapiens
taggatgaaagtggtttctg

SEQ ID NO: 7429067 - DNA, 22 bp, Homo sapiens
taggatggtacaaggcaggggt

SEQ ID NO: 7429068 - DNA, 22 bp, Homo sapiens
taggatgatcttgtagagagat

SEQ ID NO: 7429069 - DNA, 22 bp, Homo sapiens
taggatgatcttgtagagagat

SEQ ID NO: 7429070 - DNA, 22 bp, Homo sapiens
taggatggtacaaggcaggggt

SEQ ID NO: 7429071 - DNA, 22 bp, Homo sapiens
taggatggtacaaggcaggggt

SEQ ID NO: 7429072 - DNA, 22 bp, Homo sapiens
taggatggtcacagagatggac

SEQ ID NO: 7429073 - DNA, 22 bp, Homo sapiens
taggatggtcacagagatggac

SEQ ID NO: 7429074 - DNA, 22 bp, Homo sapiens
taggatgtgccaggaaagaaag

SEQ ID NO: 7429075 - DNA, 22 bp, Homo sapiens
taggatttactttgacaatatt

SEQ ID NO: 7429076 - DNA, 22 bp, Homo sapiens
taggatttactttgacaatatt

SEQ ID NO: 7429077 - DNA, 22 bp, Homo sapiens
taggatttaataaaagaataga

SEQ ID NO: 7429078 - DNA, 22 bp, Homo sapiens
taggatttaggctttaacatct

SEQ ID NO: 7429079 - DNA, 22 bp, Homo sapiens
taggatttaggctttaacatct

SEQ ID NO: 7429080 - DNA, 22 bp, Homo sapiens
taggatttaggctttaacatct

SEQ ID NO: 7429081 - DNA, 21 bp, Homo sapiens
taggatgaaagtgagtgagaa

SEQ ID NO: 7429082 - DNA, 22 bp, Homo sapiens
taggatctatttgtatttcagg

SEQ ID NO: 7429083 - DNA, 22 bp, Homo sapiens
taggatgaaaagtgttctttga

SEQ ID NO: 7429084 - DNA, 22 bp, Homo sapiens
taggatctatttgtatttcagg

SEQ ID NO: 7429085 - DNA, 22 bp, Homo sapiens
taggatatgtgaaatcatatta

SEQ ID NO: 7429086 - DNA, 22 bp, Homo sapiens
taggagggttagagggaaatat

SEQ ID NO: 7429087 - DNA, 22 bp, Homo sapiens
taggatatgcatttttatacat

SEQ ID NO: 7429088 - DNA, 22 bp, Homo sapiens
tagctttgaacttctgggctca

SEQ ID NO: 7429089 - DNA, 22 bp, Homo sapiens
tagctttgcaaaggaagtttta

SEQ ID NO: 7429090 - DNA, 22 bp, Homo sapiens
tagctttgccacacatgtagat

SEQ ID NO: 7429091 - DNA, 22 bp, Homo sapiens
tagctttgccatctgtcacata

SEQ ID NO: 7429092 - DNA, 22 bp, Homo sapiens
tagctttgcccgtgctggattt

SEQ ID NO: 7429093 - DNA, 22 bp, Homo sapiens
tagctttgcctgaagtaatcag

SEQ ID NO: 7429094 - DNA, 22 bp, Homo sapiens
tagctttgcctgttaatcacaa

SEQ ID NO: 7429095 - DNA, 22 bp, Homo sapiens
tagctttgctggcaagcatgtc

SEQ ID NO: 7429096 - DNA, 22 bp, Homo sapiens
tagctttaggatggttctcttg

SEQ ID NO: 7429097 - DNA, 22 bp, Homo sapiens
tagctttagaaatattctcaga

SEQ ID NO: 7429098 - DNA, 22 bp, Homo sapiens
tagctttagaaatattctcaga

SEQ ID NO: 7429099 - DNA, 22 bp, Homo sapiens
tagctttaccatagaagagtat

SEQ ID NO: 7429100 - DNA, 22 bp, Homo sapiens
tagctttaccatagaagagtat

SEQ ID NO: 7429101 - DNA, 22 bp, Homo sapiens
tagctttaccatagaagagtat

SEQ ID NO: 7429102 - DNA, 22 bp, Homo sapiens
tagctttacaaagtgctgcacc

SEQ ID NO: 7429103 - DNA, 22 bp, Homo sapiens
tagctttacaaagtgctgcacc

SEQ ID NO: 7429104 - DNA, 22 bp, Homo sapiens
tagctttaccatagaagagtat

SEQ ID NO: 7429105 - DNA, 22 bp, Homo sapiens
tagctttacaaagtgctgcacc

SEQ ID NO: 7429106 - DNA, 22 bp, Homo sapiens
tagctttagtgaaaaatatcag

SEQ ID NO: 7429107 - DNA, 22 bp, Homo sapiens
tagctttagtgaaaaatatcag

SEQ ID NO: 7429108 - DNA, 22 bp, Homo sapiens
tagctttaggcacgtttgaatt

SEQ ID NO: 7429109 - DNA, 22 bp, Homo sapiens
tagctttagtgaaaaatatcag

SEQ ID NO: 7429110 - DNA, 22 bp, Homo sapiens
tagctttgtgtatgatgtctgt

SEQ ID NO: 7429111 - DNA, 22 bp, Homo sapiens
tagctttgtgtcctgatttagc

SEQ ID NO: 7429112 - DNA, 22 bp, Homo sapiens
tagctttgttagaatgtcttca

SEQ ID NO: 7429113 - DNA, 22 bp, Homo sapiens
tagcttttaagtcataacctca

SEQ ID NO: 7429114 - DNA, 22 bp, Homo sapiens
tagcttttagtacttaatggct

SEQ ID NO: 7429115 - DNA, 22 bp, Homo sapiens
taggaaaaagaggctggcaagg

SEQ ID NO: 7429116 - DNA, 16 bp, Homo sapiens
tagctttttcctatgt

SEQ ID NO: 7429117 - DNA, 22 bp, Homo sapiens
tagcttttagtacttaatggct

SEQ ID NO: 7429118 - DNA, 22 bp, Homo sapiens
tagcttttatccactgcttttg

SEQ ID NO: 7429119 - DNA, 22 bp, Homo sapiens
taggaaaaatacagaattatat

SEQ ID NO: 7429120 - DNA, 22 bp, Homo sapiens
taggaaaaatacagaattatat

SEQ ID NO: 7429121 - DNA, 22 bp, Homo sapiens
taggaaaaagaggctggcaagg

SEQ ID NO: 7429122 - DNA, 22 bp, Homo sapiens
taggaaaaagaggctggcaagg

SEQ ID NO: 7429123 - DNA, 22 bp, Homo sapiens
taggaaaacgtgattttctcac

SEQ ID NO: 7429124 - DNA, 22 bp, Homo sapiens
taggaaaaatacagaattatat

SEQ ID NO: 7429125 - DNA, 22 bp, Homo sapiens
taggaaaacgtgattttctcac

SEQ ID NO: 7429126 - DNA, 22 bp, Homo sapiens
taggaaaaatacagaattatat

SEQ ID NO: 7429127 - DNA, 22 bp, Homo sapiens
tagcttttaagtcataacctca

SEQ ID NO: 7429128 - DNA, 22 bp, Homo sapiens
taggaaaaatacagaattatat

SEQ ID NO: 7429129 - DNA, 22 bp, Homo sapiens
taggaaaaatacagaattatat

SEQ ID NO: 7429130 - DNA, 22 bp, Homo sapiens
taggaaaacgtgattttctcac

SEQ ID NO: 7429131 - DNA, 22 bp, Homo sapiens
taggaaaagcacaggatgttct

SEQ ID NO: 7429132 - DNA, 22 bp, Homo sapiens
taggaaaagcacaggatgttct

SEQ ID NO: 7429133 - DNA, 22 bp, Homo sapiens
taggaaaagcacaggatgttct

SEQ ID NO: 7429134 - DNA, 22 bp, Homo sapiens
taggaaaagcacaggatgttct

SEQ ID NO: 7429135 - DNA, 22 bp, Homo sapiens
taggaaaagtctagattgatga

SEQ ID NO: 7429136 - DNA, 22 bp, Homo sapiens
taggaaaagtctagattgatga

SEQ ID NO: 7429137 - DNA, 22 bp, Homo sapiens
taggaaaagtctagattgatga

SEQ ID NO: 7429138 - DNA, 22 bp, Homo sapiens
taggaaaagtctagattgatga

SEQ ID NO: 7429139 - DNA, 22 bp, Homo sapiens
taggaaaagtctagattgatga

SEQ ID NO: 7429140 - DNA, 22 bp, Homo sapiens
taggaaaagtctagattgatga

SEQ ID NO: 7429141 - DNA, 22 bp, Homo sapiens
taggaaaagtctagattgatga

SEQ ID NO: 7429142 - DNA, 22 bp, Homo sapiens
tagggagcagccctgccactcc

SEQ ID NO: 7429143 - DNA, 22 bp, Homo sapiens
tagggagcagccctgccactcc

SEQ ID NO: 7429144 - DNA, 22 bp, Homo sapiens
tagggagctctggcagaaggaa

SEQ ID NO: 7429145 - DNA, 22 bp, Homo sapiens
tagggagctctggcagaaggaa

SEQ ID NO: 7429146 - DNA, 22 bp, Homo sapiens
tagggagatgcaagggacggag

SEQ ID NO: 7429147 - DNA, 22 bp, Homo sapiens
tagggagatgcaagggacggag

SEQ ID NO: 7429148 - DNA, 22 bp, Homo sapiens
tagggaggagggttttcaaatc

SEQ ID NO: 7429149 - DNA, 22 bp, Homo sapiens
tagggagctctggcagaaggaa

SEQ ID NO: 7429150 - DNA, 22 bp, Homo sapiens
tagggaggagggttttcaaatc

SEQ ID NO: 7429151 - DNA, 22 bp, Homo sapiens
tagggaggagggttttcaaatc

SEQ ID NO: 7429152 - DNA, 22 bp, Homo sapiens
tagggaggagggttttcaaatc

SEQ ID NO: 7429153 - DNA, 22 bp, Homo sapiens
tagggaggagggttttcaaatc

SEQ ID NO: 7429154 - DNA, 22 bp, Homo sapiens
tagggaggctacttcttgtagg

SEQ ID NO: 7429155 - DNA, 22 bp, Homo sapiens
tagggaggagggttttcaaatc

SEQ ID NO: 7429156 - DNA, 22 bp, Homo sapiens
tagggaggctacttcttgtagg

SEQ ID NO: 7429157 - DNA, 22 bp, Homo sapiens
tagggaggctacttcttgtagg

SEQ ID NO: 7429158 - DNA, 22 bp, Homo sapiens
tagggaggctacttcttgtagg

SEQ ID NO: 7429159 - DNA, 22 bp, Homo sapiens
tagggaggctacttcttgtagg

SEQ ID NO: 7429160 - DNA, 22 bp, Homo sapiens
tagggaggctacttcttgtagg

SEQ ID NO: 7429161 - DNA, 22 bp, Homo sapiens
tagggaggctacttcttgtagg

SEQ ID NO: 7429162 - DNA, 22 bp, Homo sapiens
tagggatgaggatagatttttc

SEQ ID NO: 7429163 - DNA, 22 bp, Homo sapiens
tagggatgagccagtgggtagt

SEQ ID NO: 7429164 - DNA, 22 bp, Homo sapiens
tagggatgaggatagatttttc

SEQ ID NO: 7429165 - DNA, 22 bp, Homo sapiens
tagggatgatggagcctatgta

SEQ ID NO: 7429166 - DNA, 22 bp, Homo sapiens
tagggatgactatgattcccac

SEQ ID NO: 7429167 - DNA, 22 bp, Homo sapiens
tagggatgagcaactggtagtg

SEQ ID NO: 7429168 - DNA, 22 bp, Homo sapiens
tagggatgagcaactggtagtg

SEQ ID NO: 7429169 - DNA, 22 bp, Homo sapiens
tagggatgagccagtgggtagt

SEQ ID NO: 7429170 - DNA, 22 bp, Homo sapiens
tagggatgagccagtgggtagt

SEQ ID NO: 7429171 - DNA, 22 bp, Homo sapiens
tagggatgacgaaaggacagag

SEQ ID NO: 7429172 - DNA, 22 bp, Homo sapiens
tagggatgacgaaaggacagag

SEQ ID NO: 7429173 - DNA, 22 bp, Homo sapiens
tagggatgactatgattcccac

SEQ ID NO: 7429174 - DNA, 22 bp, Homo sapiens
tagggatgaagatggtatttct

SEQ ID NO: 7429175 - DNA, 22 bp, Homo sapiens
tagggatgaagatggtatttct

SEQ ID NO: 7429176 - DNA, 22 bp, Homo sapiens
tagggatgaagttgctatttac

SEQ ID NO: 7429177 - DNA, 22 bp, Homo sapiens
tagggatgaagttgctatttac

SEQ ID NO: 7429178 - DNA, 22 bp, Homo sapiens
tagggcagagcttgtacacgat

SEQ ID NO: 7429179 - DNA, 22 bp, Homo sapiens
tagggcagagcttgtacacgat

SEQ ID NO: 7429180 - DNA, 22 bp, Homo sapiens
tagggcactatttgtgactgaa

SEQ ID NO: 7429181 - DNA, 22 bp, Homo sapiens
tagggcagagcttgtacacgat

SEQ ID NO: 7429182 - DNA, 22 bp, Homo sapiens
tagggcagagtccaggatgggc

SEQ ID NO: 7429183 - DNA, 22 bp, Homo sapiens
tagggcagagcttgtacacgat

SEQ ID NO: 7429184 - DNA, 22 bp, Homo sapiens
tagggcagagcttgtacacgat

SEQ ID NO: 7429185 - DNA, 22 bp, Homo sapiens
tagggcagagcttgtacacgat

SEQ ID NO: 7429186 - DNA, 22 bp, Homo sapiens
tagggatgtcctgagacttggc

SEQ ID NO: 7429187 - DNA, 22 bp, Homo sapiens
tagggatgtcctgagacttggc

SEQ ID NO: 7429188 - DNA, 22 bp, Homo sapiens
tagggatgtaaacatagtaatt

SEQ ID NO: 7429189 - DNA, 22 bp, Homo sapiens
tagggatgtaaacatagtaatt

SEQ ID NO: 7429190 - DNA, 22 bp, Homo sapiens
tagggatgtggtgagaactgag

SEQ ID NO: 7429191 - DNA, 22 bp, Homo sapiens
tagggatgtggtgagaactgag

SEQ ID NO: 7429192 - DNA, 22 bp, Homo sapiens
tagggcaatatttcccagaaaa

SEQ ID NO: 7429193 - DNA, 22 bp, Homo sapiens
tagggcaatatttcccagaaaa

SEQ ID NO: 7429194 - DNA, 22 bp, Homo sapiens
tagggcaatatttcccagaaaa

SEQ ID NO: 7429195 - DNA, 22 bp, Homo sapiens
tagggatgggagattctcaaac

SEQ ID NO: 7429196 - DNA, 22 bp, Homo sapiens
tagggatgggagattctcaaac

SEQ ID NO: 7429197 - DNA, 22 bp, Homo sapiens
tagggatggcagcatgtagctt

SEQ ID NO: 7429198 - DNA, 22 bp, Homo sapiens
tagggatggaaactaggaatct

SEQ ID NO: 7429199 - DNA, 22 bp, Homo sapiens
tagggatggatgatgcctggca

SEQ ID NO: 7429200 - DNA, 22 bp, Homo sapiens
tagggatggatgatgcctggca

SEQ ID NO: 7429201 - DNA, 22 bp, Homo sapiens
tagggatggcagcatgtagctt

SEQ ID NO: 7429202 - DNA, 22 bp, Homo sapiens
tagggatgatggagcctatgta

SEQ ID NO: 7429203 - DNA, 22 bp, Homo sapiens
tagggatgatggagcctatgta

SEQ ID NO: 7429204 - DNA, 22 bp, Homo sapiens
tagggatgatgtctaaaatcat

SEQ ID NO: 7429205 - DNA, 22 bp, Homo sapiens
tagggatgatgtctaaaatcat

SEQ ID NO: 7429206 - DNA, 20 bp, Homo sapiens
tagggatgccagtacttctc

SEQ ID NO: 7429207 - DNA, 20 bp, Homo sapiens
tagggatgccagtacttctc

SEQ ID NO: 7429208 - DNA, 22 bp, Homo sapiens
tagggatgcttagtaggaccca

SEQ ID NO: 7429209 - DNA, 22 bp, Homo sapiens
tagggatgcttagtaggaccca

SEQ ID NO: 7429210 - DNA, 22 bp, Homo sapiens
tagggatggaaacccgttttct

SEQ ID NO: 7429211 - DNA, 22 bp, Homo sapiens
tagggatggaaacccgttttct

SEQ ID NO: 7429212 - DNA, 22 bp, Homo sapiens
tagggatggaaactaggaatct

SEQ ID NO: 7429213 - DNA, 22 bp, Homo sapiens
tagggagatgcaagggacggag

SEQ ID NO: 7429214 - DNA, 20 bp, Homo sapiens
tagggagatatgctcttttc

SEQ ID NO: 7429215 - DNA, 22 bp, Homo sapiens
tagggagatgcaagggacggag

SEQ ID NO: 7429216 - DNA, 20 bp, Homo sapiens
tagggagatatgctcttttc

SEQ ID NO: 7429217 - DNA, 22 bp, Homo sapiens
tagggagaggaagcaggccgct

SEQ ID NO: 7429218 - DNA, 22 bp, Homo sapiens
tagggagatgcaagggacggag

SEQ ID NO: 7429219 - DNA, 22 bp, Homo sapiens
tagggagaggaagcaggccgct

SEQ ID NO: 7429220 - DNA, 20 bp, Homo sapiens
tagggagatatgctcttttc

SEQ ID NO: 7429221 - DNA, 22 bp, Homo sapiens
tagggagaaacaccaatttatt

SEQ ID NO: 7429222 - DNA, 22 bp, Homo sapiens
tagggactagtttcaaggctaa

SEQ ID NO: 7429223 - DNA, 22 bp, Homo sapiens
tagggagaggaagcaggccgct

SEQ ID NO: 7429224 - DNA, 22 bp, Homo sapiens
tagggacactgctcatgagttc

SEQ ID NO: 7429225 - DNA, 22 bp, Homo sapiens
tagggacactgctcatgagttc

SEQ ID NO: 7429226 - DNA, 22 bp, Homo sapiens
tagggacactgctcatgagttc

SEQ ID NO: 7429227 - DNA, 22 bp, Homo sapiens
taggctgggcctgccttccagg

SEQ ID NO: 7429228 - DNA, 22 bp, Homo sapiens
taggctgggcattctggccagg

SEQ ID NO: 7429229 - DNA, 22 bp, Homo sapiens
tagggactagtttcaaggctaa

SEQ ID NO: 7429230 - DNA, 22 bp, Homo sapiens
tagggagaaacaccaatttatt

SEQ ID NO: 7429231 - DNA, 22 bp, Homo sapiens
tagggactgtgtgagggacttg

SEQ ID NO: 7429232 - DNA, 22 bp, Homo sapiens
taggcactggggaggcagcatg

SEQ ID NO: 7429233 - DNA, 22 bp, Homo sapiens
taggcactggttgtggatagtt

SEQ ID NO: 7429234 - DNA, 22 bp, Homo sapiens
taggcagaaaggaaggcaagtt

SEQ ID NO: 7429235 - DNA, 22 bp, Homo sapiens
taggcagaaaggaaggcaagtt

SEQ ID NO: 7429236 - DNA, 22 bp, Homo sapiens
taggcagaaaggaaggcaagtt

SEQ ID NO: 7429237 - DNA, 22 bp, Homo sapiens
taggctgggcattctggccagg

SEQ ID NO: 7429238 - DNA, 22 bp, Homo sapiens
taggctgggcattctggccagg

SEQ ID NO: 7429239 - DNA, 22 bp, Homo sapiens
taggctgggcattctggccagg

SEQ ID NO: 7429240 - DNA, 22 bp, Homo sapiens
taggctgggcattctggccagg

SEQ ID NO: 7429241 - DNA, 22 bp, Homo sapiens
taggctgggagcctgaggctag

SEQ ID NO: 7429242 - DNA, 22 bp, Homo sapiens
taggctgggagcctgaggctag

SEQ ID NO: 7429243 - DNA, 22 bp, Homo sapiens
taggctgggagcctgaggctag

SEQ ID NO: 7429244 - DNA, 22 bp, Homo sapiens
taggctgggcattctggccagg

SEQ ID NO: 7429245 - DNA, 22 bp, Homo sapiens
taggcactgagtacatattggt

SEQ ID NO: 7429246 - DNA, 22 bp, Homo sapiens
taggcactgaggggagcaaggt

SEQ ID NO: 7429247 - DNA, 22 bp, Homo sapiens
taggcactgaggggagcaaggt

SEQ ID NO: 7429248 - DNA, 22 bp, Homo sapiens
taggcactgaccttctcagatt

SEQ ID NO: 7429249 - DNA, 22 bp, Homo sapiens
taggcactgggctaggacaggt

SEQ ID NO: 7429250 - DNA, 22 bp, Homo sapiens
taggcactgggctaggacaggt

SEQ ID NO: 7429251 - DNA, 22 bp, Homo sapiens
taggcacaagaccatgcaaagg

SEQ ID NO: 7429252 - DNA, 22 bp, Homo sapiens
taggcacaagaccatgcaaagg

SEQ ID NO: 7429253 - DNA, 22 bp, Homo sapiens
taggcactagacatggttacca

SEQ ID NO: 7429254 - DNA, 22 bp, Homo sapiens
taggcactagacatggttacca

SEQ ID NO: 7429255 - DNA, 22 bp, Homo sapiens
taggcacaaaatgaaaatggca

SEQ ID NO: 7429256 - DNA, 22 bp, Homo sapiens
taggcacaaaatgaaaatggca

SEQ ID NO: 7429257 - DNA, 21 bp, Homo sapiens
taggcaatttgttgtcatagc

SEQ ID NO: 7429258 - DNA, 22 bp, Homo sapiens
taggcaattagtaacgcagaaa

SEQ ID NO: 7429259 - DNA, 22 bp, Homo sapiens
taggcaatgttctaaggaatga

SEQ ID NO: 7429260 - DNA, 22 bp, Homo sapiens
taggcaagttgcccaatctctc

SEQ ID NO: 7429261 - DNA, 22 bp, Homo sapiens
taggcaatgggtggccctagaa

SEQ ID NO: 7429262 - DNA, 22 bp, Homo sapiens
taggcaatattagactttgtct

SEQ ID NO: 7429263 - DNA, 22 bp, Homo sapiens
taggcaatattagactttgtct

SEQ ID NO: 7429264 - DNA, 22 bp, Homo sapiens
taggcaagtggaccagaggttt

SEQ ID NO: 7429265 - DNA, 22 bp, Homo sapiens
taggcaagtggaccagaggttt

SEQ ID NO: 7429266 - DNA, 22 bp, Homo sapiens
taggcaagtggaccagaggttt

SEQ ID NO: 7429267 - DNA, 22 bp, Homo sapiens
taggcaagtggaccagaggttt

SEQ ID NO: 7429268 - DNA, 22 bp, Homo sapiens
taggcaagtggaccagaggttt

SEQ ID NO: 7429269 - DNA, 22 bp, Homo sapiens
taggcaagtggaccagaggttt

SEQ ID NO: 7429270 - DNA, 22 bp, Homo sapiens
taggcaaggagatttctaagca

SEQ ID NO: 7429271 - DNA, 22 bp, Homo sapiens
taggcaagtagaaaagtttgaa

SEQ ID NO: 7429272 - DNA, 22 bp, Homo sapiens
taggcaagtctctttgtttata

SEQ ID NO: 7429273 - DNA, 22 bp, Homo sapiens
taggatttattctacaatattg

SEQ ID NO: 7429274 - DNA, 22 bp, Homo sapiens
taggatttattctacaatattg

SEQ ID NO: 7429275 - DNA, 22 bp, Homo sapiens
taggatttattctacaatattg

SEQ ID NO: 7429276 - DNA, 22 bp, Homo sapiens
taggatttaggctttaacatct

SEQ ID NO: 7429277 - DNA, 22 bp, Homo sapiens
taggatttggctttagtcaggt

SEQ ID NO: 7429278 - DNA, 22 bp, Homo sapiens
taggatttctctttttgcaact

SEQ ID NO: 7429279 - DNA, 22 bp, Homo sapiens
taggatttctctttttgcaact

SEQ ID NO: 7429280 - DNA, 22 bp, Homo sapiens
taggatttggctttagtcaggt

SEQ ID NO: 7429281 - DNA, 22 bp, Homo sapiens
taggattttttggattctggat

SEQ ID NO: 7429282 - DNA, 22 bp, Homo sapiens
taggcaagaccttccctcttta

SEQ ID NO: 7429283 - DNA, 22 bp, Homo sapiens
taggattttaacccacctctga

SEQ ID NO: 7429284 - DNA, 22 bp, Homo sapiens
taggattttttggattctggat

SEQ ID NO: 7429285 - DNA, 22 bp, Homo sapiens
tcaggatgttaatatagcatta

SEQ ID NO: 7429286 - DNA, 20 bp, Homo sapiens
tcaggatgtgctgagtgaag

SEQ ID NO: 7429287 - DNA, 20 bp, Homo sapiens
tcaggatgtgctgagtgaag

SEQ ID NO: 7429288 - DNA, 22 bp, Homo sapiens
tcaggatgttaatatagcatta

SEQ ID NO: 7429289 - DNA, 22 bp, Homo sapiens
tcaggcagtagaattgcttgaa

SEQ ID NO: 7429290 - DNA, 22 bp, Homo sapiens
tcaggatgtccaaaatccagcc

SEQ ID NO: 7429291 - DNA, 22 bp, Homo sapiens
tcaggcagtctgactccggagg

SEQ ID NO: 7429292 - DNA, 22 bp, Homo sapiens
tcaggcagtctgactccggagg

SEQ ID NO: 7429293 - DNA, 22 bp, Homo sapiens
tcaggcagtctgactccggagg

SEQ ID NO: 7429294 - DNA, 22 bp, Homo sapiens
tcaggcagtagaattgcttgaa

SEQ ID NO: 7429295 - DNA, 20 bp, Homo sapiens
tcaggcagtggggaaaggca

SEQ ID NO: 7429296 - DNA, 20 bp, Homo sapiens
tcaggcagtggggaaaggca

SEQ ID NO: 7429297 - DNA, 20 bp, Homo sapiens
tcaggcagtggggaaaggca

SEQ ID NO: 7429298 - DNA, 21 bp, Homo sapiens
tcaggcagtgcaaatacatgg

SEQ ID NO: 7429299 - DNA, 21 bp, Homo sapiens
tcaggcagtgcaaatacatgg

SEQ ID NO: 7429300 - DNA, 21 bp, Homo sapiens
tcaggcagtgcaaatacatgg

SEQ ID NO: 7429301 - DNA, 21 bp, Homo sapiens
tcaggcagtgcaaatacatgg

SEQ ID NO: 7429302 - DNA, 21 bp, Homo sapiens
tcaggcagtgcaaatacatgg

SEQ ID NO: 7429303 - DNA, 22 bp, Homo sapiens
tcaggcagtctgactccggagg

SEQ ID NO: 7429304 - DNA, 22 bp, Homo sapiens
tcaggcagtctgactccggagg

SEQ ID NO: 7429305 - DNA, 22 bp, Homo sapiens
tcaggatggagggaagcacaga

SEQ ID NO: 7429306 - DNA, 22 bp, Homo sapiens
tcaggatggagggaagcacaga

SEQ ID NO: 7429307 - DNA, 22 bp, Homo sapiens
tcaggatggagggaagcacaga

SEQ ID NO: 7429308 - DNA, 22 bp, Homo sapiens
tcaggatggagtctatccagtg

SEQ ID NO: 7429309 - DNA, 22 bp, Homo sapiens
tcaggatgagctcataactatg

SEQ ID NO: 7429310 - DNA, 22 bp, Homo sapiens
tcaggatgacttcaaggaggaa

SEQ ID NO: 7429311 - DNA, 22 bp, Homo sapiens
tcaggatgagtcatcaagctgc

SEQ ID NO: 7429312 - DNA, 22 bp, Homo sapiens
tcaggatgagtcatcaagctgc

SEQ ID NO: 7429313 - DNA, 22 bp, Homo sapiens
tcaggatggcacccaagctctt

SEQ ID NO: 7429314 - DNA, 22 bp, Homo sapiens
tcaggatggcacccaagctctt

SEQ ID NO: 7429315 - DNA, 22 bp, Homo sapiens
tcaggatggcttctgcatcaaa

SEQ ID NO: 7429316 - DNA, 22 bp, Homo sapiens
tcaggatggagtctatccagtg

SEQ ID NO: 7429317 - DNA, 22 bp, Homo sapiens
tcaggatggcttctgcatcaaa

SEQ ID NO: 7429318 - DNA, 22 bp, Homo sapiens
tcaggatggcttctgcatcaaa

SEQ ID NO: 7429319 - DNA, 22 bp, Homo sapiens
tcaggatggtgtggaggaaata

SEQ ID NO: 7429320 - DNA, 22 bp, Homo sapiens
tcaggatggtgtggaggaaata

SEQ ID NO: 7429321 - DNA, 22 bp, Homo sapiens
tcaggatgaccacgagcctcta

SEQ ID NO: 7429322 - DNA, 22 bp, Homo sapiens
tcaggatgaagtcagaggggtc

SEQ ID NO: 7429323 - DNA, 22 bp, Homo sapiens
tcaggatgaccacgagcctcta

SEQ ID NO: 7429324 - DNA, 22 bp, Homo sapiens
tcaggatgaccacgagcctcta

SEQ ID NO: 7429325 - DNA, 22 bp, Homo sapiens
tcaggatgacttcaaggaggaa

SEQ ID NO: 7429326 - DNA, 22 bp, Homo sapiens
tcaggatgacttcaaggaggaa

SEQ ID NO: 7429327 - DNA, 22 bp, Homo sapiens
tcaggatgacttcaaggaggaa

SEQ ID NO: 7429328 - DNA, 22 bp, Homo sapiens
tcaggatgacttcaaggaggaa

SEQ ID NO: 7429329 - DNA, 22 bp, Homo sapiens
tcaggatgaccacgagcctcta

SEQ ID NO: 7429330 - DNA, 22 bp, Homo sapiens
tcaggatgaagtcagaggggtc

SEQ ID NO: 7429331 - DNA, 22 bp, Homo sapiens
tcaggatcggcctttttttaag

SEQ ID NO: 7429332 - DNA, 22 bp, Homo sapiens
tcaggatgaagtcagaggggtc

SEQ ID NO: 7429333 - DNA, 22 bp, Homo sapiens
tcaggatccatagactcccaaa

SEQ ID NO: 7429334 - DNA, 18 bp, Homo sapiens
tcaggagtttgtggatgg

SEQ ID NO: 7429335 - DNA, 18 bp, Homo sapiens
tcaggagtttgtggatgg

SEQ ID NO: 7429336 - DNA, 22 bp, Homo sapiens
tcaggagtttggcctacagagg

SEQ ID NO: 7429337 - DNA, 22 bp, Homo sapiens
tcaggagtttggcctacagagg

SEQ ID NO: 7429338 - DNA, 18 bp, Homo sapiens
tcaggagtttgtggatgg

SEQ ID NO: 7429339 - DNA, 22 bp, Homo sapiens
tcaggatcaggggcctttcctt

SEQ ID NO: 7429340 - DNA, 22 bp, Homo sapiens
tcaggagtgcagcagtttggag

SEQ ID NO: 7429341 - DNA, 22 bp, Homo sapiens
tcaggagtgcagcagtttggag

SEQ ID NO: 7429342 - DNA, 22 bp, Homo sapiens
tcaggagtgataccatttgtca

SEQ ID NO: 7429343 - DNA, 22 bp, Homo sapiens
tcaggagtgataccatttgtca

SEQ ID NO: 7429344 - DNA, 22 bp, Homo sapiens
tcaggagtctgtgcagttccac

SEQ ID NO: 7429345 - DNA, 21 bp, Homo sapiens
tcaggagtggagagaattggt

SEQ ID NO: 7429346 - DNA, 22 bp, Homo sapiens
tcaggagtgccagtaccttttg

SEQ ID NO: 7429347 - DNA, 22 bp, Homo sapiens
tcaggagtgccagtaccttttg

SEQ ID NO: 7429348 - DNA, 22 bp, Homo sapiens
tcaggagtgcagcagtttggag

SEQ ID NO: 7429349 - DNA, 21 bp, Homo sapiens
tcaggagtggagagaattggt

SEQ ID NO: 7429350 - DNA, 19 bp, Homo sapiens
tcaggagttagttgtgctc

SEQ ID NO: 7429351 - DNA, 22 bp, Homo sapiens
tcaggagttgaaggggatcctg

SEQ ID NO: 7429352 - DNA, 22 bp, Homo sapiens
tcaggagtttggcctacagagg

SEQ ID NO: 7429353 - DNA, 22 bp, Homo sapiens
tcaggagtttggcctacagagg

SEQ ID NO: 7429354 - DNA, 22 bp, Homo sapiens
tcaggagtttcaggtgtaagtg

SEQ ID NO: 7429355 - DNA, 22 bp, Homo sapiens
tcaggagtttcaggtgtaagtg

SEQ ID NO: 7429356 - DNA, 22 bp, Homo sapiens
tcaggagtttcaggtgtaagtg

SEQ ID NO: 7429357 - DNA, 22 bp, Homo sapiens
tcaggagtttcaggtgtaagtg

SEQ ID NO: 7429358 - DNA, 22 bp, Homo sapiens
tcaggcctgcaggcttcctgga

SEQ ID NO: 7429359 - DNA, 22 bp, Homo sapiens
tcaggcctgcaggcttcctgga

SEQ ID NO: 7429360 - DNA, 22 bp, Homo sapiens
tcaggcctgcagtgccaaccca

SEQ ID NO: 7429361 - DNA, 22 bp, Homo sapiens
tcaggcctgcagtgccaaccca

SEQ ID NO: 7429362 - DNA, 22 bp, Homo sapiens
tcaggcctgcagtgccaaccca

SEQ ID NO: 7429363 - DNA, 22 bp, Homo sapiens
tcaggcctgcagtgccaaccca

SEQ ID NO: 7429364 - DNA, 22 bp, Homo sapiens
tcaggcctgctgtatgatggat

SEQ ID NO: 7429365 - DNA, 22 bp, Homo sapiens
tcaggcctgctgtatgatggat

SEQ ID NO: 7429366 - DNA, 22 bp, Homo sapiens
tcaggcctgccctgaaagcaca

SEQ ID NO: 7429367 - DNA, 22 bp, Homo sapiens
tcaggcctgcagtgccaaccca

SEQ ID NO: 7429368 - DNA, 22 bp, Homo sapiens
tcaggcctgccctgaaagcaca

SEQ ID NO: 7429369 - DNA, 22 bp, Homo sapiens
tcaggcctgccctgaaagcaca

SEQ ID NO: 7429370 - DNA, 22 bp, Homo sapiens
tcaggcctgcaggcttcctgga

SEQ ID NO: 7429371 - DNA, 22 bp, Homo sapiens
tcaggcctgcaaggagagtccc

SEQ ID NO: 7429372 - DNA, 22 bp, Homo sapiens
tcaggcctgcaggcttcctgga

SEQ ID NO: 7429373 - DNA, 22 bp, Homo sapiens
tcaggcctgcaggcttcctgga

SEQ ID NO: 7429374 - DNA, 22 bp, Homo sapiens
tcaggcctgcaggcttcctgga

SEQ ID NO: 7429375 - DNA, 22 bp, Homo sapiens
tcaggcctgcaaggagagtccc

SEQ ID NO: 7429376 - DNA, 22 bp, Homo sapiens
tcaggcctgcaggcttcctgga

SEQ ID NO: 7429377 - DNA, 22 bp, Homo sapiens
tcaggccaggagatcagattga

SEQ ID NO: 7429378 - DNA, 22 bp, Homo sapiens
tcaggcctgcaaggagagtccc

SEQ ID NO: 7429379 - DNA, 22 bp, Homo sapiens
tcaggcctgcaaggagagtccc

SEQ ID NO: 7429380 - DNA, 22 bp, Homo sapiens
tcaggcctgcaaggagagtccc

SEQ ID NO: 7429381 - DNA, 22 bp, Homo sapiens
tcaggcctgcaaatgaatggta

SEQ ID NO: 7429382 - DNA, 22 bp, Homo sapiens
tcaggcctgcaaatgaatggta

SEQ ID NO: 7429383 - DNA, 22 bp, Homo sapiens
tcaggcctgcaaatgaatggta

SEQ ID NO: 7429384 - DNA, 22 bp, Homo sapiens
tcaggcctgcaaatgaatggta

SEQ ID NO: 7429385 - DNA, 22 bp, Homo sapiens
tcaggccagcaccatccctatc

SEQ ID NO: 7429386 - DNA, 22 bp, Homo sapiens
tcaggccagcaccatccctatc

SEQ ID NO: 7429387 - DNA, 22 bp, Homo sapiens
tcaggccaggagatcagattga

SEQ ID NO: 7429388 - DNA, 22 bp, Homo sapiens
tcaggccaggagatcagattga

SEQ ID NO: 7429389 - DNA, 22 bp, Homo sapiens
tcaggccacggctcactgagac

SEQ ID NO: 7429390 - DNA, 22 bp, Homo sapiens
tcaggccacggctcactgagac

SEQ ID NO: 7429391 - DNA, 22 bp, Homo sapiens
tcaggccacttcacaggtgatt

SEQ ID NO: 7429392 - DNA, 22 bp, Homo sapiens
tcaggccacggctcactgagac

SEQ ID NO: 7429393 - DNA, 22 bp, Homo sapiens
tcaggccacttcacaggtgatt

SEQ ID NO: 7429394 - DNA, 22 bp, Homo sapiens
tcaggccacttcacaggtgatt

SEQ ID NO: 7429395 - DNA, 22 bp, Homo sapiens
tcaggccacttcacaggtgatt

SEQ ID NO: 7429396 - DNA, 22 bp, Homo sapiens
tcaggccaaagaaacagcatga

SEQ ID NO: 7429397 - DNA, 22 bp, Homo sapiens
tcaggccaaagaaacagcatga

SEQ ID NO: 7429398 - DNA, 22 bp, Homo sapiens
tcaggccaaagaaacagcatga

SEQ ID NO: 7429399 - DNA, 22 bp, Homo sapiens
tcaggccaaggtagacatgact

SEQ ID NO: 7429400 - DNA, 22 bp, Homo sapiens
tcaggccaaggtagacatgact

SEQ ID NO: 7429401 - DNA, 22 bp, Homo sapiens
tcaggccacggctcactgagac

SEQ ID NO: 7429402 - DNA, 22 bp, Homo sapiens
tcaggccacggctcactgagac

SEQ ID NO: 7429403 - DNA, 22 bp, Homo sapiens
tcaggccaaggtagacatgact

SEQ ID NO: 7429404 - DNA, 22 bp, Homo sapiens
tcaggcatgtgtactctttgat

SEQ ID NO: 7429405 - DNA, 22 bp, Homo sapiens
tcaggcattcccatgcataaga

SEQ ID NO: 7429406 - DNA, 22 bp, Homo sapiens
tcaggcattgtgcagagccttg

SEQ ID NO: 7429407 - DNA, 22 bp, Homo sapiens
tcaggcatggctcttcctcagg

SEQ ID NO: 7429408 - DNA, 22 bp, Homo sapiens
tcaggcatggctcttcctcagg

SEQ ID NO: 7429409 - DNA, 22 bp, Homo sapiens
tcaggcatgcattctgcaggtt

SEQ ID NO: 7429410 - DNA, 19 bp, Homo sapiens
tcaggcagttattcacaaa

SEQ ID NO: 7429411 - DNA, 22 bp, Homo sapiens
tcaggcatgcattctgcaggtt

SEQ ID NO: 7429412 - DNA, 22 bp, Homo sapiens
tcaggcatgcattctgcaggtt

SEQ ID NO: 7429413 - DNA, 19 bp, Homo sapiens
tcaggcagttattcacaaa

SEQ ID NO: 7429414 - DNA, 19 bp, Homo sapiens
tcaggcagttattcacaaa

SEQ ID NO: 7429415 - DNA, 22 bp, Homo sapiens
tcaggcagtggtaaatgagtta

SEQ ID NO: 7429416 - DNA, 22 bp, Homo sapiens
tcaggcagtggtaaatgagtta

SEQ ID NO: 7429417 - DNA, 20 bp, Homo sapiens
tcaggcagtggggaaaggca

SEQ ID NO: 7429418 - DNA, 20 bp, Homo sapiens
tcaggcagtggggaaaggca

SEQ ID NO: 7429419 - DNA, 20 bp, Homo sapiens
tcaggcagtggggaaaggca

SEQ ID NO: 7429420 - DNA, 20 bp, Homo sapiens
tcaggcagtggggaaaggca

SEQ ID NO: 7429421 - DNA, 20 bp, Homo sapiens
tcaggcagtggggaaaggca

SEQ ID NO: 7429422 - DNA, 19 bp, Homo sapiens
tcaggcagttattcacaaa

SEQ ID NO: 7429423 - DNA, 19 bp, Homo sapiens
tcaggcagttattcacaaa

SEQ ID NO: 7429424 - DNA, 19 bp, Homo sapiens
tcaggcagttattcacaaa

SEQ ID NO: 7429425 - DNA, 19 bp, Homo sapiens
tcaggcagttattcacaaa

SEQ ID NO: 7429426 - DNA, 19 bp, Homo sapiens
tcaggcagttattcacaaa

SEQ ID NO: 7429427 - DNA, 19 bp, Homo sapiens
tcaggcagttattcacaaa

SEQ ID NO: 7429428 - DNA, 19 bp, Homo sapiens
tcaggcagttattcacaaa

SEQ ID NO: 7429429 - DNA, 22 bp, Homo sapiens
tcaggcagtggtaaatgagtta

SEQ ID NO: 7429430 - DNA, 22 bp, Homo sapiens
tcaggcagtggtaaatgagtta

SEQ ID NO: 7429431 - DNA, 22 bp, Homo sapiens
tcaggcagtggtaaatgagtta

SEQ ID NO: 7429432 - DNA, 22 bp, Homo sapiens
tcagggaaatagcagggctgaa

SEQ ID NO: 7429433 - DNA, 22 bp, Homo sapiens
tcagggaaaggggagagtcatt

SEQ ID NO: 7429434 - DNA, 22 bp, Homo sapiens
tcagggaaatagcagggctgaa

SEQ ID NO: 7429435 - DNA, 22 bp, Homo sapiens
tcagggaaatagcagggctgaa

SEQ ID NO: 7429436 - DNA, 22 bp, Homo sapiens
tcagggaaatagcagggctgaa

SEQ ID NO: 7429437 - DNA, 22 bp, Homo sapiens
tcagggaaattcaagggagatt

SEQ ID NO: 7429438 - DNA, 22 bp, Homo sapiens
tcagggaaatttccatgtgttt

SEQ ID NO: 7429439 - DNA, 22 bp, Homo sapiens
tcagggaaattcaagggagatt

SEQ ID NO: 7429440 - DNA, 22 bp, Homo sapiens
tcagggaaattcaagggagatt

SEQ ID NO: 7429441 - DNA, 22 bp, Homo sapiens
tcagggaaattcaagggagatt

SEQ ID NO: 7429442 - DNA, 22 bp, Homo sapiens
tcagggaaattcaagggagatt

SEQ ID NO: 7429443 - DNA, 22 bp, Homo sapiens
tcagggaacctctcctgtttct

SEQ ID NO: 7429444 - DNA, 22 bp, Homo sapiens
tcagggaacatcgttaaactag

SEQ ID NO: 7429445 - DNA, 22 bp, Homo sapiens
tcagggaacatcgttaaactag

SEQ ID NO: 7429446 - DNA, 22 bp, Homo sapiens
tcagggaacatcgttaaactag

SEQ ID NO: 7429447 - DNA, 22 bp, Homo sapiens
tcagggaacaatgttatggctt

SEQ ID NO: 7429448 - DNA, 22 bp, Homo sapiens
tcagggaaatttccatgtgttt

SEQ ID NO: 7429449 - DNA, 22 bp, Homo sapiens
tcagggaaattcaagggagatt

SEQ ID NO: 7429450 - DNA, 22 bp, Homo sapiens
tcagggaaatttccatgtgttt

SEQ ID NO: 7429451 - DNA, 22 bp, Homo sapiens
tcagggaaatttccatgtgttt

SEQ ID NO: 7429452 - DNA, 22 bp, Homo sapiens
tcagggaacaatgttatggctt

SEQ ID NO: 7429453 - DNA, 22 bp, Homo sapiens
tcagggaacaatgttatggctt

SEQ ID NO: 7429454 - DNA, 22 bp, Homo sapiens
tcagggaacaatgttatggctt

SEQ ID NO: 7429455 - DNA, 22 bp, Homo sapiens
tcagggaaaggggagagtcatt

SEQ ID NO: 7429456 - DNA, 22 bp, Homo sapiens
tcagggaaatagcagggctgaa

SEQ ID NO: 7429457 - DNA, 22 bp, Homo sapiens
tcagggaaaggggagagtcatt

SEQ ID NO: 7429458 - DNA, 22 bp, Homo sapiens
tcagggaaaggggagagtcatt

SEQ ID NO: 7429459 - DNA, 22 bp, Homo sapiens
tcagggaaacctaaggaagcca

SEQ ID NO: 7429460 - DNA, 22 bp, Homo sapiens
tcagggaaacctaaggaagcca

SEQ ID NO: 7429461 - DNA, 22 bp, Homo sapiens
tcagggaaaggggagagtcatt

SEQ ID NO: 7429462 - DNA, 22 bp, Homo sapiens
tcagggaaaggggagagtcatt

SEQ ID NO: 7429463 - DNA, 22 bp, Homo sapiens
tcagggaaacctaaggaagcca

SEQ ID NO: 7429464 - DNA, 22 bp, Homo sapiens
tcagggaaaggggagagtcatt

SEQ ID NO: 7429465 - DNA, 22 bp, Homo sapiens
tcagggaaaagtcacactgggt

SEQ ID NO: 7429466 - DNA, 22 bp, Homo sapiens
tcagggaaaagtcacactgggt

SEQ ID NO: 7429467 - DNA, 22 bp, Homo sapiens
tcagggaaaagtcacactgggt

SEQ ID NO: 7429468 - DNA, 22 bp, Homo sapiens
tcagggaaaagtcacactgggt

SEQ ID NO: 7429469 - DNA, 22 bp, Homo sapiens
tcagggaaaagtcacactgggt

SEQ ID NO: 7429470 - DNA, 22 bp, Homo sapiens
tcagggaaaagtcacactgggt

SEQ ID NO: 7429471 - DNA, 22 bp, Homo sapiens
tcagggaaacctaaggaagcca

SEQ ID NO: 7429472 - DNA, 22 bp, Homo sapiens
tcagggaaacctaaggaagcca

SEQ ID NO: 7429473 - DNA, 22 bp, Homo sapiens
tcagggaaacctaaggaagcca

SEQ ID NO: 7429474 - DNA, 22 bp, Homo sapiens
tcagggaaacaggttttccctt

SEQ ID NO: 7429475 - DNA, 22 bp, Homo sapiens
tcagggaaacctaaggaagcca

SEQ ID NO: 7429476 - DNA, 22 bp, Homo sapiens
tcagggaaacaggttttccctt

SEQ ID NO: 7429477 - DNA, 22 bp, Homo sapiens
tcagggaaacaggttttccctt

SEQ ID NO: 7429478 - DNA, 22 bp, Homo sapiens
tcaggctggggtgctaaggtgt

SEQ ID NO: 7429479 - DNA, 22 bp, Homo sapiens
tcaggctgggctcctctcccca

SEQ ID NO: 7429480 - DNA, 22 bp, Homo sapiens
tcaggctggggtgctaaggtgt

SEQ ID NO: 7429481 - DNA, 22 bp, Homo sapiens
tcaggctggggtgctaaggtgt

SEQ ID NO: 7429482 - DNA, 22 bp, Homo sapiens
tcaggctgggctcctctcccca

SEQ ID NO: 7429483 - DNA, 22 bp, Homo sapiens
tcaggctgggctcctctcccca

SEQ ID NO: 7429484 - DNA, 22 bp, Homo sapiens
tcaggctgggctcctctcccca

SEQ ID NO: 7429485 - DNA, 22 bp, Homo sapiens
tcaggctgggctcctctcccca

SEQ ID NO: 7429486 - DNA, 18 bp, Homo sapiens
tcaggctgggcctccttc

SEQ ID NO: 7429487 - DNA, 22 bp, Homo sapiens
tcaggctgggctcctctcccca

SEQ ID NO: 7429488 - DNA, 22 bp, Homo sapiens
tcaggctggggtgctaaggtgt

SEQ ID NO: 7429489 - DNA, 22 bp, Homo sapiens
tcaggctggggtgctaaggtgt

SEQ ID NO: 7429490 - DNA, 22 bp, Homo sapiens
tcaggctggggtgctaaggtgt

SEQ ID NO: 7429491 - DNA, 22 bp, Homo sapiens
tcaggctggggtgctaaggtgt

SEQ ID NO: 7429492 - DNA, 17 bp, Homo sapiens
tcaggctgggtgcagtg

SEQ ID NO: 7429493 - DNA, 22 bp, Homo sapiens
tcaggctttttctcaacctctt

SEQ ID NO: 7429494 - DNA, 22 bp, Homo sapiens
tcagggaaaacatcccgcctaa

SEQ ID NO: 7429495 - DNA, 22 bp, Homo sapiens
tcagggaaaacatcccgcctaa

SEQ ID NO: 7429496 - DNA, 22 bp, Homo sapiens
tcaggctgggagacaatcactg

SEQ ID NO: 7429497 - DNA, 22 bp, Homo sapiens
tcaggctggagtgcagtggcgc

SEQ ID NO: 7429498 - DNA, 22 bp, Homo sapiens
tcaggctggagtgcagtggcgc

SEQ ID NO: 7429499 - DNA, 22 bp, Homo sapiens
tcaggctggagtgcagtggcgc

SEQ ID NO: 7429500 - DNA, 22 bp, Homo sapiens
tcaggctggagtgcagtggcgc

SEQ ID NO: 7429501 - DNA, 22 bp, Homo sapiens
tcaggctgggagacaatcactg

SEQ ID NO: 7429502 - DNA, 22 bp, Homo sapiens
tcaggctgggagacaatcactg

SEQ ID NO: 7429503 - DNA, 22 bp, Homo sapiens
tcaggctgggagacaatcactg

SEQ ID NO: 7429504 - DNA, 18 bp, Homo sapiens
tcaggctgggcctccttc

SEQ ID NO: 7429505 - DNA, 18 bp, Homo sapiens
tcaggctgggcctccttc

SEQ ID NO: 7429506 - DNA, 22 bp, Homo sapiens
tcaggctgggagacaatcactg

SEQ ID NO: 7429507 - DNA, 18 bp, Homo sapiens
tcaggctgggcctccttc

SEQ ID NO: 7429508 - DNA, 18 bp, Homo sapiens
tcaggctgggcctccttc

SEQ ID NO: 7429509 - DNA, 22 bp, Homo sapiens
tcaggctgggctcctctcccca

SEQ ID NO: 7429510 - DNA, 18 bp, Homo sapiens
tcaggctgggcctccttc

SEQ ID NO: 7429511 - DNA, 22 bp, Homo sapiens
tcaggcctggagaaaggaatga

SEQ ID NO: 7429512 - DNA, 22 bp, Homo sapiens
tcaggcctggagaaaggaatga

SEQ ID NO: 7429513 - DNA, 16 bp, Homo sapiens
tcaggcctggacgagc

SEQ ID NO: 7429514 - DNA, 16 bp, Homo sapiens
tcaggcctggacgagc

SEQ ID NO: 7429515 - DNA, 22 bp, Homo sapiens
tcaggccttcagacctggcccg

SEQ ID NO: 7429516 - DNA, 22 bp, Homo sapiens
tcaggcctgtgctggaggagat

SEQ ID NO: 7429517 - DNA, 22 bp, Homo sapiens
tcaggcctgtgctggaggagat

SEQ ID NO: 7429518 - DNA, 22 bp, Homo sapiens
tcaggcctgtgctggaggagat

SEQ ID NO: 7429519 - DNA, 22 bp, Homo sapiens
tcaggccttcagacctggcccg

SEQ ID NO: 7429520 - DNA, 22 bp, Homo sapiens
tcaggccttcagacctggcccg

SEQ ID NO: 7429521 - DNA, 22 bp, Homo sapiens
tcaggccttgtcctgacctcct

SEQ ID NO: 7429522 - DNA, 22 bp, Homo sapiens
tcaggccttgtcctgacctcct

SEQ ID NO: 7429523 - DNA, 22 bp, Homo sapiens
tcaggctgataggaggaactga

SEQ ID NO: 7429524 - DNA, 22 bp, Homo sapiens
tcaggctgataggaggaactga

SEQ ID NO: 7429525 - DNA, 22 bp, Homo sapiens
tcaggctgataggaggaactga

SEQ ID NO: 7429526 - DNA, 22 bp, Homo sapiens
tcaggctgaggtcatctgcatc

SEQ ID NO: 7429527 - DNA, 22 bp, Homo sapiens
tcaggctgaggtcatctgcatc

SEQ ID NO: 7429528 - DNA, 22 bp, Homo sapiens
tcaggccttcagacctggcccg

SEQ ID NO: 7429529 - DNA, 21 bp, Homo sapiens
tcaggctgatgtcgatgttag

SEQ ID NO: 7429530 - DNA, 21 bp, Homo sapiens
tcaggctgatgtcgatgttag

SEQ ID NO: 7429531 - DNA, 22 bp, Homo sapiens
tcaggctgctggccagcaggct

SEQ ID NO: 7429532 - DNA, 22 bp, Homo sapiens
tcaggctgataggaggaactga

SEQ ID NO: 7429533 - DNA, 22 bp, Homo sapiens
tcaggctgataggaggaactga

SEQ ID NO: 7429534 - DNA, 22 bp, Homo sapiens
tcaggctgaggtcatctgcatc

SEQ ID NO: 7429535 - DNA, 22 bp, Homo sapiens
tcaggctgataggaggaactga

SEQ ID NO: 7429536 - DNA, 22 bp, Homo sapiens
tcaggctgctggccagcaggct

SEQ ID NO: 7429537 - DNA, 22 bp, Homo sapiens
tcaggctgctggccagcaggct

SEQ ID NO: 7429538 - DNA, 22 bp, Homo sapiens
tcaggctgctggccagcaggct

SEQ ID NO: 7429539 - DNA, 22 bp, Homo sapiens
tcaggctgctggccagcaggct

SEQ ID NO: 7429540 - DNA, 22 bp, Homo sapiens
tcaggctgctggccagcaggct

SEQ ID NO: 7429541 - DNA, 22 bp, Homo sapiens
tcaggctgctgtactgtgaatg

SEQ ID NO: 7429542 - DNA, 22 bp, Homo sapiens
tcaggctgctggccagcaggct

SEQ ID NO: 7429543 - DNA, 22 bp, Homo sapiens
tcaggctgctggccagcaggct

SEQ ID NO: 7429544 - DNA, 22 bp, Homo sapiens
tcaggctgctggccagcaggct

SEQ ID NO: 7429545 - DNA, 22 bp, Homo sapiens
tcaggctgctggccagcaggct

SEQ ID NO: 7429546 - DNA, 22 bp, Homo sapiens
tcaggctggagtgcagtggcgc

SEQ ID NO: 7429547 - DNA, 22 bp, Homo sapiens
tcaggctggagtgcagtggcgc

SEQ ID NO: 7429548 - DNA, 22 bp, Homo sapiens
tcaggctggaatgcagtggggc

SEQ ID NO: 7429549 - DNA, 22 bp, Homo sapiens
tcaggctggaatgcagtggggc

SEQ ID NO: 7429550 - DNA, 22 bp, Homo sapiens
tcaggctggagtgcagtggcgc

SEQ ID NO: 7429551 - DNA, 22 bp, Homo sapiens
tcaggctggagtgcagtggcgc

SEQ ID NO: 7429552 - DNA, 22 bp, Homo sapiens
tcaggctggagtgcagtggcgc

SEQ ID NO: 7429553 - DNA, 22 bp, Homo sapiens
tcaggctggagtgcagtggcgc

SEQ ID NO: 7429554 - DNA, 22 bp, Homo sapiens
tcaggctggagtgcagtggcgc

SEQ ID NO: 7429555 - DNA, 22 bp, Homo sapiens
tcaggctggagtgcagtggcgc

SEQ ID NO: 7429556 - DNA, 22 bp, Homo sapiens
tcaggctggagtgcagtggcgc

SEQ ID NO: 7429557 - DNA, 22 bp, Homo sapiens
tcaggctggaatgcagtggggc

SEQ ID NO: 7429558 - DNA, 22 bp, Homo sapiens
tcaggctggaatgcagtggggc

SEQ ID NO: 7429559 - DNA, 22 bp, Homo sapiens
tcaggctggaatgcagtggggc

SEQ ID NO: 7429560 - DNA, 22 bp, Homo sapiens
tcaggctggaatgcagtggggc

SEQ ID NO: 7429561 - DNA, 22 bp, Homo sapiens
tcaggctggaatgcagtggggc

SEQ ID NO: 7429562 - DNA, 22 bp, Homo sapiens
tcaggctggaatgcagtggggc

SEQ ID NO: 7429563 - DNA, 22 bp, Homo sapiens
tcaggctggaatgcagtggggc

SEQ ID NO: 7429564 - DNA, 22 bp, Homo sapiens
tcaggctggaatgcagtggggc

SEQ ID NO: 7429565 - DNA, 22 bp, Homo sapiens
tcaggctggaatgcagtggggc

SEQ ID NO: 7429566 - DNA, 22 bp, Homo sapiens
tcaggctgctttcatgcttaga

SEQ ID NO: 7429567 - DNA, 22 bp, Homo sapiens
tcaggctgctgtactgtgaatg

SEQ ID NO: 7429568 - DNA, 22 bp, Homo sapiens
tcaggctgctttcatgcttaga

SEQ ID NO: 7429569 - DNA, 22 bp, Homo sapiens
tcaggctgctgtactgtgaatg

SEQ ID NO: 7429570 - DNA, 22 bp, Homo sapiens
tcaggctgctgtactgtgaatg

SEQ ID NO: 7429571 - DNA, 22 bp, Homo sapiens
tcaggctgctgtactgtgaatg

SEQ ID NO: 7429572 - DNA, 22 bp, Homo sapiens
tcaggctgctgtactgtgaatg

SEQ ID NO: 7429573 - DNA, 18 bp, Homo sapiens
tcaggctggaagtttgcc

SEQ ID NO: 7429574 - DNA, 18 bp, Homo sapiens
tcaggctggaagtttgcc

SEQ ID NO: 7429575 - DNA, 18 bp, Homo sapiens
tcaggctggaagtttgcc

SEQ ID NO: 7429576 - DNA, 22 bp, Homo sapiens
tcaggctgctttcatgcttaga

SEQ ID NO: 7429577 - DNA, 22 bp, Homo sapiens
tcaggctgctttcatgcttaga

SEQ ID NO: 7429578 - DNA, 22 bp, Homo sapiens
tcaggctggaatgcagtggggc

SEQ ID NO: 7429579 - DNA, 18 bp, Homo sapiens
tcaggctggaagtttgcc

SEQ ID NO: 7429580 - DNA, 18 bp, Homo sapiens
tcaggctggaagtttgcc

SEQ ID NO: 7429581 - DNA, 22 bp, Homo sapiens
tcaggaggtgtaggtcaagtga

SEQ ID NO: 7429582 - DNA, 22 bp, Homo sapiens
tcaggaggtgtaggtcaagtga

SEQ ID NO: 7429583 - DNA, 22 bp, Homo sapiens
tcaggaggtgtaggtcaagtga

SEQ ID NO: 7429584 - DNA, 17 bp, Homo sapiens
tcaggaggtgtttctag

SEQ ID NO: 7429585 - DNA, 17 bp, Homo sapiens
tcaggaggtgtttctag

SEQ ID NO: 7429586 - DNA, 17 bp, Homo sapiens
tcaggaggtgtttctag

SEQ ID NO: 7429587 - DNA, 17 bp, Homo sapiens
tcaggaggtgtttctag

SEQ ID NO: 7429588 - DNA, 22 bp, Homo sapiens
tcaggaggtgtaggtcaagtga

SEQ ID NO: 7429589 - DNA, 22 bp, Homo sapiens
tcaggaagggctcagtctgtgc

SEQ ID NO: 7429590 - DNA, 22 bp, Homo sapiens
tcaggaggtgtaacgaatacag

SEQ ID NO: 7429591 - DNA, 22 bp, Homo sapiens
tcaggaagggctcagtctgtgc

SEQ ID NO: 7429592 - DNA, 22 bp, Homo sapiens
tcaggaggttgaccacggggca

SEQ ID NO: 7429593 - DNA, 22 bp, Homo sapiens
tcaggaggttgaccacggggca

SEQ ID NO: 7429594 - DNA, 22 bp, Homo sapiens
tcaggaggttgaccacggggca

SEQ ID NO: 7429595 - DNA, 22 bp, Homo sapiens
tcaggaggttgaccacggggca

SEQ ID NO: 7429596 - DNA, 22 bp, Homo sapiens
tcaggaggttgaccacggggca

SEQ ID NO: 7429597 - DNA, 22 bp, Homo sapiens
tcaggaggttgaccacggggca

SEQ ID NO: 7429598 - DNA, 22 bp, Homo sapiens
tcaggaggttgaccacggggca

SEQ ID NO: 7429599 - DNA, 22 bp, Homo sapiens
tcaggaggtttggattcagtta

SEQ ID NO: 7429600 - DNA, 22 bp, Homo sapiens
tcaggaggtttggattcagtta

SEQ ID NO: 7429601 - DNA, 22 bp, Homo sapiens
tcaggaggtttggattcagtta

SEQ ID NO: 7429602 - DNA, 22 bp, Homo sapiens
tcaggaggttgaccacggggca

SEQ ID NO: 7429603 - DNA, 22 bp, Homo sapiens
tcaggaggttgaccacggggca

SEQ ID NO: 7429604 - DNA, 22 bp, Homo sapiens
tcaggagtcctgcctgcagcct

SEQ ID NO: 7429605 - DNA, 22 bp, Homo sapiens
tcaggagtcctgcctgcagcct

SEQ ID NO: 7429606 - DNA, 22 bp, Homo sapiens
tcaggagtctgtgcagttccac

SEQ ID NO: 7429607 - DNA, 22 bp, Homo sapiens
tcaggagtcctgcctgcagcct

SEQ ID NO: 7429608 - DNA, 22 bp, Homo sapiens
tcaggagtcctgcctgcagcct

SEQ ID NO: 7429609 - DNA, 22 bp, Homo sapiens
tcaggagtactggtgtctacag

SEQ ID NO: 7429610 - DNA, 22 bp, Homo sapiens
tcaggagtactggtgtctacag

SEQ ID NO: 7429611 - DNA, 22 bp, Homo sapiens
tcaggagtactggtgtctacag

SEQ ID NO: 7429612 - DNA, 22 bp, Homo sapiens
tcaggagtaagttataagtatt

SEQ ID NO: 7429613 - DNA, 22 bp, Homo sapiens
tcaggagtaaagacagagttcc

SEQ ID NO: 7429614 - DNA, 22 bp, Homo sapiens
tcaggagtaaagaagacttgac

SEQ ID NO: 7429615 - DNA, 22 bp, Homo sapiens
tcaggagtaaagaagacttgac

SEQ ID NO: 7429616 - DNA, 22 bp, Homo sapiens
tcaggaggtttggattcagtta

SEQ ID NO: 7429617 - DNA, 22 bp, Homo sapiens
tcaggagtaagggtaacccaga

SEQ ID NO: 7429618 - DNA, 22 bp, Homo sapiens
tcaggagtaagttataagtatt

SEQ ID NO: 7429619 - DNA, 22 bp, Homo sapiens
tcaggagtaagttataagtatt

SEQ ID NO: 7429620 - DNA, 22 bp, Homo sapiens
tcaggagtaaagacagagttcc

SEQ ID NO: 7429621 - DNA, 22 bp, Homo sapiens
tcaggagtaaagacagagttcc

SEQ ID NO: 7429622 - DNA, 22 bp, Homo sapiens
tcaggagtaagggtaacccaga

SEQ ID NO: 7429623 - DNA, 22 bp, Homo sapiens
tcaggagtaagggtaacccaga

SEQ ID NO: 7429624 - DNA, 22 bp, Homo sapiens
tcaggagtaaagacagagttcc

SEQ ID NO: 7429625 - DNA, 22 bp, Homo sapiens
tcaggaagctgctctgggtggt

SEQ ID NO: 7429626 - DNA, 22 bp, Homo sapiens
tcaggaagctgaattacaaaaa

SEQ ID NO: 7429627 - DNA, 22 bp, Homo sapiens
tcaggaagctgaattacaaaaa

SEQ ID NO: 7429628 - DNA, 22 bp, Homo sapiens
tcaggaagctgaattacaaaaa

SEQ ID NO: 7429629 - DNA, 22 bp, Homo sapiens
tcaggaagctgaattacaaaaa

SEQ ID NO: 7429630 - DNA, 22 bp, Homo sapiens
tcaggaagctgaattacaaaaa

SEQ ID NO: 7429631 - DNA, 22 bp, Homo sapiens
tcaggaagctgctctgggtggt

SEQ ID NO: 7429632 - DNA, 22 bp, Homo sapiens
tcaggaagctgctctgggtggt

SEQ ID NO: 7429633 - DNA, 22 bp, Homo sapiens
tcaggaagctgctctgggtggt

SEQ ID NO: 7429634 - DNA, 22 bp, Homo sapiens
tcaggaaggagctggcctgcca

SEQ ID NO: 7429635 - DNA, 22 bp, Homo sapiens
tcaggaaggagctggcctgcca

SEQ ID NO: 7429636 - DNA, 22 bp, Homo sapiens
tcaggaagctgctctgggtggt

SEQ ID NO: 7429637 - DNA, 22 bp, Homo sapiens
tcaggaaggagctggcctgcca

SEQ ID NO: 7429638 - DNA, 22 bp, Homo sapiens
tcaggaaggcaaattgcatgat

SEQ ID NO: 7429639 - DNA, 22 bp, Homo sapiens
tcaggaaggcaaattgcatgat

SEQ ID NO: 7429640 - DNA, 22 bp, Homo sapiens
tcaggaaggcaaattgcatgat

SEQ ID NO: 7429641 - DNA, 22 bp, Homo sapiens
tcaggaaggagctggcctgcca

SEQ ID NO: 7429642 - DNA, 22 bp, Homo sapiens
tcaggaaggagctggcctgcca

SEQ ID NO: 7429643 - DNA, 22 bp, Homo sapiens
tcaggaaggcacttggtgtgtt

SEQ ID NO: 7429644 - DNA, 22 bp, Homo sapiens
tcaggaaggcacttggtgtgtt

SEQ ID NO: 7429645 - DNA, 22 bp, Homo sapiens
tcaggaaggcaaattgcatgat

SEQ ID NO: 7429646 - DNA, 22 bp, Homo sapiens
tcaggaaggcaaattgcatgat

SEQ ID NO: 7429647 - DNA, 22 bp, Homo sapiens
tcaggaaggcgccccatcagga

SEQ ID NO: 7429648 - DNA, 22 bp, Homo sapiens
tcaggaaggcgccccatcagga

SEQ ID NO: 7429649 - DNA, 22 bp, Homo sapiens
tcaggaaggcacttggtgtgtt

SEQ ID NO: 7429650 - DNA, 22 bp, Homo sapiens
tcaggaaggcacttggtgtgtt

SEQ ID NO: 7429651 - DNA, 22 bp, Homo sapiens
tcaggaagggctcagtctgtgc

SEQ ID NO: 7429652 - DNA, 22 bp, Homo sapiens
tcaggaagggctcagtctgtgc

SEQ ID NO: 7429653 - DNA, 22 bp, Homo sapiens
tcaggaaggcttcacacgagtg

SEQ ID NO: 7429654 - DNA, 22 bp, Homo sapiens
tcaggaaggcttcacacgagtg

SEQ ID NO: 7429655 - DNA, 22 bp, Homo sapiens
tcaggaaggcgccccatcagga

SEQ ID NO: 7429656 - DNA, 22 bp, Homo sapiens
tcaggaaggcttcacacgagtg

SEQ ID NO: 7429657 - DNA, 22 bp, Homo sapiens
tcaggaaggcttcacacgagtg

SEQ ID NO: 7429658 - DNA, 22 bp, Homo sapiens
tcaggaaggcgccccatcagga

SEQ ID NO: 7429659 - DNA, 22 bp, Homo sapiens
tcaggaaggcgccccatcagga

SEQ ID NO: 7429660 - DNA, 22 bp, Homo sapiens
tcaggaagcatcctgaggtgtc

SEQ ID NO: 7429661 - DNA, 22 bp, Homo sapiens
tcaggaagcatcctgaggtgtc

SEQ ID NO: 7429662 - DNA, 22 bp, Homo sapiens
tcaggaagcatcctgaggtgtc

SEQ ID NO: 7429663 - DNA, 22 bp, Homo sapiens
tcaggaagcatcctgaggtgtc

SEQ ID NO: 7429664 - DNA, 22 bp, Homo sapiens
tcaggaagcatcctgaggtgtc

SEQ ID NO: 7429665 - DNA, 22 bp, Homo sapiens
tcaggaagcatcctgaggtgtc

SEQ ID NO: 7429666 - DNA, 22 bp, Homo sapiens
tcaggaagattagtttcctacc

SEQ ID NO: 7429667 - DNA, 22 bp, Homo sapiens
tcaggaagattagtttcctacc

SEQ ID NO: 7429668 - DNA, 21 bp, Homo sapiens
tcaggaagagcttctcccact

SEQ ID NO: 7429669 - DNA, 21 bp, Homo sapiens
tcaggaagagcttctcccact

SEQ ID NO: 7429670 - DNA, 22 bp, Homo sapiens
tcaggaagattagtttcctacc

SEQ ID NO: 7429671 - DNA, 22 bp, Homo sapiens
tcaggaagattagtttcctacc

SEQ ID NO: 7429672 - DNA, 21 bp, Homo sapiens
tcaggaagagccagttcatgc

SEQ ID NO: 7429673 - DNA, 21 bp, Homo sapiens
tcaggaagagccagttcatgc

SEQ ID NO: 7429674 - DNA, 21 bp, Homo sapiens
tcaggaagagccagttcatgc

SEQ ID NO: 7429675 - DNA, 21 bp, Homo sapiens
tcaggaagagccagttcatgc

SEQ ID NO: 7429676 - DNA, 21 bp, Homo sapiens
tcaggaagagccagttcatgc

SEQ ID NO: 7429677 - DNA, 21 bp, Homo sapiens
tcaggaagagccagttcatgc

SEQ ID NO: 7429678 - DNA, 21 bp, Homo sapiens
tcaggaagagcttctcccact

SEQ ID NO: 7429679 - DNA, 21 bp, Homo sapiens
tcaggaagagcttctcccact

SEQ ID NO: 7429680 - DNA, 22 bp, Homo sapiens
tcaggaagccggttaaatagat

SEQ ID NO: 7429681 - DNA, 22 bp, Homo sapiens
tcaggaagccggttaaatagat

SEQ ID NO: 7429682 - DNA, 22 bp, Homo sapiens
tcaggaagccggttaaatagat

SEQ ID NO: 7429683 - DNA, 22 bp, Homo sapiens
tcaggaagccggttaaatagat

SEQ ID NO: 7429684 - DNA, 22 bp, Homo sapiens
tcaggaagccggttaaatagat

SEQ ID NO: 7429685 - DNA, 22 bp, Homo sapiens
tcaggaagccactccacagaga

SEQ ID NO: 7429686 - DNA, 22 bp, Homo sapiens
tcaggaagccactccacagaga

SEQ ID NO: 7429687 - DNA, 22 bp, Homo sapiens
tcaggaagcatcctgaggtgtc

SEQ ID NO: 7429688 - DNA, 22 bp, Homo sapiens
tcaggaagccactccacagaga

SEQ ID NO: 7429689 - DNA, 22 bp, Homo sapiens
tcaggaagccactccacagaga

SEQ ID NO: 7429690 - DNA, 22 bp, Homo sapiens
tcaggaagctactgccagcagc

SEQ ID NO: 7429691 - DNA, 22 bp, Homo sapiens
tcaggaagctactgccagcagc

SEQ ID NO: 7429692 - DNA, 22 bp, Homo sapiens
tcaggaagctactgccagcagc

SEQ ID NO: 7429693 - DNA, 22 bp, Homo sapiens
tcaggaagctactgccagcagc

SEQ ID NO: 7429694 - DNA, 22 bp, Homo sapiens
tcaggaagctactgccagcagc

SEQ ID NO: 7429695 - DNA, 22 bp, Homo sapiens
tcaggaagctcttgctgattct

SEQ ID NO: 7429696 - DNA, 22 bp, Homo sapiens
tcaggaagctcttgctgattct

SEQ ID NO: 7429697 - DNA, 22 bp, Homo sapiens
tcaggaagctcttgctgattct

SEQ ID NO: 7429698 - DNA, 22 bp, Homo sapiens
tcaggaagctcttgctgattct

SEQ ID NO: 7429699 - DNA, 22 bp, Homo sapiens
tcaggaagctcttgctgattct

SEQ ID NO: 7429700 - DNA, 22 bp, Homo sapiens
tcaggaagctcttgctgattct

SEQ ID NO: 7429701 - DNA, 22 bp, Homo sapiens
tcaggaagaagacggggcagga

SEQ ID NO: 7429702 - DNA, 22 bp, Homo sapiens
tcaggaagaagacggggcagga

SEQ ID NO: 7429703 - DNA, 22 bp, Homo sapiens
tcaggaagaagacggggcagga

SEQ ID NO: 7429704 - DNA, 22 bp, Homo sapiens
tcaggaagaagacggggcagga

SEQ ID NO: 7429705 - DNA, 22 bp, Homo sapiens
tcaggaagacaatctttggctc

SEQ ID NO: 7429706 - DNA, 22 bp, Homo sapiens
tcaggaagacaatctttggctc

SEQ ID NO: 7429707 - DNA, 22 bp, Homo sapiens
tcaggaagacaatctttggctc

SEQ ID NO: 7429708 - DNA, 22 bp, Homo sapiens
tcaggaagacaatctttggctc

SEQ ID NO: 7429709 - DNA, 22 bp, Homo sapiens
tcaggaagaaagaagggagtgt

SEQ ID NO: 7429710 - DNA, 22 bp, Homo sapiens
tcaggaagaaagaagggagtgt

SEQ ID NO: 7429711 - DNA, 22 bp, Homo sapiens
tcaggaagaaagaagggagtgt

SEQ ID NO: 7429712 - DNA, 22 bp, Homo sapiens
tcaggaagaaagaagggagtgt

SEQ ID NO: 7429713 - DNA, 22 bp, Homo sapiens
tcaggaagaaagaagggagtgt

SEQ ID NO: 7429714 - DNA, 22 bp, Homo sapiens
tcaggaagaaagaagggagtgt

SEQ ID NO: 7429715 - DNA, 22 bp, Homo sapiens
tcaggaagaaattctgtatctt

SEQ ID NO: 7429716 - DNA, 22 bp, Homo sapiens
tcaggaagaaattctgtatctt

SEQ ID NO: 7429717 - DNA, 22 bp, Homo sapiens
tcaggaagaaattctgtatctt

SEQ ID NO: 7429718 - DNA, 22 bp, Homo sapiens
tcaggaagaaattctgtatctt

SEQ ID NO: 7429719 - DNA, 22 bp, Homo sapiens
tcaggaagaaattctgtatctt

SEQ ID NO: 7429720 - DNA, 22 bp, Homo sapiens
tcaggaacatttaaccacaggg

SEQ ID NO: 7429721 - DNA, 22 bp, Homo sapiens
tcaggaacatttaaccacaggg

SEQ ID NO: 7429722 - DNA, 22 bp, Homo sapiens
tcaggaacataatgtgagtcag

SEQ ID NO: 7429723 - DNA, 22 bp, Homo sapiens
tcaggaacatttaaccacaggg

SEQ ID NO: 7429724 - DNA, 22 bp, Homo sapiens
tcaggaacataatgtgagtcag

SEQ ID NO: 7429725 - DNA, 22 bp, Homo sapiens
tcaggaacagaattttctaaaa

SEQ ID NO: 7429726 - DNA, 22 bp, Homo sapiens
tcaggaacagaattttctaaaa

SEQ ID NO: 7429727 - DNA, 22 bp, Homo sapiens
tcaggaacagcagggaggaaag

SEQ ID NO: 7429728 - DNA, 22 bp, Homo sapiens
tcaggaacagcagggaggaaag

SEQ ID NO: 7429729 - DNA, 22 bp, Homo sapiens
tcaggaaccctggtctcctgct

SEQ ID NO: 7429730 - DNA, 22 bp, Homo sapiens
tcaggaacccccgctgggtgaa

SEQ ID NO: 7429731 - DNA, 22 bp, Homo sapiens
tcaggaacccccgctgggtgaa

SEQ ID NO: 7429732 - DNA, 22 bp, Homo sapiens
tcaggaacttctaggaaagctg

SEQ ID NO: 7429733 - DNA, 22 bp, Homo sapiens
tcaggaacttctaggaaagctg

SEQ ID NO: 7429734 - DNA, 22 bp, Homo sapiens
tcaggaaccctggtctcctgct

SEQ ID NO: 7429735 - DNA, 22 bp, Homo sapiens
tcaggaacccccgctgggtgaa

SEQ ID NO: 7429736 - DNA, 22 bp, Homo sapiens
tcaggaaccctggtctcctgct

SEQ ID NO: 7429737 - DNA, 22 bp, Homo sapiens
tcagctctctgggctcgaacct

SEQ ID NO: 7429738 - DNA, 22 bp, Homo sapiens
tcagctctgcaaggtcacctcc

SEQ ID NO: 7429739 - DNA, 22 bp, Homo sapiens
tcagctctgcaaggtcacctcc

SEQ ID NO: 7429740 - DNA, 22 bp, Homo sapiens
tcagctctgcaaggtcacctcc

SEQ ID NO: 7429741 - DNA, 22 bp, Homo sapiens
tcagctctgcaaggtcacctcc

SEQ ID NO: 7429742 - DNA, 22 bp, Homo sapiens
tcagctctgcaaggtcacctcc

SEQ ID NO: 7429743 - DNA, 22 bp, Homo sapiens
tcagctctgcactccactgtgg

SEQ ID NO: 7429744 - DNA, 22 bp, Homo sapiens
tcagctctgcactccactgtgg

SEQ ID NO: 7429745 - DNA, 22 bp, Homo sapiens
tcaggaacacaggggcccatgc

SEQ ID NO: 7429746 - DNA, 21 bp, Homo sapiens
tcagcagaaagcaaggtcagt

SEQ ID NO: 7429747 - DNA, 22 bp, Homo sapiens
tcagcagaaaggcactagatga

SEQ ID NO: 7429748 - DNA, 22 bp, Homo sapiens
tcagcagaaaggcactagatga

SEQ ID NO: 7429749 - DNA, 22 bp, Homo sapiens
tcagcagaaaggcactagatga

SEQ ID NO: 7429750 - DNA, 22 bp, Homo sapiens
tcagcagaaaggcactagatga

SEQ ID NO: 7429751 - DNA, 22 bp, Homo sapiens
tcagcactttttaaagcagcat

SEQ ID NO: 7429752 - DNA, 22 bp, Homo sapiens
tcagcactttttaaagcagcat

SEQ ID NO: 7429753 - DNA, 21 bp, Homo sapiens
tcagcagaaagcaaggtcagt

SEQ ID NO: 7429754 - DNA, 21 bp, Homo sapiens
tcagcagaaagcaaggtcagt

SEQ ID NO: 7429755 - DNA, 21 bp, Homo sapiens
tcagcagaaagcaaggtcagt

SEQ ID NO: 7429756 - DNA, 22 bp, Homo sapiens
tcagcacttggatttcagagat

SEQ ID NO: 7429757 - DNA, 22 bp, Homo sapiens
tcagcacttggatttcagagat

SEQ ID NO: 7429758 - DNA, 22 bp, Homo sapiens
tcagcactttgaagcagaagga

SEQ ID NO: 7429759 - DNA, 22 bp, Homo sapiens
tcagcactttgaagcagaagga

SEQ ID NO: 7429760 - DNA, 22 bp, Homo sapiens
tcagcacttttactctctttgc

SEQ ID NO: 7429761 - DNA, 22 bp, Homo sapiens
tcagcacttttactctctttgc

SEQ ID NO: 7429762 - DNA, 22 bp, Homo sapiens
tcagcactttgaagcagaagga

SEQ ID NO: 7429763 - DNA, 22 bp, Homo sapiens
tcagcactttgaagcagaagga

SEQ ID NO: 7429764 - DNA, 22 bp, Homo sapiens
tcagcagaagtatagaggccat

SEQ ID NO: 7429765 - DNA, 22 bp, Homo sapiens
tcagcagaagtatagaggccat

SEQ ID NO: 7429766 - DNA, 21 bp, Homo sapiens
tcagcagcttttgcagtccct

SEQ ID NO: 7429767 - DNA, 22 bp, Homo sapiens
tcagcagccgcagctgactcag

SEQ ID NO: 7429768 - DNA, 22 bp, Homo sapiens
tcagcagaagtatagaggccat

SEQ ID NO: 7429769 - DNA, 22 bp, Homo sapiens
tcagcagaacaaggaagcttaa

SEQ ID NO: 7429770 - DNA, 22 bp, Homo sapiens
tcagcagaacaaggaagcttaa

SEQ ID NO: 7429771 - DNA, 22 bp, Homo sapiens
tcagcagaacaaggaagcttaa

SEQ ID NO: 7429772 - DNA, 22 bp, Homo sapiens
tcagcagaacaaggaagcttaa

SEQ ID NO: 7429773 - DNA, 21 bp, Homo sapiens
tcagcagaaggaccactaggg

SEQ ID NO: 7429774 - DNA, 21 bp, Homo sapiens
tcagcagaaggaccactaggg

SEQ ID NO: 7429775 - DNA, 21 bp, Homo sapiens
tcagcagaaggaccactaggg

SEQ ID NO: 7429776 - DNA, 21 bp, Homo sapiens
tcagcagaaggaccactaggg

SEQ ID NO: 7429777 - DNA, 22 bp, Homo sapiens
tcagcaggcacaccaaaaactg

SEQ ID NO: 7429778 - DNA, 21 bp, Homo sapiens
tcagcagcttttgcagtccct

SEQ ID NO: 7429779 - DNA, 21 bp, Homo sapiens
tcagcagcttttgcagtccct

SEQ ID NO: 7429780 - DNA, 21 bp, Homo sapiens
tcagcagcttttgcagtccct

SEQ ID NO: 7429781 - DNA, 22 bp, Homo sapiens
tcagcaggcacggacaggctgc

SEQ ID NO: 7429782 - DNA, 22 bp, Homo sapiens
tcagcaggcacggacaggctgc

SEQ ID NO: 7429783 - DNA, 22 bp, Homo sapiens
tcagcaggcacggacaggctgc

SEQ ID NO: 7429784 - DNA, 22 bp, Homo sapiens
tcagcaggcacggacaggctgc

SEQ ID NO: 7429785 - DNA, 22 bp, Homo sapiens
tcagcaggcacggacaggctgc

SEQ ID NO: 7429786 - DNA, 22 bp, Homo sapiens
tcagcaggcagaaatctgcaga

SEQ ID NO: 7429787 - DNA, 22 bp, Homo sapiens
tcagcaggcagaaatctgcaga

SEQ ID NO: 7429788 - DNA, 22 bp, Homo sapiens
tcagcaggcagaaatctgcaga

SEQ ID NO: 7429789 - DNA, 22 bp, Homo sapiens
tcagcaggcagaaatctgcaga

SEQ ID NO: 7429790 - DNA, 22 bp, Homo sapiens
tcagcaggcagaaatctgcaga

SEQ ID NO: 7429791 - DNA, 22 bp, Homo sapiens
tcagcctgcgtcatggtgacac

SEQ ID NO: 7429792 - DNA, 22 bp, Homo sapiens
tcagcctgctccaagtgctgcc

SEQ ID NO: 7429793 - DNA, 22 bp, Homo sapiens
tcagcctgctccaagtgctgcc

SEQ ID NO: 7429794 - DNA, 22 bp, Homo sapiens
tcagcctgctccaagtgctgcc

SEQ ID NO: 7429795 - DNA, 22 bp, Homo sapiens
tcagcctgctccaagtgctgcc

SEQ ID NO: 7429796 - DNA, 22 bp, Homo sapiens
tcagcaggcaccggaagtgttt

SEQ ID NO: 7429797 - DNA, 22 bp, Homo sapiens
tcagcaggcaccggaagtgttt

SEQ ID NO: 7429798 - DNA, 22 bp, Homo sapiens
tcagcaggcaccggaagtgttt

SEQ ID NO: 7429799 - DNA, 22 bp, Homo sapiens
tcagcaggcaccggaagtgttt

SEQ ID NO: 7429800 - DNA, 22 bp, Homo sapiens
tcagcaggcacggacaggctgc

SEQ ID NO: 7429801 - DNA, 22 bp, Homo sapiens
tcagcaggcacggacaggctgc

SEQ ID NO: 7429802 - DNA, 22 bp, Homo sapiens
tcagcaggcacggacaggctgc

SEQ ID NO: 7429803 - DNA, 22 bp, Homo sapiens
tcagcaggcacaccaaaaactg

SEQ ID NO: 7429804 - DNA, 21 bp, Homo sapiens
tcagcaggcaccagaaggctg

SEQ ID NO: 7429805 - DNA, 21 bp, Homo sapiens
tcagcaggcaccagaaggctg

SEQ ID NO: 7429806 - DNA, 21 bp, Homo sapiens
tcagcaggcaccagaaggctg

SEQ ID NO: 7429807 - DNA, 22 bp, Homo sapiens
tcagcaggcaccggaagtgttt

SEQ ID NO: 7429808 - DNA, 21 bp, Homo sapiens
tcagcaggcaccagaaggctg

SEQ ID NO: 7429809 - DNA, 21 bp, Homo sapiens
tcagcaggcaccagaaggctg

SEQ ID NO: 7429810 - DNA, 22 bp, Homo sapiens
tcagctctaagttttatgcaaa

SEQ ID NO: 7429811 - DNA, 22 bp, Homo sapiens
tcagctcctcatgcaggggata

SEQ ID NO: 7429812 - DNA, 22 bp, Homo sapiens
tcagctcctcatgcaggggata

SEQ ID NO: 7429813 - DNA, 22 bp, Homo sapiens
tcagctcctcagagcctcagtt

SEQ ID NO: 7429814 - DNA, 22 bp, Homo sapiens
tcagctcctcatgcaggggata

SEQ ID NO: 7429815 - DNA, 22 bp, Homo sapiens
tcagctcctcagagcctcagtt

SEQ ID NO: 7429816 - DNA, 22 bp, Homo sapiens
tcagctcctcagagcctcagtt

SEQ ID NO: 7429817 - DNA, 22 bp, Homo sapiens
tcagctcctcagagcctcagtt

SEQ ID NO: 7429818 - DNA, 22 bp, Homo sapiens
tcagctccatccctgcttttgc

SEQ ID NO: 7429819 - DNA, 22 bp, Homo sapiens
tcagctcctatactttgtcctg

SEQ ID NO: 7429820 - DNA, 22 bp, Homo sapiens
tcagctccatccctgcttttgc

SEQ ID NO: 7429821 - DNA, 22 bp, Homo sapiens
tcagctccagagttgcacagtg

SEQ ID NO: 7429822 - DNA, 22 bp, Homo sapiens
tcagctccagagttgcacagtg

SEQ ID NO: 7429823 - DNA, 22 bp, Homo sapiens
tcagctctacacacacctgtgt

SEQ ID NO: 7429824 - DNA, 22 bp, Homo sapiens
tcagctctacacacacctgtgt

SEQ ID NO: 7429825 - DNA, 22 bp, Homo sapiens
tcagctctaagttttatgcaaa

SEQ ID NO: 7429826 - DNA, 22 bp, Homo sapiens
tcagctctacacacacctgtgt

SEQ ID NO: 7429827 - DNA, 22 bp, Homo sapiens
tcagctctacacacacctgtgt

SEQ ID NO: 7429828 - DNA, 22 bp, Homo sapiens
tcagctctacacacacctgtgt

SEQ ID NO: 7429829 - DNA, 22 bp, Homo sapiens
tcagctctacacacacctgtgt

SEQ ID NO: 7429830 - DNA, 22 bp, Homo sapiens
tcagctctacacacacctgtgt

SEQ ID NO: 7429831 - DNA, 22 bp, Homo sapiens
tcagctctcacagatctcaacc

SEQ ID NO: 7429832 - DNA, 22 bp, Homo sapiens
tcagctctctgggctcgaacct

SEQ ID NO: 7429833 - DNA, 22 bp, Homo sapiens
tcagctctgcaaggtcacctcc

SEQ ID NO: 7429834 - DNA, 22 bp, Homo sapiens
tcagctctcacagatctcaacc

SEQ ID NO: 7429835 - DNA, 22 bp, Homo sapiens
tcagctctacctgggagctgtc

SEQ ID NO: 7429836 - DNA, 18 bp, Homo sapiens
tcagcctgttgtctgcct

SEQ ID NO: 7429837 - DNA, 18 bp, Homo sapiens
tcagcctgttgtctgcct

SEQ ID NO: 7429838 - DNA, 18 bp, Homo sapiens
tcagcctgttgtctgcct

SEQ ID NO: 7429839 - DNA, 18 bp, Homo sapiens
tcagcctgttgtctgcct

SEQ ID NO: 7429840 - DNA, 20 bp, Homo sapiens
tcagccttgaatgcttgaaa

SEQ ID NO: 7429841 - DNA, 22 bp, Homo sapiens
tcagcctggtgattcctctgtc

SEQ ID NO: 7429842 - DNA, 22 bp, Homo sapiens
tcagcctggcaggatggcctgg

SEQ ID NO: 7429843 - DNA, 22 bp, Homo sapiens
tcagcctggcaggatggcctgg

SEQ ID NO: 7429844 - DNA, 22 bp, Homo sapiens
tcagcctggtgattcctctgtc

SEQ ID NO: 7429845 - DNA, 22 bp, Homo sapiens
tcagcctggtgattcctctgtc

SEQ ID NO: 7429846 - DNA, 22 bp, Homo sapiens
tcagcctggtgattcctctgtc

SEQ ID NO: 7429847 - DNA, 22 bp, Homo sapiens
tcagccttctgaggacctggga

SEQ ID NO: 7429848 - DNA, 22 bp, Homo sapiens
tcagcctttatctttctcccat

SEQ ID NO: 7429849 - DNA, 22 bp, Homo sapiens
tcagccttgtggccctgctcca

SEQ ID NO: 7429850 - DNA, 22 bp, Homo sapiens
tcagctaggcacttctcactga

SEQ ID NO: 7429851 - DNA, 16 bp, Homo sapiens
tcagctatagggattg

SEQ ID NO: 7429852 - DNA, 22 bp, Homo sapiens
tcagctcactctgcttcctggg

SEQ ID NO: 7429853 - DNA, 22 bp, Homo sapiens
tcagctcactctgcttcctggg

SEQ ID NO: 7429854 - DNA, 21 bp, Homo sapiens
tcagctcaaatgtcgcttcct

SEQ ID NO: 7429855 - DNA, 22 bp, Homo sapiens
tcagctcactctgcttcctggg

SEQ ID NO: 7429856 - DNA, 22 bp, Homo sapiens
tcagctattgagggtggtgagt

SEQ ID NO: 7429857 - DNA, 22 bp, Homo sapiens
tcagctatgaggtggtggttct

SEQ ID NO: 7429858 - DNA, 17 bp, Homo sapiens
tcagctcagagcacctg

SEQ ID NO: 7429859 - DNA, 17 bp, Homo sapiens
tcagctcagagcacctg

SEQ ID NO: 7429860 - DNA, 22 bp, Homo sapiens
tcagctcactctgcttcctggg

SEQ ID NO: 7429861 - DNA, 17 bp, Homo sapiens
tcagctcagagcacctg

SEQ ID NO: 7429862 - DNA, 22 bp, Homo sapiens
tcagctcatctgagtgtcagcg

SEQ ID NO: 7429863 - DNA, 22 bp, Homo sapiens
tcagctcatctgagtgtcagcg

SEQ ID NO: 7429864 - DNA, 22 bp, Homo sapiens
tcagctccagagttgcacagtg

SEQ ID NO: 7429865 - DNA, 22 bp, Homo sapiens
tcagctccagagttgcacagtg

SEQ ID NO: 7429866 - DNA, 22 bp, Homo sapiens
tcagctccacagctcctctgcc

SEQ ID NO: 7429867 - DNA, 22 bp, Homo sapiens
tcatataagtttaaaactatct

SEQ ID NO: 7429868 - DNA, 22 bp, Homo sapiens
tcatataagtttaaaactatct

SEQ ID NO: 7429869 - DNA, 22 bp, Homo sapiens
tcatataagagctttagagtca

SEQ ID NO: 7429870 - DNA, 22 bp, Homo sapiens
tcatataagtttaaaactatct

SEQ ID NO: 7429871 - DNA, 22 bp, Homo sapiens
tcatataagtttaaaactatct

SEQ ID NO: 7429872 - DNA, 22 bp, Homo sapiens
tcatataagtttaaaactatct

SEQ ID NO: 7429873 - DNA, 22 bp, Homo sapiens
tcatataagtttaaaactatct

SEQ ID NO: 7429874 - DNA, 22 bp, Homo sapiens
tcatataagtttaaaactatct

SEQ ID NO: 7429875 - DNA, 22 bp, Homo sapiens
tcatataactggatattttcaa

SEQ ID NO: 7429876 - DNA, 22 bp, Homo sapiens
tcatataactggatattttcaa

SEQ ID NO: 7429877 - DNA, 22 bp, Homo sapiens
tcatataactggatattttcaa

SEQ ID NO: 7429878 - DNA, 22 bp, Homo sapiens
tcatataagagctttagagtca

SEQ ID NO: 7429879 - DNA, 22 bp, Homo sapiens
tcatataagagctttagagtca

SEQ ID NO: 7429880 - DNA, 22 bp, Homo sapiens
tcatagggcatcaagcagagca

SEQ ID NO: 7429881 - DNA, 22 bp, Homo sapiens
tcatagtttagttagtatgatt

SEQ ID NO: 7429882 - DNA, 22 bp, Homo sapiens
tcatagtttagttagtatgatt

SEQ ID NO: 7429883 - DNA, 18 bp, Homo sapiens
tcatagattcaagagtat

SEQ ID NO: 7429884 - DNA, 22 bp, Homo sapiens
tcagtgttcgctcagggactcc

SEQ ID NO: 7429885 - DNA, 22 bp, Homo sapiens
tcagtgttcgctcagggactcc

SEQ ID NO: 7429886 - DNA, 16 bp, Homo sapiens
tcagtgttccagaata

SEQ ID NO: 7429887 - DNA, 22 bp, Homo sapiens
tcatagctaagctccagagtgc

SEQ ID NO: 7429888 - DNA, 22 bp, Homo sapiens
tcataggagtagcagtgagagg

SEQ ID NO: 7429889 - DNA, 22 bp, Homo sapiens
tcagtgttattagatgaggttt

SEQ ID NO: 7429890 - DNA, 22 bp, Homo sapiens
tcagtgttagacaagtttggaa

SEQ ID NO: 7429891 - DNA, 22 bp, Homo sapiens
tcagtgttagacaagtttggaa

SEQ ID NO: 7429892 - DNA, 22 bp, Homo sapiens
tcagtgttcagcggtgtgtgca

SEQ ID NO: 7429893 - DNA, 22 bp, Homo sapiens
tcatatgattgtaatgagaata

SEQ ID NO: 7429894 - DNA, 22 bp, Homo sapiens
tcatatattttggcagtgatca

SEQ ID NO: 7429895 - DNA, 22 bp, Homo sapiens
tcatatgattgtaatgagaata

SEQ ID NO: 7429896 - DNA, 22 bp, Homo sapiens
tcatatgtatgatctctgtaca

SEQ ID NO: 7429897 - DNA, 20 bp, Homo sapiens
tcatatgtggttgtatacaa

SEQ ID NO: 7429898 - DNA, 22 bp, Homo sapiens
tcatattaacaatgaaactcag

SEQ ID NO: 7429899 - DNA, 22 bp, Homo sapiens
tcatattaacaatgaaactcag

SEQ ID NO: 7429900 - DNA, 22 bp, Homo sapiens
tcatatattttggcagtgatca

SEQ ID NO: 7429901 - DNA, 22 bp, Homo sapiens
tcatatatttagttgtgcaaca

SEQ ID NO: 7429902 - DNA, 22 bp, Homo sapiens
tcatatattttggcagtgatca

SEQ ID NO: 7429903 - DNA, 22 bp, Homo sapiens
tcatatattttggcagtgatca

SEQ ID NO: 7429904 - DNA, 22 bp, Homo sapiens
tcatatatctgcaaagcagtat

SEQ ID NO: 7429905 - DNA, 22 bp, Homo sapiens
tcatatatctgcaaagcagtat

SEQ ID NO: 7429906 - DNA, 21 bp, Homo sapiens
tcatatattccagctgcagct

SEQ ID NO: 7429907 - DNA, 22 bp, Homo sapiens
tcatatatttagttgtgcaaca

SEQ ID NO: 7429908 - DNA, 22 bp, Homo sapiens
tcatatatttagttgtgcaaca

SEQ ID NO: 7429909 - DNA, 22 bp, Homo sapiens
tcatatatctgcaaagcagtat

SEQ ID NO: 7429910 - DNA, 22 bp, Homo sapiens
tcatatatctgcaaagcagtat

SEQ ID NO: 7429911 - DNA, 22 bp, Homo sapiens
tcatatatctgcaaagcagtat

SEQ ID NO: 7429912 - DNA, 22 bp, Homo sapiens
tcatatatctgcaaagcagtat

SEQ ID NO: 7429913 - DNA, 22 bp, Homo sapiens
tcatatactgccttgtagatta

SEQ ID NO: 7429914 - DNA, 22 bp, Homo sapiens
tcatatactgccttgtagatta

SEQ ID NO: 7429915 - DNA, 22 bp, Homo sapiens
tcatatagagggcatacaaatg

SEQ ID NO: 7429916 - DNA, 22 bp, Homo sapiens
tcatatagagggcatacaaatg

SEQ ID NO: 7429917 - DNA, 22 bp, Homo sapiens
tcatatagagggcatacaaatg

SEQ ID NO: 7429918 - DNA, 22 bp, Homo sapiens
tcatataccagagagtttatat

SEQ ID NO: 7429919 - DNA, 22 bp, Homo sapiens
tcatataagtttaaaactatct

SEQ ID NO: 7429920 - DNA, 22 bp, Homo sapiens
tcatataccagagagtttatat

SEQ ID NO: 7429921 - DNA, 22 bp, Homo sapiens
tcatataccagagagtttatat

SEQ ID NO: 7429922 - DNA, 22 bp, Homo sapiens
tcatataccagagagtttatat

SEQ ID NO: 7429923 - DNA, 22 bp, Homo sapiens
tcatataagtttaaaactatct

SEQ ID NO: 7429924 - DNA, 22 bp, Homo sapiens
tcatatactgccttgtagatta

SEQ ID NO: 7429925 - DNA, 22 bp, Homo sapiens
tcatatacctgcatgtgcatgt

SEQ ID NO: 7429926 - DNA, 22 bp, Homo sapiens
tcatatacctgcatgtgcatgt

SEQ ID NO: 7429927 - DNA, 22 bp, Homo sapiens
tcatataccagagagtttatat

SEQ ID NO: 7429928 - DNA, 22 bp, Homo sapiens
tcatatacctgcatgtgcatgt

SEQ ID NO: 7429929 - DNA, 21 bp, Homo sapiens
tcatatttctcttgctattgt

SEQ ID NO: 7429930 - DNA, 21 bp, Homo sapiens
tcatatttctcttgctattgt

SEQ ID NO: 7429931 - DNA, 22 bp, Homo sapiens
tcatgcatgttgtactggccca

SEQ ID NO: 7429932 - DNA, 22 bp, Homo sapiens
tcatgcattaacacttcatttt

SEQ ID NO: 7429933 - DNA, 22 bp, Homo sapiens
tcatgcattggaatcttcctag

SEQ ID NO: 7429934 - DNA, 22 bp, Homo sapiens
tcatgcattgcagcacattcag

SEQ ID NO: 7429935 - DNA, 22 bp, Homo sapiens
tcatgcattggaatcttcctag

SEQ ID NO: 7429936 - DNA, 22 bp, Homo sapiens
tcatgccaatttctgcatggct

SEQ ID NO: 7429937 - DNA, 22 bp, Homo sapiens
tcatgccacttacaaaataatg

SEQ ID NO: 7429938 - DNA, 22 bp, Homo sapiens
tcatgccacttacaaaataatg

SEQ ID NO: 7429939 - DNA, 22 bp, Homo sapiens
tcatgccacttacaaaataatg

SEQ ID NO: 7429940 - DNA, 19 bp, Homo sapiens
tcatgcatttctaagtgca

SEQ ID NO: 7429941 - DNA, 22 bp, Homo sapiens
tcatgccaaactgaacacagtt

SEQ ID NO: 7429942 - DNA, 22 bp, Homo sapiens
tcatgcccagagcagtaaatta

SEQ ID NO: 7429943 - DNA, 23 bp, Homo sapiens
tcatgcccaggctccagatgtca

SEQ ID NO: 7429944 - DNA, 22 bp, Homo sapiens
tcatgcctgattatgttactca

SEQ ID NO: 7429945 - DNA, 22 bp, Homo sapiens
tcatgctatgagcgagggcctg

SEQ ID NO: 7429946 - DNA, 22 bp, Homo sapiens
tcatgctatgagcgagggcctg

SEQ ID NO: 7429947 - DNA, 22 bp, Homo sapiens
tcatgctatgagcgagggcctg

SEQ ID NO: 7429948 - DNA, 22 bp, Homo sapiens
tcatgctagttaagaacacaat

SEQ ID NO: 7429949 - DNA, 22 bp, Homo sapiens
tcatgctgaggggattttaaat

SEQ ID NO: 7429950 - DNA, 22 bp, Homo sapiens
tcatgctgaggatgctgtgaag

SEQ ID NO: 7429951 - DNA, 22 bp, Homo sapiens
tcatgctgcaggcccaggcagg

SEQ ID NO: 7429952 - DNA, 22 bp, Homo sapiens
tcatgctggcccagaatggagg

SEQ ID NO: 7429953 - DNA, 22 bp, Homo sapiens
tcatgctggcccagaatggagg

SEQ ID NO: 7429954 - DNA, 22 bp, Homo sapiens
tcatgctgggtactatggctgc

SEQ ID NO: 7429955 - DNA, 22 bp, Homo sapiens
tcatgctgagtcctggctttgt

SEQ ID NO: 7429956 - DNA, 22 bp, Homo sapiens
tcatgctgagtcctggctttgt

SEQ ID NO: 7429957 - DNA, 22 bp, Homo sapiens
tcatgctgagtcctggctttgt

SEQ ID NO: 7429958 - DNA, 22 bp, Homo sapiens
tcatatttaggcctttaattca

SEQ ID NO: 7429959 - DNA, 22 bp, Homo sapiens
tcatatttaggcctttaattca

SEQ ID NO: 7429960 - DNA, 22 bp, Homo sapiens
tcatatttaggcctttaattca

SEQ ID NO: 7429961 - DNA, 22 bp, Homo sapiens
tcatatttaggcctttaattca

SEQ ID NO: 7429962 - DNA, 22 bp, Homo sapiens
tcatatttaggcctttaattca

SEQ ID NO: 7429963 - DNA, 20 bp, Homo sapiens
tcatatgtggttgtatacaa

SEQ ID NO: 7429964 - DNA, 22 bp, Homo sapiens
tcatattagggtaatgataaga

SEQ ID NO: 7429965 - DNA, 22 bp, Homo sapiens
tcatattagggtaatgataaga

SEQ ID NO: 7429966 - DNA, 22 bp, Homo sapiens
tcatattagggtaatgataaga

SEQ ID NO: 7429967 - DNA, 22 bp, Homo sapiens
tcatattagggtaatgataaga

SEQ ID NO: 7429968 - DNA, 22 bp, Homo sapiens
tcatattagggtaatgataaga

SEQ ID NO: 7429969 - DNA, 22 bp, Homo sapiens
tcatattagggtaatgataaga

SEQ ID NO: 7429970 - DNA, 22 bp, Homo sapiens
tcatattagggtaatgataaga

SEQ ID NO: 7429971 - DNA, 22 bp, Homo sapiens
tcatattagggtaatgataaga

SEQ ID NO: 7429972 - DNA, 22 bp, Homo sapiens
tcatatttagttcacgctcaat

SEQ ID NO: 7429973 - DNA, 22 bp, Homo sapiens
tcatatttaggcctttaattca

SEQ ID NO: 7429974 - DNA, 22 bp, Homo sapiens
tcatatttagttcacgctcaat

SEQ ID NO: 7429975 - DNA, 22 bp, Homo sapiens
tcatatttagttcacgctcaat

SEQ ID NO: 7429976 - DNA, 22 bp, Homo sapiens
tcatatttatatgttggcacag

SEQ ID NO: 7429977 - DNA, 22 bp, Homo sapiens
tcatatttatatgttggcacag

SEQ ID NO: 7429978 - DNA, 22 bp, Homo sapiens
tcatatttatatgttggcacag

SEQ ID NO: 7429979 - DNA, 22 bp, Homo sapiens
tcatatttatatgttggcacag

SEQ ID NO: 7429980 - DNA, 22 bp, Homo sapiens
tcatatttcaaaatggctggag

SEQ ID NO: 7429981 - DNA, 21 bp, Homo sapiens
tcatatttctcttgctattgt

SEQ ID NO: 7429982 - DNA, 21 bp, Homo sapiens
tcatatttctcttgctattgt

SEQ ID NO: 7429983 - DNA, 21 bp, Homo sapiens
tcatatttctcttgctattgt

SEQ ID NO: 7429984 - DNA, 21 bp, Homo sapiens
tcatatttctcttgctattgt

SEQ ID NO: 7429985 - DNA, 21 bp, Homo sapiens
tcatatttctcttgctattgt

SEQ ID NO: 7429986 - DNA, 21 bp, Homo sapiens
tcatatttctcttgctattgt

SEQ ID NO: 7429987 - DNA, 22 bp, Homo sapiens
tcatgctgtgaactgtatacat

SEQ ID NO: 7429988 - DNA, 22 bp, Homo sapiens
tcatgctgggtactatggctgc

SEQ ID NO: 7429989 - DNA, 22 bp, Homo sapiens
tcatgctgggtactatggctgc

SEQ ID NO: 7429990 - DNA, 22 bp, Homo sapiens
tcatgctgtgaactgtatacat

SEQ ID NO: 7429991 - DNA, 22 bp, Homo sapiens
tcatgcttattgcatatttgga

SEQ ID NO: 7429992 - DNA, 22 bp, Homo sapiens
tcatgctttgttaatgtggcac

SEQ ID NO: 7429993 - DNA, 22 bp, Homo sapiens
tcatgctttgggttagaaacct

SEQ ID NO: 7429994 - DNA, 22 bp, Homo sapiens
tcatgctttgggttagaaacct

SEQ ID NO: 7429995 - DNA, 22 bp, Homo sapiens
tcatgctttggttgctgtcctt

SEQ ID NO: 7429996 - DNA, 22 bp, Homo sapiens
tcatggaaacagcaatgctaat

SEQ ID NO: 7429997 - DNA, 22 bp, Homo sapiens
tcatggaaacagcaatgctaat

SEQ ID NO: 7429998 - DNA, 22 bp, Homo sapiens
tcatggaaacagcaatgctaat

SEQ ID NO: 7429999 - DNA, 22 bp, Homo sapiens
tcatggaaacagcaatgctaat

SEQ ID NO: 7430000 - DNA, 22 bp, Homo sapiens
tcatggaaacaatgcggaaaaa

SEQ ID NO: 7430001 - DNA, 23 bp, Homo sapiens
tcatggaactgggcaatcttgaa

SEQ ID NO: 7430002 - DNA, 23 bp, Homo sapiens
tcatggaactgggcaatcttgaa

SEQ ID NO: 7430003 - DNA, 22 bp, Homo sapiens
tcatggaaacagcaatgctaat

SEQ ID NO: 7430004 - DNA, 19 bp, Homo sapiens
tcatggaagaaatgtgata

SEQ ID NO: 7430005 - DNA, 20 bp, Homo sapiens
tcatggaatctcactctagt

SEQ ID NO: 7430006 - DNA, 21 bp, Homo sapiens
tcatggaagtaacaaacatat

SEQ ID NO: 7430007 - DNA, 22 bp, Homo sapiens
tcatggaatagagcagtggcaa

SEQ ID NO: 7430008 - DNA, 22 bp, Homo sapiens
tcatggcattgttaagggtttt

SEQ ID NO: 7430009 - DNA, 22 bp, Homo sapiens
tcatggcagtttaataagtggt

SEQ ID NO: 7430010 - DNA, 22 bp, Homo sapiens
tcatggcagtttaataagtggt

SEQ ID NO: 7430011 - DNA, 22 bp, Homo sapiens
tcatggcagtataattcctcaa

SEQ ID NO: 7430012 - DNA, 22 bp, Homo sapiens
tcatggcagccctttactagag

SEQ ID NO: 7430013 - DNA, 20 bp, Homo sapiens
tcatggcagccacccacagg

SEQ ID NO: 7430014 - DNA, 22 bp, Homo sapiens
tcatggcacttagtgtctcaaa

SEQ ID NO: 7430015 - DNA, 21 bp, Homo sapiens
tcatggccagcaagtggcaga

SEQ ID NO: 7430016 - DNA, 22 bp, Homo sapiens
tcatggccaaagtcaggagtgt

SEQ ID NO: 7430017 - DNA, 22 bp, Homo sapiens
tcatggccaaagtcaggagtgt

SEQ ID NO: 7430018 - DNA, 22 bp, Homo sapiens
tcatggcattgttaagggtttt

SEQ ID NO: 7430019 - DNA, 22 bp, Homo sapiens
tcatggctctaaagacatagat

SEQ ID NO: 7430020 - DNA, 22 bp, Homo sapiens
tcatggctaatgcagtatattc

SEQ ID NO: 7430021 - DNA, 22 bp, Homo sapiens
tcatggctctaaagacatagat

SEQ ID NO: 7430022 - DNA, 22 bp, Homo sapiens
tcatggctaaccaaggcctgat

SEQ ID NO: 7430023 - DNA, 22 bp, Homo sapiens
tcatggctaaccaaggcctgat

SEQ ID NO: 7430024 - DNA, 22 bp, Homo sapiens
tcatggctaatgcagtatattc

SEQ ID NO: 7430025 - DNA, 21 bp, Homo sapiens
tcatggattttctctgctttt

SEQ ID NO: 7430026 - DNA, 22 bp, Homo sapiens
tcatggattaaattattaagtt

SEQ ID NO: 7430027 - DNA, 22 bp, Homo sapiens
tcatggcacatgccctccaggg

SEQ ID NO: 7430028 - DNA, 22 bp, Homo sapiens
tcatggcacttagcacagtcct

SEQ ID NO: 7430029 - DNA, 22 bp, Homo sapiens
tcatggcacttagcacagtcct

SEQ ID NO: 7430030 - DNA, 22 bp, Homo sapiens
tcatggcacttagcacagtcct

SEQ ID NO: 7430031 - DNA, 22 bp, Homo sapiens
tcatggatgggcccagctctgt

SEQ ID NO: 7430032 - DNA, 22 bp, Homo sapiens
tcatggatgatagcttcattgc

SEQ ID NO: 7430033 - DNA, 22 bp, Homo sapiens
tcatggataaaatattggttaa

SEQ ID NO: 7430034 - DNA, 22 bp, Homo sapiens
tcatggacgtcaccatggtcct

SEQ ID NO: 7430035 - DNA, 22 bp, Homo sapiens
tcatggagactttgagcctgtt

SEQ ID NO: 7430036 - DNA, 22 bp, Homo sapiens
tcatggagactttgagcctgtt

SEQ ID NO: 7430037 - DNA, 22 bp, Homo sapiens
tcattcactgcccagcagtgta

SEQ ID NO: 7430038 - DNA, 22 bp, Homo sapiens
tcattcactgcccagcagtgta

SEQ ID NO: 7430039 - DNA, 22 bp, Homo sapiens
tcattcactttgaaataaacga

SEQ ID NO: 7430040 - DNA, 22 bp, Homo sapiens
tcattcactttgaaataaacga

SEQ ID NO: 7430041 - DNA, 22 bp, Homo sapiens
tcattcaggttgggcaagtgtc

SEQ ID NO: 7430042 - DNA, 22 bp, Homo sapiens
tcattcagagagaatgttccag

SEQ ID NO: 7430043 - DNA, 22 bp, Homo sapiens
tcattcagagagaatgttccag

SEQ ID NO: 7430044 - DNA, 22 bp, Homo sapiens
tcattcagagagaatgttccag

SEQ ID NO: 7430045 - DNA, 22 bp, Homo sapiens
tcattcatatctctcaagctta

SEQ ID NO: 7430046 - DNA, 22 bp, Homo sapiens
tcattcatatctctcaagctta

SEQ ID NO: 7430047 - DNA, 22 bp, Homo sapiens
tcattgaacgaagagctccatt

SEQ ID NO: 7430048 - DNA, 16 bp, Homo sapiens
tcattgaagacagtac

SEQ ID NO: 7430049 - DNA, 22 bp, Homo sapiens
tcattcataaaaattagttggc

SEQ ID NO: 7430050 - DNA, 22 bp, Homo sapiens
tcattcataaaaattagttggc

SEQ ID NO: 7430051 - DNA, 22 bp, Homo sapiens
tcattcaggttgggcaagtgtc

SEQ ID NO: 7430052 - DNA, 23 bp, Homo sapiens
tcattcaaggctggtatctttca

SEQ ID NO: 7430053 - DNA, 22 bp, Homo sapiens
tcattcaagatttcaatagatt

SEQ ID NO: 7430054 - DNA, 18 bp, Homo sapiens
tcattcaaagtctactga

SEQ ID NO: 7430055 - DNA, 23 bp, Homo sapiens
tcattcaaggctggtatctttca

SEQ ID NO: 7430056 - DNA, 23 bp, Homo sapiens
tcattcaaggctggtatctttca

SEQ ID NO: 7430057 - DNA, 22 bp, Homo sapiens
tcattcaatgtaagcatatata

SEQ ID NO: 7430058 - DNA, 22 bp, Homo sapiens
tcattcaatgtaagcatatata

SEQ ID NO: 7430059 - DNA, 22 bp, Homo sapiens
tcattatttgctttagttatgt

SEQ ID NO: 7430060 - DNA, 22 bp, Homo sapiens
tcattatttgctttagttatgt

SEQ ID NO: 7430061 - DNA, 22 bp, Homo sapiens
tcattatttgctttagttatgt

SEQ ID NO: 7430062 - DNA, 22 bp, Homo sapiens
tcattattttggactggagtgt

SEQ ID NO: 7430063 - DNA, 22 bp, Homo sapiens
tcattattttggactggagtgt

SEQ ID NO: 7430064 - DNA, 18 bp, Homo sapiens
tcattcaaagtctactga

SEQ ID NO: 7430065 - DNA, 18 bp, Homo sapiens
tcattcaaagtctactga

SEQ ID NO: 7430066 - DNA, 22 bp, Homo sapiens
tcattatttgctttagttatgt

SEQ ID NO: 7430067 - DNA, 18 bp, Homo sapiens
tcattattgtttctggag

SEQ ID NO: 7430068 - DNA, 18 bp, Homo sapiens
tcattattgtttctggag

SEQ ID NO: 7430069 - DNA, 22 bp, Homo sapiens
tcattattctctttaatgttct

SEQ ID NO: 7430070 - DNA, 22 bp, Homo sapiens
tcattattctctttaatgttct

SEQ ID NO: 7430071 - DNA, 22 bp, Homo sapiens
tcattatagagttgtattttag

SEQ ID NO: 7430072 - DNA, 22 bp, Homo sapiens
tcattatagagttgtattttag

SEQ ID NO: 7430073 - DNA, 22 bp, Homo sapiens
tcattataaacatatgctaaag

SEQ ID NO: 7430074 - DNA, 22 bp, Homo sapiens
tcattataaacatatgctaaag

SEQ ID NO: 7430075 - DNA, 22 bp, Homo sapiens
tcattatcctagtatcttgaat

SEQ ID NO: 7430076 - DNA, 22 bp, Homo sapiens
tcattatcttggctcatttctg

SEQ ID NO: 7430077 - DNA, 22 bp, Homo sapiens
tcattatcctagtatcttgaat

SEQ ID NO: 7430078 - DNA, 18 bp, Homo sapiens
tcattagggattgcaaag

SEQ ID NO: 7430079 - DNA, 22 bp, Homo sapiens
tcattagaaatgcagattctca

SEQ ID NO: 7430080 - DNA, 22 bp, Homo sapiens
tcattagaaatgcagattctca

SEQ ID NO: 7430081 - DNA, 22 bp, Homo sapiens
tcattacagtgtttatatgtct

SEQ ID NO: 7430082 - DNA, 22 bp, Homo sapiens
tcattacagtgtttatatgtct

SEQ ID NO: 7430083 - DNA, 22 bp, Homo sapiens
tcattacatcttggccaaaact

SEQ ID NO: 7430084 - DNA, 22 bp, Homo sapiens
tcattactataacctaatcctt

SEQ ID NO: 7430085 - DNA, 22 bp, Homo sapiens
tcattactgtctaactgtccct

SEQ ID NO: 7430086 - DNA, 22 bp, Homo sapiens
tcattacttattaaaagccttg

SEQ ID NO: 7430087 - DNA, 20 bp, Homo sapiens
tcattacagtgctaagatgt

SEQ ID NO: 7430088 - DNA, 22 bp, Homo sapiens
tcattacagagatataatctac

SEQ ID NO: 7430089 - DNA, 20 bp, Homo sapiens
tcattacagtgctaagatgt

SEQ ID NO: 7430090 - DNA, 22 bp, Homo sapiens
tcattacagagatataatctac

SEQ ID NO: 7430091 - DNA, 22 bp, Homo sapiens
tcattacagagatataatctac

SEQ ID NO: 7430092 - DNA, 22 bp, Homo sapiens
tcatggctgaaacagtaacaca

SEQ ID NO: 7430093 - DNA, 22 bp, Homo sapiens
tcagtgtctcatatgaggtttc

SEQ ID NO: 7430094 - DNA, 22 bp, Homo sapiens
tcagtgtctcatatgaggtttc

SEQ ID NO: 7430095 - DNA, 22 bp, Homo sapiens
tcagtgtctatagataaggttt

SEQ ID NO: 7430096 - DNA, 22 bp, Homo sapiens
tcagtgtctatagataaggttt

SEQ ID NO: 7430097 - DNA, 22 bp, Homo sapiens
tcagtgtgttactttctcctat

SEQ ID NO: 7430098 - DNA, 22 bp, Homo sapiens
tcagtgtgttattctactttca

SEQ ID NO: 7430099 - DNA, 22 bp, Homo sapiens
tcagtgtctgtgggcaggatgg

SEQ ID NO: 7430100 - DNA, 22 bp, Homo sapiens
tcagtgtgttaacccaggggca

SEQ ID NO: 7430101 - DNA, 22 bp, Homo sapiens
tcagtgtgttaacccaggggca

SEQ ID NO: 7430102 - DNA, 22 bp, Homo sapiens
tcagtgttacattatatagaac

SEQ ID NO: 7430103 - DNA, 22 bp, Homo sapiens
tcagtgttacattatatagaac

SEQ ID NO: 7430104 - DNA, 22 bp, Homo sapiens
tcagtgttaatcagtggtacct

SEQ ID NO: 7430105 - DNA, 22 bp, Homo sapiens
tcagtgtgttcaattggatagg

SEQ ID NO: 7430106 - DNA, 22 bp, Homo sapiens
tcagtgttaatcagtggtacct

SEQ ID NO: 7430107 - DNA, 22 bp, Homo sapiens
tcagtgtgttattctactttca

SEQ ID NO: 7430108 - DNA, 22 bp, Homo sapiens
tcagtgtgttattctactttca

SEQ ID NO: 7430109 - DNA, 22 bp, Homo sapiens
tcagtgtgttcaattggatagg

SEQ ID NO: 7430110 - DNA, 22 bp, Homo sapiens
tcagtgtcctgtgcggtgcagc

SEQ ID NO: 7430111 - DNA, 22 bp, Homo sapiens
tcagtgtcctgtgcggtgcagc

SEQ ID NO: 7430112 - DNA, 22 bp, Homo sapiens
tcagtgtccttcgttcttgttg

SEQ ID NO: 7430113 - DNA, 22 bp, Homo sapiens
tcagtgtccttcgttcttgttg

SEQ ID NO: 7430114 - DNA, 22 bp, Homo sapiens
tcagtgtctagggacagtaatc

SEQ ID NO: 7430115 - DNA, 22 bp, Homo sapiens
tcagtgtctagggacagtaatc

SEQ ID NO: 7430116 - DNA, 22 bp, Homo sapiens
tcagtgtctagggacagtaatc

SEQ ID NO: 7430117 - DNA, 23 bp, Homo sapiens
tcagtgtctagttgtggaattga

SEQ ID NO: 7430118 - DNA, 23 bp, Homo sapiens
tcagtgtctagttgtggaattga

SEQ ID NO: 7430119 - DNA, 22 bp, Homo sapiens
tcagtgtccggagcctgagtgc

SEQ ID NO: 7430120 - DNA, 19 bp, Homo sapiens
tcagtgtccctgttaatat

SEQ ID NO: 7430121 - DNA, 22 bp, Homo sapiens
tcagtgtccggagcctgagtgc

SEQ ID NO: 7430122 - DNA, 22 bp, Homo sapiens
tcagtgtccggagcctgagtgc

SEQ ID NO: 7430123 - DNA, 22 bp, Homo sapiens
tcagtgtcccgtctcttaactc

SEQ ID NO: 7430124 - DNA, 22 bp, Homo sapiens
tcagtgtcccgtctcttaactc

SEQ ID NO: 7430125 - DNA, 19 bp, Homo sapiens
tcagtgtccctgttaatat

SEQ ID NO: 7430126 - DNA, 22 bp, Homo sapiens
tcagtgtccaaaaagaggcaag

SEQ ID NO: 7430127 - DNA, 22 bp, Homo sapiens
tcagtgtccaaaaagaggcaag

SEQ ID NO: 7430128 - DNA, 22 bp, Homo sapiens
tcagtgtccaaaaagaggcaag

SEQ ID NO: 7430129 - DNA, 22 bp, Homo sapiens
tcagtgtccaaaaagaggcaag

SEQ ID NO: 7430130 - DNA, 22 bp, Homo sapiens
tcagtgtccataaataaagttt

SEQ ID NO: 7430131 - DNA, 22 bp, Homo sapiens
tcagtgtccataaataaagttt

SEQ ID NO: 7430132 - DNA, 22 bp, Homo sapiens
tcagtgtccataaataaagttt

SEQ ID NO: 7430133 - DNA, 22 bp, Homo sapiens
tcagtggtggaagcagcaaacc

SEQ ID NO: 7430134 - DNA, 22 bp, Homo sapiens
tcagtggtggaagcagcaaacc

SEQ ID NO: 7430135 - DNA, 22 bp, Homo sapiens
tcagtgcagtagaactttagtt

SEQ ID NO: 7430136 - DNA, 22 bp, Homo sapiens
tcagtggtcttggctgattgtt

SEQ ID NO: 7430137 - DNA, 22 bp, Homo sapiens
tcagtggtctaggcaatatata

SEQ ID NO: 7430138 - DNA, 22 bp, Homo sapiens
tcagtgcagtagaactttagtt

SEQ ID NO: 7430139 - DNA, 22 bp, Homo sapiens
tcagtgcagtagaactttagtt

SEQ ID NO: 7430140 - DNA, 22 bp, Homo sapiens
tcagtgcagggtgggagagaga

SEQ ID NO: 7430141 - DNA, 22 bp, Homo sapiens
tcagtgcagggtgggagagaga

SEQ ID NO: 7430142 - DNA, 22 bp, Homo sapiens
tcagtgtagcagacttgtagcc

SEQ ID NO: 7430143 - DNA, 18 bp, Homo sapiens
tcagtgtagatctgtgta

SEQ ID NO: 7430144 - DNA, 22 bp, Homo sapiens
tcagtgtaagtttttggatagg

SEQ ID NO: 7430145 - DNA, 18 bp, Homo sapiens
tcagtgtagatctgtgta

SEQ ID NO: 7430146 - DNA, 22 bp, Homo sapiens
tcagtgtaagttatgtagatgt

SEQ ID NO: 7430147 - DNA, 22 bp, Homo sapiens
tcagtgtaagttatgtagatgt

SEQ ID NO: 7430148 - DNA, 22 bp, Homo sapiens
tcagtgtaagttatgtagatgt

SEQ ID NO: 7430149 - DNA, 21 bp, Homo sapiens
tcagtgtatttaagaatgttg

SEQ ID NO: 7430150 - DNA, 22 bp, Homo sapiens
tcagtgtcacaggatgctatgc

SEQ ID NO: 7430151 - DNA, 22 bp, Homo sapiens
tcagtgtcacaggatgctatgc

SEQ ID NO: 7430152 - DNA, 16 bp, Homo sapiens
tcagtgtcagctcctg

SEQ ID NO: 7430153 - DNA, 16 bp, Homo sapiens
tcagtgtcagctcctg

SEQ ID NO: 7430154 - DNA, 20 bp, Homo sapiens
tcagtgtatcctcagtggct

SEQ ID NO: 7430155 - DNA, 22 bp, Homo sapiens
tcagtgtatggagtgctggatt

SEQ ID NO: 7430156 - DNA, 22 bp, Homo sapiens
tcagtgtagggcagacccctgg

SEQ ID NO: 7430157 - DNA, 18 bp, Homo sapiens
tcagtgtagatctgtgta

SEQ ID NO: 7430158 - DNA, 22 bp, Homo sapiens
tcagtgtatggagtgctggatt

SEQ ID NO: 7430159 - DNA, 20 bp, Homo sapiens
tcagtgtatcctcagtggct

SEQ ID NO: 7430160 - DNA, 21 bp, Homo sapiens
tcagtgtatttaagaatgttg

SEQ ID NO: 7430161 - DNA, 20 bp, Homo sapiens
tcagtgtcagtagccactac

SEQ ID NO: 7430162 - DNA, 20 bp, Homo sapiens
tcagtgtcagtagccactac

SEQ ID NO: 7430163 - DNA, 20 bp, Homo sapiens
tcagtgtcagtagccactac

SEQ ID NO: 7430164 - DNA, 20 bp, Homo sapiens
tcagtgtcagtagccactac

SEQ ID NO: 7430165 - DNA, 22 bp, Homo sapiens
tcagtgtcagtcttttagatat

SEQ ID NO: 7430166 - DNA, 22 bp, Homo sapiens
tcagtgtcatatcaagaagatg

SEQ ID NO: 7430167 - DNA, 22 bp, Homo sapiens
tcagtgtcatatcaagaagatg

SEQ ID NO: 7430168 - DNA, 22 bp, Homo sapiens
tcagtgtcagtcttttagatat

SEQ ID NO: 7430169 - DNA, 22 bp, Homo sapiens
tcagtgtcatcacttaatataa

SEQ ID NO: 7430170 - DNA, 22 bp, Homo sapiens
tcagtgtcatcacttaatataa

SEQ ID NO: 7430171 - DNA, 22 bp, Homo sapiens
tcagtgtcatatcaagaagatg

SEQ ID NO: 7430172 - DNA, 22 bp, Homo sapiens
tcagtgtcatcacttaatataa

SEQ ID NO: 7430173 - DNA, 22 bp, Homo sapiens
tcagtgcagactgtaagttgga

SEQ ID NO: 7430174 - DNA, 22 bp, Homo sapiens
tcagtgcagactgtaagttgga

SEQ ID NO: 7430175 - DNA, 22 bp, Homo sapiens
tcagtgcagactgtaagttgga

SEQ ID NO: 7430176 - DNA, 22 bp, Homo sapiens
tcagtgcagaatagtgatgcat

SEQ ID NO: 7430177 - DNA, 22 bp, Homo sapiens
tcagtgcacagagatttttgtt

SEQ ID NO: 7430178 - DNA, 22 bp, Homo sapiens
tcagtgcagaatagtgatgcat

SEQ ID NO: 7430179 - DNA, 22 bp, Homo sapiens
tcagtgcacccaattctctcca

SEQ ID NO: 7430180 - DNA, 22 bp, Homo sapiens
tcagtgcagcggcagcagctct

SEQ ID NO: 7430181 - DNA, 22 bp, Homo sapiens
tcagtgcagcggcagcagctct

SEQ ID NO: 7430182 - DNA, 22 bp, Homo sapiens
tcagtgcagcggcagcagctct

SEQ ID NO: 7430183 - DNA, 22 bp, Homo sapiens
tcagtgcagcggcagcagctct

SEQ ID NO: 7430184 - DNA, 20 bp, Homo sapiens
tcagtgcagattgtccaagt

SEQ ID NO: 7430185 - DNA, 22 bp, Homo sapiens
tcagtgcaggaatttccttaga

SEQ ID NO: 7430186 - DNA, 22 bp, Homo sapiens
tcagtgcagggtgggagagaga

SEQ ID NO: 7430187 - DNA, 22 bp, Homo sapiens
tcagtgcaggaatttccttaga

SEQ ID NO: 7430188 - DNA, 22 bp, Homo sapiens
tcagtgcaggaatctctagcca

SEQ ID NO: 7430189 - DNA, 21 bp, Homo sapiens
tcagtgcaattctatggggaa

SEQ ID NO: 7430190 - DNA, 22 bp, Homo sapiens
tcagtgcaatcaaggtatgttt

SEQ ID NO: 7430191 - DNA, 23 bp, Homo sapiens
tcagtgcaaaaataggattttgg

SEQ ID NO: 7430192 - DNA, 22 bp, Homo sapiens
tcagtgcaatcaaggtatgttt

SEQ ID NO: 7430193 - DNA, 23 bp, Homo sapiens
tcagtgcaaaaataggattttgg

SEQ ID NO: 7430194 - DNA, 22 bp, Homo sapiens
tcagtgcaaaaaatgggctaga

SEQ ID NO: 7430195 - DNA, 22 bp, Homo sapiens
tcagtgcaaaaaatgggctaga

SEQ ID NO: 7430196 - DNA, 22 bp, Homo sapiens
tcagtgcaaaaaatgggctaga

SEQ ID NO: 7430197 - DNA, 20 bp, Homo sapiens
tcagtgattttgaagaggaa

SEQ ID NO: 7430198 - DNA, 22 bp, Homo sapiens
tcagtgcacagagatttttgtt

SEQ ID NO: 7430199 - DNA, 22 bp, Homo sapiens
tcagtgcacccaattctctcca

SEQ ID NO: 7430200 - DNA, 22 bp, Homo sapiens
tcagtgcacaatgacggtggct

SEQ ID NO: 7430201 - DNA, 22 bp, Homo sapiens
tcagtgcacaatgacggtggct

SEQ ID NO: 7430202 - DNA, 21 bp, Homo sapiens
tcagtgcaattctatggggaa

SEQ ID NO: 7430203 - DNA, 22 bp, Homo sapiens
tcagtgaaatgcatattcttcg

SEQ ID NO: 7430204 - DNA, 22 bp, Homo sapiens
tcagtgaaatgcatattcttcg

SEQ ID NO: 7430205 - DNA, 22 bp, Homo sapiens
tcagtgaaccttctgtggcagg

SEQ ID NO: 7430206 - DNA, 22 bp, Homo sapiens
tcagtgaaatgcatattcttcg

SEQ ID NO: 7430207 - DNA, 22 bp, Homo sapiens
tcagtgaaccttctgtggcagg

SEQ ID NO: 7430208 - DNA, 22 bp, Homo sapiens
tcagtgaaatgcatattcttcg

SEQ ID NO: 7430209 - DNA, 22 bp, Homo sapiens
tcagtcttttaactttctgcca

SEQ ID NO: 7430210 - DNA, 22 bp, Homo sapiens
tcagtctttgcttatgacaata

SEQ ID NO: 7430211 - DNA, 22 bp, Homo sapiens
tcagtcttttgccctgaggagt

SEQ ID NO: 7430212 - DNA, 22 bp, Homo sapiens
tcagtcttttaactttctgcca

SEQ ID NO: 7430213 - DNA, 22 bp, Homo sapiens
tcagtctttttctcttaagtac

SEQ ID NO: 7430214 - DNA, 22 bp, Homo sapiens
tcagtctttttctcttaagtac

SEQ ID NO: 7430215 - DNA, 22 bp, Homo sapiens
tcagtgaaatgcatattcttcg

SEQ ID NO: 7430216 - DNA, 22 bp, Homo sapiens
tcagtctttcgaattcagccag

SEQ ID NO: 7430217 - DNA, 22 bp, Homo sapiens
tcagtctttaaaagctcaggaa

SEQ ID NO: 7430218 - DNA, 22 bp, Homo sapiens
tcagtctttccctccctcagtt

SEQ ID NO: 7430219 - DNA, 22 bp, Homo sapiens
tcagtctttcgaattcagccag

SEQ ID NO: 7430220 - DNA, 22 bp, Homo sapiens
tcagtctttcgaattcagccag

SEQ ID NO: 7430221 - DNA, 22 bp, Homo sapiens
tcagtctttgcttatgacaata

SEQ ID NO: 7430222 - DNA, 22 bp, Homo sapiens
tcagtctttcgaattcagccag

SEQ ID NO: 7430223 - DNA, 23 bp, Homo sapiens
tcagtcttggcttctgattttcc

SEQ ID NO: 7430224 - DNA, 22 bp, Homo sapiens
tcagtcttgtttgattcctcac

SEQ ID NO: 7430225 - DNA, 22 bp, Homo sapiens
tcagtcttgtttgattcctcac

SEQ ID NO: 7430226 - DNA, 23 bp, Homo sapiens
tcagtcttggcttctgattttcc

SEQ ID NO: 7430227 - DNA, 22 bp, Homo sapiens
tcagtcttgcttctcttgggtc

SEQ ID NO: 7430228 - DNA, 22 bp, Homo sapiens
tcagtctttaaaagctcaggaa

SEQ ID NO: 7430229 - DNA, 22 bp, Homo sapiens
tcagtctttaaaagctcaggaa

SEQ ID NO: 7430230 - DNA, 22 bp, Homo sapiens
tcagtcttgtttttctggtcca

SEQ ID NO: 7430231 - DNA, 22 bp, Homo sapiens
tcagtcttgtttttctggtcca

SEQ ID NO: 7430232 - DNA, 22 bp, Homo sapiens
tcagtgatgaggtggctttcaa

SEQ ID NO: 7430233 - DNA, 23 bp, Homo sapiens
tcagtgatgttgaacctagcagt

SEQ ID NO: 7430234 - DNA, 22 bp, Homo sapiens
tcagtgattggtggactgccta

SEQ ID NO: 7430235 - DNA, 22 bp, Homo sapiens
tcagtgattggtggactgccta

SEQ ID NO: 7430236 - DNA, 22 bp, Homo sapiens
tcagtgattggtggactgccta

SEQ ID NO: 7430237 - DNA, 22 bp, Homo sapiens
tcagtgatttctggggtgaggg

SEQ ID NO: 7430238 - DNA, 22 bp, Homo sapiens
tcagtgatttctggggtgaggg

SEQ ID NO: 7430239 - DNA, 22 bp, Homo sapiens
tcagtgacaactatgaatattt

SEQ ID NO: 7430240 - DNA, 22 bp, Homo sapiens
tcagtgacaactatgaatattt

SEQ ID NO: 7430241 - DNA, 22 bp, Homo sapiens
tcagtgaatgagataactttag

SEQ ID NO: 7430242 - DNA, 22 bp, Homo sapiens
tcagtgaagtaatggtgagaga

SEQ ID NO: 7430243 - DNA, 22 bp, Homo sapiens
tcagtgaatgagataactttag

SEQ ID NO: 7430244 - DNA, 22 bp, Homo sapiens
tcagtgactgggtattaaatca

SEQ ID NO: 7430245 - DNA, 22 bp, Homo sapiens
tcagtgactgggtattaaatca

SEQ ID NO: 7430246 - DNA, 22 bp, Homo sapiens
tcagtgatctaagggtatggcc

SEQ ID NO: 7430247 - DNA, 22 bp, Homo sapiens
tcagtgatctaagggtatggcc

SEQ ID NO: 7430248 - DNA, 21 bp, Homo sapiens
tcagtgacaggtgctgacctc

SEQ ID NO: 7430249 - DNA, 21 bp, Homo sapiens
tcagtgacaggtgctgacctc

SEQ ID NO: 7430250 - DNA, 22 bp, Homo sapiens
tcaggttctggtgagggccctt

SEQ ID NO: 7430251 - DNA, 22 bp, Homo sapiens
tcaggtttaggaatttggaaag

SEQ ID NO: 7430252 - DNA, 22 bp, Homo sapiens
tcaggttcagactagtcccagt

SEQ ID NO: 7430253 - DNA, 22 bp, Homo sapiens
tcagtctctggctgtgtctgac

SEQ ID NO: 7430254 - DNA, 22 bp, Homo sapiens
tcagtctctggctgtgtctgac

SEQ ID NO: 7430255 - DNA, 22 bp, Homo sapiens
tcagtctctggctgtgtctgac

SEQ ID NO: 7430256 - DNA, 17 bp, Homo sapiens
tcagtctctgtcctgga

SEQ ID NO: 7430257 - DNA, 17 bp, Homo sapiens
tcagtctctgtcctgga

SEQ ID NO: 7430258 - DNA, 21 bp, Homo sapiens
tcagtaaaaaaactacctaga

SEQ ID NO: 7430259 - DNA, 21 bp, Homo sapiens
tcagtaaaaaaactacctaga

SEQ ID NO: 7430260 - DNA, 22 bp, Homo sapiens
tcaggtttttctcaaatcaggt

SEQ ID NO: 7430261 - DNA, 22 bp, Homo sapiens
tcagtcttcaaatctgagtcgt

SEQ ID NO: 7430262 - DNA, 17 bp, Homo sapiens
tcagtctctgtcctgga

SEQ ID NO: 7430263 - DNA, 17 bp, Homo sapiens
tcagtctctgtcctgga

SEQ ID NO: 7430264 - DNA, 22 bp, Homo sapiens
tcagtcttcaaatctgagtcgt

SEQ ID NO: 7430265 - DNA, 22 bp, Homo sapiens
tcagtcttccctccagtgcaac

SEQ ID NO: 7430266 - DNA, 22 bp, Homo sapiens
tcagtcttccctccagtgcaac

SEQ ID NO: 7430267 - DNA, 22 bp, Homo sapiens
tcagtcttccctccagtgcaac

SEQ ID NO: 7430268 - DNA, 22 bp, Homo sapiens
tcagtcttccctccagtgcaac

SEQ ID NO: 7430269 - DNA, 22 bp, Homo sapiens
tcagtcttcaaatctgagtcgt

SEQ ID NO: 7430270 - DNA, 23 bp, Homo sapiens
tcagtcttggcttctgattttcc

SEQ ID NO: 7430271 - DNA, 23 bp, Homo sapiens
tcagtcttggcttctgattttcc

SEQ ID NO: 7430272 - DNA, 22 bp, Homo sapiens
tcagtcttgcttctcttgggtc

SEQ ID NO: 7430273 - DNA, 23 bp, Homo sapiens
tcagtcttggcttctgattttcc

SEQ ID NO: 7430274 - DNA, 22 bp, Homo sapiens
tcagtcttctagcaaatccagg

SEQ ID NO: 7430275 - DNA, 22 bp, Homo sapiens
tcagtcttgcttctcttgggtc

SEQ ID NO: 7430276 - DNA, 23 bp, Homo sapiens
tcagtcttccctgtcagtaatag

SEQ ID NO: 7430277 - DNA, 22 bp, Homo sapiens
tcagtcttctaaagggatgcaa

SEQ ID NO: 7430278 - DNA, 22 bp, Homo sapiens
tcagtcttctaaagggatgcaa

SEQ ID NO: 7430279 - DNA, 23 bp, Homo sapiens
tcagtcttccctgtcagtaatag

SEQ ID NO: 7430280 - DNA, 23 bp, Homo sapiens
tcagtcttccctgtcagtaatag

SEQ ID NO: 7430281 - DNA, 22 bp, Homo sapiens
tcagtcttctagcaaatccagg

SEQ ID NO: 7430282 - DNA, 22 bp, Homo sapiens
tcagtcttctagcaaatccagg

SEQ ID NO: 7430283 - DNA, 16 bp, Homo sapiens
tcaggtgtgacttttt

SEQ ID NO: 7430284 - DNA, 22 bp, Homo sapiens
tcaggtgtggaccgaggtcaga

SEQ ID NO: 7430285 - DNA, 22 bp, Homo sapiens
tcaggtgttagaagaaatttca

SEQ ID NO: 7430286 - DNA, 22 bp, Homo sapiens
tcaggtgttctccactcagttt

SEQ ID NO: 7430287 - DNA, 17 bp, Homo sapiens
tcagggaatgaggttgt

SEQ ID NO: 7430288 - DNA, 22 bp, Homo sapiens
tcagggaatgatgcacacagtt

SEQ ID NO: 7430289 - DNA, 22 bp, Homo sapiens
tcagggaatgatgcacacagtt

SEQ ID NO: 7430290 - DNA, 22 bp, Homo sapiens
tcagggaatgatgcacacagtt

SEQ ID NO: 7430291 - DNA, 22 bp, Homo sapiens
tcagggaatgatgcacacagtt

SEQ ID NO: 7430292 - DNA, 22 bp, Homo sapiens
tcagggaatgtgatacaggaag

SEQ ID NO: 7430293 - DNA, 22 bp, Homo sapiens
tcagggaatgtgatacaggaag

SEQ ID NO: 7430294 - DNA, 22 bp, Homo sapiens
tcagggaatgtgatacaggaag

SEQ ID NO: 7430295 - DNA, 22 bp, Homo sapiens
tcagggaatgggcccagtccct

SEQ ID NO: 7430296 - DNA, 22 bp, Homo sapiens
tcagggaatgggcccagtccct

SEQ ID NO: 7430297 - DNA, 22 bp, Homo sapiens
tcagggaatgggcccagtccct

SEQ ID NO: 7430298 - DNA, 22 bp, Homo sapiens
tcagggaatgggcccagtccct

SEQ ID NO: 7430299 - DNA, 22 bp, Homo sapiens
tcagggaccaccactcacccag

SEQ ID NO: 7430300 - DNA, 22 bp, Homo sapiens
tcagggacatttagacactgat

SEQ ID NO: 7430301 - DNA, 22 bp, Homo sapiens
tcagggacagggtgctgctgcg

SEQ ID NO: 7430302 - DNA, 23 bp, Homo sapiens
tcagggacatgatgtgtcatatc

SEQ ID NO: 7430303 - DNA, 22 bp, Homo sapiens
tcagggacagttcttagggtgg

SEQ ID NO: 7430304 - DNA, 22 bp, Homo sapiens
tcagggacagggtgctgctgcg

SEQ ID NO: 7430305 - DNA, 22 bp, Homo sapiens
tcagggacagggtgctgctgcg

SEQ ID NO: 7430306 - DNA, 22 bp, Homo sapiens
tcagggacaggatgggcatttc

SEQ ID NO: 7430307 - DNA, 22 bp, Homo sapiens
tcagggacagggtgctgctgcg

SEQ ID NO: 7430308 - DNA, 22 bp, Homo sapiens
tcaggtggccaaatgggagcgc

SEQ ID NO: 7430309 - DNA, 22 bp, Homo sapiens
tcaggtggccaaatgggagcgc

SEQ ID NO: 7430310 - DNA, 22 bp, Homo sapiens
tcaggtggccaaatgggagcgc

SEQ ID NO: 7430311 - DNA, 22 bp, Homo sapiens
tcaggtggccaaatgggagcgc

SEQ ID NO: 7430312 - DNA, 22 bp, Homo sapiens
tcaggtggctggttgctggcta

SEQ ID NO: 7430313 - DNA, 22 bp, Homo sapiens
tcaggtgtcaagcagggagctg

SEQ ID NO: 7430314 - DNA, 22 bp, Homo sapiens
tcagggacccctctgagtggag

SEQ ID NO: 7430315 - DNA, 22 bp, Homo sapiens
tcagggacccctctgagtggag

SEQ ID NO: 7430316 - DNA, 22 bp, Homo sapiens
tcagggacccctctgagtggag

SEQ ID NO: 7430317 - DNA, 22 bp, Homo sapiens
tcagggacccctctgagtggag

SEQ ID NO: 7430318 - DNA, 22 bp, Homo sapiens
tcaggtggccaaatgggagcgc

SEQ ID NO: 7430319 - DNA, 22 bp, Homo sapiens
tcagggacgtgagctcagagtc

SEQ ID NO: 7430320 - DNA, 22 bp, Homo sapiens
tcagggaagaaatgggacttta

SEQ ID NO: 7430321 - DNA, 22 bp, Homo sapiens
tcagggaagaaatgggacttta

SEQ ID NO: 7430322 - DNA, 22 bp, Homo sapiens
tcagggaagacttcttagagga

SEQ ID NO: 7430323 - DNA, 22 bp, Homo sapiens
tcagggaagacttcttagagga

SEQ ID NO: 7430324 - DNA, 22 bp, Homo sapiens
tcagggaagacttcttagagga

SEQ ID NO: 7430325 - DNA, 22 bp, Homo sapiens
tcagggaacctctcctgtttct

SEQ ID NO: 7430326 - DNA, 22 bp, Homo sapiens
tcagggaacctctcctgtttct

SEQ ID NO: 7430327 - DNA, 22 bp, Homo sapiens
tcagggaacctctcctgtttct

SEQ ID NO: 7430328 - DNA, 22 bp, Homo sapiens
tcagggaactacttctccctat

SEQ ID NO: 7430329 - DNA, 22 bp, Homo sapiens
tcagggaactacttctccctat

SEQ ID NO: 7430330 - DNA, 22 bp, Homo sapiens
tcagggaagaaatgggacttta

SEQ ID NO: 7430331 - DNA, 22 bp, Homo sapiens
tcagggaagaaatgggacttta

SEQ ID NO: 7430332 - DNA, 21 bp, Homo sapiens
tcagggaagtgtgcagaaggg

SEQ ID NO: 7430333 - DNA, 21 bp, Homo sapiens
tcagggaagtgtgcagaaggg

SEQ ID NO: 7430334 - DNA, 21 bp, Homo sapiens
tcagggaagtgtgcagaaggg

SEQ ID NO: 7430335 - DNA, 22 bp, Homo sapiens
tcagggaagagagatctcctag

SEQ ID NO: 7430336 - DNA, 22 bp, Homo sapiens
tcagggaagagagatctcctag

SEQ ID NO: 7430337 - DNA, 22 bp, Homo sapiens
tcagggaagagagatctcctag

SEQ ID NO: 7430338 - DNA, 22 bp, Homo sapiens
tcagggaagagagatctcctag

SEQ ID NO: 7430339 - DNA, 18 bp, Homo sapiens
tcagggaagagaatatga

SEQ ID NO: 7430340 - DNA, 18 bp, Homo sapiens
tcagggaagagaatatga

SEQ ID NO: 7430341 - DNA, 18 bp, Homo sapiens
tcagggaagagaatatga

SEQ ID NO: 7430342 - DNA, 22 bp, Homo sapiens
tcagggaagacttcttagagga

SEQ ID NO: 7430343 - DNA, 18 bp, Homo sapiens
tcagggaagagaatatga

SEQ ID NO: 7430344 - DNA, 18 bp, Homo sapiens
tcagggaagagaatatga

SEQ ID NO: 7430345 - DNA, 18 bp, Homo sapiens
tcagggaagagaatatga

SEQ ID NO: 7430346 - DNA, 18 bp, Homo sapiens
tcagggaatcttggcctt

SEQ ID NO: 7430347 - DNA, 18 bp, Homo sapiens
tcagggaatcttggcctt

SEQ ID NO: 7430348 - DNA, 22 bp, Homo sapiens
tcagggaataagtagatgagtg

SEQ ID NO: 7430349 - DNA, 22 bp, Homo sapiens
tcagggaatcagactctgcagc

SEQ ID NO: 7430350 - DNA, 22 bp, Homo sapiens
tcagggaatcagactctgcagc

SEQ ID NO: 7430351 - DNA, 17 bp, Homo sapiens
tcagggaatgaggttgt

SEQ ID NO: 7430352 - DNA, 17 bp, Homo sapiens
tcagggaatgaggttgt

SEQ ID NO: 7430353 - DNA, 17 bp, Homo sapiens
tcagggaatgaggttgt

SEQ ID NO: 7430354 - DNA, 17 bp, Homo sapiens
tcagggaatgaggttgt

SEQ ID NO: 7430355 - DNA, 22 bp, Homo sapiens
tcagggaataagtagatgagtg

SEQ ID NO: 7430356 - DNA, 22 bp, Homo sapiens
tcagggaataagtagatgagtg

SEQ ID NO: 7430357 - DNA, 22 bp, Homo sapiens
tcagggaataagtagatgagtg

SEQ ID NO: 7430358 - DNA, 19 bp, Homo sapiens
tcagggaagttcaaagctc

SEQ ID NO: 7430359 - DNA, 21 bp, Homo sapiens
tcagggaagtgtgcagaaggg

SEQ ID NO: 7430360 - DNA, 21 bp, Homo sapiens
tcagggaagtgtgcagaaggg

SEQ ID NO: 7430361 - DNA, 21 bp, Homo sapiens
tcagggaagtgtgcagaaggg

SEQ ID NO: 7430362 - DNA, 21 bp, Homo sapiens
tcagggaagtgtgcagaaggg

SEQ ID NO: 7430363 - DNA, 19 bp, Homo sapiens
tcagggaagttcaaagctc

SEQ ID NO: 7430364 - DNA, 19 bp, Homo sapiens
tcagggaagttcaaagctc

SEQ ID NO: 7430365 - DNA, 19 bp, Homo sapiens
tcagggaagttcaaagctc

SEQ ID NO: 7430366 - DNA, 22 bp, Homo sapiens
tcactgaaggaagacactgtca

SEQ ID NO: 7430367 - DNA, 22 bp, Homo sapiens
tcactgaagtcttcaagtagga

SEQ ID NO: 7430368 - DNA, 22 bp, Homo sapiens
tcactgaagtcttcaagtagga

SEQ ID NO: 7430369 - DNA, 22 bp, Homo sapiens
tcactgaagtcttcaagtagga

SEQ ID NO: 7430370 - DNA, 22 bp, Homo sapiens
tcactgaagtcttcaagtagga

SEQ ID NO: 7430371 - DNA, 22 bp, Homo sapiens
tcactgaagtcttcaagtagga

SEQ ID NO: 7430372 - DNA, 22 bp, Homo sapiens
tcactgaatacttgtctcatcc

SEQ ID NO: 7430373 - DNA, 22 bp, Homo sapiens
tcactgaatacttgtctcatcc

SEQ ID NO: 7430374 - DNA, 22 bp, Homo sapiens
tcactgaatacttgtctcatcc

SEQ ID NO: 7430375 - DNA, 22 bp, Homo sapiens
tcactgaatgcagatacgtgac

SEQ ID NO: 7430376 - DNA, 22 bp, Homo sapiens
tcactgaagactgggctctaaa

SEQ ID NO: 7430377 - DNA, 22 bp, Homo sapiens
tcactgaagactgggctctaaa

SEQ ID NO: 7430378 - DNA, 21 bp, Homo sapiens
tcactgaagcctaagatgttt

SEQ ID NO: 7430379 - DNA, 22 bp, Homo sapiens
tcactgaactctcatagagaaa

SEQ ID NO: 7430380 - DNA, 22 bp, Homo sapiens
tcactgaaggaagacactgtca

SEQ ID NO: 7430381 - DNA, 21 bp, Homo sapiens
tcactgaagcctaagatgttt

SEQ ID NO: 7430382 - DNA, 21 bp, Homo sapiens
tcactgaagcctaagatgttt

SEQ ID NO: 7430383 - DNA, 22 bp, Homo sapiens
tcactgaatacttgtctcatcc

SEQ ID NO: 7430384 - DNA, 22 bp, Homo sapiens
tcactgaatgcagatacgtgac

SEQ ID NO: 7430385 - DNA, 22 bp, Homo sapiens
tcactgaatttcaagctagtgg

SEQ ID NO: 7430386 - DNA, 22 bp, Homo sapiens
tcactgaatttcaagctagtgg

SEQ ID NO: 7430387 - DNA, 22 bp, Homo sapiens
tcactgaatttcaagctagtgg

SEQ ID NO: 7430388 - DNA, 22 bp, Homo sapiens
tcactgagaagagtaacagcag

SEQ ID NO: 7430389 - DNA, 22 bp, Homo sapiens
tcactgagaagagtaacagcag

SEQ ID NO: 7430390 - DNA, 22 bp, Homo sapiens
tcactgacgtggggctacttga

SEQ ID NO: 7430391 - DNA, 18 bp, Homo sapiens
tcactgagccgcctctct

SEQ ID NO: 7430392 - DNA, 22 bp, Homo sapiens
tcactgaggcattcatgctctg

SEQ ID NO: 7430393 - DNA, 23 bp, Homo sapiens
tcactgatgttacagcagccagt

SEQ ID NO: 7430394 - DNA, 22 bp, Homo sapiens
tcactgtgctctctagataggc

SEQ ID NO: 7430395 - DNA, 22 bp, Homo sapiens
tcactgtgctctctagataggc

SEQ ID NO: 7430396 - DNA, 22 bp, Homo sapiens
tcactgtgctctctagataggc

SEQ ID NO: 7430397 - DNA, 19 bp, Homo sapiens
tcactgaggctttgttggc

SEQ ID NO: 7430398 - DNA, 23 bp, Homo sapiens
tcactgatgttacagcagccagt

SEQ ID NO: 7430399 - DNA, 22 bp, Homo sapiens
tcactgatgcttatgaaagtgt

SEQ ID NO: 7430400 - DNA, 22 bp, Homo sapiens
tcactgaaccagggatctctag

SEQ ID NO: 7430401 - DNA, 22 bp, Homo sapiens
tcactgaaagtaattctagtga

SEQ ID NO: 7430402 - DNA, 22 bp, Homo sapiens
tcactgaaccagggatctctag

SEQ ID NO: 7430403 - DNA, 22 bp, Homo sapiens
tcactgaaccagggatctctag

SEQ ID NO: 7430404 - DNA, 22 bp, Homo sapiens
tcactgaactctcatagagaaa

SEQ ID NO: 7430405 - DNA, 22 bp, Homo sapiens
tcactgaaagtaattctagtga

SEQ ID NO: 7430406 - DNA, 22 bp, Homo sapiens
tcactgaaagaatgacattatg

SEQ ID NO: 7430407 - DNA, 22 bp, Homo sapiens
tcactgaaacctccacctctcg

SEQ ID NO: 7430408 - DNA, 22 bp, Homo sapiens
tcactgaaagtaattctagtga

SEQ ID NO: 7430409 - DNA, 22 bp, Homo sapiens
tcactgaaacctccacctctcg

SEQ ID NO: 7430410 - DNA, 22 bp, Homo sapiens
tcactgaaagaatgacattatg

SEQ ID NO: 7430411 - DNA, 22 bp, Homo sapiens
tcactgaaagaatgacattatg

SEQ ID NO: 7430412 - DNA, 22 bp, Homo sapiens
tcactgaaagaatgacattatg

SEQ ID NO: 7430413 - DNA, 22 bp, Homo sapiens
tcactctgttttactcactgtt

SEQ ID NO: 7430414 - DNA, 22 bp, Homo sapiens
tcactctgttttactcactgtt

SEQ ID NO: 7430415 - DNA, 22 bp, Homo sapiens
tcactgaaaaccatacttcttt

SEQ ID NO: 7430416 - DNA, 22 bp, Homo sapiens
tcactgaaaaccatacttcttt

SEQ ID NO: 7430417 - DNA, 22 bp, Homo sapiens
tcactctgttttactcactgtt

SEQ ID NO: 7430418 - DNA, 22 bp, Homo sapiens
tcactctgttttactcactgtt

SEQ ID NO: 7430419 - DNA, 22 bp, Homo sapiens
tcactctgttttactcactgtt

SEQ ID NO: 7430420 - DNA, 22 bp, Homo sapiens
tcactctgttagaggaaagtgc

SEQ ID NO: 7430421 - DNA, 22 bp, Homo sapiens
tcactctgttagaggaaagtgc

SEQ ID NO: 7430422 - DNA, 22 bp, Homo sapiens
tcactctgtggcccaggcagtg

SEQ ID NO: 7430423 - DNA, 22 bp, Homo sapiens
tcactctgtggcccaggcagtg

SEQ ID NO: 7430424 - DNA, 22 bp, Homo sapiens
tcactctgtggcccaggcagtg

SEQ ID NO: 7430425 - DNA, 22 bp, Homo sapiens
tcactctgtggcccaggcagtg

SEQ ID NO: 7430426 - DNA, 22 bp, Homo sapiens
tcactctgtgtttccctgggac

SEQ ID NO: 7430427 - DNA, 22 bp, Homo sapiens
tcactctgggccctactgggct

SEQ ID NO: 7430428 - DNA, 22 bp, Homo sapiens
tcactctggcctctgcagcagt

SEQ ID NO: 7430429 - DNA, 22 bp, Homo sapiens
tcactctgggccagcgcaggta

SEQ ID NO: 7430430 - DNA, 22 bp, Homo sapiens
tcactctgggccagcgcaggta

SEQ ID NO: 7430431 - DNA, 22 bp, Homo sapiens
tcactctgtcccccattgagat

SEQ ID NO: 7430432 - DNA, 22 bp, Homo sapiens
tcactctgtggcccaggcagtg

SEQ ID NO: 7430433 - DNA, 20 bp, Homo sapiens
tcacttcttccttttgtcta

SEQ ID NO: 7430434 - DNA, 22 bp, Homo sapiens
tcacttgaacctgggaggcaga

SEQ ID NO: 7430435 - DNA, 23 bp, Homo sapiens
tcacttgaagctagaatctgccc

SEQ ID NO: 7430436 - DNA, 23 bp, Homo sapiens
tcacttgaagctagaatctgccc

SEQ ID NO: 7430437 - DNA, 20 bp, Homo sapiens
tcacttcttccttttgtcta

SEQ ID NO: 7430438 - DNA, 22 bp, Homo sapiens
tcacttgacctcttgaactcct

SEQ ID NO: 7430439 - DNA, 22 bp, Homo sapiens
tcacttgacccttctctagcct

SEQ ID NO: 7430440 - DNA, 22 bp, Homo sapiens
tcacttgaattcattctgcgaa

SEQ ID NO: 7430441 - DNA, 19 bp, Homo sapiens
tcacttgaagttcagaaat

SEQ ID NO: 7430442 - DNA, 19 bp, Homo sapiens
tcacttgaagttcagaaat

SEQ ID NO: 7430443 - DNA, 22 bp, Homo sapiens
tcacttgctaacagatattgag

SEQ ID NO: 7430444 - DNA, 22 bp, Homo sapiens
tcacttgcctagcccagttcag

SEQ ID NO: 7430445 - DNA, 22 bp, Homo sapiens
tcacttgcctagcccagttcag

SEQ ID NO: 7430446 - DNA, 22 bp, Homo sapiens
tcacttgatccttccctgaaat

SEQ ID NO: 7430447 - DNA, 22 bp, Homo sapiens
tcacttgagatgtaccacaaac

SEQ ID NO: 7430448 - DNA, 22 bp, Homo sapiens
tcacttgagagatattagaagt

SEQ ID NO: 7430449 - DNA, 22 bp, Homo sapiens
tcacttgagagatattagaagt

SEQ ID NO: 7430450 - DNA, 22 bp, Homo sapiens
tcacttgactttccagtcttgg

SEQ ID NO: 7430451 - DNA, 22 bp, Homo sapiens
tcacttgactccagtttcttct

SEQ ID NO: 7430452 - DNA, 22 bp, Homo sapiens
tcactgttaataaatagcaaag

SEQ ID NO: 7430453 - DNA, 18 bp, Homo sapiens
tcactgtgtgtcttgggt

SEQ ID NO: 7430454 - DNA, 18 bp, Homo sapiens
tcactgtgtgtcttgggt

SEQ ID NO: 7430455 - DNA, 22 bp, Homo sapiens
tcactgtgctctctagataggc

SEQ ID NO: 7430456 - DNA, 22 bp, Homo sapiens
tcactgtggtatatatgtatca

SEQ ID NO: 7430457 - DNA, 22 bp, Homo sapiens
tcactgtggtatatatgtatca

SEQ ID NO: 7430458 - DNA, 22 bp, Homo sapiens
tcactgtgtcctttctgcgtag

SEQ ID NO: 7430459 - DNA, 22 bp, Homo sapiens
tcacttcttcccttgcacatat

SEQ ID NO: 7430460 - DNA, 22 bp, Homo sapiens
tcacttcttcccttgcacatat

SEQ ID NO: 7430461 - DNA, 22 bp, Homo sapiens
tcacttcttcagctttccttga

SEQ ID NO: 7430462 - DNA, 19 bp, Homo sapiens
tcacttctgttagcatgga

SEQ ID NO: 7430463 - DNA, 22 bp, Homo sapiens
tcactgttagagcaaacgtatg

SEQ ID NO: 7430464 - DNA, 22 bp, Homo sapiens
tcactttagaggaaacattgag

SEQ ID NO: 7430465 - DNA, 22 bp, Homo sapiens
tcactttagaggaaacattgag

SEQ ID NO: 7430466 - DNA, 22 bp, Homo sapiens
tcactttactttgttaatctgg

SEQ ID NO: 7430467 - DNA, 22 bp, Homo sapiens
tcactttagaggaaacattgag

SEQ ID NO: 7430468 - DNA, 22 bp, Homo sapiens
tcactttactttgttaatctgg

SEQ ID NO: 7430469 - DNA, 22 bp, Homo sapiens
tcactttacctcattcaggcag

SEQ ID NO: 7430470 - DNA, 22 bp, Homo sapiens
tcactttactttgttaatctgg

SEQ ID NO: 7430471 - DNA, 22 bp, Homo sapiens
tcactttaatgatttgtagaat

SEQ ID NO: 7430472 - DNA, 22 bp, Homo sapiens
tcactttaatgatttgtagaat

SEQ ID NO: 7430473 - DNA, 22 bp, Homo sapiens
tcactttaatgatttgtagaat

SEQ ID NO: 7430474 - DNA, 22 bp, Homo sapiens
tcactttaaactactgtggtct

SEQ ID NO: 7430475 - DNA, 22 bp, Homo sapiens
tcactttaaactactgtggtct

SEQ ID NO: 7430476 - DNA, 22 bp, Homo sapiens
tcactttaagcgggaggcagag

SEQ ID NO: 7430477 - DNA, 22 bp, Homo sapiens
tcactttaagcgggaggcagag

SEQ ID NO: 7430478 - DNA, 22 bp, Homo sapiens
tcactttaatgatttgtagaat

SEQ ID NO: 7430479 - DNA, 22 bp, Homo sapiens
tcactttacagatgggaaaact

SEQ ID NO: 7430480 - DNA, 22 bp, Homo sapiens
tcactttacagatgggaaaact

SEQ ID NO: 7430481 - DNA, 22 bp, Homo sapiens
tcactttacagatgggaaaact

SEQ ID NO: 7430482 - DNA, 22 bp, Homo sapiens
tcactttaccaaagtacaggag

SEQ ID NO: 7430483 - DNA, 22 bp, Homo sapiens
tcactttacagctaaggttgtt

SEQ ID NO: 7430484 - DNA, 22 bp, Homo sapiens
tcactttaccaaagtacaggag

SEQ ID NO: 7430485 - DNA, 23 bp, Homo sapiens
tcactttgatgtaattgaaaagc

SEQ ID NO: 7430486 - DNA, 23 bp, Homo sapiens
tcactttgatgtaattgaaaagc

SEQ ID NO: 7430487 - DNA, 23 bp, Homo sapiens
tcactttgatgtaattgaaaagc

SEQ ID NO: 7430488 - DNA, 22 bp, Homo sapiens
tcactttggattatgtaatttc

SEQ ID NO: 7430489 - DNA, 22 bp, Homo sapiens
tcactttggattatgtaatttc

SEQ ID NO: 7430490 - DNA, 22 bp, Homo sapiens
tcactttggattatgtaatttc

SEQ ID NO: 7430491 - DNA, 22 bp, Homo sapiens
tcactttggaagatagcacatc

SEQ ID NO: 7430492 - DNA, 22 bp, Homo sapiens
tcactttgacagagaaatgaat

SEQ ID NO: 7430493 - DNA, 22 bp, Homo sapiens
tcactttgacggccaacttcta

SEQ ID NO: 7430494 - DNA, 22 bp, Homo sapiens
tcactttgatgacattgtagct

SEQ ID NO: 7430495 - DNA, 22 bp, Homo sapiens
tcactttgatgacattgtagct

SEQ ID NO: 7430496 - DNA, 22 bp, Homo sapiens
tcactttcctcatcacgactag

SEQ ID NO: 7430497 - DNA, 22 bp, Homo sapiens
tcactttagatcttcatctctt

SEQ ID NO: 7430498 - DNA, 22 bp, Homo sapiens
tcactttagatcttcatctctt

SEQ ID NO: 7430499 - DNA, 22 bp, Homo sapiens
tcactttgaattccttgatttt

SEQ ID NO: 7430500 - DNA, 22 bp, Homo sapiens
tcacccaggctggagtgcagtg

SEQ ID NO: 7430501 - DNA, 22 bp, Homo sapiens
tcacccaggctggactgcagtg

SEQ ID NO: 7430502 - DNA, 22 bp, Homo sapiens
tcacccaggctggagtgcagtg

SEQ ID NO: 7430503 - DNA, 22 bp, Homo sapiens
tcacccaggctggagtgcagtg

SEQ ID NO: 7430504 - DNA, 22 bp, Homo sapiens
tcacccaggctggagtgtagtg

SEQ ID NO: 7430505 - DNA, 22 bp, Homo sapiens
tcacccaggctggagtgtagtg

SEQ ID NO: 7430506 - DNA, 22 bp, Homo sapiens
tcacccaggctggagtgtagtg

SEQ ID NO: 7430507 - DNA, 22 bp, Homo sapiens
tcacccaggctggagtgcagtg

SEQ ID NO: 7430508 - DNA, 22 bp, Homo sapiens
tcacccaggctggagtgcagtg

SEQ ID NO: 7430509 - DNA, 22 bp, Homo sapiens
tcacccaggctggagtgcagtg

SEQ ID NO: 7430510 - DNA, 22 bp, Homo sapiens
tcacccaggctggtatgcagtg

SEQ ID NO: 7430511 - DNA, 22 bp, Homo sapiens
tcacccaggctggagtgtagtg

SEQ ID NO: 7430512 - DNA, 22 bp, Homo sapiens
tcacccaggctggagtgtagtg

SEQ ID NO: 7430513 - DNA, 22 bp, Homo sapiens
tcacccaggctggtatgcagtg

SEQ ID NO: 7430514 - DNA, 22 bp, Homo sapiens
tcacccaggctggtatgcagtg

SEQ ID NO: 7430515 - DNA, 22 bp, Homo sapiens
tcacccaggctggtgcgcagtg

SEQ ID NO: 7430516 - DNA, 22 bp, Homo sapiens
tcacccaggctggtgcgcagtg

SEQ ID NO: 7430517 - DNA, 22 bp, Homo sapiens
tcacccaggatattgaagtcag

SEQ ID NO: 7430518 - DNA, 22 bp, Homo sapiens
tcacccaggatattgaagtcag

SEQ ID NO: 7430519 - DNA, 22 bp, Homo sapiens
tcacccaggatattgaagtcag

SEQ ID NO: 7430520 - DNA, 22 bp, Homo sapiens
tcacccagcgggcgcacactcg

SEQ ID NO: 7430521 - DNA, 22 bp, Homo sapiens
tcacccagcgggcgcacactcg

SEQ ID NO: 7430522 - DNA, 22 bp, Homo sapiens
tcacccagcgggcgcacactcg

SEQ ID NO: 7430523 - DNA, 22 bp, Homo sapiens
tcacccagcgggcgcacactcg

SEQ ID NO: 7430524 - DNA, 22 bp, Homo sapiens
tcacccagccttggcgggtttg

SEQ ID NO: 7430525 - DNA, 22 bp, Homo sapiens
tcacccagccttggcgggtttg

SEQ ID NO: 7430526 - DNA, 22 bp, Homo sapiens
tcacccagccttggcgggtttg

SEQ ID NO: 7430527 - DNA, 19 bp, Homo sapiens
tcacccaggctgctggctc

SEQ ID NO: 7430528 - DNA, 19 bp, Homo sapiens
tcacccaggctgctggctc

SEQ ID NO: 7430529 - DNA, 19 bp, Homo sapiens
tcacccaggctgctggctc

SEQ ID NO: 7430530 - DNA, 22 bp, Homo sapiens
tcacccaggatattgaagtcag

SEQ ID NO: 7430531 - DNA, 22 bp, Homo sapiens
tcaccagctctgcctcgccagt

SEQ ID NO: 7430532 - DNA, 19 bp, Homo sapiens
tcacccaggctgctggctc

SEQ ID NO: 7430533 - DNA, 22 bp, Homo sapiens
tcacccaggctggactgcagtg

SEQ ID NO: 7430534 - DNA, 22 bp, Homo sapiens
tcacccaggctggactgcagtg

SEQ ID NO: 7430535 - DNA, 19 bp, Homo sapiens
tcacccaggctgctggctc

SEQ ID NO: 7430536 - DNA, 22 bp, Homo sapiens
tcacccaggctggactgcagtg

SEQ ID NO: 7430537 - DNA, 22 bp, Homo sapiens
tcacccaggctggactgcagtg

SEQ ID NO: 7430538 - DNA, 22 bp, Homo sapiens
tcacccaggctggactgcagtg

SEQ ID NO: 7430539 - DNA, 22 bp, Homo sapiens
tcactagtcgcggggggaggta

SEQ ID NO: 7430540 - DNA, 23 bp, Homo sapiens
tcactagtcaagtgcctttgagt

SEQ ID NO: 7430541 - DNA, 22 bp, Homo sapiens
tcactagtcatcaacttccatt

SEQ ID NO: 7430542 - DNA, 22 bp, Homo sapiens
tcactagtcatcaacttccatt

SEQ ID NO: 7430543 - DNA, 22 bp, Homo sapiens
tcactagtggtttctggtggtt

SEQ ID NO: 7430544 - DNA, 22 bp, Homo sapiens
tcactataatatgtcaaaatac

SEQ ID NO: 7430545 - DNA, 22 bp, Homo sapiens
tcactataatatgtcaaaatac

SEQ ID NO: 7430546 - DNA, 22 bp, Homo sapiens
tcactctgacttggcctccaac

SEQ ID NO: 7430547 - DNA, 22 bp, Homo sapiens
tcactagtggaatctgggagca

SEQ ID NO: 7430548 - DNA, 22 bp, Homo sapiens
tcactagtcatcatatattttt

SEQ ID NO: 7430549 - DNA, 21 bp, Homo sapiens
tcactagtgccttctgtcatt

SEQ ID NO: 7430550 - DNA, 22 bp, Homo sapiens
tcactacctgacaatacagtat

SEQ ID NO: 7430551 - DNA, 20 bp, Homo sapiens
tcactagtaaccatctgctt

SEQ ID NO: 7430552 - DNA, 22 bp, Homo sapiens
tcactagcattgttgaaggact

SEQ ID NO: 7430553 - DNA, 22 bp, Homo sapiens
tcactacattttagacagtaaa

SEQ ID NO: 7430554 - DNA, 22 bp, Homo sapiens
tcactactgtggaacaactgat

SEQ ID NO: 7430555 - DNA, 22 bp, Homo sapiens
tcactacacaatatatttcaga

SEQ ID NO: 7430556 - DNA, 22 bp, Homo sapiens
tcactacacaatatatttcaga

SEQ ID NO: 7430557 - DNA, 22 bp, Homo sapiens
tcactacaacctccgcctcctg

SEQ ID NO: 7430558 - DNA, 22 bp, Homo sapiens
tcactacaacctccgcctcctg

SEQ ID NO: 7430559 - DNA, 20 bp, Homo sapiens
tcactctgatgctagggtgg

SEQ ID NO: 7430560 - DNA, 20 bp, Homo sapiens
tcactctgatgctagggtgg

SEQ ID NO: 7430561 - DNA, 22 bp, Homo sapiens
tcactctgatagataagctaac

SEQ ID NO: 7430562 - DNA, 21 bp, Homo sapiens
tcactctgattaggtgtctct

SEQ ID NO: 7430563 - DNA, 20 bp, Homo sapiens
tcactctgatgctagggtgg

SEQ ID NO: 7430564 - DNA, 22 bp, Homo sapiens
tcactctgagaggtcactggaa

SEQ ID NO: 7430565 - DNA, 22 bp, Homo sapiens
tcactctgagaggtcactggaa

SEQ ID NO: 7430566 - DNA, 22 bp, Homo sapiens
tcactctgcaggaaggagcagc

SEQ ID NO: 7430567 - DNA, 22 bp, Homo sapiens
tcactctgcaggaaggagcagc

SEQ ID NO: 7430568 - DNA, 22 bp, Homo sapiens
tcactctgcaggaaggagcagc

SEQ ID NO: 7430569 - DNA, 22 bp, Homo sapiens
tcactctgcctccatattacta

SEQ ID NO: 7430570 - DNA, 22 bp, Homo sapiens
tcactctgctgcccgagggctg

SEQ ID NO: 7430571 - DNA, 22 bp, Homo sapiens
tcactctgctgcccgagggctg

SEQ ID NO: 7430572 - DNA, 22 bp, Homo sapiens
tcactctggcctctgcagcagt

SEQ ID NO: 7430573 - DNA, 22 bp, Homo sapiens
tcactctggcctctgcagcagt

SEQ ID NO: 7430574 - DNA, 22 bp, Homo sapiens
tcactctggagtccgctaccag

SEQ ID NO: 7430575 - DNA, 22 bp, Homo sapiens
tcactctgctgcccgagggctg

SEQ ID NO: 7430576 - DNA, 22 bp, Homo sapiens
tcactctggagtccgctaccag

SEQ ID NO: 7430577 - DNA, 22 bp, Homo sapiens
tcaccaggattgggctgtaggc

SEQ ID NO: 7430578 - DNA, 22 bp, Homo sapiens
tcaccaggattgggctgtaggc

SEQ ID NO: 7430579 - DNA, 22 bp, Homo sapiens
tcaccaggattgggctgtaggc

SEQ ID NO: 7430580 - DNA, 22 bp, Homo sapiens
tcaccaggcaactatgtactcc

SEQ ID NO: 7430581 - DNA, 22 bp, Homo sapiens
tcaccaggattgggctgtaggc

SEQ ID NO: 7430582 - DNA, 22 bp, Homo sapiens
tcaccaggctagagtgcagtgg

SEQ ID NO: 7430583 - DNA, 22 bp, Homo sapiens
tcaccaggctagagtgcagtgg

SEQ ID NO: 7430584 - DNA, 22 bp, Homo sapiens
tcaccaggcaactatgtactcc

SEQ ID NO: 7430585 - DNA, 22 bp, Homo sapiens
tcaccaggctagagtgcagtgg

SEQ ID NO: 7430586 - DNA, 22 bp, Homo sapiens
tcacccagcagctgcttctgct

SEQ ID NO: 7430587 - DNA, 22 bp, Homo sapiens
tcacccagcagctgcttctgct

SEQ ID NO: 7430588 - DNA, 22 bp, Homo sapiens
tcaccaggattcctatcagtag

SEQ ID NO: 7430589 - DNA, 22 bp, Homo sapiens
tcaccaggattcctatcagtag

SEQ ID NO: 7430590 - DNA, 22 bp, Homo sapiens
tcaccaggactgagaccttggg

SEQ ID NO: 7430591 - DNA, 22 bp, Homo sapiens
tcaccaggactgagaccttggg

SEQ ID NO: 7430592 - DNA, 22 bp, Homo sapiens
tcaccagatctctctgtaatgg

SEQ ID NO: 7430593 - DNA, 22 bp, Homo sapiens
tcaccagatctctctgtaatgg

SEQ ID NO: 7430594 - DNA, 22 bp, Homo sapiens
tcaccagatctctctgtaatgg

SEQ ID NO: 7430595 - DNA, 22 bp, Homo sapiens
tcaccagatgatttttcttcag

SEQ ID NO: 7430596 - DNA, 22 bp, Homo sapiens
tcaccagatgatttttcttcag

SEQ ID NO: 7430597 - DNA, 22 bp, Homo sapiens
tcaccaaggcattttcacagca

SEQ ID NO: 7430598 - DNA, 22 bp, Homo sapiens
tcaccaaggcattttcacagca

SEQ ID NO: 7430599 - DNA, 22 bp, Homo sapiens
tcacattttttactggacttaa

SEQ ID NO: 7430600 - DNA, 22 bp, Homo sapiens
tcacattttttactggacttaa

SEQ ID NO: 7430601 - DNA, 22 bp, Homo sapiens
tcacattttttactggacttaa

SEQ ID NO: 7430602 - DNA, 22 bp, Homo sapiens
tcaccactcactcaggcaagtc

SEQ ID NO: 7430603 - DNA, 22 bp, Homo sapiens
tcaccactcactcaggcaagtc

SEQ ID NO: 7430604 - DNA, 22 bp, Homo sapiens
tcaccaagtccatatgcatcat

SEQ ID NO: 7430605 - DNA, 22 bp, Homo sapiens
tcaccaccagaagagctattct

SEQ ID NO: 7430606 - DNA, 23 bp, Homo sapiens
tcaccagaaggggtcaataaaga

SEQ ID NO: 7430607 - DNA, 23 bp, Homo sapiens
tcaccagaaggggtcaataaaga

SEQ ID NO: 7430608 - DNA, 23 bp, Homo sapiens
tcaccagaaggggtcaataaaga

SEQ ID NO: 7430609 - DNA, 22 bp, Homo sapiens
tcaccactgaggccacgtggct

SEQ ID NO: 7430610 - DNA, 22 bp, Homo sapiens
tcaccagacagttactgcatgt

SEQ ID NO: 7430611 - DNA, 22 bp, Homo sapiens
tcaccagacgcgtgggtctgag

SEQ ID NO: 7430612 - DNA, 22 bp, Homo sapiens
tcacattttctactactgtacg

SEQ ID NO: 7430613 - DNA, 22 bp, Homo sapiens
tcacattttctactactgtacg

SEQ ID NO: 7430614 - DNA, 22 bp, Homo sapiens
tcacattttcttaggaaactta

SEQ ID NO: 7430615 - DNA, 22 bp, Homo sapiens
tcacattttgttcaaggctagt

SEQ ID NO: 7430616 - DNA, 22 bp, Homo sapiens
tcacattttcttaggaaactta

SEQ ID NO: 7430617 - DNA, 22 bp, Homo sapiens
tcacattttgttcaaggctagt

SEQ ID NO: 7430618 - DNA, 22 bp, Homo sapiens
tcacattttcttaggaaactta

SEQ ID NO: 7430619 - DNA, 22 bp, Homo sapiens
tcacattttcttaggaaactta

SEQ ID NO: 7430620 - DNA, 22 bp, Homo sapiens
tcacattttctactactgtacg

SEQ ID NO: 7430621 - DNA, 22 bp, Homo sapiens
tcacattttctactactgtacg

SEQ ID NO: 7430622 - DNA, 22 bp, Homo sapiens
tcacattttctactactgtacg

SEQ ID NO: 7430623 - DNA, 22 bp, Homo sapiens
tcacattttctactactgtacg

SEQ ID NO: 7430624 - DNA, 22 bp, Homo sapiens
tcacattttctactactgtacg

SEQ ID NO: 7430625 - DNA, 22 bp, Homo sapiens
tcacattttcatattctctgag

SEQ ID NO: 7430626 - DNA, 22 bp, Homo sapiens
tcacattttcatattctctgag

SEQ ID NO: 7430627 - DNA, 22 bp, Homo sapiens
tcacattttcatattctctgag

SEQ ID NO: 7430628 - DNA, 22 bp, Homo sapiens
tcacattttccttggtatctgt

SEQ ID NO: 7430629 - DNA, 22 bp, Homo sapiens
tcacattttccttggtatctgt

SEQ ID NO: 7430630 - DNA, 22 bp, Homo sapiens
tcacagtagccatttcatgagt

SEQ ID NO: 7430631 - DNA, 22 bp, Homo sapiens
tcacagtagttgttctctgttt

SEQ ID NO: 7430632 - DNA, 22 bp, Homo sapiens
tcacagtagccatttcatgagt

SEQ ID NO: 7430633 - DNA, 22 bp, Homo sapiens
tcacagtagttgttctctgttt

SEQ ID NO: 7430634 - DNA, 22 bp, Homo sapiens
tcacagtataacctcatatagg

SEQ ID NO: 7430635 - DNA, 22 bp, Homo sapiens
tcacagtagttgttctctgttt

SEQ ID NO: 7430636 - DNA, 22 bp, Homo sapiens
tcacagtataacctcatatagg

SEQ ID NO: 7430637 - DNA, 22 bp, Homo sapiens
tcacagtataacctcatatagg

SEQ ID NO: 7430638 - DNA, 22 bp, Homo sapiens
tcacattttcatattctctgag

SEQ ID NO: 7430639 - DNA, 22 bp, Homo sapiens
tcacattttcaaaagctggtgc

SEQ ID NO: 7430640 - DNA, 22 bp, Homo sapiens
tcacattttatctgagattgac

SEQ ID NO: 7430641 - DNA, 22 bp, Homo sapiens
tcacattttcaaaagctggtgc

SEQ ID NO: 7430642 - DNA, 22 bp, Homo sapiens
tcacagtatagagttattttgg

SEQ ID NO: 7430643 - DNA, 22 bp, Homo sapiens
tcacagtatagagttattttgg

SEQ ID NO: 7430644 - DNA, 22 bp, Homo sapiens
tcacattttatctgagattgac

SEQ ID NO: 7430645 - DNA, 22 bp, Homo sapiens
tcacattttatctgagattgac

SEQ ID NO: 7430646 - DNA, 22 bp, Homo sapiens
tcacttttgatccctatgcagt

SEQ ID NO: 7430647 - DNA, 22 bp, Homo sapiens
tcacttttgatccctatgcagt

SEQ ID NO: 7430648 - DNA, 22 bp, Homo sapiens
tcacttttgatccctatgcagt

SEQ ID NO: 7430649 - DNA, 22 bp, Homo sapiens
tcacttttgatccctatgcagt

SEQ ID NO: 7430650 - DNA, 22 bp, Homo sapiens
tcacttttgatccctatgcagt

SEQ ID NO: 7430651 - DNA, 22 bp, Homo sapiens
tcacttttgatccctatgcagt

SEQ ID NO: 7430652 - DNA, 22 bp, Homo sapiens
tcactttttgatatcattctgc

SEQ ID NO: 7430653 - DNA, 22 bp, Homo sapiens
tcacttttgggtttccagtaga

SEQ ID NO: 7430654 - DNA, 22 bp, Homo sapiens
tcacttttgggtttccagtaga

SEQ ID NO: 7430655 - DNA, 22 bp, Homo sapiens
tcacttttgggtttccagtaga

SEQ ID NO: 7430656 - DNA, 22 bp, Homo sapiens
tcacttttgggtttccagtaga

SEQ ID NO: 7430657 - DNA, 22 bp, Homo sapiens
tcagaaaagaccacattattct

SEQ ID NO: 7430658 - DNA, 22 bp, Homo sapiens
tcagaaaagaccacattattct

SEQ ID NO: 7430659 - DNA, 22 bp, Homo sapiens
tcagaaaagaccacattattct

SEQ ID NO: 7430660 - DNA, 22 bp, Homo sapiens
tcagaaaagaccacattattct

SEQ ID NO: 7430661 - DNA, 22 bp, Homo sapiens
tcagaaaagaccacattattct

SEQ ID NO: 7430662 - DNA, 22 bp, Homo sapiens
tcagaaaagaccacattattct

SEQ ID NO: 7430663 - DNA, 22 bp, Homo sapiens
tcagaaaagaccacattattct

SEQ ID NO: 7430664 - DNA, 22 bp, Homo sapiens
tcactttttgatatcattctgc

SEQ ID NO: 7430665 - DNA, 22 bp, Homo sapiens
tcacttttgggtttccagtaga

SEQ ID NO: 7430666 - DNA, 22 bp, Homo sapiens
tcactttttgatatcattctgc

SEQ ID NO: 7430667 - DNA, 22 bp, Homo sapiens
tcactttttgatatcattctgc

SEQ ID NO: 7430668 - DNA, 22 bp, Homo sapiens
tcagaaaagactcaggggctga

SEQ ID NO: 7430669 - DNA, 22 bp, Homo sapiens
tcagaaaagactcaggggctga

SEQ ID NO: 7430670 - DNA, 22 bp, Homo sapiens
tcagaaaagagaaaatcttata

SEQ ID NO: 7430671 - DNA, 22 bp, Homo sapiens
tcagaaaagagaaaatcttata

SEQ ID NO: 7430672 - DNA, 22 bp, Homo sapiens
tcagaaaagagaaaatcttata

SEQ ID NO: 7430673 - DNA, 22 bp, Homo sapiens
tcagaaaagagaaaatcttata

SEQ ID NO: 7430674 - DNA, 22 bp, Homo sapiens
tcagaaaagagaaaatcttata

SEQ ID NO: 7430675 - DNA, 22 bp, Homo sapiens
tcagaaaagaccacattattct

SEQ ID NO: 7430676 - DNA, 22 bp, Homo sapiens
tcagaaaagaccacattattct

SEQ ID NO: 7430677 - DNA, 22 bp, Homo sapiens
tcagaaaagaccacattattct

SEQ ID NO: 7430678 - DNA, 22 bp, Homo sapiens
tcagaaaagaccacattattct

SEQ ID NO: 7430679 - DNA, 22 bp, Homo sapiens
tcagaaaagagaaaatcttata

SEQ ID NO: 7430680 - DNA, 22 bp, Homo sapiens
tcagaaaagagaaaatcttata

SEQ ID NO: 7430681 - DNA, 22 bp, Homo sapiens
tcagaaaagagaaaatcttata

SEQ ID NO: 7430682 - DNA, 22 bp, Homo sapiens
tcagaaaagagaaaatcttata

SEQ ID NO: 7430683 - DNA, 22 bp, Homo sapiens
tcagaaaagagaaaatcttata

SEQ ID NO: 7430684 - DNA, 22 bp, Homo sapiens
tcagaaaagagaaaatcttata

SEQ ID NO: 7430685 - DNA, 22 bp, Homo sapiens
tcagaaaaggtagctgtgacaa

SEQ ID NO: 7430686 - DNA, 22 bp, Homo sapiens
tcagaaaaggtagctgtgacaa

SEQ ID NO: 7430687 - DNA, 22 bp, Homo sapiens
tcagaaaaggtagctgtgacaa

SEQ ID NO: 7430688 - DNA, 22 bp, Homo sapiens
tcagaaaaggtagctgtgacaa

SEQ ID NO: 7430689 - DNA, 22 bp, Homo sapiens
tcagaaaaggtagctgtgacaa

SEQ ID NO: 7430690 - DNA, 22 bp, Homo sapiens
tcagacagattttgacacttgc

SEQ ID NO: 7430691 - DNA, 22 bp, Homo sapiens
tcagacagattttgacacttgc

SEQ ID NO: 7430692 - DNA, 22 bp, Homo sapiens
tcagaaaataactgttagtttg

SEQ ID NO: 7430693 - DNA, 22 bp, Homo sapiens
tcagacagattttgacacttgc

SEQ ID NO: 7430694 - DNA, 22 bp, Homo sapiens
tcagaaaataactgttagtttg

SEQ ID NO: 7430695 - DNA, 22 bp, Homo sapiens
tcagaaaaggtagctgtgacaa

SEQ ID NO: 7430696 - DNA, 22 bp, Homo sapiens
tcagaaaaggtagctgtgacaa

SEQ ID NO: 7430697 - DNA, 22 bp, Homo sapiens
tcagaaaaggtagctgtgacaa

SEQ ID NO: 7430698 - DNA, 22 bp, Homo sapiens
tcagacagcttgggataactga

SEQ ID NO: 7430699 - DNA, 22 bp, Homo sapiens
tcagacaggcctctccagcctc

SEQ ID NO: 7430700 - DNA, 22 bp, Homo sapiens
tcagacaggcctctccagcctc

SEQ ID NO: 7430701 - DNA, 22 bp, Homo sapiens
tcagacaggcctctccagcctc

SEQ ID NO: 7430702 - DNA, 22 bp, Homo sapiens
tcagacagcttgcagggaggtg

SEQ ID NO: 7430703 - DNA, 22 bp, Homo sapiens
tcagacagcttgggataactga

SEQ ID NO: 7430704 - DNA, 22 bp, Homo sapiens
tcagacagcttgggataactga

SEQ ID NO: 7430705 - DNA, 20 bp, Homo sapiens
tcagacagtcgcagttctgg

SEQ ID NO: 7430706 - DNA, 22 bp, Homo sapiens
tcagacagtcatcagagcttgt

SEQ ID NO: 7430707 - DNA, 22 bp, Homo sapiens
tcagacagggcttctcaaactt

SEQ ID NO: 7430708 - DNA, 22 bp, Homo sapiens
tcagacagggagtcagaaaata

SEQ ID NO: 7430709 - DNA, 22 bp, Homo sapiens
tcagacagggagtcagaaaata

SEQ ID NO: 7430710 - DNA, 22 bp, Homo sapiens
tcagacaggcttctttctccct

SEQ ID NO: 7430711 - DNA, 22 bp, Homo sapiens
tcagacaggcttctttctccct

SEQ ID NO: 7430712 - DNA, 22 bp, Homo sapiens
tcagacaggctggacagcttgc

SEQ ID NO: 7430713 - DNA, 22 bp, Homo sapiens
tcagacaggctggacagcttgc

SEQ ID NO: 7430714 - DNA, 22 bp, Homo sapiens
tcagagaaggctgagtcacggc

SEQ ID NO: 7430715 - DNA, 20 bp, Homo sapiens
tcagagaagggactgagatt

SEQ ID NO: 7430716 - DNA, 20 bp, Homo sapiens
tcagagaagggactgagatt

SEQ ID NO: 7430717 - DNA, 22 bp, Homo sapiens
tcagagaggcaatactgtttaa

SEQ ID NO: 7430718 - DNA, 22 bp, Homo sapiens
tcagagaaggctgagtcacggc

SEQ ID NO: 7430719 - DNA, 22 bp, Homo sapiens
tcagagaaggcaattttatggt

SEQ ID NO: 7430720 - DNA, 22 bp, Homo sapiens
tcagagaaggctgagtcacggc

SEQ ID NO: 7430721 - DNA, 22 bp, Homo sapiens
tcagagaaggctgagtcacggc

SEQ ID NO: 7430722 - DNA, 22 bp, Homo sapiens
tcagagaaggctgagtcacggc

SEQ ID NO: 7430723 - DNA, 22 bp, Homo sapiens
tcagagaaggcaattttatggt

SEQ ID NO: 7430724 - DNA, 22 bp, Homo sapiens
tcagagaaggaggcacgagggc

SEQ ID NO: 7430725 - DNA, 22 bp, Homo sapiens
tcagagaaggaggcacgagggc

SEQ ID NO: 7430726 - DNA, 22 bp, Homo sapiens
tcagagaaggaggcacgagggc

SEQ ID NO: 7430727 - DNA, 22 bp, Homo sapiens
tcagagaagcttaagctgtaat

SEQ ID NO: 7430728 - DNA, 20 bp, Homo sapiens
tcagagaaggagctttcctg

SEQ ID NO: 7430729 - DNA, 22 bp, Homo sapiens
tcagagaagcttaagctgtaat

SEQ ID NO: 7430730 - DNA, 22 bp, Homo sapiens
tcagagaagcttaagctgtaat

SEQ ID NO: 7430731 - DNA, 20 bp, Homo sapiens
tcagagaaggagctttcctg

SEQ ID NO: 7430732 - DNA, 20 bp, Homo sapiens
tcagagaaggagctttcctg

SEQ ID NO: 7430733 - DNA, 20 bp, Homo sapiens
tcagagaaggagctttcctg

SEQ ID NO: 7430734 - DNA, 20 bp, Homo sapiens
tcagagaaggagctttcctg

SEQ ID NO: 7430735 - DNA, 20 bp, Homo sapiens
tcagagaaggagctttcctg

SEQ ID NO: 7430736 - DNA, 20 bp, Homo sapiens
tcagagaaggagctttcctg

SEQ ID NO: 7430737 - DNA, 20 bp, Homo sapiens
tcagagaaggagctttcctg

SEQ ID NO: 7430738 - DNA, 22 bp, Homo sapiens
tcagagaaggaggcacgagggc

SEQ ID NO: 7430739 - DNA, 22 bp, Homo sapiens
tcagagaaggaggcacgagggc

SEQ ID NO: 7430740 - DNA, 22 bp, Homo sapiens
tcagagaaggaggcacgagggc

SEQ ID NO: 7430741 - DNA, 22 bp, Homo sapiens
tcagagaagacatcattgtgaa

SEQ ID NO: 7430742 - DNA, 22 bp, Homo sapiens
tcagagaagacatcattgtgaa

SEQ ID NO: 7430743 - DNA, 22 bp, Homo sapiens
tcagagaactggcatgtttaga

SEQ ID NO: 7430744 - DNA, 22 bp, Homo sapiens
tcagagaactggcatgtttaga

SEQ ID NO: 7430745 - DNA, 22 bp, Homo sapiens
tcagagaactggcatgtttaga

SEQ ID NO: 7430746 - DNA, 22 bp, Homo sapiens
tcagagaactggcatgtttaga

SEQ ID NO: 7430747 - DNA, 22 bp, Homo sapiens
tcagagaactggcatgtttaga

SEQ ID NO: 7430748 - DNA, 22 bp, Homo sapiens
tcagagaactgcagcccttcct

SEQ ID NO: 7430749 - DNA, 22 bp, Homo sapiens
tcagagaactgcagcccttcct

SEQ ID NO: 7430750 - DNA, 22 bp, Homo sapiens
tcagagaactgcagcccttcct

SEQ ID NO: 7430751 - DNA, 22 bp, Homo sapiens
tcagagaactgcagcccttcct

SEQ ID NO: 7430752 - DNA, 22 bp, Homo sapiens
tcagagaactgcagcccttcct

SEQ ID NO: 7430753 - DNA, 23 bp, Homo sapiens
tcagagaactcgggcagatgacc

SEQ ID NO: 7430754 - DNA, 23 bp, Homo sapiens
tcagagaactcgggcagatgacc

SEQ ID NO: 7430755 - DNA, 22 bp, Homo sapiens
tcagagaagctgccaggcgagc

SEQ ID NO: 7430756 - DNA, 22 bp, Homo sapiens
tcagagaagctgccaggcgagc

SEQ ID NO: 7430757 - DNA, 22 bp, Homo sapiens
tcagagaagctgccaggcgagc

SEQ ID NO: 7430758 - DNA, 22 bp, Homo sapiens
tcagagaagctgccaggcgagc

SEQ ID NO: 7430759 - DNA, 22 bp, Homo sapiens
tcagagaagacatcattgtgaa

SEQ ID NO: 7430760 - DNA, 22 bp, Homo sapiens
tcagagaagacatcattgtgaa

SEQ ID NO: 7430761 - DNA, 22 bp, Homo sapiens
tcagagaagctgccaggcgagc

SEQ ID NO: 7430762 - DNA, 22 bp, Homo sapiens
tcagagaagctgccaggcgagc

SEQ ID NO: 7430763 - DNA, 22 bp, Homo sapiens
tcagagaagcttaagctgtaat

SEQ ID NO: 7430764 - DNA, 22 bp, Homo sapiens
tcagagaagcttaagctgtaat

SEQ ID NO: 7430765 - DNA, 22 bp, Homo sapiens
tcagagaagcttaagctgtaat

SEQ ID NO: 7430766 - DNA, 21 bp, Homo sapiens
tcagagaacccggcaggcaag

SEQ ID NO: 7430767 - DNA, 22 bp, Homo sapiens
tcagaccttgtcgtcacttaga

SEQ ID NO: 7430768 - DNA, 22 bp, Homo sapiens
tcagagaactccacaccttagg

SEQ ID NO: 7430769 - DNA, 22 bp, Homo sapiens
tcagagaactccacaccttagg

SEQ ID NO: 7430770 - DNA, 22 bp, Homo sapiens
tcagagaactccacaccttagg

SEQ ID NO: 7430771 - DNA, 22 bp, Homo sapiens
tcagagaactccacaccttagg

SEQ ID NO: 7430772 - DNA, 23 bp, Homo sapiens
tcagagaactcgggcagatgacc

SEQ ID NO: 7430773 - DNA, 23 bp, Homo sapiens
tcagagaactcgggcagatgacc

SEQ ID NO: 7430774 - DNA, 23 bp, Homo sapiens
tcagagaactcgggcagatgacc

SEQ ID NO: 7430775 - DNA, 23 bp, Homo sapiens
tcagagaactcgggcagatgacc

SEQ ID NO: 7430776 - DNA, 23 bp, Homo sapiens
tcagagaactcgggcagatgacc

SEQ ID NO: 7430777 - DNA, 23 bp, Homo sapiens
tcagagaactcgggcagatgacc

SEQ ID NO: 7430778 - DNA, 22 bp, Homo sapiens
tcagagaactccacaccttagg

SEQ ID NO: 7430779 - DNA, 22 bp, Homo sapiens
tcagagaactccacaccttagg

SEQ ID NO: 7430780 - DNA, 22 bp, Homo sapiens
tcagacctctgaccttgccaaa

SEQ ID NO: 7430781 - DNA, 22 bp, Homo sapiens
tcagacctctgaccttgccaaa

SEQ ID NO: 7430782 - DNA, 22 bp, Homo sapiens
tcagacctggccgcctccatcc

SEQ ID NO: 7430783 - DNA, 17 bp, Homo sapiens
tcagaccctgtgtcagg

SEQ ID NO: 7430784 - DNA, 22 bp, Homo sapiens
tcagacctctgaccttgccaaa

SEQ ID NO: 7430785 - DNA, 22 bp, Homo sapiens
tcagaccatcctgctgttagtg

SEQ ID NO: 7430786 - DNA, 20 bp, Homo sapiens
tcagacccagattagcaggt

SEQ ID NO: 7430787 - DNA, 22 bp, Homo sapiens
tcagacccaggtgccaagctgt

SEQ ID NO: 7430788 - DNA, 20 bp, Homo sapiens
tcagaccctacattcctcag

SEQ ID NO: 7430789 - DNA, 22 bp, Homo sapiens
tcagaccctgcggtgtttggat

SEQ ID NO: 7430790 - DNA, 22 bp, Homo sapiens
tcagacatatttttaacaaagt

SEQ ID NO: 7430791 - DNA, 22 bp, Homo sapiens
tcagacatatttttaacaaagt

SEQ ID NO: 7430792 - DNA, 22 bp, Homo sapiens
tcagacatctcataatgtatta

SEQ ID NO: 7430793 - DNA, 22 bp, Homo sapiens
tcagacattattttcaagataa

SEQ ID NO: 7430794 - DNA, 22 bp, Homo sapiens
tcagacatggggagagagacct

SEQ ID NO: 7430795 - DNA, 22 bp, Homo sapiens
tcagacatgggatatgaagctc

SEQ ID NO: 7430796 - DNA, 22 bp, Homo sapiens
tcagacatgggatatgaagctc

SEQ ID NO: 7430797 - DNA, 22 bp, Homo sapiens
tcagacagtgtgatcagtctct

SEQ ID NO: 7430798 - DNA, 22 bp, Homo sapiens
tcagacagtgtgatcagtctct

SEQ ID NO: 7430799 - DNA, 22 bp, Homo sapiens
tcagacagtttgcagtgtgcct

SEQ ID NO: 7430800 - DNA, 22 bp, Homo sapiens
tcagaggaaagggaacatagtc

SEQ ID NO: 7430801 - DNA, 22 bp, Homo sapiens
tcagaggaaagggaacatagtc

SEQ ID NO: 7430802 - DNA, 22 bp, Homo sapiens
tcagaggaaagggaacatagtc

SEQ ID NO: 7430803 - DNA, 22 bp, Homo sapiens
tcagaggaaagggaacatagtc

SEQ ID NO: 7430804 - DNA, 22 bp, Homo sapiens
tcagaggaaaggtcagatggct

SEQ ID NO: 7430805 - DNA, 22 bp, Homo sapiens
tcagaggaaaggtcagatggct

SEQ ID NO: 7430806 - DNA, 22 bp, Homo sapiens
tcagaggaaagggaacatagtc

SEQ ID NO: 7430807 - DNA, 22 bp, Homo sapiens
tcagaggaaacaatctttagta

SEQ ID NO: 7430808 - DNA, 22 bp, Homo sapiens
tcagaggaaagggaacatagtc

SEQ ID NO: 7430809 - DNA, 22 bp, Homo sapiens
tcagaggaaagggaacatagtc

SEQ ID NO: 7430810 - DNA, 22 bp, Homo sapiens
tcagaggaaacaatctttagta

SEQ ID NO: 7430811 - DNA, 22 bp, Homo sapiens
tcagaggaacactgtttcatgc

SEQ ID NO: 7430812 - DNA, 22 bp, Homo sapiens
tcagaggaaaggtcagatggct

SEQ ID NO: 7430813 - DNA, 22 bp, Homo sapiens
tcagaggaacactgtttcatgc

SEQ ID NO: 7430814 - DNA, 22 bp, Homo sapiens
tcagaggaacactgtttcatgc

SEQ ID NO: 7430815 - DNA, 22 bp, Homo sapiens
tcagaggaaaggtcagatggct

SEQ ID NO: 7430816 - DNA, 22 bp, Homo sapiens
tcagaggaaaggtcagatggct

SEQ ID NO: 7430817 - DNA, 22 bp, Homo sapiens
tcagaggaaagggaacatagtc

SEQ ID NO: 7430818 - DNA, 22 bp, Homo sapiens
tcagaggaaaggtcagatggct

SEQ ID NO: 7430819 - DNA, 22 bp, Homo sapiens
tcagaggaaaggtcagatggct

SEQ ID NO: 7430820 - DNA, 22 bp, Homo sapiens
tcagaggaaaggtcagatggct

SEQ ID NO: 7430821 - DNA, 22 bp, Homo sapiens
tcagaggaaaggtcagatggct

SEQ ID NO: 7430822 - DNA, 22 bp, Homo sapiens
tcagaggaactggactaaagcc

SEQ ID NO: 7430823 - DNA, 22 bp, Homo sapiens
tcagaggaactggactaaagcc

SEQ ID NO: 7430824 - DNA, 22 bp, Homo sapiens
tcagaggaactggactaaagcc

SEQ ID NO: 7430825 - DNA, 22 bp, Homo sapiens
tcagaggaagcatcaagttctc

SEQ ID NO: 7430826 - DNA, 22 bp, Homo sapiens
tcagaggaactggactaaagcc

SEQ ID NO: 7430827 - DNA, 22 bp, Homo sapiens
tcagaggaactggactaaagcc

SEQ ID NO: 7430828 - DNA, 22 bp, Homo sapiens
tcagaggaactggactaaagcc

SEQ ID NO: 7430829 - DNA, 22 bp, Homo sapiens
tcagaggaagccttggtgggag

SEQ ID NO: 7430830 - DNA, 22 bp, Homo sapiens
tcagaggaagccttggtgggag

SEQ ID NO: 7430831 - DNA, 22 bp, Homo sapiens
tcagaggaagccttggtgggag

SEQ ID NO: 7430832 - DNA, 22 bp, Homo sapiens
tcagaggaagcatcaagttctc

SEQ ID NO: 7430833 - DNA, 22 bp, Homo sapiens
tcagcaagcagggggatgttca

SEQ ID NO: 7430834 - DNA, 22 bp, Homo sapiens
tcagcaagcagggggatgttca

SEQ ID NO: 7430835 - DNA, 22 bp, Homo sapiens
tcagcaagtggaccatcctggg

SEQ ID NO: 7430836 - DNA, 22 bp, Homo sapiens
tcagcaagtggaccatcctggg

SEQ ID NO: 7430837 - DNA, 22 bp, Homo sapiens
tcagcaagtggaccatcctggg

SEQ ID NO: 7430838 - DNA, 22 bp, Homo sapiens
tcagcaagtattttctgaatgc

SEQ ID NO: 7430839 - DNA, 22 bp, Homo sapiens
tcagcaagtattttctgaatgc

SEQ ID NO: 7430840 - DNA, 22 bp, Homo sapiens
tcagcaaggctgcattctcatc

SEQ ID NO: 7430841 - DNA, 22 bp, Homo sapiens
tcagcaaggcagaagggaggta

SEQ ID NO: 7430842 - DNA, 22 bp, Homo sapiens
tcagcactgtcttttatttgaa

SEQ ID NO: 7430843 - DNA, 22 bp, Homo sapiens
tcagcactgtcttttatttgaa

SEQ ID NO: 7430844 - DNA, 22 bp, Homo sapiens
tcagcactgtgtccagtctccc

SEQ ID NO: 7430845 - DNA, 22 bp, Homo sapiens
tcagcactgtctattagtgaga

SEQ ID NO: 7430846 - DNA, 22 bp, Homo sapiens
tcagcacttactagtggccttt

SEQ ID NO: 7430847 - DNA, 22 bp, Homo sapiens
tcagcacttggatttcagagat

SEQ ID NO: 7430848 - DNA, 22 bp, Homo sapiens
tcagcacttactagtggccttt

SEQ ID NO: 7430849 - DNA, 22 bp, Homo sapiens
tcagcactgtgtccagtctccc

SEQ ID NO: 7430850 - DNA, 22 bp, Homo sapiens
tcagcactgtgtccagtctccc

SEQ ID NO: 7430851 - DNA, 22 bp, Homo sapiens
tcagcactgtgtccagtctccc

SEQ ID NO: 7430852 - DNA, 22 bp, Homo sapiens
tcagcactggcgctgggcaggt

SEQ ID NO: 7430853 - DNA, 22 bp, Homo sapiens
tcagcactggcgctgggcaggt

SEQ ID NO: 7430854 - DNA, 22 bp, Homo sapiens
tcagcactggcgctgggcaggt

SEQ ID NO: 7430855 - DNA, 22 bp, Homo sapiens
tcagcactgatgtttcagaaga

SEQ ID NO: 7430856 - DNA, 22 bp, Homo sapiens
tcagcactgatgtttcagaaga

SEQ ID NO: 7430857 - DNA, 22 bp, Homo sapiens
tcagcactgatgtttcagaaga

SEQ ID NO: 7430858 - DNA, 22 bp, Homo sapiens
tcagcactgatagaagtcaata

SEQ ID NO: 7430859 - DNA, 22 bp, Homo sapiens
tcagcactgaaattcttcacat

SEQ ID NO: 7430860 - DNA, 22 bp, Homo sapiens
tcagcactgatagaagtcaata

SEQ ID NO: 7430861 - DNA, 22 bp, Homo sapiens
tcagcactgatagaagtcaata

SEQ ID NO: 7430862 - DNA, 22 bp, Homo sapiens
tcagcactgaaattcttcacat

SEQ ID NO: 7430863 - DNA, 22 bp, Homo sapiens
tcagcactgaatctggatttgc

SEQ ID NO: 7430864 - DNA, 22 bp, Homo sapiens
tcagcaccagttatcctcaggg

SEQ ID NO: 7430865 - DNA, 22 bp, Homo sapiens
tcagcaccagttatcctcaggg

SEQ ID NO: 7430866 - DNA, 22 bp, Homo sapiens
tcagcacaggtcttgcaaaaca

SEQ ID NO: 7430867 - DNA, 22 bp, Homo sapiens
tcagcaccagttatcctcaggg

SEQ ID NO: 7430868 - DNA, 22 bp, Homo sapiens
tcagcaccagttatcctcaggg

SEQ ID NO: 7430869 - DNA, 22 bp, Homo sapiens
tcagcactcgctacctagtaaa

SEQ ID NO: 7430870 - DNA, 22 bp, Homo sapiens
tcagcactcgctacctagtaaa

SEQ ID NO: 7430871 - DNA, 22 bp, Homo sapiens
tcagcactatacattttgaata

SEQ ID NO: 7430872 - DNA, 22 bp, Homo sapiens
tcagcaccagttatcctcaggg

SEQ ID NO: 7430873 - DNA, 22 bp, Homo sapiens
tcagcaatatgataggctttgt

SEQ ID NO: 7430874 - DNA, 22 bp, Homo sapiens
tcagcaatgagaactggcattt

SEQ ID NO: 7430875 - DNA, 22 bp, Homo sapiens
tcagcaatgtgatactgtgcaa

SEQ ID NO: 7430876 - DNA, 20 bp, Homo sapiens
tcagcacagctgacaaggtt

SEQ ID NO: 7430877 - DNA, 20 bp, Homo sapiens
tcagcacagctgacaaggtt

SEQ ID NO: 7430878 - DNA, 22 bp, Homo sapiens
tcagcacaggtcttgcaaaaca

SEQ ID NO: 7430879 - DNA, 22 bp, Homo sapiens
tcagcacaggtcttgcaaaaca

SEQ ID NO: 7430880 - DNA, 22 bp, Homo sapiens
tcagcacaggtcttgcaaaaca

SEQ ID NO: 7430881 - DNA, 22 bp, Homo sapiens
tcagcaatgtgatactgtgcaa

SEQ ID NO: 7430882 - DNA, 22 bp, Homo sapiens
tcagcaagtggaccatcctggg

SEQ ID NO: 7430883 - DNA, 22 bp, Homo sapiens
tcagagccctgctcctccccaa

SEQ ID NO: 7430884 - DNA, 22 bp, Homo sapiens
tcagagctaaggggagagcaaa

SEQ ID NO: 7430885 - DNA, 22 bp, Homo sapiens
tcagagcccctccgctgtccca

SEQ ID NO: 7430886 - DNA, 22 bp, Homo sapiens
tcagagctaaggggagagcaaa

SEQ ID NO: 7430887 - DNA, 22 bp, Homo sapiens
tcagagccaatcatggtgcatt

SEQ ID NO: 7430888 - DNA, 22 bp, Homo sapiens
tcagagctaaggggagagcaaa

SEQ ID NO: 7430889 - DNA, 22 bp, Homo sapiens
tcagagctcatgagcagagcca

SEQ ID NO: 7430890 - DNA, 22 bp, Homo sapiens
tcagagctcatgagcagagcca

SEQ ID NO: 7430891 - DNA, 22 bp, Homo sapiens
tcagagctcatgagcagagcca

SEQ ID NO: 7430892 - DNA, 22 bp, Homo sapiens
tcagagctaaggggagagcaaa

SEQ ID NO: 7430893 - DNA, 22 bp, Homo sapiens
tcagagctaaggggagagcaaa

SEQ ID NO: 7430894 - DNA, 22 bp, Homo sapiens
tcagagctcctaagggctgatt

SEQ ID NO: 7430895 - DNA, 22 bp, Homo sapiens
tcagagctcctaagggctgatt

SEQ ID NO: 7430896 - DNA, 22 bp, Homo sapiens
tcagagctcctaagggctgatt

SEQ ID NO: 7430897 - DNA, 22 bp, Homo sapiens
tcagagctcatgagcagagcca

SEQ ID NO: 7430898 - DNA, 22 bp, Homo sapiens
tcagagcttcacctgttacatt

SEQ ID NO: 7430899 - DNA, 22 bp, Homo sapiens
tcagagcttcacctgttacatt

SEQ ID NO: 7430900 - DNA, 22 bp, Homo sapiens
tcagaggaaacaatctttagta

SEQ ID NO: 7430901 - DNA, 22 bp, Homo sapiens
tcagagctttggagaccaggaa

SEQ ID NO: 7430902 - DNA, 22 bp, Homo sapiens
tcagagctttggagaccaggaa

SEQ ID NO: 7430903 - DNA, 22 bp, Homo sapiens
tcagagcttatctcttgctgga

SEQ ID NO: 7430904 - DNA, 22 bp, Homo sapiens
tcagagcttatctcttgctgga

SEQ ID NO: 7430905 - DNA, 22 bp, Homo sapiens
tcagagctgtgcttcaggaaag

SEQ ID NO: 7430906 - DNA, 22 bp, Homo sapiens
tcagagctgggtgcttcttcct

SEQ ID NO: 7430907 - DNA, 22 bp, Homo sapiens
tcagagctgggtgcttcttcct

SEQ ID NO: 7430908 - DNA, 22 bp, Homo sapiens
tcagagctgcccatgcaagggg

SEQ ID NO: 7430909 - DNA, 22 bp, Homo sapiens
tcagagctgcccatgcaagggg

SEQ ID NO: 7430910 - DNA, 22 bp, Homo sapiens
tcagagctcctaagggctgatt

SEQ ID NO: 7430911 - DNA, 22 bp, Homo sapiens
tcagagccaatcatggtgcatt

SEQ ID NO: 7430912 - DNA, 22 bp, Homo sapiens
tcagagcattcgggtgacaaat

SEQ ID NO: 7430913 - DNA, 22 bp, Homo sapiens
tcagagccaatcatggtgcatt

SEQ ID NO: 7430914 - DNA, 22 bp, Homo sapiens
tcagagcattcgggtgacaaat

SEQ ID NO: 7430915 - DNA, 22 bp, Homo sapiens
tcagagcattcgggtgacaaat

SEQ ID NO: 7430916 - DNA, 22 bp, Homo sapiens
tcagagcattcgggtgacaaat

SEQ ID NO: 7430917 - DNA, 22 bp, Homo sapiens
tcagagcattcgggtgacaaat

SEQ ID NO: 7430918 - DNA, 22 bp, Homo sapiens
tcagagcattagaggtttgtat

SEQ ID NO: 7430919 - DNA, 22 bp, Homo sapiens
tcagagcattagaggtttgtat

SEQ ID NO: 7430920 - DNA, 22 bp, Homo sapiens
tcagagcatgtgggctgcagtt

SEQ ID NO: 7430921 - DNA, 22 bp, Homo sapiens
tcagagcacttggctcatggca

SEQ ID NO: 7430922 - DNA, 22 bp, Homo sapiens
tcagagcagactttgaaggagg

SEQ ID NO: 7430923 - DNA, 22 bp, Homo sapiens
tcagagcagactttgaaggagg

SEQ ID NO: 7430924 - DNA, 22 bp, Homo sapiens
tcagagcagcattttacaggat

SEQ ID NO: 7430925 - DNA, 22 bp, Homo sapiens
tcagagcagcattttacaggat

SEQ ID NO: 7430926 - DNA, 22 bp, Homo sapiens
tcagagcagcattttacaggat

SEQ ID NO: 7430927 - DNA, 20 bp, Homo sapiens
tcagagcagttggcttgtct

SEQ ID NO: 7430928 - DNA, 20 bp, Homo sapiens
tcagagcagttggcttgtct

SEQ ID NO: 7430929 - DNA, 20 bp, Homo sapiens
tcagagcagttggcttgtct

SEQ ID NO: 7430930 - DNA, 20 bp, Homo sapiens
tcagagcagttggcttgtct

SEQ ID NO: 7430931 - DNA, 20 bp, Homo sapiens
tcagagcagttggcttgtct

SEQ ID NO: 7430932 - DNA, 22 bp, Homo sapiens
tcagagcatgtgggctgcagtt

SEQ ID NO: 7430933 - DNA, 22 bp, Homo sapiens
tcagagcatgtgggctgcagtt

SEQ ID NO: 7430934 - DNA, 22 bp, Homo sapiens
tcagagcactggtgctaccttg

SEQ ID NO: 7430935 - DNA, 22 bp, Homo sapiens
tcagagcaccacacagttccct

SEQ ID NO: 7430936 - DNA, 22 bp, Homo sapiens
tcagagcactggtgctaccttg

SEQ ID NO: 7430937 - DNA, 22 bp, Homo sapiens
tcagagcactggtgctaccttg

SEQ ID NO: 7430938 - DNA, 22 bp, Homo sapiens
tcagagaggttggtgataagaa

SEQ ID NO: 7430939 - DNA, 22 bp, Homo sapiens
tcagagaggttggtgataagaa

SEQ ID NO: 7430940 - DNA, 22 bp, Homo sapiens
tcagagcaccacacagttccct

SEQ ID NO: 7430941 - DNA, 22 bp, Homo sapiens
tcagagaggttggtgataagaa

SEQ ID NO: 7430942 - DNA, 23 bp, Homo sapiens
tcagagaggccccctgcagagat

SEQ ID NO: 7430943 - DNA, 23 bp, Homo sapiens
tcagagaggccccctgcagagat

SEQ ID NO: 7430944 - DNA, 23 bp, Homo sapiens
tcagagaggccccctgcagagat

SEQ ID NO: 7430945 - DNA, 23 bp, Homo sapiens
tcagagaggccccctgcagagat

SEQ ID NO: 7430946 - DNA, 23 bp, Homo sapiens
tcagagaggccccctgcagagat

SEQ ID NO: 7430947 - DNA, 23 bp, Homo sapiens
tcagagaggccccctgcagagat

SEQ ID NO: 7430948 - DNA, 23 bp, Homo sapiens
tcagagaggccccctgcagagat

SEQ ID NO: 7430949 - DNA, 22 bp, Homo sapiens
tatttctgtatgcataaaagga

SEQ ID NO: 7430950 - DNA, 22 bp, Homo sapiens
tatttctgtcagccagatatgg

SEQ ID NO: 7430951 - DNA, 22 bp, Homo sapiens
tatttctgtcagccagatatgg

SEQ ID NO: 7430952 - DNA, 22 bp, Homo sapiens
tatttctgtaactcagggtctg

SEQ ID NO: 7430953 - DNA, 22 bp, Homo sapiens
tatttctgtaactcagggtctg

SEQ ID NO: 7430954 - DNA, 22 bp, Homo sapiens
tatttctgtatgcataaaagga

SEQ ID NO: 7430955 - DNA, 22 bp, Homo sapiens
tatttctgtatgcataaaagga

SEQ ID NO: 7430956 - DNA, 22 bp, Homo sapiens
tatttctgtatgcataaaagga

SEQ ID NO: 7430957 - DNA, 22 bp, Homo sapiens
tatttctgtcagccagatatgg

SEQ ID NO: 7430958 - DNA, 22 bp, Homo sapiens
tatttctgtttatttgtacatc

SEQ ID NO: 7430959 - DNA, 22 bp, Homo sapiens
tatttctgtttatttgtacatc

SEQ ID NO: 7430960 - DNA, 22 bp, Homo sapiens
tatttctgtttatttgtacatc

SEQ ID NO: 7430961 - DNA, 22 bp, Homo sapiens
tatttcttcgggattcaagcta

SEQ ID NO: 7430962 - DNA, 22 bp, Homo sapiens
tatttcttcgggattcaagcta

SEQ ID NO: 7430963 - DNA, 22 bp, Homo sapiens
tatttctgtttatttgtacatc

SEQ ID NO: 7430964 - DNA, 22 bp, Homo sapiens
tatttctgtttatttgtacatc

SEQ ID NO: 7430965 - DNA, 22 bp, Homo sapiens
tatttctgggagttcagaaatt

SEQ ID NO: 7430966 - DNA, 22 bp, Homo sapiens
tatttctgggagttcagaaatt

SEQ ID NO: 7430967 - DNA, 20 bp, Homo sapiens
tatttctgggcaaccattta

SEQ ID NO: 7430968 - DNA, 20 bp, Homo sapiens
tatttctgggcaaccattta

SEQ ID NO: 7430969 - DNA, 20 bp, Homo sapiens
tatttctgggcaaccattta

SEQ ID NO: 7430970 - DNA, 20 bp, Homo sapiens
tatttctgggcaaccattta

SEQ ID NO: 7430971 - DNA, 20 bp, Homo sapiens
tatttctgggcaaccattta

SEQ ID NO: 7430972 - DNA, 20 bp, Homo sapiens
tatttctgggcaaccattta

SEQ ID NO: 7430973 - DNA, 22 bp, Homo sapiens
tatttctgattgctcatgaggc

SEQ ID NO: 7430974 - DNA, 22 bp, Homo sapiens
tatttctggctttgagggtgat

SEQ ID NO: 7430975 - DNA, 22 bp, Homo sapiens
tatttctgggagttcagaaatt

SEQ ID NO: 7430976 - DNA, 22 bp, Homo sapiens
tatttctgggagttcagaaatt

SEQ ID NO: 7430977 - DNA, 22 bp, Homo sapiens
tatttctgattgctcatgaggc

SEQ ID NO: 7430978 - DNA, 22 bp, Homo sapiens
tatttctgaggcccaggaagtg

SEQ ID NO: 7430979 - DNA, 22 bp, Homo sapiens
tatttctgattgctcatgaggc

SEQ ID NO: 7430980 - DNA, 22 bp, Homo sapiens
tatttctgaggcccaggaagtg

SEQ ID NO: 7430981 - DNA, 22 bp, Homo sapiens
tatttctgagaaccaacttacc

SEQ ID NO: 7430982 - DNA, 22 bp, Homo sapiens
tatttctgaggcccaggaagtg

SEQ ID NO: 7430983 - DNA, 22 bp, Homo sapiens
tatttcttcgggattcaagcta

SEQ ID NO: 7430984 - DNA, 22 bp, Homo sapiens
tatttcttcgggattcaagcta

SEQ ID NO: 7430985 - DNA, 22 bp, Homo sapiens
tatttcttcgggattcaagcta

SEQ ID NO: 7430986 - DNA, 22 bp, Homo sapiens
tatttcttcgggattcaagcta

SEQ ID NO: 7430987 - DNA, 22 bp, Homo sapiens
tatttcttcgggattcaagcta

SEQ ID NO: 7430988 - DNA, 22 bp, Homo sapiens
tatttcttcgggattcaagcta

SEQ ID NO: 7430989 - DNA, 22 bp, Homo sapiens
tatttcttgagactcgtcttcc

SEQ ID NO: 7430990 - DNA, 22 bp, Homo sapiens
tatttcttgagactcgtcttcc

SEQ ID NO: 7430991 - DNA, 22 bp, Homo sapiens
tatttcttgagactcgtcttcc

SEQ ID NO: 7430992 - DNA, 22 bp, Homo sapiens
tatttcttgagactcgtcttcc

SEQ ID NO: 7430993 - DNA, 22 bp, Homo sapiens
tatttcttgagactcgtcttcc

SEQ ID NO: 7430994 - DNA, 22 bp, Homo sapiens
tatttcttcgggattcaagcta

SEQ ID NO: 7430995 - DNA, 22 bp, Homo sapiens
tatttcttgagactcgtcttcc

SEQ ID NO: 7430996 - DNA, 22 bp, Homo sapiens
tatttcttgagactcgtcttcc

SEQ ID NO: 7430997 - DNA, 22 bp, Homo sapiens
tatttcttgagactcgtcttcc

SEQ ID NO: 7430998 - DNA, 22 bp, Homo sapiens
tatttcttgagactcgtcttcc

SEQ ID NO: 7430999 - DNA, 22 bp, Homo sapiens
tatttcttgagtggtcagtttc

SEQ ID NO: 7431000 - DNA, 22 bp, Homo sapiens
tatttcttgagtggtcagtttc

SEQ ID NO: 7431001 - DNA, 22 bp, Homo sapiens
tcaagaaggagttatttattca

SEQ ID NO: 7431002 - DNA, 22 bp, Homo sapiens
tcaagaaggagttatttattca

SEQ ID NO: 7431003 - DNA, 22 bp, Homo sapiens
tcaagaagtctgtaccatttga

SEQ ID NO: 7431004 - DNA, 22 bp, Homo sapiens
tcaagaaggagttatttattca

SEQ ID NO: 7431005 - DNA, 22 bp, Homo sapiens
tatttcttgagtggtcagtttc

SEQ ID NO: 7431006 - DNA, 22 bp, Homo sapiens
tatttcttgagtggtcagtttc

SEQ ID NO: 7431007 - DNA, 22 bp, Homo sapiens
tatttcttgagtggtcagtttc

SEQ ID NO: 7431008 - DNA, 22 bp, Homo sapiens
tatttcttgagtggtcagtttc

SEQ ID NO: 7431009 - DNA, 22 bp, Homo sapiens
tatttcttgagtggtcagtttc

SEQ ID NO: 7431010 - DNA, 20 bp, Homo sapiens
tcaagacagacatggagttt

SEQ ID NO: 7431011 - DNA, 22 bp, Homo sapiens
tcaagaatttttaatgtgactg

SEQ ID NO: 7431012 - DNA, 22 bp, Homo sapiens
tcaagaatagctgcaaacaggg

SEQ ID NO: 7431013 - DNA, 22 bp, Homo sapiens
tcaagaagtctgtaccatttga

SEQ ID NO: 7431014 - DNA, 22 bp, Homo sapiens
tcaagaatttggataagaaatg

SEQ ID NO: 7431015 - DNA, 18 bp, Homo sapiens
tcaagacatcatgaaata

SEQ ID NO: 7431016 - DNA, 18 bp, Homo sapiens
tcaagacatcatgaaata

SEQ ID NO: 7431017 - DNA, 22 bp, Homo sapiens
tcaagacatcactgtgcatttt

SEQ ID NO: 7431018 - DNA, 22 bp, Homo sapiens
tcaagacatattaaatgtgcga

SEQ ID NO: 7431019 - DNA, 22 bp, Homo sapiens
tcaagacatcactgtgcatttt

SEQ ID NO: 7431020 - DNA, 22 bp, Homo sapiens
tcaagacagtgtgatactggcc

SEQ ID NO: 7431021 - DNA, 22 bp, Homo sapiens
tcaagacagtgtgatactggcc

SEQ ID NO: 7431022 - DNA, 22 bp, Homo sapiens
tcaagacatattaaatgtgcga

SEQ ID NO: 7431023 - DNA, 22 bp, Homo sapiens
tcaagacatattaaatgtgcga

SEQ ID NO: 7431024 - DNA, 22 bp, Homo sapiens
tcaagacagtgtgatactggcc

SEQ ID NO: 7431025 - DNA, 22 bp, Homo sapiens
tcaagacagtgtgatactggcc

SEQ ID NO: 7431026 - DNA, 22 bp, Homo sapiens
tcaagacagggtttaaggttga

SEQ ID NO: 7431027 - DNA, 22 bp, Homo sapiens
tcaagacagggtttaaggttga

SEQ ID NO: 7431028 - DNA, 21 bp, Homo sapiens
tcaagacagcatatttaagaa

SEQ ID NO: 7431029 - DNA, 21 bp, Homo sapiens
tcaagacagcatatttaagaa

SEQ ID NO: 7431030 - DNA, 22 bp, Homo sapiens
tcaagacagatgggtaacttgg

SEQ ID NO: 7431031 - DNA, 22 bp, Homo sapiens
tcaagacagatgggtaacttgg

SEQ ID NO: 7431032 - DNA, 22 bp, Homo sapiens
tcaagacagatgggtaacttgg

SEQ ID NO: 7431033 - DNA, 22 bp, Homo sapiens
tcaagagacaggacgtgtttca

SEQ ID NO: 7431034 - DNA, 22 bp, Homo sapiens
tcaagagaagtgctccacagta

SEQ ID NO: 7431035 - DNA, 22 bp, Homo sapiens
tcaagagaaggggaaatagact

SEQ ID NO: 7431036 - DNA, 18 bp, Homo sapiens
tcaagacatcatgaaata

SEQ ID NO: 7431037 - DNA, 18 bp, Homo sapiens
tcaagacatcatgaaata

SEQ ID NO: 7431038 - DNA, 18 bp, Homo sapiens
tcaagacatcatgaaata

SEQ ID NO: 7431039 - DNA, 18 bp, Homo sapiens
tcaagacatcatgaaata

SEQ ID NO: 7431040 - DNA, 22 bp, Homo sapiens
tcaagagattgaataataactg

SEQ ID NO: 7431041 - DNA, 22 bp, Homo sapiens
tcaagagcatgtatctccctaa

SEQ ID NO: 7431042 - DNA, 22 bp, Homo sapiens
tcaagagcatgtatctccctaa

SEQ ID NO: 7431043 - DNA, 22 bp, Homo sapiens
tcaagagccaggtaagcacagg

SEQ ID NO: 7431044 - DNA, 22 bp, Homo sapiens
tcaagagccaggtaagcacagg

SEQ ID NO: 7431045 - DNA, 22 bp, Homo sapiens
tcaagagacaggacgtgtttca

SEQ ID NO: 7431046 - DNA, 22 bp, Homo sapiens
tcaagagagtgctgcttggggt

SEQ ID NO: 7431047 - DNA, 22 bp, Homo sapiens
tcaagagattgaataataactg

SEQ ID NO: 7431048 - DNA, 22 bp, Homo sapiens
tcaagagagtgctgcttggggt

SEQ ID NO: 7431049 - DNA, 22 bp, Homo sapiens
tcaagagattgaataataactg

SEQ ID NO: 7431050 - DNA, 22 bp, Homo sapiens
tcaagcttgtcataaacagctc

SEQ ID NO: 7431051 - DNA, 22 bp, Homo sapiens
tcaaggaagatagctattatga

SEQ ID NO: 7431052 - DNA, 22 bp, Homo sapiens
tcaaggaagggatattcttgaa

SEQ ID NO: 7431053 - DNA, 22 bp, Homo sapiens
tcaagctggctgttgctatttc

SEQ ID NO: 7431054 - DNA, 22 bp, Homo sapiens
tcaagctggctgttgctatttc

SEQ ID NO: 7431055 - DNA, 22 bp, Homo sapiens
tcaagctttctgtctcttatgg

SEQ ID NO: 7431056 - DNA, 22 bp, Homo sapiens
tcaagataagtcagtatatcaa

SEQ ID NO: 7431057 - DNA, 22 bp, Homo sapiens
tcaagagttggtcaaatccaaa

SEQ ID NO: 7431058 - DNA, 22 bp, Homo sapiens
tcaagataagtcagtatatcaa

SEQ ID NO: 7431059 - DNA, 22 bp, Homo sapiens
tcaagataccaccattatatgt

SEQ ID NO: 7431060 - DNA, 22 bp, Homo sapiens
tcaagataccaccattatatgt

SEQ ID NO: 7431061 - DNA, 22 bp, Homo sapiens
tcaagataccaccattatatgt

SEQ ID NO: 7431062 - DNA, 22 bp, Homo sapiens
tcaagataccaccattatatgt

SEQ ID NO: 7431063 - DNA, 22 bp, Homo sapiens
tcaagatgaaagatgtagccat

SEQ ID NO: 7431064 - DNA, 22 bp, Homo sapiens
tcaaggaaggtctgttgctcca

SEQ ID NO: 7431065 - DNA, 22 bp, Homo sapiens
tcaaggaaggtctgttgctcca

SEQ ID NO: 7431066 - DNA, 22 bp, Homo sapiens
tcaaggaagggatattcttgaa

SEQ ID NO: 7431067 - DNA, 22 bp, Homo sapiens
tcaaggaagggatattcttgaa

SEQ ID NO: 7431068 - DNA, 22 bp, Homo sapiens
tcaaggaagtcttattgcacag

SEQ ID NO: 7431069 - DNA, 22 bp, Homo sapiens
tcaaggaagtcttattgcacag

SEQ ID NO: 7431070 - DNA, 22 bp, Homo sapiens
tcaaggaatgactatatgagga

SEQ ID NO: 7431071 - DNA, 22 bp, Homo sapiens
tcaaggaatgactatatgagga

SEQ ID NO: 7431072 - DNA, 22 bp, Homo sapiens
tcaaggaatttagtttagtaaa

SEQ ID NO: 7431073 - DNA, 22 bp, Homo sapiens
tcaaggaatgggtccttccctt

SEQ ID NO: 7431074 - DNA, 22 bp, Homo sapiens
tcaaggagacagaaagcaatgg

SEQ ID NO: 7431075 - DNA, 20 bp, Homo sapiens
tcaaggactccctgggaaga

SEQ ID NO: 7431076 - DNA, 20 bp, Homo sapiens
tcaaggactccctgggaaga

SEQ ID NO: 7431077 - DNA, 22 bp, Homo sapiens
tcaaggactattgcatgactcc

SEQ ID NO: 7431078 - DNA, 22 bp, Homo sapiens
tcaaggactattgcatgactcc

SEQ ID NO: 7431079 - DNA, 22 bp, Homo sapiens
tcaaggcaaagtaaatattcaa

SEQ ID NO: 7431080 - DNA, 22 bp, Homo sapiens
tcaaggcacttcatgtctcagt

SEQ ID NO: 7431081 - DNA, 22 bp, Homo sapiens
tcaaggcaaagtaaatattcaa

SEQ ID NO: 7431082 - DNA, 22 bp, Homo sapiens
tcaaggagcccacagtctaatg

SEQ ID NO: 7431083 - DNA, 22 bp, Homo sapiens
tcaaggaggtgcttggcttcac

SEQ ID NO: 7431084 - DNA, 22 bp, Homo sapiens
tcaaggccacagtgagcagagt

SEQ ID NO: 7431085 - DNA, 22 bp, Homo sapiens
tcaaggccacagtgagcagagt

SEQ ID NO: 7431086 - DNA, 20 bp, Homo sapiens
tcaaggccacactgccgtgc

SEQ ID NO: 7431087 - DNA, 22 bp, Homo sapiens
tcaaggccacagtgagcagagt

SEQ ID NO: 7431088 - DNA, 22 bp, Homo sapiens
tcaaggcatacatttagaagag

SEQ ID NO: 7431089 - DNA, 20 bp, Homo sapiens
tcaaggccacactgccgtgc

SEQ ID NO: 7431090 - DNA, 20 bp, Homo sapiens
tcaaggccacactgccgtgc

SEQ ID NO: 7431091 - DNA, 22 bp, Homo sapiens
tcaaggcacttcatgtctcagt

SEQ ID NO: 7431092 - DNA, 22 bp, Homo sapiens
tcaaggcctatcctcatttgta

SEQ ID NO: 7431093 - DNA, 22 bp, Homo sapiens
tcaaggccagggaatgtagggg

SEQ ID NO: 7431094 - DNA, 22 bp, Homo sapiens
tcaaggccagggaatgtagggg

SEQ ID NO: 7431095 - DNA, 21 bp, Homo sapiens
tcaaggccagcctgggcagcc

SEQ ID NO: 7431096 - DNA, 21 bp, Homo sapiens
tcaaggccagcctgggcagcc

SEQ ID NO: 7431097 - DNA, 21 bp, Homo sapiens
tcaaggccagcctgggcagcc

SEQ ID NO: 7431098 - DNA, 22 bp, Homo sapiens
tcaaggccacagtgagcagagt

SEQ ID NO: 7431099 - DNA, 21 bp, Homo sapiens
tcaaggccagcctgggcagcc

SEQ ID NO: 7431100 - DNA, 21 bp, Homo sapiens
tcaaggccagcctgggcagcc

SEQ ID NO: 7431101 - DNA, 21 bp, Homo sapiens
tcaaggctgttgcattaatgc

SEQ ID NO: 7431102 - DNA, 21 bp, Homo sapiens
tcaaggctgttgcattaatgc

SEQ ID NO: 7431103 - DNA, 19 bp, Homo sapiens
tcaaggctccctgagggat

SEQ ID NO: 7431104 - DNA, 19 bp, Homo sapiens
tcaaggctccctgagggat

SEQ ID NO: 7431105 - DNA, 19 bp, Homo sapiens
tcaaggctgcctctccttt

SEQ ID NO: 7431106 - DNA, 22 bp, Homo sapiens
tcaaggcttttggttttccata

SEQ ID NO: 7431107 - DNA, 22 bp, Homo sapiens
tcaaggcttttggttttccata

SEQ ID NO: 7431108 - DNA, 22 bp, Homo sapiens
tcaaggcttttggttttccata

SEQ ID NO: 7431109 - DNA, 22 bp, Homo sapiens
tcaaggtgactgaactataaac

SEQ ID NO: 7431110 - DNA, 22 bp, Homo sapiens
tcaaggtctaggctcttctcca

SEQ ID NO: 7431111 - DNA, 22 bp, Homo sapiens
tcaaggtctaggctcttctcca

SEQ ID NO: 7431112 - DNA, 22 bp, Homo sapiens
tcaaggtcaaagctcctgtcct

SEQ ID NO: 7431113 - DNA, 22 bp, Homo sapiens
tcaaggtcctaattgtcctttt

SEQ ID NO: 7431114 - DNA, 22 bp, Homo sapiens
tcaagggaggagacacagccct

SEQ ID NO: 7431115 - DNA, 22 bp, Homo sapiens
tcaagggaggagacacagccct

SEQ ID NO: 7431116 - DNA, 22 bp, Homo sapiens
tcaaggctattaattctgtgag

SEQ ID NO: 7431117 - DNA, 22 bp, Homo sapiens
tcaaggctattaattctgtgag

SEQ ID NO: 7431118 - DNA, 19 bp, Homo sapiens
tcaaggctccctgagggat

SEQ ID NO: 7431119 - DNA, 19 bp, Homo sapiens
tcaaggctccctgagggat

SEQ ID NO: 7431120 - DNA, 22 bp, Homo sapiens
tcaaggctattaattctgtgag

SEQ ID NO: 7431121 - DNA, 22 bp, Homo sapiens
tcaaggctaaactttcagagta

SEQ ID NO: 7431122 - DNA, 22 bp, Homo sapiens
tcaaggctattaattctgtgag

SEQ ID NO: 7431123 - DNA, 22 bp, Homo sapiens
tcaaggctaaactttcagagta

SEQ ID NO: 7431124 - DNA, 22 bp, Homo sapiens
tcaaggctaaactttcagagta

SEQ ID NO: 7431125 - DNA, 22 bp, Homo sapiens
tcaaggctaaactttcagagta

SEQ ID NO: 7431126 - DNA, 22 bp, Homo sapiens
tcaagtctggagatctggaact

SEQ ID NO: 7431127 - DNA, 22 bp, Homo sapiens
tcaagtcttcacgtgatatctc

SEQ ID NO: 7431128 - DNA, 22 bp, Homo sapiens
tcaagtctggagatctggaact

SEQ ID NO: 7431129 - DNA, 19 bp, Homo sapiens
tcaagtcctaggcccacaa

SEQ ID NO: 7431130 - DNA, 22 bp, Homo sapiens
tcaagtcatttgactgtgtgtt

SEQ ID NO: 7431131 - DNA, 19 bp, Homo sapiens
tcaagtcctaggcccacaa

SEQ ID NO: 7431132 - DNA, 22 bp, Homo sapiens
tcaagtctcaatgtattatggt

SEQ ID NO: 7431133 - DNA, 22 bp, Homo sapiens
tcaagtattatattctcatttt

SEQ ID NO: 7431134 - DNA, 22 bp, Homo sapiens
tcaagtattattacagatgtag

SEQ ID NO: 7431135 - DNA, 22 bp, Homo sapiens
tcaagtattattacagatgtag

SEQ ID NO: 7431136 - DNA, 22 bp, Homo sapiens
tcaagtatttatttctgctggc

SEQ ID NO: 7431137 - DNA, 22 bp, Homo sapiens
tcaagtatttatttctgctggc

SEQ ID NO: 7431138 - DNA, 22 bp, Homo sapiens
tcaagtcactggcagggatgct

SEQ ID NO: 7431139 - DNA, 22 bp, Homo sapiens
tcaagtatttatttctgctggc

SEQ ID NO: 7431140 - DNA, 22 bp, Homo sapiens
tcaaggttcaaggctggcttct

SEQ ID NO: 7431141 - DNA, 22 bp, Homo sapiens
tcaaggttgccaggaaggaaga

SEQ ID NO: 7431142 - DNA, 22 bp, Homo sapiens
tcaaggttgcggggaggcacga

SEQ ID NO: 7431143 - DNA, 22 bp, Homo sapiens
tcaaggttgttgaggcctgact

SEQ ID NO: 7431144 - DNA, 22 bp, Homo sapiens
tcaaggtgtgttatgtgtaata

SEQ ID NO: 7431145 - DNA, 22 bp, Homo sapiens
tcaaggtgtgttatgtgtaata

SEQ ID NO: 7431146 - DNA, 22 bp, Homo sapiens
tcaaggtgcatacattctggct

SEQ ID NO: 7431147 - DNA, 22 bp, Homo sapiens
tcaaggttaagccagggcctca

SEQ ID NO: 7431148 - DNA, 22 bp, Homo sapiens
tcaaggtgctgtgctgtgctag

SEQ ID NO: 7431149 - DNA, 22 bp, Homo sapiens
tcaaggtgcatacattctggct

SEQ ID NO: 7431150 - DNA, 22 bp, Homo sapiens
tcaaggtgatggtcttgttttc

SEQ ID NO: 7431151 - DNA, 22 bp, Homo sapiens
tcaaggtgatggtcttgttttc

SEQ ID NO: 7431152 - DNA, 22 bp, Homo sapiens
tcaagtattatattctcatttt

SEQ ID NO: 7431153 - DNA, 22 bp, Homo sapiens
tcaagtatgacatcaagtttct

SEQ ID NO: 7431154 - DNA, 22 bp, Homo sapiens
tcaagtatatctagtcattagg

SEQ ID NO: 7431155 - DNA, 22 bp, Homo sapiens
tcaagtatgacatcaagtttct

SEQ ID NO: 7431156 - DNA, 22 bp, Homo sapiens
tcaagtatatctagtcattagg

SEQ ID NO: 7431157 - DNA, 22 bp, Homo sapiens
tcaagtagtacccaatgcgtgg

SEQ ID NO: 7431158 - DNA, 22 bp, Homo sapiens
tcaagtagaactataatgatgt

SEQ ID NO: 7431159 - DNA, 22 bp, Homo sapiens
tcaaggttgttgaggcctgact

SEQ ID NO: 7431160 - DNA, 22 bp, Homo sapiens
tcaaggtttgtctgctcagcat

SEQ ID NO: 7431161 - DNA, 17 bp, Homo sapiens
tcaatacactgctttta

SEQ ID NO: 7431162 - DNA, 22 bp, Homo sapiens
tcaatacacatgccgctgttct

SEQ ID NO: 7431163 - DNA, 17 bp, Homo sapiens
tcaatacactgctttta

SEQ ID NO: 7431164 - DNA, 17 bp, Homo sapiens
tcaatacactgctttta

SEQ ID NO: 7431165 - DNA, 22 bp, Homo sapiens
tcaatacagaaaggatattttg

SEQ ID NO: 7431166 - DNA, 22 bp, Homo sapiens
tcaatttatgtggctattcatt

SEQ ID NO: 7431167 - DNA, 22 bp, Homo sapiens
tcaatttatgtggctattcatt

SEQ ID NO: 7431168 - DNA, 22 bp, Homo sapiens
tcaatttatgtggctattcatt

SEQ ID NO: 7431169 - DNA, 22 bp, Homo sapiens
tcaatttatgtggctattcatt

SEQ ID NO: 7431170 - DNA, 21 bp, Homo sapiens
tcaatacaggtgcatgtgtct

SEQ ID NO: 7431171 - DNA, 21 bp, Homo sapiens
tcaatacaggtgcatgtgtct

SEQ ID NO: 7431172 - DNA, 21 bp, Homo sapiens
tcaatacaggtgcatgtgtct

SEQ ID NO: 7431173 - DNA, 22 bp, Homo sapiens
tcaataatggcaggataaattt

SEQ ID NO: 7431174 - DNA, 22 bp, Homo sapiens
tcaataagtaggatatcaagat

SEQ ID NO: 7431175 - DNA, 22 bp, Homo sapiens
tcaataatggcaggataaattt

SEQ ID NO: 7431176 - DNA, 22 bp, Homo sapiens
tcaataatggcaggataaattt

SEQ ID NO: 7431177 - DNA, 22 bp, Homo sapiens
tcaataactttgtttagcattg

SEQ ID NO: 7431178 - DNA, 22 bp, Homo sapiens
tcaataactttgtttagcattg

SEQ ID NO: 7431179 - DNA, 22 bp, Homo sapiens
tcaataaggcaacattaagtta

SEQ ID NO: 7431180 - DNA, 22 bp, Homo sapiens
tcaataagtaggatatcaagat

SEQ ID NO: 7431181 - DNA, 22 bp, Homo sapiens
tcaataatggcaggataaattt

SEQ ID NO: 7431182 - DNA, 22 bp, Homo sapiens
tcaataatggcaggataaattt

SEQ ID NO: 7431183 - DNA, 22 bp, Homo sapiens
tcaataatggcaggataaattt

SEQ ID NO: 7431184 - DNA, 22 bp, Homo sapiens
tcaataatggcaggataaattt

SEQ ID NO: 7431185 - DNA, 22 bp, Homo sapiens
tcaatttcaacagctgataaga

SEQ ID NO: 7431186 - DNA, 22 bp, Homo sapiens
tcaatttatgtggctattcatt

SEQ ID NO: 7431187 - DNA, 22 bp, Homo sapiens
tcaatttatgtggctattcatt

SEQ ID NO: 7431188 - DNA, 20 bp, Homo sapiens
tcaatttcaggtagcatagt

SEQ ID NO: 7431189 - DNA, 20 bp, Homo sapiens
tcaatttcaggtagcatagt

SEQ ID NO: 7431190 - DNA, 22 bp, Homo sapiens
tcaatttcattctattagttaa

SEQ ID NO: 7431191 - DNA, 22 bp, Homo sapiens
tcaatttcattctattagttaa

SEQ ID NO: 7431192 - DNA, 22 bp, Homo sapiens
tcaatttctagcttggtcggtt

SEQ ID NO: 7431193 - DNA, 22 bp, Homo sapiens
tcaatttcccctattgatagac

SEQ ID NO: 7431194 - DNA, 22 bp, Homo sapiens
tcaatttcccctattgatagac

SEQ ID NO: 7431195 - DNA, 22 bp, Homo sapiens
tcaatttcccctattgatagac

SEQ ID NO: 7431196 - DNA, 22 bp, Homo sapiens
tcaattttatgaaacaaagtga

SEQ ID NO: 7431197 - DNA, 22 bp, Homo sapiens
tcaattttatgaaacaaagtga

SEQ ID NO: 7431198 - DNA, 22 bp, Homo sapiens
tcaattttatgaaacaaagtga

SEQ ID NO: 7431199 - DNA, 22 bp, Homo sapiens
tcaattttatgaaacaaagtga

SEQ ID NO: 7431200 - DNA, 22 bp, Homo sapiens
tcaattttatgaaacaaagtga

SEQ ID NO: 7431201 - DNA, 22 bp, Homo sapiens
tcaattttatgaaacaaagtga

SEQ ID NO: 7431202 - DNA, 22 bp, Homo sapiens
tcaattttatgaaacaaagtga

SEQ ID NO: 7431203 - DNA, 22 bp, Homo sapiens
tcaattttatgaaacaaagtga

SEQ ID NO: 7431204 - DNA, 22 bp, Homo sapiens
tcaatttcttggtttgataata

SEQ ID NO: 7431205 - DNA, 22 bp, Homo sapiens
tcaatttcttggtttgataata

SEQ ID NO: 7431206 - DNA, 22 bp, Homo sapiens
tcaatttcttggtttgataata

SEQ ID NO: 7431207 - DNA, 22 bp, Homo sapiens
tcaatttcttggtttgataata

SEQ ID NO: 7431208 - DNA, 20 bp, Homo sapiens
tcaagttttgcttgacaaga

SEQ ID NO: 7431209 - DNA, 20 bp, Homo sapiens
tcaagttttgcttgacaaga

SEQ ID NO: 7431210 - DNA, 20 bp, Homo sapiens
tcaagttttgcttgacaaga

SEQ ID NO: 7431211 - DNA, 20 bp, Homo sapiens
tcaagttttgcttgacaaga

SEQ ID NO: 7431212 - DNA, 20 bp, Homo sapiens
tcaagttttgcttgacaaga

SEQ ID NO: 7431213 - DNA, 22 bp, Homo sapiens
tcaagtttaattgagatgttta

SEQ ID NO: 7431214 - DNA, 22 bp, Homo sapiens
tcaagttaggtggttgttagga

SEQ ID NO: 7431215 - DNA, 22 bp, Homo sapiens
tcaagtttaattgagatgttta

SEQ ID NO: 7431216 - DNA, 22 bp, Homo sapiens
tcaagtttctctcagattatgg

SEQ ID NO: 7431217 - DNA, 22 bp, Homo sapiens
tcaagtttctctcagattatgg

SEQ ID NO: 7431218 - DNA, 22 bp, Homo sapiens
tcaagtttctctcagattatgg

SEQ ID NO: 7431219 - DNA, 22 bp, Homo sapiens
tcaagtcttgatgagacaaacc

SEQ ID NO: 7431220 - DNA, 22 bp, Homo sapiens
tcaagtcttgagggacagcatt

SEQ ID NO: 7431221 - DNA, 18 bp, Homo sapiens
tcaagtgattctcctgcc

SEQ ID NO: 7431222 - DNA, 22 bp, Homo sapiens
tcaagttaggtggttgttagga

SEQ ID NO: 7431223 - DNA, 22 bp, Homo sapiens
tcaagtgcttgtgaggtatttg

SEQ ID NO: 7431224 - DNA, 22 bp, Homo sapiens
tcaagtgtagtggtgtcaggtc

SEQ ID NO: 7431225 - DNA, 22 bp, Homo sapiens
tcaagttacctggtcattacta

SEQ ID NO: 7431226 - DNA, 22 bp, Homo sapiens
tcaataaatagcttggctcagc

SEQ ID NO: 7431227 - DNA, 22 bp, Homo sapiens
tcaataaatccctctgaccctg

SEQ ID NO: 7431228 - DNA, 22 bp, Homo sapiens
tcaataactttgtttagcattg

SEQ ID NO: 7431229 - DNA, 23 bp, Homo sapiens
tcaataactcgggttaaaataga

SEQ ID NO: 7431230 - DNA, 23 bp, Homo sapiens
tcaataactcgggttaaaataga

SEQ ID NO: 7431231 - DNA, 22 bp, Homo sapiens
tcaataaatccctctgaccctg

SEQ ID NO: 7431232 - DNA, 23 bp, Homo sapiens
tcaataactcgggttaaaataga

SEQ ID NO: 7431233 - DNA, 22 bp, Homo sapiens
tcaataaaattgttttcctatc

SEQ ID NO: 7431234 - DNA, 22 bp, Homo sapiens
tcaataaaattgttttcctatc

SEQ ID NO: 7431235 - DNA, 22 bp, Homo sapiens
tcaataaatagcttggctcagc

SEQ ID NO: 7431236 - DNA, 22 bp, Homo sapiens
tcaataaaattgttttcctatc

SEQ ID NO: 7431237 - DNA, 20 bp, Homo sapiens
tcaagttttgcttgacaaga

SEQ ID NO: 7431238 - DNA, 20 bp, Homo sapiens
tcaagttttgcttgacaaga

SEQ ID NO: 7431239 - DNA, 22 bp, Homo sapiens
tcaataaaattgttttcctatc

SEQ ID NO: 7431240 - DNA, 22 bp, Homo sapiens
tcacaggcccaaaccacgctta

SEQ ID NO: 7431241 - DNA, 22 bp, Homo sapiens
tcacaggcccaaaccacgctta

SEQ ID NO: 7431242 - DNA, 22 bp, Homo sapiens
tcacaggcccaaaccacgctta

SEQ ID NO: 7431243 - DNA, 19 bp, Homo sapiens
tcacaggcatctccccaga

SEQ ID NO: 7431244 - DNA, 19 bp, Homo sapiens
tcacaggcatctccccaga

SEQ ID NO: 7431245 - DNA, 19 bp, Homo sapiens
tcacaggcatctccccaga

SEQ ID NO: 7431246 - DNA, 19 bp, Homo sapiens
tcacaggcatctccccaga

SEQ ID NO: 7431247 - DNA, 19 bp, Homo sapiens
tcacaggcatctccccaga

SEQ ID NO: 7431248 - DNA, 22 bp, Homo sapiens
tcacaggcaaagaagattggtg

SEQ ID NO: 7431249 - DNA, 22 bp, Homo sapiens
tcacaggataaggtggcatcac

SEQ ID NO: 7431250 - DNA, 22 bp, Homo sapiens
tcacaggataaggtggcatcac

SEQ ID NO: 7431251 - DNA, 22 bp, Homo sapiens
tcacaggataaggtggcatcac

SEQ ID NO: 7431252 - DNA, 22 bp, Homo sapiens
tcacaggataaggtggcatcac

SEQ ID NO: 7431253 - DNA, 20 bp, Homo sapiens
tcacagctggctatgacagg

SEQ ID NO: 7431254 - DNA, 20 bp, Homo sapiens
tcacagctggctatgacagg

SEQ ID NO: 7431255 - DNA, 22 bp, Homo sapiens
tcacagctggacacgttggcat

SEQ ID NO: 7431256 - DNA, 22 bp, Homo sapiens
tcacagctggacacgttggcat

SEQ ID NO: 7431257 - DNA, 20 bp, Homo sapiens
tcacagctggctatgacagg

SEQ ID NO: 7431258 - DNA, 22 bp, Homo sapiens
tcacaggataaggtggcatcac

SEQ ID NO: 7431259 - DNA, 22 bp, Homo sapiens
tcacaggataaggtggcatcac

SEQ ID NO: 7431260 - DNA, 22 bp, Homo sapiens
tcacaggataaggtggcatcac

SEQ ID NO: 7431261 - DNA, 22 bp, Homo sapiens
tcacaggagtcataattacagt

SEQ ID NO: 7431262 - DNA, 22 bp, Homo sapiens
tcacaggagtcataattacagt

SEQ ID NO: 7431263 - DNA, 22 bp, Homo sapiens
tcacagaataaattgagaagac

SEQ ID NO: 7431264 - DNA, 22 bp, Homo sapiens
tcacagaataaattgagaagac

SEQ ID NO: 7431265 - DNA, 22 bp, Homo sapiens
tcacagctcactgtagcctcga

SEQ ID NO: 7431266 - DNA, 22 bp, Homo sapiens
tcacagctattctcatgtattt

SEQ ID NO: 7431267 - DNA, 22 bp, Homo sapiens
tcacagaataaattgagaagac

SEQ ID NO: 7431268 - DNA, 22 bp, Homo sapiens
tcacagaataaatgtactggcc

SEQ ID NO: 7431269 - DNA, 22 bp, Homo sapiens
tcacagaataaatgtactggcc

SEQ ID NO: 7431270 - DNA, 22 bp, Homo sapiens
tcacagaataaatgtactggcc

SEQ ID NO: 7431271 - DNA, 22 bp, Homo sapiens
tcacagaataaatgtactggcc

SEQ ID NO: 7431272 - DNA, 22 bp, Homo sapiens
tcacagctcactgtagcctcga

SEQ ID NO: 7431273 - DNA, 22 bp, Homo sapiens
tcacagctcactgtagcctcga

SEQ ID NO: 7431274 - DNA, 22 bp, Homo sapiens
tcacagctcactgtagcctcga

SEQ ID NO: 7431275 - DNA, 22 bp, Homo sapiens
tcacagctccagactgcaactc

SEQ ID NO: 7431276 - DNA, 22 bp, Homo sapiens
tcacagctccagactgcaactc

SEQ ID NO: 7431277 - DNA, 22 bp, Homo sapiens
tcacagctccagactgcaactc

SEQ ID NO: 7431278 - DNA, 22 bp, Homo sapiens
tcacagctccagactgcaactc

SEQ ID NO: 7431279 - DNA, 22 bp, Homo sapiens
tcacagctccagactgcaactc

SEQ ID NO: 7431280 - DNA, 22 bp, Homo sapiens
tcacagctccagactgcaactc

SEQ ID NO: 7431281 - DNA, 22 bp, Homo sapiens
tcacagctctgtcaattttata

SEQ ID NO: 7431282 - DNA, 22 bp, Homo sapiens
tcacagctgagtttccatttct

SEQ ID NO: 7431283 - DNA, 22 bp, Homo sapiens
tcacagctgagtttccatttct

SEQ ID NO: 7431284 - DNA, 22 bp, Homo sapiens
tcacagaagttgaatttgcatg

SEQ ID NO: 7431285 - DNA, 22 bp, Homo sapiens
tcacagaagttgaatttgcatg

SEQ ID NO: 7431286 - DNA, 22 bp, Homo sapiens
tcacagaagttgaatttgcatg

SEQ ID NO: 7431287 - DNA, 22 bp, Homo sapiens
tcacagaagttgaatttgcatg

SEQ ID NO: 7431288 - DNA, 22 bp, Homo sapiens
tcacagaagttgaatttgcatg

SEQ ID NO: 7431289 - DNA, 22 bp, Homo sapiens
tcacagaagttgaatttgcatg

SEQ ID NO: 7431290 - DNA, 22 bp, Homo sapiens
tcacagaagttgaatttgcatg

SEQ ID NO: 7431291 - DNA, 22 bp, Homo sapiens
tcacagaataaatgtactggcc

SEQ ID NO: 7431292 - DNA, 22 bp, Homo sapiens
tcacagaagtgtgtttcaggag

SEQ ID NO: 7431293 - DNA, 22 bp, Homo sapiens
tcacagaagtgtgtttcaggag

SEQ ID NO: 7431294 - DNA, 22 bp, Homo sapiens
tcacagaagtgtgtttcaggag

SEQ ID NO: 7431295 - DNA, 22 bp, Homo sapiens
tcacagaagtgtgtttcaggag

SEQ ID NO: 7431296 - DNA, 22 bp, Homo sapiens
tcacagaagtgtagtgaggaaa

SEQ ID NO: 7431297 - DNA, 22 bp, Homo sapiens
tcacagaagtgtagtgaggaaa

SEQ ID NO: 7431298 - DNA, 22 bp, Homo sapiens
tcacagaagtgtagtgaggaaa

SEQ ID NO: 7431299 - DNA, 22 bp, Homo sapiens
tcacagaagtgtagtgaggaaa

SEQ ID NO: 7431300 - DNA, 22 bp, Homo sapiens
tcacagaagtgtagtgaggaaa

SEQ ID NO: 7431301 - DNA, 22 bp, Homo sapiens
tcacagaaggtggccatagctg

SEQ ID NO: 7431302 - DNA, 22 bp, Homo sapiens
tcacagaagtgtagtgaggaaa

SEQ ID NO: 7431303 - DNA, 22 bp, Homo sapiens
tcacagaagggaaagatgccaa

SEQ ID NO: 7431304 - DNA, 22 bp, Homo sapiens
tcacagaaggtggccatagctg

SEQ ID NO: 7431305 - DNA, 22 bp, Homo sapiens
tcacagaaggtggccatagctg

SEQ ID NO: 7431306 - DNA, 22 bp, Homo sapiens
tcacagaaggtggccatagctg

SEQ ID NO: 7431307 - DNA, 22 bp, Homo sapiens
tcacagaaggtggccatagctg

SEQ ID NO: 7431308 - DNA, 22 bp, Homo sapiens
tcacagaagggaaagatgccaa

SEQ ID NO: 7431309 - DNA, 22 bp, Homo sapiens
tcacagaagggaaagatgccaa

SEQ ID NO: 7431310 - DNA, 22 bp, Homo sapiens
tcacagaagggaaagatgccaa

SEQ ID NO: 7431311 - DNA, 22 bp, Homo sapiens
tcacagaagggaaagatgccaa

SEQ ID NO: 7431312 - DNA, 22 bp, Homo sapiens
tcacagaagggaaagatgccaa

SEQ ID NO: 7431313 - DNA, 22 bp, Homo sapiens
tcacagaaggcatcacagaaga

SEQ ID NO: 7431314 - DNA, 22 bp, Homo sapiens
tcacagaaggcatcacagaaga

SEQ ID NO: 7431315 - DNA, 22 bp, Homo sapiens
tcacagaaggcatcacagaaga

SEQ ID NO: 7431316 - DNA, 22 bp, Homo sapiens
tcacagaaggcatcacagaaga

SEQ ID NO: 7431317 - DNA, 22 bp, Homo sapiens
tcacagaaggagggaagctagt

SEQ ID NO: 7431318 - DNA, 22 bp, Homo sapiens
tcacagaaggagggaagctagt

SEQ ID NO: 7431319 - DNA, 22 bp, Homo sapiens
tcacagaaggcatcacagaaga

SEQ ID NO: 7431320 - DNA, 22 bp, Homo sapiens
tcacagaaggcatcacagaaga

SEQ ID NO: 7431321 - DNA, 22 bp, Homo sapiens
tcacagaaggcatcacagaaga

SEQ ID NO: 7431322 - DNA, 22 bp, Homo sapiens
tcacagaaggcatcacagaaga

SEQ ID NO: 7431323 - DNA, 22 bp, Homo sapiens
tcacagaaggagggaagctagt

SEQ ID NO: 7431324 - DNA, 22 bp, Homo sapiens
tcacagaaggagggaagctagt

SEQ ID NO: 7431325 - DNA, 22 bp, Homo sapiens
tcacagaaggaccttgtttcat

SEQ ID NO: 7431326 - DNA, 22 bp, Homo sapiens
tcacagaaggaccttgtttcat

SEQ ID NO: 7431327 - DNA, 22 bp, Homo sapiens
tcacagaagcttgaagattttc

SEQ ID NO: 7431328 - DNA, 22 bp, Homo sapiens
tcacagaaggaccttgtttcat

SEQ ID NO: 7431329 - DNA, 22 bp, Homo sapiens
tcacagaaggaccttgtttcat

SEQ ID NO: 7431330 - DNA, 22 bp, Homo sapiens
tcacagaagcttgaagattttc

SEQ ID NO: 7431331 - DNA, 22 bp, Homo sapiens
tcacagaagccctcgcaaacta

SEQ ID NO: 7431332 - DNA, 22 bp, Homo sapiens
tcacagaagccctcgcaaacta

SEQ ID NO: 7431333 - DNA, 22 bp, Homo sapiens
tcacagaagccctcgcaaacta

SEQ ID NO: 7431334 - DNA, 22 bp, Homo sapiens
tcacagaagcttgaagattttc

SEQ ID NO: 7431335 - DNA, 22 bp, Homo sapiens
tcacagaagagcattaagatga

SEQ ID NO: 7431336 - DNA, 22 bp, Homo sapiens
tcacagaagcttgaagattttc

SEQ ID NO: 7431337 - DNA, 22 bp, Homo sapiens
tcacagaagatgctggatgttg

SEQ ID NO: 7431338 - DNA, 22 bp, Homo sapiens
tcacagaagagcattaagatga

SEQ ID NO: 7431339 - DNA, 22 bp, Homo sapiens
tcacagaagatgctggatgttg

SEQ ID NO: 7431340 - DNA, 22 bp, Homo sapiens
tcacagaagatgctggatgttg

SEQ ID NO: 7431341 - DNA, 22 bp, Homo sapiens
tcacagaagatgctggatgttg

SEQ ID NO: 7431342 - DNA, 22 bp, Homo sapiens
tcacagaagcatcatacccgga

SEQ ID NO: 7431343 - DNA, 22 bp, Homo sapiens
tcacagaagcatcatacccgga

SEQ ID NO: 7431344 - DNA, 22 bp, Homo sapiens
tcacagggtttggaagcctcct

SEQ ID NO: 7431345 - DNA, 22 bp, Homo sapiens
tcacagggtttggaagcctcct

SEQ ID NO: 7431346 - DNA, 21 bp, Homo sapiens
tcacaggtcaatgtgtgaagg

SEQ ID NO: 7431347 - DNA, 23 bp, Homo sapiens
tcacaggggccagcgctctgtgg

SEQ ID NO: 7431348 - DNA, 20 bp, Homo sapiens
tcacaggggaccaggagcag

SEQ ID NO: 7431349 - DNA, 20 bp, Homo sapiens
tcacaggggaccaggagcag

SEQ ID NO: 7431350 - DNA, 22 bp, Homo sapiens
tcacagggtatctgggatggat

SEQ ID NO: 7431351 - DNA, 22 bp, Homo sapiens
tcacagggtatctgggatggat

SEQ ID NO: 7431352 - DNA, 23 bp, Homo sapiens
tcacaggggccagcgctctgtgg

SEQ ID NO: 7431353 - DNA, 23 bp, Homo sapiens
tcacaggggccagcgctctgtgg

SEQ ID NO: 7431354 - DNA, 23 bp, Homo sapiens
tcacaggggccagcgctctgtgg

SEQ ID NO: 7431355 - DNA, 22 bp, Homo sapiens
tcacagtaaatccagaagaaat

SEQ ID NO: 7431356 - DNA, 22 bp, Homo sapiens
tcacagtaaaagcatggaagag

SEQ ID NO: 7431357 - DNA, 22 bp, Homo sapiens
tcacagtaaaagcatggaagag

SEQ ID NO: 7431358 - DNA, 22 bp, Homo sapiens
tcacagtaaaagcatggaagag

SEQ ID NO: 7431359 - DNA, 22 bp, Homo sapiens
tcacaggttccagggatgagaa

SEQ ID NO: 7431360 - DNA, 22 bp, Homo sapiens
tcacagtacatgattcagtggt

SEQ ID NO: 7431361 - DNA, 22 bp, Homo sapiens
tcacagtaactttgttgctttt

SEQ ID NO: 7431362 - DNA, 22 bp, Homo sapiens
tcacagtaactttgttgctttt

SEQ ID NO: 7431363 - DNA, 22 bp, Homo sapiens
tcacagtaaatccagaagaaat

SEQ ID NO: 7431364 - DNA, 22 bp, Homo sapiens
tcacagtaaatccagaagaaat

SEQ ID NO: 7431365 - DNA, 22 bp, Homo sapiens
tcacagtagacttctcaagagc

SEQ ID NO: 7431366 - DNA, 22 bp, Homo sapiens
tcacagtagacttctcaagagc

SEQ ID NO: 7431367 - DNA, 22 bp, Homo sapiens
tcacagtagacttctcaagagc

SEQ ID NO: 7431368 - DNA, 22 bp, Homo sapiens
tcacagtactgtgtgacttgag

SEQ ID NO: 7431369 - DNA, 22 bp, Homo sapiens
tcacagtactgtgactattgac

SEQ ID NO: 7431370 - DNA, 22 bp, Homo sapiens
tcacagtactgtgactattgac

SEQ ID NO: 7431371 - DNA, 22 bp, Homo sapiens
tcacagtactgtgactattgac

SEQ ID NO: 7431372 - DNA, 22 bp, Homo sapiens
tcacagtactgtgactattgac

SEQ ID NO: 7431373 - DNA, 22 bp, Homo sapiens
tcacagtactccccaaagtttc

SEQ ID NO: 7431374 - DNA, 22 bp, Homo sapiens
tcacagtactccccaaagtttc

SEQ ID NO: 7431375 - DNA, 22 bp, Homo sapiens
tcacagtactccccaaagtttc

SEQ ID NO: 7431376 - DNA, 22 bp, Homo sapiens
tcacagtactccccaaagtttc

SEQ ID NO: 7431377 - DNA, 22 bp, Homo sapiens
tcacaggctccagggcctggat

SEQ ID NO: 7431378 - DNA, 21 bp, Homo sapiens
tcacaggctcagggagagagt

SEQ ID NO: 7431379 - DNA, 22 bp, Homo sapiens
tcacaggctaaatttatgcagg

SEQ ID NO: 7431380 - DNA, 21 bp, Homo sapiens
tcacaggctcagggagagagt

SEQ ID NO: 7431381 - DNA, 21 bp, Homo sapiens
tcacaggctcagggagagagt

SEQ ID NO: 7431382 - DNA, 22 bp, Homo sapiens
tcacaggctccagggcctggat

SEQ ID NO: 7431383 - DNA, 22 bp, Homo sapiens
tcacaggctccagggcctggat

SEQ ID NO: 7431384 - DNA, 22 bp, Homo sapiens
tcacaggctaaatttatgcagg

SEQ ID NO: 7431385 - DNA, 22 bp, Homo sapiens
tcacaggctaaatttatgcagg

SEQ ID NO: 7431386 - DNA, 22 bp, Homo sapiens
tcacaggcctggggcagagggc

SEQ ID NO: 7431387 - DNA, 22 bp, Homo sapiens
tcacaggcctggggcagagggc

SEQ ID NO: 7431388 - DNA, 22 bp, Homo sapiens
tcacaggcctggggcagagggc

SEQ ID NO: 7431389 - DNA, 22 bp, Homo sapiens
tcacaggcctggggcagagggc

SEQ ID NO: 7431390 - DNA, 22 bp, Homo sapiens
tcacaggcccaaaccacgctta

SEQ ID NO: 7431391 - DNA, 22 bp, Homo sapiens
tcacaggcctggggcagagggc

SEQ ID NO: 7431392 - DNA, 22 bp, Homo sapiens
tcacaggcccaaaccacgctta

SEQ ID NO: 7431393 - DNA, 22 bp, Homo sapiens
tcacaggcccaaaccacgctta

SEQ ID NO: 7431394 - DNA, 22 bp, Homo sapiens
tcacaggcccaaaccacgctta

SEQ ID NO: 7431395 - DNA, 22 bp, Homo sapiens
tcacaggctggtctccgaggac

SEQ ID NO: 7431396 - DNA, 22 bp, Homo sapiens
tcacaggctggtctccgaggac

SEQ ID NO: 7431397 - DNA, 22 bp, Homo sapiens
tcacaggctggtctccgaggac

SEQ ID NO: 7431398 - DNA, 22 bp, Homo sapiens
tcacaggctggtctccgaggac

SEQ ID NO: 7431399 - DNA, 22 bp, Homo sapiens
tcacaggctggtctccgaggac

SEQ ID NO: 7431400 - DNA, 22 bp, Homo sapiens
tcacaggctctccaccatgagg

SEQ ID NO: 7431401 - DNA, 22 bp, Homo sapiens
tcacaggctctccaccatgagg

SEQ ID NO: 7431402 - DNA, 22 bp, Homo sapiens
tcacaggctctccaccatgagg

SEQ ID NO: 7431403 - DNA, 22 bp, Homo sapiens
tcacaggctctccaccatgagg

SEQ ID NO: 7431404 - DNA, 22 bp, Homo sapiens
tcacaggctctccaccatgagg

SEQ ID NO: 7431405 - DNA, 22 bp, Homo sapiens
tcacaggctctagggattaaga

SEQ ID NO: 7431406 - DNA, 22 bp, Homo sapiens
tcacaggctctagggattaaga

SEQ ID NO: 7431407 - DNA, 22 bp, Homo sapiens
tcacaggctggtctccgaggac

SEQ ID NO: 7431408 - DNA, 22 bp, Homo sapiens
tcacaggcttgtgaacattgca

SEQ ID NO: 7431409 - DNA, 22 bp, Homo sapiens
tcacagggatggaatagaaata

SEQ ID NO: 7431410 - DNA, 22 bp, Homo sapiens
tcacagggatggaatagaaata

SEQ ID NO: 7431411 - DNA, 23 bp, Homo sapiens
tcacagggcactggctggggttg

SEQ ID NO: 7431412 - DNA, 23 bp, Homo sapiens
tcacagggcactggctggggttg

SEQ ID NO: 7431413 - DNA, 23 bp, Homo sapiens
tcacagggcactggctggggttg

SEQ ID NO: 7431414 - DNA, 22 bp, Homo sapiens
tcacagggcattatggctccag

SEQ ID NO: 7431415 - DNA, 22 bp, Homo sapiens
tcacagggcattatggctccag

SEQ ID NO: 7431416 - DNA, 23 bp, Homo sapiens
tcacagggcactggctggggttg

SEQ ID NO: 7431417 - DNA, 22 bp, Homo sapiens
tcacaaatagctatattaagga

SEQ ID NO: 7431418 - DNA, 22 bp, Homo sapiens
tcacaaagtgaagtgtgtcatg

SEQ ID NO: 7431419 - DNA, 22 bp, Homo sapiens
tcacaaagggagggatagctgg

SEQ ID NO: 7431420 - DNA, 22 bp, Homo sapiens
tcacaaagtgaagtgtgtcatg

SEQ ID NO: 7431421 - DNA, 22 bp, Homo sapiens
tcacaaagggagggatagctgg

SEQ ID NO: 7431422 - DNA, 22 bp, Homo sapiens
tcacaaagggagggatagctgg

SEQ ID NO: 7431423 - DNA, 22 bp, Homo sapiens
tcacaaagggagggatagctgg

SEQ ID NO: 7431424 - DNA, 22 bp, Homo sapiens
tcacaaagggagggatagctgg

SEQ ID NO: 7431425 - DNA, 22 bp, Homo sapiens
tcacaaagggagggatagctgg

SEQ ID NO: 7431426 - DNA, 22 bp, Homo sapiens
tcacaaatagctatattaagga

SEQ ID NO: 7431427 - DNA, 22 bp, Homo sapiens
tcacaagagctggactgtcttt

SEQ ID NO: 7431428 - DNA, 22 bp, Homo sapiens
tcacaagagctggactgtcttt

SEQ ID NO: 7431429 - DNA, 22 bp, Homo sapiens
tcacaagagtaagttcatgcct

SEQ ID NO: 7431430 - DNA, 22 bp, Homo sapiens
tcacaagagtaagttcatgcct

SEQ ID NO: 7431431 - DNA, 22 bp, Homo sapiens
tcacaagagtaagttcatgcct

SEQ ID NO: 7431432 - DNA, 22 bp, Homo sapiens
tcacaagagtaagttcatgcct

SEQ ID NO: 7431433 - DNA, 22 bp, Homo sapiens
tcacaagagctggactgtcttt

SEQ ID NO: 7431434 - DNA, 22 bp, Homo sapiens
tcacaagggccctgcagtccac

SEQ ID NO: 7431435 - DNA, 22 bp, Homo sapiens
tcacaagatggctgctgcagcc

SEQ ID NO: 7431436 - DNA, 22 bp, Homo sapiens
tcacaagatggctgctgcagcc

SEQ ID NO: 7431437 - DNA, 22 bp, Homo sapiens
tcacaatactcactcaatggct

SEQ ID NO: 7431438 - DNA, 22 bp, Homo sapiens
tcacaaggtcctggtggataga

SEQ ID NO: 7431439 - DNA, 22 bp, Homo sapiens
tcacaagatatttcagtccttt

SEQ ID NO: 7431440 - DNA, 22 bp, Homo sapiens
tcacaagatatttcagtccttt

SEQ ID NO: 7431441 - DNA, 22 bp, Homo sapiens
tcacaagatatttcagtccttt

SEQ ID NO: 7431442 - DNA, 22 bp, Homo sapiens
tcacaagatatttcagtccttt

SEQ ID NO: 7431443 - DNA, 22 bp, Homo sapiens
tcacaagatatttcagtccttt

SEQ ID NO: 7431444 - DNA, 22 bp, Homo sapiens
tcacaagatacagttagaagca

SEQ ID NO: 7431445 - DNA, 22 bp, Homo sapiens
tcacaagatacagttagaagca

SEQ ID NO: 7431446 - DNA, 22 bp, Homo sapiens
tcacaagatacagttagaagca

SEQ ID NO: 7431447 - DNA, 22 bp, Homo sapiens
tcacaagataaacatagctcca

SEQ ID NO: 7431448 - DNA, 22 bp, Homo sapiens
tcacaagatacagttagaagca

SEQ ID NO: 7431449 - DNA, 22 bp, Homo sapiens
tcacaagatacagttagaagca

SEQ ID NO: 7431450 - DNA, 22 bp, Homo sapiens
tcacaagataaacatagctcca

SEQ ID NO: 7431451 - DNA, 20 bp, Homo sapiens
tcaattttctacaacatttg

SEQ ID NO: 7431452 - DNA, 20 bp, Homo sapiens
tcaattttctacaacatttg

SEQ ID NO: 7431453 - DNA, 20 bp, Homo sapiens
tcaattttctacaacatttg

SEQ ID NO: 7431454 - DNA, 20 bp, Homo sapiens
tcaattttctacaacatttg

SEQ ID NO: 7431455 - DNA, 20 bp, Homo sapiens
tcaattttctacaacatttg

SEQ ID NO: 7431456 - DNA, 20 bp, Homo sapiens
tcaattttctacaacatttg

SEQ ID NO: 7431457 - DNA, 20 bp, Homo sapiens
tcaattttctacaacatttg

SEQ ID NO: 7431458 - DNA, 22 bp, Homo sapiens
tcacaaaagcttttgaatttgg

SEQ ID NO: 7431459 - DNA, 20 bp, Homo sapiens
tcaattttctacaacatttg

SEQ ID NO: 7431460 - DNA, 20 bp, Homo sapiens
tcaattttctacaacatttg

SEQ ID NO: 7431461 - DNA, 22 bp, Homo sapiens
tcacaaaagcttttgaatttgg

SEQ ID NO: 7431462 - DNA, 22 bp, Homo sapiens
tcacaaaagcttttgaatttgg

SEQ ID NO: 7431463 - DNA, 22 bp, Homo sapiens
tcacaaaagcttttgaatttgg

SEQ ID NO: 7431464 - DNA, 22 bp, Homo sapiens
tcacaaaagcttttgaatttgg

SEQ ID NO: 7431465 - DNA, 22 bp, Homo sapiens
tcacaaaagcttttgaatttgg

SEQ ID NO: 7431466 - DNA, 22 bp, Homo sapiens
tcacaaaagcttttgaatttgg

SEQ ID NO: 7431467 - DNA, 22 bp, Homo sapiens
tcacaaaagcttttgaatttgg

SEQ ID NO: 7431468 - DNA, 22 bp, Homo sapiens
tcacaaaagcttttgaatttgg

SEQ ID NO: 7431469 - DNA, 22 bp, Homo sapiens
tcacaaaagcttttgaatttgg

SEQ ID NO: 7431470 - DNA, 22 bp, Homo sapiens
tcacaaaagcttttgaatttgg

SEQ ID NO: 7431471 - DNA, 22 bp, Homo sapiens
tcacaaaagcttttgaatttgg

SEQ ID NO: 7431472 - DNA, 22 bp, Homo sapiens
tcacaaaagcttttgaatttgg

SEQ ID NO: 7431473 - DNA, 22 bp, Homo sapiens
tcacaaaagcttttgaatttgg

SEQ ID NO: 7431474 - DNA, 22 bp, Homo sapiens
tcacaaaagcttttgaatttgg

SEQ ID NO: 7431475 - DNA, 22 bp, Homo sapiens
tcacaaaggatgatgaattctg

SEQ ID NO: 7431476 - DNA, 22 bp, Homo sapiens
tcacaaaggatgatgaattctg

SEQ ID NO: 7431477 - DNA, 22 bp, Homo sapiens
tcacaaagctttgataagcaga

SEQ ID NO: 7431478 - DNA, 22 bp, Homo sapiens
tcacaaagctttgataagcaga

SEQ ID NO: 7431479 - DNA, 22 bp, Homo sapiens
tcacaaagctttgataagcaga

SEQ ID NO: 7431480 - DNA, 22 bp, Homo sapiens
tcacaaagctttgataagcaga

SEQ ID NO: 7431481 - DNA, 22 bp, Homo sapiens
tcacaaagctttgataagcaga

SEQ ID NO: 7431482 - DNA, 22 bp, Homo sapiens
tcacaaagctttgataagcaga

SEQ ID NO: 7431483 - DNA, 22 bp, Homo sapiens
tcacaaagctttgataagcaga

SEQ ID NO: 7431484 - DNA, 22 bp, Homo sapiens
tcacaaagctttgataagcaga

SEQ ID NO: 7431485 - DNA, 22 bp, Homo sapiens
tcacaaagctttgataagcaga

SEQ ID NO: 7431486 - DNA, 22 bp, Homo sapiens
tcacaaagctttgataagcaga

SEQ ID NO: 7431487 - DNA, 22 bp, Homo sapiens
tcacaaaaggccatgtggcttc

SEQ ID NO: 7431488 - DNA, 22 bp, Homo sapiens
tcacaaaaggccatgtggcttc

SEQ ID NO: 7431489 - DNA, 22 bp, Homo sapiens
tcacaaaaggccatgtggcttc

SEQ ID NO: 7431490 - DNA, 22 bp, Homo sapiens
tcacaaaaggccatgtggcttc

SEQ ID NO: 7431491 - DNA, 22 bp, Homo sapiens
tcacaaacaatgctttggaatt

SEQ ID NO: 7431492 - DNA, 22 bp, Homo sapiens
tcacaaaaggccatgtggcttc

SEQ ID NO: 7431493 - DNA, 22 bp, Homo sapiens
tcacaaaaggccatgtggcttc

SEQ ID NO: 7431494 - DNA, 22 bp, Homo sapiens
tcacaaagctttgataagcaga

SEQ ID NO: 7431495 - DNA, 22 bp, Homo sapiens
tcacaaagagaattgtgggtgt

SEQ ID NO: 7431496 - DNA, 22 bp, Homo sapiens
tcacaaacaatgctttggaatt

SEQ ID NO: 7431497 - DNA, 22 bp, Homo sapiens
tcacaaagagaattgtgggtgt

SEQ ID NO: 7431498 - DNA, 20 bp, Homo sapiens
tcacaatatgagctcataca

SEQ ID NO: 7431499 - DNA, 22 bp, Homo sapiens
tcacaatactcactcaatggct

SEQ ID NO: 7431500 - DNA, 20 bp, Homo sapiens
tcacaatatgagctcataca

SEQ ID NO: 7431501 - DNA, 20 bp, Homo sapiens
tcacaatatgagctcataca

SEQ ID NO: 7431502 - DNA, 21 bp, Homo sapiens
tcacaagtactcatctctgcc

SEQ ID NO: 7431503 - DNA, 20 bp, Homo sapiens
tcacaatatgagctcataca

SEQ ID NO: 7431504 - DNA, 22 bp, Homo sapiens
tcacaatatttatcttccaatt

SEQ ID NO: 7431505 - DNA, 22 bp, Homo sapiens
tcacaatatttatcttccaatt

SEQ ID NO: 7431506 - DNA, 22 bp, Homo sapiens
tcacaatatgggtgtgggaact

SEQ ID NO: 7431507 - DNA, 22 bp, Homo sapiens
tcacaatgaaaaacactacata

SEQ ID NO: 7431508 - DNA, 22 bp, Homo sapiens
tcacaattcagaaaccaagtag

SEQ ID NO: 7431509 - DNA, 22 bp, Homo sapiens
tcacacatgagtaaatacaggg

SEQ ID NO: 7431510 - DNA, 22 bp, Homo sapiens
tcacacatgagtaaatacaggg

SEQ ID NO: 7431511 - DNA, 22 bp, Homo sapiens
tcacaatgaaaaacactacata

SEQ ID NO: 7431512 - DNA, 22 bp, Homo sapiens
tcacaatgcaagtgttcagtgg

SEQ ID NO: 7431513 - DNA, 22 bp, Homo sapiens
tcacaatgcaagtgttcagtgg

SEQ ID NO: 7431514 - DNA, 22 bp, Homo sapiens
tcacaatgcaagtgttcagtgg

SEQ ID NO: 7431515 - DNA, 22 bp, Homo sapiens
tcacagaaaagctgagcatcag

SEQ ID NO: 7431516 - DNA, 22 bp, Homo sapiens
tcacagaaaagctgagcatcag

SEQ ID NO: 7431517 - DNA, 22 bp, Homo sapiens
tcacagaaaagctgagcatcag

SEQ ID NO: 7431518 - DNA, 20 bp, Homo sapiens
tcacacatggtaagctatga

SEQ ID NO: 7431519 - DNA, 20 bp, Homo sapiens
tcacacatggtaagctatga

SEQ ID NO: 7431520 - DNA, 22 bp, Homo sapiens
tcacacatgctaagccagagat

SEQ ID NO: 7431521 - DNA, 22 bp, Homo sapiens
tcacacatgctaagccagagat

SEQ ID NO: 7431522 - DNA, 20 bp, Homo sapiens
tcacagaaacaaatagagaa

SEQ ID NO: 7431523 - DNA, 22 bp, Homo sapiens
tcacagaaaagtggagagccta

SEQ ID NO: 7431524 - DNA, 20 bp, Homo sapiens
tcacagaaacaaatagagaa

SEQ ID NO: 7431525 - DNA, 20 bp, Homo sapiens
tcacagaaacaaatagagaa

SEQ ID NO: 7431526 - DNA, 20 bp, Homo sapiens
tcacagaaacaaatagagaa

SEQ ID NO: 7431527 - DNA, 22 bp, Homo sapiens
tcacagaaacagaatggcacag

SEQ ID NO: 7431528 - DNA, 22 bp, Homo sapiens
tcacagaaacagaatggcacag

SEQ ID NO: 7431529 - DNA, 22 bp, Homo sapiens
tcacagaaacagaatggcacag

SEQ ID NO: 7431530 - DNA, 22 bp, Homo sapiens
tcacagaaaagctgagcatcag

SEQ ID NO: 7431531 - DNA, 20 bp, Homo sapiens
tcacagaaacaaatagagaa

SEQ ID NO: 7431532 - DNA, 20 bp, Homo sapiens
tcacagaaacaaatagagaa

SEQ ID NO: 7431533 - DNA, 20 bp, Homo sapiens
tcacagaaacaaatagagaa

SEQ ID NO: 7431534 - DNA, 22 bp, Homo sapiens
tcacagaaaagtggagagccta

SEQ ID NO: 7431535 - DNA, 22 bp, Homo sapiens
tcacagaaaagctgagcatcag

SEQ ID NO: 7431536 - DNA, 22 bp, Homo sapiens
tcacagaaaagctgagcatcag

SEQ ID NO: 7431537 - DNA, 22 bp, Homo sapiens
tcacagaaaagctgagcatcag

SEQ ID NO: 7431538 - DNA, 22 bp, Homo sapiens
tcacagaaataagatagttatt

SEQ ID NO: 7431539 - DNA, 22 bp, Homo sapiens
tcacagaaataagatagttatt

SEQ ID NO: 7431540 - DNA, 22 bp, Homo sapiens
tcacagaaataagatagttatt

SEQ ID NO: 7431541 - DNA, 22 bp, Homo sapiens
tcacagaaataagatagttatt

SEQ ID NO: 7431542 - DNA, 22 bp, Homo sapiens
tcacagaaagctgtgtcctgac

SEQ ID NO: 7431543 - DNA, 22 bp, Homo sapiens
tcacagaaataagatagttatt

SEQ ID NO: 7431544 - DNA, 22 bp, Homo sapiens
tcacagaaagctgtgtcctgac

SEQ ID NO: 7431545 - DNA, 22 bp, Homo sapiens
tcacagaaacagaatggcacag

SEQ ID NO: 7431546 - DNA, 22 bp, Homo sapiens
tcacagaaacagaatggcacag

SEQ ID NO: 7431547 - DNA, 22 bp, Homo sapiens
tcacagaaagctgtgtcctgac

SEQ ID NO: 7431548 - DNA, 22 bp, Homo sapiens
tcacagaaagctgtgtcctgac

SEQ ID NO: 7431549 - DNA, 22 bp, Homo sapiens
tcacagaacaagcctggtggag

SEQ ID NO: 7431550 - DNA, 22 bp, Homo sapiens
tcacagaacaagcctggtggag

SEQ ID NO: 7431551 - DNA, 22 bp, Homo sapiens
tcacagaacaatgtttagttct

SEQ ID NO: 7431552 - DNA, 22 bp, Homo sapiens
tcacagaacaagcctggtggag

SEQ ID NO: 7431553 - DNA, 22 bp, Homo sapiens
tcacagaacaagcctggtggag

SEQ ID NO: 7431554 - DNA, 22 bp, Homo sapiens
tcacagaacaagcctggtggag

SEQ ID NO: 7431555 - DNA, 22 bp, Homo sapiens
tcacagaacaagcctggtggag

SEQ ID NO: 7431556 - DNA, 22 bp, Homo sapiens
tcacagaacaagcctggtggag

SEQ ID NO: 7431557 - DNA, 22 bp, Homo sapiens
tcacagaaataagatagttatt

SEQ ID NO: 7431558 - DNA, 22 bp, Homo sapiens
tcacagaaataagatagttatt

SEQ ID NO: 7431559 - DNA, 22 bp, Homo sapiens
tcacagaaatctgttttttcta

SEQ ID NO: 7431560 - DNA, 22 bp, Homo sapiens
tcacagaaatctgttttttcta

SEQ ID NO: 7431561 - DNA, 22 bp, Homo sapiens
tcacagaaatctgttttttcta

SEQ ID NO: 7431562 - DNA, 22 bp, Homo sapiens
tcacagaagagatattgacaga

SEQ ID NO: 7431563 - DNA, 22 bp, Homo sapiens
tcacagaagagatattgacaga

SEQ ID NO: 7431564 - DNA, 22 bp, Homo sapiens
tcacagaagaagtagattgcat

SEQ ID NO: 7431565 - DNA, 22 bp, Homo sapiens
tcacagaagaagtagattgcat

SEQ ID NO: 7431566 - DNA, 22 bp, Homo sapiens
tcacagaagagatattgacaga

SEQ ID NO: 7431567 - DNA, 22 bp, Homo sapiens
tcacagaagagatattgacaga

SEQ ID NO: 7431568 - DNA, 22 bp, Homo sapiens
tcacagaagagatattgacaga

SEQ ID NO: 7431569 - DNA, 22 bp, Homo sapiens
tcacagaagagatattgacaga

SEQ ID NO: 7431570 - DNA, 22 bp, Homo sapiens
tcacagaagagcattaagatga

SEQ ID NO: 7431571 - DNA, 22 bp, Homo sapiens
tcacagaagagcattaagatga

SEQ ID NO: 7431572 - DNA, 22 bp, Homo sapiens
tcacagaagagcattaagatga

SEQ ID NO: 7431573 - DNA, 22 bp, Homo sapiens
tcacagaagagatattgacaga

SEQ ID NO: 7431574 - DNA, 22 bp, Homo sapiens
tcacagaacaatgtttagttct

SEQ ID NO: 7431575 - DNA, 22 bp, Homo sapiens
tcacagaacaatgtttagttct

SEQ ID NO: 7431576 - DNA, 22 bp, Homo sapiens
tcacagaacaatgtttagttct

SEQ ID NO: 7431577 - DNA, 22 bp, Homo sapiens
tcacagaacacaaatgccactt

SEQ ID NO: 7431578 - DNA, 22 bp, Homo sapiens
tcacagaacacaaatgccactt

SEQ ID NO: 7431579 - DNA, 22 bp, Homo sapiens
tcacagaacacaaatgccactt

SEQ ID NO: 7431580 - DNA, 22 bp, Homo sapiens
tcacagaacacaaatgccactt

SEQ ID NO: 7431581 - DNA, 22 bp, Homo sapiens
tcacagaacacaaatgccactt

SEQ ID NO: 7431582 - DNA, 22 bp, Homo sapiens
tcacagaacacaaatgccactt

SEQ ID NO: 7431583 - DNA, 22 bp, Homo sapiens
tcacagaacacaaatgccactt

SEQ ID NO: 7431584 - DNA, 22 bp, Homo sapiens
tcacagaacacaaatgccactt

SEQ ID NO: 7431585 - DNA, 22 bp, Homo sapiens
tcacagaacacaaatgccactt

SEQ ID NO: 7431586 - DNA, 22 bp, Homo sapiens
tcacagaagaagtagattgcat

SEQ ID NO: 7431587 - DNA, 22 bp, Homo sapiens
tcacagaagaagtagattgcat

SEQ ID NO: 7431588 - DNA, 22 bp, Homo sapiens
tcacagaagaagtagattgcat

SEQ ID NO: 7431589 - DNA, 22 bp, Homo sapiens
tccccaccccagaactactagg

SEQ ID NO: 7431590 - DNA, 22 bp, Homo sapiens
tccccaccccagaactactagg

SEQ ID NO: 7431591 - DNA, 22 bp, Homo sapiens
tccccaccccagaactactagg

SEQ ID NO: 7431592 - DNA, 22 bp, Homo sapiens
tccccaccccagaactactagg

SEQ ID NO: 7431593 - DNA, 21 bp, Homo sapiens
tccccacatttctaaacagac

SEQ ID NO: 7431594 - DNA, 21 bp, Homo sapiens
tccccacatttctaaacagac

SEQ ID NO: 7431595 - DNA, 21 bp, Homo sapiens
tccccacatttctaaacagac

SEQ ID NO: 7431596 - DNA, 22 bp, Homo sapiens
tccccacatctctgcatcaggc

SEQ ID NO: 7431597 - DNA, 22 bp, Homo sapiens
tccccacatctctgcatcaggc

SEQ ID NO: 7431598 - DNA, 22 bp, Homo sapiens
tccccacatctctgcatcaggc

SEQ ID NO: 7431599 - DNA, 21 bp, Homo sapiens
tccccacatttctaaacagac

SEQ ID NO: 7431600 - DNA, 22 bp, Homo sapiens
tccccacagcagaagatctgag

SEQ ID NO: 7431601 - DNA, 21 bp, Homo sapiens
tccccacatttctaaacagac

SEQ ID NO: 7431602 - DNA, 22 bp, Homo sapiens
tccccacatctctgcatcaggc

SEQ ID NO: 7431603 - DNA, 22 bp, Homo sapiens
tccccacatctctgcatcaggc

SEQ ID NO: 7431604 - DNA, 22 bp, Homo sapiens
tccccacagcagaagatctgag

SEQ ID NO: 7431605 - DNA, 22 bp, Homo sapiens
tccccacatctctgcatcaggc

SEQ ID NO: 7431606 - DNA, 22 bp, Homo sapiens
tccccacatctctgcatcaggc

SEQ ID NO: 7431607 - DNA, 22 bp, Homo sapiens
tccccacatctctgcatcaggc

SEQ ID NO: 7431608 - DNA, 22 bp, Homo sapiens
tccccacatctctgcatcaggc

SEQ ID NO: 7431609 - DNA, 22 bp, Homo sapiens
tccccacactttcactcctggc

SEQ ID NO: 7431610 - DNA, 22 bp, Homo sapiens
tccccacactttcactcctggc

SEQ ID NO: 7431611 - DNA, 22 bp, Homo sapiens
tccccacactttcactcctggc

SEQ ID NO: 7431612 - DNA, 22 bp, Homo sapiens
tccccacactttcactcctggc

SEQ ID NO: 7431613 - DNA, 22 bp, Homo sapiens
tccccacacagatacagagtag

SEQ ID NO: 7431614 - DNA, 22 bp, Homo sapiens
tccccacacagatacagagtag

SEQ ID NO: 7431615 - DNA, 22 bp, Homo sapiens
tccccacacagatacagagtag

SEQ ID NO: 7431616 - DNA, 22 bp, Homo sapiens
tccccacacagatacagagtag

SEQ ID NO: 7431617 - DNA, 22 bp, Homo sapiens
tccccaatttgagtcacctctg

SEQ ID NO: 7431618 - DNA, 22 bp, Homo sapiens
tccccacacagatacagagtag

SEQ ID NO: 7431619 - DNA, 22 bp, Homo sapiens
tccccaagtaaagatcctgaga

SEQ ID NO: 7431620 - DNA, 22 bp, Homo sapiens
tccccaagcaggcaatctcccg

SEQ ID NO: 7431621 - DNA, 22 bp, Homo sapiens
tccccaagcaggcaatctcccg

SEQ ID NO: 7431622 - DNA, 22 bp, Homo sapiens
tcccatttcatgctggctgtgg

SEQ ID NO: 7431623 - DNA, 22 bp, Homo sapiens
tcccatttcacaacaaaactgg

SEQ ID NO: 7431624 - DNA, 22 bp, Homo sapiens
tccccaaaatacatggacgtgt

SEQ ID NO: 7431625 - DNA, 22 bp, Homo sapiens
tccccaaaatacatggacgtgt

SEQ ID NO: 7431626 - DNA, 22 bp, Homo sapiens
tccccaaagctttgtggtcagg

SEQ ID NO: 7431627 - DNA, 19 bp, Homo sapiens
tccccaagagttctagctc

SEQ ID NO: 7431628 - DNA, 22 bp, Homo sapiens
tccccaaagctttgtggtcagg

SEQ ID NO: 7431629 - DNA, 19 bp, Homo sapiens
tccccaagagttctagctc

SEQ ID NO: 7431630 - DNA, 22 bp, Homo sapiens
tccccacctaagatacccatct

SEQ ID NO: 7431631 - DNA, 22 bp, Homo sapiens
tccccaccccagaactactagg

SEQ ID NO: 7431632 - DNA, 22 bp, Homo sapiens
tccccaccccagaactactagg

SEQ ID NO: 7431633 - DNA, 22 bp, Homo sapiens
tccccacctaagatacccatct

SEQ ID NO: 7431634 - DNA, 22 bp, Homo sapiens
tccccacctaagatacccatct

SEQ ID NO: 7431635 - DNA, 22 bp, Homo sapiens
tccccacctaagatacccatct

SEQ ID NO: 7431636 - DNA, 22 bp, Homo sapiens
tccccacctaagatacccatct

SEQ ID NO: 7431637 - DNA, 22 bp, Homo sapiens
tccccacctaagatacccatct

SEQ ID NO: 7431638 - DNA, 22 bp, Homo sapiens
tccccacctacacactgctcct

SEQ ID NO: 7431639 - DNA, 22 bp, Homo sapiens
tccccacctacacactgctcct

SEQ ID NO: 7431640 - DNA, 22 bp, Homo sapiens
tccccacctacacactgctcct

SEQ ID NO: 7431641 - DNA, 22 bp, Homo sapiens
tccccacctacacactgctcct

SEQ ID NO: 7431642 - DNA, 22 bp, Homo sapiens
tccccacctacacactgctcct

SEQ ID NO: 7431643 - DNA, 22 bp, Homo sapiens
tccccacctacacactgctcct

SEQ ID NO: 7431644 - DNA, 22 bp, Homo sapiens
tccccacctacacactgctcct

SEQ ID NO: 7431645 - DNA, 22 bp, Homo sapiens
tccccacctacacactgctcct

SEQ ID NO: 7431646 - DNA, 22 bp, Homo sapiens
tccccaggaatcaggtggttgc

SEQ ID NO: 7431647 - DNA, 22 bp, Homo sapiens
tccccaggaatcaggtggttgc

SEQ ID NO: 7431648 - DNA, 22 bp, Homo sapiens
tccccaggaatcaggtggttgc

SEQ ID NO: 7431649 - DNA, 22 bp, Homo sapiens
tccccaggagcaatgattcagt

SEQ ID NO: 7431650 - DNA, 22 bp, Homo sapiens
tccccaggagcaatgattcagt

SEQ ID NO: 7431651 - DNA, 22 bp, Homo sapiens
tccccaggactaagttgcaatc

SEQ ID NO: 7431652 - DNA, 22 bp, Homo sapiens
tccccaggactaagttgcaatc

SEQ ID NO: 7431653 - DNA, 22 bp, Homo sapiens
tccccaggaaggcccttcctgg

SEQ ID NO: 7431654 - DNA, 22 bp, Homo sapiens
tccccaggaaggcccttcctgg

SEQ ID NO: 7431655 - DNA, 22 bp, Homo sapiens
tccccaggaaattctgattctt

SEQ ID NO: 7431656 - DNA, 22 bp, Homo sapiens
tccccactcaccactggccaaa

SEQ ID NO: 7431657 - DNA, 22 bp, Homo sapiens
tccccactcaccactggccaaa

SEQ ID NO: 7431658 - DNA, 22 bp, Homo sapiens
tccccaggggcctgggcacagt

SEQ ID NO: 7431659 - DNA, 22 bp, Homo sapiens
tccccaggggcctgggcacagt

SEQ ID NO: 7431660 - DNA, 22 bp, Homo sapiens
tccccaggggcctgggcacagt

SEQ ID NO: 7431661 - DNA, 22 bp, Homo sapiens
tccccaggggcctgggcacagt

SEQ ID NO: 7431662 - DNA, 22 bp, Homo sapiens
tccccaggggcatctctctgct

SEQ ID NO: 7431663 - DNA, 22 bp, Homo sapiens
tccccaggggcatctctctgct

SEQ ID NO: 7431664 - DNA, 22 bp, Homo sapiens
tccccaggggcatctctctgct

SEQ ID NO: 7431665 - DNA, 22 bp, Homo sapiens
tccccaggggcatctctctgct

SEQ ID NO: 7431666 - DNA, 22 bp, Homo sapiens
tccccagggtccctgcttccat

SEQ ID NO: 7431667 - DNA, 22 bp, Homo sapiens
tccccaggggcctgggcacagt

SEQ ID NO: 7431668 - DNA, 22 bp, Homo sapiens
tccccagggtccctgcttccat

SEQ ID NO: 7431669 - DNA, 22 bp, Homo sapiens
tccccagggtccctgcttccat

SEQ ID NO: 7431670 - DNA, 22 bp, Homo sapiens
tccccagggtccctgcttccat

SEQ ID NO: 7431671 - DNA, 22 bp, Homo sapiens
tccccaggggcctgggcacagt

SEQ ID NO: 7431672 - DNA, 22 bp, Homo sapiens
tccccaggggcctgggcacagt

SEQ ID NO: 7431673 - DNA, 22 bp, Homo sapiens
tccccaggggcctgggcacagt

SEQ ID NO: 7431674 - DNA, 22 bp, Homo sapiens
tccccagggctgcagagggtgt

SEQ ID NO: 7431675 - DNA, 20 bp, Homo sapiens
tccccagggcatcaggagca

SEQ ID NO: 7431676 - DNA, 22 bp, Homo sapiens
tccccagggctgcagagggtgt

SEQ ID NO: 7431677 - DNA, 22 bp, Homo sapiens
tccccagggctgcagagggtgt

SEQ ID NO: 7431678 - DNA, 22 bp, Homo sapiens
tccccagggctgcagagggtgt

SEQ ID NO: 7431679 - DNA, 22 bp, Homo sapiens
tccccagggctgcagagggtgt

SEQ ID NO: 7431680 - DNA, 22 bp, Homo sapiens
tccccaggggcatctctctgct

SEQ ID NO: 7431681 - DNA, 22 bp, Homo sapiens
tccccaggggcatctctctgct

SEQ ID NO: 7431682 - DNA, 22 bp, Homo sapiens
tccccaggggcatctctctgct

SEQ ID NO: 7431683 - DNA, 22 bp, Homo sapiens
tccccaggggcatctctctgct

SEQ ID NO: 7431684 - DNA, 22 bp, Homo sapiens
tccccaggagttttactttgca

SEQ ID NO: 7431685 - DNA, 22 bp, Homo sapiens
tccccaggagttttactttgca

SEQ ID NO: 7431686 - DNA, 22 bp, Homo sapiens
tccccaggagcaatgattcagt

SEQ ID NO: 7431687 - DNA, 20 bp, Homo sapiens
tccccagggcatcaggagca

SEQ ID NO: 7431688 - DNA, 20 bp, Homo sapiens
tccccagggcatcaggagca

SEQ ID NO: 7431689 - DNA, 20 bp, Homo sapiens
tccccagggcatcaggagca

SEQ ID NO: 7431690 - DNA, 20 bp, Homo sapiens
tccccagggcatcaggagca

SEQ ID NO: 7431691 - DNA, 20 bp, Homo sapiens
tccccagggcatcaggagca

SEQ ID NO: 7431692 - DNA, 20 bp, Homo sapiens
tccccagggcatcaggagca

SEQ ID NO: 7431693 - DNA, 22 bp, Homo sapiens
tcccagtttttctccactaagg

SEQ ID NO: 7431694 - DNA, 22 bp, Homo sapiens
tcccagtttttctccactaagg

SEQ ID NO: 7431695 - DNA, 22 bp, Homo sapiens
tcccagtttttctccactaagg

SEQ ID NO: 7431696 - DNA, 22 bp, Homo sapiens
tcccagtttttctccactaagg

SEQ ID NO: 7431697 - DNA, 22 bp, Homo sapiens
tcccatagatttttcagggtta

SEQ ID NO: 7431698 - DNA, 22 bp, Homo sapiens
tcccatatatgcaaaaatgtaa

SEQ ID NO: 7431699 - DNA, 22 bp, Homo sapiens
tcccatcacatggagagtgaag

SEQ ID NO: 7431700 - DNA, 22 bp, Homo sapiens
tcccatcaatgtctgcagaaga

SEQ ID NO: 7431701 - DNA, 22 bp, Homo sapiens
tcccatcaatgtctgcagaaga

SEQ ID NO: 7431702 - DNA, 22 bp, Homo sapiens
tcccagtggtcttgaaacaggg

SEQ ID NO: 7431703 - DNA, 22 bp, Homo sapiens
tcccagtgtggcaggccatgga

SEQ ID NO: 7431704 - DNA, 22 bp, Homo sapiens
tcccagtggtgggtgcacattt

SEQ ID NO: 7431705 - DNA, 22 bp, Homo sapiens
tcccagtggtgggtgcacattt

SEQ ID NO: 7431706 - DNA, 22 bp, Homo sapiens
tcccagtgggtgactggaggct

SEQ ID NO: 7431707 - DNA, 22 bp, Homo sapiens
tcccagtgggtgactggaggct

SEQ ID NO: 7431708 - DNA, 22 bp, Homo sapiens
tcccagtgggtgactggaggct

SEQ ID NO: 7431709 - DNA, 22 bp, Homo sapiens
tcccagtggtcctggccctggg

SEQ ID NO: 7431710 - DNA, 22 bp, Homo sapiens
tcccagtggtcttgaaacaggg

SEQ ID NO: 7431711 - DNA, 22 bp, Homo sapiens
tcccagtgaggtcctggctgtc

SEQ ID NO: 7431712 - DNA, 22 bp, Homo sapiens
tcccagtgagcacaggtagtgc

SEQ ID NO: 7431713 - DNA, 22 bp, Homo sapiens
tcccagtgagcacaggtagtgc

SEQ ID NO: 7431714 - DNA, 22 bp, Homo sapiens
tcccagtgagatgaaacaggta

SEQ ID NO: 7431715 - DNA, 20 bp, Homo sapiens
tcccagtcagccagagtgag

SEQ ID NO: 7431716 - DNA, 22 bp, Homo sapiens
tcccaggttccaccatccaggg

SEQ ID NO: 7431717 - DNA, 22 bp, Homo sapiens
tcccagtctagagccggattgg

SEQ ID NO: 7431718 - DNA, 20 bp, Homo sapiens
tcccagtcagccagagtgag

SEQ ID NO: 7431719 - DNA, 20 bp, Homo sapiens
tcccagtcagccagagtgag

SEQ ID NO: 7431720 - DNA, 22 bp, Homo sapiens
tcccagtgggaagcagcacgct

SEQ ID NO: 7431721 - DNA, 22 bp, Homo sapiens
tcccagtggcttcataaggcag

SEQ ID NO: 7431722 - DNA, 22 bp, Homo sapiens
tcccagtggcttcataaggcag

SEQ ID NO: 7431723 - DNA, 19 bp, Homo sapiens
tcccagtggggagaggtgt

SEQ ID NO: 7431724 - DNA, 22 bp, Homo sapiens
tcccagtgctgctaaagaggta

SEQ ID NO: 7431725 - DNA, 22 bp, Homo sapiens
tcccagtgctacagacagggca

SEQ ID NO: 7431726 - DNA, 22 bp, Homo sapiens
tcccagtgctgctaaagaggta

SEQ ID NO: 7431727 - DNA, 22 bp, Homo sapiens
tcccagtgctacagacagggca

SEQ ID NO: 7431728 - DNA, 22 bp, Homo sapiens
tcccagtgctacagacagggca

SEQ ID NO: 7431729 - DNA, 20 bp, Homo sapiens
tcccagtctttggtctgagc

SEQ ID NO: 7431730 - DNA, 22 bp, Homo sapiens
tcccagtgaggtcctggctgtc

SEQ ID NO: 7431731 - DNA, 22 bp, Homo sapiens
tcccagtgaggtcctggctgtc

SEQ ID NO: 7431732 - DNA, 22 bp, Homo sapiens
tcccattgccatagataggaca

SEQ ID NO: 7431733 - DNA, 22 bp, Homo sapiens
tcccattgtttgctctaggctg

SEQ ID NO: 7431734 - DNA, 22 bp, Homo sapiens
tcccatttattaattagtttgc

SEQ ID NO: 7431735 - DNA, 22 bp, Homo sapiens
tcccatgttaggtgtttctgtt

SEQ ID NO: 7431736 - DNA, 22 bp, Homo sapiens
tcccatgttaggtgtttctgtt

SEQ ID NO: 7431737 - DNA, 22 bp, Homo sapiens
tcccatgttgatctttgggttg

SEQ ID NO: 7431738 - DNA, 22 bp, Homo sapiens
tcccatgttgatctttgggttg

SEQ ID NO: 7431739 - DNA, 22 bp, Homo sapiens
tcccatgttaccaaggagtcac

SEQ ID NO: 7431740 - DNA, 18 bp, Homo sapiens
tcccatgttgtttttaaa

SEQ ID NO: 7431741 - DNA, 18 bp, Homo sapiens
tcccatgttgtttttaaa

SEQ ID NO: 7431742 - DNA, 22 bp, Homo sapiens
tcccatgttgtgcctggctgca

SEQ ID NO: 7431743 - DNA, 22 bp, Homo sapiens
tcccatgttgtgcctggctgca

SEQ ID NO: 7431744 - DNA, 20 bp, Homo sapiens
tcccatgtccatatcagccc

SEQ ID NO: 7431745 - DNA, 20 bp, Homo sapiens
tcccatgtccatatcagccc

SEQ ID NO: 7431746 - DNA, 22 bp, Homo sapiens
tcccatgtaagaaggagacagg

SEQ ID NO: 7431747 - DNA, 22 bp, Homo sapiens
tcccatggtctatatagaggca

SEQ ID NO: 7431748 - DNA, 22 bp, Homo sapiens
tcccatgtaagaaggagacagg

SEQ ID NO: 7431749 - DNA, 22 bp, Homo sapiens
tcccatgtaagaaggagacagg

SEQ ID NO: 7431750 - DNA, 22 bp, Homo sapiens
tcccatgtgactcagctgcctg

SEQ ID NO: 7431751 - DNA, 22 bp, Homo sapiens
tcccatgtgttcctctagtcta

SEQ ID NO: 7431752 - DNA, 20 bp, Homo sapiens
tcccatcacgcctgtgccag

SEQ ID NO: 7431753 - DNA, 22 bp, Homo sapiens
tcccatcactagcatctgcacc

SEQ ID NO: 7431754 - DNA, 22 bp, Homo sapiens
tcccatcactagcatctgcacc

SEQ ID NO: 7431755 - DNA, 18 bp, Homo sapiens
tcccatcatcctctccag

SEQ ID NO: 7431756 - DNA, 18 bp, Homo sapiens
tcccatcatcctctccag

SEQ ID NO: 7431757 - DNA, 22 bp, Homo sapiens
tcccatcatctgttctggctac

SEQ ID NO: 7431758 - DNA, 22 bp, Homo sapiens
tcccatcatctgttctggctac

SEQ ID NO: 7431759 - DNA, 22 bp, Homo sapiens
tcccatggtctatatagaggca

SEQ ID NO: 7431760 - DNA, 22 bp, Homo sapiens
tcccatggtctatatagaggca

SEQ ID NO: 7431761 - DNA, 23 bp, Homo sapiens
tcccatgggctcactgccctgca

SEQ ID NO: 7431762 - DNA, 22 bp, Homo sapiens
tcccatggtctatatagaggca

SEQ ID NO: 7431763 - DNA, 23 bp, Homo sapiens
tcccatgggctcactgccctgca

SEQ ID NO: 7431764 - DNA, 23 bp, Homo sapiens
tcccatgggctcactgccctgca

SEQ ID NO: 7431765 - DNA, 22 bp, Homo sapiens
tcccagggattaggacatggat

SEQ ID NO: 7431766 - DNA, 21 bp, Homo sapiens
tcccagggtcttatgggatgt

SEQ ID NO: 7431767 - DNA, 22 bp, Homo sapiens
tcccagggattaggacatggat

SEQ ID NO: 7431768 - DNA, 22 bp, Homo sapiens
tcccagggattaggacatggat

SEQ ID NO: 7431769 - DNA, 22 bp, Homo sapiens
tcccagggattaggacatggat

SEQ ID NO: 7431770 - DNA, 22 bp, Homo sapiens
tcccagggattaggacatggat

SEQ ID NO: 7431771 - DNA, 22 bp, Homo sapiens
tcccagggatcctccgggtcgc

SEQ ID NO: 7431772 - DNA, 22 bp, Homo sapiens
tcccagggatcctccgggtcgc

SEQ ID NO: 7431773 - DNA, 22 bp, Homo sapiens
tcccagggtgaaatgcagtagg

SEQ ID NO: 7431774 - DNA, 22 bp, Homo sapiens
tcccagggtgaaatgcagtagg

SEQ ID NO: 7431775 - DNA, 22 bp, Homo sapiens
tcccagggtgaaatgcagtagg

SEQ ID NO: 7431776 - DNA, 22 bp, Homo sapiens
tcccagggtgaaatgcagtagg

SEQ ID NO: 7431777 - DNA, 21 bp, Homo sapiens
tcccagggtcttatgggatgt

SEQ ID NO: 7431778 - DNA, 21 bp, Homo sapiens
tcccagggtcttatgggatgt

SEQ ID NO: 7431779 - DNA, 21 bp, Homo sapiens
tcccagggtcttatgggatgt

SEQ ID NO: 7431780 - DNA, 22 bp, Homo sapiens
tcccagggtgaaatgcagtagg

SEQ ID NO: 7431781 - DNA, 22 bp, Homo sapiens
tcccagggttacagccagggca

SEQ ID NO: 7431782 - DNA, 22 bp, Homo sapiens
tcccaggtctttgggttcctca

SEQ ID NO: 7431783 - DNA, 22 bp, Homo sapiens
tcccagggttacagccagggca

SEQ ID NO: 7431784 - DNA, 22 bp, Homo sapiens
tcccaggttccaccatccaggg

SEQ ID NO: 7431785 - DNA, 22 bp, Homo sapiens
tcccaggtgatgctgaggccac

SEQ ID NO: 7431786 - DNA, 22 bp, Homo sapiens
tcccagggttacagccagggca

SEQ ID NO: 7431787 - DNA, 22 bp, Homo sapiens
tcccagggttacagccagggca

SEQ ID NO: 7431788 - DNA, 22 bp, Homo sapiens
tcccagggttacagccagggca

SEQ ID NO: 7431789 - DNA, 22 bp, Homo sapiens
tcccagggtgcgcctgccctcg

SEQ ID NO: 7431790 - DNA, 22 bp, Homo sapiens
tcccagggtgcgcctgccctcg

SEQ ID NO: 7431791 - DNA, 22 bp, Homo sapiens
tcccagggtgcgcctgccctcg

SEQ ID NO: 7431792 - DNA, 22 bp, Homo sapiens
tcccagggtgcgcctgccctcg

SEQ ID NO: 7431793 - DNA, 22 bp, Homo sapiens
tcccagggttacagccagggca

SEQ ID NO: 7431794 - DNA, 22 bp, Homo sapiens
tcccagggttacagccagggca

SEQ ID NO: 7431795 - DNA, 22 bp, Homo sapiens
tcccagggttacagccagggca

SEQ ID NO: 7431796 - DNA, 22 bp, Homo sapiens
tcccagggttacagccagggca

SEQ ID NO: 7431797 - DNA, 22 bp, Homo sapiens
tcccagggttacagccagggca

SEQ ID NO: 7431798 - DNA, 22 bp, Homo sapiens
tcccagggttacagccagggca

SEQ ID NO: 7431799 - DNA, 22 bp, Homo sapiens
tcccacaggagcctgagtccca

SEQ ID NO: 7431800 - DNA, 22 bp, Homo sapiens
tcccacaggagcctgagtccca

SEQ ID NO: 7431801 - DNA, 22 bp, Homo sapiens
tcccacagcttcgtgcttcccc

SEQ ID NO: 7431802 - DNA, 22 bp, Homo sapiens
tcccacaggaaagtagacattg

SEQ ID NO: 7431803 - DNA, 22 bp, Homo sapiens
tcccacaggaaagtagacattg

SEQ ID NO: 7431804 - DNA, 22 bp, Homo sapiens
tcccacaggaaagtagacattg

SEQ ID NO: 7431805 - DNA, 22 bp, Homo sapiens
tcccacagcttcgtgcttcccc

SEQ ID NO: 7431806 - DNA, 22 bp, Homo sapiens
tcccacagcttcgtgcttcccc

SEQ ID NO: 7431807 - DNA, 22 bp, Homo sapiens
tcccacaggggctctgtgggtt

SEQ ID NO: 7431808 - DNA, 22 bp, Homo sapiens
tcccacagggcttctctgtaca

SEQ ID NO: 7431809 - DNA, 22 bp, Homo sapiens
tcccacagggcttctctgtaca

SEQ ID NO: 7431810 - DNA, 22 bp, Homo sapiens
tcccacagggcttctctgtaca

SEQ ID NO: 7431811 - DNA, 22 bp, Homo sapiens
tcccacaggcccagggcggaaa

SEQ ID NO: 7431812 - DNA, 22 bp, Homo sapiens
tcccacagggcttctctgtaca

SEQ ID NO: 7431813 - DNA, 22 bp, Homo sapiens
tcccacaggagcctgagtccca

SEQ ID NO: 7431814 - DNA, 22 bp, Homo sapiens
tcccacaggagcctgagtccca

SEQ ID NO: 7431815 - DNA, 22 bp, Homo sapiens
tcccacaggaggagttggaaat

SEQ ID NO: 7431816 - DNA, 22 bp, Homo sapiens
tcccacaggaggagttggaaat

SEQ ID NO: 7431817 - DNA, 22 bp, Homo sapiens
tcccacaggcccagggcggaaa

SEQ ID NO: 7431818 - DNA, 22 bp, Homo sapiens
tcccacaggcccagggcggaaa

SEQ ID NO: 7431819 - DNA, 22 bp, Homo sapiens
tcccacaggtggagcttgcagt

SEQ ID NO: 7431820 - DNA, 22 bp, Homo sapiens
tcccacaggggctctgtgggtt

SEQ ID NO: 7431821 - DNA, 22 bp, Homo sapiens
tcccacaggtggagcttgcagt

SEQ ID NO: 7431822 - DNA, 22 bp, Homo sapiens
tcccacaggtggagcttgcagt

SEQ ID NO: 7431823 - DNA, 22 bp, Homo sapiens
tcccacagtctcacaatgcata

SEQ ID NO: 7431824 - DNA, 22 bp, Homo sapiens
tcccacagtgaagttcatgata

SEQ ID NO: 7431825 - DNA, 22 bp, Homo sapiens
tcccacagtgaagttcatgata

SEQ ID NO: 7431826 - DNA, 22 bp, Homo sapiens
tcccagggactgggctaggctt

SEQ ID NO: 7431827 - DNA, 22 bp, Homo sapiens
tcccagggactgggctaggctt

SEQ ID NO: 7431828 - DNA, 22 bp, Homo sapiens
tcccacagtgaagttcatgata

SEQ ID NO: 7431829 - DNA, 22 bp, Homo sapiens
tcccagggatcctccgggtcgc

SEQ ID NO: 7431830 - DNA, 22 bp, Homo sapiens
tcccagggatcctccgggtcgc

SEQ ID NO: 7431831 - DNA, 22 bp, Homo sapiens
tcccagggatcctccgggtcgc

SEQ ID NO: 7431832 - DNA, 22 bp, Homo sapiens
tcccagggactgggctaggctt

SEQ ID NO: 7431833 - DNA, 22 bp, Homo sapiens
tcccacagatgctgtccagagt

SEQ ID NO: 7431834 - DNA, 22 bp, Homo sapiens
tcccacagatgctgtccagagt

SEQ ID NO: 7431835 - DNA, 22 bp, Homo sapiens
tcccacagagtggctcacctag

SEQ ID NO: 7431836 - DNA, 22 bp, Homo sapiens
tcccacagatgctgtccagagt

SEQ ID NO: 7431837 - DNA, 22 bp, Homo sapiens
tcccacagatgctgtccagagt

SEQ ID NO: 7431838 - DNA, 22 bp, Homo sapiens
tcccacagatgctgtccagagt

SEQ ID NO: 7431839 - DNA, 21 bp, Homo sapiens
tcccacagaaactgcgaaatt

SEQ ID NO: 7431840 - DNA, 21 bp, Homo sapiens
tcccacagaaactgcgaaatt

SEQ ID NO: 7431841 - DNA, 22 bp, Homo sapiens
tcccacagagtggctcacctag

SEQ ID NO: 7431842 - DNA, 22 bp, Homo sapiens
tcccacagaccatgagtggaag

SEQ ID NO: 7431843 - DNA, 22 bp, Homo sapiens
tcccacagaccatgagtggaag

SEQ ID NO: 7431844 - DNA, 21 bp, Homo sapiens
tcccacagcgccagctcctgt

SEQ ID NO: 7431845 - DNA, 22 bp, Homo sapiens
tcccacagatgctgtccagagt

SEQ ID NO: 7431846 - DNA, 22 bp, Homo sapiens
tcccacagatgctgtccagagt

SEQ ID NO: 7431847 - DNA, 22 bp, Homo sapiens
tcccacagcatgagtaactctc

SEQ ID NO: 7431848 - DNA, 22 bp, Homo sapiens
tcccacagcttcgtgcttcccc

SEQ ID NO: 7431849 - DNA, 21 bp, Homo sapiens
tcccacagcgccagctcctgt

SEQ ID NO: 7431850 - DNA, 21 bp, Homo sapiens
tcccacagcgccagctcctgt

SEQ ID NO: 7431851 - DNA, 21 bp, Homo sapiens
tcccacagcgccagctcctgt

SEQ ID NO: 7431852 - DNA, 21 bp, Homo sapiens
tcccacagcgccagctcctgt

SEQ ID NO: 7431853 - DNA, 21 bp, Homo sapiens
tcccacagcgccagctcctgt

SEQ ID NO: 7431854 - DNA, 22 bp, Homo sapiens
tcccaatgtggtttctgcaaga

SEQ ID NO: 7431855 - DNA, 22 bp, Homo sapiens
tcccaagtgtcttggaccaggg

SEQ ID NO: 7431856 - DNA, 22 bp, Homo sapiens
tcccaagtactaccaatctaat

SEQ ID NO: 7431857 - DNA, 22 bp, Homo sapiens
tcccaatttcgagagttttaga

SEQ ID NO: 7431858 - DNA, 22 bp, Homo sapiens
tcccacacagcccgctcaccgg

SEQ ID NO: 7431859 - DNA, 22 bp, Homo sapiens
tcccacacagcccgctcaccgg

SEQ ID NO: 7431860 - DNA, 22 bp, Homo sapiens
tcccaattaacaggtatcaggc

SEQ ID NO: 7431861 - DNA, 21 bp, Homo sapiens
tcccacagaaactgcgaaatt

SEQ ID NO: 7431862 - DNA, 21 bp, Homo sapiens
tcccacagaaactgcgaaatt

SEQ ID NO: 7431863 - DNA, 22 bp, Homo sapiens
tcccacacttgaaacaaggctg

SEQ ID NO: 7431864 - DNA, 22 bp, Homo sapiens
tcccacacttgaaacaaggctg

SEQ ID NO: 7431865 - DNA, 22 bp, Homo sapiens
tcccacacctgtctattcctag

SEQ ID NO: 7431866 - DNA, 22 bp, Homo sapiens
tcccaaggccaggcatctagaa

SEQ ID NO: 7431867 - DNA, 22 bp, Homo sapiens
tcccaaggcacagggcagggac

SEQ ID NO: 7431868 - DNA, 22 bp, Homo sapiens
tcccaaggcacagggcagggac

SEQ ID NO: 7431869 - DNA, 20 bp, Homo sapiens
tcccaaggatgcctgggtgt

SEQ ID NO: 7431870 - DNA, 22 bp, Homo sapiens
tcccaaggcacagggcagggac

SEQ ID NO: 7431871 - DNA, 22 bp, Homo sapiens
tcccaaggataagagagtctga

SEQ ID NO: 7431872 - DNA, 22 bp, Homo sapiens
tcccaaggataagagagtctga

SEQ ID NO: 7431873 - DNA, 22 bp, Homo sapiens
tcccaaggataagagagtctga

SEQ ID NO: 7431874 - DNA, 20 bp, Homo sapiens
tcccaaggatgcctgggtgt

SEQ ID NO: 7431875 - DNA, 20 bp, Homo sapiens
tcccaaggatgcctgggtgt

SEQ ID NO: 7431876 - DNA, 20 bp, Homo sapiens
tcccaaggatgcctgggtgt

SEQ ID NO: 7431877 - DNA, 20 bp, Homo sapiens
tcccaaggatgcctgggtgt

SEQ ID NO: 7431878 - DNA, 20 bp, Homo sapiens
tcccaaggatgcctgggtgt

SEQ ID NO: 7431879 - DNA, 22 bp, Homo sapiens
tcccaaggtgctcggcaacagg

SEQ ID NO: 7431880 - DNA, 22 bp, Homo sapiens
tcccaaggtgctcggcaacagg

SEQ ID NO: 7431881 - DNA, 20 bp, Homo sapiens
tcccaagggctgagaggatc

SEQ ID NO: 7431882 - DNA, 22 bp, Homo sapiens
tcccaaggtgctcggcaacagg

SEQ ID NO: 7431883 - DNA, 22 bp, Homo sapiens
tcccaaggtgctcggcaacagg

SEQ ID NO: 7431884 - DNA, 20 bp, Homo sapiens
tcccaagggctgagaggatc

SEQ ID NO: 7431885 - DNA, 20 bp, Homo sapiens
tcccaagggctgagaggatc

SEQ ID NO: 7431886 - DNA, 20 bp, Homo sapiens
tcccaagggctgagaggatc

SEQ ID NO: 7431887 - DNA, 22 bp, Homo sapiens
tcccaaggcctctagttgatta

SEQ ID NO: 7431888 - DNA, 22 bp, Homo sapiens
tcccaaggcctctagttgatta

SEQ ID NO: 7431889 - DNA, 22 bp, Homo sapiens
tcccaaggcctctagttgatta

SEQ ID NO: 7431890 - DNA, 22 bp, Homo sapiens
tcccaaggccaggcatctagaa

SEQ ID NO: 7431891 - DNA, 22 bp, Homo sapiens
tcccaaggcacagggcagggac

SEQ ID NO: 7431892 - DNA, 22 bp, Homo sapiens
tccatgcagcagcctcccagcc

SEQ ID NO: 7431893 - DNA, 20 bp, Homo sapiens
tccatgcagtttccatacag

SEQ ID NO: 7431894 - DNA, 22 bp, Homo sapiens
tccatgcagaggagctggtggc

SEQ ID NO: 7431895 - DNA, 22 bp, Homo sapiens
tccatgcagaggagctggtggc

SEQ ID NO: 7431896 - DNA, 22 bp, Homo sapiens
tccatgcagagtccaggcctca

SEQ ID NO: 7431897 - DNA, 22 bp, Homo sapiens
tccatgccaggcagtcgatgca

SEQ ID NO: 7431898 - DNA, 22 bp, Homo sapiens
tccatgccaggcagtcgatgca

SEQ ID NO: 7431899 - DNA, 20 bp, Homo sapiens
tccatgcagtttccatacag

SEQ ID NO: 7431900 - DNA, 22 bp, Homo sapiens
tcccaagcaatgagtcagggcc

SEQ ID NO: 7431901 - DNA, 22 bp, Homo sapiens
tcccaagcaatgagtcagggcc

SEQ ID NO: 7431902 - DNA, 22 bp, Homo sapiens
tcccaagcttagggctctcagt

SEQ ID NO: 7431903 - DNA, 22 bp, Homo sapiens
tcccaagcttagggctctcagt

SEQ ID NO: 7431904 - DNA, 21 bp, Homo sapiens
tcccaagctgctggctcagct

SEQ ID NO: 7431905 - DNA, 22 bp, Homo sapiens
tcccaagcttagggctctcagt

SEQ ID NO: 7431906 - DNA, 22 bp, Homo sapiens
tcccaagcttagggctctcagt

SEQ ID NO: 7431907 - DNA, 22 bp, Homo sapiens
tcccaagcttagggctctcagt

SEQ ID NO: 7431908 - DNA, 22 bp, Homo sapiens
tcccaagcttagggctctcagt

SEQ ID NO: 7431909 - DNA, 22 bp, Homo sapiens
tcccaaggataagagagtctga

SEQ ID NO: 7431910 - DNA, 21 bp, Homo sapiens
tcccaagctgctggctcagct

SEQ ID NO: 7431911 - DNA, 21 bp, Homo sapiens
tcccaagctgctggctcagct

SEQ ID NO: 7431912 - DNA, 21 bp, Homo sapiens
tcccaagctgctggctcagct

SEQ ID NO: 7431913 - DNA, 22 bp, Homo sapiens
tcccaagccctggatgcctcag

SEQ ID NO: 7431914 - DNA, 22 bp, Homo sapiens
tcccaagccctggatgcctcag

SEQ ID NO: 7431915 - DNA, 22 bp, Homo sapiens
tcccaagccctggatgcctcag

SEQ ID NO: 7431916 - DNA, 22 bp, Homo sapiens
tcccaagccctggatgcctcag

SEQ ID NO: 7431917 - DNA, 22 bp, Homo sapiens
tccatgagaggtaactttacaa

SEQ ID NO: 7431918 - DNA, 22 bp, Homo sapiens
tccatgagaacccttggagata

SEQ ID NO: 7431919 - DNA, 22 bp, Homo sapiens
tccatgactaggaaaccagttt

SEQ ID NO: 7431920 - DNA, 20 bp, Homo sapiens
tccatcttgggcagaagcag

SEQ ID NO: 7431921 - DNA, 22 bp, Homo sapiens
tccatgacagcgtgagagtttg

SEQ ID NO: 7431922 - DNA, 23 bp, Homo sapiens
tccatgagatgtgggcttctagt

SEQ ID NO: 7431923 - DNA, 23 bp, Homo sapiens
tccatgagatgtgggcttctagt

SEQ ID NO: 7431924 - DNA, 17 bp, Homo sapiens
tccatgagacatgaaga

SEQ ID NO: 7431925 - DNA, 22 bp, Homo sapiens
tccatgagctagctttccaaag

SEQ ID NO: 7431926 - DNA, 22 bp, Homo sapiens
tccatgagctagggattcatca

SEQ ID NO: 7431927 - DNA, 22 bp, Homo sapiens
tccatgaggcagggaggctggc

SEQ ID NO: 7431928 - DNA, 22 bp, Homo sapiens
tccatgagaacccttggagata

SEQ ID NO: 7431929 - DNA, 22 bp, Homo sapiens
tccatgagctagggattcatca

SEQ ID NO: 7431930 - DNA, 22 bp, Homo sapiens
tccatgaggcagggaggctggc

SEQ ID NO: 7431931 - DNA, 22 bp, Homo sapiens
tccatgaggcagggaggctggc

SEQ ID NO: 7431932 - DNA, 22 bp, Homo sapiens
tccatgaggcagggaggctggc

SEQ ID NO: 7431933 - DNA, 22 bp, Homo sapiens
tccatgagggacactggatgct

SEQ ID NO: 7431934 - DNA, 22 bp, Homo sapiens
tccatgagtttgaggaaaagag

SEQ ID NO: 7431935 - DNA, 22 bp, Homo sapiens
tccatgagtttgaggaaaagag

SEQ ID NO: 7431936 - DNA, 22 bp, Homo sapiens
tccatgattggtcatcatagaa

SEQ ID NO: 7431937 - DNA, 22 bp, Homo sapiens
tccatgatttgagcacatgccg

SEQ ID NO: 7431938 - DNA, 22 bp, Homo sapiens
tccatgatttgagcacatgccg

SEQ ID NO: 7431939 - DNA, 22 bp, Homo sapiens
tccatgcaaacagtggctagct

SEQ ID NO: 7431940 - DNA, 22 bp, Homo sapiens
tccatgcaaacagtggctagct

SEQ ID NO: 7431941 - DNA, 22 bp, Homo sapiens
tccatgcaaacagtggctagct

SEQ ID NO: 7431942 - DNA, 20 bp, Homo sapiens
tccatgcaaatacagagttt

SEQ ID NO: 7431943 - DNA, 22 bp, Homo sapiens
tccatgcagagaactgaagtac

SEQ ID NO: 7431944 - DNA, 22 bp, Homo sapiens
tccatctgcatttggtttctgt

SEQ ID NO: 7431945 - DNA, 22 bp, Homo sapiens
tccatctggatggtatgtgtaa

SEQ ID NO: 7431946 - DNA, 22 bp, Homo sapiens
tccatctggagacttcctggtc

SEQ ID NO: 7431947 - DNA, 22 bp, Homo sapiens
tccatctggtaaaattcattga

SEQ ID NO: 7431948 - DNA, 20 bp, Homo sapiens
tccatctggtataagctgat

SEQ ID NO: 7431949 - DNA, 22 bp, Homo sapiens
tccatctggtggcttccttttg

SEQ ID NO: 7431950 - DNA, 22 bp, Homo sapiens
tccatctggtgagtgaggagcc

SEQ ID NO: 7431951 - DNA, 22 bp, Homo sapiens
tccatctggtgagtgaggagcc

SEQ ID NO: 7431952 - DNA, 22 bp, Homo sapiens
tccatctggtgagtgaggagcc

SEQ ID NO: 7431953 - DNA, 22 bp, Homo sapiens
tccatctgtcaaatatcatgct

SEQ ID NO: 7431954 - DNA, 22 bp, Homo sapiens
tccatctgtctttcccatccac

SEQ ID NO: 7431955 - DNA, 22 bp, Homo sapiens
tccatctgtcaaatatcatgct

SEQ ID NO: 7431956 - DNA, 22 bp, Homo sapiens
tccatctgtctttcccatccac

SEQ ID NO: 7431957 - DNA, 22 bp, Homo sapiens
tccatctgtctttcccatccac

SEQ ID NO: 7431958 - DNA, 20 bp, Homo sapiens
tccatcttgggcagaagcag

SEQ ID NO: 7431959 - DNA, 20 bp, Homo sapiens
tccatcttgggcagaagcag

SEQ ID NO: 7431960 - DNA, 22 bp, Homo sapiens
tccatctgtttactataaagat

SEQ ID NO: 7431961 - DNA, 22 bp, Homo sapiens
tccatctgtttactataaagat

SEQ ID NO: 7431962 - DNA, 22 bp, Homo sapiens
tccatccctgactcctcctgga

SEQ ID NO: 7431963 - DNA, 22 bp, Homo sapiens
tccatccggctgacatccgcag

SEQ ID NO: 7431964 - DNA, 21 bp, Homo sapiens
tccatccatcagtccagccag

SEQ ID NO: 7431965 - DNA, 22 bp, Homo sapiens
tccatccatttgagagtggagt

SEQ ID NO: 7431966 - DNA, 22 bp, Homo sapiens
tccatccattttctttgctgtt

SEQ ID NO: 7431967 - DNA, 22 bp, Homo sapiens
tccatccctgactcctcctgga

SEQ ID NO: 7431968 - DNA, 22 bp, Homo sapiens
tccatctcacctgcactctgcg

SEQ ID NO: 7431969 - DNA, 18 bp, Homo sapiens
tccatcctctgctcttca

SEQ ID NO: 7431970 - DNA, 22 bp, Homo sapiens
tccatctacggctataccaccc

SEQ ID NO: 7431971 - DNA, 22 bp, Homo sapiens
tccatccatgtaggaagatggt

SEQ ID NO: 7431972 - DNA, 22 bp, Homo sapiens
tccatccatgtaggaagatggt

SEQ ID NO: 7431973 - DNA, 21 bp, Homo sapiens
tccatccatcagtccagccag

SEQ ID NO: 7431974 - DNA, 22 bp, Homo sapiens
tccatccatggatggaaatgtg

SEQ ID NO: 7431975 - DNA, 22 bp, Homo sapiens
tccatccaggccagcagtaatc

SEQ ID NO: 7431976 - DNA, 22 bp, Homo sapiens
tccatccagattttaagtgctg

SEQ ID NO: 7431977 - DNA, 22 bp, Homo sapiens
tccatccaggccagcagtaatc

SEQ ID NO: 7431978 - DNA, 22 bp, Homo sapiens
tccatccaccctgcattatatt

SEQ ID NO: 7431979 - DNA, 22 bp, Homo sapiens
tccatccagattttaagtgctg

SEQ ID NO: 7431980 - DNA, 22 bp, Homo sapiens
tccatccaggccagcagtaatc

SEQ ID NO: 7431981 - DNA, 22 bp, Homo sapiens
tccatccataccacttggagac

SEQ ID NO: 7431982 - DNA, 22 bp, Homo sapiens
tccatccataccacttggagac

SEQ ID NO: 7431983 - DNA, 22 bp, Homo sapiens
tccagtttccaatcactgcacg

SEQ ID NO: 7431984 - DNA, 22 bp, Homo sapiens
tccagtttatttttggcagggt

SEQ ID NO: 7431985 - DNA, 22 bp, Homo sapiens
tccagtttatttttggcagggt

SEQ ID NO: 7431986 - DNA, 22 bp, Homo sapiens
tccatcacgtaggcatgattga

SEQ ID NO: 7431987 - DNA, 22 bp, Homo sapiens
tccatcactattatctacaaca

SEQ ID NO: 7431988 - DNA, 22 bp, Homo sapiens
tccatcagattccctcctgaga

SEQ ID NO: 7431989 - DNA, 22 bp, Homo sapiens
tccatcagcatgcaggctgttc

SEQ ID NO: 7431990 - DNA, 22 bp, Homo sapiens
tccatcaccatttctgcgagct

SEQ ID NO: 7431991 - DNA, 22 bp, Homo sapiens
tccagtttcatagctaaggaac

SEQ ID NO: 7431992 - DNA, 22 bp, Homo sapiens
tccatcaggctcgtgggctctc

SEQ ID NO: 7431993 - DNA, 22 bp, Homo sapiens
tccatcaggctcgtgggctctc

SEQ ID NO: 7431994 - DNA, 22 bp, Homo sapiens
tccatcagcatgcaggctgttc

SEQ ID NO: 7431995 - DNA, 22 bp, Homo sapiens
tccatcagcatgcaggctgttc

SEQ ID NO: 7431996 - DNA, 22 bp, Homo sapiens
tccatcagcatgcaggctgttc

SEQ ID NO: 7431997 - DNA, 22 bp, Homo sapiens
tccatcagcatgcaggctgttc

SEQ ID NO: 7431998 - DNA, 22 bp, Homo sapiens
tccatcaggctcgtgggctctc

SEQ ID NO: 7431999 - DNA, 22 bp, Homo sapiens
tccatcatggcagcagcagtga

SEQ ID NO: 7432000 - DNA, 22 bp, Homo sapiens
tccatcatggcagcagcagtga

SEQ ID NO: 7432001 - DNA, 22 bp, Homo sapiens
tccatcatgttcacagctatat

SEQ ID NO: 7432002 - DNA, 22 bp, Homo sapiens
tccatcatgttcacagctatat

SEQ ID NO: 7432003 - DNA, 22 bp, Homo sapiens
tccatccacattaacagatacg

SEQ ID NO: 7432004 - DNA, 22 bp, Homo sapiens
tccatccacattaacagatacg

SEQ ID NO: 7432005 - DNA, 22 bp, Homo sapiens
tccatccaccctgcattatatt

SEQ ID NO: 7432006 - DNA, 22 bp, Homo sapiens
tccagggctcattccctctgca

SEQ ID NO: 7432007 - DNA, 22 bp, Homo sapiens
tccagggctcattccctctgca

SEQ ID NO: 7432008 - DNA, 22 bp, Homo sapiens
tccagggctcattccctctgca

SEQ ID NO: 7432009 - DNA, 20 bp, Homo sapiens
tccagggctagggagctcat

SEQ ID NO: 7432010 - DNA, 22 bp, Homo sapiens
tccagggctcattccctctgca

SEQ ID NO: 7432011 - DNA, 22 bp, Homo sapiens
tccagggctcattccctctgca

SEQ ID NO: 7432012 - DNA, 22 bp, Homo sapiens
tccagggctcattccctctgca

SEQ ID NO: 7432013 - DNA, 22 bp, Homo sapiens
tccagtttacagggttgctttt

SEQ ID NO: 7432014 - DNA, 22 bp, Homo sapiens
tccagtttattatgcatttaca

SEQ ID NO: 7432015 - DNA, 22 bp, Homo sapiens
tccagggctccccaacatccag

SEQ ID NO: 7432016 - DNA, 22 bp, Homo sapiens
tccagggctccccaacatccag

SEQ ID NO: 7432017 - DNA, 22 bp, Homo sapiens
tccagttgcccatctctcttct

SEQ ID NO: 7432018 - DNA, 22 bp, Homo sapiens
tccagggctacaaggcaccaga

SEQ ID NO: 7432019 - DNA, 22 bp, Homo sapiens
tccagggctacaaggcaccaga

SEQ ID NO: 7432020 - DNA, 22 bp, Homo sapiens
tccagggctacaaggcaccaga

SEQ ID NO: 7432021 - DNA, 22 bp, Homo sapiens
tccagggctacaaggcaccaga

SEQ ID NO: 7432022 - DNA, 22 bp, Homo sapiens
tccagggctacaaggcaccaga

SEQ ID NO: 7432023 - DNA, 22 bp, Homo sapiens
tccagggctacaaggcaccaga

SEQ ID NO: 7432024 - DNA, 22 bp, Homo sapiens
tccagggctacaaggcaccaga

SEQ ID NO: 7432025 - DNA, 22 bp, Homo sapiens
tccagggctacaaggcaccaga

SEQ ID NO: 7432026 - DNA, 22 bp, Homo sapiens
tccagggctacaaggcaccaga

SEQ ID NO: 7432027 - DNA, 20 bp, Homo sapiens
tccagggctagggagctcat

SEQ ID NO: 7432028 - DNA, 20 bp, Homo sapiens
tccagggctagggagctcat

SEQ ID NO: 7432029 - DNA, 20 bp, Homo sapiens
tccagggctagggagctcat

SEQ ID NO: 7432030 - DNA, 20 bp, Homo sapiens
tccagggctagggagctcat

SEQ ID NO: 7432031 - DNA, 22 bp, Homo sapiens
tccagggccttacctcttcaga

SEQ ID NO: 7432032 - DNA, 22 bp, Homo sapiens
tccagggccttacctcttcaga

SEQ ID NO: 7432033 - DNA, 22 bp, Homo sapiens
tccagggccttacctcttcaga

SEQ ID NO: 7432034 - DNA, 22 bp, Homo sapiens
tccagggcctgaggttgaagtg

SEQ ID NO: 7432035 - DNA, 22 bp, Homo sapiens
tccagggcctgaggttgaagtg

SEQ ID NO: 7432036 - DNA, 22 bp, Homo sapiens
tccagggcctgaggttgaagtg

SEQ ID NO: 7432037 - DNA, 22 bp, Homo sapiens
tccagggcctgaggttgaagtg

SEQ ID NO: 7432038 - DNA, 20 bp, Homo sapiens
tccagggccctggctcctct

SEQ ID NO: 7432039 - DNA, 22 bp, Homo sapiens
tccagggcgtgtgtgaaggaaa

SEQ ID NO: 7432040 - DNA, 22 bp, Homo sapiens
tccagggcgtgtgtgaaggaaa

SEQ ID NO: 7432041 - DNA, 22 bp, Homo sapiens
tccagggcgtgtgtgaaggaaa

SEQ ID NO: 7432042 - DNA, 21 bp, Homo sapiens
tccagggcgggcgcacggaga

SEQ ID NO: 7432043 - DNA, 21 bp, Homo sapiens
tccagggcgggcgcacggaga

SEQ ID NO: 7432044 - DNA, 21 bp, Homo sapiens
tccagggcgggcgcacggaga

SEQ ID NO: 7432045 - DNA, 21 bp, Homo sapiens
tccagggcgggcgcacggaga

SEQ ID NO: 7432046 - DNA, 22 bp, Homo sapiens
tccagggccatgaagttgcaca

SEQ ID NO: 7432047 - DNA, 22 bp, Homo sapiens
tccagggccatgaagttgcaca

SEQ ID NO: 7432048 - DNA, 22 bp, Homo sapiens
tccagggccatgaagttgcaca

SEQ ID NO: 7432049 - DNA, 22 bp, Homo sapiens
tccagggccatgaagttgcaca

SEQ ID NO: 7432050 - DNA, 22 bp, Homo sapiens
tccagggccatgaagttgcaca

SEQ ID NO: 7432051 - DNA, 22 bp, Homo sapiens
tccagggccccccagttgcacg

SEQ ID NO: 7432052 - DNA, 22 bp, Homo sapiens
tccagggccccccagttgcacg

SEQ ID NO: 7432053 - DNA, 22 bp, Homo sapiens
tccagggccccccagttgcacg

SEQ ID NO: 7432054 - DNA, 22 bp, Homo sapiens
tccagggccccccagttgcacg

SEQ ID NO: 7432055 - DNA, 22 bp, Homo sapiens
tccagggccccccagttgcacg

SEQ ID NO: 7432056 - DNA, 20 bp, Homo sapiens
tccagggccctggctcctct

SEQ ID NO: 7432057 - DNA, 20 bp, Homo sapiens
tccagggccctggctcctct

SEQ ID NO: 7432058 - DNA, 20 bp, Homo sapiens
tccagggccctggctcctct

SEQ ID NO: 7432059 - DNA, 20 bp, Homo sapiens
tccagggccctggctcctct

SEQ ID NO: 7432060 - DNA, 20 bp, Homo sapiens
tccagggccctggctcctct

SEQ ID NO: 7432061 - DNA, 20 bp, Homo sapiens
tccagggccctggctcctct

SEQ ID NO: 7432062 - DNA, 22 bp, Homo sapiens
tccagggccagtccttgtctgt

SEQ ID NO: 7432063 - DNA, 22 bp, Homo sapiens
tccagggccacagaggatgcta

SEQ ID NO: 7432064 - DNA, 22 bp, Homo sapiens
tccagggccacagaggatgcta

SEQ ID NO: 7432065 - DNA, 22 bp, Homo sapiens
tccagggccacagaggatgcta

SEQ ID NO: 7432066 - DNA, 22 bp, Homo sapiens
tccagggccacagaggatgcta

SEQ ID NO: 7432067 - DNA, 22 bp, Homo sapiens
tccagggccacagaggatgcta

SEQ ID NO: 7432068 - DNA, 22 bp, Homo sapiens
tccagggccacagaggatgcta

SEQ ID NO: 7432069 - DNA, 22 bp, Homo sapiens
tccagggccacagaggatgcta

SEQ ID NO: 7432070 - DNA, 22 bp, Homo sapiens
tccagggccacagaggatgcta

SEQ ID NO: 7432071 - DNA, 22 bp, Homo sapiens
tccagggccatctccatgaggc

SEQ ID NO: 7432072 - DNA, 22 bp, Homo sapiens
tccagggccatctccatgaggc

SEQ ID NO: 7432073 - DNA, 22 bp, Homo sapiens
tccagggccatctccatgaggc

SEQ ID NO: 7432074 - DNA, 22 bp, Homo sapiens
tccagggccagtccttgtctgt

SEQ ID NO: 7432075 - DNA, 22 bp, Homo sapiens
tccagggccagtccttgtctgt

SEQ ID NO: 7432076 - DNA, 22 bp, Homo sapiens
tccagggccatctccatgaggc

SEQ ID NO: 7432077 - DNA, 22 bp, Homo sapiens
tccagggccacagaggatgcta

SEQ ID NO: 7432078 - DNA, 22 bp, Homo sapiens
tccagggccacagaggatgcta

SEQ ID NO: 7432079 - DNA, 22 bp, Homo sapiens
tccagggcagggtgcgcatggg

SEQ ID NO: 7432080 - DNA, 22 bp, Homo sapiens
tccagggcagggtgcgcatggg

SEQ ID NO: 7432081 - DNA, 22 bp, Homo sapiens
tccagggcagggtgcgcatggg

SEQ ID NO: 7432082 - DNA, 19 bp, Homo sapiens
tccagggcaggaacatgta

SEQ ID NO: 7432083 - DNA, 19 bp, Homo sapiens
tccagggcaggaacatgta

SEQ ID NO: 7432084 - DNA, 19 bp, Homo sapiens
tccagggcaggaacatgta

SEQ ID NO: 7432085 - DNA, 19 bp, Homo sapiens
tccagggcaggaacatgta

SEQ ID NO: 7432086 - DNA, 19 bp, Homo sapiens
tccagggcaggaacatgta

SEQ ID NO: 7432087 - DNA, 19 bp, Homo sapiens
tccagggcaggaacatgta

SEQ ID NO: 7432088 - DNA, 19 bp, Homo sapiens
tccagggcaggaacatgta

SEQ ID NO: 7432089 - DNA, 22 bp, Homo sapiens
tccagggcagccgcgggtgcgc

SEQ ID NO: 7432090 - DNA, 22 bp, Homo sapiens
tccaggctgcagtcttgccctc

SEQ ID NO: 7432091 - DNA, 22 bp, Homo sapiens
tccaggctgcaaggccacaggg

SEQ ID NO: 7432092 - DNA, 22 bp, Homo sapiens
tccaggctgcagtcttgccctc

SEQ ID NO: 7432093 - DNA, 22 bp, Homo sapiens
tccaggctgcagtcttgccctc

SEQ ID NO: 7432094 - DNA, 22 bp, Homo sapiens
tccaggctgcagtcttgccctc

SEQ ID NO: 7432095 - DNA, 22 bp, Homo sapiens
tccaggctgcagtcttgccctc

SEQ ID NO: 7432096 - DNA, 22 bp, Homo sapiens
tccaggctgccacagtgcaacg

SEQ ID NO: 7432097 - DNA, 22 bp, Homo sapiens
tccaggctgccacagtgcaacg

SEQ ID NO: 7432098 - DNA, 22 bp, Homo sapiens
tccaggctgccacagtgcaacg

SEQ ID NO: 7432099 - DNA, 22 bp, Homo sapiens
tccaggctgcagtcttgccctc

SEQ ID NO: 7432100 - DNA, 21 bp, Homo sapiens
tccaggctggaaggggcgttg

SEQ ID NO: 7432101 - DNA, 22 bp, Homo sapiens
tccaggctggaaatgtcaaact

SEQ ID NO: 7432102 - DNA, 22 bp, Homo sapiens
tccaggctggaaatgtcaaact

SEQ ID NO: 7432103 - DNA, 22 bp, Homo sapiens
tccaggctggaaatgtcaaact

SEQ ID NO: 7432104 - DNA, 22 bp, Homo sapiens
tccaggctgccacagtgcaacg

SEQ ID NO: 7432105 - DNA, 22 bp, Homo sapiens
tccaggctgccacagtgcaacg

SEQ ID NO: 7432106 - DNA, 19 bp, Homo sapiens
tccaggctgagagtcagct

SEQ ID NO: 7432107 - DNA, 19 bp, Homo sapiens
tccaggctgagagtcagct

SEQ ID NO: 7432108 - DNA, 19 bp, Homo sapiens
tccaggctgagagtcagct

SEQ ID NO: 7432109 - DNA, 19 bp, Homo sapiens
tccaggctgagagtcagct

SEQ ID NO: 7432110 - DNA, 19 bp, Homo sapiens
tccaggctgagagtcagct

SEQ ID NO: 7432111 - DNA, 23 bp, Homo sapiens
tccaggctgaaggagcagatttt

SEQ ID NO: 7432112 - DNA, 19 bp, Homo sapiens
tccaggctgagagtcagct

SEQ ID NO: 7432113 - DNA, 22 bp, Homo sapiens
tccaggctgacgcagctattta

SEQ ID NO: 7432114 - DNA, 22 bp, Homo sapiens
tccaggctgacgcagctattta

SEQ ID NO: 7432115 - DNA, 22 bp, Homo sapiens
tccaggctgacgcagctattta

SEQ ID NO: 7432116 - DNA, 22 bp, Homo sapiens
tccaggctgacgcagctattta

SEQ ID NO: 7432117 - DNA, 22 bp, Homo sapiens
tccaggctgacgcagctattta

SEQ ID NO: 7432118 - DNA, 22 bp, Homo sapiens
tccaggctctcaggtgtcagca

SEQ ID NO: 7432119 - DNA, 23 bp, Homo sapiens
tccaggctgaaggagcagatttt

SEQ ID NO: 7432120 - DNA, 23 bp, Homo sapiens
tccaggctgaaggagcagatttt

SEQ ID NO: 7432121 - DNA, 23 bp, Homo sapiens
tccaggctgaaggagcagatttt

SEQ ID NO: 7432122 - DNA, 22 bp, Homo sapiens
tccaggctgacgcagctattta

SEQ ID NO: 7432123 - DNA, 23 bp, Homo sapiens
tccaggctgaaggagcagatttt

SEQ ID NO: 7432124 - DNA, 23 bp, Homo sapiens
tccaggctgaaggagcagatttt

SEQ ID NO: 7432125 - DNA, 22 bp, Homo sapiens
tccaggctgcaaggccacaggg

SEQ ID NO: 7432126 - DNA, 21 bp, Homo sapiens
tccaggctgatgatgtcaact

SEQ ID NO: 7432127 - DNA, 22 bp, Homo sapiens
tccaggctgcaaggccacaggg

SEQ ID NO: 7432128 - DNA, 22 bp, Homo sapiens
tccaggctgcaaggccacaggg

SEQ ID NO: 7432129 - DNA, 21 bp, Homo sapiens
tccaggctgatgatgtcaact

SEQ ID NO: 7432130 - DNA, 21 bp, Homo sapiens
tccaggctgatgatgtcaact

SEQ ID NO: 7432131 - DNA, 22 bp, Homo sapiens
tccaggctgcaaggccacaggg

SEQ ID NO: 7432132 - DNA, 22 bp, Homo sapiens
tccaggctgcaaggccacaggg

SEQ ID NO: 7432133 - DNA, 22 bp, Homo sapiens
tccaggctgcaaggccacaggg

SEQ ID NO: 7432134 - DNA, 22 bp, Homo sapiens
tccaggctgcaaggccacaggg

SEQ ID NO: 7432135 - DNA, 22 bp, Homo sapiens
tccaggctgcaaggccacaggg

SEQ ID NO: 7432136 - DNA, 21 bp, Homo sapiens
tccaggctgatgatgtcaact

SEQ ID NO: 7432137 - DNA, 22 bp, Homo sapiens
tccaggctgatccatgaagaat

SEQ ID NO: 7432138 - DNA, 22 bp, Homo sapiens
tccaggctgatccatgaagaat

SEQ ID NO: 7432139 - DNA, 22 bp, Homo sapiens
tccaggctgatccatgaagaat

SEQ ID NO: 7432140 - DNA, 19 bp, Homo sapiens
tccaggctgagagtcagct

SEQ ID NO: 7432141 - DNA, 19 bp, Homo sapiens
tccaggctgagagtcagct

SEQ ID NO: 7432142 - DNA, 22 bp, Homo sapiens
tccaggctgatccatgaagaat

SEQ ID NO: 7432143 - DNA, 19 bp, Homo sapiens
tccaggctgagagtcagct

SEQ ID NO: 7432144 - DNA, 22 bp, Homo sapiens
tccaggctctcaggtgtcagca

SEQ ID NO: 7432145 - DNA, 22 bp, Homo sapiens
tccaggctctcaggtgtcagca

SEQ ID NO: 7432146 - DNA, 22 bp, Homo sapiens
tccaggctctaggctgctctcc

SEQ ID NO: 7432147 - DNA, 22 bp, Homo sapiens
tccaggctctaggctgctctcc

SEQ ID NO: 7432148 - DNA, 22 bp, Homo sapiens
tccaggctctaggctgctctcc

SEQ ID NO: 7432149 - DNA, 22 bp, Homo sapiens
tccaggctctcaggtgtcagca

SEQ ID NO: 7432150 - DNA, 22 bp, Homo sapiens
tccaggctctcaggtgtcagca

SEQ ID NO: 7432151 - DNA, 22 bp, Homo sapiens
tccaggctctcaggtgtcagca

SEQ ID NO: 7432152 - DNA, 22 bp, Homo sapiens
tccaggctctcaggtgtcagca

SEQ ID NO: 7432153 - DNA, 22 bp, Homo sapiens
tccaggctctcaggtgtcagca

SEQ ID NO: 7432154 - DNA, 22 bp, Homo sapiens
tccaggctctcaggtgtcagca

SEQ ID NO: 7432155 - DNA, 22 bp, Homo sapiens
tccaggctctaggctgctctcc

SEQ ID NO: 7432156 - DNA, 22 bp, Homo sapiens
tccaggctctaggctgctctcc

SEQ ID NO: 7432157 - DNA, 22 bp, Homo sapiens
tccaggctctaggctgctctcc

SEQ ID NO: 7432158 - DNA, 22 bp, Homo sapiens
tccaggctctaggctgctctcc

SEQ ID NO: 7432159 - DNA, 22 bp, Homo sapiens
tccaggctctaggctgctctcc

SEQ ID NO: 7432160 - DNA, 22 bp, Homo sapiens
tccaggctcctgactttttggg

SEQ ID NO: 7432161 - DNA, 22 bp, Homo sapiens
tccaggctcagcacttgctact

SEQ ID NO: 7432162 - DNA, 22 bp, Homo sapiens
tccaggctaggtttacaggaca

SEQ ID NO: 7432163 - DNA, 22 bp, Homo sapiens
tccaggctcagcacttgctact

SEQ ID NO: 7432164 - DNA, 22 bp, Homo sapiens
tccaggctcagcacttgctact

SEQ ID NO: 7432165 - DNA, 22 bp, Homo sapiens
tccaggctcagcacttgctact

SEQ ID NO: 7432166 - DNA, 22 bp, Homo sapiens
tccaggctaggtttacaggaca

SEQ ID NO: 7432167 - DNA, 22 bp, Homo sapiens
tccaggctaggtttacaggaca

SEQ ID NO: 7432168 - DNA, 22 bp, Homo sapiens
tccaggctaggtttacaggaca

SEQ ID NO: 7432169 - DNA, 22 bp, Homo sapiens
tccaggccactgcagaggctct

SEQ ID NO: 7432170 - DNA, 22 bp, Homo sapiens
tccaggccactgcagaggctct

SEQ ID NO: 7432171 - DNA, 22 bp, Homo sapiens
tccaggccactgcagaggctct

SEQ ID NO: 7432172 - DNA, 22 bp, Homo sapiens
tccaggccactgcagaggctct

SEQ ID NO: 7432173 - DNA, 22 bp, Homo sapiens
tccaggccactgcagaggctct

SEQ ID NO: 7432174 - DNA, 22 bp, Homo sapiens
tccaggccactgcagaggctct

SEQ ID NO: 7432175 - DNA, 22 bp, Homo sapiens
tccaggccactgcagaggctct

SEQ ID NO: 7432176 - DNA, 22 bp, Homo sapiens
tccaggccactgcagaggctct

SEQ ID NO: 7432177 - DNA, 22 bp, Homo sapiens
tccaggcatcccccaggacaga

SEQ ID NO: 7432178 - DNA, 16 bp, Homo sapiens
tccaggcatatctgag

SEQ ID NO: 7432179 - DNA, 22 bp, Homo sapiens
tccaggcatcccccaggacaga

SEQ ID NO: 7432180 - DNA, 22 bp, Homo sapiens
tccaggcatcccccaggacaga

SEQ ID NO: 7432181 - DNA, 22 bp, Homo sapiens
tccaggcatcccccaggacaga

SEQ ID NO: 7432182 - DNA, 22 bp, Homo sapiens
tccaggcatcccccaggacaga

SEQ ID NO: 7432183 - DNA, 17 bp, Homo sapiens
tccaggcatatctccta

SEQ ID NO: 7432184 - DNA, 17 bp, Homo sapiens
tccaggcatatctccta

SEQ ID NO: 7432185 - DNA, 16 bp, Homo sapiens
tccaggcatatctgag

SEQ ID NO: 7432186 - DNA, 17 bp, Homo sapiens
tccaggcatatctccta

SEQ ID NO: 7432187 - DNA, 22 bp, Homo sapiens
tccaggcatcccccaggacaga

SEQ ID NO: 7432188 - DNA, 19 bp, Homo sapiens
tccaggcatccttcaggct

SEQ ID NO: 7432189 - DNA, 19 bp, Homo sapiens
tccaggcatccttcaggct

SEQ ID NO: 7432190 - DNA, 19 bp, Homo sapiens
tccaggcatccttcaggct

SEQ ID NO: 7432191 - DNA, 23 bp, Homo sapiens
tccaggcatgagctctggatgga

SEQ ID NO: 7432192 - DNA, 23 bp, Homo sapiens
tccaggcatgagctctggatgga

SEQ ID NO: 7432193 - DNA, 23 bp, Homo sapiens
tccaggcatgagctctggatgga

SEQ ID NO: 7432194 - DNA, 23 bp, Homo sapiens
tccaggcatgagctctggatgga

SEQ ID NO: 7432195 - DNA, 22 bp, Homo sapiens
tccaggcatctgtattttttaa

SEQ ID NO: 7432196 - DNA, 19 bp, Homo sapiens
tccaggcatccttcaggct

SEQ ID NO: 7432197 - DNA, 22 bp, Homo sapiens
tccaggcatctgtattttttaa

SEQ ID NO: 7432198 - DNA, 22 bp, Homo sapiens
tccaggcatgtggccagtactc

SEQ ID NO: 7432199 - DNA, 22 bp, Homo sapiens
tccaggcatgtggccagtactc

SEQ ID NO: 7432200 - DNA, 22 bp, Homo sapiens
tccaggcatgtggccagtactc

SEQ ID NO: 7432201 - DNA, 22 bp, Homo sapiens
tccaggcatgtctgagtccttc

SEQ ID NO: 7432202 - DNA, 22 bp, Homo sapiens
tccaggcatgtctgagtccttc

SEQ ID NO: 7432203 - DNA, 22 bp, Homo sapiens
tccaggcatgtctgagtccttc

SEQ ID NO: 7432204 - DNA, 22 bp, Homo sapiens
tccaggcatgtctgagtccttc

SEQ ID NO: 7432205 - DNA, 22 bp, Homo sapiens
tccaggcatgtcccaagccgga

SEQ ID NO: 7432206 - DNA, 22 bp, Homo sapiens
tccaggcatggtgtaattttgc

SEQ ID NO: 7432207 - DNA, 22 bp, Homo sapiens
tccaggcatggtgtaattttgc

SEQ ID NO: 7432208 - DNA, 23 bp, Homo sapiens
tccaggcatgagctctggatgga

SEQ ID NO: 7432209 - DNA, 23 bp, Homo sapiens
tccaggcatgagctctggatgga

SEQ ID NO: 7432210 - DNA, 23 bp, Homo sapiens
tccaggcatgagctctggatgga

SEQ ID NO: 7432211 - DNA, 23 bp, Homo sapiens
tccaggcatgagctctggatgga

SEQ ID NO: 7432212 - DNA, 23 bp, Homo sapiens
tccaggcatgagctctggatgga

SEQ ID NO: 7432213 - DNA, 23 bp, Homo sapiens
tccaggcatgagctctggatgga

SEQ ID NO: 7432214 - DNA, 22 bp, Homo sapiens
tccaggccacgacctcctggat

SEQ ID NO: 7432215 - DNA, 22 bp, Homo sapiens
tccaggccacgacctcctggat

SEQ ID NO: 7432216 - DNA, 22 bp, Homo sapiens
tccaggccacgacctcctggat

SEQ ID NO: 7432217 - DNA, 22 bp, Homo sapiens
tccaggccacgacctcctggat

SEQ ID NO: 7432218 - DNA, 22 bp, Homo sapiens
tccaggccacatggatggcgat

SEQ ID NO: 7432219 - DNA, 22 bp, Homo sapiens
tccaggccacgacctcctggat

SEQ ID NO: 7432220 - DNA, 22 bp, Homo sapiens
tccaggccacgacctcctggat

SEQ ID NO: 7432221 - DNA, 22 bp, Homo sapiens
tccaggccacgacctcctggat

SEQ ID NO: 7432222 - DNA, 22 bp, Homo sapiens
tccaggccaatgtagcaggccc

SEQ ID NO: 7432223 - DNA, 22 bp, Homo sapiens
tccaggccaatgtagcaggccc

SEQ ID NO: 7432224 - DNA, 22 bp, Homo sapiens
tccaggccacatggatggcgat

SEQ ID NO: 7432225 - DNA, 22 bp, Homo sapiens
tccaggccacatggatggcgat

SEQ ID NO: 7432226 - DNA, 22 bp, Homo sapiens
tccaggccacatggatggcgat

SEQ ID NO: 7432227 - DNA, 22 bp, Homo sapiens
tccaggccacatggatggcgat

SEQ ID NO: 7432228 - DNA, 22 bp, Homo sapiens
tccaggccacatggatggcgat

SEQ ID NO: 7432229 - DNA, 22 bp, Homo sapiens
tccaggcatgttgggaagatga

SEQ ID NO: 7432230 - DNA, 22 bp, Homo sapiens
tccaggcatgttgggaagatga

SEQ ID NO: 7432231 - DNA, 15 bp, Homo sapiens
tccaggcattcattc

SEQ ID NO: 7432232 - DNA, 22 bp, Homo sapiens
tccaggcatgttgggaagatga

SEQ ID NO: 7432233 - DNA, 22 bp, Homo sapiens
tccaggcattccagccattcca

SEQ ID NO: 7432234 - DNA, 22 bp, Homo sapiens
tccaggcattccagccattcca

SEQ ID NO: 7432235 - DNA, 22 bp, Homo sapiens
tccaggcattccagccattcca

SEQ ID NO: 7432236 - DNA, 22 bp, Homo sapiens
tccaggccaatgtagcaggccc

SEQ ID NO: 7432237 - DNA, 22 bp, Homo sapiens
tccaggccaatgtagcaggccc

SEQ ID NO: 7432238 - DNA, 22 bp, Homo sapiens
tccaggcattggagagataatg

SEQ ID NO: 7432239 - DNA, 22 bp, Homo sapiens
tccaggcattggagagataatg

SEQ ID NO: 7432240 - DNA, 22 bp, Homo sapiens
tccaggccaatgtagcaggccc

SEQ ID NO: 7432241 - DNA, 22 bp, Homo sapiens
tccaggccaatgtagcaggccc

SEQ ID NO: 7432242 - DNA, 22 bp, Homo sapiens
tccaggccaatgtagcaggccc

SEQ ID NO: 7432243 - DNA, 22 bp, Homo sapiens
tccaggccaatgtagcaggccc

SEQ ID NO: 7432244 - DNA, 22 bp, Homo sapiens
tccaggagtggggcagaggtct

SEQ ID NO: 7432245 - DNA, 22 bp, Homo sapiens
tccaggagtggggcagaggtct

SEQ ID NO: 7432246 - DNA, 22 bp, Homo sapiens
tccaggagtggggcagaggtct

SEQ ID NO: 7432247 - DNA, 22 bp, Homo sapiens
tccaggagtgataaggccactg

SEQ ID NO: 7432248 - DNA, 21 bp, Homo sapiens
tccaggagtggctgggcaggg

SEQ ID NO: 7432249 - DNA, 21 bp, Homo sapiens
tccaggagtggctgggcaggg

SEQ ID NO: 7432250 - DNA, 22 bp, Homo sapiens
tccaggagtgctggttagagta

SEQ ID NO: 7432251 - DNA, 21 bp, Homo sapiens
tccaggagtggctgggcaggg

SEQ ID NO: 7432252 - DNA, 21 bp, Homo sapiens
tccaggagtggctgggcaggg

SEQ ID NO: 7432253 - DNA, 21 bp, Homo sapiens
tccaggagtggctgggcaggg

SEQ ID NO: 7432254 - DNA, 22 bp, Homo sapiens
tccaggagtgataaggccactg

SEQ ID NO: 7432255 - DNA, 22 bp, Homo sapiens
tccaggagtgataaggccactg

SEQ ID NO: 7432256 - DNA, 22 bp, Homo sapiens
tccaggagtgctggttagagta

SEQ ID NO: 7432257 - DNA, 22 bp, Homo sapiens
tccaggagtgataaggccactg

SEQ ID NO: 7432258 - DNA, 22 bp, Homo sapiens
tccaggagtgataaggccactg

SEQ ID NO: 7432259 - DNA, 22 bp, Homo sapiens
tccaggagtgctggttagagta

SEQ ID NO: 7432260 - DNA, 21 bp, Homo sapiens
tccaggagtggctgggcaggg

SEQ ID NO: 7432261 - DNA, 21 bp, Homo sapiens
tccaggagttctaataggtgt

SEQ ID NO: 7432262 - DNA, 22 bp, Homo sapiens
tccaggagtgtgtgctaatggg

SEQ ID NO: 7432263 - DNA, 22 bp, Homo sapiens
tccaggagtgtgtgctaatggg

SEQ ID NO: 7432264 - DNA, 22 bp, Homo sapiens
tccaggagtgtgtgctaatggg

SEQ ID NO: 7432265 - DNA, 22 bp, Homo sapiens
tccaggagtgtgtgctaatggg

SEQ ID NO: 7432266 - DNA, 22 bp, Homo sapiens
tccaggagtggggcagaggtct

SEQ ID NO: 7432267 - DNA, 22 bp, Homo sapiens
tccaggagtggggcagaggtct

SEQ ID NO: 7432268 - DNA, 22 bp, Homo sapiens
tccaggagtggggcagaggtct

SEQ ID NO: 7432269 - DNA, 22 bp, Homo sapiens
tccaggagtggggcagaggtct

SEQ ID NO: 7432270 - DNA, 21 bp, Homo sapiens
tccaggagttctaataggtgt

SEQ ID NO: 7432271 - DNA, 22 bp, Homo sapiens
tccaggagtttgacctgtgggc

SEQ ID NO: 7432272 - DNA, 21 bp, Homo sapiens
tccaggagttctaataggtgt

SEQ ID NO: 7432273 - DNA, 21 bp, Homo sapiens
tccaggagttctaataggtgt

SEQ ID NO: 7432274 - DNA, 22 bp, Homo sapiens
tccaggagtttgagactgcagt

SEQ ID NO: 7432275 - DNA, 22 bp, Homo sapiens
tccaggagtttgagactgcagt

SEQ ID NO: 7432276 - DNA, 22 bp, Homo sapiens
tccaggagtttgacctgtgggc

SEQ ID NO: 7432277 - DNA, 22 bp, Homo sapiens
tccaggagtttgagactgcagt

SEQ ID NO: 7432278 - DNA, 22 bp, Homo sapiens
tccaggagtttgagactgcagt

SEQ ID NO: 7432279 - DNA, 22 bp, Homo sapiens
tccaggagtttgagactgcagt

SEQ ID NO: 7432280 - DNA, 22 bp, Homo sapiens
tccaggcagggcagccatcaag

SEQ ID NO: 7432281 - DNA, 22 bp, Homo sapiens
tccaggcagggcagccatcaag

SEQ ID NO: 7432282 - DNA, 22 bp, Homo sapiens
tccaggcagggcagccatcaag

SEQ ID NO: 7432283 - DNA, 22 bp, Homo sapiens
tccaggcagggcagccatcaag

SEQ ID NO: 7432284 - DNA, 22 bp, Homo sapiens
tccaggcagggcagccatcaag

SEQ ID NO: 7432285 - DNA, 22 bp, Homo sapiens
tccaggcagggcagccatcaag

SEQ ID NO: 7432286 - DNA, 22 bp, Homo sapiens
tccaggattgtcagccagaagg

SEQ ID NO: 7432287 - DNA, 22 bp, Homo sapiens
tccaggattgcaggtgcacaac

SEQ ID NO: 7432288 - DNA, 22 bp, Homo sapiens
tccaggattgcaggtgcacaac

SEQ ID NO: 7432289 - DNA, 22 bp, Homo sapiens
tccaggagtttgagactgcagt

SEQ ID NO: 7432290 - DNA, 22 bp, Homo sapiens
tccaggcataatgcccagtggt

SEQ ID NO: 7432291 - DNA, 22 bp, Homo sapiens
tccaggcataagccttgagtgt

SEQ ID NO: 7432292 - DNA, 22 bp, Homo sapiens
tccaggcataagccttgagtgt

SEQ ID NO: 7432293 - DNA, 22 bp, Homo sapiens
tccaggcataagccttgagtgt

SEQ ID NO: 7432294 - DNA, 22 bp, Homo sapiens
tccaggcataagccttgagtgt

SEQ ID NO: 7432295 - DNA, 22 bp, Homo sapiens
tccaggcatagaaggcacgcac

SEQ ID NO: 7432296 - DNA, 22 bp, Homo sapiens
tccaggcatagaaggcacgcac

SEQ ID NO: 7432297 - DNA, 22 bp, Homo sapiens
tccaggcataatgcccagtggt

SEQ ID NO: 7432298 - DNA, 22 bp, Homo sapiens
tccaggcataatgcccagtggt

SEQ ID NO: 7432299 - DNA, 22 bp, Homo sapiens
tccaggcagggttaagggtcct

SEQ ID NO: 7432300 - DNA, 22 bp, Homo sapiens
tccaggcagggttaagggtcct

SEQ ID NO: 7432301 - DNA, 22 bp, Homo sapiens
tccaggcagggttaagggtcct

SEQ ID NO: 7432302 - DNA, 22 bp, Homo sapiens
tccaggcagggttaagggtcct

SEQ ID NO: 7432303 - DNA, 22 bp, Homo sapiens
tccaggcagggttaagggtcct

SEQ ID NO: 7432304 - DNA, 22 bp, Homo sapiens
tccaggcagttttccaggttgt

SEQ ID NO: 7432305 - DNA, 22 bp, Homo sapiens
tccaggcagttttccaggttgt

SEQ ID NO: 7432306 - DNA, 22 bp, Homo sapiens
tccaggcagttttccaggttgt

SEQ ID NO: 7432307 - DNA, 22 bp, Homo sapiens
tccaggcagtcattaatctcta

SEQ ID NO: 7432308 - DNA, 22 bp, Homo sapiens
tccaggcagtcattaatctcta

SEQ ID NO: 7432309 - DNA, 22 bp, Homo sapiens
tccaggaggttgagactgcagt

SEQ ID NO: 7432310 - DNA, 22 bp, Homo sapiens
tccaggaggttgagactgcagt

SEQ ID NO: 7432311 - DNA, 20 bp, Homo sapiens
tccaggaggttagtgtggct

SEQ ID NO: 7432312 - DNA, 20 bp, Homo sapiens
tccaggaggttagtgtggct

SEQ ID NO: 7432313 - DNA, 20 bp, Homo sapiens
tccaggaggttagtgtggct

SEQ ID NO: 7432314 - DNA, 20 bp, Homo sapiens
tccaggaggttagtgtggct

SEQ ID NO: 7432315 - DNA, 20 bp, Homo sapiens
tccaggaggttagtgtggct

SEQ ID NO: 7432316 - DNA, 22 bp, Homo sapiens
tccaggaggttgagactgcagt

SEQ ID NO: 7432317 - DNA, 22 bp, Homo sapiens
tccaggaggttgagactgcagt

SEQ ID NO: 7432318 - DNA, 22 bp, Homo sapiens
tccaggaggttgagactgcagt

SEQ ID NO: 7432319 - DNA, 22 bp, Homo sapiens
tccaggaggttgagactgcagt

SEQ ID NO: 7432320 - DNA, 22 bp, Homo sapiens
tccaggaggtgaggggaccaaa

SEQ ID NO: 7432321 - DNA, 22 bp, Homo sapiens
tccaggaggtgaggggaccaaa

SEQ ID NO: 7432322 - DNA, 22 bp, Homo sapiens
tccaggaggtgaggggaccaaa

SEQ ID NO: 7432323 - DNA, 22 bp, Homo sapiens
tccaggaggtgaggggaccaaa

SEQ ID NO: 7432324 - DNA, 22 bp, Homo sapiens
tccaggaggtgaggggaccaaa

SEQ ID NO: 7432325 - DNA, 22 bp, Homo sapiens
tccaggaggtgaggggaccaaa

SEQ ID NO: 7432326 - DNA, 22 bp, Homo sapiens
tccaggaggtgaggggaccaaa

SEQ ID NO: 7432327 - DNA, 22 bp, Homo sapiens
tccaggaggtatgagtggcccc

SEQ ID NO: 7432328 - DNA, 22 bp, Homo sapiens
tccaggaggtatgagtggcccc

SEQ ID NO: 7432329 - DNA, 22 bp, Homo sapiens
tccaggaggtagtgcttaattt

SEQ ID NO: 7432330 - DNA, 22 bp, Homo sapiens
tccaggagggggagccgtgccg

SEQ ID NO: 7432331 - DNA, 22 bp, Homo sapiens
tccaggagggattgggctgtgg

SEQ ID NO: 7432332 - DNA, 22 bp, Homo sapiens
tccaggaggggtaggcagtatg

SEQ ID NO: 7432333 - DNA, 22 bp, Homo sapiens
tccaggaggggtaggcagtatg

SEQ ID NO: 7432334 - DNA, 22 bp, Homo sapiens
tccaggaggggtaggcagtatg

SEQ ID NO: 7432335 - DNA, 22 bp, Homo sapiens
tccaggaggggtaggcagtatg

SEQ ID NO: 7432336 - DNA, 22 bp, Homo sapiens
tccaggaggggtaggcagtatg

SEQ ID NO: 7432337 - DNA, 22 bp, Homo sapiens
tccaggaggtagtgcttaattt

SEQ ID NO: 7432338 - DNA, 22 bp, Homo sapiens
tccaggagggttttctgccttc

SEQ ID NO: 7432339 - DNA, 22 bp, Homo sapiens
tccaggaggtatgagtggcccc

SEQ ID NO: 7432340 - DNA, 22 bp, Homo sapiens
tccaggagggttttctgccttc

SEQ ID NO: 7432341 - DNA, 22 bp, Homo sapiens
tccaggaggggtaggcagtatg

SEQ ID NO: 7432342 - DNA, 22 bp, Homo sapiens
tccaggagggttttctgccttc

SEQ ID NO: 7432343 - DNA, 22 bp, Homo sapiens
tccaggagggttttctgccttc

SEQ ID NO: 7432344 - DNA, 22 bp, Homo sapiens
tccaggagggttttctgccttc

SEQ ID NO: 7432345 - DNA, 22 bp, Homo sapiens
tccaggagtcagacagatggtg

SEQ ID NO: 7432346 - DNA, 22 bp, Homo sapiens
tccaggaggtttggaggaagca

SEQ ID NO: 7432347 - DNA, 22 bp, Homo sapiens
tccaggagtcagacagatggtg

SEQ ID NO: 7432348 - DNA, 22 bp, Homo sapiens
tccaggagtcagacagatggtg

SEQ ID NO: 7432349 - DNA, 22 bp, Homo sapiens
tccaggagtcagacagatggtg

SEQ ID NO: 7432350 - DNA, 22 bp, Homo sapiens
tccaggagtcagacagatggtg

SEQ ID NO: 7432351 - DNA, 22 bp, Homo sapiens
tccaggagtcctgggagtgatt

SEQ ID NO: 7432352 - DNA, 22 bp, Homo sapiens
tccaggagtcctgggagtgatt

SEQ ID NO: 7432353 - DNA, 22 bp, Homo sapiens
tccaggagtcagacagatggtg

SEQ ID NO: 7432354 - DNA, 22 bp, Homo sapiens
tccaggagtcagacagatggtg

SEQ ID NO: 7432355 - DNA, 22 bp, Homo sapiens
tccaggaggttgagtgagttcc

SEQ ID NO: 7432356 - DNA, 22 bp, Homo sapiens
tccaggaggtttggaggaagca

SEQ ID NO: 7432357 - DNA, 22 bp, Homo sapiens
tccaggaggttgagtgagttcc

SEQ ID NO: 7432358 - DNA, 22 bp, Homo sapiens
tccaggaggttgagtgagttcc

SEQ ID NO: 7432359 - DNA, 22 bp, Homo sapiens
tccaggaggttgagtgagttcc

SEQ ID NO: 7432360 - DNA, 22 bp, Homo sapiens
tccaggaggttgagtgagttcc

SEQ ID NO: 7432361 - DNA, 22 bp, Homo sapiens
tccaggaggtttggaggaagca

SEQ ID NO: 7432362 - DNA, 22 bp, Homo sapiens
tccaggaggtttggaggaagca

SEQ ID NO: 7432363 - DNA, 22 bp, Homo sapiens
tccaggaggtttggaggaagca

SEQ ID NO: 7432364 - DNA, 22 bp, Homo sapiens
tccaggaggtttggaggaagca

SEQ ID NO: 7432365 - DNA, 22 bp, Homo sapiens
tccaggaggtttggaggaagca

SEQ ID NO: 7432366 - DNA, 22 bp, Homo sapiens
tccaggagtctagcctcaggcc

SEQ ID NO: 7432367 - DNA, 22 bp, Homo sapiens
tccaggagtctagcctcaggcc

SEQ ID NO: 7432368 - DNA, 22 bp, Homo sapiens
tccaggagtctagcctcaggcc

SEQ ID NO: 7432369 - DNA, 22 bp, Homo sapiens
tccaggagtctagcctcaggcc

SEQ ID NO: 7432370 - DNA, 22 bp, Homo sapiens
tccaggagtctagcctcaggcc

SEQ ID NO: 7432371 - DNA, 22 bp, Homo sapiens
tccaggagtcctgggtggcccc

SEQ ID NO: 7432372 - DNA, 22 bp, Homo sapiens
tccaggagtctagcctcaggcc

SEQ ID NO: 7432373 - DNA, 22 bp, Homo sapiens
tccaggagtctagcctcaggcc

SEQ ID NO: 7432374 - DNA, 22 bp, Homo sapiens
tccaggagtgataaggccactg

SEQ ID NO: 7432375 - DNA, 22 bp, Homo sapiens
tccaggagtctagcctcaggcc

SEQ ID NO: 7432376 - DNA, 22 bp, Homo sapiens
tccaggagtcctgggtggcccc

SEQ ID NO: 7432377 - DNA, 22 bp, Homo sapiens
tccaggagtcctgggtggcccc

SEQ ID NO: 7432378 - DNA, 22 bp, Homo sapiens
tccaggagtcctgggtggcccc

SEQ ID NO: 7432379 - DNA, 22 bp, Homo sapiens
tccaggagtcctgggtggcccc

SEQ ID NO: 7432380 - DNA, 22 bp, Homo sapiens
tccaggagtcctgggtggcccc

SEQ ID NO: 7432381 - DNA, 22 bp, Homo sapiens
tccaggagtcctgggagtgatt

SEQ ID NO: 7432382 - DNA, 22 bp, Homo sapiens
tccaggagtcctgggagtgatt

SEQ ID NO: 7432383 - DNA, 22 bp, Homo sapiens
tccaggagtcctgggagtgatt

SEQ ID NO: 7432384 - DNA, 22 bp, Homo sapiens
tccaggagtcctgggagtgatt

SEQ ID NO: 7432385 - DNA, 22 bp, Homo sapiens
tccaggagtcctgggagtgatt

SEQ ID NO: 7432386 - DNA, 22 bp, Homo sapiens
tccaggagtcctgggagtgatt

SEQ ID NO: 7432387 - DNA, 22 bp, Homo sapiens
tccaggagtcctgggagtgatt

SEQ ID NO: 7432388 - DNA, 23 bp, Homo sapiens
tccagcagagccttccaggaggg

SEQ ID NO: 7432389 - DNA, 22 bp, Homo sapiens
tccagcagaggttgataatacc

SEQ ID NO: 7432390 - DNA, 23 bp, Homo sapiens
tccagcagagccttccaggaggg

SEQ ID NO: 7432391 - DNA, 23 bp, Homo sapiens
tccagcagagccttccaggaggg

SEQ ID NO: 7432392 - DNA, 23 bp, Homo sapiens
tccagcagagccttccaggaggg

SEQ ID NO: 7432393 - DNA, 23 bp, Homo sapiens
tccagcagagccttccaggaggg

SEQ ID NO: 7432394 - DNA, 22 bp, Homo sapiens
tccagcagactcatcagcaagg

SEQ ID NO: 7432395 - DNA, 23 bp, Homo sapiens
tccagcagagccttccaggaggg

SEQ ID NO: 7432396 - DNA, 22 bp, Homo sapiens
tccagcagaccatcaaggctca

SEQ ID NO: 7432397 - DNA, 22 bp, Homo sapiens
tccagcagactcatcagcaagg

SEQ ID NO: 7432398 - DNA, 22 bp, Homo sapiens
tccagcagactcatcagcaagg

SEQ ID NO: 7432399 - DNA, 22 bp, Homo sapiens
tccagcagactcatcagcaagg

SEQ ID NO: 7432400 - DNA, 22 bp, Homo sapiens
tccagcagactcatcagcaagg

SEQ ID NO: 7432401 - DNA, 22 bp, Homo sapiens
tccagcagaccatcaaggctca

SEQ ID NO: 7432402 - DNA, 22 bp, Homo sapiens
tccagcagaccatcaaggctca

SEQ ID NO: 7432403 - DNA, 22 bp, Homo sapiens
tccagcagaccatcaaggctca

SEQ ID NO: 7432404 - DNA, 22 bp, Homo sapiens
tccagcagaccatcaaggctca

SEQ ID NO: 7432405 - DNA, 22 bp, Homo sapiens
tccagcagaccatcaaggctca

SEQ ID NO: 7432406 - DNA, 23 bp, Homo sapiens
tccagcagccaagaagggtagaa

SEQ ID NO: 7432407 - DNA, 23 bp, Homo sapiens
tccagcagccaagaagggtagaa

SEQ ID NO: 7432408 - DNA, 23 bp, Homo sapiens
tccagcagccaagaagggtagaa

SEQ ID NO: 7432409 - DNA, 22 bp, Homo sapiens
tccagcagccacacctctggac

SEQ ID NO: 7432410 - DNA, 23 bp, Homo sapiens
tccagcagccaagaagggtagaa

SEQ ID NO: 7432411 - DNA, 22 bp, Homo sapiens
tccagcagccacacctctggac

SEQ ID NO: 7432412 - DNA, 22 bp, Homo sapiens
tccagcagccacacctctggac

SEQ ID NO: 7432413 - DNA, 23 bp, Homo sapiens
tccagcagccaagaagggtagaa

SEQ ID NO: 7432414 - DNA, 23 bp, Homo sapiens
tccagcagccaagaagggtagaa

SEQ ID NO: 7432415 - DNA, 23 bp, Homo sapiens
tccagcagccaagaagggtagaa

SEQ ID NO: 7432416 - DNA, 18 bp, Homo sapiens
tccagcagcatagtttcc

SEQ ID NO: 7432417 - DNA, 18 bp, Homo sapiens
tccagcagcatagtttcc

SEQ ID NO: 7432418 - DNA, 23 bp, Homo sapiens
tccagcagccaagaagggtagaa

SEQ ID NO: 7432419 - DNA, 22 bp, Homo sapiens
tccagcagagtctctgaggggg

SEQ ID NO: 7432420 - DNA, 22 bp, Homo sapiens
tccagcagagtctctgaggggg

SEQ ID NO: 7432421 - DNA, 22 bp, Homo sapiens
tccagcagagtctctgaggggg

SEQ ID NO: 7432422 - DNA, 22 bp, Homo sapiens
tccagcagagtctctgaggggg

SEQ ID NO: 7432423 - DNA, 22 bp, Homo sapiens
tccagcagagtctctgaggggg

SEQ ID NO: 7432424 - DNA, 22 bp, Homo sapiens
tccagcagagtctctgaggggg

SEQ ID NO: 7432425 - DNA, 22 bp, Homo sapiens
tccagcaggtccgagacaagtt

SEQ ID NO: 7432426 - DNA, 22 bp, Homo sapiens
tccagcagggaattagtagtct

SEQ ID NO: 7432427 - DNA, 22 bp, Homo sapiens
tccagcaggtccgagacaagtt

SEQ ID NO: 7432428 - DNA, 22 bp, Homo sapiens
tccagcaggtccgagacaagtt

SEQ ID NO: 7432429 - DNA, 22 bp, Homo sapiens
tccagcaggtccgagacaagtt

SEQ ID NO: 7432430 - DNA, 22 bp, Homo sapiens
tccagcaggtccgagacaagtt

SEQ ID NO: 7432431 - DNA, 18 bp, Homo sapiens
tccagcaggtctgaggtg

SEQ ID NO: 7432432 - DNA, 18 bp, Homo sapiens
tccagcaggtctgaggtg

SEQ ID NO: 7432433 - DNA, 22 bp, Homo sapiens
tccagcaggtgtttgccaactt

SEQ ID NO: 7432434 - DNA, 22 bp, Homo sapiens
tccagcaggtgtttgccaactt

SEQ ID NO: 7432435 - DNA, 22 bp, Homo sapiens
tccagcaggtgtttgccaactt

SEQ ID NO: 7432436 - DNA, 22 bp, Homo sapiens
tccagcaggtgtttgccaactt

SEQ ID NO: 7432437 - DNA, 22 bp, Homo sapiens
tccagcaggtgtttgccaactt

SEQ ID NO: 7432438 - DNA, 22 bp, Homo sapiens
tccagcaggtgtttgccaactt

SEQ ID NO: 7432439 - DNA, 18 bp, Homo sapiens
tccagcaggtctgaggtg

SEQ ID NO: 7432440 - DNA, 18 bp, Homo sapiens
tccagcaggtctgaggtg

SEQ ID NO: 7432441 - DNA, 18 bp, Homo sapiens
tccagcaggtctgaggtg

SEQ ID NO: 7432442 - DNA, 18 bp, Homo sapiens
tccagcaggtctgaggtg

SEQ ID NO: 7432443 - DNA, 18 bp, Homo sapiens
tccagcaggtctgaggtg

SEQ ID NO: 7432444 - DNA, 22 bp, Homo sapiens
tccagcagcccgaaggcccatc

SEQ ID NO: 7432445 - DNA, 22 bp, Homo sapiens
tccagcagcccgaaggcccatc

SEQ ID NO: 7432446 - DNA, 22 bp, Homo sapiens
tccagcagcccgaaggcccatc

SEQ ID NO: 7432447 - DNA, 22 bp, Homo sapiens
tccagcagcctgacttccctct

SEQ ID NO: 7432448 - DNA, 22 bp, Homo sapiens
tccagcagcctgacttccctct

SEQ ID NO: 7432449 - DNA, 22 bp, Homo sapiens
tccagcagcctgacttccctct

SEQ ID NO: 7432450 - DNA, 22 bp, Homo sapiens
tccagcagccacacctctggac

SEQ ID NO: 7432451 - DNA, 22 bp, Homo sapiens
tccagcagccacacctctggac

SEQ ID NO: 7432452 - DNA, 22 bp, Homo sapiens
tccagcagccacacctctggac

SEQ ID NO: 7432453 - DNA, 22 bp, Homo sapiens
tccagcagccacacctctggac

SEQ ID NO: 7432454 - DNA, 22 bp, Homo sapiens
tccagcagcccgaaggcccatc

SEQ ID NO: 7432455 - DNA, 22 bp, Homo sapiens
tccagcagccacacctctggac

SEQ ID NO: 7432456 - DNA, 22 bp, Homo sapiens
tccagcagccacacctctggac

SEQ ID NO: 7432457 - DNA, 22 bp, Homo sapiens
tccagcagccacacctctggac

SEQ ID NO: 7432458 - DNA, 22 bp, Homo sapiens
tccagcagccacacctctggac

SEQ ID NO: 7432459 - DNA, 18 bp, Homo sapiens
tccagagctggtgcttct

SEQ ID NO: 7432460 - DNA, 18 bp, Homo sapiens
tccagagctggtgcttct

SEQ ID NO: 7432461 - DNA, 22 bp, Homo sapiens
tccagagctgtatgattttttt

SEQ ID NO: 7432462 - DNA, 22 bp, Homo sapiens
tccagagctgtatgattttttt

SEQ ID NO: 7432463 - DNA, 22 bp, Homo sapiens
tccagagctgtcctactgtgag

SEQ ID NO: 7432464 - DNA, 22 bp, Homo sapiens
tccagagctgtcctactgtgag

SEQ ID NO: 7432465 - DNA, 22 bp, Homo sapiens
tccagagctgtcctactgtgag

SEQ ID NO: 7432466 - DNA, 22 bp, Homo sapiens
tccagagctgtcctactgtgag

SEQ ID NO: 7432467 - DNA, 22 bp, Homo sapiens
tccagagctgtcctactgtgag

SEQ ID NO: 7432468 - DNA, 14 bp, Homo sapiens
tccagagctttccg

SEQ ID NO: 7432469 - DNA, 21 bp, Homo sapiens
tccagaggaggacagactcag

SEQ ID NO: 7432470 - DNA, 22 bp, Homo sapiens
tccagaggcaaaaaggtatgga

SEQ ID NO: 7432471 - DNA, 21 bp, Homo sapiens
tccagaggaggacagactcag

SEQ ID NO: 7432472 - DNA, 22 bp, Homo sapiens
tccagaggcaaaaaggtatgga

SEQ ID NO: 7432473 - DNA, 22 bp, Homo sapiens
tccagaggcaaaaaggtatgga

SEQ ID NO: 7432474 - DNA, 22 bp, Homo sapiens
tccagaggcaaaaaggtatgga

SEQ ID NO: 7432475 - DNA, 22 bp, Homo sapiens
tccagaggcaaaaaggtatgga

SEQ ID NO: 7432476 - DNA, 21 bp, Homo sapiens
tccagaggaggacagactcag

SEQ ID NO: 7432477 - DNA, 22 bp, Homo sapiens
tccagagctgggtctgtgctca

SEQ ID NO: 7432478 - DNA, 22 bp, Homo sapiens
tccagagctgggtctgtgctca

SEQ ID NO: 7432479 - DNA, 22 bp, Homo sapiens
tccagagctgagggtcagtaga

SEQ ID NO: 7432480 - DNA, 22 bp, Homo sapiens
tccagagctgagggtcagtaga

SEQ ID NO: 7432481 - DNA, 22 bp, Homo sapiens
tccagagctgagggtcagtaga

SEQ ID NO: 7432482 - DNA, 22 bp, Homo sapiens
tccagagctgggtctgtgctca

SEQ ID NO: 7432483 - DNA, 22 bp, Homo sapiens
tccagagctgggtctgtgctca

SEQ ID NO: 7432484 - DNA, 22 bp, Homo sapiens
tccagagctgggtctgtgctca

SEQ ID NO: 7432485 - DNA, 22 bp, Homo sapiens
tccagagctgggtctgtgctca

SEQ ID NO: 7432486 - DNA, 22 bp, Homo sapiens
tccagagctctgggcatagctg

SEQ ID NO: 7432487 - DNA, 22 bp, Homo sapiens
tccagagctctgggcatagctg

SEQ ID NO: 7432488 - DNA, 23 bp, Homo sapiens
tccagagctcatgctctcaacca

SEQ ID NO: 7432489 - DNA, 22 bp, Homo sapiens
tccagagctctgggcatagctg

SEQ ID NO: 7432490 - DNA, 22 bp, Homo sapiens
tccagagctctgggcatagctg

SEQ ID NO: 7432491 - DNA, 22 bp, Homo sapiens
tccagagctgagcagtcattct

SEQ ID NO: 7432492 - DNA, 22 bp, Homo sapiens
tccagagctgagcagtcattct

SEQ ID NO: 7432493 - DNA, 22 bp, Homo sapiens
tccagagctgagcagtcattct

SEQ ID NO: 7432494 - DNA, 22 bp, Homo sapiens
tccagagctgagcagtcattct

SEQ ID NO: 7432495 - DNA, 22 bp, Homo sapiens
tccagaggcaaaaaggtatgga

SEQ ID NO: 7432496 - DNA, 22 bp, Homo sapiens
tccagaggcagctgcggtcagg

SEQ ID NO: 7432497 - DNA, 22 bp, Homo sapiens
tccagaggcagctgcggtcagg

SEQ ID NO: 7432498 - DNA, 22 bp, Homo sapiens
tccagaggcagctgcggtcagg

SEQ ID NO: 7432499 - DNA, 20 bp, Homo sapiens
tccagaggccacatccagtg

SEQ ID NO: 7432500 - DNA, 22 bp, Homo sapiens
tccagaggcagctgcggtcagg

SEQ ID NO: 7432501 - DNA, 20 bp, Homo sapiens
tccagaggccacatccagtg

SEQ ID NO: 7432502 - DNA, 22 bp, Homo sapiens
tccagaggctccaaagggagat

SEQ ID NO: 7432503 - DNA, 22 bp, Homo sapiens
tccagaggctccaaagggagat

SEQ ID NO: 7432504 - DNA, 22 bp, Homo sapiens
tccagaggctccaaagggagat

SEQ ID NO: 7432505 - DNA, 20 bp, Homo sapiens
tccagaggccacatccagtg

SEQ ID NO: 7432506 - DNA, 20 bp, Homo sapiens
tccagaggccacatccagtg

SEQ ID NO: 7432507 - DNA, 20 bp, Homo sapiens
tccagaggccacatccagtg

SEQ ID NO: 7432508 - DNA, 20 bp, Homo sapiens
tccagaggccacatccagtg

SEQ ID NO: 7432509 - DNA, 22 bp, Homo sapiens
tccagaggctctgagggagagt

SEQ ID NO: 7432510 - DNA, 22 bp, Homo sapiens
tccagaggctctgagggagagt

SEQ ID NO: 7432511 - DNA, 22 bp, Homo sapiens
tccagaggctctgagggagagt

SEQ ID NO: 7432512 - DNA, 22 bp, Homo sapiens
tccagaggctctgagggagagt

SEQ ID NO: 7432513 - DNA, 22 bp, Homo sapiens
tccagaggctccaaagggagat

SEQ ID NO: 7432514 - DNA, 22 bp, Homo sapiens
tccagaggctccaaagggagat

SEQ ID NO: 7432515 - DNA, 22 bp, Homo sapiens
tccagaggctccaaagggagat

SEQ ID NO: 7432516 - DNA, 22 bp, Homo sapiens
tccagaggtatgtagagagtat

SEQ ID NO: 7432517 - DNA, 22 bp, Homo sapiens
tccagaggggcagccctgtgct

SEQ ID NO: 7432518 - DNA, 22 bp, Homo sapiens
tccagaggtatgtagagagtat

SEQ ID NO: 7432519 - DNA, 22 bp, Homo sapiens
tccagaggtatgtagagagtat

SEQ ID NO: 7432520 - DNA, 22 bp, Homo sapiens
tccagaggtatgtagagagtat

SEQ ID NO: 7432521 - DNA, 22 bp, Homo sapiens
tccagaggggcagccctgtgct

SEQ ID NO: 7432522 - DNA, 22 bp, Homo sapiens
tccagaggggcagccctgtgct

SEQ ID NO: 7432523 - DNA, 22 bp, Homo sapiens
tccagaggctctgagggagagt

SEQ ID NO: 7432524 - DNA, 22 bp, Homo sapiens
tccagagggcgatggctggggg

SEQ ID NO: 7432525 - DNA, 22 bp, Homo sapiens
tccagagggcgatggctggggg

SEQ ID NO: 7432526 - DNA, 22 bp, Homo sapiens
tccagagggcgatggctggggg

SEQ ID NO: 7432527 - DNA, 22 bp, Homo sapiens
tccagagggcgatggctggggg

SEQ ID NO: 7432528 - DNA, 22 bp, Homo sapiens
tccagagggcgatggctggggg

SEQ ID NO: 7432529 - DNA, 22 bp, Homo sapiens
tccagagggcgatggctggggg

SEQ ID NO: 7432530 - DNA, 22 bp, Homo sapiens
tccagagggcgatggctggggg

SEQ ID NO: 7432531 - DNA, 22 bp, Homo sapiens
tccagaggggcagccctgtgct

SEQ ID NO: 7432532 - DNA, 22 bp, Homo sapiens
tccagaggggcagccctgtgct

SEQ ID NO: 7432533 - DNA, 22 bp, Homo sapiens
tccagaggggcagccctgtgct

SEQ ID NO: 7432534 - DNA, 22 bp, Homo sapiens
tcattgccatggcatttgcaga

SEQ ID NO: 7432535 - DNA, 22 bp, Homo sapiens
tcattgcagtagggagagaccc

SEQ ID NO: 7432536 - DNA, 22 bp, Homo sapiens
tcattgcagttgagttgtgtta

SEQ ID NO: 7432537 - DNA, 22 bp, Homo sapiens
tccagaaggccacccggggatg

SEQ ID NO: 7432538 - DNA, 22 bp, Homo sapiens
tccagaaggccacccggggatg

SEQ ID NO: 7432539 - DNA, 22 bp, Homo sapiens
tccagaaggggaaatttggctt

SEQ ID NO: 7432540 - DNA, 19 bp, Homo sapiens
tccagaagtccctgagcgg

SEQ ID NO: 7432541 - DNA, 19 bp, Homo sapiens
tccagaagtccctgagcgg

SEQ ID NO: 7432542 - DNA, 19 bp, Homo sapiens
tccagaagtccctgagcgg

SEQ ID NO: 7432543 - DNA, 22 bp, Homo sapiens
tcattgcagactaacaatctca

SEQ ID NO: 7432544 - DNA, 22 bp, Homo sapiens
tcattgcagaaataaaggtgaa

SEQ ID NO: 7432545 - DNA, 22 bp, Homo sapiens
tcattgcagactaacaatctca

SEQ ID NO: 7432546 - DNA, 19 bp, Homo sapiens
tccagaagtccctgagcgg

SEQ ID NO: 7432547 - DNA, 22 bp, Homo sapiens
tccagaatactctgaaatcatt

SEQ ID NO: 7432548 - DNA, 22 bp, Homo sapiens
tccagaatactctgaaatcatt

SEQ ID NO: 7432549 - DNA, 22 bp, Homo sapiens
tccagaatatttgggaaagatg

SEQ ID NO: 7432550 - DNA, 22 bp, Homo sapiens
tccagaatcaatagcagttatc

SEQ ID NO: 7432551 - DNA, 20 bp, Homo sapiens
tccagacatctagctcagtt

SEQ ID NO: 7432552 - DNA, 20 bp, Homo sapiens
tccagacatctagctcagtt

SEQ ID NO: 7432553 - DNA, 22 bp, Homo sapiens
tccagaatcaatagcagttatc

SEQ ID NO: 7432554 - DNA, 20 bp, Homo sapiens
tccagacatctagctcagtt

SEQ ID NO: 7432555 - DNA, 20 bp, Homo sapiens
tccagacatctagctcagtt

SEQ ID NO: 7432556 - DNA, 18 bp, Homo sapiens
tccagagagggagaagtg

SEQ ID NO: 7432557 - DNA, 22 bp, Homo sapiens
tccagacattttatagcagtct

SEQ ID NO: 7432558 - DNA, 20 bp, Homo sapiens
tccagagagtggcaaagctc

SEQ ID NO: 7432559 - DNA, 20 bp, Homo sapiens
tccagagagtggcaaagctc

SEQ ID NO: 7432560 - DNA, 20 bp, Homo sapiens
tccagagagtggcaaagctc

SEQ ID NO: 7432561 - DNA, 20 bp, Homo sapiens
tccagagagtggcaaagctc

SEQ ID NO: 7432562 - DNA, 20 bp, Homo sapiens
tccagagagtggcaaagctc

SEQ ID NO: 7432563 - DNA, 20 bp, Homo sapiens
tccagagagtggcaaagctc

SEQ ID NO: 7432564 - DNA, 22 bp, Homo sapiens
tccagagaggtttctccatgct

SEQ ID NO: 7432565 - DNA, 22 bp, Homo sapiens
tccagagaggtttctccatgct

SEQ ID NO: 7432566 - DNA, 22 bp, Homo sapiens
tccagacattttatagcagtct

SEQ ID NO: 7432567 - DNA, 22 bp, Homo sapiens
tccagagaggtttctccatgct

SEQ ID NO: 7432568 - DNA, 22 bp, Homo sapiens
tccagagaggtttctccatgct

SEQ ID NO: 7432569 - DNA, 22 bp, Homo sapiens
tccagagaggtttctccatgct

SEQ ID NO: 7432570 - DNA, 22 bp, Homo sapiens
tccagagaggtttctccatgct

SEQ ID NO: 7432571 - DNA, 22 bp, Homo sapiens
tcattgaatttggttcaatatg

SEQ ID NO: 7432572 - DNA, 22 bp, Homo sapiens
tcattgaatttggttcaatatg

SEQ ID NO: 7432573 - DNA, 22 bp, Homo sapiens
tcattgaatttcacagctttat

SEQ ID NO: 7432574 - DNA, 22 bp, Homo sapiens
tcattgaatttggttcaatatg

SEQ ID NO: 7432575 - DNA, 22 bp, Homo sapiens
tcattgaatttggttcaatatg

SEQ ID NO: 7432576 - DNA, 22 bp, Homo sapiens
tcattgagtaatactgtagtgt

SEQ ID NO: 7432577 - DNA, 22 bp, Homo sapiens
tcattgagttcaaatccttcat

SEQ ID NO: 7432578 - DNA, 22 bp, Homo sapiens
tcattgagctgtatggacacaa

SEQ ID NO: 7432579 - DNA, 22 bp, Homo sapiens
tcattgaggaaaggtagtggct

SEQ ID NO: 7432580 - DNA, 22 bp, Homo sapiens
tcattgagcggttcttaaccca

SEQ ID NO: 7432581 - DNA, 22 bp, Homo sapiens
tcattgacttgaagaaaacaat

SEQ ID NO: 7432582 - DNA, 22 bp, Homo sapiens
tcattgacagttgtttcaaata

SEQ ID NO: 7432583 - DNA, 22 bp, Homo sapiens
tcattgcaagctcatttatctg

SEQ ID NO: 7432584 - DNA, 19 bp, Homo sapiens
tcattgattgtagttacat

SEQ ID NO: 7432585 - DNA, 21 bp, Homo sapiens
tcattgatagaatgtgatgag

SEQ ID NO: 7432586 - DNA, 22 bp, Homo sapiens
tcattgagttgcacttttacta

SEQ ID NO: 7432587 - DNA, 22 bp, Homo sapiens
tcattgagttgcacttttacta

SEQ ID NO: 7432588 - DNA, 22 bp, Homo sapiens
tcattgaagtgactgaaagatt

SEQ ID NO: 7432589 - DNA, 22 bp, Homo sapiens
tcattgaagcccttgacaagcc

SEQ ID NO: 7432590 - DNA, 22 bp, Homo sapiens
tcattgaagtgactgaaagatt

SEQ ID NO: 7432591 - DNA, 22 bp, Homo sapiens
tcattgaatacatatttgggat

SEQ ID NO: 7432592 - DNA, 22 bp, Homo sapiens
tcattgaagacttactggcttc

SEQ ID NO: 7432593 - DNA, 22 bp, Homo sapiens
tcattgaagcattttgtgtatt

SEQ ID NO: 7432594 - DNA, 22 bp, Homo sapiens
tcattgaagcccttgacaagcc

SEQ ID NO: 7432595 - DNA, 22 bp, Homo sapiens
tcattgaattctgggggttgag

SEQ ID NO: 7432596 - DNA, 22 bp, Homo sapiens
tcattgaatgctctgcaggttg

SEQ ID NO: 7432597 - DNA, 22 bp, Homo sapiens
tcattgaatatggggccataca

SEQ ID NO: 7432598 - DNA, 22 bp, Homo sapiens
tcattgaatgagatgcaataga

SEQ ID NO: 7432599 - DNA, 22 bp, Homo sapiens
tcattgaatgagatgcaataga

SEQ ID NO: 7432600 - DNA, 22 bp, Homo sapiens
tccagagatctctcttccctgt

SEQ ID NO: 7432601 - DNA, 22 bp, Homo sapiens
tccagagatccaaagaatatga

SEQ ID NO: 7432602 - DNA, 22 bp, Homo sapiens
tccagagatctctcttccctgt

SEQ ID NO: 7432603 - DNA, 17 bp, Homo sapiens
tccagagcacagagctc

SEQ ID NO: 7432604 - DNA, 22 bp, Homo sapiens
tccagagatctctcttccctgt

SEQ ID NO: 7432605 - DNA, 22 bp, Homo sapiens
tccagagcaaagtttgctaaca

SEQ ID NO: 7432606 - DNA, 22 bp, Homo sapiens
tccagagcaaagtttgctaaca

SEQ ID NO: 7432607 - DNA, 17 bp, Homo sapiens
tccagagcacagagctc

SEQ ID NO: 7432608 - DNA, 17 bp, Homo sapiens
tccagagcacagagctc

SEQ ID NO: 7432609 - DNA, 17 bp, Homo sapiens
tccagagcacagagctc

SEQ ID NO: 7432610 - DNA, 17 bp, Homo sapiens
tccagagcacagagctc

SEQ ID NO: 7432611 - DNA, 22 bp, Homo sapiens
tccagagatcacactgggcagg

SEQ ID NO: 7432612 - DNA, 22 bp, Homo sapiens
tccagagatcacactgggcagg

SEQ ID NO: 7432613 - DNA, 22 bp, Homo sapiens
tccagagataactatttaggag

SEQ ID NO: 7432614 - DNA, 20 bp, Homo sapiens
tccagagagtggcaaagctc

SEQ ID NO: 7432615 - DNA, 22 bp, Homo sapiens
tccagagataactatttaggag

SEQ ID NO: 7432616 - DNA, 22 bp, Homo sapiens
tccagagatcacactgggcagg

SEQ ID NO: 7432617 - DNA, 22 bp, Homo sapiens
tccagagatcacactgggcagg

SEQ ID NO: 7432618 - DNA, 22 bp, Homo sapiens
tccagagatcacactgggcagg

SEQ ID NO: 7432619 - DNA, 22 bp, Homo sapiens
tccagagatccaaagaatatga

SEQ ID NO: 7432620 - DNA, 22 bp, Homo sapiens
tccagagatccaaagaatatga

SEQ ID NO: 7432621 - DNA, 22 bp, Homo sapiens
tccagagatccaaagaatatga

SEQ ID NO: 7432622 - DNA, 22 bp, Homo sapiens
tccagagccccagtctagtggg

SEQ ID NO: 7432623 - DNA, 22 bp, Homo sapiens
tccagagccccagtctagtggg

SEQ ID NO: 7432624 - DNA, 22 bp, Homo sapiens
tccagagccccagtctagtggg

SEQ ID NO: 7432625 - DNA, 22 bp, Homo sapiens
tccagagccccagtctagtggg

SEQ ID NO: 7432626 - DNA, 22 bp, Homo sapiens
tccagagccccagtctagtggg

SEQ ID NO: 7432627 - DNA, 18 bp, Homo sapiens
tccagagcagtctttggc

SEQ ID NO: 7432628 - DNA, 22 bp, Homo sapiens
tccagagcatgcagatcatcaa

SEQ ID NO: 7432629 - DNA, 22 bp, Homo sapiens
tccagagccccaattcacctct

SEQ ID NO: 7432630 - DNA, 22 bp, Homo sapiens
tccagagccccaattcacctct

SEQ ID NO: 7432631 - DNA, 22 bp, Homo sapiens
tccagagccccaattcacctct

SEQ ID NO: 7432632 - DNA, 18 bp, Homo sapiens
tccagagcagtctttggc

SEQ ID NO: 7432633 - DNA, 18 bp, Homo sapiens
tccagagcagtctttggc

SEQ ID NO: 7432634 - DNA, 18 bp, Homo sapiens
tccagagcagtctttggc

SEQ ID NO: 7432635 - DNA, 22 bp, Homo sapiens
tccagagcaggtgtctacacag

SEQ ID NO: 7432636 - DNA, 22 bp, Homo sapiens
tccagagcaggtgtctacacag

SEQ ID NO: 7432637 - DNA, 22 bp, Homo sapiens
tccagagcaggtggtcagaagg

SEQ ID NO: 7432638 - DNA, 22 bp, Homo sapiens
tccagagcaggtggtcagaagg

SEQ ID NO: 7432639 - DNA, 22 bp, Homo sapiens
tccagagcaggtggtcagaagg

SEQ ID NO: 7432640 - DNA, 22 bp, Homo sapiens
tccagagcaggtggtcagaagg

SEQ ID NO: 7432641 - DNA, 22 bp, Homo sapiens
tccagagcaggtggtcagaagg

SEQ ID NO: 7432642 - DNA, 22 bp, Homo sapiens
tccagagcctgcgcactggctg

SEQ ID NO: 7432643 - DNA, 22 bp, Homo sapiens
tccagagcctgcgcactggctg

SEQ ID NO: 7432644 - DNA, 22 bp, Homo sapiens
tccagagcctgcgcactggctg

SEQ ID NO: 7432645 - DNA, 22 bp, Homo sapiens
tccagagcctatatgttcaact

SEQ ID NO: 7432646 - DNA, 22 bp, Homo sapiens
tccagagcctatatgttcaact

SEQ ID NO: 7432647 - DNA, 22 bp, Homo sapiens
tccagagcctatatgttcaact

SEQ ID NO: 7432648 - DNA, 22 bp, Homo sapiens
tccagagcctgcgcactggctg

SEQ ID NO: 7432649 - DNA, 22 bp, Homo sapiens
tccagagcctgcgcactggctg

SEQ ID NO: 7432650 - DNA, 22 bp, Homo sapiens
tccagagcctttctgcttgaca

SEQ ID NO: 7432651 - DNA, 22 bp, Homo sapiens
tccagagcctttccacccactt

SEQ ID NO: 7432652 - DNA, 22 bp, Homo sapiens
tccagagcctttctgcttgaca

SEQ ID NO: 7432653 - DNA, 22 bp, Homo sapiens
tccagagcctttctgcttgaca

SEQ ID NO: 7432654 - DNA, 22 bp, Homo sapiens
tccagagcctttctgcttgaca

SEQ ID NO: 7432655 - DNA, 22 bp, Homo sapiens
tccagagcctttctgcttgaca

SEQ ID NO: 7432656 - DNA, 22 bp, Homo sapiens
tccagagcctgcgcactggctg

SEQ ID NO: 7432657 - DNA, 22 bp, Homo sapiens
tccagagcctggggtttgtaac

SEQ ID NO: 7432658 - DNA, 22 bp, Homo sapiens
tccagagcctggggtttgtaac

SEQ ID NO: 7432659 - DNA, 22 bp, Homo sapiens
tccagagcctggggtttgtaac

SEQ ID NO: 7432660 - DNA, 22 bp, Homo sapiens
tccagagccttcgataagaaga

SEQ ID NO: 7432661 - DNA, 22 bp, Homo sapiens
tccagagccttcgataagaaga

SEQ ID NO: 7432662 - DNA, 22 bp, Homo sapiens
tccagagcctttccacccactt

SEQ ID NO: 7432663 - DNA, 22 bp, Homo sapiens
tccagagctaattcagcagctg

SEQ ID NO: 7432664 - DNA, 22 bp, Homo sapiens
tccagagctaattcagcagctg

SEQ ID NO: 7432665 - DNA, 22 bp, Homo sapiens
tccagagctaattcagcagctg

SEQ ID NO: 7432666 - DNA, 22 bp, Homo sapiens
tccagagctaattcagcagctg

SEQ ID NO: 7432667 - DNA, 22 bp, Homo sapiens
tccagagctaattcagcagctg

SEQ ID NO: 7432668 - DNA, 18 bp, Homo sapiens
tccagagctactgtggtg

SEQ ID NO: 7432669 - DNA, 22 bp, Homo sapiens
tccagagctaattcagcagctg

SEQ ID NO: 7432670 - DNA, 18 bp, Homo sapiens
tccagagctactgtggtg

SEQ ID NO: 7432671 - DNA, 18 bp, Homo sapiens
tccagagctactgtggtg

SEQ ID NO: 7432672 - DNA, 18 bp, Homo sapiens
tccagagctactgtggtg

SEQ ID NO: 7432673 - DNA, 18 bp, Homo sapiens
tccagagctactgtggtg

SEQ ID NO: 7432674 - DNA, 22 bp, Homo sapiens
tccagagctacttgctcaactt

SEQ ID NO: 7432675 - DNA, 22 bp, Homo sapiens
tccagagctacttgctcaactt

SEQ ID NO: 7432676 - DNA, 22 bp, Homo sapiens
tccagagctacttgctcaactt

SEQ ID NO: 7432677 - DNA, 22 bp, Homo sapiens
tccagagctacttgctcaactt

SEQ ID NO: 7432678 - DNA, 23 bp, Homo sapiens
tccagagctcatgctctcaacca

SEQ ID NO: 7432679 - DNA, 23 bp, Homo sapiens
tccagagctcatgctctcaacca

SEQ ID NO: 7432680 - DNA, 23 bp, Homo sapiens
tccagagctcatgctctcaacca

SEQ ID NO: 7432681 - DNA, 22 bp, Homo sapiens
tccaggaggctctggttgacgt

SEQ ID NO: 7432682 - DNA, 22 bp, Homo sapiens
tccaggaggctctggttgacgt

SEQ ID NO: 7432683 - DNA, 22 bp, Homo sapiens
tccaggaggcctcatttcctgt

SEQ ID NO: 7432684 - DNA, 22 bp, Homo sapiens
tccaggaggctctggttgacgt

SEQ ID NO: 7432685 - DNA, 22 bp, Homo sapiens
tccaggaggctctggttgacgt

SEQ ID NO: 7432686 - DNA, 22 bp, Homo sapiens
tccaggaggcctcatttcctgt

SEQ ID NO: 7432687 - DNA, 22 bp, Homo sapiens
tccaggaggcctcatttcctgt

SEQ ID NO: 7432688 - DNA, 22 bp, Homo sapiens
tccaggaggcctcatttcctgt

SEQ ID NO: 7432689 - DNA, 22 bp, Homo sapiens
tccaggagggattgggctgtgg

SEQ ID NO: 7432690 - DNA, 19 bp, Homo sapiens
tccaggaggctgccattga

SEQ ID NO: 7432691 - DNA, 22 bp, Homo sapiens
tccaggagggattgggctgtgg

SEQ ID NO: 7432692 - DNA, 19 bp, Homo sapiens
tccaggaggctgccattga

SEQ ID NO: 7432693 - DNA, 19 bp, Homo sapiens
tccaggaggctgccattga

SEQ ID NO: 7432694 - DNA, 22 bp, Homo sapiens
tccaggaggctctggttgacgt

SEQ ID NO: 7432695 - DNA, 22 bp, Homo sapiens
tccaggaaagcactgggctggg

SEQ ID NO: 7432696 - DNA, 22 bp, Homo sapiens
tccaggaaagcactgggctggg

SEQ ID NO: 7432697 - DNA, 22 bp, Homo sapiens
tccaggaaagtgggatgtgtgt

SEQ ID NO: 7432698 - DNA, 22 bp, Homo sapiens
tccaggaaacagcatctcagca

SEQ ID NO: 7432699 - DNA, 22 bp, Homo sapiens
tccaggaaagcactgggctggg

SEQ ID NO: 7432700 - DNA, 22 bp, Homo sapiens
tccaggaaacatctccgcctaa

SEQ ID NO: 7432701 - DNA, 22 bp, Homo sapiens
tccaggaaatcagaagtggtaa

SEQ ID NO: 7432702 - DNA, 21 bp, Homo sapiens
tccaggaaagttttaagagtg

SEQ ID NO: 7432703 - DNA, 21 bp, Homo sapiens
tccaggaaagttttaagagtg

SEQ ID NO: 7432704 - DNA, 22 bp, Homo sapiens
tccaggaaagtgggatgtgtgt

SEQ ID NO: 7432705 - DNA, 22 bp, Homo sapiens
tccagctttggctctagctaca

SEQ ID NO: 7432706 - DNA, 22 bp, Homo sapiens
tccagctttgcctgatcatata

SEQ ID NO: 7432707 - DNA, 20 bp, Homo sapiens
tccagctttgcctctaactg

SEQ ID NO: 7432708 - DNA, 22 bp, Homo sapiens
tccaggaaacatctccgcctaa

SEQ ID NO: 7432709 - DNA, 22 bp, Homo sapiens
tccaggaaacatctccgcctaa

SEQ ID NO: 7432710 - DNA, 22 bp, Homo sapiens
tccaggaaacagcatctcagca

SEQ ID NO: 7432711 - DNA, 22 bp, Homo sapiens
tccaggaaaaggcttgcagggg

SEQ ID NO: 7432712 - DNA, 22 bp, Homo sapiens
tccaggaaaaggcttgcagggg

SEQ ID NO: 7432713 - DNA, 22 bp, Homo sapiens
tccagcttttattggatgagga

SEQ ID NO: 7432714 - DNA, 22 bp, Homo sapiens
tccaggaaaaggcttgcagggg

SEQ ID NO: 7432715 - DNA, 22 bp, Homo sapiens
tccaggaaaaggcttgcagggg

SEQ ID NO: 7432716 - DNA, 22 bp, Homo sapiens
tccaggaaacactcaagccatg

SEQ ID NO: 7432717 - DNA, 22 bp, Homo sapiens
tccaggaaacactcaagccatg

SEQ ID NO: 7432718 - DNA, 22 bp, Homo sapiens
tccagcttcagctcttggatag

SEQ ID NO: 7432719 - DNA, 19 bp, Homo sapiens
tccagctgttttgagtcac

SEQ ID NO: 7432720 - DNA, 19 bp, Homo sapiens
tccagctgttttgagtcac

SEQ ID NO: 7432721 - DNA, 22 bp, Homo sapiens
tccagctgttgatattctaggt

SEQ ID NO: 7432722 - DNA, 22 bp, Homo sapiens
tccagctgttgatattctaggt

SEQ ID NO: 7432723 - DNA, 22 bp, Homo sapiens
tccagctgttgttttatctcag

SEQ ID NO: 7432724 - DNA, 22 bp, Homo sapiens
tccagctgttgttttatctcag

SEQ ID NO: 7432725 - DNA, 22 bp, Homo sapiens
tccagctgttgttttatctcag

SEQ ID NO: 7432726 - DNA, 19 bp, Homo sapiens
tccagctgttttgagtcac

SEQ ID NO: 7432727 - DNA, 19 bp, Homo sapiens
tccagctgttttgagtcac

SEQ ID NO: 7432728 - DNA, 22 bp, Homo sapiens
tccagctgttgatattctaggt

SEQ ID NO: 7432729 - DNA, 22 bp, Homo sapiens
tccagctgttgatattctaggt

SEQ ID NO: 7432730 - DNA, 22 bp, Homo sapiens
tccagctgttccatcagctctt

SEQ ID NO: 7432731 - DNA, 22 bp, Homo sapiens
tccagctgttccatcagctctt

SEQ ID NO: 7432732 - DNA, 20 bp, Homo sapiens
tccagctgttgagatctgag

SEQ ID NO: 7432733 - DNA, 18 bp, Homo sapiens
tccagcttgcacttaaat

SEQ ID NO: 7432734 - DNA, 22 bp, Homo sapiens
tccagcttcttgacttggtggt

SEQ ID NO: 7432735 - DNA, 22 bp, Homo sapiens
tccagcttggagagaagtttct

SEQ ID NO: 7432736 - DNA, 22 bp, Homo sapiens
tccagcttggcagagctacctg

SEQ ID NO: 7432737 - DNA, 22 bp, Homo sapiens
tccagcttgggtgggaggaggt

SEQ ID NO: 7432738 - DNA, 22 bp, Homo sapiens
tccagctttcacgctcctgcct

SEQ ID NO: 7432739 - DNA, 22 bp, Homo sapiens
tccagctttcacgctcctgcct

SEQ ID NO: 7432740 - DNA, 22 bp, Homo sapiens
tccagctctggcttggctagct

SEQ ID NO: 7432741 - DNA, 22 bp, Homo sapiens
tccagctctggcttggctagct

SEQ ID NO: 7432742 - DNA, 22 bp, Homo sapiens
tccagctctggcttggctagct

SEQ ID NO: 7432743 - DNA, 22 bp, Homo sapiens
tccagctctggcttggctagct

SEQ ID NO: 7432744 - DNA, 22 bp, Homo sapiens
tccagctctggcttggctagct

SEQ ID NO: 7432745 - DNA, 22 bp, Homo sapiens
tccagctctggcttggctagct

SEQ ID NO: 7432746 - DNA, 22 bp, Homo sapiens
tccagctctggcttggctagct

SEQ ID NO: 7432747 - DNA, 21 bp, Homo sapiens
tccagctcttatgttcatgaa

SEQ ID NO: 7432748 - DNA, 21 bp, Homo sapiens
tccagctcttatgttcatgaa

SEQ ID NO: 7432749 - DNA, 21 bp, Homo sapiens
tccagctcttatgttcatgaa

SEQ ID NO: 7432750 - DNA, 21 bp, Homo sapiens
tccagctcttatgttcatgaa

SEQ ID NO: 7432751 - DNA, 22 bp, Homo sapiens
tccagctctggcttggctagct

SEQ ID NO: 7432752 - DNA, 22 bp, Homo sapiens
tccagctggggcagtggctggg

SEQ ID NO: 7432753 - DNA, 22 bp, Homo sapiens
tccagctggggccgaagtggat

SEQ ID NO: 7432754 - DNA, 22 bp, Homo sapiens
tccagctggggccgaagtggat

SEQ ID NO: 7432755 - DNA, 22 bp, Homo sapiens
tccagctggggcagtggctggg

SEQ ID NO: 7432756 - DNA, 22 bp, Homo sapiens
tccagctggggcagtggctggg

SEQ ID NO: 7432757 - DNA, 22 bp, Homo sapiens
tccagctggggacatgggcttc

SEQ ID NO: 7432758 - DNA, 22 bp, Homo sapiens
tccagctggggacatgggcttc

SEQ ID NO: 7432759 - DNA, 22 bp, Homo sapiens
tccagctggggcagtggctggg

SEQ ID NO: 7432760 - DNA, 22 bp, Homo sapiens
tccagctggggcagtggctggg

SEQ ID NO: 7432761 - DNA, 22 bp, Homo sapiens
tccagctcttcagttctgcaaa

SEQ ID NO: 7432762 - DNA, 22 bp, Homo sapiens
tccagctggggccgaagtggat

SEQ ID NO: 7432763 - DNA, 19 bp, Homo sapiens
tccagctggtatgcccaga

SEQ ID NO: 7432764 - DNA, 19 bp, Homo sapiens
tccagctggtatgcccaga

SEQ ID NO: 7432765 - DNA, 19 bp, Homo sapiens
tccagctggtatgcccaga

SEQ ID NO: 7432766 - DNA, 19 bp, Homo sapiens
tccagctggtatgcccaga

SEQ ID NO: 7432767 - DNA, 19 bp, Homo sapiens
tccagctggtatgcccaga

SEQ ID NO: 7432768 - DNA, 22 bp, Homo sapiens
tccagctgtagtggatttgaga

SEQ ID NO: 7432769 - DNA, 22 bp, Homo sapiens
tccagctgtagtggatttgaga

SEQ ID NO: 7432770 - DNA, 22 bp, Homo sapiens
tccagctgtactttgtcctggc

SEQ ID NO: 7432771 - DNA, 22 bp, Homo sapiens
tccagctgtactttgtcctggc

SEQ ID NO: 7432772 - DNA, 22 bp, Homo sapiens
tccagctgtactttgtcctggc

SEQ ID NO: 7432773 - DNA, 22 bp, Homo sapiens
tccagctgtgctccaggaggtg

SEQ ID NO: 7432774 - DNA, 22 bp, Homo sapiens
tccagctgtgctccaggaggtg

SEQ ID NO: 7432775 - DNA, 21 bp, Homo sapiens
tccagctgtgattatgaatgt

SEQ ID NO: 7432776 - DNA, 22 bp, Homo sapiens
tccagctgtgctccaggaggtg

SEQ ID NO: 7432777 - DNA, 22 bp, Homo sapiens
tccagctgtgctccaggaggtg

SEQ ID NO: 7432778 - DNA, 22 bp, Homo sapiens
tccagctgtgctccaggaggtg

SEQ ID NO: 7432779 - DNA, 22 bp, Homo sapiens
tccagctgttccatcagctctt

SEQ ID NO: 7432780 - DNA, 22 bp, Homo sapiens
tccagctgttccatcagctctt

SEQ ID NO: 7432781 - DNA, 20 bp, Homo sapiens
tccagctgtctttcagagac

SEQ ID NO: 7432782 - DNA, 20 bp, Homo sapiens
tccagctgtctttcagagac

SEQ ID NO: 7432783 - DNA, 20 bp, Homo sapiens
tccagctgtctttcagagac

SEQ ID NO: 7432784 - DNA, 21 bp, Homo sapiens
tccagctgtgattatgaatgt

SEQ ID NO: 7432785 - DNA, 22 bp, Homo sapiens
tccagctctgcttcacagtctc

SEQ ID NO: 7432786 - DNA, 22 bp, Homo sapiens
tccagctctgcttcacagtctc

SEQ ID NO: 7432787 - DNA, 22 bp, Homo sapiens
tccagctctggcttggctagct

SEQ ID NO: 7432788 - DNA, 22 bp, Homo sapiens
tccagctctgcttcacagtctc

SEQ ID NO: 7432789 - DNA, 22 bp, Homo sapiens
tccagctctgctgtgcgccggt

SEQ ID NO: 7432790 - DNA, 22 bp, Homo sapiens
tccagctctgcttcacagtctc

SEQ ID NO: 7432791 - DNA, 22 bp, Homo sapiens
tccagctctgcttcacagtctc

SEQ ID NO: 7432792 - DNA, 22 bp, Homo sapiens
tccagctctgcttcacagtctc

SEQ ID NO: 7432793 - DNA, 22 bp, Homo sapiens
tccagctctgctgtgcgccggt

SEQ ID NO: 7432794 - DNA, 18 bp, Homo sapiens
tccagctctgccacttac

SEQ ID NO: 7432795 - DNA, 21 bp, Homo sapiens
tccagctctcatagtgttcca

SEQ ID NO: 7432796 - DNA, 22 bp, Homo sapiens
tccagctctgattctcactagc

SEQ ID NO: 7432797 - DNA, 22 bp, Homo sapiens
tccagctctgattctcactagc

SEQ ID NO: 7432798 - DNA, 22 bp, Homo sapiens
tccagctctgattctcactagc

SEQ ID NO: 7432799 - DNA, 21 bp, Homo sapiens
tccagctctcatagtgttcca

SEQ ID NO: 7432800 - DNA, 22 bp, Homo sapiens
tccagctctgattctcactagc

SEQ ID NO: 7432801 - DNA, 22 bp, Homo sapiens
tccagctctgattctcactagc

SEQ ID NO: 7432802 - DNA, 22 bp, Homo sapiens
tccagctctgattctcactagc

SEQ ID NO: 7432803 - DNA, 18 bp, Homo sapiens
tccagctctgccacttac

SEQ ID NO: 7432804 - DNA, 18 bp, Homo sapiens
tccagctctgccacttac

SEQ ID NO: 7432805 - DNA, 22 bp, Homo sapiens
tccagctcctgagttcactgct

SEQ ID NO: 7432806 - DNA, 22 bp, Homo sapiens
tccagctcctctacccgatgcg

SEQ ID NO: 7432807 - DNA, 22 bp, Homo sapiens
tccagctcctgagttcactgct

SEQ ID NO: 7432808 - DNA, 22 bp, Homo sapiens
tccagctcctgagttcactgct

SEQ ID NO: 7432809 - DNA, 21 bp, Homo sapiens
tccagctcctgccactcctta

SEQ ID NO: 7432810 - DNA, 21 bp, Homo sapiens
tccagctcctgccactcctta

SEQ ID NO: 7432811 - DNA, 21 bp, Homo sapiens
tccagctcctgccactcctta

SEQ ID NO: 7432812 - DNA, 21 bp, Homo sapiens
tccagctcctgccactcctta

SEQ ID NO: 7432813 - DNA, 21 bp, Homo sapiens
tccagctcctgccactcctta

SEQ ID NO: 7432814 - DNA, 21 bp, Homo sapiens
tccagctcctgccactcctta

SEQ ID NO: 7432815 - DNA, 22 bp, Homo sapiens
tccagctctaacatgctgggcc

SEQ ID NO: 7432816 - DNA, 22 bp, Homo sapiens
tccagctctaacatgctgggcc

SEQ ID NO: 7432817 - DNA, 22 bp, Homo sapiens
tccagctctaacatgctgggcc

SEQ ID NO: 7432818 - DNA, 22 bp, Homo sapiens
tccagctctaacatgctgggcc

SEQ ID NO: 7432819 - DNA, 22 bp, Homo sapiens
tccagctctaaggctgatagcc

SEQ ID NO: 7432820 - DNA, 22 bp, Homo sapiens
tccagctctaaggctgatagcc

SEQ ID NO: 7432821 - DNA, 22 bp, Homo sapiens
tccagctctaaggctgatagcc

SEQ ID NO: 7432822 - DNA, 22 bp, Homo sapiens
tccagctctaaggctgatagcc

SEQ ID NO: 7432823 - DNA, 22 bp, Homo sapiens
tccagctctaaggctgatagcc

SEQ ID NO: 7432824 - DNA, 22 bp, Homo sapiens
tccagctctaaggctgatagcc

SEQ ID NO: 7432825 - DNA, 22 bp, Homo sapiens
tccagctctaaggctgatagcc

SEQ ID NO: 7432826 - DNA, 22 bp, Homo sapiens
tccagctctaaggctgatagcc

SEQ ID NO: 7432827 - DNA, 22 bp, Homo sapiens
tccagcagtccatgtgagacac

SEQ ID NO: 7432828 - DNA, 22 bp, Homo sapiens
tccagcagtccatgtgagacac

SEQ ID NO: 7432829 - DNA, 22 bp, Homo sapiens
tccagcagtccatgtgagacac

SEQ ID NO: 7432830 - DNA, 22 bp, Homo sapiens
tccagcagtccatgtgagacac

SEQ ID NO: 7432831 - DNA, 22 bp, Homo sapiens
tccagcagtccatgtgagacac

SEQ ID NO: 7432832 - DNA, 20 bp, Homo sapiens
tccagcagtatgctatactt

SEQ ID NO: 7432833 - DNA, 20 bp, Homo sapiens
tccagcagtatgctatactt

SEQ ID NO: 7432834 - DNA, 22 bp, Homo sapiens
tccagcagtaaggaaagtacat

SEQ ID NO: 7432835 - DNA, 22 bp, Homo sapiens
tccagcaggttggtcaggtgca

SEQ ID NO: 7432836 - DNA, 22 bp, Homo sapiens
tccagcaggttggtcaggtgca

SEQ ID NO: 7432837 - DNA, 22 bp, Homo sapiens
tccagcaggttggtcaggtgca

SEQ ID NO: 7432838 - DNA, 22 bp, Homo sapiens
tccagcaggttggtcaggtgca

SEQ ID NO: 7432839 - DNA, 22 bp, Homo sapiens
tccagcaggttggtcaggtgca

SEQ ID NO: 7432840 - DNA, 22 bp, Homo sapiens
tccagcaggttggtcaggtgca

SEQ ID NO: 7432841 - DNA, 22 bp, Homo sapiens
tccagcaggttggtcaggtgca

SEQ ID NO: 7432842 - DNA, 22 bp, Homo sapiens
tccagcaggttggtcaggtgca

SEQ ID NO: 7432843 - DNA, 22 bp, Homo sapiens
tccagcaggttggtcaggtgca

SEQ ID NO: 7432844 - DNA, 19 bp, Homo sapiens
tccagcagtgcttgaaatc

SEQ ID NO: 7432845 - DNA, 20 bp, Homo sapiens
tccagcatataaactcctct

SEQ ID NO: 7432846 - DNA, 19 bp, Homo sapiens
tccagcagtgcttgaaatc

SEQ ID NO: 7432847 - DNA, 22 bp, Homo sapiens
tccagcagtgctctagagcgtg

SEQ ID NO: 7432848 - DNA, 22 bp, Homo sapiens
tccagcagtgctctagagcgtg

SEQ ID NO: 7432849 - DNA, 22 bp, Homo sapiens
tccagcagtgctcaggactcac

SEQ ID NO: 7432850 - DNA, 22 bp, Homo sapiens
tccagcagtgctcaggactcac

SEQ ID NO: 7432851 - DNA, 22 bp, Homo sapiens
tccagcagtgctcaggactcac

SEQ ID NO: 7432852 - DNA, 22 bp, Homo sapiens
tccagcagtgctctagagcgtg

SEQ ID NO: 7432853 - DNA, 22 bp, Homo sapiens
tccagcagtgctcaggactcac

SEQ ID NO: 7432854 - DNA, 16 bp, Homo sapiens
tccagcagtctctgta

SEQ ID NO: 7432855 - DNA, 22 bp, Homo sapiens
tccagcagtgctcaggactcac

SEQ ID NO: 7432856 - DNA, 22 bp, Homo sapiens
tccagccaactgcctagggagc

SEQ ID NO: 7432857 - DNA, 23 bp, Homo sapiens
tccagccaaatctggctgacagt

SEQ ID NO: 7432858 - DNA, 23 bp, Homo sapiens
tccagccaaatctggctgacagt

SEQ ID NO: 7432859 - DNA, 23 bp, Homo sapiens
tccagccaaatctggctgacagt

SEQ ID NO: 7432860 - DNA, 22 bp, Homo sapiens
tccagcatttttcaatagaatt

SEQ ID NO: 7432861 - DNA, 22 bp, Homo sapiens
tccagcatatatagagaatgag

SEQ ID NO: 7432862 - DNA, 20 bp, Homo sapiens
tccagcatataaactcctct

SEQ ID NO: 7432863 - DNA, 22 bp, Homo sapiens
tccagcatatatagagaatgag

SEQ ID NO: 7432864 - DNA, 22 bp, Homo sapiens
tccagcattcttagacctctat

SEQ ID NO: 7432865 - DNA, 22 bp, Homo sapiens
tccagcattagatgtgaaattg

SEQ ID NO: 7432866 - DNA, 22 bp, Homo sapiens
tccagcatgtttgtgctgctga

SEQ ID NO: 7432867 - DNA, 22 bp, Homo sapiens
tccagcattagatgtgaaattg

SEQ ID NO: 7432868 - DNA, 22 bp, Homo sapiens
tccagcattagatgtgaaattg

SEQ ID NO: 7432869 - DNA, 22 bp, Homo sapiens
tccagcattcttagacctctat

SEQ ID NO: 7432870 - DNA, 22 bp, Homo sapiens
tccagccaagccttggtagctg

SEQ ID NO: 7432871 - DNA, 22 bp, Homo sapiens
tccagccaagccttggtagctg

SEQ ID NO: 7432872 - DNA, 22 bp, Homo sapiens
tccagccaagccttggtagctg

SEQ ID NO: 7432873 - DNA, 22 bp, Homo sapiens
tccagccaactgcctagggagc

SEQ ID NO: 7432874 - DNA, 22 bp, Homo sapiens
tccagccaatcaactattgttt

SEQ ID NO: 7432875 - DNA, 22 bp, Homo sapiens
tccagccaagggaggttactag

SEQ ID NO: 7432876 - DNA, 22 bp, Homo sapiens
tccagccaatcagagctgaggc

SEQ ID NO: 7432877 - DNA, 22 bp, Homo sapiens
tccagccaccaccttgattgcc

SEQ ID NO: 7432878 - DNA, 22 bp, Homo sapiens
tccagccaatcagagctgaggc

SEQ ID NO: 7432879 - DNA, 22 bp, Homo sapiens
tccagccaatcagagctgaggc

SEQ ID NO: 7432880 - DNA, 22 bp, Homo sapiens
tccagccaatcagagctgaggc

SEQ ID NO: 7432881 - DNA, 22 bp, Homo sapiens
tccagccaatcagagctgaggc

SEQ ID NO: 7432882 - DNA, 22 bp, Homo sapiens
tccagcctttctactcactgag

SEQ ID NO: 7432883 - DNA, 22 bp, Homo sapiens
tccagcctttctactcactgag

SEQ ID NO: 7432884 - DNA, 22 bp, Homo sapiens
tccagcctttctactcactgag

SEQ ID NO: 7432885 - DNA, 22 bp, Homo sapiens
tccagcctttctactcactgag

SEQ ID NO: 7432886 - DNA, 22 bp, Homo sapiens
tccagcctttctactcactgag

SEQ ID NO: 7432887 - DNA, 22 bp, Homo sapiens
tccagcctttctactcactgag

SEQ ID NO: 7432888 - DNA, 22 bp, Homo sapiens
tccagctcagatgcagggatca

SEQ ID NO: 7432889 - DNA, 22 bp, Homo sapiens
tccagctcagatgcagggatca

SEQ ID NO: 7432890 - DNA, 22 bp, Homo sapiens
tccagctcagatgcagggatca

SEQ ID NO: 7432891 - DNA, 22 bp, Homo sapiens
tccagctcagggttggctcaag

SEQ ID NO: 7432892 - DNA, 22 bp, Homo sapiens
tccagctcagatgcagggatca

SEQ ID NO: 7432893 - DNA, 22 bp, Homo sapiens
tccagctcagggttggctcaag

SEQ ID NO: 7432894 - DNA, 22 bp, Homo sapiens
tccagctcagggttggctcaag

SEQ ID NO: 7432895 - DNA, 22 bp, Homo sapiens
tccagctcagatgcagggatca

SEQ ID NO: 7432896 - DNA, 22 bp, Homo sapiens
tccagctcagggttggctcaag

SEQ ID NO: 7432897 - DNA, 22 bp, Homo sapiens
tccagctcagggttggctcaag

SEQ ID NO: 7432898 - DNA, 22 bp, Homo sapiens
tccagctcagggttggctcaag

SEQ ID NO: 7432899 - DNA, 18 bp, Homo sapiens
tccagctcacagatgggc

SEQ ID NO: 7432900 - DNA, 18 bp, Homo sapiens
tccagctcacagatgggc

SEQ ID NO: 7432901 - DNA, 22 bp, Homo sapiens
tccagctcagatgcagggatca

SEQ ID NO: 7432902 - DNA, 18 bp, Homo sapiens
tccagctcacagatgggc

SEQ ID NO: 7432903 - DNA, 18 bp, Homo sapiens
tccagctcacagatgggc

SEQ ID NO: 7432904 - DNA, 18 bp, Homo sapiens
tccagctcacagatgggc

SEQ ID NO: 7432905 - DNA, 18 bp, Homo sapiens
tccagctcacagatgggc

SEQ ID NO: 7432906 - DNA, 18 bp, Homo sapiens
tccagctcacagatgggc

SEQ ID NO: 7432907 - DNA, 18 bp, Homo sapiens
tccagctcacagatgggc

SEQ ID NO: 7432908 - DNA, 22 bp, Homo sapiens
tccagctcacagatagcgtggg

SEQ ID NO: 7432909 - DNA, 22 bp, Homo sapiens
tccagctcacagatagcgtggg

SEQ ID NO: 7432910 - DNA, 22 bp, Homo sapiens
tccagctcacagatagcgtggg

SEQ ID NO: 7432911 - DNA, 22 bp, Homo sapiens
tccagctcacagatagcgtggg

SEQ ID NO: 7432912 - DNA, 22 bp, Homo sapiens
tccagctcaaattcagcttcca

SEQ ID NO: 7432913 - DNA, 22 bp, Homo sapiens
tccagctcaaattcagcttcca

SEQ ID NO: 7432914 - DNA, 22 bp, Homo sapiens
tccagctcaaattcagcttcca

SEQ ID NO: 7432915 - DNA, 22 bp, Homo sapiens
tccagctcaaagtgctcctgtc

SEQ ID NO: 7432916 - DNA, 22 bp, Homo sapiens
tccagctcaaagtgctcctgtc

SEQ ID NO: 7432917 - DNA, 22 bp, Homo sapiens
tccagctcaaagtgctcctgtc

SEQ ID NO: 7432918 - DNA, 22 bp, Homo sapiens
tccagcctttctactcactgag

SEQ ID NO: 7432919 - DNA, 22 bp, Homo sapiens
tccagcctttctactcactgag

SEQ ID NO: 7432920 - DNA, 22 bp, Homo sapiens
tccagctcaaagtgctcctgtc

SEQ ID NO: 7432921 - DNA, 22 bp, Homo sapiens
tccagctcaaagtgctcctgtc

SEQ ID NO: 7432922 - DNA, 23 bp, Homo sapiens
tccagctaagcaataatagaaga

SEQ ID NO: 7432923 - DNA, 22 bp, Homo sapiens
tccagctcaaagtgctcctgtc

SEQ ID NO: 7432924 - DNA, 22 bp, Homo sapiens
tccagctcaaagtgctcctgtc

SEQ ID NO: 7432925 - DNA, 22 bp, Homo sapiens
tccagctaacacctactggcca

SEQ ID NO: 7432926 - DNA, 23 bp, Homo sapiens
tccagctcccttcaatggcactg

SEQ ID NO: 7432927 - DNA, 23 bp, Homo sapiens
tccagctcccttcaatggcactg

SEQ ID NO: 7432928 - DNA, 23 bp, Homo sapiens
tccagctcccttcaatggcactg

SEQ ID NO: 7432929 - DNA, 23 bp, Homo sapiens
tccagctcccttcaatggcactg

SEQ ID NO: 7432930 - DNA, 22 bp, Homo sapiens
tccagctcccactctcactgct

SEQ ID NO: 7432931 - DNA, 23 bp, Homo sapiens
tccagctcccttcaatggcactg

SEQ ID NO: 7432932 - DNA, 23 bp, Homo sapiens
tccagctcccttcaatggcactg

SEQ ID NO: 7432933 - DNA, 23 bp, Homo sapiens
tccagctcccttcaatggcactg

SEQ ID NO: 7432934 - DNA, 20 bp, Homo sapiens
tccagctccgtgttcttcct

SEQ ID NO: 7432935 - DNA, 20 bp, Homo sapiens
tccagctccgtgttcttcct

SEQ ID NO: 7432936 - DNA, 20 bp, Homo sapiens
tccagctccgtgttcttcct

SEQ ID NO: 7432937 - DNA, 17 bp, Homo sapiens
tccagctcctcattgtt

SEQ ID NO: 7432938 - DNA, 22 bp, Homo sapiens
tccagctcctctacccgatgcg

SEQ ID NO: 7432939 - DNA, 22 bp, Homo sapiens
tccagctcctctacccgatgcg

SEQ ID NO: 7432940 - DNA, 17 bp, Homo sapiens
tccagctcctcattgtt

SEQ ID NO: 7432941 - DNA, 22 bp, Homo sapiens
tccagctcctctacccgatgcg

SEQ ID NO: 7432942 - DNA, 22 bp, Homo sapiens
tccagctcctgagttcactgct

SEQ ID NO: 7432943 - DNA, 22 bp, Homo sapiens
tccagctcctctacccgatgcg

SEQ ID NO: 7432944 - DNA, 22 bp, Homo sapiens
tccagctcctctacccgatgcg

SEQ ID NO: 7432945 - DNA, 17 bp, Homo sapiens
tccagctcctcattgtt

SEQ ID NO: 7432946 - DNA, 17 bp, Homo sapiens
tccagctcctcattgtt

SEQ ID NO: 7432947 - DNA, 17 bp, Homo sapiens
tccagctcctcattgtt

SEQ ID NO: 7432948 - DNA, 17 bp, Homo sapiens
tccagctcctcattgtt

SEQ ID NO: 7432949 - DNA, 17 bp, Homo sapiens
tccagctcctcattgtt

SEQ ID NO: 7432950 - DNA, 17 bp, Homo sapiens
tccagctcctcattgtt

SEQ ID NO: 7432951 - DNA, 17 bp, Homo sapiens
tccagctcctcattgtt

SEQ ID NO: 7432952 - DNA, 20 bp, Homo sapiens
tccagctccgtgttcttcct

SEQ ID NO: 7432953 - DNA, 20 bp, Homo sapiens
tccagctcagtttttttgtc

SEQ ID NO: 7432954 - DNA, 22 bp, Homo sapiens
tccagctcatctgtctccatta

SEQ ID NO: 7432955 - DNA, 20 bp, Homo sapiens
tccagctcagtttttttgtc

SEQ ID NO: 7432956 - DNA, 22 bp, Homo sapiens
tccagctcagggttggctcaag

SEQ ID NO: 7432957 - DNA, 22 bp, Homo sapiens
tccagctcagggttggctcaag

SEQ ID NO: 7432958 - DNA, 22 bp, Homo sapiens
tccagctccacagcctccctgt

SEQ ID NO: 7432959 - DNA, 22 bp, Homo sapiens
tccagctcatctgtctccatta

SEQ ID NO: 7432960 - DNA, 22 bp, Homo sapiens
tccagctcatctgtctccatta

SEQ ID NO: 7432961 - DNA, 22 bp, Homo sapiens
tccagctcatctgtctccatta

SEQ ID NO: 7432962 - DNA, 22 bp, Homo sapiens
tccagctcatctgtctccatta

SEQ ID NO: 7432963 - DNA, 22 bp, Homo sapiens
tccagctcccactctcactgct

SEQ ID NO: 7432964 - DNA, 22 bp, Homo sapiens
tccagctccacagcctccctgt

SEQ ID NO: 7432965 - DNA, 22 bp, Homo sapiens
tccagctcccactctcactgct

SEQ ID NO: 7432966 - DNA, 22 bp, Homo sapiens
tccagctcccactctcactgct

SEQ ID NO: 7432967 - DNA, 22 bp, Homo sapiens
tccagctcccactctcactgct

SEQ ID NO: 7432968 - DNA, 22 bp, Homo sapiens
tccagctccacagcctccctgt

SEQ ID NO: 7432969 - DNA, 22 bp, Homo sapiens
tccagctccacagcctccctgt

SEQ ID NO: 7432970 - DNA, 22 bp, Homo sapiens
tccagctccacagcctccctgt

SEQ ID NO: 7432971 - DNA, 22 bp, Homo sapiens
tccagctcccactctcactgct

SEQ ID NO: 7432972 - DNA, 22 bp, Homo sapiens
tccagctcccactctcactgct

SEQ ID NO: 7432973 - DNA, 22 bp, Homo sapiens
tccagctcccactctcactgct

SEQ ID NO: 7432974 - DNA, 22 bp, Homo sapiens
tccagctcccactctcactgct

SEQ ID NO: 7432975 - DNA, 19 bp, Homo sapiens
gctgagggccacccagccc

SEQ ID NO: 7432976 - DNA, 19 bp, Homo sapiens
gctgagggccacccagccc

SEQ ID NO: 7432977 - DNA, 19 bp, Homo sapiens
gctgagggccacccagccc

SEQ ID NO: 7432978 - DNA, 19 bp, Homo sapiens
gctgagggccacccagccc

SEQ ID NO: 7432979 - DNA, 19 bp, Homo sapiens
gctgagggccacccagccc

SEQ ID NO: 7432980 - DNA, 22 bp, Homo sapiens
gctgagggcatgtgtggcgact

SEQ ID NO: 7432981 - DNA, 22 bp, Homo sapiens
gctgagggcatgtgtggcgact

SEQ ID NO: 7432982 - DNA, 22 bp, Homo sapiens
gctgagggcatgtgtggcgact

SEQ ID NO: 7432983 - DNA, 22 bp, Homo sapiens
gctgagggcatgtgtggcgact

SEQ ID NO: 7432984 - DNA, 22 bp, Homo sapiens
gctgagggcatgtgtggcgact

SEQ ID NO: 7432985 - DNA, 22 bp, Homo sapiens
gctgagggcatgtgtggcgact

SEQ ID NO: 7432986 - DNA, 22 bp, Homo sapiens
gctgagggcatgtgtggcgact

SEQ ID NO: 7432987 - DNA, 22 bp, Homo sapiens
gctgagggcagcctcctaggtc

SEQ ID NO: 7432988 - DNA, 22 bp, Homo sapiens
gctgagggcagcctcctaggtc

SEQ ID NO: 7432989 - DNA, 22 bp, Homo sapiens
gctgagggcagcctcctaggtc

SEQ ID NO: 7432990 - DNA, 22 bp, Homo sapiens
gctgagggatagctgctcactg

SEQ ID NO: 7432991 - DNA, 22 bp, Homo sapiens
gctgagggccgcatagggtcat

SEQ ID NO: 7432992 - DNA, 22 bp, Homo sapiens
gctgagggccgcatagggtcat

SEQ ID NO: 7432993 - DNA, 22 bp, Homo sapiens
gctgagggccgcatagggtcat

SEQ ID NO: 7432994 - DNA, 22 bp, Homo sapiens
gctgagggccgcatagggtcat

SEQ ID NO: 7432995 - DNA, 22 bp, Homo sapiens
gctgagggctgtaacagcagag

SEQ ID NO: 7432996 - DNA, 22 bp, Homo sapiens
gctgagggctgtaacagcagag

SEQ ID NO: 7432997 - DNA, 22 bp, Homo sapiens
gctgagggctgtaacagcagag

SEQ ID NO: 7432998 - DNA, 22 bp, Homo sapiens
gctgagggctgtaacagcagag

SEQ ID NO: 7432999 - DNA, 22 bp, Homo sapiens
gctgagggctggtcacatttgt

SEQ ID NO: 7433000 - DNA, 22 bp, Homo sapiens
gctgagggccgcatagggtcat

SEQ ID NO: 7433001 - DNA, 22 bp, Homo sapiens
gctgcccaattacagggccgtg

SEQ ID NO: 7433002 - DNA, 22 bp, Homo sapiens
gctgcccaattacagggccgtg

SEQ ID NO: 7433003 - DNA, 22 bp, Homo sapiens
gctgcccacaaccccgtgtcta

SEQ ID NO: 7433004 - DNA, 22 bp, Homo sapiens
gctgcccaattacagggccgtg

SEQ ID NO: 7433005 - DNA, 22 bp, Homo sapiens
gctgcccaattacagggccgtg

SEQ ID NO: 7433006 - DNA, 22 bp, Homo sapiens
gctgcccaattacagggccgtg

SEQ ID NO: 7433007 - DNA, 22 bp, Homo sapiens
gctgcccaattacagggccgtg

SEQ ID NO: 7433008 - DNA, 22 bp, Homo sapiens
gctgagggctgtaacagcagag

SEQ ID NO: 7433009 - DNA, 22 bp, Homo sapiens
gctgagggctgtaacagcagag

SEQ ID NO: 7433010 - DNA, 22 bp, Homo sapiens
gctgcccagttctgctgctgcc

SEQ ID NO: 7433011 - DNA, 22 bp, Homo sapiens
gctgcccagttctgctgctgcc

SEQ ID NO: 7433012 - DNA, 22 bp, Homo sapiens
gctgcccagtgtgctcatgcag

SEQ ID NO: 7433013 - DNA, 22 bp, Homo sapiens
gctgcccagtgtgctcatgcag

SEQ ID NO: 7433014 - DNA, 22 bp, Homo sapiens
gctgcccagtgtgctcatgcag

SEQ ID NO: 7433015 - DNA, 22 bp, Homo sapiens
gctgcccagtgtgctcatgcag

SEQ ID NO: 7433016 - DNA, 22 bp, Homo sapiens
gctgcccattccactggatggt

SEQ ID NO: 7433017 - DNA, 22 bp, Homo sapiens
gctgcccagttctgctgctgcc

SEQ ID NO: 7433018 - DNA, 22 bp, Homo sapiens
gctgcccattccactggatggt

SEQ ID NO: 7433019 - DNA, 22 bp, Homo sapiens
gctgcccattccactggatggt

SEQ ID NO: 7433020 - DNA, 22 bp, Homo sapiens
gctgcccagttctgctgctgcc

SEQ ID NO: 7433021 - DNA, 22 bp, Homo sapiens
gctgcccagttctgctgctgcc

SEQ ID NO: 7433022 - DNA, 22 bp, Homo sapiens
gctgcccagttctgctgctgcc

SEQ ID NO: 7433023 - DNA, 22 bp, Homo sapiens
gctgcccagggctgagtgtcct

SEQ ID NO: 7433024 - DNA, 22 bp, Homo sapiens
gctgcccagggtggagccggct

SEQ ID NO: 7433025 - DNA, 22 bp, Homo sapiens
gctgcccagggtggagccggct

SEQ ID NO: 7433026 - DNA, 22 bp, Homo sapiens
gctgcccagggtggagccggct

SEQ ID NO: 7433027 - DNA, 22 bp, Homo sapiens
gctgcccagggtggagccggct

SEQ ID NO: 7433028 - DNA, 22 bp, Homo sapiens
gctgcccagggtggagccggct

SEQ ID NO: 7433029 - DNA, 22 bp, Homo sapiens
gctgcccagggctgagtgtcct

SEQ ID NO: 7433030 - DNA, 22 bp, Homo sapiens
gctgcccagggctgagtgtcct

SEQ ID NO: 7433031 - DNA, 22 bp, Homo sapiens
gctgcccagggctgagtgtcct

SEQ ID NO: 7433032 - DNA, 22 bp, Homo sapiens
gctgcccagggctgagtgtcct

SEQ ID NO: 7433033 - DNA, 22 bp, Homo sapiens
gctgcccaggcaacattgactt

SEQ ID NO: 7433034 - DNA, 22 bp, Homo sapiens
gctgcccaggcaacattgactt

SEQ ID NO: 7433035 - DNA, 22 bp, Homo sapiens
gctgcccaggcaacattgactt

SEQ ID NO: 7433036 - DNA, 22 bp, Homo sapiens
gctgcccagggctgagtgtcct

SEQ ID NO: 7433037 - DNA, 22 bp, Homo sapiens
gctgcccagcaggccccagggg

SEQ ID NO: 7433038 - DNA, 22 bp, Homo sapiens
gctgcccaggaagcctggggtt

SEQ ID NO: 7433039 - DNA, 22 bp, Homo sapiens
gctgcccaggaagcctggggtt

SEQ ID NO: 7433040 - DNA, 22 bp, Homo sapiens
gctgcccagcaggccccagggg

SEQ ID NO: 7433041 - DNA, 22 bp, Homo sapiens
gctgcccaggagaggtggggct

SEQ ID NO: 7433042 - DNA, 22 bp, Homo sapiens
gctgcccaggagaggtggggct

SEQ ID NO: 7433043 - DNA, 22 bp, Homo sapiens
gctgcccaggaagcctggggtt

SEQ ID NO: 7433044 - DNA, 22 bp, Homo sapiens
gctgcccaggagaggtggggct

SEQ ID NO: 7433045 - DNA, 22 bp, Homo sapiens
gctgcccaggagaggtggggct

SEQ ID NO: 7433046 - DNA, 22 bp, Homo sapiens
gctgcccaggaagcctggggtt

SEQ ID NO: 7433047 - DNA, 22 bp, Homo sapiens
gctgcccagacattgaatcagg

SEQ ID NO: 7433048 - DNA, 22 bp, Homo sapiens
gctgcccacagcgggtgtttcg

SEQ ID NO: 7433049 - DNA, 22 bp, Homo sapiens
gctgcccagacattgaatcagg

SEQ ID NO: 7433050 - DNA, 22 bp, Homo sapiens
gctgcccacagcgggtgtttcg

SEQ ID NO: 7433051 - DNA, 22 bp, Homo sapiens
gctgcccagcaggccccagggg

SEQ ID NO: 7433052 - DNA, 22 bp, Homo sapiens
gctgcccagacattgaatcagg

SEQ ID NO: 7433053 - DNA, 22 bp, Homo sapiens
gctgcccagcaggccccagggg

SEQ ID NO: 7433054 - DNA, 22 bp, Homo sapiens
gctgcccacaatgattacatgg

SEQ ID NO: 7433055 - DNA, 22 bp, Homo sapiens
gctgcccacaaccccgtgtcta

SEQ ID NO: 7433056 - DNA, 22 bp, Homo sapiens
gctgcccacagcgggtgtttcg

SEQ ID NO: 7433057 - DNA, 22 bp, Homo sapiens
gctgcccacaatgattacatgg

SEQ ID NO: 7433058 - DNA, 22 bp, Homo sapiens
gctgcccacaaccccgtgtcta

SEQ ID NO: 7433059 - DNA, 22 bp, Homo sapiens
gctgcccacaaccccgtgtcta

SEQ ID NO: 7433060 - DNA, 22 bp, Homo sapiens
gctgcccacaaccccgtgtcta

SEQ ID NO: 7433061 - DNA, 22 bp, Homo sapiens
gctgccctacccgaggcactct

SEQ ID NO: 7433062 - DNA, 22 bp, Homo sapiens
gctgccctacccgaggcactct

SEQ ID NO: 7433063 - DNA, 22 bp, Homo sapiens
gctgccctacccgaggcactct

SEQ ID NO: 7433064 - DNA, 22 bp, Homo sapiens
gctgccctacccgaggcactct

SEQ ID NO: 7433065 - DNA, 22 bp, Homo sapiens
gctgccctacccgaggcactct

SEQ ID NO: 7433066 - DNA, 22 bp, Homo sapiens
gctgccctagaagtacagagag

SEQ ID NO: 7433067 - DNA, 22 bp, Homo sapiens
gctgccctagaagtacagagag

SEQ ID NO: 7433068 - DNA, 22 bp, Homo sapiens
gctgccctagaagtacagagag

SEQ ID NO: 7433069 - DNA, 22 bp, Homo sapiens
gctgccctagaagtacagagag

SEQ ID NO: 7433070 - DNA, 22 bp, Homo sapiens
gctgccctgtctgcagcaggac

SEQ ID NO: 7433071 - DNA, 18 bp, Homo sapiens
gctgccctagctcccctc

SEQ ID NO: 7433072 - DNA, 22 bp, Homo sapiens
gctgccctgtctgcagcaggac

SEQ ID NO: 7433073 - DNA, 22 bp, Homo sapiens
gctgccctgtggtagagggtgg

SEQ ID NO: 7433074 - DNA, 22 bp, Homo sapiens
gctgccctgtggtagagggtgg

SEQ ID NO: 7433075 - DNA, 22 bp, Homo sapiens
gctgccctgtggtccagcaggt

SEQ ID NO: 7433076 - DNA, 22 bp, Homo sapiens
gctgccctgtggtccagcaggt

SEQ ID NO: 7433077 - DNA, 22 bp, Homo sapiens
gctgccctgtggtccagcaggt

SEQ ID NO: 7433078 - DNA, 22 bp, Homo sapiens
gctgccctgtggtccagcaggt

SEQ ID NO: 7433079 - DNA, 22 bp, Homo sapiens
gctgccccccggactcggcggg

SEQ ID NO: 7433080 - DNA, 22 bp, Homo sapiens
gctgccccccggactcggcggg

SEQ ID NO: 7433081 - DNA, 22 bp, Homo sapiens
gctgccccgagccatccttcag

SEQ ID NO: 7433082 - DNA, 22 bp, Homo sapiens
gctgccccgagccatccttcag

SEQ ID NO: 7433083 - DNA, 22 bp, Homo sapiens
gctgccccgagccatccttcag

SEQ ID NO: 7433084 - DNA, 22 bp, Homo sapiens
gctgccccgagccatccttcag

SEQ ID NO: 7433085 - DNA, 22 bp, Homo sapiens
gctgccctaatatcacatgtta

SEQ ID NO: 7433086 - DNA, 22 bp, Homo sapiens
gctgccctaatatcacatgtta

SEQ ID NO: 7433087 - DNA, 22 bp, Homo sapiens
gctgcccattgcacgttgtggc

SEQ ID NO: 7433088 - DNA, 22 bp, Homo sapiens
gctgccctaatatcacatgtta

SEQ ID NO: 7433089 - DNA, 22 bp, Homo sapiens
gctgccctaatatcacatgtta

SEQ ID NO: 7433090 - DNA, 22 bp, Homo sapiens
gctgccccccggactcggcggg

SEQ ID NO: 7433091 - DNA, 22 bp, Homo sapiens
gctgccccccggactcggcggg

SEQ ID NO: 7433092 - DNA, 22 bp, Homo sapiens
gctgcccattgctctcccactc

SEQ ID NO: 7433093 - DNA, 22 bp, Homo sapiens
gctgcccattgctctcccactc

SEQ ID NO: 7433094 - DNA, 22 bp, Homo sapiens
gctgcccattgctctcccactc

SEQ ID NO: 7433095 - DNA, 22 bp, Homo sapiens
gctgccccagctgggggctgga

SEQ ID NO: 7433096 - DNA, 22 bp, Homo sapiens
gctgccccagctgggggctgga

SEQ ID NO: 7433097 - DNA, 22 bp, Homo sapiens
gctgcccattgctctcccactc

SEQ ID NO: 7433098 - DNA, 22 bp, Homo sapiens
gctgcccattgcacgttgtggc

SEQ ID NO: 7433099 - DNA, 22 bp, Homo sapiens
gctgcccattccactggatggt

SEQ ID NO: 7433100 - DNA, 22 bp, Homo sapiens
gctgcctccaatctgtgccccg

SEQ ID NO: 7433101 - DNA, 22 bp, Homo sapiens
gctgcctccaatctgtgccccg

SEQ ID NO: 7433102 - DNA, 22 bp, Homo sapiens
gctgcctgtcctgaggagtccg

SEQ ID NO: 7433103 - DNA, 22 bp, Homo sapiens
gctgcctgtcctgaggagtccg

SEQ ID NO: 7433104 - DNA, 22 bp, Homo sapiens
gctgcctgtcctgaggagtccg

SEQ ID NO: 7433105 - DNA, 22 bp, Homo sapiens
gctgcctgtcctgaggagtccg

SEQ ID NO: 7433106 - DNA, 22 bp, Homo sapiens
gctgcctgtcctgaggagtccg

SEQ ID NO: 7433107 - DNA, 22 bp, Homo sapiens
gctgcctgtcctgaggagtccg

SEQ ID NO: 7433108 - DNA, 22 bp, Homo sapiens
gctgcctcaggcacctcctggc

SEQ ID NO: 7433109 - DNA, 22 bp, Homo sapiens
gctgcctcaggcacctcctggc

SEQ ID NO: 7433110 - DNA, 22 bp, Homo sapiens
gctgcctcaggcacctcctggc

SEQ ID NO: 7433111 - DNA, 22 bp, Homo sapiens
gctgcctcaggcacctcctggc

SEQ ID NO: 7433112 - DNA, 22 bp, Homo sapiens
gctgcctccaatctgtgccccg

SEQ ID NO: 7433113 - DNA, 22 bp, Homo sapiens
gctgcctccaatctgtgccccg

SEQ ID NO: 7433114 - DNA, 22 bp, Homo sapiens
gctgcctcaggcacctcctggc

SEQ ID NO: 7433115 - DNA, 22 bp, Homo sapiens
gctgcctacgcttgagccctgg

SEQ ID NO: 7433116 - DNA, 22 bp, Homo sapiens
gctgccgacccacaggggttaa

SEQ ID NO: 7433117 - DNA, 22 bp, Homo sapiens
gctgccgacccacaggggttaa

SEQ ID NO: 7433118 - DNA, 22 bp, Homo sapiens
gctgcctagttctttatgtgaa

SEQ ID NO: 7433119 - DNA, 22 bp, Homo sapiens
gctgcctagtctgctgagcaga

SEQ ID NO: 7433120 - DNA, 22 bp, Homo sapiens
gctgcctcactccagcccaata

SEQ ID NO: 7433121 - DNA, 22 bp, Homo sapiens
gctgcctcactccagcccaata

SEQ ID NO: 7433122 - DNA, 22 bp, Homo sapiens
gctgcctcactccagcccaata

SEQ ID NO: 7433123 - DNA, 22 bp, Homo sapiens
gctgcctcactccagcccaata

SEQ ID NO: 7433124 - DNA, 22 bp, Homo sapiens
gctgcctcactccagcccaata

SEQ ID NO: 7433125 - DNA, 22 bp, Homo sapiens
gctgcctcaggcacctcctggc

SEQ ID NO: 7433126 - DNA, 22 bp, Homo sapiens
gctgccctgtttagccagggtt

SEQ ID NO: 7433127 - DNA, 22 bp, Homo sapiens
gctgccctgtttagccagggtt

SEQ ID NO: 7433128 - DNA, 22 bp, Homo sapiens
gctgccctgtttagccagggtt

SEQ ID NO: 7433129 - DNA, 22 bp, Homo sapiens
gctgcccttcgtcatctataaa

SEQ ID NO: 7433130 - DNA, 22 bp, Homo sapiens
gctgcccttcgtcatctataaa

SEQ ID NO: 7433131 - DNA, 22 bp, Homo sapiens
gctgccctgtttagccagggtt

SEQ ID NO: 7433132 - DNA, 22 bp, Homo sapiens
gctgccctgtttagccagggtt

SEQ ID NO: 7433133 - DNA, 22 bp, Homo sapiens
gctgccctgtggtccagcaggt

SEQ ID NO: 7433134 - DNA, 22 bp, Homo sapiens
gctgccttagagggagtggttc

SEQ ID NO: 7433135 - DNA, 22 bp, Homo sapiens
gctgccttaacttcttcgctgt

SEQ ID NO: 7433136 - DNA, 22 bp, Homo sapiens
gctgccttatgtctattagtat

SEQ ID NO: 7433137 - DNA, 22 bp, Homo sapiens
gctgccttcagttctgattcat

SEQ ID NO: 7433138 - DNA, 22 bp, Homo sapiens
gctgccttatgtctattagtat

SEQ ID NO: 7433139 - DNA, 20 bp, Homo sapiens
gctgcctgtttctgtaagta

SEQ ID NO: 7433140 - DNA, 22 bp, Homo sapiens
gctgcctgttgaagggtctgtg

SEQ ID NO: 7433141 - DNA, 20 bp, Homo sapiens
gctgcctgtttctgtaagta

SEQ ID NO: 7433142 - DNA, 20 bp, Homo sapiens
gctgcctgtttctgtaagta

SEQ ID NO: 7433143 - DNA, 20 bp, Homo sapiens
gctgcctgtttctgtaagta

SEQ ID NO: 7433144 - DNA, 20 bp, Homo sapiens
gctgcctgtttctgtaagta

SEQ ID NO: 7433145 - DNA, 22 bp, Homo sapiens
gctgctagacagcatgtgagct

SEQ ID NO: 7433146 - DNA, 22 bp, Homo sapiens
gctgctagggcattatgataaa

SEQ ID NO: 7433147 - DNA, 22 bp, Homo sapiens
gctgctagggcattatgataaa

SEQ ID NO: 7433148 - DNA, 22 bp, Homo sapiens
gctgctattagtcttctattca

SEQ ID NO: 7433149 - DNA, 22 bp, Homo sapiens
gctgctcactgaaggaccctgt

SEQ ID NO: 7433150 - DNA, 22 bp, Homo sapiens
gctgctcagtgggcctgagcct

SEQ ID NO: 7433151 - DNA, 22 bp, Homo sapiens
gctgctcagtgggcctgagcct

SEQ ID NO: 7433152 - DNA, 18 bp, Homo sapiens
gctgcgtgggatgtgacc

SEQ ID NO: 7433153 - DNA, 18 bp, Homo sapiens
gctgcgtgggatgtgacc

SEQ ID NO: 7433154 - DNA, 22 bp, Homo sapiens
gctgcgtcgagacagcctggca

SEQ ID NO: 7433155 - DNA, 18 bp, Homo sapiens
gctgcgtgggatgtgacc

SEQ ID NO: 7433156 - DNA, 22 bp, Homo sapiens
gctgctaagcgtttctgttcca

SEQ ID NO: 7433157 - DNA, 22 bp, Homo sapiens
gctgcgccggatcccacgttcc

SEQ ID NO: 7433158 - DNA, 22 bp, Homo sapiens
gctgccttttgctcctcccacc

SEQ ID NO: 7433159 - DNA, 22 bp, Homo sapiens
gctgcgagctcttgttctgaga

SEQ ID NO: 7433160 - DNA, 20 bp, Homo sapiens
gctgcgatccgtttcacagt

SEQ ID NO: 7433161 - DNA, 22 bp, Homo sapiens
gctgcgccggatcccacgttcc

SEQ ID NO: 7433162 - DNA, 22 bp, Homo sapiens
gctgcgccggatcccacgttcc

SEQ ID NO: 7433163 - DNA, 22 bp, Homo sapiens
gctgcggtggctggcgatggga

SEQ ID NO: 7433164 - DNA, 22 bp, Homo sapiens
gctgcgtcgagacagcctggca

SEQ ID NO: 7433165 - DNA, 22 bp, Homo sapiens
gctgcggtggctggcgatggga

SEQ ID NO: 7433166 - DNA, 22 bp, Homo sapiens
gctgcggtgaacttggatggtg

SEQ ID NO: 7433167 - DNA, 22 bp, Homo sapiens
gctgcctgttgaagggtctgtg

SEQ ID NO: 7433168 - DNA, 22 bp, Homo sapiens
gctgcctgttgaagggtctgtg

SEQ ID NO: 7433169 - DNA, 22 bp, Homo sapiens
gctgcctgttgaagggtctgtg

SEQ ID NO: 7433170 - DNA, 22 bp, Homo sapiens
gctgcctgttgaagggtctgtg

SEQ ID NO: 7433171 - DNA, 22 bp, Homo sapiens
gctgcctgttgaagggtctgtg

SEQ ID NO: 7433172 - DNA, 22 bp, Homo sapiens
gctgcctgttgaagggtctgtg

SEQ ID NO: 7433173 - DNA, 22 bp, Homo sapiens
gctgcctgttgaagggtctgtg

SEQ ID NO: 7433174 - DNA, 22 bp, Homo sapiens
gctgcctgtgtggccactcact

SEQ ID NO: 7433175 - DNA, 22 bp, Homo sapiens
gctgcctgtgtggccactcact

SEQ ID NO: 7433176 - DNA, 22 bp, Homo sapiens
gctgcctgtgtggccactcact

SEQ ID NO: 7433177 - DNA, 22 bp, Homo sapiens
gctgcctgtgtggccactcact

SEQ ID NO: 7433178 - DNA, 22 bp, Homo sapiens
gctgcctgtgtggccactcact

SEQ ID NO: 7433179 - DNA, 22 bp, Homo sapiens
gctgcctgtggcccttctgggt

SEQ ID NO: 7433180 - DNA, 22 bp, Homo sapiens
gctgcctgtggcccttctgggt

SEQ ID NO: 7433181 - DNA, 22 bp, Homo sapiens
gctgcctgtggcccttctgggt

SEQ ID NO: 7433182 - DNA, 22 bp, Homo sapiens
gctgcctgtggcccttctgggt

SEQ ID NO: 7433183 - DNA, 22 bp, Homo sapiens
gctgcctgtctgctgacccagg

SEQ ID NO: 7433184 - DNA, 22 bp, Homo sapiens
gctgcctgtctgctgacccagg

SEQ ID NO: 7433185 - DNA, 22 bp, Homo sapiens
gctgcctgtctgctgacccagg

SEQ ID NO: 7433186 - DNA, 22 bp, Homo sapiens
gctgcctgtctgctgacccagg

SEQ ID NO: 7433187 - DNA, 22 bp, Homo sapiens
gctgcctgtcctgaggagtccg

SEQ ID NO: 7433188 - DNA, 22 bp, Homo sapiens
gctgcctgtcctgaggagtccg

SEQ ID NO: 7433189 - DNA, 22 bp, Homo sapiens
gctgcctgtctgtttcttttat

SEQ ID NO: 7433190 - DNA, 22 bp, Homo sapiens
gctgcctgtctgtttcttttat

SEQ ID NO: 7433191 - DNA, 22 bp, Homo sapiens
gctgcctgtctgctgacccagg

SEQ ID NO: 7433192 - DNA, 22 bp, Homo sapiens
gctgcctgtctgctgacccagg

SEQ ID NO: 7433193 - DNA, 19 bp, Homo sapiens
gctgcctgtcttagccagt

SEQ ID NO: 7433194 - DNA, 19 bp, Homo sapiens
gctgcctgtcttagccagt

SEQ ID NO: 7433195 - DNA, 22 bp, Homo sapiens
gctgcctgtgcactttctcgta

SEQ ID NO: 7433196 - DNA, 22 bp, Homo sapiens
gctgcctgtgcactttctcgta

SEQ ID NO: 7433197 - DNA, 22 bp, Homo sapiens
gctgcctgtgcgggtcgctagg

SEQ ID NO: 7433198 - DNA, 22 bp, Homo sapiens
gctgcctgtgcgggtcgctagg

SEQ ID NO: 7433199 - DNA, 22 bp, Homo sapiens
gctgcctgtgcgggtcgctagg

SEQ ID NO: 7433200 - DNA, 22 bp, Homo sapiens
gctgcctgtggcccttctgggt

SEQ ID NO: 7433201 - DNA, 22 bp, Homo sapiens
gctgcctgtggcccttctgggt

SEQ ID NO: 7433202 - DNA, 22 bp, Homo sapiens
gctgcctgtggcccttctgggt

SEQ ID NO: 7433203 - DNA, 21 bp, Homo sapiens
gctgctcgagatccagtgctt

SEQ ID NO: 7433204 - DNA, 21 bp, Homo sapiens
gctgctcgagatccagtgctt

SEQ ID NO: 7433205 - DNA, 21 bp, Homo sapiens
gctgctcgagatccagtgctt

SEQ ID NO: 7433206 - DNA, 21 bp, Homo sapiens
gctgctcgagatccagtgctt

SEQ ID NO: 7433207 - DNA, 21 bp, Homo sapiens
gctgctcgagatccagtgctt

SEQ ID NO: 7433208 - DNA, 22 bp, Homo sapiens
gctgctgtgaattttttaaatg

SEQ ID NO: 7433209 - DNA, 22 bp, Homo sapiens
gctgctgtctggtctgagggct

SEQ ID NO: 7433210 - DNA, 22 bp, Homo sapiens
gctgctgtctggtctgagggct

SEQ ID NO: 7433211 - DNA, 22 bp, Homo sapiens
gctgctgtgaattttttaaatg

SEQ ID NO: 7433212 - DNA, 21 bp, Homo sapiens
gctgctgtgggccagggaggc

SEQ ID NO: 7433213 - DNA, 21 bp, Homo sapiens
gctgctgtgggccagggaggc

SEQ ID NO: 7433214 - DNA, 21 bp, Homo sapiens
gctgctgtgggccagggaggc

SEQ ID NO: 7433215 - DNA, 21 bp, Homo sapiens
gctgctgtgggccagggaggc

SEQ ID NO: 7433216 - DNA, 22 bp, Homo sapiens
gctgctgtgccccatctgcaga

SEQ ID NO: 7433217 - DNA, 22 bp, Homo sapiens
gctgctgtgccccatctgcaga

SEQ ID NO: 7433218 - DNA, 22 bp, Homo sapiens
gctgctgtgcctggcgtcctgt

SEQ ID NO: 7433219 - DNA, 22 bp, Homo sapiens
gctgctccgtctgagctctggt

SEQ ID NO: 7433220 - DNA, 22 bp, Homo sapiens
gctgctccgtctgagctctggt

SEQ ID NO: 7433221 - DNA, 22 bp, Homo sapiens
gctgctccgcagagtgtgtgtg

SEQ ID NO: 7433222 - DNA, 22 bp, Homo sapiens
gctgctccgcagagtgtgtgtg

SEQ ID NO: 7433223 - DNA, 22 bp, Homo sapiens
gctgctccgtctgagctctggt

SEQ ID NO: 7433224 - DNA, 22 bp, Homo sapiens
gctgctccgtctgagctctggt

SEQ ID NO: 7433225 - DNA, 19 bp, Homo sapiens
gctgctcctggctgaccac

SEQ ID NO: 7433226 - DNA, 19 bp, Homo sapiens
gctgctcctggctgaccac

SEQ ID NO: 7433227 - DNA, 22 bp, Homo sapiens
gctgctcctgagtcccgcgcgc

SEQ ID NO: 7433228 - DNA, 22 bp, Homo sapiens
gctgctccagctgtgctgcaga

SEQ ID NO: 7433229 - DNA, 22 bp, Homo sapiens
gctgctcatttgtatcctttgt

SEQ ID NO: 7433230 - DNA, 22 bp, Homo sapiens
gctgctccagctgtgctgcaga

SEQ ID NO: 7433231 - DNA, 22 bp, Homo sapiens
gctgctccagctgtgctgcaga

SEQ ID NO: 7433232 - DNA, 22 bp, Homo sapiens
gctgctcagtgggcctgagcct

SEQ ID NO: 7433233 - DNA, 22 bp, Homo sapiens
gctgcttcagggacgtgccagc

SEQ ID NO: 7433234 - DNA, 22 bp, Homo sapiens
gctgcttcctagaaggcccagt

SEQ ID NO: 7433235 - DNA, 22 bp, Homo sapiens
gctgcttcctagaaggcccagt

SEQ ID NO: 7433236 - DNA, 22 bp, Homo sapiens
gctgcttcctttcctgctgacc

SEQ ID NO: 7433237 - DNA, 22 bp, Homo sapiens
gctgctgttgatttagtccaat

SEQ ID NO: 7433238 - DNA, 22 bp, Homo sapiens
gctgctgttcctccagtggatc

SEQ ID NO: 7433239 - DNA, 22 bp, Homo sapiens
gctgcttgattaggttgacact

SEQ ID NO: 7433240 - DNA, 22 bp, Homo sapiens
gctgctttaaaatcagcatagc

SEQ ID NO: 7433241 - DNA, 22 bp, Homo sapiens
gctgctttaactggacggctcc

SEQ ID NO: 7433242 - DNA, 22 bp, Homo sapiens
gctgctgttcctccagtggatc

SEQ ID NO: 7433243 - DNA, 22 bp, Homo sapiens
gctgctgttcctccagtggatc

SEQ ID NO: 7433244 - DNA, 22 bp, Homo sapiens
gctgctgttccggctacagccc

SEQ ID NO: 7433245 - DNA, 22 bp, Homo sapiens
gctgctgttatgatgttacttt

SEQ ID NO: 7433246 - DNA, 22 bp, Homo sapiens
gctgctgtgtgggagacaggcg

SEQ ID NO: 7433247 - DNA, 22 bp, Homo sapiens
gctgctgtgtgggagacaggcg

SEQ ID NO: 7433248 - DNA, 21 bp, Homo sapiens
gctgctgtgggccagggaggc

SEQ ID NO: 7433249 - DNA, 22 bp, Homo sapiens
gctgctgtgtgggagacaggcg

SEQ ID NO: 7433250 - DNA, 22 bp, Homo sapiens
gctgctgtgtgggagacaggcg

SEQ ID NO: 7433251 - DNA, 22 bp, Homo sapiens
gctgctgtgtgggagacaggcg

SEQ ID NO: 7433252 - DNA, 22 bp, Homo sapiens
gctgctgtgttggagagggact

SEQ ID NO: 7433253 - DNA, 22 bp, Homo sapiens
gctcccttagtccttgccggga

SEQ ID NO: 7433254 - DNA, 22 bp, Homo sapiens
gctcccttaggccttgccggga

SEQ ID NO: 7433255 - DNA, 22 bp, Homo sapiens
gctccctgttctcagccatgat

SEQ ID NO: 7433256 - DNA, 22 bp, Homo sapiens
gctccctgttctcagccatgat

SEQ ID NO: 7433257 - DNA, 22 bp, Homo sapiens
gctcctccaatatggactcctc

SEQ ID NO: 7433258 - DNA, 22 bp, Homo sapiens
gctcctccaatatggactcctc

SEQ ID NO: 7433259 - DNA, 22 bp, Homo sapiens
gctccgtgggcattgctaggtg

SEQ ID NO: 7433260 - DNA, 22 bp, Homo sapiens
gctccctgtgctctgagtgata

SEQ ID NO: 7433261 - DNA, 22 bp, Homo sapiens
gctccctgtgctctgagtgata

SEQ ID NO: 7433262 - DNA, 22 bp, Homo sapiens
gctccctgtgggatgaggcgcc

SEQ ID NO: 7433263 - DNA, 22 bp, Homo sapiens
gctccctgtgggatgaggcgcc

SEQ ID NO: 7433264 - DNA, 22 bp, Homo sapiens
gctccctgtgctctgagtgata

SEQ ID NO: 7433265 - DNA, 22 bp, Homo sapiens
gctccctgttctcagccatgat

SEQ ID NO: 7433266 - DNA, 22 bp, Homo sapiens
gctccctgtgggatgaggcgcc

SEQ ID NO: 7433267 - DNA, 22 bp, Homo sapiens
gctccctgtgggatgaggcgcc

SEQ ID NO: 7433268 - DNA, 22 bp, Homo sapiens
gctccctgttctcagccatgat

SEQ ID NO: 7433269 - DNA, 22 bp, Homo sapiens
gctcctctcccagagctgcagg

SEQ ID NO: 7433270 - DNA, 22 bp, Homo sapiens
gctcctctcccagagctgcagg

SEQ ID NO: 7433271 - DNA, 22 bp, Homo sapiens
gctcctctcccagagctgcagg

SEQ ID NO: 7433272 - DNA, 22 bp, Homo sapiens
gctctggctcaaaccaccggct

SEQ ID NO: 7433273 - DNA, 22 bp, Homo sapiens
gctctggctcaaaccaccggct

SEQ ID NO: 7433274 - DNA, 22 bp, Homo sapiens
gctctggctagttacctcttac

SEQ ID NO: 7433275 - DNA, 22 bp, Homo sapiens
gctctggctcaaaccaccggct

SEQ ID NO: 7433276 - DNA, 22 bp, Homo sapiens
gctctggctcaaaccaccggct

SEQ ID NO: 7433277 - DNA, 22 bp, Homo sapiens
gctcctctattccccacatttt

SEQ ID NO: 7433278 - DNA, 22 bp, Homo sapiens
gctcctctattccccacatttt

SEQ ID NO: 7433279 - DNA, 22 bp, Homo sapiens
gctcctccaatatggactcctc

SEQ ID NO: 7433280 - DNA, 22 bp, Homo sapiens
gctcctccctgtgcagacccag

SEQ ID NO: 7433281 - DNA, 22 bp, Homo sapiens
gctcctccctgtgcagacccag

SEQ ID NO: 7433282 - DNA, 22 bp, Homo sapiens
gctcctccctgtgcagacccag

SEQ ID NO: 7433283 - DNA, 22 bp, Homo sapiens
gctctggcttggggcactcgtc

SEQ ID NO: 7433284 - DNA, 22 bp, Homo sapiens
gctctggcttggggcactcgtc

SEQ ID NO: 7433285 - DNA, 18 bp, Homo sapiens
gctctggctcacctccag

SEQ ID NO: 7433286 - DNA, 22 bp, Homo sapiens
gctctggcttggggcactcgtc

SEQ ID NO: 7433287 - DNA, 22 bp, Homo sapiens
gctctgggaactgactgccttc

SEQ ID NO: 7433288 - DNA, 22 bp, Homo sapiens
gctctgggaactgactgccttc

SEQ ID NO: 7433289 - DNA, 22 bp, Homo sapiens
gctctgggaactgactgccttc

SEQ ID NO: 7433290 - DNA, 18 bp, Homo sapiens
gctctggctcacctccag

SEQ ID NO: 7433291 - DNA, 22 bp, Homo sapiens
gctctggctcaaaccaccggct

SEQ ID NO: 7433292 - DNA, 22 bp, Homo sapiens
gctctggctcaaaccaccggct

SEQ ID NO: 7433293 - DNA, 18 bp, Homo sapiens
gctctggctcacctccag

SEQ ID NO: 7433294 - DNA, 18 bp, Homo sapiens
gctctggctcacctccag

SEQ ID NO: 7433295 - DNA, 18 bp, Homo sapiens
gctctggctcacctccag

SEQ ID NO: 7433296 - DNA, 18 bp, Homo sapiens
gctctggctcacctccag

SEQ ID NO: 7433297 - DNA, 18 bp, Homo sapiens
gctctggctcacctccag

SEQ ID NO: 7433298 - DNA, 22 bp, Homo sapiens
gctctgggaaggatcgtagtga

SEQ ID NO: 7433299 - DNA, 22 bp, Homo sapiens
gctctgggaaggatcgtagtga

SEQ ID NO: 7433300 - DNA, 22 bp, Homo sapiens
gctctgggaaggatcgtagtga

SEQ ID NO: 7433301 - DNA, 22 bp, Homo sapiens
gctctgggaactgactgccttc

SEQ ID NO: 7433302 - DNA, 22 bp, Homo sapiens
gctctgggaactgactgccttc

SEQ ID NO: 7433303 - DNA, 22 bp, Homo sapiens
gctctgggaactgactgccttc

SEQ ID NO: 7433304 - DNA, 22 bp, Homo sapiens
gctctgggaattcagaaagcct

SEQ ID NO: 7433305 - DNA, 22 bp, Homo sapiens
gctctgggaattcagaaagcct

SEQ ID NO: 7433306 - DNA, 22 bp, Homo sapiens
gctctgggaattcagaaagcct

SEQ ID NO: 7433307 - DNA, 22 bp, Homo sapiens
gctctgggaattcagaaagcct

SEQ ID NO: 7433308 - DNA, 22 bp, Homo sapiens
gctctgggaagtcctttaccat

SEQ ID NO: 7433309 - DNA, 22 bp, Homo sapiens
gctctgggaagtcctttaccat

SEQ ID NO: 7433310 - DNA, 22 bp, Homo sapiens
gctctgggaaggatcgtagtga

SEQ ID NO: 7433311 - DNA, 22 bp, Homo sapiens
gctctgggaaggatcgtagtga

SEQ ID NO: 7433312 - DNA, 22 bp, Homo sapiens
gctctgggccgggcaccagcct

SEQ ID NO: 7433313 - DNA, 22 bp, Homo sapiens
gctctgggccgggcaccagcct

SEQ ID NO: 7433314 - DNA, 22 bp, Homo sapiens
gctctgggccgggcaccagcct

SEQ ID NO: 7433315 - DNA, 22 bp, Homo sapiens
gctctgggccgggcaccagcct

SEQ ID NO: 7433316 - DNA, 22 bp, Homo sapiens
gctctgggccgggcaccagcct

SEQ ID NO: 7433317 - DNA, 22 bp, Homo sapiens
gctctgggccgggcaccagcct

SEQ ID NO: 7433318 - DNA, 22 bp, Homo sapiens
gctctgggccgggcaccagcct

SEQ ID NO: 7433319 - DNA, 22 bp, Homo sapiens
gctctgggccatcctggccggg

SEQ ID NO: 7433320 - DNA, 22 bp, Homo sapiens
gctctgggccatcctggccggg

SEQ ID NO: 7433321 - DNA, 22 bp, Homo sapiens
gctctgggccatcctggccggg

SEQ ID NO: 7433322 - DNA, 22 bp, Homo sapiens
gctctgggccatcctggccggg

SEQ ID NO: 7433323 - DNA, 22 bp, Homo sapiens
gctctgggccatcctggccggg

SEQ ID NO: 7433324 - DNA, 22 bp, Homo sapiens
gctctgggattaccagccttag

SEQ ID NO: 7433325 - DNA, 22 bp, Homo sapiens
gctctgggattaccagccttag

SEQ ID NO: 7433326 - DNA, 22 bp, Homo sapiens
gctctgggccatcctggccggg

SEQ ID NO: 7433327 - DNA, 22 bp, Homo sapiens
gctctgggccatcctggccggg

SEQ ID NO: 7433328 - DNA, 22 bp, Homo sapiens
gctctgggaattcagaaagcct

SEQ ID NO: 7433329 - DNA, 22 bp, Homo sapiens
gctctgggaattcagaaagcct

SEQ ID NO: 7433330 - DNA, 20 bp, Homo sapiens
gctctgggagggatgtgatg

SEQ ID NO: 7433331 - DNA, 20 bp, Homo sapiens
gctctgggagggatgtgatg

SEQ ID NO: 7433332 - DNA, 20 bp, Homo sapiens
gctctgggagggatgtgatg

SEQ ID NO: 7433333 - DNA, 20 bp, Homo sapiens
gctctgggagggatgtgatg

SEQ ID NO: 7433334 - DNA, 22 bp, Homo sapiens
gctctgggattaccagccttag

SEQ ID NO: 7433335 - DNA, 22 bp, Homo sapiens
gctctgggattaccagccttag

SEQ ID NO: 7433336 - DNA, 22 bp, Homo sapiens
gctctgggattaccagccttag

SEQ ID NO: 7433337 - DNA, 22 bp, Homo sapiens
gctctgggattaccagccttag

SEQ ID NO: 7433338 - DNA, 22 bp, Homo sapiens
gctctgggattaccagccttag

SEQ ID NO: 7433339 - DNA, 20 bp, Homo sapiens
gctctgggagggatgtgatg

SEQ ID NO: 7433340 - DNA, 22 bp, Homo sapiens
gctctgggattaccagccttag

SEQ ID NO: 7433341 - DNA, 22 bp, Homo sapiens
gctctggggatgcttctgccgt

SEQ ID NO: 7433342 - DNA, 22 bp, Homo sapiens
gctctggggatgcttctgccgt

SEQ ID NO: 7433343 - DNA, 22 bp, Homo sapiens
gctctggggcccagggatcaca

SEQ ID NO: 7433344 - DNA, 22 bp, Homo sapiens
gctctggggcccagggatcaca

SEQ ID NO: 7433345 - DNA, 22 bp, Homo sapiens
gctctggggcccagggatcaca

SEQ ID NO: 7433346 - DNA, 22 bp, Homo sapiens
gctctggggcccagggatcaca

SEQ ID NO: 7433347 - DNA, 22 bp, Homo sapiens
gctctggggttggaaagtgatc

SEQ ID NO: 7433348 - DNA, 22 bp, Homo sapiens
gctctggggttggaaagtgatc

SEQ ID NO: 7433349 - DNA, 22 bp, Homo sapiens
gctctggggttggaaagtgatc

SEQ ID NO: 7433350 - DNA, 22 bp, Homo sapiens
gctgaataggggtcccaaagat

SEQ ID NO: 7433351 - DNA, 22 bp, Homo sapiens
gctgaataggcacagagggcat

SEQ ID NO: 7433352 - DNA, 23 bp, Homo sapiens
gctgaattaagcaatgaagaaat

SEQ ID NO: 7433353 - DNA, 23 bp, Homo sapiens
gctgaattaagcaatgaagaaat

SEQ ID NO: 7433354 - DNA, 22 bp, Homo sapiens
gctctgggctgccctctggaca

SEQ ID NO: 7433355 - DNA, 22 bp, Homo sapiens
gctctggggatgcttctgccgt

SEQ ID NO: 7433356 - DNA, 22 bp, Homo sapiens
gctctggggatgcttctgccgt

SEQ ID NO: 7433357 - DNA, 22 bp, Homo sapiens
gctctggggatgcttctgccgt

SEQ ID NO: 7433358 - DNA, 22 bp, Homo sapiens
gctctggggatgcttctgccgt

SEQ ID NO: 7433359 - DNA, 22 bp, Homo sapiens
gctctgggctgccctctggaca

SEQ ID NO: 7433360 - DNA, 22 bp, Homo sapiens
gctctgggctgccctctggaca

SEQ ID NO: 7433361 - DNA, 22 bp, Homo sapiens
gctctgggctgccctctggaca

SEQ ID NO: 7433362 - DNA, 22 bp, Homo sapiens
gctctgggctgccctctggaca

SEQ ID NO: 7433363 - DNA, 22 bp, Homo sapiens
gctctgggctgccctctggaca

SEQ ID NO: 7433364 - DNA, 22 bp, Homo sapiens
gctctgggctgccctctggaca

SEQ ID NO: 7433365 - DNA, 22 bp, Homo sapiens
gctctgggctgccctctggaca

SEQ ID NO: 7433366 - DNA, 22 bp, Homo sapiens
gctctgggctgaatcatttatc

SEQ ID NO: 7433367 - DNA, 22 bp, Homo sapiens
gctctgggctgccctctggaca

SEQ ID NO: 7433368 - DNA, 22 bp, Homo sapiens
gctctgggctgaatcatttatc

SEQ ID NO: 7433369 - DNA, 22 bp, Homo sapiens
gctctgggctgaatcatttatc

SEQ ID NO: 7433370 - DNA, 22 bp, Homo sapiens
gctctgggctgaatcatttatc

SEQ ID NO: 7433371 - DNA, 22 bp, Homo sapiens
gctctgggccgggcaccagcct

SEQ ID NO: 7433372 - DNA, 22 bp, Homo sapiens
gctgagaatgttcctactggta

SEQ ID NO: 7433373 - DNA, 22 bp, Homo sapiens
gctgagaatgttcctactggta

SEQ ID NO: 7433374 - DNA, 22 bp, Homo sapiens
gctgagaatgttcctactggta

SEQ ID NO: 7433375 - DNA, 21 bp, Homo sapiens
gctgagacgcaacctcagtga

SEQ ID NO: 7433376 - DNA, 22 bp, Homo sapiens
gctgagaatgttcctactggta

SEQ ID NO: 7433377 - DNA, 22 bp, Homo sapiens
gctgagaagtcccatgatccgc

SEQ ID NO: 7433378 - DNA, 22 bp, Homo sapiens
gctgagaatcaagatggagagg

SEQ ID NO: 7433379 - DNA, 22 bp, Homo sapiens
gctgagaagtcccatgatccgc

SEQ ID NO: 7433380 - DNA, 22 bp, Homo sapiens
gctgacacttagaagtgccctg

SEQ ID NO: 7433381 - DNA, 22 bp, Homo sapiens
gctgacacttagaagtgccctg

SEQ ID NO: 7433382 - DNA, 22 bp, Homo sapiens
gctgacacttagaagtgccctg

SEQ ID NO: 7433383 - DNA, 17 bp, Homo sapiens
gctgagaaggggaagag

SEQ ID NO: 7433384 - DNA, 17 bp, Homo sapiens
gctgagaaggggaagag

SEQ ID NO: 7433385 - DNA, 23 bp, Homo sapiens
gctgaattaagcaatgaagaaat

SEQ ID NO: 7433386 - DNA, 23 bp, Homo sapiens
gctgaattaagcaatgaagaaat

SEQ ID NO: 7433387 - DNA, 22 bp, Homo sapiens
gctgaattcctgctcttggatt

SEQ ID NO: 7433388 - DNA, 23 bp, Homo sapiens
gctgaattaagcaatgaagaaat

SEQ ID NO: 7433389 - DNA, 22 bp, Homo sapiens
gctgaattcctgctcttggatt

SEQ ID NO: 7433390 - DNA, 22 bp, Homo sapiens
gctgaattttgttctagggttt

SEQ ID NO: 7433391 - DNA, 22 bp, Homo sapiens
gctgagagatcaaggcaggatt

SEQ ID NO: 7433392 - DNA, 22 bp, Homo sapiens
gctgagagatcaaggcaggatt

SEQ ID NO: 7433393 - DNA, 22 bp, Homo sapiens
gctgagagaaaagtgaggttct

SEQ ID NO: 7433394 - DNA, 22 bp, Homo sapiens
gctgagagaaaagtgaggttct

SEQ ID NO: 7433395 - DNA, 22 bp, Homo sapiens
gctgagagatcaaggcaggatt

SEQ ID NO: 7433396 - DNA, 22 bp, Homo sapiens
gctgagagatcaaggcaggatt

SEQ ID NO: 7433397 - DNA, 22 bp, Homo sapiens
gctgagactggcagcaggaagt

SEQ ID NO: 7433398 - DNA, 22 bp, Homo sapiens
gctgagactggcagcaggaagt

SEQ ID NO: 7433399 - DNA, 22 bp, Homo sapiens
gctgagactgacatgaagaggt

SEQ ID NO: 7433400 - DNA, 22 bp, Homo sapiens
gctgagactggcagcaggaagt

SEQ ID NO: 7433401 - DNA, 21 bp, Homo sapiens
gctgagacgcaacctcagtga

SEQ ID NO: 7433402 - DNA, 22 bp, Homo sapiens
gctgagagaaaagtgaggttct

SEQ ID NO: 7433403 - DNA, 22 bp, Homo sapiens
gctgagacttccactgccatct

SEQ ID NO: 7433404 - DNA, 22 bp, Homo sapiens
gctgagagaaaagtgaggttct

SEQ ID NO: 7433405 - DNA, 22 bp, Homo sapiens
gctgagacttccactgccatct

SEQ ID NO: 7433406 - DNA, 21 bp, Homo sapiens
gctgagaggttgggaagttca

SEQ ID NO: 7433407 - DNA, 22 bp, Homo sapiens
gctgagagtccaggaaaacatc

SEQ ID NO: 7433408 - DNA, 21 bp, Homo sapiens
gctgagaggttgggaagttca

SEQ ID NO: 7433409 - DNA, 22 bp, Homo sapiens
gctgagagtccaggaaaacatc

SEQ ID NO: 7433410 - DNA, 22 bp, Homo sapiens
gctgagagtccaggaaaacatc

SEQ ID NO: 7433411 - DNA, 22 bp, Homo sapiens
gctgagagtgagcactggatat

SEQ ID NO: 7433412 - DNA, 22 bp, Homo sapiens
gctgagagtgagcactggatat

SEQ ID NO: 7433413 - DNA, 22 bp, Homo sapiens
gctgagagtgagcactggatat

SEQ ID NO: 7433414 - DNA, 22 bp, Homo sapiens
gctgagagtgagcactggatat

SEQ ID NO: 7433415 - DNA, 22 bp, Homo sapiens
gctgagaggcagccagaccctc

SEQ ID NO: 7433416 - DNA, 22 bp, Homo sapiens
gctgagaggcagccagaccctc

SEQ ID NO: 7433417 - DNA, 22 bp, Homo sapiens
gctgagaggcagccagaccctc

SEQ ID NO: 7433418 - DNA, 17 bp, Homo sapiens
gctgagaggcagcacag

SEQ ID NO: 7433419 - DNA, 17 bp, Homo sapiens
gctgagaggcagcacag

SEQ ID NO: 7433420 - DNA, 17 bp, Homo sapiens
gctgagaggcagcacag

SEQ ID NO: 7433421 - DNA, 17 bp, Homo sapiens
gctgagaggcagcacag

SEQ ID NO: 7433422 - DNA, 17 bp, Homo sapiens
gctgagaggcagcacag

SEQ ID NO: 7433423 - DNA, 17 bp, Homo sapiens
gctgagaggcagcacag

SEQ ID NO: 7433424 - DNA, 22 bp, Homo sapiens
gctgagaggcactatctccgga

SEQ ID NO: 7433425 - DNA, 22 bp, Homo sapiens
gctgagagcggccagctgggaa

SEQ ID NO: 7433426 - DNA, 22 bp, Homo sapiens
gctgagagcagtgtggccttaa

SEQ ID NO: 7433427 - DNA, 22 bp, Homo sapiens
gctgagagcagtgtggccttaa

SEQ ID NO: 7433428 - DNA, 22 bp, Homo sapiens
gctgagagcacatagaaggggc

SEQ ID NO: 7433429 - DNA, 22 bp, Homo sapiens
gctgagagcacatagaaggggc

SEQ ID NO: 7433430 - DNA, 22 bp, Homo sapiens
gctgagagcacatagaaggggc

SEQ ID NO: 7433431 - DNA, 22 bp, Homo sapiens
gctgagagcggccagctgggaa

SEQ ID NO: 7433432 - DNA, 22 bp, Homo sapiens
gctgagagcggccagctgggaa

SEQ ID NO: 7433433 - DNA, 22 bp, Homo sapiens
gctgagagcggccagctgggaa

SEQ ID NO: 7433434 - DNA, 22 bp, Homo sapiens
gctgagagcggccagctgggaa

SEQ ID NO: 7433435 - DNA, 22 bp, Homo sapiens
gctgagagcaaagcatgtctag

SEQ ID NO: 7433436 - DNA, 22 bp, Homo sapiens
gctgagagcaaagcatgtctag

SEQ ID NO: 7433437 - DNA, 22 bp, Homo sapiens
gctgagagcaaagcatgtctag

SEQ ID NO: 7433438 - DNA, 22 bp, Homo sapiens
gctgagagcaaagcatgtctag

SEQ ID NO: 7433439 - DNA, 22 bp, Homo sapiens
gctgagagatcaaggcaggatt

SEQ ID NO: 7433440 - DNA, 22 bp, Homo sapiens
gctgagagatcaaggcaggatt

SEQ ID NO: 7433441 - DNA, 22 bp, Homo sapiens
gctgagagcacatagaaggggc

SEQ ID NO: 7433442 - DNA, 22 bp, Homo sapiens
gctgagagcaaggacaaagcat

SEQ ID NO: 7433443 - DNA, 22 bp, Homo sapiens
gctgagagcaaggacaaagcat

SEQ ID NO: 7433444 - DNA, 22 bp, Homo sapiens
gctgagagcaaggacaaagcat

SEQ ID NO: 7433445 - DNA, 22 bp, Homo sapiens
gctgaggctgggagcagcctgt

SEQ ID NO: 7433446 - DNA, 22 bp, Homo sapiens
gctgaggctgggagcagcctgt

SEQ ID NO: 7433447 - DNA, 22 bp, Homo sapiens
gctgaggctgggagcagcctgt

SEQ ID NO: 7433448 - DNA, 22 bp, Homo sapiens
gctgagggaccatgtttcagga

SEQ ID NO: 7433449 - DNA, 22 bp, Homo sapiens
gctgagggaccatgtttcagga

SEQ ID NO: 7433450 - DNA, 22 bp, Homo sapiens
gctgagggaccatgtttcagga

SEQ ID NO: 7433451 - DNA, 22 bp, Homo sapiens
gctgaggcttagctaaaaattt

SEQ ID NO: 7433452 - DNA, 22 bp, Homo sapiens
gctgaggcttagctaaaaattt

SEQ ID NO: 7433453 - DNA, 22 bp, Homo sapiens
gctgagggatagctgctcactg

SEQ ID NO: 7433454 - DNA, 22 bp, Homo sapiens
gctgagggatagctgctcactg

SEQ ID NO: 7433455 - DNA, 22 bp, Homo sapiens
gctgagggaggctgaactgagt

SEQ ID NO: 7433456 - DNA, 22 bp, Homo sapiens
gctgagggatagctgctcactg

SEQ ID NO: 7433457 - DNA, 22 bp, Homo sapiens
gctgagggatagctgctcactg

SEQ ID NO: 7433458 - DNA, 22 bp, Homo sapiens
gctgagggatagctgctcactg

SEQ ID NO: 7433459 - DNA, 22 bp, Homo sapiens
gctgagggatagctgctcactg

SEQ ID NO: 7433460 - DNA, 22 bp, Homo sapiens
gctgagggaggctgaactgagt

SEQ ID NO: 7433461 - DNA, 22 bp, Homo sapiens
gctgagggaccatgtttcagga

SEQ ID NO: 7433462 - DNA, 22 bp, Homo sapiens
gctgagggaggctgaactgagt

SEQ ID NO: 7433463 - DNA, 22 bp, Homo sapiens
gctgaggctgggagcagcctgt

SEQ ID NO: 7433464 - DNA, 22 bp, Homo sapiens
gctgaggctgggagcagcctgt

SEQ ID NO: 7433465 - DNA, 22 bp, Homo sapiens
gctgaggctgggagcagcctgt

SEQ ID NO: 7433466 - DNA, 22 bp, Homo sapiens
gctgaggctcctcgggaggaca

SEQ ID NO: 7433467 - DNA, 22 bp, Homo sapiens
gctgaggctgggagcagcctgt

SEQ ID NO: 7433468 - DNA, 22 bp, Homo sapiens
gctgaggctgggagcagcctgt

SEQ ID NO: 7433469 - DNA, 22 bp, Homo sapiens
gctgaggctgggagcagcctgt

SEQ ID NO: 7433470 - DNA, 22 bp, Homo sapiens
gctgaggctgggagcagcctgt

SEQ ID NO: 7433471 - DNA, 22 bp, Homo sapiens
gctgaggctgggagcagcctgt

SEQ ID NO: 7433472 - DNA, 22 bp, Homo sapiens
gctgaggctcctcgggaggaca

SEQ ID NO: 7433473 - DNA, 22 bp, Homo sapiens
gctgaggctcaatccccttctg

SEQ ID NO: 7433474 - DNA, 22 bp, Homo sapiens
gctgaggctcaatccccttctg

SEQ ID NO: 7433475 - DNA, 22 bp, Homo sapiens
gctgaggctcaagtcatgggtc

SEQ ID NO: 7433476 - DNA, 22 bp, Homo sapiens
gctgaggctcaagtcatgggtc

SEQ ID NO: 7433477 - DNA, 22 bp, Homo sapiens
gctgaggctcaatccccttctg

SEQ ID NO: 7433478 - DNA, 22 bp, Homo sapiens
gctgaggctcctcgggaggaca

SEQ ID NO: 7433479 - DNA, 22 bp, Homo sapiens
gctgaggctcctcgggaggaca

SEQ ID NO: 7433480 - DNA, 22 bp, Homo sapiens
gctgaggctcaatccccttctg

SEQ ID NO: 7433481 - DNA, 22 bp, Homo sapiens
gctgaggctcctcgggaggaca

SEQ ID NO: 7433482 - DNA, 22 bp, Homo sapiens
gctgaggctcctcgggaggaca

SEQ ID NO: 7433483 - DNA, 22 bp, Homo sapiens
gctgaggccagtttaatgagga

SEQ ID NO: 7433484 - DNA, 22 bp, Homo sapiens
gctgaggccccagggtgatggg

SEQ ID NO: 7433485 - DNA, 22 bp, Homo sapiens
gctgaggccccagggtgatggg

SEQ ID NO: 7433486 - DNA, 22 bp, Homo sapiens
gctgaggccccagggtgatggg

SEQ ID NO: 7433487 - DNA, 22 bp, Homo sapiens
gctgaggccccagggtgatggg

SEQ ID NO: 7433488 - DNA, 22 bp, Homo sapiens
gctgaggccccagggtgatggg

SEQ ID NO: 7433489 - DNA, 22 bp, Homo sapiens
gctgaggccccagggtgatggg

SEQ ID NO: 7433490 - DNA, 22 bp, Homo sapiens
gctgaggccccagggtgatggg

SEQ ID NO: 7433491 - DNA, 22 bp, Homo sapiens
gctgaggccccagggtgatggg

SEQ ID NO: 7433492 - DNA, 22 bp, Homo sapiens
gctgaggcctcagaaggctgag

SEQ ID NO: 7433493 - DNA, 22 bp, Homo sapiens
gctgagagtgggtgcagtgctt

SEQ ID NO: 7433494 - DNA, 22 bp, Homo sapiens
gctgaggccaggccccaccgga

SEQ ID NO: 7433495 - DNA, 22 bp, Homo sapiens
gctgaggccaggccccaccgga

SEQ ID NO: 7433496 - DNA, 22 bp, Homo sapiens
gctgaggccaggccccaccgga

SEQ ID NO: 7433497 - DNA, 22 bp, Homo sapiens
gctgaggccaggccccaccgga

SEQ ID NO: 7433498 - DNA, 22 bp, Homo sapiens
gctgaggccagtttaatgagga

SEQ ID NO: 7433499 - DNA, 22 bp, Homo sapiens
gctgaggccagtttaatgagga

SEQ ID NO: 7433500 - DNA, 22 bp, Homo sapiens
gctgaggccagtttaatgagga

SEQ ID NO: 7433501 - DNA, 22 bp, Homo sapiens
gctgaggccagtttaatgagga

SEQ ID NO: 7433502 - DNA, 22 bp, Homo sapiens
gctgaggcctcagaaggctgag

SEQ ID NO: 7433503 - DNA, 22 bp, Homo sapiens
gctgaggcctcagaaggctgag

SEQ ID NO: 7433504 - DNA, 22 bp, Homo sapiens
gctgaggcctcagaaggctgag

SEQ ID NO: 7433505 - DNA, 22 bp, Homo sapiens
gctgaggcctcagaaggctgag

SEQ ID NO: 7433506 - DNA, 22 bp, Homo sapiens
gctgaggcctcagaaggctgag

SEQ ID NO: 7433507 - DNA, 22 bp, Homo sapiens
gctgaggcctcagaaggctgag

SEQ ID NO: 7433508 - DNA, 22 bp, Homo sapiens
gctgaggcctcagaaggctgag

SEQ ID NO: 7433509 - DNA, 22 bp, Homo sapiens
gctgaggcctcagaaggctgag

SEQ ID NO: 7433510 - DNA, 22 bp, Homo sapiens
gctgaggctcaagtcatgggtc

SEQ ID NO: 7433511 - DNA, 22 bp, Homo sapiens
gctgaggctcaagtcatgggtc

SEQ ID NO: 7433512 - DNA, 22 bp, Homo sapiens
gctgaggctcaagtcatgggtc

SEQ ID NO: 7433513 - DNA, 22 bp, Homo sapiens
gctgaggctcaagtcatgggtc

SEQ ID NO: 7433514 - DNA, 22 bp, Homo sapiens
gctgaggcggaaggattgctag

SEQ ID NO: 7433515 - DNA, 22 bp, Homo sapiens
gctgaggcggaaggattgctag

SEQ ID NO: 7433516 - DNA, 22 bp, Homo sapiens
gctgaggcggaaggattgctag

SEQ ID NO: 7433517 - DNA, 22 bp, Homo sapiens
gctgaggcggaaggattgctag

SEQ ID NO: 7433518 - DNA, 22 bp, Homo sapiens
gcctttatcttgggccaagttt

SEQ ID NO: 7433519 - DNA, 22 bp, Homo sapiens
gcctttatcttcctgattcaga

SEQ ID NO: 7433520 - DNA, 22 bp, Homo sapiens
gcctttatcttcctgattcaga

SEQ ID NO: 7433521 - DNA, 22 bp, Homo sapiens
gcctttatccctgtacaaggtg

SEQ ID NO: 7433522 - DNA, 23 bp, Homo sapiens
gcctttattaggcacaggggtac

SEQ ID NO: 7433523 - DNA, 22 bp, Homo sapiens
gcctttattgtttattcagtgc

SEQ ID NO: 7433524 - DNA, 22 bp, Homo sapiens
gcctttatgtctgaaaatcagc

SEQ ID NO: 7433525 - DNA, 22 bp, Homo sapiens
gcctttatgtctgaaaatcagc

SEQ ID NO: 7433526 - DNA, 22 bp, Homo sapiens
gcctttatttacgaaagggaaa

SEQ ID NO: 7433527 - DNA, 22 bp, Homo sapiens
gcctttattgtttattcagtgc

SEQ ID NO: 7433528 - DNA, 22 bp, Homo sapiens
gcctttattttcaacggagtgt

SEQ ID NO: 7433529 - DNA, 22 bp, Homo sapiens
gcctttcacagagatttaaaaa

SEQ ID NO: 7433530 - DNA, 22 bp, Homo sapiens
gcctttcacagagatttaaaaa

SEQ ID NO: 7433531 - DNA, 22 bp, Homo sapiens
gcctttcatctcagctggccgg

SEQ ID NO: 7433532 - DNA, 22 bp, Homo sapiens
gcctttcagtgccttctgttca

SEQ ID NO: 7433533 - DNA, 22 bp, Homo sapiens
gcctttcactggtgccggctgt

SEQ ID NO: 7433534 - DNA, 22 bp, Homo sapiens
gcctttatcagtttcatggctt

SEQ ID NO: 7433535 - DNA, 22 bp, Homo sapiens
gcctttatatttttctggtgtt

SEQ ID NO: 7433536 - DNA, 22 bp, Homo sapiens
gcctttatcagtttcatggctt

SEQ ID NO: 7433537 - DNA, 22 bp, Homo sapiens
gcctttatccctgtacaaggtg

SEQ ID NO: 7433538 - DNA, 22 bp, Homo sapiens
gcctttatccctgtacaaggtg

SEQ ID NO: 7433539 - DNA, 22 bp, Homo sapiens
gcctttatatccctgatatcta

SEQ ID NO: 7433540 - DNA, 22 bp, Homo sapiens
gcctttatatccctgatatcta

SEQ ID NO: 7433541 - DNA, 17 bp, Homo sapiens
gcctttatacatgctgc

SEQ ID NO: 7433542 - DNA, 22 bp, Homo sapiens
gcctttatattacatttggaag

SEQ ID NO: 7433543 - DNA, 22 bp, Homo sapiens
gccttgtttcattacacgtggt

SEQ ID NO: 7433544 - DNA, 22 bp, Homo sapiens
gccttgtttcattacacgtggt

SEQ ID NO: 7433545 - DNA, 22 bp, Homo sapiens
gccttgggtttcctatcctgag

SEQ ID NO: 7433546 - DNA, 22 bp, Homo sapiens
gccttggttggccagcaggtcc

SEQ ID NO: 7433547 - DNA, 22 bp, Homo sapiens
gccttggttggccagcaggtcc

SEQ ID NO: 7433548 - DNA, 22 bp, Homo sapiens
gccttggttggccagcaggtcc

SEQ ID NO: 7433549 - DNA, 22 bp, Homo sapiens
gccttgttgctcctatttgttt

SEQ ID NO: 7433550 - DNA, 22 bp, Homo sapiens
gcctttaaagctggcaggcttt

SEQ ID NO: 7433551 - DNA, 22 bp, Homo sapiens
gcctttaaagctggcaggcttt

SEQ ID NO: 7433552 - DNA, 22 bp, Homo sapiens
gcctttagactttgggacttat

SEQ ID NO: 7433553 - DNA, 22 bp, Homo sapiens
gcctttaaagccccgagagccc

SEQ ID NO: 7433554 - DNA, 18 bp, Homo sapiens
gcctttgaatgagggatt

SEQ ID NO: 7433555 - DNA, 18 bp, Homo sapiens
gcctttgaatgagggatt

SEQ ID NO: 7433556 - DNA, 22 bp, Homo sapiens
gcctttcatgcttggagggcca

SEQ ID NO: 7433557 - DNA, 22 bp, Homo sapiens
gcctttcctgctctggcattca

SEQ ID NO: 7433558 - DNA, 22 bp, Homo sapiens
gcctttgaattgttgtggtgag

SEQ ID NO: 7433559 - DNA, 18 bp, Homo sapiens
gcctttgcacaagcagct

SEQ ID NO: 7433560 - DNA, 18 bp, Homo sapiens
gcctttgcacaagcagct

SEQ ID NO: 7433561 - DNA, 22 bp, Homo sapiens
gcctttgcaccatcagtgcaat

SEQ ID NO: 7433562 - DNA, 22 bp, Homo sapiens
gcctttgctgtgacaatgctgg

SEQ ID NO: 7433563 - DNA, 22 bp, Homo sapiens
gcctttgctgtgacaatgctgg

SEQ ID NO: 7433564 - DNA, 22 bp, Homo sapiens
gcctttgcaccatcagtgcaat

SEQ ID NO: 7433565 - DNA, 22 bp, Homo sapiens
gcctttgcctgcgacgtggctg

SEQ ID NO: 7433566 - DNA, 22 bp, Homo sapiens
gcctttggagatgtcataggat

SEQ ID NO: 7433567 - DNA, 22 bp, Homo sapiens
gcctttggagaatccagtcatg

SEQ ID NO: 7433568 - DNA, 22 bp, Homo sapiens
gcctttggagatgtcataggat

SEQ ID NO: 7433569 - DNA, 22 bp, Homo sapiens
gcctttggatatattcagggat

SEQ ID NO: 7433570 - DNA, 18 bp, Homo sapiens
gcctttggactgctccca

SEQ ID NO: 7433571 - DNA, 18 bp, Homo sapiens
gcctttggactgctccca

SEQ ID NO: 7433572 - DNA, 18 bp, Homo sapiens
gcctttggactgctccca

SEQ ID NO: 7433573 - DNA, 22 bp, Homo sapiens
gcctttggactgaggtagtcag

SEQ ID NO: 7433574 - DNA, 22 bp, Homo sapiens
gcctttgctgtgacaatgctgg

SEQ ID NO: 7433575 - DNA, 22 bp, Homo sapiens
gcctttggactgaggtagtcag

SEQ ID NO: 7433576 - DNA, 22 bp, Homo sapiens
gcctttggtgacaggcatgtgt

SEQ ID NO: 7433577 - DNA, 21 bp, Homo sapiens
gcctttggtttcttgtcctgc

SEQ ID NO: 7433578 - DNA, 19 bp, Homo sapiens
gcctttgggcgttgttggg

SEQ ID NO: 7433579 - DNA, 22 bp, Homo sapiens
gcctttggtgacaggcatgtgt

SEQ ID NO: 7433580 - DNA, 19 bp, Homo sapiens
gcctttgggcgttgttggg

SEQ ID NO: 7433581 - DNA, 22 bp, Homo sapiens
gcctttggctctgtctgacctg

SEQ ID NO: 7433582 - DNA, 22 bp, Homo sapiens
gcctttggatggtttttctatt

SEQ ID NO: 7433583 - DNA, 22 bp, Homo sapiens
gcctttggatatattcagggat

SEQ ID NO: 7433584 - DNA, 22 bp, Homo sapiens
gcctttggatggtttttctatt

SEQ ID NO: 7433585 - DNA, 22 bp, Homo sapiens
gcctttggatatattcagggat

SEQ ID NO: 7433586 - DNA, 22 bp, Homo sapiens
gccttttaaggcagagggagat

SEQ ID NO: 7433587 - DNA, 21 bp, Homo sapiens
gcctttggtttcttgtcctgc

SEQ ID NO: 7433588 - DNA, 22 bp, Homo sapiens
gccttttaaggcagagggagat

SEQ ID NO: 7433589 - DNA, 22 bp, Homo sapiens
gcggggggcaggcagtacgttg

SEQ ID NO: 7433590 - DNA, 22 bp, Homo sapiens
gcgggggtggccagcaagacct

SEQ ID NO: 7433591 - DNA, 22 bp, Homo sapiens
gcggggttccgtgccccagagt

SEQ ID NO: 7433592 - DNA, 22 bp, Homo sapiens
gcggggttccgtgccccagagt

SEQ ID NO: 7433593 - DNA, 22 bp, Homo sapiens
gcggggttccgtgccccagagt

SEQ ID NO: 7433594 - DNA, 22 bp, Homo sapiens
gcggggttccgtgccccagagt

SEQ ID NO: 7433595 - DNA, 22 bp, Homo sapiens
gcgggtggaacggctccacgtg

SEQ ID NO: 7433596 - DNA, 22 bp, Homo sapiens
gcgggtggaacggctccacgtg

SEQ ID NO: 7433597 - DNA, 22 bp, Homo sapiens
gcgggtttgatgtgctaatgag

SEQ ID NO: 7433598 - DNA, 22 bp, Homo sapiens
gcgggttgaagggcgcatcgaa

SEQ ID NO: 7433599 - DNA, 22 bp, Homo sapiens
gcgggtggatcatgaggtcagg

SEQ ID NO: 7433600 - DNA, 22 bp, Homo sapiens
gcgggtggtgtccctgctcctc

SEQ ID NO: 7433601 - DNA, 22 bp, Homo sapiens
gcgggtggatcatgaggtcagg

SEQ ID NO: 7433602 - DNA, 22 bp, Homo sapiens
gcgggtggatcatgaggtcagg

SEQ ID NO: 7433603 - DNA, 22 bp, Homo sapiens
gcgggtggatcatgaggtcagg

SEQ ID NO: 7433604 - DNA, 22 bp, Homo sapiens
gcgggtggatcatgaggtcagg

SEQ ID NO: 7433605 - DNA, 22 bp, Homo sapiens
gcgggtggatcatgaggtcagg

SEQ ID NO: 7433606 - DNA, 22 bp, Homo sapiens
gcgtggcttagagtggggtacc

SEQ ID NO: 7433607 - DNA, 22 bp, Homo sapiens
gcgtggcttagagtggggtacc

SEQ ID NO: 7433608 - DNA, 22 bp, Homo sapiens
gcgtggcttagagtggggtacc

SEQ ID NO: 7433609 - DNA, 22 bp, Homo sapiens
gcgtggcttagagtggggtacc

SEQ ID NO: 7433610 - DNA, 22 bp, Homo sapiens
gcgtggcttagagtggggtacc

SEQ ID NO: 7433611 - DNA, 20 bp, Homo sapiens
gcgtggcctgggatcccaag

SEQ ID NO: 7433612 - DNA, 18 bp, Homo sapiens
gcgtggagcgggctcggt

SEQ ID NO: 7433613 - DNA, 22 bp, Homo sapiens
gcgtggagacaactctggggtg

SEQ ID NO: 7433614 - DNA, 22 bp, Homo sapiens
gcgtggagacaactctggggtg

SEQ ID NO: 7433615 - DNA, 22 bp, Homo sapiens
gcgtggggcagcccagggcttc

SEQ ID NO: 7433616 - DNA, 22 bp, Homo sapiens
gcgtggggcagcccagggcttc

SEQ ID NO: 7433617 - DNA, 22 bp, Homo sapiens
gcgtggggcagcccagggcttc

SEQ ID NO: 7433618 - DNA, 22 bp, Homo sapiens
gcgtggggcagcccagggcttc

SEQ ID NO: 7433619 - DNA, 22 bp, Homo sapiens
gcgtgggctggactgggatgaa

SEQ ID NO: 7433620 - DNA, 22 bp, Homo sapiens
gcgtgggctggactgggatgaa

SEQ ID NO: 7433621 - DNA, 22 bp, Homo sapiens
gcgtgggctggactgggatgaa

SEQ ID NO: 7433622 - DNA, 22 bp, Homo sapiens
gctacagagctctgtgaagaga

SEQ ID NO: 7433623 - DNA, 22 bp, Homo sapiens
gctacagagctctgtgaagaga

SEQ ID NO: 7433624 - DNA, 22 bp, Homo sapiens
gctacagatttatcatgttata

SEQ ID NO: 7433625 - DNA, 22 bp, Homo sapiens
gctacagagctctgtgaagaga

SEQ ID NO: 7433626 - DNA, 22 bp, Homo sapiens
gctacaggagataaaggcctct

SEQ ID NO: 7433627 - DNA, 22 bp, Homo sapiens
gctacaggagctgtcacatgct

SEQ ID NO: 7433628 - DNA, 22 bp, Homo sapiens
gctacaggagataaaggcctct

SEQ ID NO: 7433629 - DNA, 22 bp, Homo sapiens
gctacaggtgacagcctctgca

SEQ ID NO: 7433630 - DNA, 22 bp, Homo sapiens
gctacaggtatatagatgaaac

SEQ ID NO: 7433631 - DNA, 22 bp, Homo sapiens
gctacaggtatatagatgaaac

SEQ ID NO: 7433632 - DNA, 22 bp, Homo sapiens
gctacaggtgacagcctctgca

SEQ ID NO: 7433633 - DNA, 22 bp, Homo sapiens
gctacaggggtcagtcctttgc

SEQ ID NO: 7433634 - DNA, 22 bp, Homo sapiens
gctacaggggtcagtcctttgc

SEQ ID NO: 7433635 - DNA, 22 bp, Homo sapiens
gctacaggagataaaggcctct

SEQ ID NO: 7433636 - DNA, 22 bp, Homo sapiens
gctacaggtatatagatgaaac

SEQ ID NO: 7433637 - DNA, 22 bp, Homo sapiens
gcggtggggaaaggaggtgctg

SEQ ID NO: 7433638 - DNA, 22 bp, Homo sapiens
gcggtggggaaaggaggtgctg

SEQ ID NO: 7433639 - DNA, 22 bp, Homo sapiens
gcggtgggggaaaggagcggtt

SEQ ID NO: 7433640 - DNA, 22 bp, Homo sapiens
gcggtgggggaaaggagcggtt

SEQ ID NO: 7433641 - DNA, 22 bp, Homo sapiens
gcggtgggggaaaggagcggtt

SEQ ID NO: 7433642 - DNA, 22 bp, Homo sapiens
gcggtgggggaaaggagcggtt

SEQ ID NO: 7433643 - DNA, 22 bp, Homo sapiens
gcggtgggggaaaggagcggtt

SEQ ID NO: 7433644 - DNA, 22 bp, Homo sapiens
gcggtggggaaaggaggtgctg

SEQ ID NO: 7433645 - DNA, 22 bp, Homo sapiens
gcggtggggaaaggaggtgctg

SEQ ID NO: 7433646 - DNA, 22 bp, Homo sapiens
gcggtggggaaaggaggtgctg

SEQ ID NO: 7433647 - DNA, 22 bp, Homo sapiens
gcggtggagccaggcctgggct

SEQ ID NO: 7433648 - DNA, 22 bp, Homo sapiens
gcggtcggcagaggggctctgc

SEQ ID NO: 7433649 - DNA, 22 bp, Homo sapiens
gcgggttttgtgaatgtaggtt

SEQ ID NO: 7433650 - DNA, 22 bp, Homo sapiens
gcggtagctcaagcttgtaatc

SEQ ID NO: 7433651 - DNA, 22 bp, Homo sapiens
gcggtcggcagaggggctctgc

SEQ ID NO: 7433652 - DNA, 22 bp, Homo sapiens
gcggtcggcagaggggctctgc

SEQ ID NO: 7433653 - DNA, 22 bp, Homo sapiens
gcgtctcaaggcccccaggcca

SEQ ID NO: 7433654 - DNA, 22 bp, Homo sapiens
gcgtctcaaggcccccaggcca

SEQ ID NO: 7433655 - DNA, 22 bp, Homo sapiens
gcgtggagacaactctggggtg

SEQ ID NO: 7433656 - DNA, 22 bp, Homo sapiens
gcgtgcatggccgtgtgtatgc

SEQ ID NO: 7433657 - DNA, 22 bp, Homo sapiens
gcgtctgagttgcgggggctca

SEQ ID NO: 7433658 - DNA, 23 bp, Homo sapiens
gcgtcaggactgttttgtgaccc

SEQ ID NO: 7433659 - DNA, 23 bp, Homo sapiens
gcgtcaggactgttttgtgaccc

SEQ ID NO: 7433660 - DNA, 22 bp, Homo sapiens
gcgtctcaaggcccccaggcca

SEQ ID NO: 7433661 - DNA, 22 bp, Homo sapiens
gcgtctcaaggcccccaggcca

SEQ ID NO: 7433662 - DNA, 22 bp, Homo sapiens
gccttggaaagctggagcagtt

SEQ ID NO: 7433663 - DNA, 22 bp, Homo sapiens
gccttgctgattaccttccttt

SEQ ID NO: 7433664 - DNA, 21 bp, Homo sapiens
gccttgccgtgaaagcccttt

SEQ ID NO: 7433665 - DNA, 22 bp, Homo sapiens
gccttgctaatttctcctcaac

SEQ ID NO: 7433666 - DNA, 22 bp, Homo sapiens
gccttgcctcagccatggaaac

SEQ ID NO: 7433667 - DNA, 22 bp, Homo sapiens
gccttggagatcactgctcatg

SEQ ID NO: 7433668 - DNA, 22 bp, Homo sapiens
gccttggagatcactgctcatg

SEQ ID NO: 7433669 - DNA, 23 bp, Homo sapiens
gccttggagaagtcactcaggga

SEQ ID NO: 7433670 - DNA, 23 bp, Homo sapiens
gccttggagaagtcactcaggga

SEQ ID NO: 7433671 - DNA, 22 bp, Homo sapiens
gccttggactcgggtggactca

SEQ ID NO: 7433672 - DNA, 22 bp, Homo sapiens
gccttggactcgggtggactca

SEQ ID NO: 7433673 - DNA, 22 bp, Homo sapiens
gccttggactcgggtggactca

SEQ ID NO: 7433674 - DNA, 22 bp, Homo sapiens
gccttggactaccactcccaca

SEQ ID NO: 7433675 - DNA, 22 bp, Homo sapiens
gccttggactaccactcccaca

SEQ ID NO: 7433676 - DNA, 22 bp, Homo sapiens
gccttggactaccactcccaca

SEQ ID NO: 7433677 - DNA, 22 bp, Homo sapiens
gccttggaaagctggagcagtt

SEQ ID NO: 7433678 - DNA, 22 bp, Homo sapiens
gccttggaacaattattgctgc

SEQ ID NO: 7433679 - DNA, 22 bp, Homo sapiens
gccttggaacaattattgctgc

SEQ ID NO: 7433680 - DNA, 20 bp, Homo sapiens
gcctgagctattgccaggat

SEQ ID NO: 7433681 - DNA, 20 bp, Homo sapiens
gcctgagctattgccaggat

SEQ ID NO: 7433682 - DNA, 20 bp, Homo sapiens
gcctgagctattgccaggat

SEQ ID NO: 7433683 - DNA, 20 bp, Homo sapiens
gcctgagctattgccaggat

SEQ ID NO: 7433684 - DNA, 20 bp, Homo sapiens
gcctgagctattgccaggat

SEQ ID NO: 7433685 - DNA, 22 bp, Homo sapiens
gcctgagctactagggagtctg

SEQ ID NO: 7433686 - DNA, 22 bp, Homo sapiens
gcctgagctactagggagtctg

SEQ ID NO: 7433687 - DNA, 22 bp, Homo sapiens
gcctgagccgcctgagcggcgg

SEQ ID NO: 7433688 - DNA, 22 bp, Homo sapiens
gcctgagctactagggagtctg

SEQ ID NO: 7433689 - DNA, 22 bp, Homo sapiens
gcctgagccgcctgagcggcgg

SEQ ID NO: 7433690 - DNA, 20 bp, Homo sapiens
gcctgagctccgcctcctgt

SEQ ID NO: 7433691 - DNA, 20 bp, Homo sapiens
gcctgagctccgcctcctgt

SEQ ID NO: 7433692 - DNA, 20 bp, Homo sapiens
gcctgagctccgcctcctgt

SEQ ID NO: 7433693 - DNA, 22 bp, Homo sapiens
gccttgccgctcagcagtgggg

SEQ ID NO: 7433694 - DNA, 22 bp, Homo sapiens
gcctgaggaatgctcctgactt

SEQ ID NO: 7433695 - DNA, 21 bp, Homo sapiens
gccttgccacatgtgccacag

SEQ ID NO: 7433696 - DNA, 22 bp, Homo sapiens
gcctgagctttaattttcttgt

SEQ ID NO: 7433697 - DNA, 22 bp, Homo sapiens
gcctgaggaatgctcctgactt

SEQ ID NO: 7433698 - DNA, 22 bp, Homo sapiens
gcctgaggaatgctcctgactt

SEQ ID NO: 7433699 - DNA, 22 bp, Homo sapiens
gccttggcccacagtgctcctg

SEQ ID NO: 7433700 - DNA, 22 bp, Homo sapiens
gccttggccttcctaggcctga

SEQ ID NO: 7433701 - DNA, 22 bp, Homo sapiens
gccttggccttcctaggcctga

SEQ ID NO: 7433702 - DNA, 22 bp, Homo sapiens
gccttggcccacagtgctcctg

SEQ ID NO: 7433703 - DNA, 22 bp, Homo sapiens
gccttggccttcctaggcctga

SEQ ID NO: 7433704 - DNA, 19 bp, Homo sapiens
gccttggcattctctgctt

SEQ ID NO: 7433705 - DNA, 22 bp, Homo sapiens
gccttggccaacaccttgcaaa

SEQ ID NO: 7433706 - DNA, 22 bp, Homo sapiens
gccttggccaacaccttgcaaa

SEQ ID NO: 7433707 - DNA, 22 bp, Homo sapiens
gccttggcaggctgataacatg

SEQ ID NO: 7433708 - DNA, 22 bp, Homo sapiens
gccttggcaggctgataacatg

SEQ ID NO: 7433709 - DNA, 19 bp, Homo sapiens
gccttggcattctctgctt

SEQ ID NO: 7433710 - DNA, 19 bp, Homo sapiens
gccttggcattctctgctt

SEQ ID NO: 7433711 - DNA, 19 bp, Homo sapiens
gccttggcattctctgctt

SEQ ID NO: 7433712 - DNA, 22 bp, Homo sapiens
gccttggctccagccctttccg

SEQ ID NO: 7433713 - DNA, 22 bp, Homo sapiens
gccttggctccagccctttccg

SEQ ID NO: 7433714 - DNA, 22 bp, Homo sapiens
gccttggctgatgtgcgaatga

SEQ ID NO: 7433715 - DNA, 22 bp, Homo sapiens
gccttggctgatgtgcgaatga

SEQ ID NO: 7433716 - DNA, 23 bp, Homo sapiens
gccttggcgatccgtggggcatc

SEQ ID NO: 7433717 - DNA, 23 bp, Homo sapiens
gccttggcgatccgtggggcatc

SEQ ID NO: 7433718 - DNA, 22 bp, Homo sapiens
gccttggccttcctaggcctga

SEQ ID NO: 7433719 - DNA, 23 bp, Homo sapiens
gccttggcgatccgtggggcatc

SEQ ID NO: 7433720 - DNA, 23 bp, Homo sapiens
gccttggcgatccgtggggcatc

SEQ ID NO: 7433721 - DNA, 23 bp, Homo sapiens
gccttggcgatccgtggggcatc

SEQ ID NO: 7433722 - DNA, 22 bp, Homo sapiens
gccttggctgccaagctgctga

SEQ ID NO: 7433723 - DNA, 22 bp, Homo sapiens
gccttggctgccaagctgctga

SEQ ID NO: 7433724 - DNA, 22 bp, Homo sapiens
gccttggctgccaagctgctga

SEQ ID NO: 7433725 - DNA, 22 bp, Homo sapiens
gccttggctgttggagcttgat

SEQ ID NO: 7433726 - DNA, 22 bp, Homo sapiens
gccttggctgccaagctgctga

SEQ ID NO: 7433727 - DNA, 22 bp, Homo sapiens
gccttgggacggaggggtcacc

SEQ ID NO: 7433728 - DNA, 22 bp, Homo sapiens
gccttgggaaagtgggaggaga

SEQ ID NO: 7433729 - DNA, 22 bp, Homo sapiens
gccttgggaaagtgggaggaga

SEQ ID NO: 7433730 - DNA, 22 bp, Homo sapiens
gccttggctgttggagcttgat

SEQ ID NO: 7433731 - DNA, 22 bp, Homo sapiens
gccttggctgttggagcttgat

SEQ ID NO: 7433732 - DNA, 22 bp, Homo sapiens
gccttgggaaagtgggaggaga

SEQ ID NO: 7433733 - DNA, 22 bp, Homo sapiens
gccttgggcacaggcagggccc

SEQ ID NO: 7433734 - DNA, 22 bp, Homo sapiens
gccttgggattcttggatgctc

SEQ ID NO: 7433735 - DNA, 22 bp, Homo sapiens
gccttgggattcttggatgctc

SEQ ID NO: 7433736 - DNA, 22 bp, Homo sapiens
gccttgggattcttggatgctc

SEQ ID NO: 7433737 - DNA, 22 bp, Homo sapiens
gccttgggacggaggggtcacc

SEQ ID NO: 7433738 - DNA, 22 bp, Homo sapiens
gccttgggcacaggcagggccc

SEQ ID NO: 7433739 - DNA, 22 bp, Homo sapiens
gccttgggcacaggcagggccc

SEQ ID NO: 7433740 - DNA, 22 bp, Homo sapiens
gccttgggccagctgctctgga

SEQ ID NO: 7433741 - DNA, 22 bp, Homo sapiens
gccttgggggtgaaagaggcta

SEQ ID NO: 7433742 - DNA, 22 bp, Homo sapiens
gccttgggccagctgctctgga

SEQ ID NO: 7433743 - DNA, 22 bp, Homo sapiens
gccttgggggtgaaagaggcta

SEQ ID NO: 7433744 - DNA, 22 bp, Homo sapiens
gccttgggggtgaaagaggcta

SEQ ID NO: 7433745 - DNA, 18 bp, Homo sapiens
gcctctgttgcttgcctg

SEQ ID NO: 7433746 - DNA, 22 bp, Homo sapiens
gcctgagattggacattattta

SEQ ID NO: 7433747 - DNA, 18 bp, Homo sapiens
gcctctgttgcttgcctg

SEQ ID NO: 7433748 - DNA, 22 bp, Homo sapiens
gcctgagcaggcgtggaccatg

SEQ ID NO: 7433749 - DNA, 22 bp, Homo sapiens
gcctgagcagctatacacacag

SEQ ID NO: 7433750 - DNA, 22 bp, Homo sapiens
gcctgagcaggcgtggaccatg

SEQ ID NO: 7433751 - DNA, 22 bp, Homo sapiens
gcctgagcaggcgtggaccatg

SEQ ID NO: 7433752 - DNA, 22 bp, Homo sapiens
gcctgagcagctatacacacag

SEQ ID NO: 7433753 - DNA, 22 bp, Homo sapiens
gcctctggtccctcatgctgtg

SEQ ID NO: 7433754 - DNA, 22 bp, Homo sapiens
gcctctgtaggagtgagagcat

SEQ ID NO: 7433755 - DNA, 22 bp, Homo sapiens
gcctctgtcatagctcatgtga

SEQ ID NO: 7433756 - DNA, 22 bp, Homo sapiens
gcctctgtggctcagccttgct

SEQ ID NO: 7433757 - DNA, 22 bp, Homo sapiens
gcctctgtggctcagccttgct

SEQ ID NO: 7433758 - DNA, 19 bp, Homo sapiens
gcctgagccagccatgcaa

SEQ ID NO: 7433759 - DNA, 19 bp, Homo sapiens
gcctgagccagccatgcaa

SEQ ID NO: 7433760 - DNA, 22 bp, Homo sapiens
gcctgagccgcctgagcggcgg

SEQ ID NO: 7433761 - DNA, 22 bp, Homo sapiens
gcctgagccgcctgagcggcgg

SEQ ID NO: 7433762 - DNA, 22 bp, Homo sapiens
gcctgagccgcctgagcggcgg

SEQ ID NO: 7433763 - DNA, 22 bp, Homo sapiens
gcctgagcccaggtgtgcagag

SEQ ID NO: 7433764 - DNA, 22 bp, Homo sapiens
gcctgagcccaggtgtgcagag

SEQ ID NO: 7433765 - DNA, 22 bp, Homo sapiens
gcctgagcccaggtgtgcagag

SEQ ID NO: 7433766 - DNA, 19 bp, Homo sapiens
gcctgagccagccatgcaa

SEQ ID NO: 7433767 - DNA, 21 bp, Homo sapiens
gcctgagcatgtcttcaggtc

SEQ ID NO: 7433768 - DNA, 21 bp, Homo sapiens
gcctgagcatgtcttcaggtc

SEQ ID NO: 7433769 - DNA, 21 bp, Homo sapiens
gcctgagcatgtcttcaggtc

SEQ ID NO: 7433770 - DNA, 22 bp, Homo sapiens
gcctgagcaggcgtggaccatg

SEQ ID NO: 7433771 - DNA, 22 bp, Homo sapiens
gcctgagcaggcgtggaccatg

SEQ ID NO: 7433772 - DNA, 22 bp, Homo sapiens
gcctgagcaggcgtggaccatg

SEQ ID NO: 7433773 - DNA, 22 bp, Homo sapiens
gcctctggtccctcatgctgtg

SEQ ID NO: 7433774 - DNA, 22 bp, Homo sapiens
gcctctggtccctcatgctgtg

SEQ ID NO: 7433775 - DNA, 22 bp, Homo sapiens
gcctctggtccctcatgctgtg

SEQ ID NO: 7433776 - DNA, 22 bp, Homo sapiens
gcctctggtccctcatgctgtg

SEQ ID NO: 7433777 - DNA, 22 bp, Homo sapiens
gcctctggtccctcatgctgtg

SEQ ID NO: 7433778 - DNA, 22 bp, Homo sapiens
gcctctggtccctcatgctgtg

SEQ ID NO: 7433779 - DNA, 22 bp, Homo sapiens
gcctctggtccctcatgctgtg

SEQ ID NO: 7433780 - DNA, 22 bp, Homo sapiens
gcctctggtccctcatgctgtg

SEQ ID NO: 7433781 - DNA, 22 bp, Homo sapiens
gcctctgggttggtgacaggct

SEQ ID NO: 7433782 - DNA, 22 bp, Homo sapiens
gcctctgggttggtgacaggct

SEQ ID NO: 7433783 - DNA, 22 bp, Homo sapiens
gcctctgggttggtgacaggct

SEQ ID NO: 7433784 - DNA, 22 bp, Homo sapiens
gcctctgggttggtgacaggct

SEQ ID NO: 7433785 - DNA, 22 bp, Homo sapiens
gcctctggtccctcatgctgtg

SEQ ID NO: 7433786 - DNA, 22 bp, Homo sapiens
gcctctggtccctcatgctgtg

SEQ ID NO: 7433787 - DNA, 22 bp, Homo sapiens
gcctctggtccctcatgctgtg

SEQ ID NO: 7433788 - DNA, 22 bp, Homo sapiens
gcctctgggttggtgacaggct

SEQ ID NO: 7433789 - DNA, 22 bp, Homo sapiens
gcctctgggttggtgacaggct

SEQ ID NO: 7433790 - DNA, 22 bp, Homo sapiens
gcctctggggtggagcccagca

SEQ ID NO: 7433791 - DNA, 22 bp, Homo sapiens
gcctctggggtggagcccagca

SEQ ID NO: 7433792 - DNA, 22 bp, Homo sapiens
gcctctggggtggagcccagca

SEQ ID NO: 7433793 - DNA, 22 bp, Homo sapiens
gcctctggggtggagcccagca

SEQ ID NO: 7433794 - DNA, 22 bp, Homo sapiens
gcctctgggtgacgaaaggtga

SEQ ID NO: 7433795 - DNA, 22 bp, Homo sapiens
gcctctgggtgacgaaaggtga

SEQ ID NO: 7433796 - DNA, 22 bp, Homo sapiens
gcctctggggtggagcccagca

SEQ ID NO: 7433797 - DNA, 22 bp, Homo sapiens
gcctctggggttaatagagttt

SEQ ID NO: 7433798 - DNA, 22 bp, Homo sapiens
gcctctgggggctcagacctgt

SEQ ID NO: 7433799 - DNA, 22 bp, Homo sapiens
gcctctgggggctcagacctgt

SEQ ID NO: 7433800 - DNA, 22 bp, Homo sapiens
gcctctggggcagctgagtcat

SEQ ID NO: 7433801 - DNA, 22 bp, Homo sapiens
gcctctgggggctcagacctgt

SEQ ID NO: 7433802 - DNA, 22 bp, Homo sapiens
gcctctgggggctcagacctgt

SEQ ID NO: 7433803 - DNA, 22 bp, Homo sapiens
gcctctggggcagctgagtcat

SEQ ID NO: 7433804 - DNA, 22 bp, Homo sapiens
gcctctggggcagctgagtcat

SEQ ID NO: 7433805 - DNA, 22 bp, Homo sapiens
gcctctggggcagctgagtcat

SEQ ID NO: 7433806 - DNA, 22 bp, Homo sapiens
gctcagagttaattggatgggt

SEQ ID NO: 7433807 - DNA, 22 bp, Homo sapiens
gctcagagttaaatatagtgct

SEQ ID NO: 7433808 - DNA, 22 bp, Homo sapiens
gctcagagtggcctggctaggg

SEQ ID NO: 7433809 - DNA, 22 bp, Homo sapiens
gctcagagttaaatatagtgct

SEQ ID NO: 7433810 - DNA, 22 bp, Homo sapiens
gctcagagttaaatatagtgct

SEQ ID NO: 7433811 - DNA, 22 bp, Homo sapiens
gctcagagttaattggatgggt

SEQ ID NO: 7433812 - DNA, 22 bp, Homo sapiens
gctcagagttaattggatgggt

SEQ ID NO: 7433813 - DNA, 23 bp, Homo sapiens
gctcagatgccctaggaggtggc

SEQ ID NO: 7433814 - DNA, 19 bp, Homo sapiens
gctcagcagacccagtgct

SEQ ID NO: 7433815 - DNA, 22 bp, Homo sapiens
gctcagcactttctccaaccac

SEQ ID NO: 7433816 - DNA, 22 bp, Homo sapiens
gctcagccgaacttcagagcag

SEQ ID NO: 7433817 - DNA, 19 bp, Homo sapiens
gctcagcagacccagtgct

SEQ ID NO: 7433818 - DNA, 22 bp, Homo sapiens
gctcagccgaacttcagagcag

SEQ ID NO: 7433819 - DNA, 22 bp, Homo sapiens
gctcagccgaacttcagagcag

SEQ ID NO: 7433820 - DNA, 22 bp, Homo sapiens
gctcagctctatggacacaaag

SEQ ID NO: 7433821 - DNA, 18 bp, Homo sapiens
gctcagctatgggaggtt

SEQ ID NO: 7433822 - DNA, 18 bp, Homo sapiens
gctcagctatgggaggtt

SEQ ID NO: 7433823 - DNA, 22 bp, Homo sapiens
gctcagctctatggacacaaag

SEQ ID NO: 7433824 - DNA, 22 bp, Homo sapiens
gctcagctctatggacacaaag

SEQ ID NO: 7433825 - DNA, 22 bp, Homo sapiens
gctcagctgagcgaaggacatg

SEQ ID NO: 7433826 - DNA, 22 bp, Homo sapiens
gctcagctatcagtgttcctga

SEQ ID NO: 7433827 - DNA, 22 bp, Homo sapiens
gctcagctatcagtgttcctga

SEQ ID NO: 7433828 - DNA, 22 bp, Homo sapiens
gctcagctatcagtgttcctga

SEQ ID NO: 7433829 - DNA, 18 bp, Homo sapiens
gctcagctatgggaggtt

SEQ ID NO: 7433830 - DNA, 22 bp, Homo sapiens
gctcagctatcagtgttcctga

SEQ ID NO: 7433831 - DNA, 22 bp, Homo sapiens
gctcagctacttacaggtggct

SEQ ID NO: 7433832 - DNA, 22 bp, Homo sapiens
gctcagctacttacaggtggct

SEQ ID NO: 7433833 - DNA, 22 bp, Homo sapiens
gctcagctacttacaggtggct

SEQ ID NO: 7433834 - DNA, 22 bp, Homo sapiens
gctcagctacttacaggtggct

SEQ ID NO: 7433835 - DNA, 22 bp, Homo sapiens
gctcagctacttacaggtggct

SEQ ID NO: 7433836 - DNA, 22 bp, Homo sapiens
gctcagccgaacttcagagcag

SEQ ID NO: 7433837 - DNA, 23 bp, Homo sapiens
gctcagcctcagcaggcccagga

SEQ ID NO: 7433838 - DNA, 23 bp, Homo sapiens
gctcagcctcagcaggcccagga

SEQ ID NO: 7433839 - DNA, 22 bp, Homo sapiens
gctccagggtcagctcagaact

SEQ ID NO: 7433840 - DNA, 22 bp, Homo sapiens
gctccagggtcagctcagaact

SEQ ID NO: 7433841 - DNA, 22 bp, Homo sapiens
gctccagggtcagctcagaact

SEQ ID NO: 7433842 - DNA, 22 bp, Homo sapiens
gctccagggtcagctcagaact

SEQ ID NO: 7433843 - DNA, 22 bp, Homo sapiens
gctccagggtcagctcagaact

SEQ ID NO: 7433844 - DNA, 22 bp, Homo sapiens
gctccagggagtacatttatca

SEQ ID NO: 7433845 - DNA, 22 bp, Homo sapiens
gctccagggagtacatttatca

SEQ ID NO: 7433846 - DNA, 22 bp, Homo sapiens
gctccagggagtacatttatca

SEQ ID NO: 7433847 - DNA, 22 bp, Homo sapiens
gctccagggtggatgacaattc

SEQ ID NO: 7433848 - DNA, 22 bp, Homo sapiens
gctccagggtggatgacaattc

SEQ ID NO: 7433849 - DNA, 22 bp, Homo sapiens
gctccagggtggatgacaattc

SEQ ID NO: 7433850 - DNA, 22 bp, Homo sapiens
gctccagggtggatgacaattc

SEQ ID NO: 7433851 - DNA, 22 bp, Homo sapiens
gctccagggtcagctcagaact

SEQ ID NO: 7433852 - DNA, 22 bp, Homo sapiens
gctccagggtcagctcagaact

SEQ ID NO: 7433853 - DNA, 22 bp, Homo sapiens
gctccaggaggctcccgcgtct

SEQ ID NO: 7433854 - DNA, 22 bp, Homo sapiens
gctccaggaggctcccgcgtct

SEQ ID NO: 7433855 - DNA, 22 bp, Homo sapiens
gctccaggaggctcccgcgtct

SEQ ID NO: 7433856 - DNA, 22 bp, Homo sapiens
gctcagctgcacctggagagcc

SEQ ID NO: 7433857 - DNA, 22 bp, Homo sapiens
gctcagctgcacctggagagcc

SEQ ID NO: 7433858 - DNA, 22 bp, Homo sapiens
gctcagctgagcgaaggacatg

SEQ ID NO: 7433859 - DNA, 22 bp, Homo sapiens
gctcagctgagcgaaggacatg

SEQ ID NO: 7433860 - DNA, 22 bp, Homo sapiens
gctcagctgagcgaaggacatg

SEQ ID NO: 7433861 - DNA, 22 bp, Homo sapiens
gctccaggataataaagttgtt

SEQ ID NO: 7433862 - DNA, 22 bp, Homo sapiens
gctccaggataataaagttgtt

SEQ ID NO: 7433863 - DNA, 22 bp, Homo sapiens
gctccaggcagagcctctttcg

SEQ ID NO: 7433864 - DNA, 22 bp, Homo sapiens
gctccaggcagagcctctttcg

SEQ ID NO: 7433865 - DNA, 22 bp, Homo sapiens
gctccagggacccaagagaaaa

SEQ ID NO: 7433866 - DNA, 22 bp, Homo sapiens
gctccaggcagagcctctttcg

SEQ ID NO: 7433867 - DNA, 22 bp, Homo sapiens
gctccaggcagagcctctttcg

SEQ ID NO: 7433868 - DNA, 22 bp, Homo sapiens
gctcagaggccaagtgcccgcc

SEQ ID NO: 7433869 - DNA, 22 bp, Homo sapiens
gctcagaggccaagtgcccgcc

SEQ ID NO: 7433870 - DNA, 22 bp, Homo sapiens
gctcagaggcacgacctcttgg

SEQ ID NO: 7433871 - DNA, 22 bp, Homo sapiens
gctcagaggatgctcctttatg

SEQ ID NO: 7433872 - DNA, 22 bp, Homo sapiens
gctcagaggaggcctttaccta

SEQ ID NO: 7433873 - DNA, 22 bp, Homo sapiens
gctcagaggaggcctttaccta

SEQ ID NO: 7433874 - DNA, 22 bp, Homo sapiens
gctcagaggagcatcataagga

SEQ ID NO: 7433875 - DNA, 22 bp, Homo sapiens
gctcagaggagcatcataagga

SEQ ID NO: 7433876 - DNA, 22 bp, Homo sapiens
gctcagagcttgaagttccact

SEQ ID NO: 7433877 - DNA, 22 bp, Homo sapiens
gctcagagggaacaaggggctg

SEQ ID NO: 7433878 - DNA, 22 bp, Homo sapiens
gctcagagggaacaaggggctg

SEQ ID NO: 7433879 - DNA, 22 bp, Homo sapiens
gctcagagggaacaaggggctg

SEQ ID NO: 7433880 - DNA, 22 bp, Homo sapiens
gctcagagggaacaaggggctg

SEQ ID NO: 7433881 - DNA, 22 bp, Homo sapiens
gctcagagggaacaaggggctg

SEQ ID NO: 7433882 - DNA, 22 bp, Homo sapiens
gctcagaggccactgttggaaa

SEQ ID NO: 7433883 - DNA, 22 bp, Homo sapiens
gctcagaggccaagtgcccgcc

SEQ ID NO: 7433884 - DNA, 22 bp, Homo sapiens
gctcagaggccactgttggaaa

SEQ ID NO: 7433885 - DNA, 22 bp, Homo sapiens
gctactgatcaggtttgcttta

SEQ ID NO: 7433886 - DNA, 22 bp, Homo sapiens
gctactgaaatggtgtgctgga

SEQ ID NO: 7433887 - DNA, 22 bp, Homo sapiens
gctactgattgaccttggagag

SEQ ID NO: 7433888 - DNA, 22 bp, Homo sapiens
gctactgattgaccttggagag

SEQ ID NO: 7433889 - DNA, 22 bp, Homo sapiens
gctactgattgaccttggagag

SEQ ID NO: 7433890 - DNA, 22 bp, Homo sapiens
gctactgattgaccttggagag

SEQ ID NO: 7433891 - DNA, 17 bp, Homo sapiens
gctactggttacctcta

SEQ ID NO: 7433892 - DNA, 22 bp, Homo sapiens
gctactttgcagctagctagga

SEQ ID NO: 7433893 - DNA, 22 bp, Homo sapiens
gctactttgcagctagctagga

SEQ ID NO: 7433894 - DNA, 22 bp, Homo sapiens
gctcagagcttgaagttccact

SEQ ID NO: 7433895 - DNA, 22 bp, Homo sapiens
gctcagagcttgaagttccact

SEQ ID NO: 7433896 - DNA, 19 bp, Homo sapiens
gctactgaggcccaggacc

SEQ ID NO: 7433897 - DNA, 19 bp, Homo sapiens
gctactgaggcccaggacc

SEQ ID NO: 7433898 - DNA, 22 bp, Homo sapiens
gctactaggaagattccaggat

SEQ ID NO: 7433899 - DNA, 21 bp, Homo sapiens
gctactcaagaagaaggcttt

SEQ ID NO: 7433900 - DNA, 21 bp, Homo sapiens
gctactcaagaagaaggcttt

SEQ ID NO: 7433901 - DNA, 22 bp, Homo sapiens
gctacccagagcctcaccctgt

SEQ ID NO: 7433902 - DNA, 22 bp, Homo sapiens
gctaccctgggaatctccctca

SEQ ID NO: 7433903 - DNA, 22 bp, Homo sapiens
gctacagtagataaggacggtc

SEQ ID NO: 7433904 - DNA, 22 bp, Homo sapiens
gctacagtgataggaaacacat

SEQ ID NO: 7433905 - DNA, 22 bp, Homo sapiens
gctacagtagataaggacggtc

SEQ ID NO: 7433906 - DNA, 22 bp, Homo sapiens
gctacaggtgacagcctctgca

SEQ ID NO: 7433907 - DNA, 20 bp, Homo sapiens
gctaccagaacaaggccatt

SEQ ID NO: 7433908 - DNA, 19 bp, Homo sapiens
gctaccaaggcaagacaaa

SEQ ID NO: 7433909 - DNA, 22 bp, Homo sapiens
gctacatagtaacccacaaatc

SEQ ID NO: 7433910 - DNA, 19 bp, Homo sapiens
gctcagagtccccctgcgg

SEQ ID NO: 7433911 - DNA, 19 bp, Homo sapiens
gctcagagtccccctgcgg

SEQ ID NO: 7433912 - DNA, 22 bp, Homo sapiens
gctcagagtggcctggctaggg

SEQ ID NO: 7433913 - DNA, 19 bp, Homo sapiens
gctcagagtccccctgcgg

SEQ ID NO: 7433914 - DNA, 19 bp, Homo sapiens
gctcagagtccccctgcgg

SEQ ID NO: 7433915 - DNA, 19 bp, Homo sapiens
gctcagagtccccctgcgg

SEQ ID NO: 7433916 - DNA, 22 bp, Homo sapiens
gctcagagtggcctggctaggg

SEQ ID NO: 7433917 - DNA, 22 bp, Homo sapiens
gctcagagtggcctggctaggg

SEQ ID NO: 7433918 - DNA, 22 bp, Homo sapiens
gctcagagtggcctggctaggg

SEQ ID NO: 7433919 - DNA, 22 bp, Homo sapiens
gctcagagtggcctggctaggg

SEQ ID NO: 7433920 - DNA, 22 bp, Homo sapiens
gctcagagtggcctggctaggg

SEQ ID NO: 7433921 - DNA, 21 bp, Homo sapiens
gctcagagtattgcactgttt

SEQ ID NO: 7433922 - DNA, 21 bp, Homo sapiens
gctcagagtattgcactgttt

SEQ ID NO: 7433923 - DNA, 21 bp, Homo sapiens
gctcagagtattgcactgttt

SEQ ID NO: 7433924 - DNA, 21 bp, Homo sapiens
gctcagagtattgcactgttt

SEQ ID NO: 7433925 - DNA, 21 bp, Homo sapiens
gctcagagtattgcactgttt

SEQ ID NO: 7433926 - DNA, 23 bp, Homo sapiens
gctcagaggtttttctctggatg

SEQ ID NO: 7433927 - DNA, 17 bp, Homo sapiens
gctcagagtacacgtgt

SEQ ID NO: 7433928 - DNA, 23 bp, Homo sapiens
gctcagaggtttttctctggatg

SEQ ID NO: 7433929 - DNA, 23 bp, Homo sapiens
gctcagaggtttttctctggatg

SEQ ID NO: 7433930 - DNA, 22 bp, Homo sapiens
gctcagaggttgttcttgggtt

SEQ ID NO: 7433931 - DNA, 22 bp, Homo sapiens
gctcagaggttgttcttgggtt

SEQ ID NO: 7433932 - DNA, 19 bp, Homo sapiens
gctcagagggccctgtgct

SEQ ID NO: 7433933 - DNA, 22 bp, Homo sapiens
gctcagaggttgttcttgggtt

SEQ ID NO: 7433934 - DNA, 22 bp, Homo sapiens
gctcagaggttgttcttgggtt

SEQ ID NO: 7433935 - DNA, 23 bp, Homo sapiens
gctcagaggtttttctctggatg

SEQ ID NO: 7433936 - DNA, 23 bp, Homo sapiens
gctcagaggtttttctctggatg

SEQ ID NO: 7433937 - DNA, 23 bp, Homo sapiens
gctcagaggtttttctctggatg

SEQ ID NO: 7433938 - DNA, 23 bp, Homo sapiens
gctcagaggtttttctctggatg

SEQ ID NO: 7433939 - DNA, 22 bp, Homo sapiens
gctcagagggttttggccaagt

SEQ ID NO: 7433940 - DNA, 22 bp, Homo sapiens
gctcagagggttttggccaagt

SEQ ID NO: 7433941 - DNA, 22 bp, Homo sapiens
gctcagagggttttggccaagt

SEQ ID NO: 7433942 - DNA, 22 bp, Homo sapiens
gctcagagggttttggccaagt

SEQ ID NO: 7433943 - DNA, 23 bp, Homo sapiens
gctcagaggtgaaatgttttggg

SEQ ID NO: 7433944 - DNA, 19 bp, Homo sapiens
gctcagagggccctgtgct

SEQ ID NO: 7433945 - DNA, 19 bp, Homo sapiens
gctcagagggccctgtgct

SEQ ID NO: 7433946 - DNA, 19 bp, Homo sapiens
gctcagagggccctgtgct

SEQ ID NO: 7433947 - DNA, 19 bp, Homo sapiens
gctcagagggccctgtgct

SEQ ID NO: 7433948 - DNA, 19 bp, Homo sapiens
gctcagagggccctgtgct

SEQ ID NO: 7433949 - DNA, 22 bp, Homo sapiens
gctcccacctttgctatcagta

SEQ ID NO: 7433950 - DNA, 22 bp, Homo sapiens
gctcccacctttgctatcagta

SEQ ID NO: 7433951 - DNA, 22 bp, Homo sapiens
gctcccacgcaattcttttcag

SEQ ID NO: 7433952 - DNA, 22 bp, Homo sapiens
gctcccactgcagccctgagcc

SEQ ID NO: 7433953 - DNA, 22 bp, Homo sapiens
gctcccactgcagccctgagcc

SEQ ID NO: 7433954 - DNA, 22 bp, Homo sapiens
gctcccagaaccaaggctgggg

SEQ ID NO: 7433955 - DNA, 22 bp, Homo sapiens
gctcccagaaccaaggctgggg

SEQ ID NO: 7433956 - DNA, 22 bp, Homo sapiens
gctcccactgcagccctgagcc

SEQ ID NO: 7433957 - DNA, 22 bp, Homo sapiens
gctcccactgcagccctgagcc

SEQ ID NO: 7433958 - DNA, 22 bp, Homo sapiens
gctcccagaaccaaggctgggg

SEQ ID NO: 7433959 - DNA, 22 bp, Homo sapiens
gctcccagactgaccagaggtg

SEQ ID NO: 7433960 - DNA, 22 bp, Homo sapiens
gctcccagaaccaaggctgggg

SEQ ID NO: 7433961 - DNA, 22 bp, Homo sapiens
gctcccagaaccaaggctgggg

SEQ ID NO: 7433962 - DNA, 22 bp, Homo sapiens
gctcccagaaccaaggctgggg

SEQ ID NO: 7433963 - DNA, 22 bp, Homo sapiens
gctcccagaaccaaggctgggg

SEQ ID NO: 7433964 - DNA, 22 bp, Homo sapiens
gctcccagaaccaaggctgggg

SEQ ID NO: 7433965 - DNA, 22 bp, Homo sapiens
gctcccagaaccaaggctgggg

SEQ ID NO: 7433966 - DNA, 22 bp, Homo sapiens
gctcccagaaccaaggctgggg

SEQ ID NO: 7433967 - DNA, 22 bp, Homo sapiens
gctcccacaaccttcttgctcc

SEQ ID NO: 7433968 - DNA, 22 bp, Homo sapiens
gctcccacaaccttcttgctcc

SEQ ID NO: 7433969 - DNA, 22 bp, Homo sapiens
gctcccaccaggcagacctacc

SEQ ID NO: 7433970 - DNA, 22 bp, Homo sapiens
gctcccaccaggcagacctacc

SEQ ID NO: 7433971 - DNA, 22 bp, Homo sapiens
gctcccaccaggcagacctacc

SEQ ID NO: 7433972 - DNA, 22 bp, Homo sapiens
gctcccaccaggcagacctacc

SEQ ID NO: 7433973 - DNA, 22 bp, Homo sapiens
gctcccacctccagcctgagtt

SEQ ID NO: 7433974 - DNA, 22 bp, Homo sapiens
gctcccaccgccgctatgggta

SEQ ID NO: 7433975 - DNA, 22 bp, Homo sapiens
gctcccaccgccgctatgggta

SEQ ID NO: 7433976 - DNA, 22 bp, Homo sapiens
gctcccacctccagcctgagtt

SEQ ID NO: 7433977 - DNA, 22 bp, Homo sapiens
gctcccacctccagcctgagtt

SEQ ID NO: 7433978 - DNA, 22 bp, Homo sapiens
gctcccacctccagcctgagtt

SEQ ID NO: 7433979 - DNA, 22 bp, Homo sapiens
gctcccaccttaaccttcacat

SEQ ID NO: 7433980 - DNA, 22 bp, Homo sapiens
gctcccaccttaaccttcacat

SEQ ID NO: 7433981 - DNA, 22 bp, Homo sapiens
gctcccaccttaaccttcacat

SEQ ID NO: 7433982 - DNA, 22 bp, Homo sapiens
gctcccacctttgctatcagta

SEQ ID NO: 7433983 - DNA, 22 bp, Homo sapiens
gctccaggtatttgccctttta

SEQ ID NO: 7433984 - DNA, 22 bp, Homo sapiens
gctccaggtatttgccctttta

SEQ ID NO: 7433985 - DNA, 22 bp, Homo sapiens
gctccaggtatttgccctttta

SEQ ID NO: 7433986 - DNA, 20 bp, Homo sapiens
gctccaggtcagagaggacg

SEQ ID NO: 7433987 - DNA, 20 bp, Homo sapiens
gctccaggtcagagaggacg

SEQ ID NO: 7433988 - DNA, 20 bp, Homo sapiens
gctccaggtcagagaggacg

SEQ ID NO: 7433989 - DNA, 20 bp, Homo sapiens
gctccaggtcagagaggacg

SEQ ID NO: 7433990 - DNA, 20 bp, Homo sapiens
gctccaggtcagagaggacg

SEQ ID NO: 7433991 - DNA, 20 bp, Homo sapiens
gctccaggtcagagaggacg

SEQ ID NO: 7433992 - DNA, 22 bp, Homo sapiens
gctccaggtgaatcctctcacc

SEQ ID NO: 7433993 - DNA, 22 bp, Homo sapiens
gctccaggtgaatcctctcacc

SEQ ID NO: 7433994 - DNA, 22 bp, Homo sapiens
gctccaggtgaatcctctcacc

SEQ ID NO: 7433995 - DNA, 22 bp, Homo sapiens
gctccaggtgaatcctctcacc

SEQ ID NO: 7433996 - DNA, 22 bp, Homo sapiens
gctccaggtgaatcctctcacc

SEQ ID NO: 7433997 - DNA, 20 bp, Homo sapiens
gctccaggtcagagaggacg

SEQ ID NO: 7433998 - DNA, 22 bp, Homo sapiens
gctccaggtggcttatttgtat

SEQ ID NO: 7433999 - DNA, 22 bp, Homo sapiens
gctccaggtggcttatttgtat

SEQ ID NO: 7434000 - DNA, 22 bp, Homo sapiens
gctccaggtgtcccaggtaaaa

SEQ ID NO: 7434001 - DNA, 22 bp, Homo sapiens
gctccaggtgtcccaggtaaaa

SEQ ID NO: 7434002 - DNA, 22 bp, Homo sapiens
gctccaggtgtcccaggtaaaa

SEQ ID NO: 7434003 - DNA, 22 bp, Homo sapiens
gctccaggtgtcccaggtaaaa

SEQ ID NO: 7434004 - DNA, 22 bp, Homo sapiens
gctcccaactcaggcctcctcc

SEQ ID NO: 7434005 - DNA, 22 bp, Homo sapiens
gctcccaactcaggcctcctcc

SEQ ID NO: 7434006 - DNA, 22 bp, Homo sapiens
gctcccaactcaggcctcctcc

SEQ ID NO: 7434007 - DNA, 22 bp, Homo sapiens
gctcccacaaccttcttgctcc

SEQ ID NO: 7434008 - DNA, 17 bp, Homo sapiens
gctccctgaggacagct

SEQ ID NO: 7434009 - DNA, 22 bp, Homo sapiens
gctccctgcactctgcagccct

SEQ ID NO: 7434010 - DNA, 22 bp, Homo sapiens
gctccctgcactctgcagccct

SEQ ID NO: 7434011 - DNA, 22 bp, Homo sapiens
gctccctgcactctgcagccct

SEQ ID NO: 7434012 - DNA, 22 bp, Homo sapiens
gctccctgcactctgcagccct

SEQ ID NO: 7434013 - DNA, 17 bp, Homo sapiens
gctccctgaggacagct

SEQ ID NO: 7434014 - DNA, 17 bp, Homo sapiens
gctccctgaggacagct

SEQ ID NO: 7434015 - DNA, 22 bp, Homo sapiens
gctccctgactcagttcctgag

SEQ ID NO: 7434016 - DNA, 22 bp, Homo sapiens
gctccctgactcagttcctgag

SEQ ID NO: 7434017 - DNA, 17 bp, Homo sapiens
gctccctgaggacagct

SEQ ID NO: 7434018 - DNA, 17 bp, Homo sapiens
gctccctgaggacagct

SEQ ID NO: 7434019 - DNA, 17 bp, Homo sapiens
gctccctgaggacagct

SEQ ID NO: 7434020 - DNA, 17 bp, Homo sapiens
gctccctgaggacagct

SEQ ID NO: 7434021 - DNA, 17 bp, Homo sapiens
gctccctgaggacagct

SEQ ID NO: 7434022 - DNA, 22 bp, Homo sapiens
gctccctgactcagttcctgag

SEQ ID NO: 7434023 - DNA, 22 bp, Homo sapiens
gctccctgactcagttcctgag

SEQ ID NO: 7434024 - DNA, 22 bp, Homo sapiens
gctccctgaaaagaacaaagtc

SEQ ID NO: 7434025 - DNA, 22 bp, Homo sapiens
gctccctgactcagttcctgag

SEQ ID NO: 7434026 - DNA, 22 bp, Homo sapiens
gctccctgaagagatttggtct

SEQ ID NO: 7434027 - DNA, 22 bp, Homo sapiens
gctccctgactcagttcctgag

SEQ ID NO: 7434028 - DNA, 22 bp, Homo sapiens
gctccctgactcagttcctgag

SEQ ID NO: 7434029 - DNA, 22 bp, Homo sapiens
gctccctgactcagttcctgag

SEQ ID NO: 7434030 - DNA, 22 bp, Homo sapiens
gctccctgcagctgagagttcc

SEQ ID NO: 7434031 - DNA, 22 bp, Homo sapiens
gctccctgcagctgagagttcc

SEQ ID NO: 7434032 - DNA, 22 bp, Homo sapiens
gctccctgcactctgcagccct

SEQ ID NO: 7434033 - DNA, 22 bp, Homo sapiens
gctccctgcactctgcagccct

SEQ ID NO: 7434034 - DNA, 22 bp, Homo sapiens
gctccctgcatttcccaccctt

SEQ ID NO: 7434035 - DNA, 22 bp, Homo sapiens
gctccctgcatttcccaccctt

SEQ ID NO: 7434036 - DNA, 22 bp, Homo sapiens
gctccctgcagctgagagttcc

SEQ ID NO: 7434037 - DNA, 22 bp, Homo sapiens
gctccctgcagctgagagttcc

SEQ ID NO: 7434038 - DNA, 22 bp, Homo sapiens
gctccctgcagctgagagttcc

SEQ ID NO: 7434039 - DNA, 22 bp, Homo sapiens
gctccctgcctacacggacctt

SEQ ID NO: 7434040 - DNA, 22 bp, Homo sapiens
gctccctgcctacacggacctt

SEQ ID NO: 7434041 - DNA, 21 bp, Homo sapiens
gctccctgctcagctcctggg

SEQ ID NO: 7434042 - DNA, 21 bp, Homo sapiens
gctccctgctcagctcctggg

SEQ ID NO: 7434043 - DNA, 21 bp, Homo sapiens
gctccctgctcagctcctggg

SEQ ID NO: 7434044 - DNA, 21 bp, Homo sapiens
gctccctgctcagctcctggg

SEQ ID NO: 7434045 - DNA, 21 bp, Homo sapiens
gctccctgctcagctcctggg

SEQ ID NO: 7434046 - DNA, 21 bp, Homo sapiens
gctccctgctcagctcctggg

SEQ ID NO: 7434047 - DNA, 21 bp, Homo sapiens
gctccctgctcagctcctggg

SEQ ID NO: 7434048 - DNA, 22 bp, Homo sapiens
gctccctgtctctggggtccat

SEQ ID NO: 7434049 - DNA, 22 bp, Homo sapiens
gctccctgtctctggggtccat

SEQ ID NO: 7434050 - DNA, 23 bp, Homo sapiens
gctccctgtccctgcacttaggc

SEQ ID NO: 7434051 - DNA, 23 bp, Homo sapiens
gctccctgtccctgcacttaggc

SEQ ID NO: 7434052 - DNA, 23 bp, Homo sapiens
gctccctgtccctgcacttaggc

SEQ ID NO: 7434053 - DNA, 23 bp, Homo sapiens
gctccctgtccctgcacttaggc

SEQ ID NO: 7434054 - DNA, 23 bp, Homo sapiens
gctccctgtgctccaggagatgc

SEQ ID NO: 7434055 - DNA, 23 bp, Homo sapiens
gctccctgtgctccaggagatgc

SEQ ID NO: 7434056 - DNA, 23 bp, Homo sapiens
gctccctgtgctccaggagatgc

SEQ ID NO: 7434057 - DNA, 23 bp, Homo sapiens
gctccctgtgctccaggagatgc

SEQ ID NO: 7434058 - DNA, 23 bp, Homo sapiens
gctccctgtgctccaggagatgc

SEQ ID NO: 7434059 - DNA, 22 bp, Homo sapiens
gctccctggtagccatgctctc

SEQ ID NO: 7434060 - DNA, 22 bp, Homo sapiens
gctccctggtagccatgctctc

SEQ ID NO: 7434061 - DNA, 22 bp, Homo sapiens
gctccctggtagccatgctctc

SEQ ID NO: 7434062 - DNA, 22 bp, Homo sapiens
gctccctggtattgctgccact

SEQ ID NO: 7434063 - DNA, 22 bp, Homo sapiens
gctccctggtattgctgccact

SEQ ID NO: 7434064 - DNA, 22 bp, Homo sapiens
gctccctggtattgctgccact

SEQ ID NO: 7434065 - DNA, 22 bp, Homo sapiens
gctccctggtattgctgccact

SEQ ID NO: 7434066 - DNA, 21 bp, Homo sapiens
gctccctgctcagctcctggg

SEQ ID NO: 7434067 - DNA, 22 bp, Homo sapiens
gctccctgctccttcaccgacc

SEQ ID NO: 7434068 - DNA, 22 bp, Homo sapiens
gctccctgctccttcaccgacc

SEQ ID NO: 7434069 - DNA, 22 bp, Homo sapiens
gctccctggaatgttggctgcc

SEQ ID NO: 7434070 - DNA, 22 bp, Homo sapiens
gctccctggaatgttggctgcc

SEQ ID NO: 7434071 - DNA, 22 bp, Homo sapiens
gctccctggaatgttggctgcc

SEQ ID NO: 7434072 - DNA, 22 bp, Homo sapiens
gctccctggaatgttggctgcc

SEQ ID NO: 7434073 - DNA, 21 bp, Homo sapiens
gctccctggctgtgtgacctg

SEQ ID NO: 7434074 - DNA, 21 bp, Homo sapiens
gctccctggctgtgtgacctg

SEQ ID NO: 7434075 - DNA, 18 bp, Homo sapiens
gctccctggatgttactc

SEQ ID NO: 7434076 - DNA, 18 bp, Homo sapiens
gctccctggatgttactc

SEQ ID NO: 7434077 - DNA, 22 bp, Homo sapiens
gctccctggaggatgtgaactt

SEQ ID NO: 7434078 - DNA, 22 bp, Homo sapiens
gctccctggaggatgtgaactt

SEQ ID NO: 7434079 - DNA, 22 bp, Homo sapiens
gctccctggaatgttggctgcc

SEQ ID NO: 7434080 - DNA, 22 bp, Homo sapiens
gctccctggaatgttggctgcc

SEQ ID NO: 7434081 - DNA, 22 bp, Homo sapiens
gctccctggtagccatgctctc

SEQ ID NO: 7434082 - DNA, 20 bp, Homo sapiens
gctccctggtagaaatgttt

SEQ ID NO: 7434083 - DNA, 20 bp, Homo sapiens
gctccctggtagaaatgttt

SEQ ID NO: 7434084 - DNA, 22 bp, Homo sapiens
gctccctggtagccatgctctc

SEQ ID NO: 7434085 - DNA, 22 bp, Homo sapiens
gctccctggtagccatgctctc

SEQ ID NO: 7434086 - DNA, 22 bp, Homo sapiens
gctccctggcttttacagtgta

SEQ ID NO: 7434087 - DNA, 22 bp, Homo sapiens
gctccctggcttttacagtgta

SEQ ID NO: 7434088 - DNA, 22 bp, Homo sapiens
gctccctggcttttacagtgta

SEQ ID NO: 7434089 - DNA, 22 bp, Homo sapiens
gctccctggcttttacagtgta

SEQ ID NO: 7434090 - DNA, 22 bp, Homo sapiens
gctccctggcttttacagtgta

SEQ ID NO: 7434091 - DNA, 22 bp, Homo sapiens
gctccctggcttttacagtgta

SEQ ID NO: 7434092 - DNA, 22 bp, Homo sapiens
gctccctggcttttacagtgta

SEQ ID NO: 7434093 - DNA, 22 bp, Homo sapiens
ggagagaactggctccttctag

SEQ ID NO: 7434094 - DNA, 22 bp, Homo sapiens
ggagagaactgacctgaaagga

SEQ ID NO: 7434095 - DNA, 22 bp, Homo sapiens
ggagagaactggctccttctag

SEQ ID NO: 7434096 - DNA, 22 bp, Homo sapiens
ggagagaactgacctgaaagga

SEQ ID NO: 7434097 - DNA, 22 bp, Homo sapiens
ggagagaactgacctgaaagga

SEQ ID NO: 7434098 - DNA, 22 bp, Homo sapiens
ggagagaatctgaacctgctcc

SEQ ID NO: 7434099 - DNA, 22 bp, Homo sapiens
ggagagaatctgaacctgctcc

SEQ ID NO: 7434100 - DNA, 22 bp, Homo sapiens
ggagagaatctgaacctgctcc

SEQ ID NO: 7434101 - DNA, 22 bp, Homo sapiens
ggagagaactggctccttctag

SEQ ID NO: 7434102 - DNA, 22 bp, Homo sapiens
ggagagaactggctccttctag

SEQ ID NO: 7434103 - DNA, 22 bp, Homo sapiens
ggagagaactggctccttctag

SEQ ID NO: 7434104 - DNA, 22 bp, Homo sapiens
ggagagaagggagaatttgttc

SEQ ID NO: 7434105 - DNA, 22 bp, Homo sapiens
ggagagaattccatggacatgt

SEQ ID NO: 7434106 - DNA, 22 bp, Homo sapiens
ggagagaattccatggacatgt

SEQ ID NO: 7434107 - DNA, 22 bp, Homo sapiens
ggagagaattccatggacatgt

SEQ ID NO: 7434108 - DNA, 22 bp, Homo sapiens
ggagagaattcagcttaagatt

SEQ ID NO: 7434109 - DNA, 22 bp, Homo sapiens
ggagagaattccatggacatgt

SEQ ID NO: 7434110 - DNA, 22 bp, Homo sapiens
ggagagaatctgaacctgctcc

SEQ ID NO: 7434111 - DNA, 22 bp, Homo sapiens
ggagagaaattgaggtagcaag

SEQ ID NO: 7434112 - DNA, 22 bp, Homo sapiens
ggagagaaattgaggtagcaag

SEQ ID NO: 7434113 - DNA, 22 bp, Homo sapiens
ggagagaaattgaggtagcaag

SEQ ID NO: 7434114 - DNA, 22 bp, Homo sapiens
ggagacttgagtttttgtctta

SEQ ID NO: 7434115 - DNA, 22 bp, Homo sapiens
ggagactgatctgagtgataac

SEQ ID NO: 7434116 - DNA, 22 bp, Homo sapiens
ggagagaaattgaggtagcaag

SEQ ID NO: 7434117 - DNA, 22 bp, Homo sapiens
ggagagaaattgaggtagcaag

SEQ ID NO: 7434118 - DNA, 22 bp, Homo sapiens
ggagagaaattgaggtagcaag

SEQ ID NO: 7434119 - DNA, 22 bp, Homo sapiens
ggagagaaattgaggtagcaag

SEQ ID NO: 7434120 - DNA, 22 bp, Homo sapiens
ggagagaactgacctgaaagga

SEQ ID NO: 7434121 - DNA, 22 bp, Homo sapiens
ggagagaactgacctgaaagga

SEQ ID NO: 7434122 - DNA, 22 bp, Homo sapiens
ggagagaactgacctgaaagga

SEQ ID NO: 7434123 - DNA, 22 bp, Homo sapiens
ggagagaactgacctgaaagga

SEQ ID NO: 7434124 - DNA, 22 bp, Homo sapiens
ggagagaactgacctgaaagga

SEQ ID NO: 7434125 - DNA, 22 bp, Homo sapiens
ggagagaaattgaggtagcaag

SEQ ID NO: 7434126 - DNA, 22 bp, Homo sapiens
ggagagaaattgaggtagcaag

SEQ ID NO: 7434127 - DNA, 22 bp, Homo sapiens
ggagagaaattgaggtagcaag

SEQ ID NO: 7434128 - DNA, 22 bp, Homo sapiens
ggagacagtgacttagagactg

SEQ ID NO: 7434129 - DNA, 22 bp, Homo sapiens
ggagacagtgacttagagactg

SEQ ID NO: 7434130 - DNA, 22 bp, Homo sapiens
ggagacagtgacttagagactg

SEQ ID NO: 7434131 - DNA, 22 bp, Homo sapiens
ggagacagtgacttagagactg

SEQ ID NO: 7434132 - DNA, 22 bp, Homo sapiens
ggagacagtgacttagagactg

SEQ ID NO: 7434133 - DNA, 22 bp, Homo sapiens
ggagacagtggtagggcctaag

SEQ ID NO: 7434134 - DNA, 22 bp, Homo sapiens
ggagacagtggtagggcctaag

SEQ ID NO: 7434135 - DNA, 22 bp, Homo sapiens
ggagacagtggtagggcctaag

SEQ ID NO: 7434136 - DNA, 22 bp, Homo sapiens
ggagacagtggtagggcctaag

SEQ ID NO: 7434137 - DNA, 22 bp, Homo sapiens
ggagacagtggtagggcctaag

SEQ ID NO: 7434138 - DNA, 22 bp, Homo sapiens
ggagacagtggtagggcctaag

SEQ ID NO: 7434139 - DNA, 22 bp, Homo sapiens
ggagacagtggtagggcctaag

SEQ ID NO: 7434140 - DNA, 22 bp, Homo sapiens
ggagacagtggtagggcctaag

SEQ ID NO: 7434141 - DNA, 22 bp, Homo sapiens
ggagacagtggtagggcctaag

SEQ ID NO: 7434142 - DNA, 22 bp, Homo sapiens
ggagacatcatgtaggtttctt

SEQ ID NO: 7434143 - DNA, 22 bp, Homo sapiens
ggagacatgcagactgagatac

SEQ ID NO: 7434144 - DNA, 22 bp, Homo sapiens
ggagaccaggtcagagatggtg

SEQ ID NO: 7434145 - DNA, 22 bp, Homo sapiens
ggagaccagaaggaagcttcga

SEQ ID NO: 7434146 - DNA, 22 bp, Homo sapiens
ggagacccaggttaggaagtaa

SEQ ID NO: 7434147 - DNA, 22 bp, Homo sapiens
ggagacatcatgtaggtttctt

SEQ ID NO: 7434148 - DNA, 22 bp, Homo sapiens
ggagaccagaaggaagcttcga

SEQ ID NO: 7434149 - DNA, 22 bp, Homo sapiens
ggagaccttaaggtgcttccta

SEQ ID NO: 7434150 - DNA, 18 bp, Homo sapiens
ggagactaaactgttgac

SEQ ID NO: 7434151 - DNA, 22 bp, Homo sapiens
ggagaccaggtcagagatggtg

SEQ ID NO: 7434152 - DNA, 19 bp, Homo sapiens
ggagactcagcccatgcct

SEQ ID NO: 7434153 - DNA, 22 bp, Homo sapiens
ggagactacctagcaggctgtt

SEQ ID NO: 7434154 - DNA, 22 bp, Homo sapiens
ggagactacctagcaggctgtt

SEQ ID NO: 7434155 - DNA, 22 bp, Homo sapiens
ggagactgatctgagtgataac

SEQ ID NO: 7434156 - DNA, 19 bp, Homo sapiens
ggagactcagcccatgcct

SEQ ID NO: 7434157 - DNA, 22 bp, Homo sapiens
ggagactcgggttctagccttg

SEQ ID NO: 7434158 - DNA, 22 bp, Homo sapiens
ggagcatgtggggtgagcaggg

SEQ ID NO: 7434159 - DNA, 22 bp, Homo sapiens
ggagcatgtggggtgagcaggg

SEQ ID NO: 7434160 - DNA, 22 bp, Homo sapiens
ggagccagaaatgctgtggttg

SEQ ID NO: 7434161 - DNA, 22 bp, Homo sapiens
ggagccagaaatgctgtggttg

SEQ ID NO: 7434162 - DNA, 22 bp, Homo sapiens
ggagccagaaatgctgtggttg

SEQ ID NO: 7434163 - DNA, 22 bp, Homo sapiens
ggagcatgtggggtgagcaggg

SEQ ID NO: 7434164 - DNA, 22 bp, Homo sapiens
ggagcatgtggggtgagcaggg

SEQ ID NO: 7434165 - DNA, 22 bp, Homo sapiens
ggagcatgtggggtgagcaggg

SEQ ID NO: 7434166 - DNA, 22 bp, Homo sapiens
ggagcatgtggggtgagcaggg

SEQ ID NO: 7434167 - DNA, 22 bp, Homo sapiens
ggagcatgggtcagaactcagt

SEQ ID NO: 7434168 - DNA, 22 bp, Homo sapiens
ggagccagagcactggggagcc

SEQ ID NO: 7434169 - DNA, 22 bp, Homo sapiens
ggagccagagcactggggagcc

SEQ ID NO: 7434170 - DNA, 22 bp, Homo sapiens
ggagccagagcactggggagcc

SEQ ID NO: 7434171 - DNA, 22 bp, Homo sapiens
ggagccagagcactggggagcc

SEQ ID NO: 7434172 - DNA, 22 bp, Homo sapiens
ggagccagagcactggggagcc

SEQ ID NO: 7434173 - DNA, 22 bp, Homo sapiens
ggagccagaaatgctgtggttg

SEQ ID NO: 7434174 - DNA, 22 bp, Homo sapiens
ggagccagaaatgctgtggttg

SEQ ID NO: 7434175 - DNA, 22 bp, Homo sapiens
ggagccagaaatgctgtggttg

SEQ ID NO: 7434176 - DNA, 22 bp, Homo sapiens
ggagccagaaatgctgtggttg

SEQ ID NO: 7434177 - DNA, 22 bp, Homo sapiens
ggagcagttgttgagcaagcca

SEQ ID NO: 7434178 - DNA, 22 bp, Homo sapiens
ggagcagtggtcattcagctgg

SEQ ID NO: 7434179 - DNA, 22 bp, Homo sapiens
ggagcagttgttgagcaagcca

SEQ ID NO: 7434180 - DNA, 22 bp, Homo sapiens
ggagcagtctggtgatactcag

SEQ ID NO: 7434181 - DNA, 22 bp, Homo sapiens
ggagcagtgagggatcatgggc

SEQ ID NO: 7434182 - DNA, 22 bp, Homo sapiens
ggagcagtgagggatcatgggc

SEQ ID NO: 7434183 - DNA, 22 bp, Homo sapiens
ggagcagtctggtgatactcag

SEQ ID NO: 7434184 - DNA, 22 bp, Homo sapiens
ggagcatctgaacagggagaag

SEQ ID NO: 7434185 - DNA, 22 bp, Homo sapiens
ggagcatctgaacagggagaag

SEQ ID NO: 7434186 - DNA, 22 bp, Homo sapiens
ggagcatgcgctctgtgaccga

SEQ ID NO: 7434187 - DNA, 22 bp, Homo sapiens
ggagcatgcgctctgtgaccga

SEQ ID NO: 7434188 - DNA, 22 bp, Homo sapiens
ggagcagggaattacagcgcag

SEQ ID NO: 7434189 - DNA, 22 bp, Homo sapiens
ggagcagggaattacagcgcag

SEQ ID NO: 7434190 - DNA, 22 bp, Homo sapiens
ggagcagggcagtgaattctgg

SEQ ID NO: 7434191 - DNA, 22 bp, Homo sapiens
ggagcagggcagtgaattctgg

SEQ ID NO: 7434192 - DNA, 22 bp, Homo sapiens
ggagcagtctaaatgataagag

SEQ ID NO: 7434193 - DNA, 22 bp, Homo sapiens
ggagcagtctaaatgataagag

SEQ ID NO: 7434194 - DNA, 22 bp, Homo sapiens
ggagcagggcagtgaattctgg

SEQ ID NO: 7434195 - DNA, 22 bp, Homo sapiens
ggagagagagattgtgtttatt

SEQ ID NO: 7434196 - DNA, 22 bp, Homo sapiens
ggagagagagctcattagctgc

SEQ ID NO: 7434197 - DNA, 22 bp, Homo sapiens
ggagagagagctcattagctgc

SEQ ID NO: 7434198 - DNA, 22 bp, Homo sapiens
ggagagagagctcattagctgc

SEQ ID NO: 7434199 - DNA, 22 bp, Homo sapiens
ggagagagagctcattagctgc

SEQ ID NO: 7434200 - DNA, 22 bp, Homo sapiens
ggagagagacctccatgcccag

SEQ ID NO: 7434201 - DNA, 22 bp, Homo sapiens
ggagagagacctccatgcccag

SEQ ID NO: 7434202 - DNA, 22 bp, Homo sapiens
ggagagagacctccatgcccag

SEQ ID NO: 7434203 - DNA, 22 bp, Homo sapiens
ggagagagacctccatgcccag

SEQ ID NO: 7434204 - DNA, 22 bp, Homo sapiens
ggagagagacctccatgcccag

SEQ ID NO: 7434205 - DNA, 22 bp, Homo sapiens
ggagagagacctccatgcccag

SEQ ID NO: 7434206 - DNA, 22 bp, Homo sapiens
ggagagaattccatggacatgt

SEQ ID NO: 7434207 - DNA, 22 bp, Homo sapiens
ggagagaccctggagaaggtcc

SEQ ID NO: 7434208 - DNA, 22 bp, Homo sapiens
ggagagaccctggagaaggtcc

SEQ ID NO: 7434209 - DNA, 22 bp, Homo sapiens
ggagagaccctggagaaggtcc

SEQ ID NO: 7434210 - DNA, 22 bp, Homo sapiens
ggagagaccctggagaaggtcc

SEQ ID NO: 7434211 - DNA, 22 bp, Homo sapiens
ggagcagggaattacagcgcag

SEQ ID NO: 7434212 - DNA, 22 bp, Homo sapiens
ggagcagggaattacagcgcag

SEQ ID NO: 7434213 - DNA, 22 bp, Homo sapiens
ggagcagggaattacagcgcag

SEQ ID NO: 7434214 - DNA, 22 bp, Homo sapiens
ggagcagggaattacagcgcag

SEQ ID NO: 7434215 - DNA, 22 bp, Homo sapiens
ggagcagggaattacagcgcag

SEQ ID NO: 7434216 - DNA, 22 bp, Homo sapiens
ggagcaggctctgtggtttcca

SEQ ID NO: 7434217 - DNA, 22 bp, Homo sapiens
ggagcagggaattacagcgcag

SEQ ID NO: 7434218 - DNA, 22 bp, Homo sapiens
ggagcaggctctgtggtttcca

SEQ ID NO: 7434219 - DNA, 22 bp, Homo sapiens
ggagcaggctctgtggtttcca

SEQ ID NO: 7434220 - DNA, 22 bp, Homo sapiens
ggagcaggctctgtggtttcca

SEQ ID NO: 7434221 - DNA, 22 bp, Homo sapiens
ggagcaggctctgtggtttcca

SEQ ID NO: 7434222 - DNA, 22 bp, Homo sapiens
ggagcagcactgccacacagag

SEQ ID NO: 7434223 - DNA, 22 bp, Homo sapiens
ggagcagcactgccacacagag

SEQ ID NO: 7434224 - DNA, 22 bp, Homo sapiens
ggagcagcactgccacacagag

SEQ ID NO: 7434225 - DNA, 22 bp, Homo sapiens
ggagcagcactgattagcggtt

SEQ ID NO: 7434226 - DNA, 22 bp, Homo sapiens
ggagcagcactgattagcggtt

SEQ ID NO: 7434227 - DNA, 22 bp, Homo sapiens
ggagcagatgtcttcatggcct

SEQ ID NO: 7434228 - DNA, 22 bp, Homo sapiens
ggagcagatgtcttcatggcct

SEQ ID NO: 7434229 - DNA, 22 bp, Homo sapiens
ggagcagcactgccacacagag

SEQ ID NO: 7434230 - DNA, 22 bp, Homo sapiens
ggagcagcactgccacacagag

SEQ ID NO: 7434231 - DNA, 22 bp, Homo sapiens
ggagcagcactgccacacagag

SEQ ID NO: 7434232 - DNA, 22 bp, Homo sapiens
ggagcagcactgccacacagag

SEQ ID NO: 7434233 - DNA, 22 bp, Homo sapiens
ggagcagcactgccacacagag

SEQ ID NO: 7434234 - DNA, 22 bp, Homo sapiens
ggacacaggcagctgggtgggt

SEQ ID NO: 7434235 - DNA, 22 bp, Homo sapiens
ggacacagctgcagccacaccc

SEQ ID NO: 7434236 - DNA, 22 bp, Homo sapiens
ggacacaggcagctgggtgggt

SEQ ID NO: 7434237 - DNA, 22 bp, Homo sapiens
ggacacaggcagctgggtgggt

SEQ ID NO: 7434238 - DNA, 22 bp, Homo sapiens
ggacacaggcagctgggtgggt

SEQ ID NO: 7434239 - DNA, 22 bp, Homo sapiens
ggacacaggcagctgggtgggt

SEQ ID NO: 7434240 - DNA, 22 bp, Homo sapiens
ggacacagctgcagccacaccc

SEQ ID NO: 7434241 - DNA, 22 bp, Homo sapiens
ggacacagctgcagccacaccc

SEQ ID NO: 7434242 - DNA, 22 bp, Homo sapiens
ggacacagctgcagccacaccc

SEQ ID NO: 7434243 - DNA, 22 bp, Homo sapiens
ggacacagctgcagccacaccc

SEQ ID NO: 7434244 - DNA, 22 bp, Homo sapiens
ggacacagctgcagccacaccc

SEQ ID NO: 7434245 - DNA, 22 bp, Homo sapiens
ggacacagggctcactctctct

SEQ ID NO: 7434246 - DNA, 22 bp, Homo sapiens
ggacacagggctcactctctct

SEQ ID NO: 7434247 - DNA, 22 bp, Homo sapiens
ggacacagggctcactctctct

SEQ ID NO: 7434248 - DNA, 23 bp, Homo sapiens
ggacacaggccttgtctgcgcct

SEQ ID NO: 7434249 - DNA, 23 bp, Homo sapiens
ggacacaggccttgtctgcgcct

SEQ ID NO: 7434250 - DNA, 23 bp, Homo sapiens
ggacacaggccttgtctgcgcct

SEQ ID NO: 7434251 - DNA, 23 bp, Homo sapiens
ggacacaggccttgtctgcgcct

SEQ ID NO: 7434252 - DNA, 23 bp, Homo sapiens
ggacacaggccttgtctgcgcct

SEQ ID NO: 7434253 - DNA, 23 bp, Homo sapiens
ggacacaggccttgtctgcgcct

SEQ ID NO: 7434254 - DNA, 22 bp, Homo sapiens
ggacagggttggggcatataaa

SEQ ID NO: 7434255 - DNA, 22 bp, Homo sapiens
ggacagggttggggcatataaa

SEQ ID NO: 7434256 - DNA, 22 bp, Homo sapiens
ggacagggtaagtactagtgtg

SEQ ID NO: 7434257 - DNA, 22 bp, Homo sapiens
ggacagggtaagtactagtgtg

SEQ ID NO: 7434258 - DNA, 22 bp, Homo sapiens
ggacagggtaagtactagtgtg

SEQ ID NO: 7434259 - DNA, 22 bp, Homo sapiens
ggacacaggtaaataccactga

SEQ ID NO: 7434260 - DNA, 22 bp, Homo sapiens
ggacacaggtaaataccactga

SEQ ID NO: 7434261 - DNA, 22 bp, Homo sapiens
ggacacagtggaagacagcttg

SEQ ID NO: 7434262 - DNA, 22 bp, Homo sapiens
ggacacagtggaagacagcttg

SEQ ID NO: 7434263 - DNA, 22 bp, Homo sapiens
ggacacagtggaagacagcttg

SEQ ID NO: 7434264 - DNA, 22 bp, Homo sapiens
ggacacagtggaagacagcttg

SEQ ID NO: 7434265 - DNA, 22 bp, Homo sapiens
ggacagggtaagtactagtgtg

SEQ ID NO: 7434266 - DNA, 22 bp, Homo sapiens
ggacagggtaagtactagtgtg

SEQ ID NO: 7434267 - DNA, 22 bp, Homo sapiens
ggacacagtggaagacagcttg

SEQ ID NO: 7434268 - DNA, 22 bp, Homo sapiens
ggacacaggtaaataccactga

SEQ ID NO: 7434269 - DNA, 22 bp, Homo sapiens
ggacaggtgtgaggctggcaca

SEQ ID NO: 7434270 - DNA, 22 bp, Homo sapiens
ggacaggtgtgaggctggcaca

SEQ ID NO: 7434271 - DNA, 22 bp, Homo sapiens
ggacaggtgcaaagggcacatg

SEQ ID NO: 7434272 - DNA, 22 bp, Homo sapiens
ggacaggtgactgcccagagtg

SEQ ID NO: 7434273 - DNA, 22 bp, Homo sapiens
ggacaggtgactgcccagagtg

SEQ ID NO: 7434274 - DNA, 22 bp, Homo sapiens
ggacaggtgactgcccagagtg

SEQ ID NO: 7434275 - DNA, 22 bp, Homo sapiens
ggacagggttggggcatataaa

SEQ ID NO: 7434276 - DNA, 22 bp, Homo sapiens
ggacaggtgcaaagggcacatg

SEQ ID NO: 7434277 - DNA, 22 bp, Homo sapiens
ggacaggttcagcagtttataa

SEQ ID NO: 7434278 - DNA, 22 bp, Homo sapiens
ggacaggttcagcagtttataa

SEQ ID NO: 7434279 - DNA, 21 bp, Homo sapiens
ggacagtagtagtcaggagag

SEQ ID NO: 7434280 - DNA, 22 bp, Homo sapiens
ggacagtacaaaaagtgtctaa

SEQ ID NO: 7434281 - DNA, 22 bp, Homo sapiens
ggacagtagtcactaaactaga

SEQ ID NO: 7434282 - DNA, 16 bp, Homo sapiens
ggacagtatgtcagga

SEQ ID NO: 7434283 - DNA, 22 bp, Homo sapiens
ggacagtattcattggagagaa

SEQ ID NO: 7434284 - DNA, 23 bp, Homo sapiens
ggacagtagtgtggtatttagaa

SEQ ID NO: 7434285 - DNA, 22 bp, Homo sapiens
ggacagtagtcactaaactaga

SEQ ID NO: 7434286 - DNA, 22 bp, Homo sapiens
ggacagtattctcttgaaataa

SEQ ID NO: 7434287 - DNA, 22 bp, Homo sapiens
ggacagtccacctcagtgaaga

SEQ ID NO: 7434288 - DNA, 22 bp, Homo sapiens
ggacagtgtgggccatctcact

SEQ ID NO: 7434289 - DNA, 22 bp, Homo sapiens
ggacagtgtctgcttcaggccc

SEQ ID NO: 7434290 - DNA, 22 bp, Homo sapiens
ggacagtggcctggtggtatag

SEQ ID NO: 7434291 - DNA, 19 bp, Homo sapiens
ggacatcactctaagcctt

SEQ ID NO: 7434292 - DNA, 22 bp, Homo sapiens
ggacatagaggccctgcatggc

SEQ ID NO: 7434293 - DNA, 22 bp, Homo sapiens
ggacagtgcgagacacagtaac

SEQ ID NO: 7434294 - DNA, 22 bp, Homo sapiens
ggacagtggcctggtggtatag

SEQ ID NO: 7434295 - DNA, 22 bp, Homo sapiens
ggacagtgtctgcttcaggccc

SEQ ID NO: 7434296 - DNA, 22 bp, Homo sapiens
ggacagtgtctgcttcaggccc

SEQ ID NO: 7434297 - DNA, 22 bp, Homo sapiens
ggacagtggcctggtggtatag

SEQ ID NO: 7434298 - DNA, 22 bp, Homo sapiens
ggacagtgcgagacacagtaac

SEQ ID NO: 7434299 - DNA, 22 bp, Homo sapiens
ggacagtgcgagacacagtaac

SEQ ID NO: 7434300 - DNA, 22 bp, Homo sapiens
ggacagtgaatgtggggatgca

SEQ ID NO: 7434301 - DNA, 22 bp, Homo sapiens
ggacagtgaatgtggggatgca

SEQ ID NO: 7434302 - DNA, 22 bp, Homo sapiens
ggacagtgaatgtggggatgca

SEQ ID NO: 7434303 - DNA, 22 bp, Homo sapiens
ggacagtgaatctggaggtata

SEQ ID NO: 7434304 - DNA, 22 bp, Homo sapiens
ggacagtgaatctggaggtata

SEQ ID NO: 7434305 - DNA, 22 bp, Homo sapiens
ggacagtgaatctggaggtata

SEQ ID NO: 7434306 - DNA, 22 bp, Homo sapiens
ggacagtctttcctcattcctt

SEQ ID NO: 7434307 - DNA, 19 bp, Homo sapiens
ggacagtctcagcctcatg

SEQ ID NO: 7434308 - DNA, 19 bp, Homo sapiens
ggacagtctcagcctcatg

SEQ ID NO: 7434309 - DNA, 20 bp, Homo sapiens
ggacagtgagacatatctca

SEQ ID NO: 7434310 - DNA, 20 bp, Homo sapiens
ggacagtgagacatatctca

SEQ ID NO: 7434311 - DNA, 20 bp, Homo sapiens
ggacagtgagacatatctca

SEQ ID NO: 7434312 - DNA, 22 bp, Homo sapiens
ggacagtgaatgtggggatgca

SEQ ID NO: 7434313 - DNA, 22 bp, Homo sapiens
ggacagtgaatgtggggatgca

SEQ ID NO: 7434314 - DNA, 22 bp, Homo sapiens
ggagacagtatggcttgtagct

SEQ ID NO: 7434315 - DNA, 22 bp, Homo sapiens
ggagacagggttgaaccacgca

SEQ ID NO: 7434316 - DNA, 22 bp, Homo sapiens
ggagacagggttgaaccacgca

SEQ ID NO: 7434317 - DNA, 22 bp, Homo sapiens
ggagacagggttgaaccacgca

SEQ ID NO: 7434318 - DNA, 22 bp, Homo sapiens
ggaccatctctagccagagctt

SEQ ID NO: 7434319 - DNA, 22 bp, Homo sapiens
ggaccatgaggagatgggcctc

SEQ ID NO: 7434320 - DNA, 22 bp, Homo sapiens
ggaccatgaggagatgggcctc

SEQ ID NO: 7434321 - DNA, 22 bp, Homo sapiens
ggaccatgttccctctgaagct

SEQ ID NO: 7434322 - DNA, 22 bp, Homo sapiens
ggacccaccaggccgggctcca

SEQ ID NO: 7434323 - DNA, 22 bp, Homo sapiens
ggagacagtatggcttgtagct

SEQ ID NO: 7434324 - DNA, 22 bp, Homo sapiens
ggagacagtatggcttgtagct

SEQ ID NO: 7434325 - DNA, 22 bp, Homo sapiens
ggagacagtatggcttgtagct

SEQ ID NO: 7434326 - DNA, 22 bp, Homo sapiens
ggagacagtatggcttgtagct

SEQ ID NO: 7434327 - DNA, 22 bp, Homo sapiens
ggagacagtatggcttgtagct

SEQ ID NO: 7434328 - DNA, 22 bp, Homo sapiens
ggagacagggttgaaccacgca

SEQ ID NO: 7434329 - DNA, 22 bp, Homo sapiens
ggagacagtatggcttgtagct

SEQ ID NO: 7434330 - DNA, 22 bp, Homo sapiens
ggagacagtgacttagagactg

SEQ ID NO: 7434331 - DNA, 22 bp, Homo sapiens
ggagacagtatggcttgtagct

SEQ ID NO: 7434332 - DNA, 22 bp, Homo sapiens
ggagacagtatggcttgtagct

SEQ ID NO: 7434333 - DNA, 19 bp, Homo sapiens
ggaccaggtcctgggcagc

SEQ ID NO: 7434334 - DNA, 19 bp, Homo sapiens
ggaccaggtcctgggcagc

SEQ ID NO: 7434335 - DNA, 19 bp, Homo sapiens
ggaccaggtcctgggcagc

SEQ ID NO: 7434336 - DNA, 17 bp, Homo sapiens
ggaccaggggttgccat

SEQ ID NO: 7434337 - DNA, 22 bp, Homo sapiens
ggaccaggctgagcacctgcct

SEQ ID NO: 7434338 - DNA, 22 bp, Homo sapiens
ggaccaggggcgcactccctgc

SEQ ID NO: 7434339 - DNA, 22 bp, Homo sapiens
ggaccaggggcgcactccctgc

SEQ ID NO: 7434340 - DNA, 19 bp, Homo sapiens
ggaccaggtcctgggcagc

SEQ ID NO: 7434341 - DNA, 19 bp, Homo sapiens
ggaccaggtcctgggcagc

SEQ ID NO: 7434342 - DNA, 19 bp, Homo sapiens
ggaccaggtcctgggcagc

SEQ ID NO: 7434343 - DNA, 20 bp, Homo sapiens
ggaccaggtggggcggtggc

SEQ ID NO: 7434344 - DNA, 19 bp, Homo sapiens
ggaccaggtcctgggcagc

SEQ ID NO: 7434345 - DNA, 20 bp, Homo sapiens
ggaccaggtggggcggtggc

SEQ ID NO: 7434346 - DNA, 22 bp, Homo sapiens
ggaccagtttcaaactgtacca

SEQ ID NO: 7434347 - DNA, 20 bp, Homo sapiens
ggaccaggtggggcggtggc

SEQ ID NO: 7434348 - DNA, 22 bp, Homo sapiens
ggaccagtttcaaactgtacca

SEQ ID NO: 7434349 - DNA, 22 bp, Homo sapiens
ggacatgattagcagggagagc

SEQ ID NO: 7434350 - DNA, 22 bp, Homo sapiens
ggacatgatatttcaggaagac

SEQ ID NO: 7434351 - DNA, 22 bp, Homo sapiens
ggacatggaaatcggcttgctc

SEQ ID NO: 7434352 - DNA, 20 bp, Homo sapiens
ggaccagctgtctgaggggc

SEQ ID NO: 7434353 - DNA, 20 bp, Homo sapiens
ggaccagctgtctgaggggc

SEQ ID NO: 7434354 - DNA, 20 bp, Homo sapiens
ggaccagctgtctgaggggc

SEQ ID NO: 7434355 - DNA, 22 bp, Homo sapiens
ggacatggaaatcggcttgctc

SEQ ID NO: 7434356 - DNA, 22 bp, Homo sapiens
ggacatgattagcagggagagc

SEQ ID NO: 7434357 - DNA, 22 bp, Homo sapiens
ggacatggaaatcggcttgctc

SEQ ID NO: 7434358 - DNA, 22 bp, Homo sapiens
ggacatgatatttcaggaagac

SEQ ID NO: 7434359 - DNA, 21 bp, Homo sapiens
ggacatgaggcaggagaggct

SEQ ID NO: 7434360 - DNA, 22 bp, Homo sapiens
ggacatcttccagctgcttgcc

SEQ ID NO: 7434361 - DNA, 22 bp, Homo sapiens
ggacatgaagcaaaatgggagg

SEQ ID NO: 7434362 - DNA, 22 bp, Homo sapiens
ggacatcttggttgcttccaag

SEQ ID NO: 7434363 - DNA, 22 bp, Homo sapiens
ggacatcttggttgcttccaag

SEQ ID NO: 7434364 - DNA, 22 bp, Homo sapiens
ggacatgaagcaaaatgggagg

SEQ ID NO: 7434365 - DNA, 22 bp, Homo sapiens
ggacatctgttgtggtagagga

SEQ ID NO: 7434366 - DNA, 22 bp, Homo sapiens
ggacatctgttgtggtagagga

SEQ ID NO: 7434367 - DNA, 22 bp, Homo sapiens
ggacatctgggccccaggtcta

SEQ ID NO: 7434368 - DNA, 22 bp, Homo sapiens
ggacatctgggccccaggtcta

SEQ ID NO: 7434369 - DNA, 22 bp, Homo sapiens
ggacatctcttgccagggctgc

SEQ ID NO: 7434370 - DNA, 22 bp, Homo sapiens
ggacatctcttgccagggctgc

SEQ ID NO: 7434371 - DNA, 22 bp, Homo sapiens
ggacatctcttgccagggctgc

SEQ ID NO: 7434372 - DNA, 19 bp, Homo sapiens
ggacatcactctaagcctt

SEQ ID NO: 7434373 - DNA, 18 bp, Homo sapiens
ggacatcatcaggtgctt

SEQ ID NO: 7434374 - DNA, 22 bp, Homo sapiens
ggaccaggccagcctccctgcg

SEQ ID NO: 7434375 - DNA, 22 bp, Homo sapiens
ggaccaggcaagctgaggcggg

SEQ ID NO: 7434376 - DNA, 22 bp, Homo sapiens
ggaccaggccagcctccctgcg

SEQ ID NO: 7434377 - DNA, 22 bp, Homo sapiens
ggaccaggccagcctccctgcg

SEQ ID NO: 7434378 - DNA, 22 bp, Homo sapiens
ggaccaggcaagctgaggcggg

SEQ ID NO: 7434379 - DNA, 22 bp, Homo sapiens
ggaccaggcaagctgaggcggg

SEQ ID NO: 7434380 - DNA, 22 bp, Homo sapiens
ggaccaggctgagcacctgcct

SEQ ID NO: 7434381 - DNA, 22 bp, Homo sapiens
ggaccaggccagcctccctgcg

SEQ ID NO: 7434382 - DNA, 22 bp, Homo sapiens
ggaccaggctgagcacctgcct

SEQ ID NO: 7434383 - DNA, 22 bp, Homo sapiens
ggaccaggctgagcacctgcct

SEQ ID NO: 7434384 - DNA, 22 bp, Homo sapiens
ggaccaggctgagcacctgcct

SEQ ID NO: 7434385 - DNA, 19 bp, Homo sapiens
ggaccagctttcaggaggc

SEQ ID NO: 7434386 - DNA, 19 bp, Homo sapiens
ggaccagctttcaggaggc

SEQ ID NO: 7434387 - DNA, 19 bp, Homo sapiens
ggaccagctttcaggaggc

SEQ ID NO: 7434388 - DNA, 22 bp, Homo sapiens
ggaccaggactggtggtatctc

SEQ ID NO: 7434389 - DNA, 22 bp, Homo sapiens
ggaccaggactggtggtatctc

SEQ ID NO: 7434390 - DNA, 22 bp, Homo sapiens
ggaccaggagctcagagccctc

SEQ ID NO: 7434391 - DNA, 22 bp, Homo sapiens
ggaccaggagctcagagccctc

SEQ ID NO: 7434392 - DNA, 22 bp, Homo sapiens
ggaccaggagctcagagccctc

SEQ ID NO: 7434393 - DNA, 22 bp, Homo sapiens
ggaccaggagctcagagccctc

SEQ ID NO: 7434394 - DNA, 22 bp, Homo sapiens
ggaccaggagctcagagccctc

SEQ ID NO: 7434395 - DNA, 22 bp, Homo sapiens
ggaccaggagctcagagccctc

SEQ ID NO: 7434396 - DNA, 22 bp, Homo sapiens
gctttggaacttaaatccttgg

SEQ ID NO: 7434397 - DNA, 22 bp, Homo sapiens
gctttggaaatatagactcaag

SEQ ID NO: 7434398 - DNA, 22 bp, Homo sapiens
gctttggaacttaaatccttgg

SEQ ID NO: 7434399 - DNA, 22 bp, Homo sapiens
gctttggaacttaaatccttgg

SEQ ID NO: 7434400 - DNA, 22 bp, Homo sapiens
gctttggaaggggctggtggag

SEQ ID NO: 7434401 - DNA, 22 bp, Homo sapiens
gctttggaaggggctggtggag

SEQ ID NO: 7434402 - DNA, 22 bp, Homo sapiens
gctttggaaataagaggctaaa

SEQ ID NO: 7434403 - DNA, 22 bp, Homo sapiens
gctttggaaataagaggctaaa

SEQ ID NO: 7434404 - DNA, 17 bp, Homo sapiens
gctttggaaagccttcc

SEQ ID NO: 7434405 - DNA, 17 bp, Homo sapiens
gctttggaaagccttcc

SEQ ID NO: 7434406 - DNA, 17 bp, Homo sapiens
gctttggaaagccttcc

SEQ ID NO: 7434407 - DNA, 22 bp, Homo sapiens
gctttggaaatatagactcaag

SEQ ID NO: 7434408 - DNA, 22 bp, Homo sapiens
gctttggaaatatagactcaag

SEQ ID NO: 7434409 - DNA, 22 bp, Homo sapiens
gctttggaaatatagactcaag

SEQ ID NO: 7434410 - DNA, 22 bp, Homo sapiens
gctttgcttcctgttctagcct

SEQ ID NO: 7434411 - DNA, 22 bp, Homo sapiens
gctttgctgggtgcttcatgta

SEQ ID NO: 7434412 - DNA, 22 bp, Homo sapiens
gctttgctggcttgaaatgctg

SEQ ID NO: 7434413 - DNA, 22 bp, Homo sapiens
gctttgctggcttgaaatgctg

SEQ ID NO: 7434414 - DNA, 22 bp, Homo sapiens
gctttgcttcctgttctagcct

SEQ ID NO: 7434415 - DNA, 22 bp, Homo sapiens
gctttgcttccttccccttcaa

SEQ ID NO: 7434416 - DNA, 22 bp, Homo sapiens
gctttgcttccttccccttcaa

SEQ ID NO: 7434417 - DNA, 22 bp, Homo sapiens
gctttggaaactggccctgcgc

SEQ ID NO: 7434418 - DNA, 22 bp, Homo sapiens
gctttggaaactggccctgcgc

SEQ ID NO: 7434419 - DNA, 22 bp, Homo sapiens
gctttggaaactggccctgcgc

SEQ ID NO: 7434420 - DNA, 20 bp, Homo sapiens
gctttctatgagatggactg

SEQ ID NO: 7434421 - DNA, 22 bp, Homo sapiens
gctttctcttcactgatgttca

SEQ ID NO: 7434422 - DNA, 22 bp, Homo sapiens
gctttctgaagcagtgtttctc

SEQ ID NO: 7434423 - DNA, 22 bp, Homo sapiens
gctttctgaagcagtgtttctc

SEQ ID NO: 7434424 - DNA, 22 bp, Homo sapiens
gctttctgatgagcttaagaaa

SEQ ID NO: 7434425 - DNA, 22 bp, Homo sapiens
gctttctgattgcgaaaacaaa

SEQ ID NO: 7434426 - DNA, 22 bp, Homo sapiens
gctttctgattgcgaaaacaaa

SEQ ID NO: 7434427 - DNA, 22 bp, Homo sapiens
gctttctgcctgggctccattt

SEQ ID NO: 7434428 - DNA, 22 bp, Homo sapiens
gctttgctatgactcaccagca

SEQ ID NO: 7434429 - DNA, 22 bp, Homo sapiens
gctttgctatgactcaccagca

SEQ ID NO: 7434430 - DNA, 22 bp, Homo sapiens
gctttgctgaggtctgaggatt

SEQ ID NO: 7434431 - DNA, 22 bp, Homo sapiens
gctttgctggcttgaaatgctg

SEQ ID NO: 7434432 - DNA, 22 bp, Homo sapiens
gctttattttgtgagggattac

SEQ ID NO: 7434433 - DNA, 22 bp, Homo sapiens
gctttattttgtgagggattac

SEQ ID NO: 7434434 - DNA, 22 bp, Homo sapiens
gctttattttgtgagggattac

SEQ ID NO: 7434435 - DNA, 22 bp, Homo sapiens
gctttattttgtgagggattac

SEQ ID NO: 7434436 - DNA, 22 bp, Homo sapiens
gctttattttgtgagggattac

SEQ ID NO: 7434437 - DNA, 22 bp, Homo sapiens
gctttattttgtgagggattac

SEQ ID NO: 7434438 - DNA, 22 bp, Homo sapiens
gctttattttgtgagggattac

SEQ ID NO: 7434439 - DNA, 22 bp, Homo sapiens
gctttcaaatcctaattccaac

SEQ ID NO: 7434440 - DNA, 22 bp, Homo sapiens
gctttattttgtgagggattac

SEQ ID NO: 7434441 - DNA, 22 bp, Homo sapiens
gctttattttgtgagggattac

SEQ ID NO: 7434442 - DNA, 20 bp, Homo sapiens
gctttcaagcttgtcattgt

SEQ ID NO: 7434443 - DNA, 20 bp, Homo sapiens
gctttcaagcttgtcattgt

SEQ ID NO: 7434444 - DNA, 20 bp, Homo sapiens
gctttcaagcttgtcattgt

SEQ ID NO: 7434445 - DNA, 22 bp, Homo sapiens
gctttcaaggaatttggtattt

SEQ ID NO: 7434446 - DNA, 22 bp, Homo sapiens
gctttcaaggaatttggtattt

SEQ ID NO: 7434447 - DNA, 22 bp, Homo sapiens
gctttcaattatgtcagcctgt

SEQ ID NO: 7434448 - DNA, 18 bp, Homo sapiens
gctttcaatttctttcct

SEQ ID NO: 7434449 - DNA, 18 bp, Homo sapiens
gctttcaatttctttcct

SEQ ID NO: 7434450 - DNA, 21 bp, Homo sapiens
gctttcagaagtctcatagtt

SEQ ID NO: 7434451 - DNA, 22 bp, Homo sapiens
gctttcagggtcactgtcaaca

SEQ ID NO: 7434452 - DNA, 22 bp, Homo sapiens
gctttcatgaaaataatctact

SEQ ID NO: 7434453 - DNA, 22 bp, Homo sapiens
gctttccctgccctcagaagga

SEQ ID NO: 7434454 - DNA, 22 bp, Homo sapiens
gctttcctggccctgtccctgc

SEQ ID NO: 7434455 - DNA, 22 bp, Homo sapiens
gctttcctggccctgtccctgc

SEQ ID NO: 7434456 - DNA, 22 bp, Homo sapiens
gctttcatgaaaataatctact

SEQ ID NO: 7434457 - DNA, 22 bp, Homo sapiens
gctttccctgccctcagaagga

SEQ ID NO: 7434458 - DNA, 22 bp, Homo sapiens
gctttctaggcagagatgactg

SEQ ID NO: 7434459 - DNA, 22 bp, Homo sapiens
gctttctaatctatttccttac

SEQ ID NO: 7434460 - DNA, 22 bp, Homo sapiens
gctttctacaccaagtatgtgc

SEQ ID NO: 7434461 - DNA, 22 bp, Homo sapiens
ggaagaggaggagccaggcttt

SEQ ID NO: 7434462 - DNA, 22 bp, Homo sapiens
ggaagacagaagcctacagctt

SEQ ID NO: 7434463 - DNA, 22 bp, Homo sapiens
ggaagacagaagcctacagctt

SEQ ID NO: 7434464 - DNA, 22 bp, Homo sapiens
ggaagaggaggagccaggcttt

SEQ ID NO: 7434465 - DNA, 22 bp, Homo sapiens
ggaagaggaggagccaggcttt

SEQ ID NO: 7434466 - DNA, 22 bp, Homo sapiens
ggaagaggaggagccaggcttt

SEQ ID NO: 7434467 - DNA, 22 bp, Homo sapiens
ggaagaggaggagccaggcttt

SEQ ID NO: 7434468 - DNA, 22 bp, Homo sapiens
ggaagacaagcagtggctgagc

SEQ ID NO: 7434469 - DNA, 22 bp, Homo sapiens
ggaagacaagcagtggctgagc

SEQ ID NO: 7434470 - DNA, 22 bp, Homo sapiens
ggaagacaagcagtggctgagc

SEQ ID NO: 7434471 - DNA, 22 bp, Homo sapiens
ggaagaagggtcattggcagcc

SEQ ID NO: 7434472 - DNA, 22 bp, Homo sapiens
ggaagaagggtcattggcagcc

SEQ ID NO: 7434473 - DNA, 22 bp, Homo sapiens
ggaagaagggtcattggcagcc

SEQ ID NO: 7434474 - DNA, 22 bp, Homo sapiens
ggaagacaagcagtggctgagc

SEQ ID NO: 7434475 - DNA, 22 bp, Homo sapiens
ggaagacaagcagtggctgagc

SEQ ID NO: 7434476 - DNA, 22 bp, Homo sapiens
ggaagacagaagcctacagctt

SEQ ID NO: 7434477 - DNA, 22 bp, Homo sapiens
ggaagacaagcagtggctgagc

SEQ ID NO: 7434478 - DNA, 17 bp, Homo sapiens
gctttggaagggtagac

SEQ ID NO: 7434479 - DNA, 17 bp, Homo sapiens
gctttggaagggtagac

SEQ ID NO: 7434480 - DNA, 22 bp, Homo sapiens
gctttggaaggggctggtggag

SEQ ID NO: 7434481 - DNA, 22 bp, Homo sapiens
gctttggaaggggctggtggag

SEQ ID NO: 7434482 - DNA, 22 bp, Homo sapiens
gctttggaaggggctggtggag

SEQ ID NO: 7434483 - DNA, 17 bp, Homo sapiens
gctttggaagggtagac

SEQ ID NO: 7434484 - DNA, 22 bp, Homo sapiens
gctttggaatctgcatcctctt

SEQ ID NO: 7434485 - DNA, 22 bp, Homo sapiens
gctttggaatctgcatcctctt

SEQ ID NO: 7434486 - DNA, 22 bp, Homo sapiens
gctttggaatgtgctgttatag

SEQ ID NO: 7434487 - DNA, 22 bp, Homo sapiens
gctttggacaataactgctttt

SEQ ID NO: 7434488 - DNA, 22 bp, Homo sapiens
gctttggacaataactgctttt

SEQ ID NO: 7434489 - DNA, 22 bp, Homo sapiens
gctttggagcctgtgttctgcc

SEQ ID NO: 7434490 - DNA, 22 bp, Homo sapiens
gctttggagcctgtgttctgcc

SEQ ID NO: 7434491 - DNA, 22 bp, Homo sapiens
ggaagaagcagggcatttgaat

SEQ ID NO: 7434492 - DNA, 22 bp, Homo sapiens
ggaagaagcagggcatttgaat

SEQ ID NO: 7434493 - DNA, 22 bp, Homo sapiens
ggaagaagcagggcatttgaat

SEQ ID NO: 7434494 - DNA, 22 bp, Homo sapiens
gctttggagtcagaaagaccta

SEQ ID NO: 7434495 - DNA, 22 bp, Homo sapiens
gctttggagtcagaaagaccta

SEQ ID NO: 7434496 - DNA, 22 bp, Homo sapiens
gctttggagttaggactcggcc

SEQ ID NO: 7434497 - DNA, 22 bp, Homo sapiens
gctttggagttaggactcggcc

SEQ ID NO: 7434498 - DNA, 22 bp, Homo sapiens
ggaagaacaggtttattttcct

SEQ ID NO: 7434499 - DNA, 19 bp, Homo sapiens
gctttggagggaggttcta

SEQ ID NO: 7434500 - DNA, 19 bp, Homo sapiens
gctttggagggaggttcta

SEQ ID NO: 7434501 - DNA, 22 bp, Homo sapiens
gctttggagggcaagagctgtt

SEQ ID NO: 7434502 - DNA, 22 bp, Homo sapiens
gctttggagggcaagagctgtt

SEQ ID NO: 7434503 - DNA, 22 bp, Homo sapiens
gctttggagggcaagagctgtt

SEQ ID NO: 7434504 - DNA, 22 bp, Homo sapiens
gctttggagtcagaaagaccta

SEQ ID NO: 7434505 - DNA, 22 bp, Homo sapiens
ggaagaggctgaggccatgctg

SEQ ID NO: 7434506 - DNA, 22 bp, Homo sapiens
ggaagaggctgaggccatgctg

SEQ ID NO: 7434507 - DNA, 22 bp, Homo sapiens
ggaagaggctgaggccatgctg

SEQ ID NO: 7434508 - DNA, 22 bp, Homo sapiens
ggaagaggctgaggccatgctg

SEQ ID NO: 7434509 - DNA, 22 bp, Homo sapiens
ggaagaggctggtagtgcccgt

SEQ ID NO: 7434510 - DNA, 22 bp, Homo sapiens
ggaagaggctgagccaggtccc

SEQ ID NO: 7434511 - DNA, 22 bp, Homo sapiens
ggaagaggctgaggccatgctg

SEQ ID NO: 7434512 - DNA, 22 bp, Homo sapiens
ggaagaggctgaggccatgctg

SEQ ID NO: 7434513 - DNA, 22 bp, Homo sapiens
ggaagaggctgaggccatgctg

SEQ ID NO: 7434514 - DNA, 22 bp, Homo sapiens
ggaagaggctgaggccatgctg

SEQ ID NO: 7434515 - DNA, 22 bp, Homo sapiens
ggaagaggctgaggccatgctg

SEQ ID NO: 7434516 - DNA, 22 bp, Homo sapiens
ggaagaggctgaggccatgctg

SEQ ID NO: 7434517 - DNA, 22 bp, Homo sapiens
ggaagaggctgaggccatgctg

SEQ ID NO: 7434518 - DNA, 22 bp, Homo sapiens
ggaagaggctgagccaggtccc

SEQ ID NO: 7434519 - DNA, 22 bp, Homo sapiens
ggaagaggctgagccaggtccc

SEQ ID NO: 7434520 - DNA, 22 bp, Homo sapiens
ggaagaggctgagccaggtccc

SEQ ID NO: 7434521 - DNA, 22 bp, Homo sapiens
ggaagaggctgagccaggtccc

SEQ ID NO: 7434522 - DNA, 22 bp, Homo sapiens
ggaagaggctctcattgagggc

SEQ ID NO: 7434523 - DNA, 22 bp, Homo sapiens
ggaagaggctctcattgagggc

SEQ ID NO: 7434524 - DNA, 22 bp, Homo sapiens
ggaagaggctctcattgagggc

SEQ ID NO: 7434525 - DNA, 22 bp, Homo sapiens
ggaagaggaggagccaggcttt

SEQ ID NO: 7434526 - DNA, 22 bp, Homo sapiens
ggaagaggctctcattgagggc

SEQ ID NO: 7434527 - DNA, 22 bp, Homo sapiens
ggaagaggctctcattgagggc

SEQ ID NO: 7434528 - DNA, 22 bp, Homo sapiens
ggaagaggctctcattgagggc

SEQ ID NO: 7434529 - DNA, 22 bp, Homo sapiens
ggaagaggctctcattgagggc

SEQ ID NO: 7434530 - DNA, 22 bp, Homo sapiens
ggaagaggctctcattgagggc

SEQ ID NO: 7434531 - DNA, 22 bp, Homo sapiens
ggaagaggctctcattgagggc

SEQ ID NO: 7434532 - DNA, 22 bp, Homo sapiens
ggaagaggctctcattgagggc

SEQ ID NO: 7434533 - DNA, 22 bp, Homo sapiens
ggaagaggctctcattgagggc

SEQ ID NO: 7434534 - DNA, 22 bp, Homo sapiens
ggaagaggctgagccaggtccc

SEQ ID NO: 7434535 - DNA, 22 bp, Homo sapiens
ggaagaggctgagccaggtccc

SEQ ID NO: 7434536 - DNA, 22 bp, Homo sapiens
ggaagaggctgagccaggtccc

SEQ ID NO: 7434537 - DNA, 22 bp, Homo sapiens
ggaagaggctgagccaggtccc

SEQ ID NO: 7434538 - DNA, 22 bp, Homo sapiens
ggaagaggctgagccaggtccc

SEQ ID NO: 7434539 - DNA, 22 bp, Homo sapiens
ggaagaggctctcattgagggc

SEQ ID NO: 7434540 - DNA, 22 bp, Homo sapiens
ggaagaggctctcattgagggc

SEQ ID NO: 7434541 - DNA, 22 bp, Homo sapiens
ggaagaggctggtagtgcccgt

SEQ ID NO: 7434542 - DNA, 22 bp, Homo sapiens
ggaagaggctggtagtgcccgt

SEQ ID NO: 7434543 - DNA, 22 bp, Homo sapiens
ggaagaggctggtagtgcccgt

SEQ ID NO: 7434544 - DNA, 22 bp, Homo sapiens
ggaagaggctggtagtgcccgt

SEQ ID NO: 7434545 - DNA, 22 bp, Homo sapiens
ggaagaggctggtagtgcccgt

SEQ ID NO: 7434546 - DNA, 22 bp, Homo sapiens
ggaagaggctggtagtgcccgt

SEQ ID NO: 7434547 - DNA, 22 bp, Homo sapiens
ggaagaggctggtagtgcccgt

SEQ ID NO: 7434548 - DNA, 22 bp, Homo sapiens
ggaagagggaaccacgactgta

SEQ ID NO: 7434549 - DNA, 22 bp, Homo sapiens
ggaagagtaacaggaggtggaa

SEQ ID NO: 7434550 - DNA, 22 bp, Homo sapiens
ggaagagtaacaggaggtggaa

SEQ ID NO: 7434551 - DNA, 22 bp, Homo sapiens
ggaagagggaaccacgactgta

SEQ ID NO: 7434552 - DNA, 22 bp, Homo sapiens
ggaagagggaaccacgactgta

SEQ ID NO: 7434553 - DNA, 22 bp, Homo sapiens
ggaagagggaaccacgactgta

SEQ ID NO: 7434554 - DNA, 22 bp, Homo sapiens
ggaagagggaaccacgactgta

SEQ ID NO: 7434555 - DNA, 22 bp, Homo sapiens
ggaagagggaaccacgactgta

SEQ ID NO: 7434556 - DNA, 22 bp, Homo sapiens
ggaagagggaaccacgactgta

SEQ ID NO: 7434557 - DNA, 22 bp, Homo sapiens
ggaagagggaaccacgactgta

SEQ ID NO: 7434558 - DNA, 22 bp, Homo sapiens
ggaagattcagcatatatgagt

SEQ ID NO: 7434559 - DNA, 22 bp, Homo sapiens
ggaagattcagcatatatgagt

SEQ ID NO: 7434560 - DNA, 18 bp, Homo sapiens
ggaagattggctatgtgc

SEQ ID NO: 7434561 - DNA, 22 bp, Homo sapiens
ggaagattcagttatctcatga

SEQ ID NO: 7434562 - DNA, 22 bp, Homo sapiens
ggaagatttcccgtagctgtgc

SEQ ID NO: 7434563 - DNA, 22 bp, Homo sapiens
ggaagcaaaatcatcagtcatt

SEQ ID NO: 7434564 - DNA, 22 bp, Homo sapiens
ggaagattttccattcctcttt

SEQ ID NO: 7434565 - DNA, 22 bp, Homo sapiens
ggaagcaaaatcatcagtcatt

SEQ ID NO: 7434566 - DNA, 22 bp, Homo sapiens
ggaagatgagaagtggggctcc

SEQ ID NO: 7434567 - DNA, 22 bp, Homo sapiens
ggaagagtgcaggtttgtttca

SEQ ID NO: 7434568 - DNA, 22 bp, Homo sapiens
ggaagagtaacaggaggtggaa

SEQ ID NO: 7434569 - DNA, 22 bp, Homo sapiens
ggaagagtaacaggaggtggaa

SEQ ID NO: 7434570 - DNA, 22 bp, Homo sapiens
ggaagatgagaagtggggctcc

SEQ ID NO: 7434571 - DNA, 22 bp, Homo sapiens
ggaagatgcccaacccagcttt

SEQ ID NO: 7434572 - DNA, 22 bp, Homo sapiens
ggaagatgagaagtggggctcc

SEQ ID NO: 7434573 - DNA, 22 bp, Homo sapiens
ggaagatgagaagtggggctcc

SEQ ID NO: 7434574 - DNA, 22 bp, Homo sapiens
ggaagcagcctgaagccaaggg

SEQ ID NO: 7434575 - DNA, 22 bp, Homo sapiens
ggaagcagcctgaagccaaggg

SEQ ID NO: 7434576 - DNA, 22 bp, Homo sapiens
ggaagcagcctgaagccaaggg

SEQ ID NO: 7434577 - DNA, 22 bp, Homo sapiens
ggaagcagcctgaagccaaggg

SEQ ID NO: 7434578 - DNA, 22 bp, Homo sapiens
ggaagcagcctgaagccaaggg

SEQ ID NO: 7434579 - DNA, 22 bp, Homo sapiens
ggaagcaggaggctggggtaaa

SEQ ID NO: 7434580 - DNA, 22 bp, Homo sapiens
ggaagcaggaggctggggtaaa

SEQ ID NO: 7434581 - DNA, 22 bp, Homo sapiens
ggaagcagcctgaagccaaggg

SEQ ID NO: 7434582 - DNA, 22 bp, Homo sapiens
ggaagcagcctgaagccaaggg

SEQ ID NO: 7434583 - DNA, 22 bp, Homo sapiens
ggaagcagcctgaagccaaggg

SEQ ID NO: 7434584 - DNA, 22 bp, Homo sapiens
ggaagcaggaggctggggtaaa

SEQ ID NO: 7434585 - DNA, 22 bp, Homo sapiens
ggaagcaggaggctggggtaaa

SEQ ID NO: 7434586 - DNA, 22 bp, Homo sapiens
ggaagcagcctgaagccaaggg

SEQ ID NO: 7434587 - DNA, 22 bp, Homo sapiens
ggaagcagcctgaagccaaggg

SEQ ID NO: 7434588 - DNA, 22 bp, Homo sapiens
ggaagcagcctgaagccaaggg

SEQ ID NO: 7434589 - DNA, 20 bp, Homo sapiens
ggaagcagagaactgttttc

SEQ ID NO: 7434590 - DNA, 20 bp, Homo sapiens
ggaagcagagaactgttttc

SEQ ID NO: 7434591 - DNA, 22 bp, Homo sapiens
ggaagcactgaggcagagaggg

SEQ ID NO: 7434592 - DNA, 22 bp, Homo sapiens
ggaagcactgaggcagagaggg

SEQ ID NO: 7434593 - DNA, 22 bp, Homo sapiens
ggaagcactgaggcagagaggg

SEQ ID NO: 7434594 - DNA, 22 bp, Homo sapiens
ggaatctcagtggagctgttag

SEQ ID NO: 7434595 - DNA, 22 bp, Homo sapiens
ggaatctcagcttctgccctga

SEQ ID NO: 7434596 - DNA, 22 bp, Homo sapiens
ggaatcctgtgagggctgagag

SEQ ID NO: 7434597 - DNA, 22 bp, Homo sapiens
ggaatctagaaagggagcaagg

SEQ ID NO: 7434598 - DNA, 22 bp, Homo sapiens
ggaatcgttaggtaagcaggga

SEQ ID NO: 7434599 - DNA, 22 bp, Homo sapiens
ggaatccttgggtctgaacgtg

SEQ ID NO: 7434600 - DNA, 22 bp, Homo sapiens
ggaatcagatgaggggcagagc

SEQ ID NO: 7434601 - DNA, 20 bp, Homo sapiens
ggaatcagggtaatgtactg

SEQ ID NO: 7434602 - DNA, 22 bp, Homo sapiens
ggaatcatgccatttatgacgt

SEQ ID NO: 7434603 - DNA, 22 bp, Homo sapiens
ggaatcctcattacatcagggt

SEQ ID NO: 7434604 - DNA, 22 bp, Homo sapiens
ggaagcaggaggctggggtaaa

SEQ ID NO: 7434605 - DNA, 22 bp, Homo sapiens
ggaatcagaattaggatttgaa

SEQ ID NO: 7434606 - DNA, 22 bp, Homo sapiens
ggaagcaggaggctggggtaaa

SEQ ID NO: 7434607 - DNA, 22 bp, Homo sapiens
ggaatcagaattactgaatgga

SEQ ID NO: 7434608 - DNA, 22 bp, Homo sapiens
ggaatcagagcagaggctgtta

SEQ ID NO: 7434609 - DNA, 22 bp, Homo sapiens
ggaatcagatgaggggcagagc

SEQ ID NO: 7434610 - DNA, 22 bp, Homo sapiens
ggaatcagatgaggggcagagc

SEQ ID NO: 7434611 - DNA, 22 bp, Homo sapiens
ggaatcagatgaggggcagagc

SEQ ID NO: 7434612 - DNA, 22 bp, Homo sapiens
ggaattggtttcaagggaaagt

SEQ ID NO: 7434613 - DNA, 18 bp, Homo sapiens
ggacacagataggtacag

SEQ ID NO: 7434614 - DNA, 18 bp, Homo sapiens
ggacacagataggtacag

SEQ ID NO: 7434615 - DNA, 22 bp, Homo sapiens
ggacacagccacttagggtacc

SEQ ID NO: 7434616 - DNA, 22 bp, Homo sapiens
ggacacagccacttagggtacc

SEQ ID NO: 7434617 - DNA, 22 bp, Homo sapiens
ggacacagccacttagggtacc

SEQ ID NO: 7434618 - DNA, 18 bp, Homo sapiens
ggacacagataggtacag

SEQ ID NO: 7434619 - DNA, 18 bp, Homo sapiens
ggacacagataggtacag

SEQ ID NO: 7434620 - DNA, 17 bp, Homo sapiens
ggacacagctcatggct

SEQ ID NO: 7434621 - DNA, 17 bp, Homo sapiens
ggacacagctcatggct

SEQ ID NO: 7434622 - DNA, 17 bp, Homo sapiens
ggacacagctcatggct

SEQ ID NO: 7434623 - DNA, 17 bp, Homo sapiens
ggacacagctcatggct

SEQ ID NO: 7434624 - DNA, 17 bp, Homo sapiens
ggacacagctcatggct

SEQ ID NO: 7434625 - DNA, 17 bp, Homo sapiens
ggacacagctcatggct

SEQ ID NO: 7434626 - DNA, 17 bp, Homo sapiens
ggacacagctcatggct

SEQ ID NO: 7434627 - DNA, 17 bp, Homo sapiens
ggacacagctcatggct

SEQ ID NO: 7434628 - DNA, 17 bp, Homo sapiens
ggacacagctcatggct

SEQ ID NO: 7434629 - DNA, 22 bp, Homo sapiens
ggacaaaaatcagccatctcta

SEQ ID NO: 7434630 - DNA, 22 bp, Homo sapiens
ggacaaaaatcagccatctcta

SEQ ID NO: 7434631 - DNA, 22 bp, Homo sapiens
ggaatttagatgtttctcaact

SEQ ID NO: 7434632 - DNA, 22 bp, Homo sapiens
ggaattggtttcaagggaaagt

SEQ ID NO: 7434633 - DNA, 22 bp, Homo sapiens
ggaattggtttcaagggaaagt

SEQ ID NO: 7434634 - DNA, 22 bp, Homo sapiens
ggacaaaatccaaacttcttag

SEQ ID NO: 7434635 - DNA, 22 bp, Homo sapiens
ggacaaaatccaaacttcttag

SEQ ID NO: 7434636 - DNA, 22 bp, Homo sapiens
ggacaaaacttcttgcatttct

SEQ ID NO: 7434637 - DNA, 22 bp, Homo sapiens
ggacaaaacttcttgcatttct

SEQ ID NO: 7434638 - DNA, 22 bp, Homo sapiens
ggacaaaatccaaacttcttag

SEQ ID NO: 7434639 - DNA, 22 bp, Homo sapiens
ggacaaaccaatagacactggc

SEQ ID NO: 7434640 - DNA, 22 bp, Homo sapiens
ggacaaaatccaaacttcttag

SEQ ID NO: 7434641 - DNA, 22 bp, Homo sapiens
ggaattctgtagctcttcctct

SEQ ID NO: 7434642 - DNA, 22 bp, Homo sapiens
ggaatgttttagcttgactttt

SEQ ID NO: 7434643 - DNA, 22 bp, Homo sapiens
ggaatgttttagcttgactttt

SEQ ID NO: 7434644 - DNA, 22 bp, Homo sapiens
ggaattcagggaagtcaaaaag

SEQ ID NO: 7434645 - DNA, 22 bp, Homo sapiens
ggaatgtttttcattgctctct

SEQ ID NO: 7434646 - DNA, 22 bp, Homo sapiens
ggaatgtttttcattgctctct

SEQ ID NO: 7434647 - DNA, 22 bp, Homo sapiens
ggaattcagtggccagacatga

SEQ ID NO: 7434648 - DNA, 22 bp, Homo sapiens
ggaatgaatttccagctgggtc

SEQ ID NO: 7434649 - DNA, 22 bp, Homo sapiens
ggaatgagctcggagcagaagg

SEQ ID NO: 7434650 - DNA, 22 bp, Homo sapiens
ggaatgcactgaaaattgtgct

SEQ ID NO: 7434651 - DNA, 22 bp, Homo sapiens
ggaatgcagtaagtgatttgaa

SEQ ID NO: 7434652 - DNA, 22 bp, Homo sapiens
ggaatgcaattttacaattctg

SEQ ID NO: 7434653 - DNA, 22 bp, Homo sapiens
ggaatgcaattttacaattctg

SEQ ID NO: 7434654 - DNA, 22 bp, Homo sapiens
ggaatgaaacacttctgattct

SEQ ID NO: 7434655 - DNA, 22 bp, Homo sapiens
ggaatgaaacacttctgattct

SEQ ID NO: 7434656 - DNA, 22 bp, Homo sapiens
ggaatgaaacacttctgattct

SEQ ID NO: 7434657 - DNA, 22 bp, Homo sapiens
ggaatctttgaaggattttaag

SEQ ID NO: 7434658 - DNA, 20 bp, Homo sapiens
ggaatctttgcaggaaaata

SEQ ID NO: 7434659 - DNA, 22 bp, Homo sapiens
ggaatctttgaaggattttaag

SEQ ID NO: 7434660 - DNA, 22 bp, Homo sapiens
ggaatgaagaaatagatggtgt

SEQ ID NO: 7434661 - DNA, 22 bp, Homo sapiens
ggaatgaagaaatagatggtgt

SEQ ID NO: 7434662 - DNA, 22 bp, Homo sapiens
ggaatgaagaaatagatggtgt

SEQ ID NO: 7434663 - DNA, 22 bp, Homo sapiens
ggaatgaagaaatagatggtgt

SEQ ID NO: 7434664 - DNA, 22 bp, Homo sapiens
ggaatgaagaaatagatggtgt

SEQ ID NO: 7434665 - DNA, 18 bp, Homo sapiens
ggaatgtggacaggctgg

SEQ ID NO: 7434666 - DNA, 22 bp, Homo sapiens
ggaatgtgctgacacgcgagag

SEQ ID NO: 7434667 - DNA, 22 bp, Homo sapiens
ggaatgtgcgtactcagtgtca

SEQ ID NO: 7434668 - DNA, 22 bp, Homo sapiens
ggaatgtagtttgtgcactgta

SEQ ID NO: 7434669 - DNA, 22 bp, Homo sapiens
ggaatgtaaatttactgttgta

SEQ ID NO: 7434670 - DNA, 22 bp, Homo sapiens
ggaatgtaacgtgaccaagttc

SEQ ID NO: 7434671 - DNA, 22 bp, Homo sapiens
ggaatgggagctattagtggaa

SEQ ID NO: 7434672 - DNA, 22 bp, Homo sapiens
ggaatgggagctattagtggaa

SEQ ID NO: 7434673 - DNA, 22 bp, Homo sapiens
ggaatggtccaagaaagcacgt

SEQ ID NO: 7434674 - DNA, 23 bp, Homo sapiens
ggaatgtttacctgtgaatgtca

SEQ ID NO: 7434675 - DNA, 22 bp, Homo sapiens
ggaatgttgtcatttacattat

SEQ ID NO: 7434676 - DNA, 22 bp, Homo sapiens
ggaatgttgtcatttacattat

SEQ ID NO: 7434677 - DNA, 23 bp, Homo sapiens
ggaatgtttacctgtgaatgtca

SEQ ID NO: 7434678 - DNA, 22 bp, Homo sapiens
ggaatgtgttcttactgtattt

SEQ ID NO: 7434679 - DNA, 22 bp, Homo sapiens
ggaatgttctggtctggttcat

SEQ ID NO: 7434680 - DNA, 22 bp, Homo sapiens
gctgtgtgaaaactgggcctgg

SEQ ID NO: 7434681 - DNA, 22 bp, Homo sapiens
gctgtgtgaaaactgggcctgg

SEQ ID NO: 7434682 - DNA, 22 bp, Homo sapiens
gctgtgtgaaaactgggcctgg

SEQ ID NO: 7434683 - DNA, 22 bp, Homo sapiens
gctgtgtctgttttacgtcaag

SEQ ID NO: 7434684 - DNA, 22 bp, Homo sapiens
gctgtgtctgttttacgtcaag

SEQ ID NO: 7434685 - DNA, 22 bp, Homo sapiens
gctgtgtcctcacacagccttt

SEQ ID NO: 7434686 - DNA, 22 bp, Homo sapiens
gctgtgtcctcacacagccttt

SEQ ID NO: 7434687 - DNA, 22 bp, Homo sapiens
gctgtgtgaccctagccagtag

SEQ ID NO: 7434688 - DNA, 22 bp, Homo sapiens
gctgtgtgaccctagccagtag

SEQ ID NO: 7434689 - DNA, 22 bp, Homo sapiens
gctgtgtgaccctagccagtag

SEQ ID NO: 7434690 - DNA, 22 bp, Homo sapiens
gctgtgtgaccctagccagtag

SEQ ID NO: 7434691 - DNA, 22 bp, Homo sapiens
gctgtgtgaaaactgggcctgg

SEQ ID NO: 7434692 - DNA, 22 bp, Homo sapiens
gctgtgtgaaaactgggcctgg

SEQ ID NO: 7434693 - DNA, 22 bp, Homo sapiens
gcttctggtgaggcctcaggaa

SEQ ID NO: 7434694 - DNA, 22 bp, Homo sapiens
gcttctggtgaggcctcaggaa

SEQ ID NO: 7434695 - DNA, 22 bp, Homo sapiens
gcttctggtgaggcctcaggaa

SEQ ID NO: 7434696 - DNA, 21 bp, Homo sapiens
gcttctgtatctagcaggaac

SEQ ID NO: 7434697 - DNA, 22 bp, Homo sapiens
gctgtgtatcagatgccacggg

SEQ ID NO: 7434698 - DNA, 22 bp, Homo sapiens
gctgtgtatcagatgccacggg

SEQ ID NO: 7434699 - DNA, 20 bp, Homo sapiens
gctgtgtagcagtgtgcagt

SEQ ID NO: 7434700 - DNA, 22 bp, Homo sapiens
gctgtgtacctactaactgctt

SEQ ID NO: 7434701 - DNA, 22 bp, Homo sapiens
gctgtggtccctctgtcctcat

SEQ ID NO: 7434702 - DNA, 22 bp, Homo sapiens
gctgtgtatcagatgccacggg

SEQ ID NO: 7434703 - DNA, 22 bp, Homo sapiens
gctgtgtatcagatgccacggg

SEQ ID NO: 7434704 - DNA, 22 bp, Homo sapiens
gctgtgtatcagatgccacggg

SEQ ID NO: 7434705 - DNA, 22 bp, Homo sapiens
gctgtgtatcagatgccacggg

SEQ ID NO: 7434706 - DNA, 22 bp, Homo sapiens
gctgtgtcctcacacagccttt

SEQ ID NO: 7434707 - DNA, 22 bp, Homo sapiens
gctgtgtcagaaactctgggga

SEQ ID NO: 7434708 - DNA, 19 bp, Homo sapiens
gctgtgtcatttcttagga

SEQ ID NO: 7434709 - DNA, 19 bp, Homo sapiens
gctgtgtcatttcttagga

SEQ ID NO: 7434710 - DNA, 22 bp, Homo sapiens
gcttctgtggtgcatctttgct

SEQ ID NO: 7434711 - DNA, 22 bp, Homo sapiens
gcttctgtggttgtcacgacta

SEQ ID NO: 7434712 - DNA, 22 bp, Homo sapiens
gcttctgtggtgcatctttgct

SEQ ID NO: 7434713 - DNA, 22 bp, Homo sapiens
gcttctgtggtgcatctttgct

SEQ ID NO: 7434714 - DNA, 22 bp, Homo sapiens
gcttctgtggttgtcacgacta

SEQ ID NO: 7434715 - DNA, 22 bp, Homo sapiens
gcttctgtggttgtcacgacta

SEQ ID NO: 7434716 - DNA, 22 bp, Homo sapiens
gcttctgttaacttatgttccc

SEQ ID NO: 7434717 - DNA, 22 bp, Homo sapiens
gcttctgttaacttatgttccc

SEQ ID NO: 7434718 - DNA, 22 bp, Homo sapiens
gcttctgttcaaggatataagg

SEQ ID NO: 7434719 - DNA, 22 bp, Homo sapiens
gcttctgttcaaggatataagg

SEQ ID NO: 7434720 - DNA, 22 bp, Homo sapiens
gcttctgttcaaggatataagg

SEQ ID NO: 7434721 - DNA, 19 bp, Homo sapiens
gcttctgtttgggcttaga

SEQ ID NO: 7434722 - DNA, 22 bp, Homo sapiens
gcttctttccttgggctggaac

SEQ ID NO: 7434723 - DNA, 22 bp, Homo sapiens
gcttctttccttgggctggaac

SEQ ID NO: 7434724 - DNA, 19 bp, Homo sapiens
gcttctgtttgggcttaga

SEQ ID NO: 7434725 - DNA, 19 bp, Homo sapiens
gcttctgtttgggcttaga

SEQ ID NO: 7434726 - DNA, 21 bp, Homo sapiens
gcttctgtatctagcaggaac

SEQ ID NO: 7434727 - DNA, 21 bp, Homo sapiens
gcttctgtatctagcaggaac

SEQ ID NO: 7434728 - DNA, 21 bp, Homo sapiens
gcttctgtatctagcaggaac

SEQ ID NO: 7434729 - DNA, 22 bp, Homo sapiens
gcttctgtatttattgtccttt

SEQ ID NO: 7434730 - DNA, 22 bp, Homo sapiens
gcttctgtatttattgtccttt

SEQ ID NO: 7434731 - DNA, 22 bp, Homo sapiens
gcttctgtcttagctacctccc

SEQ ID NO: 7434732 - DNA, 22 bp, Homo sapiens
gcttctgtcttagctacctccc

SEQ ID NO: 7434733 - DNA, 22 bp, Homo sapiens
gcttctgtatttattgtccttt

SEQ ID NO: 7434734 - DNA, 22 bp, Homo sapiens
gcttctgtcttagctacctccc

SEQ ID NO: 7434735 - DNA, 22 bp, Homo sapiens
gcttctgtgagtgcagatgctg

SEQ ID NO: 7434736 - DNA, 22 bp, Homo sapiens
gcttctgtggattggctggctt

SEQ ID NO: 7434737 - DNA, 22 bp, Homo sapiens
gcttctgtgagtgcagatgctg

SEQ ID NO: 7434738 - DNA, 22 bp, Homo sapiens
gcttctgtggattggctggctt

SEQ ID NO: 7434739 - DNA, 22 bp, Homo sapiens
gcttctgtggattggctggctt

SEQ ID NO: 7434740 - DNA, 22 bp, Homo sapiens
gcttctgtggtgaggtcacctt

SEQ ID NO: 7434741 - DNA, 22 bp, Homo sapiens
gcttctgtggtgaggtcacctt

SEQ ID NO: 7434742 - DNA, 22 bp, Homo sapiens
gcttgcctggcatttctggggc

SEQ ID NO: 7434743 - DNA, 23 bp, Homo sapiens
gcttgcctggtgtgtggctgacc

SEQ ID NO: 7434744 - DNA, 22 bp, Homo sapiens
gcttgctagaagcttaaaggta

SEQ ID NO: 7434745 - DNA, 22 bp, Homo sapiens
gcttgctcaacccccgtctctc

SEQ ID NO: 7434746 - DNA, 22 bp, Homo sapiens
gcttgctctttagccatggcca

SEQ ID NO: 7434747 - DNA, 23 bp, Homo sapiens
gcttgctcattctatcacacagc

SEQ ID NO: 7434748 - DNA, 22 bp, Homo sapiens
gcttgcattctggatctatggt

SEQ ID NO: 7434749 - DNA, 22 bp, Homo sapiens
gcttgcattaggagttatgact

SEQ ID NO: 7434750 - DNA, 22 bp, Homo sapiens
gcttgcatgattggagtgggtg

SEQ ID NO: 7434751 - DNA, 22 bp, Homo sapiens
gcttgcatgattggagtgggtg

SEQ ID NO: 7434752 - DNA, 22 bp, Homo sapiens
gcttgcatattggaaagactca

SEQ ID NO: 7434753 - DNA, 22 bp, Homo sapiens
gcttgcatgatatggcatctgg

SEQ ID NO: 7434754 - DNA, 22 bp, Homo sapiens
gcttgcatcttctagttcctag

SEQ ID NO: 7434755 - DNA, 22 bp, Homo sapiens
gcttgcatttggaatagattaa

SEQ ID NO: 7434756 - DNA, 22 bp, Homo sapiens
gcttgccagacactcgaggggg

SEQ ID NO: 7434757 - DNA, 22 bp, Homo sapiens
gcttgcattgtcagaatgacta

SEQ ID NO: 7434758 - DNA, 22 bp, Homo sapiens
gcttgccataccccattgactt

SEQ ID NO: 7434759 - DNA, 20 bp, Homo sapiens
gcttgcccacatctgcactg

SEQ ID NO: 7434760 - DNA, 20 bp, Homo sapiens
gcttgcccacatctgcactg

SEQ ID NO: 7434761 - DNA, 22 bp, Homo sapiens
gcttgcacataagcacacactt

SEQ ID NO: 7434762 - DNA, 22 bp, Homo sapiens
gcttgatgatacctaggagatg

SEQ ID NO: 7434763 - DNA, 22 bp, Homo sapiens
gcttgcaagataggttacttaa

SEQ ID NO: 7434764 - DNA, 22 bp, Homo sapiens
gcttgagttttgggacaaagcc

SEQ ID NO: 7434765 - DNA, 22 bp, Homo sapiens
gcttgagttttgggacaaagcc

SEQ ID NO: 7434766 - DNA, 22 bp, Homo sapiens
gcttgcatcatcttgagagtcc

SEQ ID NO: 7434767 - DNA, 22 bp, Homo sapiens
gcttgcatattggaaagactca

SEQ ID NO: 7434768 - DNA, 22 bp, Homo sapiens
gcttgcatagctctgtcctgtt

SEQ ID NO: 7434769 - DNA, 22 bp, Homo sapiens
gcttgcagtggttggcatgacc

SEQ ID NO: 7434770 - DNA, 22 bp, Homo sapiens
gcttgcagcaggtgcttaggaa

SEQ ID NO: 7434771 - DNA, 22 bp, Homo sapiens
gcttgcaagtgtcaagctatta

SEQ ID NO: 7434772 - DNA, 20 bp, Homo sapiens
gcttcttttctggcccatga

SEQ ID NO: 7434773 - DNA, 22 bp, Homo sapiens
gcttctttggcaaccctgacat

SEQ ID NO: 7434774 - DNA, 22 bp, Homo sapiens
gcttctgttcaaggatataagg

SEQ ID NO: 7434775 - DNA, 22 bp, Homo sapiens
gcttctttccttgggctggaac

SEQ ID NO: 7434776 - DNA, 22 bp, Homo sapiens
gcttgactaggctctggcgaca

SEQ ID NO: 7434777 - DNA, 22 bp, Homo sapiens
gcttgagggtctgagatccact

SEQ ID NO: 7434778 - DNA, 20 bp, Homo sapiens
gcttcttttctggcccatga

SEQ ID NO: 7434779 - DNA, 22 bp, Homo sapiens
gcttgaaaattcataggtattt

SEQ ID NO: 7434780 - DNA, 22 bp, Homo sapiens
gcttggaagtaggattgggaga

SEQ ID NO: 7434781 - DNA, 20 bp, Homo sapiens
gcttgctttgtctgatgggc

SEQ ID NO: 7434782 - DNA, 22 bp, Homo sapiens
gcttggaagtaggattgggaga

SEQ ID NO: 7434783 - DNA, 22 bp, Homo sapiens
gcttggaagtaggattgggaga

SEQ ID NO: 7434784 - DNA, 20 bp, Homo sapiens
gcttgctttgtctgatgggc

SEQ ID NO: 7434785 - DNA, 20 bp, Homo sapiens
gcttgctttgtctgatgggc

SEQ ID NO: 7434786 - DNA, 21 bp, Homo sapiens
gcttgcttggagtttaggagt

SEQ ID NO: 7434787 - DNA, 19 bp, Homo sapiens
gcttgctttatgaaggggg

SEQ ID NO: 7434788 - DNA, 19 bp, Homo sapiens
gcttgctttatgaaggggg

SEQ ID NO: 7434789 - DNA, 22 bp, Homo sapiens
gcttgctttgtaaatatctgtg

SEQ ID NO: 7434790 - DNA, 22 bp, Homo sapiens
gcttgctttgtaaatatctgtg

SEQ ID NO: 7434791 - DNA, 19 bp, Homo sapiens
gcttgctgctaggtaggga

SEQ ID NO: 7434792 - DNA, 19 bp, Homo sapiens
gcttgctggcgggggtctg

SEQ ID NO: 7434793 - DNA, 19 bp, Homo sapiens
gcttgctgctaggtaggga

SEQ ID NO: 7434794 - DNA, 19 bp, Homo sapiens
gcttgctgctaggtaggga

SEQ ID NO: 7434795 - DNA, 22 bp, Homo sapiens
gcttgctctttagccatggcca

SEQ ID NO: 7434796 - DNA, 22 bp, Homo sapiens
gcttgctggtgcctgcaggctc

SEQ ID NO: 7434797 - DNA, 22 bp, Homo sapiens
gcttgctggtgcctgcaggctc

SEQ ID NO: 7434798 - DNA, 22 bp, Homo sapiens
gcttgctggtgcctgcaggctc

SEQ ID NO: 7434799 - DNA, 19 bp, Homo sapiens
gcttgctggcgggggtctg

SEQ ID NO: 7434800 - DNA, 18 bp, Homo sapiens
gctttatttcttggggaa

SEQ ID NO: 7434801 - DNA, 18 bp, Homo sapiens
gctttatttcttggggaa

SEQ ID NO: 7434802 - DNA, 18 bp, Homo sapiens
gctttatttcttggggaa

SEQ ID NO: 7434803 - DNA, 18 bp, Homo sapiens
gctttatttcttggggaa

SEQ ID NO: 7434804 - DNA, 18 bp, Homo sapiens
gctttatttcttggggaa

SEQ ID NO: 7434805 - DNA, 18 bp, Homo sapiens
gctttatttcttggggaa

SEQ ID NO: 7434806 - DNA, 18 bp, Homo sapiens
gctttatttcttggggaa

SEQ ID NO: 7434807 - DNA, 18 bp, Homo sapiens
gctttatttcttggggaa

SEQ ID NO: 7434808 - DNA, 18 bp, Homo sapiens
gctttatttcttggggaa

SEQ ID NO: 7434809 - DNA, 22 bp, Homo sapiens
gcttggaagtaggattgggaga

SEQ ID NO: 7434810 - DNA, 22 bp, Homo sapiens
gcttggaagtaggattgggaga

SEQ ID NO: 7434811 - DNA, 22 bp, Homo sapiens
gctttatgtaagtccaaaggca

SEQ ID NO: 7434812 - DNA, 19 bp, Homo sapiens
gctgtgcccctgccgcttg

SEQ ID NO: 7434813 - DNA, 20 bp, Homo sapiens
gctgtgcctccagctggtgg

SEQ ID NO: 7434814 - DNA, 20 bp, Homo sapiens
gctgtgcctccagctggtgg

SEQ ID NO: 7434815 - DNA, 19 bp, Homo sapiens
gctgtgcccctgccgcttg

SEQ ID NO: 7434816 - DNA, 22 bp, Homo sapiens
gctggggctgggctgaggaaga

SEQ ID NO: 7434817 - DNA, 22 bp, Homo sapiens
gctggggctgggctgaggaaga

SEQ ID NO: 7434818 - DNA, 22 bp, Homo sapiens
gctgtgctcaacgtgccttcct

SEQ ID NO: 7434819 - DNA, 19 bp, Homo sapiens
gctgtgcctctctcctgct

SEQ ID NO: 7434820 - DNA, 19 bp, Homo sapiens
gctgtgcctctctcctgct

SEQ ID NO: 7434821 - DNA, 19 bp, Homo sapiens
gctgtgcctctctcctgct

SEQ ID NO: 7434822 - DNA, 22 bp, Homo sapiens
gctggggctgggctgaggaaga

SEQ ID NO: 7434823 - DNA, 22 bp, Homo sapiens
gctggggctgggctgaggaaga

SEQ ID NO: 7434824 - DNA, 22 bp, Homo sapiens
gctggggctgggctgaggaaga

SEQ ID NO: 7434825 - DNA, 19 bp, Homo sapiens
gctggggcctgaccagaca

SEQ ID NO: 7434826 - DNA, 22 bp, Homo sapiens
gctggggctgggctgaggaaga

SEQ ID NO: 7434827 - DNA, 22 bp, Homo sapiens
gctggggctgggctgaggaaga

SEQ ID NO: 7434828 - DNA, 22 bp, Homo sapiens
gctggggcctgaacagtcagct

SEQ ID NO: 7434829 - DNA, 22 bp, Homo sapiens
gctggggcctgaacagtcagct

SEQ ID NO: 7434830 - DNA, 19 bp, Homo sapiens
gctggggcctgaccagaca

SEQ ID NO: 7434831 - DNA, 19 bp, Homo sapiens
gctggggcctgaccagaca

SEQ ID NO: 7434832 - DNA, 19 bp, Homo sapiens
gctggggcctgaccagaca

SEQ ID NO: 7434833 - DNA, 22 bp, Homo sapiens
gctggggcctctgtgaggttaa

SEQ ID NO: 7434834 - DNA, 22 bp, Homo sapiens
gctggggcctgaacagtcagct

SEQ ID NO: 7434835 - DNA, 22 bp, Homo sapiens
gctggggcctgaacagtcagct

SEQ ID NO: 7434836 - DNA, 22 bp, Homo sapiens
gctggggcctgaacagtcagct

SEQ ID NO: 7434837 - DNA, 22 bp, Homo sapiens
gctggggcctgaacagtcagct

SEQ ID NO: 7434838 - DNA, 22 bp, Homo sapiens
gctggggcctgaacagtcagct

SEQ ID NO: 7434839 - DNA, 22 bp, Homo sapiens
gctggggcctgaacagtcagct

SEQ ID NO: 7434840 - DNA, 22 bp, Homo sapiens
gctggggcctgaacagtcagct

SEQ ID NO: 7434841 - DNA, 22 bp, Homo sapiens
gctggggagggcgtcaaggcca

SEQ ID NO: 7434842 - DNA, 22 bp, Homo sapiens
gctggggagggcgtcaaggcca

SEQ ID NO: 7434843 - DNA, 22 bp, Homo sapiens
gctggggagggcgtcaaggcca

SEQ ID NO: 7434844 - DNA, 22 bp, Homo sapiens
gctggggcctctgtgaggttaa

SEQ ID NO: 7434845 - DNA, 22 bp, Homo sapiens
gctggggcctctgtgaggttaa

SEQ ID NO: 7434846 - DNA, 22 bp, Homo sapiens
gctggggagggcgtcaaggcca

SEQ ID NO: 7434847 - DNA, 22 bp, Homo sapiens
gctggggcctctgtgaggttaa

SEQ ID NO: 7434848 - DNA, 22 bp, Homo sapiens
gctggggcctctgtgaggttaa

SEQ ID NO: 7434849 - DNA, 22 bp, Homo sapiens
gctggggcctctgtgaggttaa

SEQ ID NO: 7434850 - DNA, 22 bp, Homo sapiens
gctggggaggcagcagagaaca

SEQ ID NO: 7434851 - DNA, 22 bp, Homo sapiens
gctggggaggcagcagagaaca

SEQ ID NO: 7434852 - DNA, 22 bp, Homo sapiens
gctggggaggcagcagagaaca

SEQ ID NO: 7434853 - DNA, 22 bp, Homo sapiens
gctgggcttggtttccctgctt

SEQ ID NO: 7434854 - DNA, 22 bp, Homo sapiens
gctgggcttggtttccctgctt

SEQ ID NO: 7434855 - DNA, 22 bp, Homo sapiens
gctgggcttggtttccctgctt

SEQ ID NO: 7434856 - DNA, 22 bp, Homo sapiens
gctgggcttggtttccctgctt

SEQ ID NO: 7434857 - DNA, 19 bp, Homo sapiens
gctgggcttgggtttgtag

SEQ ID NO: 7434858 - DNA, 19 bp, Homo sapiens
gctgggcttgggtttgtag

SEQ ID NO: 7434859 - DNA, 19 bp, Homo sapiens
gctgggcttgggtttgtag

SEQ ID NO: 7434860 - DNA, 22 bp, Homo sapiens
gctgggcttggtttccctgctt

SEQ ID NO: 7434861 - DNA, 22 bp, Homo sapiens
gctgggcttggtttccctgctt

SEQ ID NO: 7434862 - DNA, 22 bp, Homo sapiens
gctgtgggtaaacgctgagggt

SEQ ID NO: 7434863 - DNA, 22 bp, Homo sapiens
gctgtggtccctctgtcctcat

SEQ ID NO: 7434864 - DNA, 22 bp, Homo sapiens
gctgtgggtttccaatcctgga

SEQ ID NO: 7434865 - DNA, 22 bp, Homo sapiens
gctgtggtctgtgagctccaaa

SEQ ID NO: 7434866 - DNA, 22 bp, Homo sapiens
gctgtgggttcctggcatttga

SEQ ID NO: 7434867 - DNA, 22 bp, Homo sapiens
gctgtgggtttccaatcctgga

SEQ ID NO: 7434868 - DNA, 22 bp, Homo sapiens
gctgtgggtttccaatcctgga

SEQ ID NO: 7434869 - DNA, 22 bp, Homo sapiens
gctgtgggtaaacgctgagggt

SEQ ID NO: 7434870 - DNA, 22 bp, Homo sapiens
gctgtgggtaaacgctgagggt

SEQ ID NO: 7434871 - DNA, 22 bp, Homo sapiens
gctgtgggtaaacgctgagggt

SEQ ID NO: 7434872 - DNA, 22 bp, Homo sapiens
gctgtgggtaaacgctgagggt

SEQ ID NO: 7434873 - DNA, 22 bp, Homo sapiens
gctgtgggccacacggctgagt

SEQ ID NO: 7434874 - DNA, 22 bp, Homo sapiens
gctgtgggccacacggctgagt

SEQ ID NO: 7434875 - DNA, 22 bp, Homo sapiens
gctgtgggccacacggctgagt

SEQ ID NO: 7434876 - DNA, 19 bp, Homo sapiens
gctgtgggacagcagggtg

SEQ ID NO: 7434877 - DNA, 22 bp, Homo sapiens
gctgtgggccacacggctgagt

SEQ ID NO: 7434878 - DNA, 22 bp, Homo sapiens
gctgtggctgaccaccaggggg

SEQ ID NO: 7434879 - DNA, 22 bp, Homo sapiens
gctgtggctgtacagagaccat

SEQ ID NO: 7434880 - DNA, 22 bp, Homo sapiens
gctgtggcttgcagctggggct

SEQ ID NO: 7434881 - DNA, 22 bp, Homo sapiens
gctgtggcttgcagctggggct

SEQ ID NO: 7434882 - DNA, 22 bp, Homo sapiens
gctgtggcttgcagctggggct

SEQ ID NO: 7434883 - DNA, 22 bp, Homo sapiens
gctgtggcttgcagctggggct

SEQ ID NO: 7434884 - DNA, 22 bp, Homo sapiens
gctgtggcttgcagctggggct

SEQ ID NO: 7434885 - DNA, 22 bp, Homo sapiens
gctgtggctttctgtttctgtt

SEQ ID NO: 7434886 - DNA, 22 bp, Homo sapiens
gctgtggctttctgtttctgtt

SEQ ID NO: 7434887 - DNA, 22 bp, Homo sapiens
gctgtggctttctgtttctgtt

SEQ ID NO: 7434888 - DNA, 22 bp, Homo sapiens
gctgtggctttctgtttctgtt

SEQ ID NO: 7434889 - DNA, 19 bp, Homo sapiens
gctgtgggacagcagggtg

SEQ ID NO: 7434890 - DNA, 19 bp, Homo sapiens
gctgtgggacagcagggtg

SEQ ID NO: 7434891 - DNA, 22 bp, Homo sapiens
gctgtggctccaatggtgagcc

SEQ ID NO: 7434892 - DNA, 22 bp, Homo sapiens
gctgtggctctcacaagcaaat

SEQ ID NO: 7434893 - DNA, 22 bp, Homo sapiens
gctgtggctccaatggtgagcc

SEQ ID NO: 7434894 - DNA, 22 bp, Homo sapiens
gctgtggctccaatggtgagcc

SEQ ID NO: 7434895 - DNA, 22 bp, Homo sapiens
gctgtggcggcagcagctggtg

SEQ ID NO: 7434896 - DNA, 22 bp, Homo sapiens
gctgtggcggcagcagctggtg

SEQ ID NO: 7434897 - DNA, 22 bp, Homo sapiens
gctgtggctgaagatgcaggga

SEQ ID NO: 7434898 - DNA, 22 bp, Homo sapiens
gctgtggctctcacaagcaaat

SEQ ID NO: 7434899 - DNA, 22 bp, Homo sapiens
gctgtggctgaagatgcaggga

SEQ ID NO: 7434900 - DNA, 22 bp, Homo sapiens
gctgtggctgaagatgcaggga

SEQ ID NO: 7434901 - DNA, 22 bp, Homo sapiens
gctgtggctgaagatgcaggga

SEQ ID NO: 7434902 - DNA, 22 bp, Homo sapiens
gctgtggctgacattgcagaca

SEQ ID NO: 7434903 - DNA, 22 bp, Homo sapiens
gctgtggctgaccaccaggggg

SEQ ID NO: 7434904 - DNA, 22 bp, Homo sapiens
gctgctttacaggtgggggagc

SEQ ID NO: 7434905 - DNA, 22 bp, Homo sapiens
gctgctttagaattgaaacaga

SEQ ID NO: 7434906 - DNA, 22 bp, Homo sapiens
gctgctttagaattgaaacaga

SEQ ID NO: 7434907 - DNA, 22 bp, Homo sapiens
gctgctttaggttgagctcagc

SEQ ID NO: 7434908 - DNA, 22 bp, Homo sapiens
gctgctttaggttgagctcagc

SEQ ID NO: 7434909 - DNA, 22 bp, Homo sapiens
gctgctttagaattgaaacaga

SEQ ID NO: 7434910 - DNA, 22 bp, Homo sapiens
gctgctttagaattgaaacaga

SEQ ID NO: 7434911 - DNA, 20 bp, Homo sapiens
gctgctttcaaatgacacgt

SEQ ID NO: 7434912 - DNA, 20 bp, Homo sapiens
gctgctttcaaatgacacgt

SEQ ID NO: 7434913 - DNA, 22 bp, Homo sapiens
gctgctttataatctcggcaga

SEQ ID NO: 7434914 - DNA, 22 bp, Homo sapiens
gctggagaaacaggaggaggaa

SEQ ID NO: 7434915 - DNA, 22 bp, Homo sapiens
gctggagaaacaggaggaggaa

SEQ ID NO: 7434916 - DNA, 22 bp, Homo sapiens
gctggagaaacaggaggaggaa

SEQ ID NO: 7434917 - DNA, 22 bp, Homo sapiens
gctggagaaacaggaggaggaa

SEQ ID NO: 7434918 - DNA, 20 bp, Homo sapiens
gctgctttcaaatgacacgt

SEQ ID NO: 7434919 - DNA, 22 bp, Homo sapiens
gctggagaaactgcagctgagg

SEQ ID NO: 7434920 - DNA, 22 bp, Homo sapiens
gctggagaaactgcagctgagg

SEQ ID NO: 7434921 - DNA, 22 bp, Homo sapiens
gctggagaaactgcagctgagg

SEQ ID NO: 7434922 - DNA, 22 bp, Homo sapiens
gctggagaaactgcagctgagg

SEQ ID NO: 7434923 - DNA, 22 bp, Homo sapiens
gctggagaaactgcagctgagg

SEQ ID NO: 7434924 - DNA, 22 bp, Homo sapiens
gctggagaaactgcagctgagg

SEQ ID NO: 7434925 - DNA, 22 bp, Homo sapiens
gctggagaaactgcagctgagg

SEQ ID NO: 7434926 - DNA, 22 bp, Homo sapiens
gctggagaaactgcagctgagg

SEQ ID NO: 7434927 - DNA, 22 bp, Homo sapiens
gctggagaaacaggaggaggaa

SEQ ID NO: 7434928 - DNA, 22 bp, Homo sapiens
gctggagaaactgcagctgagg

SEQ ID NO: 7434929 - DNA, 22 bp, Homo sapiens
gctggagaaactgcagctgagg

SEQ ID NO: 7434930 - DNA, 22 bp, Homo sapiens
gctggagaacccaggaggaaga

SEQ ID NO: 7434931 - DNA, 22 bp, Homo sapiens
gctggagaacccaggaggaaga

SEQ ID NO: 7434932 - DNA, 22 bp, Homo sapiens
gctggagaacccaggaggaaga

SEQ ID NO: 7434933 - DNA, 22 bp, Homo sapiens
gctggagaacccaggaggaaga

SEQ ID NO: 7434934 - DNA, 22 bp, Homo sapiens
gctggagacctcagagaaccca

SEQ ID NO: 7434935 - DNA, 22 bp, Homo sapiens
gctggagacctcagagaaccca

SEQ ID NO: 7434936 - DNA, 22 bp, Homo sapiens
gctggagacctcagagaaccca

SEQ ID NO: 7434937 - DNA, 22 bp, Homo sapiens
gctggagagataggcatggggt

SEQ ID NO: 7434938 - DNA, 22 bp, Homo sapiens
gctggagagataggcatggggt

SEQ ID NO: 7434939 - DNA, 22 bp, Homo sapiens
gctggagagataggcatggggt

SEQ ID NO: 7434940 - DNA, 22 bp, Homo sapiens
gctggagagataggcatggggt

SEQ ID NO: 7434941 - DNA, 22 bp, Homo sapiens
gctggagagataggcatggggt

SEQ ID NO: 7434942 - DNA, 22 bp, Homo sapiens
gctggagagataggcatggggt

SEQ ID NO: 7434943 - DNA, 22 bp, Homo sapiens
gctggctgcgtcatcacagggc

SEQ ID NO: 7434944 - DNA, 22 bp, Homo sapiens
gctggctgccttactttgtgga

SEQ ID NO: 7434945 - DNA, 22 bp, Homo sapiens
gctggctgcgtcatcacagggc

SEQ ID NO: 7434946 - DNA, 22 bp, Homo sapiens
gctggctgcgtcatcacagggc

SEQ ID NO: 7434947 - DNA, 22 bp, Homo sapiens
gctggctgccttactttgtgga

SEQ ID NO: 7434948 - DNA, 22 bp, Homo sapiens
gctggagagataggcatggggt

SEQ ID NO: 7434949 - DNA, 22 bp, Homo sapiens
gctggagagataggcatggggt

SEQ ID NO: 7434950 - DNA, 21 bp, Homo sapiens
gctggagagccaggcaggggc

SEQ ID NO: 7434951 - DNA, 22 bp, Homo sapiens
gctggctgccttactttgtgga

SEQ ID NO: 7434952 - DNA, 22 bp, Homo sapiens
gctggctgcgtcatcacagggc

SEQ ID NO: 7434953 - DNA, 22 bp, Homo sapiens
gctggctgcgtcatcacagggc

SEQ ID NO: 7434954 - DNA, 22 bp, Homo sapiens
gctggctgcgtcatcacagggc

SEQ ID NO: 7434955 - DNA, 22 bp, Homo sapiens
gctggctgcgtcatcacagggc

SEQ ID NO: 7434956 - DNA, 22 bp, Homo sapiens
gctggctgcgtcatcacagggc

SEQ ID NO: 7434957 - DNA, 22 bp, Homo sapiens
gctggctgcgtcatcacagggc

SEQ ID NO: 7434958 - DNA, 22 bp, Homo sapiens
gctggctgcgtcatcacagggc

SEQ ID NO: 7434959 - DNA, 22 bp, Homo sapiens
gctggctgcgtcatcacagggc

SEQ ID NO: 7434960 - DNA, 22 bp, Homo sapiens
gctggctgctaggacagctaca

SEQ ID NO: 7434961 - DNA, 22 bp, Homo sapiens
gctggctgctaggacagctaca

SEQ ID NO: 7434962 - DNA, 22 bp, Homo sapiens
gctggctgctaggacagctaca

SEQ ID NO: 7434963 - DNA, 22 bp, Homo sapiens
gctggctgctaggacagctaca

SEQ ID NO: 7434964 - DNA, 22 bp, Homo sapiens
gctggctgcgtcatcacagggc

SEQ ID NO: 7434965 - DNA, 22 bp, Homo sapiens
gctggctgcgtcatcacagggc

SEQ ID NO: 7434966 - DNA, 22 bp, Homo sapiens
gctggctgctgttgagacttgt

SEQ ID NO: 7434967 - DNA, 22 bp, Homo sapiens
gctggctgctaggacagctaca

SEQ ID NO: 7434968 - DNA, 22 bp, Homo sapiens
gctggctgctgttgagacttgt

SEQ ID NO: 7434969 - DNA, 22 bp, Homo sapiens
gctggctgctgttgagacttgt

SEQ ID NO: 7434970 - DNA, 22 bp, Homo sapiens
gctggctgctgttgagacttgt

SEQ ID NO: 7434971 - DNA, 22 bp, Homo sapiens
gctggctgctgttgagacttgt

SEQ ID NO: 7434972 - DNA, 22 bp, Homo sapiens
gctggctggaactagcagttgg

SEQ ID NO: 7434973 - DNA, 22 bp, Homo sapiens
gctggctgctaggacagctaca

SEQ ID NO: 7434974 - DNA, 22 bp, Homo sapiens
gctggctgctaggacagctaca

SEQ ID NO: 7434975 - DNA, 22 bp, Homo sapiens
gctggctgctaggacagctaca

SEQ ID NO: 7434976 - DNA, 22 bp, Homo sapiens
gctggctgctgttgagacttgt

SEQ ID NO: 7434977 - DNA, 22 bp, Homo sapiens
gctggctgctgttgagacttgt

SEQ ID NO: 7434978 - DNA, 22 bp, Homo sapiens
gctggctggaggtgaggaagaa

SEQ ID NO: 7434979 - DNA, 22 bp, Homo sapiens
gctggctggaggtgaggaagaa

SEQ ID NO: 7434980 - DNA, 22 bp, Homo sapiens
gctggctggaggtgaggaagaa

SEQ ID NO: 7434981 - DNA, 22 bp, Homo sapiens
gctggctggaggtgaggaagaa

SEQ ID NO: 7434982 - DNA, 22 bp, Homo sapiens
gctggctggaggtgaggaagaa

SEQ ID NO: 7434983 - DNA, 22 bp, Homo sapiens
gctggctggaggtgaggaagaa

SEQ ID NO: 7434984 - DNA, 22 bp, Homo sapiens
gctggctggaggtgaggaagaa

SEQ ID NO: 7434985 - DNA, 22 bp, Homo sapiens
gctggctggaggagggaggttg

SEQ ID NO: 7434986 - DNA, 22 bp, Homo sapiens
gctggctggaggagggaggttg

SEQ ID NO: 7434987 - DNA, 22 bp, Homo sapiens
gctggctggaggagggaggttg

SEQ ID NO: 7434988 - DNA, 22 bp, Homo sapiens
gctggctggaggagggaggttg

SEQ ID NO: 7434989 - DNA, 22 bp, Homo sapiens
gctggctggaggagggaggttg

SEQ ID NO: 7434990 - DNA, 19 bp, Homo sapiens
gctggctggaggagggaca

SEQ ID NO: 7434991 - DNA, 19 bp, Homo sapiens
gctggctggaggagggaca

SEQ ID NO: 7434992 - DNA, 19 bp, Homo sapiens
gctggctggaggagggaca

SEQ ID NO: 7434993 - DNA, 19 bp, Homo sapiens
gctggctggaggagggaca

SEQ ID NO: 7434994 - DNA, 19 bp, Homo sapiens
gctggctggaggagggaca

SEQ ID NO: 7434995 - DNA, 19 bp, Homo sapiens
gctggctggaggagggaca

SEQ ID NO: 7434996 - DNA, 19 bp, Homo sapiens
gctggctggaggagggaca

SEQ ID NO: 7434997 - DNA, 19 bp, Homo sapiens
gctggctggaggagggaca

SEQ ID NO: 7434998 - DNA, 22 bp, Homo sapiens
gctggctggaggagggaggttg

SEQ ID NO: 7434999 - DNA, 22 bp, Homo sapiens
gctggctggaggagggaggttg

SEQ ID NO: 7435000 - DNA, 22 bp, Homo sapiens
gctggctggaggagggaggttg

SEQ ID NO: 7435001 - DNA, 19 bp, Homo sapiens
gctggctggaggagggaca

SEQ ID NO: 7435002 - DNA, 22 bp, Homo sapiens
gctggctggaggagggaggttg

SEQ ID NO: 7435003 - DNA, 22 bp, Homo sapiens
gctggctggaggagggaggttg

SEQ ID NO: 7435004 - DNA, 22 bp, Homo sapiens
gctggctggaggagggaggttg

SEQ ID NO: 7435005 - DNA, 22 bp, Homo sapiens
gctggctggaggagggaggttg

SEQ ID NO: 7435006 - DNA, 22 bp, Homo sapiens
gctggctggaatgggagaagaa

SEQ ID NO: 7435007 - DNA, 22 bp, Homo sapiens
gctggctggaactagcagttgg

SEQ ID NO: 7435008 - DNA, 22 bp, Homo sapiens
gctggctggaatgggagaagaa

SEQ ID NO: 7435009 - DNA, 22 bp, Homo sapiens
gctggctggaatgggagaagaa

SEQ ID NO: 7435010 - DNA, 22 bp, Homo sapiens
gctggctggaatgggagaagaa

SEQ ID NO: 7435011 - DNA, 22 bp, Homo sapiens
gctggctggaatgggagaagaa

SEQ ID NO: 7435012 - DNA, 22 bp, Homo sapiens
gctggctggaatgggagaagaa

SEQ ID NO: 7435013 - DNA, 22 bp, Homo sapiens
gctggctggaatgggagaagaa

SEQ ID NO: 7435014 - DNA, 22 bp, Homo sapiens
gctggctggaactagcagttgg

SEQ ID NO: 7435015 - DNA, 22 bp, Homo sapiens
gctggctggaactagcagttgg

SEQ ID NO: 7435016 - DNA, 22 bp, Homo sapiens
gctggctggaactagcagttgg

SEQ ID NO: 7435017 - DNA, 22 bp, Homo sapiens
gctggctggaactagcagttgg

SEQ ID NO: 7435018 - DNA, 22 bp, Homo sapiens
gctggctggaactagcagttgg

SEQ ID NO: 7435019 - DNA, 22 bp, Homo sapiens
gctggctggaactagcagttgg

SEQ ID NO: 7435020 - DNA, 22 bp, Homo sapiens
gctggctggaatgggagaagaa

SEQ ID NO: 7435021 - DNA, 19 bp, Homo sapiens
gctggctggaggagggaca

SEQ ID NO: 7435022 - DNA, 19 bp, Homo sapiens
gctggctggaggagggaca

SEQ ID NO: 7435023 - DNA, 22 bp, Homo sapiens
gctggctggaatgggagaagaa

SEQ ID NO: 7435024 - DNA, 22 bp, Homo sapiens
gctggctggaatgggagaagaa

SEQ ID NO: 7435025 - DNA, 22 bp, Homo sapiens
gctggctggaatgggagaagaa

SEQ ID NO: 7435026 - DNA, 22 bp, Homo sapiens
gctggctggaatgggagaagaa

SEQ ID NO: 7435027 - DNA, 22 bp, Homo sapiens
gctggctggaatgggagaagaa

SEQ ID NO: 7435028 - DNA, 22 bp, Homo sapiens
gctggctggaatgggagaagaa

SEQ ID NO: 7435029 - DNA, 22 bp, Homo sapiens
gctggctggaatgggagaagaa

SEQ ID NO: 7435030 - DNA, 22 bp, Homo sapiens
gctggctggcgggtgcgtcctc

SEQ ID NO: 7435031 - DNA, 22 bp, Homo sapiens
gctggctggcgggtgcgtcctc

SEQ ID NO: 7435032 - DNA, 22 bp, Homo sapiens
gctggctggcgggtgcgtcctc

SEQ ID NO: 7435033 - DNA, 22 bp, Homo sapiens
gctggctggcgggtgcgtcctc

SEQ ID NO: 7435034 - DNA, 22 bp, Homo sapiens
gctggctggcgggtgcgtcctc

SEQ ID NO: 7435035 - DNA, 22 bp, Homo sapiens
gctggctggcgggtgcgtcctc

SEQ ID NO: 7435036 - DNA, 22 bp, Homo sapiens
gctggctggcgggtgcgtcctc

SEQ ID NO: 7435037 - DNA, 22 bp, Homo sapiens
gctggctggcgggtgcgtcctc

SEQ ID NO: 7435038 - DNA, 23 bp, Homo sapiens
gctggctggcagtaaaggttgtt

SEQ ID NO: 7435039 - DNA, 23 bp, Homo sapiens
gctggctggcagtaaaggttgtt

SEQ ID NO: 7435040 - DNA, 23 bp, Homo sapiens
gctggctggcagtaaaggttgtt

SEQ ID NO: 7435041 - DNA, 23 bp, Homo sapiens
gctggctggcagtaaaggttgtt

SEQ ID NO: 7435042 - DNA, 23 bp, Homo sapiens
gctggctggcagtaaaggttgtt

SEQ ID NO: 7435043 - DNA, 22 bp, Homo sapiens
gctggctggagtgagctaccct

SEQ ID NO: 7435044 - DNA, 22 bp, Homo sapiens
gctggctggatggttggttcgc

SEQ ID NO: 7435045 - DNA, 22 bp, Homo sapiens
gctggctggatggttggttcgc

SEQ ID NO: 7435046 - DNA, 22 bp, Homo sapiens
gctggctggatggttggttcgc

SEQ ID NO: 7435047 - DNA, 22 bp, Homo sapiens
gctggctggatggttggttcgc

SEQ ID NO: 7435048 - DNA, 22 bp, Homo sapiens
gctggctggatggttggttcgc

SEQ ID NO: 7435049 - DNA, 22 bp, Homo sapiens
gctggctggcacgttcgcacgt

SEQ ID NO: 7435050 - DNA, 23 bp, Homo sapiens
gctggctggcagtaaaggttgtt

SEQ ID NO: 7435051 - DNA, 22 bp, Homo sapiens
gctggctggcacgttcgcacgt

SEQ ID NO: 7435052 - DNA, 22 bp, Homo sapiens
gctggctggcacgttcgcacgt

SEQ ID NO: 7435053 - DNA, 22 bp, Homo sapiens
gctggctggcacgttcgcacgt

SEQ ID NO: 7435054 - DNA, 22 bp, Homo sapiens
gctggctggcacgttcgcacgt

SEQ ID NO: 7435055 - DNA, 22 bp, Homo sapiens
gctggctggagtaaggagggag

SEQ ID NO: 7435056 - DNA, 22 bp, Homo sapiens
gctggctggagtaaggagggag

SEQ ID NO: 7435057 - DNA, 22 bp, Homo sapiens
gctggctggagtaaggagggag

SEQ ID NO: 7435058 - DNA, 22 bp, Homo sapiens
gctggctggagtaaggagggag

SEQ ID NO: 7435059 - DNA, 22 bp, Homo sapiens
gctggctggagtaaggagggag

SEQ ID NO: 7435060 - DNA, 22 bp, Homo sapiens
gctggctggagtgagctaccct

SEQ ID NO: 7435061 - DNA, 22 bp, Homo sapiens
gctggctggagtgagctaccct

SEQ ID NO: 7435062 - DNA, 22 bp, Homo sapiens
gctggctggagtgagctaccct

SEQ ID NO: 7435063 - DNA, 22 bp, Homo sapiens
gctggctggagtgagctaccct

SEQ ID NO: 7435064 - DNA, 22 bp, Homo sapiens
gctggctggagtgagctaccct

SEQ ID NO: 7435065 - DNA, 22 bp, Homo sapiens
gctggctggagtgagctaccct

SEQ ID NO: 7435066 - DNA, 22 bp, Homo sapiens
gctggctggagtgagctaccct

SEQ ID NO: 7435067 - DNA, 22 bp, Homo sapiens
gctggctggaggtgaggaagaa

SEQ ID NO: 7435068 - DNA, 22 bp, Homo sapiens
gctggctggaggtgaggaagaa

SEQ ID NO: 7435069 - DNA, 22 bp, Homo sapiens
gctggctggaggtgaggaagaa

SEQ ID NO: 7435070 - DNA, 22 bp, Homo sapiens
gctggctggaggtgaggaagaa

SEQ ID NO: 7435071 - DNA, 22 bp, Homo sapiens
gctggctggaggtgaggaagaa

SEQ ID NO: 7435072 - DNA, 22 bp, Homo sapiens
gctggctggaggtgaggaagaa

SEQ ID NO: 7435073 - DNA, 22 bp, Homo sapiens
gctggctggagtaaggagggag

SEQ ID NO: 7435074 - DNA, 22 bp, Homo sapiens
gctggctggagtaaggagggag

SEQ ID NO: 7435075 - DNA, 22 bp, Homo sapiens
gctggctggagtaaggagggag

SEQ ID NO: 7435076 - DNA, 22 bp, Homo sapiens
gctggctggagtaaggagggag

SEQ ID NO: 7435077 - DNA, 22 bp, Homo sapiens
gctggctggagtaaggagggag

SEQ ID NO: 7435078 - DNA, 22 bp, Homo sapiens
gctggctggagtaaggagggag

SEQ ID NO: 7435079 - DNA, 22 bp, Homo sapiens
gctggctggagtaaggagggag

SEQ ID NO: 7435080 - DNA, 22 bp, Homo sapiens
gctggcttaatagggatgggct

SEQ ID NO: 7435081 - DNA, 22 bp, Homo sapiens
gctggcttaatagggatgggct

SEQ ID NO: 7435082 - DNA, 22 bp, Homo sapiens
gctggcttaatagggatgggct

SEQ ID NO: 7435083 - DNA, 22 bp, Homo sapiens
gctggctgttggaggtacctgc

SEQ ID NO: 7435084 - DNA, 22 bp, Homo sapiens
gctggctgttggaggtacctgc

SEQ ID NO: 7435085 - DNA, 22 bp, Homo sapiens
gctggctgttgaataatggcat

SEQ ID NO: 7435086 - DNA, 22 bp, Homo sapiens
gctggctgttggaggtacctgc

SEQ ID NO: 7435087 - DNA, 22 bp, Homo sapiens
gctggctgttggaggtacctgc

SEQ ID NO: 7435088 - DNA, 22 bp, Homo sapiens
gctggctgttggaggtacctgc

SEQ ID NO: 7435089 - DNA, 22 bp, Homo sapiens
gctggctgttggaggtacctgc

SEQ ID NO: 7435090 - DNA, 22 bp, Homo sapiens
gctggcttccctacctgcacct

SEQ ID NO: 7435091 - DNA, 22 bp, Homo sapiens
gctggcttccatcagagggtga

SEQ ID NO: 7435092 - DNA, 22 bp, Homo sapiens
gctggcttccatcagagggtga

SEQ ID NO: 7435093 - DNA, 21 bp, Homo sapiens
gctggcttcctgagggctgag

SEQ ID NO: 7435094 - DNA, 21 bp, Homo sapiens
gctggcttcctgagggctgag

SEQ ID NO: 7435095 - DNA, 21 bp, Homo sapiens
gctggcttcctgagggctgag

SEQ ID NO: 7435096 - DNA, 22 bp, Homo sapiens
gctggcttgacagaggcctggg

SEQ ID NO: 7435097 - DNA, 22 bp, Homo sapiens
gctggcttgacagaggcctggg

SEQ ID NO: 7435098 - DNA, 17 bp, Homo sapiens
gctggcttctccttgct

SEQ ID NO: 7435099 - DNA, 22 bp, Homo sapiens
gctggcttccttctgcagctag

SEQ ID NO: 7435100 - DNA, 22 bp, Homo sapiens
gctggcttccttctgcagctag

SEQ ID NO: 7435101 - DNA, 22 bp, Homo sapiens
gctggcttccttctgcagctag

SEQ ID NO: 7435102 - DNA, 22 bp, Homo sapiens
gctggcttccttctgcagctag

SEQ ID NO: 7435103 - DNA, 22 bp, Homo sapiens
gctggcttgacagaggcctggg

SEQ ID NO: 7435104 - DNA, 22 bp, Homo sapiens
gctggcttgatagtttctgctt

SEQ ID NO: 7435105 - DNA, 18 bp, Homo sapiens
gctggcttgctgggtttg

SEQ ID NO: 7435106 - DNA, 22 bp, Homo sapiens
gctggcttgtcccaggacaaag

SEQ ID NO: 7435107 - DNA, 18 bp, Homo sapiens
gctggcttgctgggtttg

SEQ ID NO: 7435108 - DNA, 22 bp, Homo sapiens
gctggcttgtaataggaatttc

SEQ ID NO: 7435109 - DNA, 22 bp, Homo sapiens
gctggctgttgaataatggcat

SEQ ID NO: 7435110 - DNA, 22 bp, Homo sapiens
gctggctgttgaataatggcat

SEQ ID NO: 7435111 - DNA, 22 bp, Homo sapiens
gctggctgttgaataatggcat

SEQ ID NO: 7435112 - DNA, 22 bp, Homo sapiens
gctggctgttgaataatggcat

SEQ ID NO: 7435113 - DNA, 22 bp, Homo sapiens
gctggctgttgaataatggcat

SEQ ID NO: 7435114 - DNA, 22 bp, Homo sapiens
gctggctgtgtttcatctctga

SEQ ID NO: 7435115 - DNA, 22 bp, Homo sapiens
gctggctgtgttccttctgcca

SEQ ID NO: 7435116 - DNA, 22 bp, Homo sapiens
gctggctgtgtttcatctctga

SEQ ID NO: 7435117 - DNA, 22 bp, Homo sapiens
gctggctgtgtttcatctctga

SEQ ID NO: 7435118 - DNA, 22 bp, Homo sapiens
gctggctgtgtttcatctctga

SEQ ID NO: 7435119 - DNA, 22 bp, Homo sapiens
gctggctgtgttccttctgcca

SEQ ID NO: 7435120 - DNA, 22 bp, Homo sapiens
gctggctgtgggctccacgctc

SEQ ID NO: 7435121 - DNA, 22 bp, Homo sapiens
gctggctgtgttccttctgcca

SEQ ID NO: 7435122 - DNA, 22 bp, Homo sapiens
gctggctgtgttccttctgcca

SEQ ID NO: 7435123 - DNA, 22 bp, Homo sapiens
gctggctgtgttccttctgcca

SEQ ID NO: 7435124 - DNA, 22 bp, Homo sapiens
gctggctgtgttccttctgcca

SEQ ID NO: 7435125 - DNA, 22 bp, Homo sapiens
gctggctgtgtttcatctctga

SEQ ID NO: 7435126 - DNA, 22 bp, Homo sapiens
gctggctgtgtttcatctctga

SEQ ID NO: 7435127 - DNA, 22 bp, Homo sapiens
gctggctgtgttccttctgcca

SEQ ID NO: 7435128 - DNA, 22 bp, Homo sapiens
gctggctgtgttccttctgcca

SEQ ID NO: 7435129 - DNA, 21 bp, Homo sapiens
gctggctggctgaccggcctt

SEQ ID NO: 7435130 - DNA, 21 bp, Homo sapiens
gctggctggctgaccggcctt

SEQ ID NO: 7435131 - DNA, 21 bp, Homo sapiens
gctggctggctgaccggcctt

SEQ ID NO: 7435132 - DNA, 22 bp, Homo sapiens
gctggctggcgggtgcgtcctc

SEQ ID NO: 7435133 - DNA, 22 bp, Homo sapiens
gctggctggcgggtgcgtcctc

SEQ ID NO: 7435134 - DNA, 21 bp, Homo sapiens
gctggctggctgaccggcctt

SEQ ID NO: 7435135 - DNA, 21 bp, Homo sapiens
gctggctggctgaccggcctt

SEQ ID NO: 7435136 - DNA, 21 bp, Homo sapiens
gctggctggctgaccggcctt

SEQ ID NO: 7435137 - DNA, 22 bp, Homo sapiens
gctggctggctgtgcaaaggca

SEQ ID NO: 7435138 - DNA, 21 bp, Homo sapiens
gctggctggctgaccggcctt

SEQ ID NO: 7435139 - DNA, 21 bp, Homo sapiens
gctggctggctgaccggcctt

SEQ ID NO: 7435140 - DNA, 21 bp, Homo sapiens
gctggctggctgaccggcctt

SEQ ID NO: 7435141 - DNA, 22 bp, Homo sapiens
gctggctgtgggctccacgctc

SEQ ID NO: 7435142 - DNA, 22 bp, Homo sapiens
gctggctgtgggctccacgctc

SEQ ID NO: 7435143 - DNA, 22 bp, Homo sapiens
gctggctgtgggctccacgctc

SEQ ID NO: 7435144 - DNA, 22 bp, Homo sapiens
gctggctgtgggctccacgctc

SEQ ID NO: 7435145 - DNA, 22 bp, Homo sapiens
gctggctgtgggctccacgctc

SEQ ID NO: 7435146 - DNA, 22 bp, Homo sapiens
gctggctgtgggctccacgctc

SEQ ID NO: 7435147 - DNA, 22 bp, Homo sapiens
gctggctgtgggctccacgctc

SEQ ID NO: 7435148 - DNA, 22 bp, Homo sapiens
gctggctgtgggctccacgctc

SEQ ID NO: 7435149 - DNA, 22 bp, Homo sapiens
gctggctgtggcttaagcaaac

SEQ ID NO: 7435150 - DNA, 22 bp, Homo sapiens
gctggctgtggcttaagcaaac

SEQ ID NO: 7435151 - DNA, 22 bp, Homo sapiens
gctggctgtgattttgccaaca

SEQ ID NO: 7435152 - DNA, 22 bp, Homo sapiens
gctggctgtgattttgccaaca

SEQ ID NO: 7435153 - DNA, 22 bp, Homo sapiens
gctggctgtggcttaagcaaac

SEQ ID NO: 7435154 - DNA, 22 bp, Homo sapiens
gctggctgtggcttaagcaaac

SEQ ID NO: 7435155 - DNA, 22 bp, Homo sapiens
gctggctgtggcttaagcaaac

SEQ ID NO: 7435156 - DNA, 22 bp, Homo sapiens
gctggctgtggcttaagcaaac

SEQ ID NO: 7435157 - DNA, 22 bp, Homo sapiens
gctggctttgcactgggtgcat

SEQ ID NO: 7435158 - DNA, 22 bp, Homo sapiens
gctggctttgcactgggtgcat

SEQ ID NO: 7435159 - DNA, 22 bp, Homo sapiens
gctggctttgtggtctctcctc

SEQ ID NO: 7435160 - DNA, 22 bp, Homo sapiens
gctggctttgtcaagggcagca

SEQ ID NO: 7435161 - DNA, 21 bp, Homo sapiens
gctggctttattctgcgtttg

SEQ ID NO: 7435162 - DNA, 21 bp, Homo sapiens
gctggctttcctggatgtgca

SEQ ID NO: 7435163 - DNA, 21 bp, Homo sapiens
gctggctttcctggatgtgca

SEQ ID NO: 7435164 - DNA, 22 bp, Homo sapiens
gctggctttatggggcttgtgg

SEQ ID NO: 7435165 - DNA, 22 bp, Homo sapiens
gctggcttgtcccaggacaaag

SEQ ID NO: 7435166 - DNA, 22 bp, Homo sapiens
gctgggctggaaggccaaggca

SEQ ID NO: 7435167 - DNA, 22 bp, Homo sapiens
gctgggctggccgccgagatcg

SEQ ID NO: 7435168 - DNA, 22 bp, Homo sapiens
gctgggctggccgccgagatcg

SEQ ID NO: 7435169 - DNA, 22 bp, Homo sapiens
gctgggctggccgccgagatcg

SEQ ID NO: 7435170 - DNA, 22 bp, Homo sapiens
gctgggctggaaggccaaggca

SEQ ID NO: 7435171 - DNA, 22 bp, Homo sapiens
gctgggctggaaggccaaggca

SEQ ID NO: 7435172 - DNA, 22 bp, Homo sapiens
gctgggctggaaggccaaggca

SEQ ID NO: 7435173 - DNA, 22 bp, Homo sapiens
gctgggctggaaggccaaggca

SEQ ID NO: 7435174 - DNA, 20 bp, Homo sapiens
gctgggaacaggattgaatc

SEQ ID NO: 7435175 - DNA, 22 bp, Homo sapiens
gctgggaacacagccatgagag

SEQ ID NO: 7435176 - DNA, 22 bp, Homo sapiens
gctgggaacacagccatgagag

SEQ ID NO: 7435177 - DNA, 22 bp, Homo sapiens
gctgggaacacagccatgagag

SEQ ID NO: 7435178 - DNA, 22 bp, Homo sapiens
gctgggaacacagccatgagag

SEQ ID NO: 7435179 - DNA, 22 bp, Homo sapiens
gctgggaacacagccatgagag

SEQ ID NO: 7435180 - DNA, 22 bp, Homo sapiens
gctggcttttgaagtctagcta

SEQ ID NO: 7435181 - DNA, 22 bp, Homo sapiens
gctggctttgtggtctctcctc

SEQ ID NO: 7435182 - DNA, 22 bp, Homo sapiens
gctggcttttgaagtctagcta

SEQ ID NO: 7435183 - DNA, 22 bp, Homo sapiens
gctgggcttcacagagccttta

SEQ ID NO: 7435184 - DNA, 22 bp, Homo sapiens
gctgggcttcacagagccttta

SEQ ID NO: 7435185 - DNA, 22 bp, Homo sapiens
gctgggcttcacagagccttta

SEQ ID NO: 7435186 - DNA, 23 bp, Homo sapiens
gctgggcttactctttcagtgag

SEQ ID NO: 7435187 - DNA, 23 bp, Homo sapiens
gctgggcttactctttcagtgag

SEQ ID NO: 7435188 - DNA, 23 bp, Homo sapiens
gctgggcttactctttcagtgag

SEQ ID NO: 7435189 - DNA, 22 bp, Homo sapiens
gctgggctgtagtttgctgacc

SEQ ID NO: 7435190 - DNA, 23 bp, Homo sapiens
gctgggcttactctttcagtgag

SEQ ID NO: 7435191 - DNA, 23 bp, Homo sapiens
gctgggcttactctttcagtgag

SEQ ID NO: 7435192 - DNA, 22 bp, Homo sapiens
gctgggctgtagtttgctgacc

SEQ ID NO: 7435193 - DNA, 22 bp, Homo sapiens
gctgggctgtagtttgctgacc

SEQ ID NO: 7435194 - DNA, 22 bp, Homo sapiens
gctgggctggccgccgagatcg

SEQ ID NO: 7435195 - DNA, 22 bp, Homo sapiens
gctgggctggccgccgagatcg

SEQ ID NO: 7435196 - DNA, 22 bp, Homo sapiens
gctgggctggccgccgagatcg

SEQ ID NO: 7435197 - DNA, 22 bp, Homo sapiens
gctgggctgtagtttgctgacc

SEQ ID NO: 7435198 - DNA, 22 bp, Homo sapiens
gctgggctgtagtttgctgacc

SEQ ID NO: 7435199 - DNA, 22 bp, Homo sapiens
gctgggcttcacctccagagtt

SEQ ID NO: 7435200 - DNA, 22 bp, Homo sapiens
gctgggcttcacctccagagtt

SEQ ID NO: 7435201 - DNA, 22 bp, Homo sapiens
gctgggcttcacctccagagtt

SEQ ID NO: 7435202 - DNA, 22 bp, Homo sapiens
gctgggcttctcaatgctgcct

SEQ ID NO: 7435203 - DNA, 22 bp, Homo sapiens
gctgggcttctcaatgctgcct

SEQ ID NO: 7435204 - DNA, 22 bp, Homo sapiens
gctgggcttctcaatgctgcct

SEQ ID NO: 7435205 - DNA, 22 bp, Homo sapiens
gctgggcttctcaatgctgcct

SEQ ID NO: 7435206 - DNA, 22 bp, Homo sapiens
gctgggcttctcaatgctgcct

SEQ ID NO: 7435207 - DNA, 22 bp, Homo sapiens
gctgggcttctcaatgctgcct

SEQ ID NO: 7435208 - DNA, 22 bp, Homo sapiens
gctgggcttcacagagccttta

SEQ ID NO: 7435209 - DNA, 22 bp, Homo sapiens
gctgggcttcacctccagagtt

SEQ ID NO: 7435210 - DNA, 22 bp, Homo sapiens
gctgggcttcacctccagagtt

SEQ ID NO: 7435211 - DNA, 22 bp, Homo sapiens
gctgggcttcacctccagagtt

SEQ ID NO: 7435212 - DNA, 22 bp, Homo sapiens
gctgggcttcacctccagagtt

SEQ ID NO: 7435213 - DNA, 22 bp, Homo sapiens
gctgggcttcacctccagagtt

SEQ ID NO: 7435214 - DNA, 22 bp, Homo sapiens
gaggccagtgtgctgtgttttc

SEQ ID NO: 7435215 - DNA, 22 bp, Homo sapiens
gaggccagtgaaatgttataaa

SEQ ID NO: 7435216 - DNA, 22 bp, Homo sapiens
gaggccagtgtgctgtgttttc

SEQ ID NO: 7435217 - DNA, 22 bp, Homo sapiens
gaggccagtgaaatgttataaa

SEQ ID NO: 7435218 - DNA, 22 bp, Homo sapiens
gaggccagtgaaatgttataaa

SEQ ID NO: 7435219 - DNA, 22 bp, Homo sapiens
gaggccaggaggatctctctaa

SEQ ID NO: 7435220 - DNA, 22 bp, Homo sapiens
gaggccaggaggatctctctaa

SEQ ID NO: 7435221 - DNA, 22 bp, Homo sapiens
gaggcccaaggactctgtcccg

SEQ ID NO: 7435222 - DNA, 22 bp, Homo sapiens
gaggccatgaatggatgttcct

SEQ ID NO: 7435223 - DNA, 22 bp, Homo sapiens
gaggcccaaggactctgtcccg

SEQ ID NO: 7435224 - DNA, 22 bp, Homo sapiens
gaggcccaaggactctgtcccg

SEQ ID NO: 7435225 - DNA, 22 bp, Homo sapiens
gaggccattcagctgggcagca

SEQ ID NO: 7435226 - DNA, 22 bp, Homo sapiens
gaggccattcagctgggcagca

SEQ ID NO: 7435227 - DNA, 22 bp, Homo sapiens
gaggccattcagctgggcagca

SEQ ID NO: 7435228 - DNA, 22 bp, Homo sapiens
gaggccatgaatggatgttcct

SEQ ID NO: 7435229 - DNA, 22 bp, Homo sapiens
gaggccatgcctcctgatcagt

SEQ ID NO: 7435230 - DNA, 22 bp, Homo sapiens
gaggccatgcctcctgatcagt

SEQ ID NO: 7435231 - DNA, 22 bp, Homo sapiens
gaggccataagaagttcttggg

SEQ ID NO: 7435232 - DNA, 22 bp, Homo sapiens
gaggccataagaagttcttggg

SEQ ID NO: 7435233 - DNA, 22 bp, Homo sapiens
gaggccagtgtgctgtgttttc

SEQ ID NO: 7435234 - DNA, 22 bp, Homo sapiens
gaggccagtgtgctgtgttttc

SEQ ID NO: 7435235 - DNA, 22 bp, Homo sapiens
gaggcccaatgcttccctcctt

SEQ ID NO: 7435236 - DNA, 22 bp, Homo sapiens
gaggcccaatgcttccctcctt

SEQ ID NO: 7435237 - DNA, 22 bp, Homo sapiens
gaggcccacagggagtaccaag

SEQ ID NO: 7435238 - DNA, 22 bp, Homo sapiens
gaggcccacagggagtaccaag

SEQ ID NO: 7435239 - DNA, 22 bp, Homo sapiens
gaggcccacagggagtaccaag

SEQ ID NO: 7435240 - DNA, 22 bp, Homo sapiens
gaggcccacagggagtaccaag

SEQ ID NO: 7435241 - DNA, 20 bp, Homo sapiens
gaggcccagagaggtgaagc

SEQ ID NO: 7435242 - DNA, 20 bp, Homo sapiens
gaggcccagagaggtgaagc

SEQ ID NO: 7435243 - DNA, 20 bp, Homo sapiens
gaggcccagagaggtgaagc

SEQ ID NO: 7435244 - DNA, 20 bp, Homo sapiens
gaggcccagagaggtgaagc

SEQ ID NO: 7435245 - DNA, 20 bp, Homo sapiens
gaggcccagagaggtgaagc

SEQ ID NO: 7435246 - DNA, 22 bp, Homo sapiens
gaggcccagagaggttgcatga

SEQ ID NO: 7435247 - DNA, 22 bp, Homo sapiens
gaggcccagagaggttgcatga

SEQ ID NO: 7435248 - DNA, 22 bp, Homo sapiens
gaggcccagagaggttgcatga

SEQ ID NO: 7435249 - DNA, 20 bp, Homo sapiens
gaggcccagagaggtgaagc

SEQ ID NO: 7435250 - DNA, 20 bp, Homo sapiens
gaggcccagagaggtgaagc

SEQ ID NO: 7435251 - DNA, 22 bp, Homo sapiens
gaggcccagcagcgcaggtctt

SEQ ID NO: 7435252 - DNA, 22 bp, Homo sapiens
gaggcccagcagcgcaggtctt

SEQ ID NO: 7435253 - DNA, 22 bp, Homo sapiens
gaggcccagaggcccaggacgt

SEQ ID NO: 7435254 - DNA, 22 bp, Homo sapiens
gaggcccagaggcccaggacgt

SEQ ID NO: 7435255 - DNA, 22 bp, Homo sapiens
gaggcccagcagcgcaggtctt

SEQ ID NO: 7435256 - DNA, 22 bp, Homo sapiens
gaggcccagcagcgcaggtctt

SEQ ID NO: 7435257 - DNA, 22 bp, Homo sapiens
gaggcccagcagcgcaggtctt

SEQ ID NO: 7435258 - DNA, 22 bp, Homo sapiens
gcaaagacaaattagaactcct

SEQ ID NO: 7435259 - DNA, 22 bp, Homo sapiens
gcaaagacaaattagaactcct

SEQ ID NO: 7435260 - DNA, 22 bp, Homo sapiens
gcaaagacaaattagaactcct

SEQ ID NO: 7435261 - DNA, 22 bp, Homo sapiens
gcaaagacaatttgaatagctt

SEQ ID NO: 7435262 - DNA, 22 bp, Homo sapiens
gcaaagacaatttgaatagctt

SEQ ID NO: 7435263 - DNA, 22 bp, Homo sapiens
gcaaagacaatttgaatagctt

SEQ ID NO: 7435264 - DNA, 22 bp, Homo sapiens
gcaaagacaaattagaactcct

SEQ ID NO: 7435265 - DNA, 22 bp, Homo sapiens
gcaaagaaatgtcagtgagagg

SEQ ID NO: 7435266 - DNA, 22 bp, Homo sapiens
gcaaagaaatgtcagtgagagg

SEQ ID NO: 7435267 - DNA, 22 bp, Homo sapiens
gcaaagactgcaattacttttg

SEQ ID NO: 7435268 - DNA, 22 bp, Homo sapiens
gcaaagactgcaattacttttg

SEQ ID NO: 7435269 - DNA, 22 bp, Homo sapiens
gcaaagactgcaattacttttg

SEQ ID NO: 7435270 - DNA, 23 bp, Homo sapiens
gcaaagactctgccaaaaactgc

SEQ ID NO: 7435271 - DNA, 22 bp, Homo sapiens
gcaaagatattagaatagagta

SEQ ID NO: 7435272 - DNA, 22 bp, Homo sapiens
gcaaagatattagaatagagta

SEQ ID NO: 7435273 - DNA, 22 bp, Homo sapiens
gcaaagacccaggtgtctatcc

SEQ ID NO: 7435274 - DNA, 22 bp, Homo sapiens
gcaaagacccaggtgtctatcc

SEQ ID NO: 7435275 - DNA, 18 bp, Homo sapiens
gcaaagacaggctgggct

SEQ ID NO: 7435276 - DNA, 18 bp, Homo sapiens
gcaaagacaggctgggct

SEQ ID NO: 7435277 - DNA, 22 bp, Homo sapiens
gcaaagacggactcaggagtgc

SEQ ID NO: 7435278 - DNA, 22 bp, Homo sapiens
gcaaagacccaggtgtctatcc

SEQ ID NO: 7435279 - DNA, 23 bp, Homo sapiens
gcaaagactctgccaaaaactgc

SEQ ID NO: 7435280 - DNA, 23 bp, Homo sapiens
gcaaagactctgccaaaaactgc

SEQ ID NO: 7435281 - DNA, 23 bp, Homo sapiens
gcaaagactctgccaaaaactgc

SEQ ID NO: 7435282 - DNA, 22 bp, Homo sapiens
gcaaagacggactcaggagtgc

SEQ ID NO: 7435283 - DNA, 22 bp, Homo sapiens
gcaaagacggactcaggagtgc

SEQ ID NO: 7435284 - DNA, 22 bp, Homo sapiens
gcaaactgttggagtagagtct

SEQ ID NO: 7435285 - DNA, 22 bp, Homo sapiens
gaggcccagcagcgcaggtctt

SEQ ID NO: 7435286 - DNA, 22 bp, Homo sapiens
gaggcccagcagcgcaggtctt

SEQ ID NO: 7435287 - DNA, 22 bp, Homo sapiens
gcaaagaaagccaaggtctaac

SEQ ID NO: 7435288 - DNA, 22 bp, Homo sapiens
gcaaagaaagccaaggtctaac

SEQ ID NO: 7435289 - DNA, 22 bp, Homo sapiens
gcaaactggtagctcgcctgcc

SEQ ID NO: 7435290 - DNA, 22 bp, Homo sapiens
gcaaactgttggagtagagtct

SEQ ID NO: 7435291 - DNA, 22 bp, Homo sapiens
gcaaactgttggagtagagtct

SEQ ID NO: 7435292 - DNA, 22 bp, Homo sapiens
gcaaagaaagccaaggtctaac

SEQ ID NO: 7435293 - DNA, 22 bp, Homo sapiens
gcaaagaaagttttaatgaggt

SEQ ID NO: 7435294 - DNA, 22 bp, Homo sapiens
gcaaagaaagttttaatgaggt

SEQ ID NO: 7435295 - DNA, 22 bp, Homo sapiens
gcaaagaaatgtcagtgagagg

SEQ ID NO: 7435296 - DNA, 22 bp, Homo sapiens
gcaaagaaatgtcagtgagagg

SEQ ID NO: 7435297 - DNA, 22 bp, Homo sapiens
gcaaagcaatcaggagtagcat

SEQ ID NO: 7435298 - DNA, 22 bp, Homo sapiens
gcaaagcacaccctcagagttt

SEQ ID NO: 7435299 - DNA, 22 bp, Homo sapiens
gcaaagcacaccctcagagttt

SEQ ID NO: 7435300 - DNA, 22 bp, Homo sapiens
gcaaagcacaccctcagagttt

SEQ ID NO: 7435301 - DNA, 22 bp, Homo sapiens
gcaaagcacaccctcagagttt

SEQ ID NO: 7435302 - DNA, 22 bp, Homo sapiens
gcaaagcaatcaggagtagcat

SEQ ID NO: 7435303 - DNA, 22 bp, Homo sapiens
gcaaagcaatcaggagtagcat

SEQ ID NO: 7435304 - DNA, 22 bp, Homo sapiens
gcaaagcaatcaggagtagcat

SEQ ID NO: 7435305 - DNA, 22 bp, Homo sapiens
gcaaagcaagctgtcagcctca

SEQ ID NO: 7435306 - DNA, 22 bp, Homo sapiens
gcaaagcaatcaggagtagcat

SEQ ID NO: 7435307 - DNA, 22 bp, Homo sapiens
gcaaagcaaatgcctgaaggcg

SEQ ID NO: 7435308 - DNA, 22 bp, Homo sapiens
gcaaagcaaatgcctgaaggcg

SEQ ID NO: 7435309 - DNA, 22 bp, Homo sapiens
gcaaagcaagattcagatgtag

SEQ ID NO: 7435310 - DNA, 22 bp, Homo sapiens
gcaaagcaaatgcctgaaggcg

SEQ ID NO: 7435311 - DNA, 22 bp, Homo sapiens
gcaaagcaagattcagatgtag

SEQ ID NO: 7435312 - DNA, 22 bp, Homo sapiens
gcaaagcaagctgtcagcctca

SEQ ID NO: 7435313 - DNA, 22 bp, Homo sapiens
gcaaagcaagattcagatgtag

SEQ ID NO: 7435314 - DNA, 22 bp, Homo sapiens
gcaaagcatcagtagaaatgtt

SEQ ID NO: 7435315 - DNA, 22 bp, Homo sapiens
gcaaagcatcagtagaaatgtt

SEQ ID NO: 7435316 - DNA, 22 bp, Homo sapiens
gcaaagcagtcttctgtgccta

SEQ ID NO: 7435317 - DNA, 22 bp, Homo sapiens
gcaaagcacactggagatgtcg

SEQ ID NO: 7435318 - DNA, 22 bp, Homo sapiens
gcaaagcacactggagatgtcg

SEQ ID NO: 7435319 - DNA, 22 bp, Homo sapiens
gcaaagcagaaccctctctatc

SEQ ID NO: 7435320 - DNA, 22 bp, Homo sapiens
gcaaagcacactggagatgtcg

SEQ ID NO: 7435321 - DNA, 22 bp, Homo sapiens
gcaaagcagaaccctctctatc

SEQ ID NO: 7435322 - DNA, 22 bp, Homo sapiens
gcaaagcatcagtagaaatgtt

SEQ ID NO: 7435323 - DNA, 22 bp, Homo sapiens
gcaaagcatcagtagaaatgtt

SEQ ID NO: 7435324 - DNA, 22 bp, Homo sapiens
gcaaagcatcagtagaaatgtt

SEQ ID NO: 7435325 - DNA, 22 bp, Homo sapiens
gcaaagctgggtgtgaatgcac

SEQ ID NO: 7435326 - DNA, 22 bp, Homo sapiens
gcaaagctgggtgtgaatgcac

SEQ ID NO: 7435327 - DNA, 22 bp, Homo sapiens
gcaaagcattctgtggagtcta

SEQ ID NO: 7435328 - DNA, 22 bp, Homo sapiens
gcaaagcattctgtggagtcta

SEQ ID NO: 7435329 - DNA, 22 bp, Homo sapiens
gcaaagcattctgtggagtcta

SEQ ID NO: 7435330 - DNA, 22 bp, Homo sapiens
gcaaagtgaaatggggcagaga

SEQ ID NO: 7435331 - DNA, 22 bp, Homo sapiens
gcaaagtctgcatctggatcag

SEQ ID NO: 7435332 - DNA, 22 bp, Homo sapiens
gcaaagtattaagtattaagtt

SEQ ID NO: 7435333 - DNA, 22 bp, Homo sapiens
gcaaagtctcaagacccaagtg

SEQ ID NO: 7435334 - DNA, 22 bp, Homo sapiens
gcaaagtgcttcagtgggagct

SEQ ID NO: 7435335 - DNA, 22 bp, Homo sapiens
gcaaagtgaaatggggcagaga

SEQ ID NO: 7435336 - DNA, 22 bp, Homo sapiens
gcaaagtgaaatggggcagaga

SEQ ID NO: 7435337 - DNA, 21 bp, Homo sapiens
gcaaagtgtgggcataaacag

SEQ ID NO: 7435338 - DNA, 21 bp, Homo sapiens
gcaaagtgtgggcataaacag

SEQ ID NO: 7435339 - DNA, 22 bp, Homo sapiens
gcaaataatatactttgatctc

SEQ ID NO: 7435340 - DNA, 22 bp, Homo sapiens
gcaaataatatactttgatctc

SEQ ID NO: 7435341 - DNA, 22 bp, Homo sapiens
gcaaataatatactttgatctc

SEQ ID NO: 7435342 - DNA, 22 bp, Homo sapiens
gcaaataatatactttgatctc

SEQ ID NO: 7435343 - DNA, 22 bp, Homo sapiens
gcaaataaatgctcactgctgt

SEQ ID NO: 7435344 - DNA, 22 bp, Homo sapiens
gcaaatacatgttgagcaccta

SEQ ID NO: 7435345 - DNA, 22 bp, Homo sapiens
gcaaatagaagattctgttgac

SEQ ID NO: 7435346 - DNA, 22 bp, Homo sapiens
gcaaatacatgttgagcaccta

SEQ ID NO: 7435347 - DNA, 22 bp, Homo sapiens
gcaaatacatgttgagcaccta

SEQ ID NO: 7435348 - DNA, 22 bp, Homo sapiens
gcaaaggcttcttttattctcc

SEQ ID NO: 7435349 - DNA, 22 bp, Homo sapiens
gcaaaggcttcttttattctcc

SEQ ID NO: 7435350 - DNA, 22 bp, Homo sapiens
gcaaagggaaagtggcagggtc

SEQ ID NO: 7435351 - DNA, 22 bp, Homo sapiens
gcaaagggaaagtggcagggtc

SEQ ID NO: 7435352 - DNA, 22 bp, Homo sapiens
gcaaaggctagagacacaggga

SEQ ID NO: 7435353 - DNA, 22 bp, Homo sapiens
gcaaaggctagagacacaggga

SEQ ID NO: 7435354 - DNA, 22 bp, Homo sapiens
gcaaaggctagagacacaggga

SEQ ID NO: 7435355 - DNA, 22 bp, Homo sapiens
gcaaagggaaagtggcagggtc

SEQ ID NO: 7435356 - DNA, 22 bp, Homo sapiens
gcaaagggaaagtggcagggtc

SEQ ID NO: 7435357 - DNA, 17 bp, Homo sapiens
gcaaaggtgaggagaga

SEQ ID NO: 7435358 - DNA, 22 bp, Homo sapiens
gcaaaggtagccaaggagctca

SEQ ID NO: 7435359 - DNA, 22 bp, Homo sapiens
gcaaagtaaagggttccagata

SEQ ID NO: 7435360 - DNA, 22 bp, Homo sapiens
gcaaagtattaaccaacaggat

SEQ ID NO: 7435361 - DNA, 22 bp, Homo sapiens
gcaaagtaaaaatagattctga

SEQ ID NO: 7435362 - DNA, 22 bp, Homo sapiens
gcaaagtaaaaatagattctga

SEQ ID NO: 7435363 - DNA, 22 bp, Homo sapiens
gcacactcctggatcctagaga

SEQ ID NO: 7435364 - DNA, 22 bp, Homo sapiens
gcacactcctggatcctagaga

SEQ ID NO: 7435365 - DNA, 22 bp, Homo sapiens
gcacactcctggatcctagaga

SEQ ID NO: 7435366 - DNA, 22 bp, Homo sapiens
gcacactgcggtgatgtgagtc

SEQ ID NO: 7435367 - DNA, 22 bp, Homo sapiens
gcacactgcggtgatgtgagtc

SEQ ID NO: 7435368 - DNA, 22 bp, Homo sapiens
gcacactgcggtgatgtgagtc

SEQ ID NO: 7435369 - DNA, 22 bp, Homo sapiens
gcacactggagcctggaagatt

SEQ ID NO: 7435370 - DNA, 22 bp, Homo sapiens
gcacactgtgaatttgcatatg

SEQ ID NO: 7435371 - DNA, 22 bp, Homo sapiens
gcacactggagcctggaagatt

SEQ ID NO: 7435372 - DNA, 22 bp, Homo sapiens
gcacacttaatactcactgtgc

SEQ ID NO: 7435373 - DNA, 22 bp, Homo sapiens
gcacacttaatactcactgtgc

SEQ ID NO: 7435374 - DNA, 22 bp, Homo sapiens
gcacagaaatgtctacacatgt

SEQ ID NO: 7435375 - DNA, 22 bp, Homo sapiens
gcacacggcagcctcctcctga

SEQ ID NO: 7435376 - DNA, 19 bp, Homo sapiens
gcacacgttgtgcttgagc

SEQ ID NO: 7435377 - DNA, 22 bp, Homo sapiens
gcacaccttagaggggagctgc

SEQ ID NO: 7435378 - DNA, 19 bp, Homo sapiens
gcacaccctgcaccaccat

SEQ ID NO: 7435379 - DNA, 19 bp, Homo sapiens
gcacaccctgcaccaccat

SEQ ID NO: 7435380 - DNA, 22 bp, Homo sapiens
gcacaccctctcaccagcactg

SEQ ID NO: 7435381 - DNA, 19 bp, Homo sapiens
gcacaccctgcaccaccat

SEQ ID NO: 7435382 - DNA, 22 bp, Homo sapiens
gcacaccctctcaccagcactg

SEQ ID NO: 7435383 - DNA, 22 bp, Homo sapiens
gcacaccctctcaccagcactg

SEQ ID NO: 7435384 - DNA, 22 bp, Homo sapiens
gcacaggccatgggaggacagc

SEQ ID NO: 7435385 - DNA, 22 bp, Homo sapiens
gcacaggctccggaggagagct

SEQ ID NO: 7435386 - DNA, 22 bp, Homo sapiens
gcacaggctccggaggagagct

SEQ ID NO: 7435387 - DNA, 22 bp, Homo sapiens
gcacaggctccggaggagagct

SEQ ID NO: 7435388 - DNA, 22 bp, Homo sapiens
gcacaggctccggaggagagct

SEQ ID NO: 7435389 - DNA, 22 bp, Homo sapiens
gcacaggctccggaggagagct

SEQ ID NO: 7435390 - DNA, 22 bp, Homo sapiens
gcacaggccatgggaggacagc

SEQ ID NO: 7435391 - DNA, 22 bp, Homo sapiens
gcacaggccatgggaggacagc

SEQ ID NO: 7435392 - DNA, 22 bp, Homo sapiens
gcacagaaccagacatgaggca

SEQ ID NO: 7435393 - DNA, 22 bp, Homo sapiens
gcacagaaccagacatgaggca

SEQ ID NO: 7435394 - DNA, 22 bp, Homo sapiens
gcacagaacagagaaatagcca

SEQ ID NO: 7435395 - DNA, 22 bp, Homo sapiens
gcacagaacagagaaatagcca

SEQ ID NO: 7435396 - DNA, 22 bp, Homo sapiens
gcacagaacagagaaatagcca

SEQ ID NO: 7435397 - DNA, 22 bp, Homo sapiens
gcacagaacagagaaatagcca

SEQ ID NO: 7435398 - DNA, 22 bp, Homo sapiens
gcacagaacactggtgagtccc

SEQ ID NO: 7435399 - DNA, 22 bp, Homo sapiens
gcacagaacactggtgagtccc

SEQ ID NO: 7435400 - DNA, 22 bp, Homo sapiens
gcacagaacagagaaatagcca

SEQ ID NO: 7435401 - DNA, 22 bp, Homo sapiens
gcacagaacagagaaatagcca

SEQ ID NO: 7435402 - DNA, 22 bp, Homo sapiens
gcacagaacactggtgagtccc

SEQ ID NO: 7435403 - DNA, 22 bp, Homo sapiens
gcacagaaatgtctacacatgt

SEQ ID NO: 7435404 - DNA, 22 bp, Homo sapiens
gcacagaaatgtctacacatgt

SEQ ID NO: 7435405 - DNA, 22 bp, Homo sapiens
gcacagaaatgtctacacatgt

SEQ ID NO: 7435406 - DNA, 22 bp, Homo sapiens
gcacagaaatgtctacacatgt

SEQ ID NO: 7435407 - DNA, 22 bp, Homo sapiens
gcacaggtaatccgaatcattc

SEQ ID NO: 7435408 - DNA, 22 bp, Homo sapiens
gcacagggctgccaggcggctt

SEQ ID NO: 7435409 - DNA, 22 bp, Homo sapiens
gcacagggctgccaggcggctt

SEQ ID NO: 7435410 - DNA, 22 bp, Homo sapiens
gcacagggctgccaggcggctt

SEQ ID NO: 7435411 - DNA, 22 bp, Homo sapiens
gcacagggctgccaggcggctt

SEQ ID NO: 7435412 - DNA, 22 bp, Homo sapiens
gcacagggctgccaggcggctt

SEQ ID NO: 7435413 - DNA, 22 bp, Homo sapiens
gcacagggctgccaggcggctt

SEQ ID NO: 7435414 - DNA, 22 bp, Homo sapiens
gcacagggctgccaggcggctt

SEQ ID NO: 7435415 - DNA, 22 bp, Homo sapiens
gcacagggctgccaggcggctt

SEQ ID NO: 7435416 - DNA, 22 bp, Homo sapiens
gcacagggctgccaggcggctt

SEQ ID NO: 7435417 - DNA, 22 bp, Homo sapiens
gcacagggctgccaggcggctt

SEQ ID NO: 7435418 - DNA, 22 bp, Homo sapiens
gcacagggctgccaggcggctt

SEQ ID NO: 7435419 - DNA, 22 bp, Homo sapiens
gcacaggctctcttggggacac

SEQ ID NO: 7435420 - DNA, 22 bp, Homo sapiens
gcacaggctctcttggggacac

SEQ ID NO: 7435421 - DNA, 22 bp, Homo sapiens
gcacaggctccggaggagagct

SEQ ID NO: 7435422 - DNA, 22 bp, Homo sapiens
gcacaggctccggaggagagct

SEQ ID NO: 7435423 - DNA, 22 bp, Homo sapiens
gcacaggctccggaggagagct

SEQ ID NO: 7435424 - DNA, 22 bp, Homo sapiens
gcacaggctccggaggagagct

SEQ ID NO: 7435425 - DNA, 22 bp, Homo sapiens
gcacaggtcaggagatgagatt

SEQ ID NO: 7435426 - DNA, 22 bp, Homo sapiens
gcacaggtcaggagatgagatt

SEQ ID NO: 7435427 - DNA, 22 bp, Homo sapiens
gcacaggttgtacttgggcacc

SEQ ID NO: 7435428 - DNA, 22 bp, Homo sapiens
gcacaggttgcaaaagttcaca

SEQ ID NO: 7435429 - DNA, 22 bp, Homo sapiens
gcacaggttgcaaaagttcaca

SEQ ID NO: 7435430 - DNA, 22 bp, Homo sapiens
gcacaggttgcaaaagttcaca

SEQ ID NO: 7435431 - DNA, 22 bp, Homo sapiens
gcacagtacctgtcacagaggc

SEQ ID NO: 7435432 - DNA, 22 bp, Homo sapiens
gcacagtacctgtcacagaggc

SEQ ID NO: 7435433 - DNA, 21 bp, Homo sapiens
gcacagtaagaaaagctgcct

SEQ ID NO: 7435434 - DNA, 21 bp, Homo sapiens
gcacagtaagaaaagctgcct

SEQ ID NO: 7435435 - DNA, 22 bp, Homo sapiens
gcacagtaggctcagctctatc

SEQ ID NO: 7435436 - DNA, 22 bp, Homo sapiens
gcacagtaggctcagctctatc

SEQ ID NO: 7435437 - DNA, 20 bp, Homo sapiens
gcacagtagcagtgcaaatg

SEQ ID NO: 7435438 - DNA, 22 bp, Homo sapiens
gcacagtgataggcagttgtgc

SEQ ID NO: 7435439 - DNA, 22 bp, Homo sapiens
gcacagtgataggcagttgtgc

SEQ ID NO: 7435440 - DNA, 22 bp, Homo sapiens
gcacagtgataggcagttgtgc

SEQ ID NO: 7435441 - DNA, 22 bp, Homo sapiens
gcacagtcaacacttattcacc

SEQ ID NO: 7435442 - DNA, 22 bp, Homo sapiens
gcacagtatttagtagaatgag

SEQ ID NO: 7435443 - DNA, 22 bp, Homo sapiens
gcacagtatttagtagaatgag

SEQ ID NO: 7435444 - DNA, 22 bp, Homo sapiens
gcacagtgataggcagttgtgc

SEQ ID NO: 7435445 - DNA, 22 bp, Homo sapiens
gcacagtgataggcagttgtgc

SEQ ID NO: 7435446 - DNA, 22 bp, Homo sapiens
gcacagtatttagtagaatgag

SEQ ID NO: 7435447 - DNA, 22 bp, Homo sapiens
gcacagtatttagtagaatgag

SEQ ID NO: 7435448 - DNA, 22 bp, Homo sapiens
gcacagtattgcacaactctag

SEQ ID NO: 7435449 - DNA, 22 bp, Homo sapiens
gcacagtattgcacaactctag

SEQ ID NO: 7435450 - DNA, 22 bp, Homo sapiens
gcacagtaggtatttacccagt

SEQ ID NO: 7435451 - DNA, 22 bp, Homo sapiens
gcacagtaggtatttacccagt

SEQ ID NO: 7435452 - DNA, 22 bp, Homo sapiens
gcaaatattcaagacttttcca

SEQ ID NO: 7435453 - DNA, 22 bp, Homo sapiens
gcaaatattcaagacttttcca

SEQ ID NO: 7435454 - DNA, 22 bp, Homo sapiens
gcaaatattcaagacttttcca

SEQ ID NO: 7435455 - DNA, 22 bp, Homo sapiens
gcaaatattcaagacttttcca

SEQ ID NO: 7435456 - DNA, 22 bp, Homo sapiens
gcaaatcaccacctagctggat

SEQ ID NO: 7435457 - DNA, 22 bp, Homo sapiens
gcaaatcaccacctagctggat

SEQ ID NO: 7435458 - DNA, 22 bp, Homo sapiens
gcacacactgttttcctcacat

SEQ ID NO: 7435459 - DNA, 22 bp, Homo sapiens
gcacacactgttttcctcacat

SEQ ID NO: 7435460 - DNA, 22 bp, Homo sapiens
gcacacactgttttcctcacat

SEQ ID NO: 7435461 - DNA, 22 bp, Homo sapiens
gcacacagaatcagtgggcata

SEQ ID NO: 7435462 - DNA, 22 bp, Homo sapiens
gcacacagaacatttggatcct

SEQ ID NO: 7435463 - DNA, 22 bp, Homo sapiens
gcacacagaacatttggatcct

SEQ ID NO: 7435464 - DNA, 22 bp, Homo sapiens
gcaaatatttctaattcctgaa

SEQ ID NO: 7435465 - DNA, 22 bp, Homo sapiens
gcacacagaacatttggatcct

SEQ ID NO: 7435466 - DNA, 22 bp, Homo sapiens
gcacacagaatcagtgggcata

SEQ ID NO: 7435467 - DNA, 22 bp, Homo sapiens
gcacacagaatcagtgggcata

SEQ ID NO: 7435468 - DNA, 22 bp, Homo sapiens
gcacacagaatcagtgggcata

SEQ ID NO: 7435469 - DNA, 22 bp, Homo sapiens
gcacacagaatcagtgggcata

SEQ ID NO: 7435470 - DNA, 22 bp, Homo sapiens
gcacacagaatcagtgggcata

SEQ ID NO: 7435471 - DNA, 22 bp, Homo sapiens
gcacacagtactatatgctaca

SEQ ID NO: 7435472 - DNA, 22 bp, Homo sapiens
gcacacagtagggattcaatga

SEQ ID NO: 7435473 - DNA, 22 bp, Homo sapiens
gcacacagtagggattcaatga

SEQ ID NO: 7435474 - DNA, 22 bp, Homo sapiens
gcacacagtagggattcaatga

SEQ ID NO: 7435475 - DNA, 22 bp, Homo sapiens
gcacacagtactatatgctaca

SEQ ID NO: 7435476 - DNA, 22 bp, Homo sapiens
gcacacagtactatatgctaca

SEQ ID NO: 7435477 - DNA, 19 bp, Homo sapiens
gcacacagtagggctggca

SEQ ID NO: 7435478 - DNA, 22 bp, Homo sapiens
gcacacagtagggattcaatga

SEQ ID NO: 7435479 - DNA, 19 bp, Homo sapiens
gcacacagtagggctggca

SEQ ID NO: 7435480 - DNA, 19 bp, Homo sapiens
gcacacagtagggctggca

SEQ ID NO: 7435481 - DNA, 19 bp, Homo sapiens
gcacacagtagggctggca

SEQ ID NO: 7435482 - DNA, 19 bp, Homo sapiens
gcacacagtagggctggca

SEQ ID NO: 7435483 - DNA, 19 bp, Homo sapiens
gcacacagtagggctggca

SEQ ID NO: 7435484 - DNA, 22 bp, Homo sapiens
gcacacatgcgtgtatatgggt

SEQ ID NO: 7435485 - DNA, 22 bp, Homo sapiens
gcacacatgcgtgtatatgggt

SEQ ID NO: 7435486 - DNA, 22 bp, Homo sapiens
gcacacatgtgagtgtcctttc

SEQ ID NO: 7435487 - DNA, 22 bp, Homo sapiens
gcacacattcggattcttaacc

SEQ ID NO: 7435488 - DNA, 22 bp, Homo sapiens
gcacacattcggattcttaacc

SEQ ID NO: 7435489 - DNA, 22 bp, Homo sapiens
gcacacattcggattcttaacc

SEQ ID NO: 7435490 - DNA, 22 bp, Homo sapiens
gcacacattctagccttttgtg

SEQ ID NO: 7435491 - DNA, 22 bp, Homo sapiens
gcacacattctagccttttgtg

SEQ ID NO: 7435492 - DNA, 22 bp, Homo sapiens
gcacacatgcatgcacaggagt

SEQ ID NO: 7435493 - DNA, 22 bp, Homo sapiens
gcacacatgcatgcacaggagt

SEQ ID NO: 7435494 - DNA, 22 bp, Homo sapiens
gcacacatgcatgtgtgcatcc

SEQ ID NO: 7435495 - DNA, 22 bp, Homo sapiens
gcacacatgcatgtgtgcatcc

SEQ ID NO: 7435496 - DNA, 22 bp, Homo sapiens
gcacacatgcatgtgtgcatcc

SEQ ID NO: 7435497 - DNA, 22 bp, Homo sapiens
gcacacatcttgtaatcctgag

SEQ ID NO: 7435498 - DNA, 22 bp, Homo sapiens
gcacacatcttgtaatcctgag

SEQ ID NO: 7435499 - DNA, 22 bp, Homo sapiens
gcacacatatatatgagcatgt

SEQ ID NO: 7435500 - DNA, 22 bp, Homo sapiens
gcacacatatatatgagcatgt

SEQ ID NO: 7435501 - DNA, 22 bp, Homo sapiens
gcacacatatatatgagcatgt

SEQ ID NO: 7435502 - DNA, 22 bp, Homo sapiens
gcacacatatatatgagcatgt

SEQ ID NO: 7435503 - DNA, 20 bp, Homo sapiens
gcacacatagaaatgcatat

SEQ ID NO: 7435504 - DNA, 20 bp, Homo sapiens
gcacacatagaaatgcatat

SEQ ID NO: 7435505 - DNA, 19 bp, Homo sapiens
gcacacatacaccctttgg

SEQ ID NO: 7435506 - DNA, 19 bp, Homo sapiens
gcacacatacaccctttgg

SEQ ID NO: 7435507 - DNA, 22 bp, Homo sapiens
gcacacagtatatgctcattaa

SEQ ID NO: 7435508 - DNA, 22 bp, Homo sapiens
gcacacagtatatgctcattaa

SEQ ID NO: 7435509 - DNA, 19 bp, Homo sapiens
gcacacagtagggctggca

SEQ ID NO: 7435510 - DNA, 19 bp, Homo sapiens
gcacacagtagggctggca

SEQ ID NO: 7435511 - DNA, 22 bp, Homo sapiens
gcacacagtatatgctcattaa

SEQ ID NO: 7435512 - DNA, 22 bp, Homo sapiens
gcagagcagagcctgcattggc

SEQ ID NO: 7435513 - DNA, 22 bp, Homo sapiens
gcagagcagagcctgcattggc

SEQ ID NO: 7435514 - DNA, 22 bp, Homo sapiens
gcagagcagagcctgcattggc

SEQ ID NO: 7435515 - DNA, 18 bp, Homo sapiens
gcagagcagaagctcaag

SEQ ID NO: 7435516 - DNA, 18 bp, Homo sapiens
gcagagcagaagctcaag

SEQ ID NO: 7435517 - DNA, 22 bp, Homo sapiens
gcagagcagagcctgcattggc

SEQ ID NO: 7435518 - DNA, 22 bp, Homo sapiens
gcagagcagagcctgcattggc

SEQ ID NO: 7435519 - DNA, 22 bp, Homo sapiens
gcagagcagaggtgcaggttgg

SEQ ID NO: 7435520 - DNA, 22 bp, Homo sapiens
gcagagcagcaaatggaaagga

SEQ ID NO: 7435521 - DNA, 22 bp, Homo sapiens
gcagagcagaggtgcaggttgg

SEQ ID NO: 7435522 - DNA, 22 bp, Homo sapiens
gcagagcagaggtgcaggttgg

SEQ ID NO: 7435523 - DNA, 22 bp, Homo sapiens
gcagagcaggaaggaagtcagg

SEQ ID NO: 7435524 - DNA, 22 bp, Homo sapiens
gcagagcaggaaggaagtcagg

SEQ ID NO: 7435525 - DNA, 22 bp, Homo sapiens
gcagagcaggaaggaagtcagg

SEQ ID NO: 7435526 - DNA, 22 bp, Homo sapiens
gcagagcaggaaggaagtcagg

SEQ ID NO: 7435527 - DNA, 22 bp, Homo sapiens
gcagagcagcaaatggaaagga

SEQ ID NO: 7435528 - DNA, 22 bp, Homo sapiens
gcagagcagcaaatggaaagga

SEQ ID NO: 7435529 - DNA, 22 bp, Homo sapiens
gcagagcagcaaatggaaagga

SEQ ID NO: 7435530 - DNA, 22 bp, Homo sapiens
gcagagcagcaaatggaaagga

SEQ ID NO: 7435531 - DNA, 22 bp, Homo sapiens
gcagagcaggggctgaacctgg

SEQ ID NO: 7435532 - DNA, 22 bp, Homo sapiens
gcagagcaggggctgaacctgg

SEQ ID NO: 7435533 - DNA, 22 bp, Homo sapiens
gcagagcaggggctgaacctgg

SEQ ID NO: 7435534 - DNA, 22 bp, Homo sapiens
gcagagcagggattttgccata

SEQ ID NO: 7435535 - DNA, 22 bp, Homo sapiens
gcagagcagggattttgccata

SEQ ID NO: 7435536 - DNA, 22 bp, Homo sapiens
gcagagcagtactctcttgact

SEQ ID NO: 7435537 - DNA, 22 bp, Homo sapiens
gcagagcagtactctcttgact

SEQ ID NO: 7435538 - DNA, 22 bp, Homo sapiens
gcagagcagtactctcttgact

SEQ ID NO: 7435539 - DNA, 22 bp, Homo sapiens
gcagagcagtactctcttgact

SEQ ID NO: 7435540 - DNA, 22 bp, Homo sapiens
gcagagcagtactctcttgact

SEQ ID NO: 7435541 - DNA, 22 bp, Homo sapiens
gcagagcagtactctcttgact

SEQ ID NO: 7435542 - DNA, 22 bp, Homo sapiens
gcagaggaggacccaggaatta

SEQ ID NO: 7435543 - DNA, 22 bp, Homo sapiens
gcagaggagtgattatgccgtg

SEQ ID NO: 7435544 - DNA, 22 bp, Homo sapiens
gcagaggagtgattatgccgtg

SEQ ID NO: 7435545 - DNA, 22 bp, Homo sapiens
gcagaggagtgattatgccgtg

SEQ ID NO: 7435546 - DNA, 22 bp, Homo sapiens
gcagaggagtgattatgccgtg

SEQ ID NO: 7435547 - DNA, 22 bp, Homo sapiens
gcagaggagtgattatgccgtg

SEQ ID NO: 7435548 - DNA, 22 bp, Homo sapiens
gcagaggatagcatatgaacct

SEQ ID NO: 7435549 - DNA, 22 bp, Homo sapiens
gcagaggatagcatatgaacct

SEQ ID NO: 7435550 - DNA, 22 bp, Homo sapiens
gcagaggatagcatatgaacct

SEQ ID NO: 7435551 - DNA, 22 bp, Homo sapiens
gcagaggagtgattatgccgtg

SEQ ID NO: 7435552 - DNA, 22 bp, Homo sapiens
gcagaggatagcatatgaacct

SEQ ID NO: 7435553 - DNA, 22 bp, Homo sapiens
gcagaggatcaggctctggaaa

SEQ ID NO: 7435554 - DNA, 22 bp, Homo sapiens
gcagaggatcaggctctggaaa

SEQ ID NO: 7435555 - DNA, 22 bp, Homo sapiens
gcagaggatcaggctctggaaa

SEQ ID NO: 7435556 - DNA, 22 bp, Homo sapiens
gcagaggatcaggctctggaaa

SEQ ID NO: 7435557 - DNA, 22 bp, Homo sapiens
gcagaggatcaggctctggaaa

SEQ ID NO: 7435558 - DNA, 22 bp, Homo sapiens
gcagaggatcaggctctggaaa

SEQ ID NO: 7435559 - DNA, 22 bp, Homo sapiens
gcagaggatcaggctctggaaa

SEQ ID NO: 7435560 - DNA, 22 bp, Homo sapiens
gcagaggatagcatatgaacct

SEQ ID NO: 7435561 - DNA, 22 bp, Homo sapiens
gcagaggatcaggctctggaaa

SEQ ID NO: 7435562 - DNA, 22 bp, Homo sapiens
gcagaggatagcatatgaacct

SEQ ID NO: 7435563 - DNA, 22 bp, Homo sapiens
gcagaggatagcatatgaacct

SEQ ID NO: 7435564 - DNA, 22 bp, Homo sapiens
gcagaggatagcatatgaacct

SEQ ID NO: 7435565 - DNA, 22 bp, Homo sapiens
gcagaggatcaggctctggaaa

SEQ ID NO: 7435566 - DNA, 22 bp, Homo sapiens
gcagaggcacagccccagatga

SEQ ID NO: 7435567 - DNA, 22 bp, Homo sapiens
gcagaggcacagccccagatga

SEQ ID NO: 7435568 - DNA, 22 bp, Homo sapiens
gcagaggcacagccccagatga

SEQ ID NO: 7435569 - DNA, 22 bp, Homo sapiens
gcagaggatcaggctctggaaa

SEQ ID NO: 7435570 - DNA, 22 bp, Homo sapiens
gcagaggatcaggctctggaaa

SEQ ID NO: 7435571 - DNA, 22 bp, Homo sapiens
gcagaggatcaggctctggaaa

SEQ ID NO: 7435572 - DNA, 22 bp, Homo sapiens
gcagaggatcaggctctggaaa

SEQ ID NO: 7435573 - DNA, 22 bp, Homo sapiens
gcagaggatcaggctctggaaa

SEQ ID NO: 7435574 - DNA, 22 bp, Homo sapiens
gcagaggcagggccctcctcca

SEQ ID NO: 7435575 - DNA, 22 bp, Homo sapiens
gcagaggcagggccctcctcca

SEQ ID NO: 7435576 - DNA, 22 bp, Homo sapiens
gcagaggcagggccctcctcca

SEQ ID NO: 7435577 - DNA, 22 bp, Homo sapiens
gcagaggcagggccctcctcca

SEQ ID NO: 7435578 - DNA, 22 bp, Homo sapiens
gcagaggcagggccctcctcca

SEQ ID NO: 7435579 - DNA, 22 bp, Homo sapiens
gcagaggcagggccctcctcca

SEQ ID NO: 7435580 - DNA, 22 bp, Homo sapiens
gcagaggcatttctgacgctgc

SEQ ID NO: 7435581 - DNA, 22 bp, Homo sapiens
gcagaggcatttctgacgctgc

SEQ ID NO: 7435582 - DNA, 22 bp, Homo sapiens
gcagaggcatttctgacgctgc

SEQ ID NO: 7435583 - DNA, 21 bp, Homo sapiens
gcagaggcacggcaccaaggg

SEQ ID NO: 7435584 - DNA, 21 bp, Homo sapiens
gcagaggcacggcaccaaggg

SEQ ID NO: 7435585 - DNA, 21 bp, Homo sapiens
gcagaggcacggcaccaaggg

SEQ ID NO: 7435586 - DNA, 21 bp, Homo sapiens
gcagaggcacggcaccaaggg

SEQ ID NO: 7435587 - DNA, 22 bp, Homo sapiens
gcagaggcacagccccagatga

SEQ ID NO: 7435588 - DNA, 22 bp, Homo sapiens
gcagaggcacagccccagatga

SEQ ID NO: 7435589 - DNA, 21 bp, Homo sapiens
gcagaggcacggcaccaaggg

SEQ ID NO: 7435590 - DNA, 21 bp, Homo sapiens
gcagaggcacggcaccaaggg

SEQ ID NO: 7435591 - DNA, 21 bp, Homo sapiens
gcagaggcacggcaccaaggg

SEQ ID NO: 7435592 - DNA, 22 bp, Homo sapiens
gcagagggtcctgtgccagcag

SEQ ID NO: 7435593 - DNA, 22 bp, Homo sapiens
gcagagggtcctgtgccagcag

SEQ ID NO: 7435594 - DNA, 22 bp, Homo sapiens
gcagagggtcctgtgccagcag

SEQ ID NO: 7435595 - DNA, 22 bp, Homo sapiens
gcagagggtcctgtgccagcag

SEQ ID NO: 7435596 - DNA, 22 bp, Homo sapiens
gcagagggtcctgtgccagcag

SEQ ID NO: 7435597 - DNA, 22 bp, Homo sapiens
gcagagggtcctgtgccagcag

SEQ ID NO: 7435598 - DNA, 22 bp, Homo sapiens
gcagaggtcaaatacctcattt

SEQ ID NO: 7435599 - DNA, 22 bp, Homo sapiens
gcagaggtcctagccaggagtc

SEQ ID NO: 7435600 - DNA, 22 bp, Homo sapiens
gcagaggtcaaatacctcattt

SEQ ID NO: 7435601 - DNA, 22 bp, Homo sapiens
gcagaggtcctagccaggagtc

SEQ ID NO: 7435602 - DNA, 22 bp, Homo sapiens
gcagaggtcctagccaggagtc

SEQ ID NO: 7435603 - DNA, 22 bp, Homo sapiens
gcagaggtcctagccaggagtc

SEQ ID NO: 7435604 - DNA, 22 bp, Homo sapiens
gcagaggtcctagccaggagtc

SEQ ID NO: 7435605 - DNA, 22 bp, Homo sapiens
gcagaggtcctagccaggagtc

SEQ ID NO: 7435606 - DNA, 22 bp, Homo sapiens
gcagaggccaggccaccagcaa

SEQ ID NO: 7435607 - DNA, 22 bp, Homo sapiens
gcagaggccaggccaccagcaa

SEQ ID NO: 7435608 - DNA, 22 bp, Homo sapiens
gcagaggccaggccaccagcaa

SEQ ID NO: 7435609 - DNA, 22 bp, Homo sapiens
gcagaggccaggccaccagcaa

SEQ ID NO: 7435610 - DNA, 22 bp, Homo sapiens
gcagaggccaggccaccagcaa

SEQ ID NO: 7435611 - DNA, 22 bp, Homo sapiens
gcagaggccaggccaccagcaa

SEQ ID NO: 7435612 - DNA, 22 bp, Homo sapiens
gcagaggccaggccaccagcaa

SEQ ID NO: 7435613 - DNA, 22 bp, Homo sapiens
gcagaggcatttctgacgctgc

SEQ ID NO: 7435614 - DNA, 22 bp, Homo sapiens
gcagaggcatttctgacgctgc

SEQ ID NO: 7435615 - DNA, 22 bp, Homo sapiens
gcagaggcatttctgacgctgc

SEQ ID NO: 7435616 - DNA, 22 bp, Homo sapiens
gcagaggccaggccaccagcaa

SEQ ID NO: 7435617 - DNA, 22 bp, Homo sapiens
gcagaggccaggccaccagcaa

SEQ ID NO: 7435618 - DNA, 22 bp, Homo sapiens
gcagaggccatcaactttgcca

SEQ ID NO: 7435619 - DNA, 22 bp, Homo sapiens
gcagagggggtacttcggccct

SEQ ID NO: 7435620 - DNA, 22 bp, Homo sapiens
gcagagggggtacttcggccct

SEQ ID NO: 7435621 - DNA, 22 bp, Homo sapiens
gcagagggggtacttcggccct

SEQ ID NO: 7435622 - DNA, 22 bp, Homo sapiens
gcagaggggaagctgaggaatt

SEQ ID NO: 7435623 - DNA, 22 bp, Homo sapiens
gcagaggggaagctgaggaatt

SEQ ID NO: 7435624 - DNA, 22 bp, Homo sapiens
gcagagttcctggaaagcaacc

SEQ ID NO: 7435625 - DNA, 22 bp, Homo sapiens
gcagatggaaagtgcttgaggg

SEQ ID NO: 7435626 - DNA, 22 bp, Homo sapiens
gcagatggaaagtgcttgaggg

SEQ ID NO: 7435627 - DNA, 22 bp, Homo sapiens
gcagatggagacgaggttccgc

SEQ ID NO: 7435628 - DNA, 22 bp, Homo sapiens
gcagatggactgtatgacctga

SEQ ID NO: 7435629 - DNA, 22 bp, Homo sapiens
gcagatggactgtatgacctga

SEQ ID NO: 7435630 - DNA, 22 bp, Homo sapiens
gcagatggagataaatggaact

SEQ ID NO: 7435631 - DNA, 20 bp, Homo sapiens
gcagagtgtgagagggtgaa

SEQ ID NO: 7435632 - DNA, 20 bp, Homo sapiens
gcagagtgtgagagggtgaa

SEQ ID NO: 7435633 - DNA, 22 bp, Homo sapiens
gcagagtggtttcagagttgag

SEQ ID NO: 7435634 - DNA, 22 bp, Homo sapiens
gcagagttcctggaaagcaacc

SEQ ID NO: 7435635 - DNA, 22 bp, Homo sapiens
gcagagttcagtgacttggcct

SEQ ID NO: 7435636 - DNA, 20 bp, Homo sapiens
gcagagtgtgagagggtgaa

SEQ ID NO: 7435637 - DNA, 20 bp, Homo sapiens
gcagagtgtgagagggtgaa

SEQ ID NO: 7435638 - DNA, 20 bp, Homo sapiens
gcagagtgtgagagggtgaa

SEQ ID NO: 7435639 - DNA, 20 bp, Homo sapiens
gcagagtgtgagagggtgaa

SEQ ID NO: 7435640 - DNA, 20 bp, Homo sapiens
gcagagtgtgagagggtgaa

SEQ ID NO: 7435641 - DNA, 20 bp, Homo sapiens
gcagagtgtgagagggtgaa

SEQ ID NO: 7435642 - DNA, 22 bp, Homo sapiens
gcagaggtctcttcaaaataat

SEQ ID NO: 7435643 - DNA, 22 bp, Homo sapiens
gcagaggtgaccagcagcaggg

SEQ ID NO: 7435644 - DNA, 22 bp, Homo sapiens
gcagaggtgaccagcagcaggg

SEQ ID NO: 7435645 - DNA, 22 bp, Homo sapiens
gcagaggtgaccagcagcaggg

SEQ ID NO: 7435646 - DNA, 22 bp, Homo sapiens
gcagaggtgaccagcagcaggg

SEQ ID NO: 7435647 - DNA, 22 bp, Homo sapiens
gcagaggtgaccagcagcaggg

SEQ ID NO: 7435648 - DNA, 22 bp, Homo sapiens
gcagaggtgaccagcagcaggg

SEQ ID NO: 7435649 - DNA, 22 bp, Homo sapiens
gcagaggtcctagccaggagtc

SEQ ID NO: 7435650 - DNA, 22 bp, Homo sapiens
gcagaggtctagcaccaagaat

SEQ ID NO: 7435651 - DNA, 22 bp, Homo sapiens
gcagaggtctagcaccaagaat

SEQ ID NO: 7435652 - DNA, 22 bp, Homo sapiens
gcagaggtctagcaccaagaat

SEQ ID NO: 7435653 - DNA, 22 bp, Homo sapiens
gcagaggtctcttcaaaataat

SEQ ID NO: 7435654 - DNA, 22 bp, Homo sapiens
gcagaggtgagaagggcctccc

SEQ ID NO: 7435655 - DNA, 22 bp, Homo sapiens
gcagaggtgagaagggcctccc

SEQ ID NO: 7435656 - DNA, 19 bp, Homo sapiens
gcagagtggggtggagggt

SEQ ID NO: 7435657 - DNA, 22 bp, Homo sapiens
gcagaggtgagtttctcagctg

SEQ ID NO: 7435658 - DNA, 22 bp, Homo sapiens
gcagagtggtttcagagttgag

SEQ ID NO: 7435659 - DNA, 22 bp, Homo sapiens
gcagagtggtttcagagttgag

SEQ ID NO: 7435660 - DNA, 22 bp, Homo sapiens
gcacatatgctgtaagcacatg

SEQ ID NO: 7435661 - DNA, 22 bp, Homo sapiens
gcacatactgcaaagattacta

SEQ ID NO: 7435662 - DNA, 22 bp, Homo sapiens
gcacatactgcaaagattacta

SEQ ID NO: 7435663 - DNA, 23 bp, Homo sapiens
gcacatactacacagaaaatggc

SEQ ID NO: 7435664 - DNA, 23 bp, Homo sapiens
gcacatagtaagtaagcagacat

SEQ ID NO: 7435665 - DNA, 22 bp, Homo sapiens
gcacatatgctgtaagcacatg

SEQ ID NO: 7435666 - DNA, 23 bp, Homo sapiens
gcacatagtaagtaagcagacat

SEQ ID NO: 7435667 - DNA, 22 bp, Homo sapiens
gcacatatgctgtaagcacatg

SEQ ID NO: 7435668 - DNA, 22 bp, Homo sapiens
gcacatccaatgattgttttga

SEQ ID NO: 7435669 - DNA, 22 bp, Homo sapiens
gcacatcagccactttgaatgg

SEQ ID NO: 7435670 - DNA, 22 bp, Homo sapiens
gcacatcagccactttgaatgg

SEQ ID NO: 7435671 - DNA, 22 bp, Homo sapiens
gcacatatgtaaatagctgcct

SEQ ID NO: 7435672 - DNA, 22 bp, Homo sapiens
gcacatacacataagcgaactg

SEQ ID NO: 7435673 - DNA, 22 bp, Homo sapiens
gcacatacacataagcgaactg

SEQ ID NO: 7435674 - DNA, 22 bp, Homo sapiens
gcacatacatattagtgtcaca

SEQ ID NO: 7435675 - DNA, 22 bp, Homo sapiens
gcacatacatattagtgtcaca

SEQ ID NO: 7435676 - DNA, 22 bp, Homo sapiens
gcacataaagggcatgggaggt

SEQ ID NO: 7435677 - DNA, 22 bp, Homo sapiens
gcacatacatattagtgtcaca

SEQ ID NO: 7435678 - DNA, 22 bp, Homo sapiens
gcacatacatattagtgtcaca

SEQ ID NO: 7435679 - DNA, 22 bp, Homo sapiens
gcacataccccaggaatggtag

SEQ ID NO: 7435680 - DNA, 22 bp, Homo sapiens
gcacataccccaggaatggtag

SEQ ID NO: 7435681 - DNA, 23 bp, Homo sapiens
gcacatactacacagaaaatggc

SEQ ID NO: 7435682 - DNA, 23 bp, Homo sapiens
gcacatactacacagaaaatggc

SEQ ID NO: 7435683 - DNA, 19 bp, Homo sapiens
gcagacaggtccagagagg

SEQ ID NO: 7435684 - DNA, 19 bp, Homo sapiens
gcagacaggtccagagagg

SEQ ID NO: 7435685 - DNA, 19 bp, Homo sapiens
gcagacaggtccagagagg

SEQ ID NO: 7435686 - DNA, 19 bp, Homo sapiens
gcagacaggtccagagagg

SEQ ID NO: 7435687 - DNA, 22 bp, Homo sapiens
gcagacaggggcttaggaaagg

SEQ ID NO: 7435688 - DNA, 20 bp, Homo sapiens
gcacatgcaacttttattta

SEQ ID NO: 7435689 - DNA, 22 bp, Homo sapiens
gcacatgcaacagagattttca

SEQ ID NO: 7435690 - DNA, 22 bp, Homo sapiens
gcacatgagttaagctggggca

SEQ ID NO: 7435691 - DNA, 21 bp, Homo sapiens
gcacatgagggagggcatgcc

SEQ ID NO: 7435692 - DNA, 22 bp, Homo sapiens
gcacatgaggctgtctttgtct

SEQ ID NO: 7435693 - DNA, 22 bp, Homo sapiens
gcacatgactttgaggaaacca

SEQ ID NO: 7435694 - DNA, 22 bp, Homo sapiens
gcacatctggagctctgtggaa

SEQ ID NO: 7435695 - DNA, 22 bp, Homo sapiens
gcacatgacagtaagtagagca

SEQ ID NO: 7435696 - DNA, 21 bp, Homo sapiens
gcacagtgccaggcacacagt

SEQ ID NO: 7435697 - DNA, 21 bp, Homo sapiens
gcacagtgccaggcacacagt

SEQ ID NO: 7435698 - DNA, 22 bp, Homo sapiens
gcacagtgcaccactttgaaaa

SEQ ID NO: 7435699 - DNA, 22 bp, Homo sapiens
gcacagtgcaccactttgaaaa

SEQ ID NO: 7435700 - DNA, 21 bp, Homo sapiens
gcacagtgccaggcacacagt

SEQ ID NO: 7435701 - DNA, 17 bp, Homo sapiens
gcacagtgatattattt

SEQ ID NO: 7435702 - DNA, 22 bp, Homo sapiens
gcacagtgataggcagttgtgc

SEQ ID NO: 7435703 - DNA, 17 bp, Homo sapiens
gcacagtgatattattt

SEQ ID NO: 7435704 - DNA, 22 bp, Homo sapiens
gcacagtgcaccactttgaaaa

SEQ ID NO: 7435705 - DNA, 22 bp, Homo sapiens
gcacagtgcaccactttgaaaa

SEQ ID NO: 7435706 - DNA, 22 bp, Homo sapiens
gcacagtgatgtcagaattgga

SEQ ID NO: 7435707 - DNA, 22 bp, Homo sapiens
gcacagtgatgtcagaattgga

SEQ ID NO: 7435708 - DNA, 17 bp, Homo sapiens
gcacagtgatattattt

SEQ ID NO: 7435709 - DNA, 22 bp, Homo sapiens
gcacagtgggtggtcatgtaca

SEQ ID NO: 7435710 - DNA, 22 bp, Homo sapiens
gcacagtgggtggtcatgtaca

SEQ ID NO: 7435711 - DNA, 22 bp, Homo sapiens
gcacagtggagtgtgtccaggg

SEQ ID NO: 7435712 - DNA, 22 bp, Homo sapiens
gcacagtgctgctaagattgag

SEQ ID NO: 7435713 - DNA, 22 bp, Homo sapiens
gcacagtggagtgtgtccaggg

SEQ ID NO: 7435714 - DNA, 22 bp, Homo sapiens
gcacagtggagtgtgtccaggg

SEQ ID NO: 7435715 - DNA, 21 bp, Homo sapiens
gcacagtgccaggcacacagt

SEQ ID NO: 7435716 - DNA, 22 bp, Homo sapiens
gcacagtggtgaaagcatgggt

SEQ ID NO: 7435717 - DNA, 22 bp, Homo sapiens
gcacagtgggtggtcatgtaca

SEQ ID NO: 7435718 - DNA, 22 bp, Homo sapiens
gcacagtggtgaaagcatgggt

SEQ ID NO: 7435719 - DNA, 22 bp, Homo sapiens
gcacagtggtgaaagcatgggt

SEQ ID NO: 7435720 - DNA, 22 bp, Homo sapiens
gcacataaagggcatgggaggt

SEQ ID NO: 7435721 - DNA, 22 bp, Homo sapiens
gcacataaagggcatgggaggt

SEQ ID NO: 7435722 - DNA, 20 bp, Homo sapiens
gcacagtttgggaaccatgg

SEQ ID NO: 7435723 - DNA, 22 bp, Homo sapiens
gcacagttgtgacaaccatcgc

SEQ ID NO: 7435724 - DNA, 22 bp, Homo sapiens
gcacagttgatttatgctggtg

SEQ ID NO: 7435725 - DNA, 22 bp, Homo sapiens
gcacagttgccattagccacat

SEQ ID NO: 7435726 - DNA, 22 bp, Homo sapiens
gcacagttgacaatgattaaga

SEQ ID NO: 7435727 - DNA, 22 bp, Homo sapiens
gcacagttctctcagtctccag

SEQ ID NO: 7435728 - DNA, 22 bp, Homo sapiens
gcacagttaaagggtcatgtga

SEQ ID NO: 7435729 - DNA, 22 bp, Homo sapiens
gcacagttaaagggtcatgtga

SEQ ID NO: 7435730 - DNA, 22 bp, Homo sapiens
gcacagttgagacttcacagct

SEQ ID NO: 7435731 - DNA, 22 bp, Homo sapiens
gcacagttgacaatgattaaga

SEQ ID NO: 7435732 - DNA, 22 bp, Homo sapiens
gcacagttgagacttcacagct

SEQ ID NO: 7435733 - DNA, 22 bp, Homo sapiens
gcacagtgtaccacagtcccta

SEQ ID NO: 7435734 - DNA, 22 bp, Homo sapiens
gcacagtgtaccacagtcccta

SEQ ID NO: 7435735 - DNA, 22 bp, Homo sapiens
gcacagtgtaccacagtcccta

SEQ ID NO: 7435736 - DNA, 22 bp, Homo sapiens
gcacagttaaagggtcatgtga

SEQ ID NO: 7435737 - DNA, 22 bp, Homo sapiens
gcagagaaggattgaaaccaga

SEQ ID NO: 7435738 - DNA, 22 bp, Homo sapiens
gcagagaagatgcccaggcttc

SEQ ID NO: 7435739 - DNA, 22 bp, Homo sapiens
gcagagaagatgcccaggcttc

SEQ ID NO: 7435740 - DNA, 22 bp, Homo sapiens
gcagagaagatgcccaggcttc

SEQ ID NO: 7435741 - DNA, 22 bp, Homo sapiens
gcagagaagatgcccaggcttc

SEQ ID NO: 7435742 - DNA, 22 bp, Homo sapiens
gcagagattgtaatgatacctg

SEQ ID NO: 7435743 - DNA, 22 bp, Homo sapiens
gcagagattgtaatgatacctg

SEQ ID NO: 7435744 - DNA, 22 bp, Homo sapiens
gcagagaagatgcccaggcttc

SEQ ID NO: 7435745 - DNA, 22 bp, Homo sapiens
gcagagaaggattgaaaccaga

SEQ ID NO: 7435746 - DNA, 22 bp, Homo sapiens
gcagagatttcagtaacagcag

SEQ ID NO: 7435747 - DNA, 22 bp, Homo sapiens
gcagagatttcagtaacagcag

SEQ ID NO: 7435748 - DNA, 22 bp, Homo sapiens
gcagagcaccaaagtgaaagat

SEQ ID NO: 7435749 - DNA, 22 bp, Homo sapiens
gcagagcaccaaagtgaaagat

SEQ ID NO: 7435750 - DNA, 22 bp, Homo sapiens
gcagagcaccaaagtgaaagat

SEQ ID NO: 7435751 - DNA, 18 bp, Homo sapiens
gcagagcagaagctcaag

SEQ ID NO: 7435752 - DNA, 18 bp, Homo sapiens
gcagagcagaagctcaag

SEQ ID NO: 7435753 - DNA, 22 bp, Homo sapiens
gcagagcaccctgcagtggtat

SEQ ID NO: 7435754 - DNA, 22 bp, Homo sapiens
gcagagcaccctgcagtggtat

SEQ ID NO: 7435755 - DNA, 22 bp, Homo sapiens
gcagagcaccaaagtgaaagat

SEQ ID NO: 7435756 - DNA, 22 bp, Homo sapiens
gcagagcaccaaagtgaaagat

SEQ ID NO: 7435757 - DNA, 22 bp, Homo sapiens
gcagagcaccctgcagtggtat

SEQ ID NO: 7435758 - DNA, 22 bp, Homo sapiens
gcagagcaccctgcagtggtat

SEQ ID NO: 7435759 - DNA, 22 bp, Homo sapiens
gcagagaagatgcccaggcttc

SEQ ID NO: 7435760 - DNA, 22 bp, Homo sapiens
gcagagaagatgcccaggcttc

SEQ ID NO: 7435761 - DNA, 22 bp, Homo sapiens
gcagagaacccagcagattggc

SEQ ID NO: 7435762 - DNA, 22 bp, Homo sapiens
gcagagaacccagcagattggc

SEQ ID NO: 7435763 - DNA, 22 bp, Homo sapiens
gcagagaagatgcccaggcttc

SEQ ID NO: 7435764 - DNA, 22 bp, Homo sapiens
gcagagaacccagcagattggc

SEQ ID NO: 7435765 - DNA, 22 bp, Homo sapiens
gcagagaacccagcagattggc

SEQ ID NO: 7435766 - DNA, 22 bp, Homo sapiens
gcagagaacccagcagattggc

SEQ ID NO: 7435767 - DNA, 22 bp, Homo sapiens
gcagagaacccagcagattggc

SEQ ID NO: 7435768 - DNA, 22 bp, Homo sapiens
gcagagaacccagcagattggc

SEQ ID NO: 7435769 - DNA, 22 bp, Homo sapiens
gcagagaaagttttgtcctcag

SEQ ID NO: 7435770 - DNA, 22 bp, Homo sapiens
gcagagaaagttttgtcctcag

SEQ ID NO: 7435771 - DNA, 22 bp, Homo sapiens
gcagagaaagttttgtcctcag

SEQ ID NO: 7435772 - DNA, 22 bp, Homo sapiens
gcagagaaagttttgtcctcag

SEQ ID NO: 7435773 - DNA, 22 bp, Homo sapiens
gcagagaaagttttgtcctcag

SEQ ID NO: 7435774 - DNA, 22 bp, Homo sapiens
gcagagaaagttttgtcctcag

SEQ ID NO: 7435775 - DNA, 22 bp, Homo sapiens
gcagagaaagttttgtcctcag

SEQ ID NO: 7435776 - DNA, 22 bp, Homo sapiens
gcagagaaagttttgtcctcag

SEQ ID NO: 7435777 - DNA, 22 bp, Homo sapiens
gcagactgtatcaatgtcagta

SEQ ID NO: 7435778 - DNA, 22 bp, Homo sapiens
gcagactgtatcaatgtcagta

SEQ ID NO: 7435779 - DNA, 22 bp, Homo sapiens
gcagagaaagttttgtcctcag

SEQ ID NO: 7435780 - DNA, 22 bp, Homo sapiens
gcagagaaagttttgtcctcag

SEQ ID NO: 7435781 - DNA, 22 bp, Homo sapiens
gcagacggagtatcttgtacat

SEQ ID NO: 7435782 - DNA, 22 bp, Homo sapiens
gcagacctgaccttgggcagca

SEQ ID NO: 7435783 - DNA, 22 bp, Homo sapiens
gcagaccctgaactgggcatgg

SEQ ID NO: 7435784 - DNA, 22 bp, Homo sapiens
gcagacgtcaccgagtcgatgg

SEQ ID NO: 7435785 - DNA, 22 bp, Homo sapiens
gcagactctgagagtgagtgcc

SEQ ID NO: 7435786 - DNA, 21 bp, Homo sapiens
gcagactgccctgctgtcccc

SEQ ID NO: 7435787 - DNA, 22 bp, Homo sapiens
gcagacctcaggacatcattag

SEQ ID NO: 7435788 - DNA, 22 bp, Homo sapiens
gcagaccagcccctggagctgc

SEQ ID NO: 7435789 - DNA, 22 bp, Homo sapiens
gcagaccagcccctggagctgc

SEQ ID NO: 7435790 - DNA, 22 bp, Homo sapiens
gcagacctcaggacatcattag

SEQ ID NO: 7435791 - DNA, 22 bp, Homo sapiens
gcagaccagcccctggagctgc

SEQ ID NO: 7435792 - DNA, 22 bp, Homo sapiens
gcagacatgttcctttctgtca

SEQ ID NO: 7435793 - DNA, 22 bp, Homo sapiens
gcagacatgttcctttctgtca

SEQ ID NO: 7435794 - DNA, 22 bp, Homo sapiens
gcagacattttgaatctaggct

SEQ ID NO: 7435795 - DNA, 22 bp, Homo sapiens
gcagacatgtgttctaacagga

SEQ ID NO: 7435796 - DNA, 22 bp, Homo sapiens
gcagacatgtgttctaacagga

SEQ ID NO: 7435797 - DNA, 22 bp, Homo sapiens
gcagacatgtgttctaacagga

SEQ ID NO: 7435798 - DNA, 22 bp, Homo sapiens
gcagacatcacctcagtgctat

SEQ ID NO: 7435799 - DNA, 22 bp, Homo sapiens
gcagacatacttctttttgtac

SEQ ID NO: 7435800 - DNA, 22 bp, Homo sapiens
gcagacatacttctttttgtac

SEQ ID NO: 7435801 - DNA, 19 bp, Homo sapiens
gcagacaggtccagagagg

SEQ ID NO: 7435802 - DNA, 22 bp, Homo sapiens
gcagacatgaccaccaaccagg

SEQ ID NO: 7435803 - DNA, 22 bp, Homo sapiens
gcagacatgggatctattcaca

SEQ ID NO: 7435804 - DNA, 22 bp, Homo sapiens
gcagacatgggatctattcaca

SEQ ID NO: 7435805 - DNA, 22 bp, Homo sapiens
gcagactgtacctggaagaggg

SEQ ID NO: 7435806 - DNA, 22 bp, Homo sapiens
gcagactgtacctggaagaggg

SEQ ID NO: 7435807 - DNA, 22 bp, Homo sapiens
gcagactgtacctggaagaggg

SEQ ID NO: 7435808 - DNA, 22 bp, Homo sapiens
gcagactgtatcaatgtcagta

SEQ ID NO: 7435809 - DNA, 22 bp, Homo sapiens
gcagactgtacctggaagaggg

SEQ ID NO: 7435810 - DNA, 22 bp, Homo sapiens
gcagactgtacctggaagaggg

SEQ ID NO: 7435811 - DNA, 22 bp, Homo sapiens
gcagactgtacactggactttg

SEQ ID NO: 7435812 - DNA, 22 bp, Homo sapiens
gcagactggtcttcagccttgg

SEQ ID NO: 7435813 - DNA, 22 bp, Homo sapiens
gcagactgtacactggactttg

SEQ ID NO: 7435814 - DNA, 22 bp, Homo sapiens
gcagactgtacactggactttg

SEQ ID NO: 7435815 - DNA, 22 bp, Homo sapiens
gcagactgcgagcgtgctggtg

SEQ ID NO: 7435816 - DNA, 22 bp, Homo sapiens
gcagactgcgagcgtgctggtg

SEQ ID NO: 7435817 - DNA, 22 bp, Homo sapiens
gcagactgcgagcgtgctggtg

SEQ ID NO: 7435818 - DNA, 21 bp, Homo sapiens
gcagactgccctgctgtcccc

SEQ ID NO: 7435819 - DNA, 21 bp, Homo sapiens
gcagactgccctgctgtcccc

SEQ ID NO: 7435820 - DNA, 21 bp, Homo sapiens
gcagactgccctgctgtcccc

SEQ ID NO: 7435821 - DNA, 22 bp, Homo sapiens
gcagactggataggtttggtag

SEQ ID NO: 7435822 - DNA, 22 bp, Homo sapiens
gcagactggtcttcagccttgg

SEQ ID NO: 7435823 - DNA, 22 bp, Homo sapiens
gcagactgcgtgaggcgccgcc

SEQ ID NO: 7435824 - DNA, 22 bp, Homo sapiens
gcagactgcgtgaggcgccgcc

SEQ ID NO: 7435825 - DNA, 17 bp, Homo sapiens
gcagactgcgggtcccc

SEQ ID NO: 7435826 - DNA, 17 bp, Homo sapiens
gcagactgcgggtcccc

SEQ ID NO: 7435827 - DNA, 22 bp, Homo sapiens
gcagactgcgagcgtgctggtg

SEQ ID NO: 7435828 - DNA, 22 bp, Homo sapiens
gcagactgcgagcgtgctggtg

SEQ ID NO: 7435829 - DNA, 20 bp, Homo sapiens
gcagctgtgcattcttagga

SEQ ID NO: 7435830 - DNA, 22 bp, Homo sapiens
gcagctgtcggaaagctaagtg

SEQ ID NO: 7435831 - DNA, 20 bp, Homo sapiens
gcagctgtgcattcttagga

SEQ ID NO: 7435832 - DNA, 19 bp, Homo sapiens
gcagctgtgggaagagcca

SEQ ID NO: 7435833 - DNA, 22 bp, Homo sapiens
gcagctttctgcaatgtcatcc

SEQ ID NO: 7435834 - DNA, 22 bp, Homo sapiens
gcagctttctaagctttattgc

SEQ ID NO: 7435835 - DNA, 22 bp, Homo sapiens
gcagctttctacttcctacagc

SEQ ID NO: 7435836 - DNA, 22 bp, Homo sapiens
gcagctttgaagacttatttgc

SEQ ID NO: 7435837 - DNA, 22 bp, Homo sapiens
gcagctttgtaaagtatgaagc

SEQ ID NO: 7435838 - DNA, 22 bp, Homo sapiens
gcagctttcttgccctaatctt

SEQ ID NO: 7435839 - DNA, 22 bp, Homo sapiens
gcagctttcttgccctaatctt

SEQ ID NO: 7435840 - DNA, 22 bp, Homo sapiens
gcagctttctttttgcatgtct

SEQ ID NO: 7435841 - DNA, 22 bp, Homo sapiens
gcagcctctgatgatggccgta

SEQ ID NO: 7435842 - DNA, 22 bp, Homo sapiens
gcagcctccgcactgcgagtcc

SEQ ID NO: 7435843 - DNA, 22 bp, Homo sapiens
gcagcctcagggcactcagatg

SEQ ID NO: 7435844 - DNA, 22 bp, Homo sapiens
gcagcctcagggcactcagatg

SEQ ID NO: 7435845 - DNA, 22 bp, Homo sapiens
gcagcctccgcactgcgagtcc

SEQ ID NO: 7435846 - DNA, 22 bp, Homo sapiens
gcagcctccgcactgcgagtcc

SEQ ID NO: 7435847 - DNA, 22 bp, Homo sapiens
gcagcctccgcactgcgagtcc

SEQ ID NO: 7435848 - DNA, 22 bp, Homo sapiens
gcagctgtcgctaggagctgtg

SEQ ID NO: 7435849 - DNA, 22 bp, Homo sapiens
gcagctgtcggaaagctaagtg

SEQ ID NO: 7435850 - DNA, 22 bp, Homo sapiens
gcagctgtcgctaggagctgtg

SEQ ID NO: 7435851 - DNA, 22 bp, Homo sapiens
gcagctgtcatttacaacaggg

SEQ ID NO: 7435852 - DNA, 22 bp, Homo sapiens
gcagctgtcatttacaacaggg

SEQ ID NO: 7435853 - DNA, 22 bp, Homo sapiens
gcagctgtcatttacaacaggg

SEQ ID NO: 7435854 - DNA, 22 bp, Homo sapiens
gcagctgtcatttacaacaggg

SEQ ID NO: 7435855 - DNA, 22 bp, Homo sapiens
gcagcctctgatgatggccgta

SEQ ID NO: 7435856 - DNA, 22 bp, Homo sapiens
gcagctgtcatttacaacaggg

SEQ ID NO: 7435857 - DNA, 22 bp, Homo sapiens
gcagctgtcgctaggagctgtg

SEQ ID NO: 7435858 - DNA, 22 bp, Homo sapiens
gcagctgtcgctaggagctgtg

SEQ ID NO: 7435859 - DNA, 22 bp, Homo sapiens
gcagccctggcctggcctactt

SEQ ID NO: 7435860 - DNA, 22 bp, Homo sapiens
gcagccctggcctggcctactt

SEQ ID NO: 7435861 - DNA, 22 bp, Homo sapiens
gcagccctggcctggcctactt

SEQ ID NO: 7435862 - DNA, 22 bp, Homo sapiens
gcagccctgcaggcagctccag

SEQ ID NO: 7435863 - DNA, 22 bp, Homo sapiens
gcagccctgcaggcagctccag

SEQ ID NO: 7435864 - DNA, 22 bp, Homo sapiens
gcagccctgcaggcagctccag

SEQ ID NO: 7435865 - DNA, 22 bp, Homo sapiens
gcagccctgcaggcagctccag

SEQ ID NO: 7435866 - DNA, 22 bp, Homo sapiens
gcagccctgcaggcagctccag

SEQ ID NO: 7435867 - DNA, 22 bp, Homo sapiens
gcagccctgcagctccacaccg

SEQ ID NO: 7435868 - DNA, 22 bp, Homo sapiens
gcagccctgcaggcagctccag

SEQ ID NO: 7435869 - DNA, 22 bp, Homo sapiens
gcagccctgcaggcagctccag

SEQ ID NO: 7435870 - DNA, 22 bp, Homo sapiens
gcagccctgcaggcagctccag

SEQ ID NO: 7435871 - DNA, 22 bp, Homo sapiens
gcagcccttcaggtgaggggca

SEQ ID NO: 7435872 - DNA, 22 bp, Homo sapiens
gcagcccttcaggtgaggggca

SEQ ID NO: 7435873 - DNA, 22 bp, Homo sapiens
gcagccctttctgggcagggga

SEQ ID NO: 7435874 - DNA, 22 bp, Homo sapiens
gcagccctttctgggcagggga

SEQ ID NO: 7435875 - DNA, 22 bp, Homo sapiens
gcagccctttctgggcagggga

SEQ ID NO: 7435876 - DNA, 22 bp, Homo sapiens
gcagcccttcaggtgaggggca

SEQ ID NO: 7435877 - DNA, 20 bp, Homo sapiens
gcagccgtggagactaggag

SEQ ID NO: 7435878 - DNA, 20 bp, Homo sapiens
gcagccgtggagactaggag

SEQ ID NO: 7435879 - DNA, 20 bp, Homo sapiens
gcagccgtggagactaggag

SEQ ID NO: 7435880 - DNA, 22 bp, Homo sapiens
gcagcctcaaactccccagctc

SEQ ID NO: 7435881 - DNA, 22 bp, Homo sapiens
gcagcctcaaactccccagctc

SEQ ID NO: 7435882 - DNA, 22 bp, Homo sapiens
gcagcctcaaactccccagctc

SEQ ID NO: 7435883 - DNA, 22 bp, Homo sapiens
gcagcctcaaactccccagctc

SEQ ID NO: 7435884 - DNA, 20 bp, Homo sapiens
gcagcctcaacaggcacagc

SEQ ID NO: 7435885 - DNA, 20 bp, Homo sapiens
gcagcctcaacaggcacagc

SEQ ID NO: 7435886 - DNA, 20 bp, Homo sapiens
gcagcctcaacaggcacagc

SEQ ID NO: 7435887 - DNA, 20 bp, Homo sapiens
gcagcctcaacaggcacagc

SEQ ID NO: 7435888 - DNA, 20 bp, Homo sapiens
gcagcctcaacaggcacagc

SEQ ID NO: 7435889 - DNA, 20 bp, Homo sapiens
gcagcctcaacaggcacagc

SEQ ID NO: 7435890 - DNA, 20 bp, Homo sapiens
gcagcctcaacaggcacagc

SEQ ID NO: 7435891 - DNA, 22 bp, Homo sapiens
gcagcctcagggcactcagatg

SEQ ID NO: 7435892 - DNA, 22 bp, Homo sapiens
gcagcctcagggcactcagatg

SEQ ID NO: 7435893 - DNA, 22 bp, Homo sapiens
gcagcctcagggcactcagatg

SEQ ID NO: 7435894 - DNA, 22 bp, Homo sapiens
gcagcctcagggcactcagatg

SEQ ID NO: 7435895 - DNA, 22 bp, Homo sapiens
gcaggaacccggccgccctggc

SEQ ID NO: 7435896 - DNA, 22 bp, Homo sapiens
gcaggaaccccgggaggctggc

SEQ ID NO: 7435897 - DNA, 22 bp, Homo sapiens
gcaggaaccccgggaggctggc

SEQ ID NO: 7435898 - DNA, 22 bp, Homo sapiens
gcaggaaccactgcccccctgt

SEQ ID NO: 7435899 - DNA, 22 bp, Homo sapiens
gcaggaacccagacaaccaggg

SEQ ID NO: 7435900 - DNA, 21 bp, Homo sapiens
gcaggaacaggtcatgatctg

SEQ ID NO: 7435901 - DNA, 22 bp, Homo sapiens
gcaggaacagtttatctctggc

SEQ ID NO: 7435902 - DNA, 22 bp, Homo sapiens
gcaggaacagtttatctctggc

SEQ ID NO: 7435903 - DNA, 22 bp, Homo sapiens
gcaggaacagtttatctctggc

SEQ ID NO: 7435904 - DNA, 22 bp, Homo sapiens
gcaggaaccactgcccccctgt

SEQ ID NO: 7435905 - DNA, 22 bp, Homo sapiens
gcaggaacccagacaaccaggg

SEQ ID NO: 7435906 - DNA, 22 bp, Homo sapiens
gcaggaaaggttgagactttgc

SEQ ID NO: 7435907 - DNA, 22 bp, Homo sapiens
gcaggaaaggttgagactttgc

SEQ ID NO: 7435908 - DNA, 22 bp, Homo sapiens
gcaggaaaggttgagactttgc

SEQ ID NO: 7435909 - DNA, 19 bp, Homo sapiens
gcaggaaatgagtgattgc

SEQ ID NO: 7435910 - DNA, 19 bp, Homo sapiens
gcaggaaatgagtgattgc

SEQ ID NO: 7435911 - DNA, 22 bp, Homo sapiens
gcaggaacagggcttcaagctt

SEQ ID NO: 7435912 - DNA, 22 bp, Homo sapiens
gcaggaacagggcttcaagctt

SEQ ID NO: 7435913 - DNA, 21 bp, Homo sapiens
gcaggaacaggtcatgatctg

SEQ ID NO: 7435914 - DNA, 22 bp, Homo sapiens
gcagctttgtggagaggcccat

SEQ ID NO: 7435915 - DNA, 22 bp, Homo sapiens
gcagctttttggatgtcagtta

SEQ ID NO: 7435916 - DNA, 22 bp, Homo sapiens
gcaggaaaaccttcccatgttt

SEQ ID NO: 7435917 - DNA, 22 bp, Homo sapiens
gcaggaaaaccttcccatgttt

SEQ ID NO: 7435918 - DNA, 22 bp, Homo sapiens
gcaggaaaaccttcccatgttt

SEQ ID NO: 7435919 - DNA, 22 bp, Homo sapiens
gcaggaagaggctcgaagcccc

SEQ ID NO: 7435920 - DNA, 22 bp, Homo sapiens
gcaggaagaggctcgaagcccc

SEQ ID NO: 7435921 - DNA, 22 bp, Homo sapiens
gcaggaagaggctcgaagcccc

SEQ ID NO: 7435922 - DNA, 22 bp, Homo sapiens
gcaggaagaggctcgaagcccc

SEQ ID NO: 7435923 - DNA, 22 bp, Homo sapiens
gcaggaagaggctcgaagcccc

SEQ ID NO: 7435924 - DNA, 22 bp, Homo sapiens
gcaggaagaggctcgaagcccc

SEQ ID NO: 7435925 - DNA, 22 bp, Homo sapiens
gcaggaagatgagctcaggtaa

SEQ ID NO: 7435926 - DNA, 22 bp, Homo sapiens
gcaggaagatgagctcaggtaa

SEQ ID NO: 7435927 - DNA, 22 bp, Homo sapiens
gcaggaagatgagctcaggtaa

SEQ ID NO: 7435928 - DNA, 22 bp, Homo sapiens
gcaggaagatgagctcaggtaa

SEQ ID NO: 7435929 - DNA, 22 bp, Homo sapiens
gcaggaagatgagctcaggtaa

SEQ ID NO: 7435930 - DNA, 22 bp, Homo sapiens
gcaggaagatgagctcaggtaa

SEQ ID NO: 7435931 - DNA, 22 bp, Homo sapiens
gcaggaagatgagctcaggtaa

SEQ ID NO: 7435932 - DNA, 22 bp, Homo sapiens
gcaggaagatgagctcaggtaa

SEQ ID NO: 7435933 - DNA, 22 bp, Homo sapiens
gcaggaacccggccgccctggc

SEQ ID NO: 7435934 - DNA, 22 bp, Homo sapiens
gcaggaacctggtaagcttcac

SEQ ID NO: 7435935 - DNA, 22 bp, Homo sapiens
gcaggaacctggtaagcttcac

SEQ ID NO: 7435936 - DNA, 23 bp, Homo sapiens
gcaggaactcagggtaggcagca

SEQ ID NO: 7435937 - DNA, 23 bp, Homo sapiens
gcaggaactcagggtaggcagca

SEQ ID NO: 7435938 - DNA, 23 bp, Homo sapiens
gcaggaactcagggtaggcagca

SEQ ID NO: 7435939 - DNA, 22 bp, Homo sapiens
gcaggaactggagctggatgtt

SEQ ID NO: 7435940 - DNA, 22 bp, Homo sapiens
gcaggaacttgcaaaatgagca

SEQ ID NO: 7435941 - DNA, 22 bp, Homo sapiens
gcaggaactggagctggatgtt

SEQ ID NO: 7435942 - DNA, 22 bp, Homo sapiens
gcaggaactggagctggatgtt

SEQ ID NO: 7435943 - DNA, 22 bp, Homo sapiens
gcaggaacttgggtgaagtcag

SEQ ID NO: 7435944 - DNA, 22 bp, Homo sapiens
gcaggaagaggctcgaagcccc

SEQ ID NO: 7435945 - DNA, 22 bp, Homo sapiens
gcaggaagaggctcgaagcccc

SEQ ID NO: 7435946 - DNA, 22 bp, Homo sapiens
gcaggaagaggctcgaagcccc

SEQ ID NO: 7435947 - DNA, 22 bp, Homo sapiens
gcaggaacttgggtgaagtcag

SEQ ID NO: 7435948 - DNA, 22 bp, Homo sapiens
gcaggaacttgcaaaatgagca

SEQ ID NO: 7435949 - DNA, 22 bp, Homo sapiens
gcaggaagccttaccaagccca

SEQ ID NO: 7435950 - DNA, 22 bp, Homo sapiens
gcaggaagccttaccaagccca

SEQ ID NO: 7435951 - DNA, 22 bp, Homo sapiens
gcaggaagccttaccaagccca

SEQ ID NO: 7435952 - DNA, 22 bp, Homo sapiens
gcaggaagccttaccaagccca

SEQ ID NO: 7435953 - DNA, 22 bp, Homo sapiens
gcaggaagccttaccaagccca

SEQ ID NO: 7435954 - DNA, 22 bp, Homo sapiens
gcaggaagcatagaagaatgcc

SEQ ID NO: 7435955 - DNA, 22 bp, Homo sapiens
gcaggaagccttaccaagccca

SEQ ID NO: 7435956 - DNA, 22 bp, Homo sapiens
gcaggaagccttaccaagccca

SEQ ID NO: 7435957 - DNA, 22 bp, Homo sapiens
gcaggaagccttaccaagccca

SEQ ID NO: 7435958 - DNA, 22 bp, Homo sapiens
gcaggaagcatagaagaatgcc

SEQ ID NO: 7435959 - DNA, 22 bp, Homo sapiens
gcaggaagcatagaagaatgcc

SEQ ID NO: 7435960 - DNA, 22 bp, Homo sapiens
gcaggaagcatagaagaatgcc

SEQ ID NO: 7435961 - DNA, 22 bp, Homo sapiens
gcaggaagcatagaagaatgcc

SEQ ID NO: 7435962 - DNA, 22 bp, Homo sapiens
gcaggaagcatagaagaatgcc

SEQ ID NO: 7435963 - DNA, 22 bp, Homo sapiens
gcaggaagcatagaagaatgcc

SEQ ID NO: 7435964 - DNA, 22 bp, Homo sapiens
gcaggaagatgagctcaggtaa

SEQ ID NO: 7435965 - DNA, 22 bp, Homo sapiens
gcaggaagatgagctcaggtaa

SEQ ID NO: 7435966 - DNA, 22 bp, Homo sapiens
gcaggaagatgagctcaggtaa

SEQ ID NO: 7435967 - DNA, 22 bp, Homo sapiens
gcaggaagcatagaagaatgcc

SEQ ID NO: 7435968 - DNA, 22 bp, Homo sapiens
gcaggaagcatagaagaatgcc

SEQ ID NO: 7435969 - DNA, 22 bp, Homo sapiens
gcaggaagcatagaagaatgcc

SEQ ID NO: 7435970 - DNA, 22 bp, Homo sapiens
gcaggaagcatagaagaatgcc

SEQ ID NO: 7435971 - DNA, 22 bp, Homo sapiens
gcaggaagcatagaagaatgcc

SEQ ID NO: 7435972 - DNA, 22 bp, Homo sapiens
gcaggaatctaacccaaggaga

SEQ ID NO: 7435973 - DNA, 22 bp, Homo sapiens
gcaggaatctaacccaaggaga

SEQ ID NO: 7435974 - DNA, 22 bp, Homo sapiens
gcaggacaaaatttccagggtg

SEQ ID NO: 7435975 - DNA, 22 bp, Homo sapiens
gcaggacaaaatttccagggtg

SEQ ID NO: 7435976 - DNA, 22 bp, Homo sapiens
gcaggacaaaatttccagggtg

SEQ ID NO: 7435977 - DNA, 22 bp, Homo sapiens
gcaggaagggaaaggttgactc

SEQ ID NO: 7435978 - DNA, 22 bp, Homo sapiens
gcaggaagggaaaggttgactc

SEQ ID NO: 7435979 - DNA, 22 bp, Homo sapiens
gcaggaagggaaaggttgactc

SEQ ID NO: 7435980 - DNA, 22 bp, Homo sapiens
gcaggaagggaaaggttgactc

SEQ ID NO: 7435981 - DNA, 22 bp, Homo sapiens
gcaggaagggaaaggttgactc

SEQ ID NO: 7435982 - DNA, 22 bp, Homo sapiens
gcaggaagggaaaggttgactc

SEQ ID NO: 7435983 - DNA, 22 bp, Homo sapiens
gcaggaagggaaaggttgactc

SEQ ID NO: 7435984 - DNA, 22 bp, Homo sapiens
gcaggaagggaaaggttgactc

SEQ ID NO: 7435985 - DNA, 22 bp, Homo sapiens
gcaggaagggaaaggttgactc

SEQ ID NO: 7435986 - DNA, 22 bp, Homo sapiens
gcaggaagggaaaggttgactc

SEQ ID NO: 7435987 - DNA, 23 bp, Homo sapiens
gcaggacaacagagtgggaaggc

SEQ ID NO: 7435988 - DNA, 23 bp, Homo sapiens
gcaggacaacagagtgggaaggc

SEQ ID NO: 7435989 - DNA, 23 bp, Homo sapiens
gcaggacaacagagtgggaaggc

SEQ ID NO: 7435990 - DNA, 22 bp, Homo sapiens
gcaggacaaaatttccagggtg

SEQ ID NO: 7435991 - DNA, 22 bp, Homo sapiens
gcaggacaaaatttccagggtg

SEQ ID NO: 7435992 - DNA, 22 bp, Homo sapiens
gcaggacaaaatttccagggtg

SEQ ID NO: 7435993 - DNA, 22 bp, Homo sapiens
gcaggacacagatgcaaggcca

SEQ ID NO: 7435994 - DNA, 22 bp, Homo sapiens
gcaggacacagatgcaaggcca

SEQ ID NO: 7435995 - DNA, 23 bp, Homo sapiens
gcaggacaacagagtgggaaggc

SEQ ID NO: 7435996 - DNA, 23 bp, Homo sapiens
gcaggacaacagagtgggaaggc

SEQ ID NO: 7435997 - DNA, 23 bp, Homo sapiens
gcaggacaacagagtgggaaggc

SEQ ID NO: 7435998 - DNA, 23 bp, Homo sapiens
gcaggacaacagagtgggaaggc

SEQ ID NO: 7435999 - DNA, 23 bp, Homo sapiens
gcaggacaacagagtgggaaggc

SEQ ID NO: 7436000 - DNA, 22 bp, Homo sapiens
gcagccctaacctgtcatagtg

SEQ ID NO: 7436001 - DNA, 18 bp, Homo sapiens
gcagcccctcttccttcc

SEQ ID NO: 7436002 - DNA, 22 bp, Homo sapiens
gcagccctaacctgtcatagtg

SEQ ID NO: 7436003 - DNA, 22 bp, Homo sapiens
gcagccctaacctgtcatagtg

SEQ ID NO: 7436004 - DNA, 18 bp, Homo sapiens
gcagcccctcttccttcc

SEQ ID NO: 7436005 - DNA, 22 bp, Homo sapiens
gcagccctaacctgtcatagtg

SEQ ID NO: 7436006 - DNA, 22 bp, Homo sapiens
gcagccctaacctgtcatagtg

SEQ ID NO: 7436007 - DNA, 22 bp, Homo sapiens
gcagccctagcgacaaattgat

SEQ ID NO: 7436008 - DNA, 22 bp, Homo sapiens
gcagccctagcgacaaattgat

SEQ ID NO: 7436009 - DNA, 22 bp, Homo sapiens
gcagccctagcgacaaattgat

SEQ ID NO: 7436010 - DNA, 22 bp, Homo sapiens
gcagccctccctgggtgtgtct

SEQ ID NO: 7436011 - DNA, 22 bp, Homo sapiens
gcagccctccctgggtgtgtct

SEQ ID NO: 7436012 - DNA, 22 bp, Homo sapiens
gcagccccaggagacgcccagg

SEQ ID NO: 7436013 - DNA, 22 bp, Homo sapiens
gcagcccataacatttgaggcc

SEQ ID NO: 7436014 - DNA, 22 bp, Homo sapiens
gcagccccaggagacgcccagg

SEQ ID NO: 7436015 - DNA, 22 bp, Homo sapiens
gcagccccaggagacgcccagg

SEQ ID NO: 7436016 - DNA, 18 bp, Homo sapiens
gcagcccctcttccttcc

SEQ ID NO: 7436017 - DNA, 22 bp, Homo sapiens
gcagcccataacatttgaggcc

SEQ ID NO: 7436018 - DNA, 22 bp, Homo sapiens
gcagcccaggtgtagctctttg

SEQ ID NO: 7436019 - DNA, 22 bp, Homo sapiens
gcagcccaggtgtagctctttg

SEQ ID NO: 7436020 - DNA, 22 bp, Homo sapiens
gcagccccaggagacgcccagg

SEQ ID NO: 7436021 - DNA, 22 bp, Homo sapiens
gcagcccaggtctctctcactc

SEQ ID NO: 7436022 - DNA, 22 bp, Homo sapiens
gcagcccataacatttgaggcc

SEQ ID NO: 7436023 - DNA, 22 bp, Homo sapiens
gcagcccataacatttgaggcc

SEQ ID NO: 7436024 - DNA, 22 bp, Homo sapiens
gcagccctcgggtactcacgtg

SEQ ID NO: 7436025 - DNA, 22 bp, Homo sapiens
gcagccctcgctagctctcccc

SEQ ID NO: 7436026 - DNA, 22 bp, Homo sapiens
gcagccctcgggtactcacgtg

SEQ ID NO: 7436027 - DNA, 22 bp, Homo sapiens
gcagccctcgggtactcacgtg

SEQ ID NO: 7436028 - DNA, 22 bp, Homo sapiens
gcagccctcgctagctctcccc

SEQ ID NO: 7436029 - DNA, 22 bp, Homo sapiens
gcagccctcgctagctctcccc

SEQ ID NO: 7436030 - DNA, 22 bp, Homo sapiens
gcagccctcgctagctctcccc

SEQ ID NO: 7436031 - DNA, 22 bp, Homo sapiens
gcagccctcgctagctctcccc

SEQ ID NO: 7436032 - DNA, 22 bp, Homo sapiens
gcagccctcgctagctctcccc

SEQ ID NO: 7436033 - DNA, 22 bp, Homo sapiens
gcagccctcgctagctctcccc

SEQ ID NO: 7436034 - DNA, 22 bp, Homo sapiens
gcagccctcgctagctctcccc

SEQ ID NO: 7436035 - DNA, 22 bp, Homo sapiens
gcagccctcgctagctctcccc

SEQ ID NO: 7436036 - DNA, 22 bp, Homo sapiens
gcagccctgcagctccacaccg

SEQ ID NO: 7436037 - DNA, 22 bp, Homo sapiens
gcagccctgcagctccacaccg

SEQ ID NO: 7436038 - DNA, 22 bp, Homo sapiens
gcagccctgcagctccacaccg

SEQ ID NO: 7436039 - DNA, 22 bp, Homo sapiens
gcagccctgcagctccacaccg

SEQ ID NO: 7436040 - DNA, 22 bp, Homo sapiens
gcagccctgcagctccacaccg

SEQ ID NO: 7436041 - DNA, 22 bp, Homo sapiens
gcagccctgcagctccacaccg

SEQ ID NO: 7436042 - DNA, 22 bp, Homo sapiens
gcagccctcgggtactcacgtg

SEQ ID NO: 7436043 - DNA, 22 bp, Homo sapiens
gcagccctcgggtactcacgtg

SEQ ID NO: 7436044 - DNA, 22 bp, Homo sapiens
gcagccctcttggtcactaggc

SEQ ID NO: 7436045 - DNA, 22 bp, Homo sapiens
gcagccctcttggtcactaggc

SEQ ID NO: 7436046 - DNA, 22 bp, Homo sapiens
gcagccctcttggtcactaggc

SEQ ID NO: 7436047 - DNA, 22 bp, Homo sapiens
gcagccctcttggtcactaggc

SEQ ID NO: 7436048 - DNA, 22 bp, Homo sapiens
gcagccctcttggtcactaggc

SEQ ID NO: 7436049 - DNA, 22 bp, Homo sapiens
gcagcccaggaggcgggagccc

SEQ ID NO: 7436050 - DNA, 22 bp, Homo sapiens
gcagcccaggagcaggcgaccc

SEQ ID NO: 7436051 - DNA, 22 bp, Homo sapiens
gcagcccaggagcaggcgaccc

SEQ ID NO: 7436052 - DNA, 22 bp, Homo sapiens
gcagcccaggaggcgggagccc

SEQ ID NO: 7436053 - DNA, 22 bp, Homo sapiens
gcagcccaggaggcgggagccc

SEQ ID NO: 7436054 - DNA, 22 bp, Homo sapiens
gcagcccaggaccctggacaga

SEQ ID NO: 7436055 - DNA, 22 bp, Homo sapiens
gcagcccaggaccctggacaga

SEQ ID NO: 7436056 - DNA, 22 bp, Homo sapiens
gcagcccaggagcaggcgaccc

SEQ ID NO: 7436057 - DNA, 22 bp, Homo sapiens
gcagcccaggagcaggcgaccc

SEQ ID NO: 7436058 - DNA, 22 bp, Homo sapiens
gcagcccaggagcaggcgaccc

SEQ ID NO: 7436059 - DNA, 22 bp, Homo sapiens
gcagcccaggctcgctcactgc

SEQ ID NO: 7436060 - DNA, 22 bp, Homo sapiens
gcagcccaggtctctctcactc

SEQ ID NO: 7436061 - DNA, 22 bp, Homo sapiens
gcagcccaggctcgctcactgc

SEQ ID NO: 7436062 - DNA, 22 bp, Homo sapiens
gcagcccaggctcgctcactgc

SEQ ID NO: 7436063 - DNA, 22 bp, Homo sapiens
gcagcccaggtggagtaatcta

SEQ ID NO: 7436064 - DNA, 22 bp, Homo sapiens
gcagcccaggtctctctcactc

SEQ ID NO: 7436065 - DNA, 22 bp, Homo sapiens
gcagcccaggtggagtaatcta

SEQ ID NO: 7436066 - DNA, 22 bp, Homo sapiens
gcagatgttcgcgttaatgcat

SEQ ID NO: 7436067 - DNA, 22 bp, Homo sapiens
gcagatgtgtcctggagggagg

SEQ ID NO: 7436068 - DNA, 22 bp, Homo sapiens
gcagatgttcgcgttaatgcat

SEQ ID NO: 7436069 - DNA, 22 bp, Homo sapiens
gcagatgtaatggctggaggtc

SEQ ID NO: 7436070 - DNA, 22 bp, Homo sapiens
gcagatgtaatggctggaggtc

SEQ ID NO: 7436071 - DNA, 22 bp, Homo sapiens
gcagatgtaatggctggaggtc

SEQ ID NO: 7436072 - DNA, 22 bp, Homo sapiens
gcagatggtgggggaggagtac

SEQ ID NO: 7436073 - DNA, 22 bp, Homo sapiens
gcagatggtgggggaggagtac

SEQ ID NO: 7436074 - DNA, 22 bp, Homo sapiens
gcagatggtgggggaggagtac

SEQ ID NO: 7436075 - DNA, 22 bp, Homo sapiens
gcagcccaggaccctggacaga

SEQ ID NO: 7436076 - DNA, 22 bp, Homo sapiens
gcagcccaggaccctggacaga

SEQ ID NO: 7436077 - DNA, 22 bp, Homo sapiens
gcagcccaggaccctggacaga

SEQ ID NO: 7436078 - DNA, 22 bp, Homo sapiens
gcagcccagcagggcccggagc

SEQ ID NO: 7436079 - DNA, 22 bp, Homo sapiens
gcagcccagcagggcccggagc

SEQ ID NO: 7436080 - DNA, 22 bp, Homo sapiens
gcagcccagagcgcaggacccc

SEQ ID NO: 7436081 - DNA, 22 bp, Homo sapiens
gcagcccacagctggaggccta

SEQ ID NO: 7436082 - DNA, 22 bp, Homo sapiens
gcagcccagagcgcaggacccc

SEQ ID NO: 7436083 - DNA, 22 bp, Homo sapiens
gcagatggcagcccaggctggg

SEQ ID NO: 7436084 - DNA, 22 bp, Homo sapiens
gcagatggcagcccaggctggg

SEQ ID NO: 7436085 - DNA, 22 bp, Homo sapiens
gcagatggcagcccaggctggg

SEQ ID NO: 7436086 - DNA, 22 bp, Homo sapiens
gcagatggcagcccaggctggg

SEQ ID NO: 7436087 - DNA, 22 bp, Homo sapiens
gcagatggcagcccaggctggg

SEQ ID NO: 7436088 - DNA, 22 bp, Homo sapiens
gcagatggcagcccaggctggg

SEQ ID NO: 7436089 - DNA, 22 bp, Homo sapiens
gcagatggcagcccaggctggg

SEQ ID NO: 7436090 - DNA, 22 bp, Homo sapiens
gcagatggcagcccaggctggg

SEQ ID NO: 7436091 - DNA, 22 bp, Homo sapiens
gcagatggatcacctgaggtcg

SEQ ID NO: 7436092 - DNA, 18 bp, Homo sapiens
gcagatggagattcaggg

SEQ ID NO: 7436093 - DNA, 22 bp, Homo sapiens
gcagatggatcacctgaggtcg

SEQ ID NO: 7436094 - DNA, 22 bp, Homo sapiens
gcagatggatcacctgaggtcg

SEQ ID NO: 7436095 - DNA, 22 bp, Homo sapiens
gcagatggatgtggacggcgcc

SEQ ID NO: 7436096 - DNA, 22 bp, Homo sapiens
gcagatggatgtggacggcgcc

SEQ ID NO: 7436097 - DNA, 22 bp, Homo sapiens
gcagatggatcacctgaggtcg

SEQ ID NO: 7436098 - DNA, 22 bp, Homo sapiens
gcagatggcagcccaggctggg

SEQ ID NO: 7436099 - DNA, 22 bp, Homo sapiens
gcagatggcagcccaggctggg

SEQ ID NO: 7436100 - DNA, 22 bp, Homo sapiens
gcagatggcagcccaggctggg

SEQ ID NO: 7436101 - DNA, 23 bp, Homo sapiens
gcagatggccccagagtgctgcc

SEQ ID NO: 7436102 - DNA, 23 bp, Homo sapiens
gcagatggccccagagtgctgcc

SEQ ID NO: 7436103 - DNA, 23 bp, Homo sapiens
gcagatggccccagagtgctgcc

SEQ ID NO: 7436104 - DNA, 23 bp, Homo sapiens
gcagatggccccagagtgctgcc

SEQ ID NO: 7436105 - DNA, 23 bp, Homo sapiens
gcagatggccccagagtgctgcc

SEQ ID NO: 7436106 - DNA, 23 bp, Homo sapiens
gcagatggccccagagtgctgcc

SEQ ID NO: 7436107 - DNA, 23 bp, Homo sapiens
gcagatggccccagagtgctgcc

SEQ ID NO: 7436108 - DNA, 23 bp, Homo sapiens
gcagatggccccagagtgctgcc

SEQ ID NO: 7436109 - DNA, 22 bp, Homo sapiens
gcagatggcgcagtggaagttc

SEQ ID NO: 7436110 - DNA, 22 bp, Homo sapiens
gcagatggctcagacactgggg

SEQ ID NO: 7436111 - DNA, 22 bp, Homo sapiens
gcagatggcgcagtggaagttc

SEQ ID NO: 7436112 - DNA, 22 bp, Homo sapiens
gcagatggtggaggcaagaggc

SEQ ID NO: 7436113 - DNA, 22 bp, Homo sapiens
gcagatggtggaggcaagaggc

SEQ ID NO: 7436114 - DNA, 22 bp, Homo sapiens
gcagatggtggaggcaagaggc

SEQ ID NO: 7436115 - DNA, 22 bp, Homo sapiens
gcagatggtggaggcaagaggc

SEQ ID NO: 7436116 - DNA, 22 bp, Homo sapiens
gcagatggtggaggcaagaggc

SEQ ID NO: 7436117 - DNA, 22 bp, Homo sapiens
gcagatggtggaggcaagaggc

SEQ ID NO: 7436118 - DNA, 22 bp, Homo sapiens
gcagatggtgggggaggagtac

SEQ ID NO: 7436119 - DNA, 22 bp, Homo sapiens
gcagatggtggggcaggaaaat

SEQ ID NO: 7436120 - DNA, 22 bp, Homo sapiens
gcagatggtggggcaggaaaat

SEQ ID NO: 7436121 - DNA, 22 bp, Homo sapiens
gcagatggtgccatgtcttgtg

SEQ ID NO: 7436122 - DNA, 22 bp, Homo sapiens
gcagatggtgccatgtcttgtg

SEQ ID NO: 7436123 - DNA, 21 bp, Homo sapiens
gcagatgggagtcatcaggct

SEQ ID NO: 7436124 - DNA, 21 bp, Homo sapiens
gcagatgggagtcatcaggct

SEQ ID NO: 7436125 - DNA, 21 bp, Homo sapiens
gcagatgggagtcatcaggct

SEQ ID NO: 7436126 - DNA, 21 bp, Homo sapiens
gcagatgggaagagacgaggc

SEQ ID NO: 7436127 - DNA, 22 bp, Homo sapiens
gcagatggctgagcctgcagat

SEQ ID NO: 7436128 - DNA, 22 bp, Homo sapiens
gcagatggctgagcctgcagat

SEQ ID NO: 7436129 - DNA, 22 bp, Homo sapiens
gcagatggctgagcctgcagat

SEQ ID NO: 7436130 - DNA, 22 bp, Homo sapiens
gcagatggctgagcctgcagat

SEQ ID NO: 7436131 - DNA, 22 bp, Homo sapiens
gcagatggctgagcctgcagat

SEQ ID NO: 7436132 - DNA, 22 bp, Homo sapiens
gcagatggctcagacactgggg

SEQ ID NO: 7436133 - DNA, 22 bp, Homo sapiens
gcagatggctcagacactgggg

SEQ ID NO: 7436134 - DNA, 22 bp, Homo sapiens
gcagatggctcagacactgggg

SEQ ID NO: 7436135 - DNA, 22 bp, Homo sapiens
gcagatgggagccccaggggag

SEQ ID NO: 7436136 - DNA, 21 bp, Homo sapiens
gcagatgggagtcatcaggct

SEQ ID NO: 7436137 - DNA, 21 bp, Homo sapiens
gcagatgggagtcatcaggct

SEQ ID NO: 7436138 - DNA, 22 bp, Homo sapiens
gcagatgggagccccaggggag

SEQ ID NO: 7436139 - DNA, 22 bp, Homo sapiens
gcagatgggagccccaggggag

SEQ ID NO: 7436140 - DNA, 22 bp, Homo sapiens
gcagatgggagccccaggggag

SEQ ID NO: 7436141 - DNA, 22 bp, Homo sapiens
gcagatgggagccccaggggag

SEQ ID NO: 7436142 - DNA, 22 bp, Homo sapiens
gcagatgggagccccaggggag

SEQ ID NO: 7436143 - DNA, 22 bp, Homo sapiens
gcagatgggagccccaggggag

SEQ ID NO: 7436144 - DNA, 21 bp, Homo sapiens
gcagatgggaagagacgaggc

SEQ ID NO: 7436145 - DNA, 21 bp, Homo sapiens
gcagatgggaagagacgaggc

SEQ ID NO: 7436146 - DNA, 22 bp, Homo sapiens
gcagggacctgccactgctgtc

SEQ ID NO: 7436147 - DNA, 22 bp, Homo sapiens
gcagggacctgccactgctgtc

SEQ ID NO: 7436148 - DNA, 22 bp, Homo sapiens
gcagggacctcactacccccag

SEQ ID NO: 7436149 - DNA, 22 bp, Homo sapiens
gcagggacctgccactgctgtc

SEQ ID NO: 7436150 - DNA, 22 bp, Homo sapiens
gcagggacctcactacccccag

SEQ ID NO: 7436151 - DNA, 22 bp, Homo sapiens
gcagggacctatgacgatggaa

SEQ ID NO: 7436152 - DNA, 22 bp, Homo sapiens
gcagggacctatgacgatggaa

SEQ ID NO: 7436153 - DNA, 22 bp, Homo sapiens
gcagggacctgccactgctgtc

SEQ ID NO: 7436154 - DNA, 22 bp, Homo sapiens
gcagggctctgctgtagtccta

SEQ ID NO: 7436155 - DNA, 22 bp, Homo sapiens
gcagggctgaaggtcccaggcc

SEQ ID NO: 7436156 - DNA, 22 bp, Homo sapiens
gcagggctgaaggtcccaggcc

SEQ ID NO: 7436157 - DNA, 22 bp, Homo sapiens
gcagggctgaaggtcccaggcc

SEQ ID NO: 7436158 - DNA, 22 bp, Homo sapiens
gcagggctgaaggtcccaggcc

SEQ ID NO: 7436159 - DNA, 22 bp, Homo sapiens
gcagggctctgctgtagtccta

SEQ ID NO: 7436160 - DNA, 22 bp, Homo sapiens
gcagggaccagggccagatcca

SEQ ID NO: 7436161 - DNA, 22 bp, Homo sapiens
gcagggaccagggccagatcca

SEQ ID NO: 7436162 - DNA, 21 bp, Homo sapiens
gcagggaccgcgacttctggg

SEQ ID NO: 7436163 - DNA, 21 bp, Homo sapiens
gcagggaccgcgacttctggg

SEQ ID NO: 7436164 - DNA, 21 bp, Homo sapiens
gcagggaccgcgacttctggg

SEQ ID NO: 7436165 - DNA, 22 bp, Homo sapiens
gcagggaccaaaagaggcagta

SEQ ID NO: 7436166 - DNA, 22 bp, Homo sapiens
gcagggaccaaaagaggcagta

SEQ ID NO: 7436167 - DNA, 22 bp, Homo sapiens
gcagggaccaaaagaggcagta

SEQ ID NO: 7436168 - DNA, 22 bp, Homo sapiens
gcagggaccaaaagaggcagta

SEQ ID NO: 7436169 - DNA, 22 bp, Homo sapiens
gcagggaccaaaagaggcagta

SEQ ID NO: 7436170 - DNA, 22 bp, Homo sapiens
gcagggaccaaaagaggcagta

SEQ ID NO: 7436171 - DNA, 22 bp, Homo sapiens
gcagggaccaaaagaggcagta

SEQ ID NO: 7436172 - DNA, 22 bp, Homo sapiens
gcagggaccaaaagaggcagta

SEQ ID NO: 7436173 - DNA, 22 bp, Homo sapiens
gcagggaccaaaagaggcagta

SEQ ID NO: 7436174 - DNA, 22 bp, Homo sapiens
gcagggaccaaaagaggcagta

SEQ ID NO: 7436175 - DNA, 22 bp, Homo sapiens
gcagggacatcttcagatcact

SEQ ID NO: 7436176 - DNA, 22 bp, Homo sapiens
gcagggacatcttcagatcact

SEQ ID NO: 7436177 - DNA, 22 bp, Homo sapiens
gcagggacatcttcagatcact

SEQ ID NO: 7436178 - DNA, 22 bp, Homo sapiens
gcagggaccaaaagaggcagta

SEQ ID NO: 7436179 - DNA, 22 bp, Homo sapiens
gcagggacatctttgtctagta

SEQ ID NO: 7436180 - DNA, 22 bp, Homo sapiens
gcagggacatctttgtctagta

SEQ ID NO: 7436181 - DNA, 22 bp, Homo sapiens
gcagggacagggcagggccttt

SEQ ID NO: 7436182 - DNA, 22 bp, Homo sapiens
gcagggacagggcagggccttt

SEQ ID NO: 7436183 - DNA, 22 bp, Homo sapiens
gcagggacagggcagggccttt

SEQ ID NO: 7436184 - DNA, 22 bp, Homo sapiens
gcagggacacctttgtgaagct

SEQ ID NO: 7436185 - DNA, 22 bp, Homo sapiens
gcagggacagggcagggccttt

SEQ ID NO: 7436186 - DNA, 22 bp, Homo sapiens
gcagggacagggcagggccttt

SEQ ID NO: 7436187 - DNA, 22 bp, Homo sapiens
gcagggacaactgtgcacctga

SEQ ID NO: 7436188 - DNA, 22 bp, Homo sapiens
gcagggacaactgtgcacctga

SEQ ID NO: 7436189 - DNA, 22 bp, Homo sapiens
gcagggacaactgtgcacctga

SEQ ID NO: 7436190 - DNA, 22 bp, Homo sapiens
gcagggacaaggcaggtgttct

SEQ ID NO: 7436191 - DNA, 18 bp, Homo sapiens
gcagggacacagggtcac

SEQ ID NO: 7436192 - DNA, 18 bp, Homo sapiens
gcagggacacagggtcac

SEQ ID NO: 7436193 - DNA, 22 bp, Homo sapiens
gcagggacacctttgtgaagct

SEQ ID NO: 7436194 - DNA, 22 bp, Homo sapiens
gcagggacacctttgtgaagct

SEQ ID NO: 7436195 - DNA, 22 bp, Homo sapiens
gcagggacacctttgtgaagct

SEQ ID NO: 7436196 - DNA, 22 bp, Homo sapiens
gcagggacaaggcaggtgttct

SEQ ID NO: 7436197 - DNA, 18 bp, Homo sapiens
gcagggacacagggtcac

SEQ ID NO: 7436198 - DNA, 18 bp, Homo sapiens
gcagggacacagggtcac

SEQ ID NO: 7436199 - DNA, 18 bp, Homo sapiens
gcagggacacagggtcac

SEQ ID NO: 7436200 - DNA, 18 bp, Homo sapiens
gcagggacacagggtcac

SEQ ID NO: 7436201 - DNA, 22 bp, Homo sapiens
gcagggctgggtcctgtctcat

SEQ ID NO: 7436202 - DNA, 22 bp, Homo sapiens
gcagggctgggtcctgtctcat

SEQ ID NO: 7436203 - DNA, 22 bp, Homo sapiens
gcagggctgggtcctgtctcat

SEQ ID NO: 7436204 - DNA, 22 bp, Homo sapiens
gcagggctgggtcctgtctcat

SEQ ID NO: 7436205 - DNA, 22 bp, Homo sapiens
gcagggctgggtcctgtctcat

SEQ ID NO: 7436206 - DNA, 22 bp, Homo sapiens
gcagggctggggctgctcctga

SEQ ID NO: 7436207 - DNA, 22 bp, Homo sapiens
gcagggctggggctgctcctga

SEQ ID NO: 7436208 - DNA, 22 bp, Homo sapiens
gcagggctgggtcctgtctcat

SEQ ID NO: 7436209 - DNA, 22 bp, Homo sapiens
gcagggctggggctgctcctga

SEQ ID NO: 7436210 - DNA, 22 bp, Homo sapiens
gcagggctggggctgctcctga

SEQ ID NO: 7436211 - DNA, 22 bp, Homo sapiens
gcagggctggggctgctcctga

SEQ ID NO: 7436212 - DNA, 22 bp, Homo sapiens
gcagggctggggctgctcctga

SEQ ID NO: 7436213 - DNA, 22 bp, Homo sapiens
gcagggctggggctgctcctga

SEQ ID NO: 7436214 - DNA, 22 bp, Homo sapiens
gcagggctggggctgctcctga

SEQ ID NO: 7436215 - DNA, 22 bp, Homo sapiens
gcagggctggggctgctcctga

SEQ ID NO: 7436216 - DNA, 22 bp, Homo sapiens
gcagggctgactcagccaccct

SEQ ID NO: 7436217 - DNA, 22 bp, Homo sapiens
gcagggctgaaggtcccaggcc

SEQ ID NO: 7436218 - DNA, 22 bp, Homo sapiens
gcagggctgtaatttgagcctg

SEQ ID NO: 7436219 - DNA, 22 bp, Homo sapiens
gcagggctgtaatttgagcctg

SEQ ID NO: 7436220 - DNA, 22 bp, Homo sapiens
gcagggctgtggacactttggt

SEQ ID NO: 7436221 - DNA, 22 bp, Homo sapiens
gcagggctgtggacactttggt

SEQ ID NO: 7436222 - DNA, 22 bp, Homo sapiens
gcagggctgggtgggagacaga

SEQ ID NO: 7436223 - DNA, 22 bp, Homo sapiens
gcagggctgggtgggagacaga

SEQ ID NO: 7436224 - DNA, 22 bp, Homo sapiens
gcagggctgggtgggagacaga

SEQ ID NO: 7436225 - DNA, 22 bp, Homo sapiens
gcagggctgggtgggagacaga

SEQ ID NO: 7436226 - DNA, 22 bp, Homo sapiens
gcagggctgggtgggagacaga

SEQ ID NO: 7436227 - DNA, 22 bp, Homo sapiens
gcagggctgggtgggagacaga

SEQ ID NO: 7436228 - DNA, 22 bp, Homo sapiens
gcagggctgggtgggagacaga

SEQ ID NO: 7436229 - DNA, 22 bp, Homo sapiens
gcagggcttgcagcagctagac

SEQ ID NO: 7436230 - DNA, 22 bp, Homo sapiens
gcagggcttgcagcagctagac

SEQ ID NO: 7436231 - DNA, 22 bp, Homo sapiens
gcagggcttgcagcagctagac

SEQ ID NO: 7436232 - DNA, 22 bp, Homo sapiens
gcagggcttgcagcagctagac

SEQ ID NO: 7436233 - DNA, 22 bp, Homo sapiens
gcagggcttgcagcagctagac

SEQ ID NO: 7436234 - DNA, 22 bp, Homo sapiens
gcagggctttttgaaacatggt

SEQ ID NO: 7436235 - DNA, 22 bp, Homo sapiens
gcagggctttttgaaacatggt

SEQ ID NO: 7436236 - DNA, 22 bp, Homo sapiens
gcagggctttttgaaacatggt

SEQ ID NO: 7436237 - DNA, 22 bp, Homo sapiens
gcaggggagtccactctatgca

SEQ ID NO: 7436238 - DNA, 22 bp, Homo sapiens
gcagggcttagaaatggtggct

SEQ ID NO: 7436239 - DNA, 22 bp, Homo sapiens
gcagggcttagaaatggtggct

SEQ ID NO: 7436240 - DNA, 22 bp, Homo sapiens
gcagggcttgcagcagctagac

SEQ ID NO: 7436241 - DNA, 22 bp, Homo sapiens
gcagggcttgcagcagctagac

SEQ ID NO: 7436242 - DNA, 22 bp, Homo sapiens
gcagggcttagaaatggtggct

SEQ ID NO: 7436243 - DNA, 22 bp, Homo sapiens
gcagggcttagaaatggtggct

SEQ ID NO: 7436244 - DNA, 22 bp, Homo sapiens
gcagggcttagaaatggtggct

SEQ ID NO: 7436245 - DNA, 22 bp, Homo sapiens
gcagggcttagaaatggtggct

SEQ ID NO: 7436246 - DNA, 22 bp, Homo sapiens
gcagggcttagaaatggtggct

SEQ ID NO: 7436247 - DNA, 22 bp, Homo sapiens
gcagggctgttcaggagggtgg

SEQ ID NO: 7436248 - DNA, 22 bp, Homo sapiens
gcagggctgttcaggagggtgg

SEQ ID NO: 7436249 - DNA, 22 bp, Homo sapiens
gcagggctgttcaggagggtgg

SEQ ID NO: 7436250 - DNA, 22 bp, Homo sapiens
gcagggctgttcaggagggtgg

SEQ ID NO: 7436251 - DNA, 22 bp, Homo sapiens
gcagggctgttcaggagggtgg

SEQ ID NO: 7436252 - DNA, 22 bp, Homo sapiens
gcagggctgttcaggagggtgg

SEQ ID NO: 7436253 - DNA, 22 bp, Homo sapiens
gcagggctgtggacactttggt

SEQ ID NO: 7436254 - DNA, 22 bp, Homo sapiens
gcagggctgtggacactttggt

SEQ ID NO: 7436255 - DNA, 22 bp, Homo sapiens
gcagggctgttcaggagggtgg

SEQ ID NO: 7436256 - DNA, 22 bp, Homo sapiens
gcagggctgttcaggagggtgg

SEQ ID NO: 7436257 - DNA, 22 bp, Homo sapiens
gcagggctgtttagtgaatagg

SEQ ID NO: 7436258 - DNA, 22 bp, Homo sapiens
gcagggcttagaaatggtggct

SEQ ID NO: 7436259 - DNA, 22 bp, Homo sapiens
gcaggcagatcacctgtcagga

SEQ ID NO: 7436260 - DNA, 22 bp, Homo sapiens
gcaggcagatcacctgtcagga

SEQ ID NO: 7436261 - DNA, 22 bp, Homo sapiens
gcaggcagatcacctgtcagga

SEQ ID NO: 7436262 - DNA, 14 bp, Homo sapiens
gcaggcagatcact

SEQ ID NO: 7436263 - DNA, 14 bp, Homo sapiens
gcaggcagatcact

SEQ ID NO: 7436264 - DNA, 22 bp, Homo sapiens
gcaggcagatcacctgtcagga

SEQ ID NO: 7436265 - DNA, 22 bp, Homo sapiens
gcaggcagatcacctgtcagga

SEQ ID NO: 7436266 - DNA, 22 bp, Homo sapiens
gcaggcagatcacctgtcagga

SEQ ID NO: 7436267 - DNA, 22 bp, Homo sapiens
gcaggcagatcacctgtcagga

SEQ ID NO: 7436268 - DNA, 22 bp, Homo sapiens
gcaggcagatcacctgtcagga

SEQ ID NO: 7436269 - DNA, 22 bp, Homo sapiens
gcaggcagatcacctgtcagga

SEQ ID NO: 7436270 - DNA, 22 bp, Homo sapiens
gcaggcagatcacctgtcagga

SEQ ID NO: 7436271 - DNA, 22 bp, Homo sapiens
gcaggcagccacgattcccttg

SEQ ID NO: 7436272 - DNA, 22 bp, Homo sapiens
gcaggcagccacgattcccttg

SEQ ID NO: 7436273 - DNA, 22 bp, Homo sapiens
gcaggcagccacgattcccttg

SEQ ID NO: 7436274 - DNA, 22 bp, Homo sapiens
gcaggcagccacgattcccttg

SEQ ID NO: 7436275 - DNA, 22 bp, Homo sapiens
gcaggcagccacgattcccttg

SEQ ID NO: 7436276 - DNA, 22 bp, Homo sapiens
gcaggcagccacgattcccttg

SEQ ID NO: 7436277 - DNA, 22 bp, Homo sapiens
gcaggcagccacgattcccttg

SEQ ID NO: 7436278 - DNA, 14 bp, Homo sapiens
gcaggcagatcatt

SEQ ID NO: 7436279 - DNA, 14 bp, Homo sapiens
gcaggcagatcatt

SEQ ID NO: 7436280 - DNA, 19 bp, Homo sapiens
gcaggcagctggggtatcc

SEQ ID NO: 7436281 - DNA, 19 bp, Homo sapiens
gcaggcagctggggtatcc

SEQ ID NO: 7436282 - DNA, 22 bp, Homo sapiens
gcaggcagccacgattcccttg

SEQ ID NO: 7436283 - DNA, 19 bp, Homo sapiens
gcaggcagctggggtatcc

SEQ ID NO: 7436284 - DNA, 19 bp, Homo sapiens
gcaggcagctggggtatcc

SEQ ID NO: 7436285 - DNA, 22 bp, Homo sapiens
gcaggcagccacgattcccttg

SEQ ID NO: 7436286 - DNA, 19 bp, Homo sapiens
gcaggcagctggggtatcc

SEQ ID NO: 7436287 - DNA, 19 bp, Homo sapiens
gcaggcagctggggtatcc

SEQ ID NO: 7436288 - DNA, 19 bp, Homo sapiens
gcaggcagctggggtatcc

SEQ ID NO: 7436289 - DNA, 19 bp, Homo sapiens
gcaggcagctggggtatcc

SEQ ID NO: 7436290 - DNA, 22 bp, Homo sapiens
gcaggcaggtggcatcttgtga

SEQ ID NO: 7436291 - DNA, 22 bp, Homo sapiens
gcaggcagaggtggaggagaca

SEQ ID NO: 7436292 - DNA, 22 bp, Homo sapiens
gcaggcagaggtggaggagaca

SEQ ID NO: 7436293 - DNA, 22 bp, Homo sapiens
gcaggcagaggtggaggagaca

SEQ ID NO: 7436294 - DNA, 22 bp, Homo sapiens
gcaggcagaggtggaggagaca

SEQ ID NO: 7436295 - DNA, 22 bp, Homo sapiens
gcaggacagacccaagcagtct

SEQ ID NO: 7436296 - DNA, 22 bp, Homo sapiens
gcaggacagacccaagcagtct

SEQ ID NO: 7436297 - DNA, 22 bp, Homo sapiens
gcaggcagaggtggaggagaca

SEQ ID NO: 7436298 - DNA, 16 bp, Homo sapiens
gcaggacactcagaca

SEQ ID NO: 7436299 - DNA, 16 bp, Homo sapiens
gcaggacactcagaca

SEQ ID NO: 7436300 - DNA, 22 bp, Homo sapiens
gcaggacacagatgcaaggcca

SEQ ID NO: 7436301 - DNA, 16 bp, Homo sapiens
gcaggacactcagaca

SEQ ID NO: 7436302 - DNA, 16 bp, Homo sapiens
gcaggacactcagaca

SEQ ID NO: 7436303 - DNA, 22 bp, Homo sapiens
gcaggacacagatgcaaggcca

SEQ ID NO: 7436304 - DNA, 22 bp, Homo sapiens
gcaggacacagatgcaaggcca

SEQ ID NO: 7436305 - DNA, 22 bp, Homo sapiens
gcaggacacagatgcaaggcca

SEQ ID NO: 7436306 - DNA, 22 bp, Homo sapiens
gcaggacacagatgcaaggcca

SEQ ID NO: 7436307 - DNA, 22 bp, Homo sapiens
gcaggcagagtcaatttgatcc

SEQ ID NO: 7436308 - DNA, 22 bp, Homo sapiens
gcaggcagagtcaatttgatcc

SEQ ID NO: 7436309 - DNA, 16 bp, Homo sapiens
gcaggcagatcacatg

SEQ ID NO: 7436310 - DNA, 16 bp, Homo sapiens
gcaggcagatcacatg

SEQ ID NO: 7436311 - DNA, 16 bp, Homo sapiens
gcaggcagatcacatg

SEQ ID NO: 7436312 - DNA, 22 bp, Homo sapiens
gcaggcagagtcaatttgatcc

SEQ ID NO: 7436313 - DNA, 22 bp, Homo sapiens
gcaggcagagtcaatttgatcc

SEQ ID NO: 7436314 - DNA, 22 bp, Homo sapiens
gcaggcagagtcaatttgatcc

SEQ ID NO: 7436315 - DNA, 22 bp, Homo sapiens
gcaggcagaggtggaggagaca

SEQ ID NO: 7436316 - DNA, 22 bp, Homo sapiens
gcaggcagagtcaatttgatcc

SEQ ID NO: 7436317 - DNA, 16 bp, Homo sapiens
gcaggcagatcacatg

SEQ ID NO: 7436318 - DNA, 14 bp, Homo sapiens
gcaggcagatcacc

SEQ ID NO: 7436319 - DNA, 14 bp, Homo sapiens
gcaggcagatcacc

SEQ ID NO: 7436320 - DNA, 15 bp, Homo sapiens
gcaggcagatcaccg

SEQ ID NO: 7436321 - DNA, 15 bp, Homo sapiens
gcaggcagatcaccg

SEQ ID NO: 7436322 - DNA, 22 bp, Homo sapiens
gcaggcagatcacctgtcagga

SEQ ID NO: 7436323 - DNA, 22 bp, Homo sapiens
gcaggcagatcacctgtcagga

SEQ ID NO: 7436324 - DNA, 22 bp, Homo sapiens
gcaggcagttatttagtagaat

SEQ ID NO: 7436325 - DNA, 22 bp, Homo sapiens
gcaggcagttatttagtagaat

SEQ ID NO: 7436326 - DNA, 19 bp, Homo sapiens
gcaggcagtggcattcgga

SEQ ID NO: 7436327 - DNA, 22 bp, Homo sapiens
gcaggcagttatttagtagaat

SEQ ID NO: 7436328 - DNA, 22 bp, Homo sapiens
gcaggcagttatttagtagaat

SEQ ID NO: 7436329 - DNA, 22 bp, Homo sapiens
gcaggcagttatttagtagaat

SEQ ID NO: 7436330 - DNA, 22 bp, Homo sapiens
gcaggcagttatttagtagaat

SEQ ID NO: 7436331 - DNA, 22 bp, Homo sapiens
gcagggaagacccggagcagcg

SEQ ID NO: 7436332 - DNA, 22 bp, Homo sapiens
gcagggaagacccggagcagcg

SEQ ID NO: 7436333 - DNA, 22 bp, Homo sapiens
gcagggaagacccggagcagcg

SEQ ID NO: 7436334 - DNA, 22 bp, Homo sapiens
gcagggaagacccggagcagcg

SEQ ID NO: 7436335 - DNA, 22 bp, Homo sapiens
gcagggaagacccggagcagcg

SEQ ID NO: 7436336 - DNA, 22 bp, Homo sapiens
gcaggcagttgcagttttctag

SEQ ID NO: 7436337 - DNA, 22 bp, Homo sapiens
gcaggcagttgcagttttctag

SEQ ID NO: 7436338 - DNA, 22 bp, Homo sapiens
gcaggcagttgcagttttctag

SEQ ID NO: 7436339 - DNA, 22 bp, Homo sapiens
gcaggcagttgcagttttctag

SEQ ID NO: 7436340 - DNA, 22 bp, Homo sapiens
gcaggcagttatttagtagaat

SEQ ID NO: 7436341 - DNA, 22 bp, Homo sapiens
gcaggcagtcatctttcatatt

SEQ ID NO: 7436342 - DNA, 22 bp, Homo sapiens
gcaggcagtcatctttcatatt

SEQ ID NO: 7436343 - DNA, 19 bp, Homo sapiens
gcaggcagtggcattcgga

SEQ ID NO: 7436344 - DNA, 22 bp, Homo sapiens
gcaggcagtcatctttcatatt

SEQ ID NO: 7436345 - DNA, 22 bp, Homo sapiens
gcaggcagtcatctttcatatt

SEQ ID NO: 7436346 - DNA, 22 bp, Homo sapiens
gcaggcagtcatctttcatatt

SEQ ID NO: 7436347 - DNA, 19 bp, Homo sapiens
gcaggcagtggcattcgga

SEQ ID NO: 7436348 - DNA, 19 bp, Homo sapiens
gcaggcagtggcattcgga

SEQ ID NO: 7436349 - DNA, 19 bp, Homo sapiens
gcaggcagtggcattcgga

SEQ ID NO: 7436350 - DNA, 19 bp, Homo sapiens
gcaggcagtggcattcgga

SEQ ID NO: 7436351 - DNA, 19 bp, Homo sapiens
gcaggcagtggcattcgga

SEQ ID NO: 7436352 - DNA, 22 bp, Homo sapiens
gcaggcagttatttagtagaat

SEQ ID NO: 7436353 - DNA, 19 bp, Homo sapiens
gcaggcagtggcattcgga

SEQ ID NO: 7436354 - DNA, 22 bp, Homo sapiens
gcagggacaactgtgcacctga

SEQ ID NO: 7436355 - DNA, 22 bp, Homo sapiens
gcagggacaactgtgcacctga

SEQ ID NO: 7436356 - DNA, 21 bp, Homo sapiens
gcagggacaaagcttcaggag

SEQ ID NO: 7436357 - DNA, 21 bp, Homo sapiens
gcagggacaaagcttcaggag

SEQ ID NO: 7436358 - DNA, 21 bp, Homo sapiens
gcagggacaaagcttcaggag

SEQ ID NO: 7436359 - DNA, 21 bp, Homo sapiens
gcagggacaaagcttcaggag

SEQ ID NO: 7436360 - DNA, 21 bp, Homo sapiens
gcagggacaaagcttcaggag

SEQ ID NO: 7436361 - DNA, 22 bp, Homo sapiens
gcagggaagtttgatctttttc

SEQ ID NO: 7436362 - DNA, 21 bp, Homo sapiens
gcagggacaaagcttcaggag

SEQ ID NO: 7436363 - DNA, 21 bp, Homo sapiens
gcagggacaaagcttcaggag

SEQ ID NO: 7436364 - DNA, 21 bp, Homo sapiens
gcagggacaaagcttcaggag

SEQ ID NO: 7436365 - DNA, 22 bp, Homo sapiens
gcagggaaggggcatgctggag

SEQ ID NO: 7436366 - DNA, 22 bp, Homo sapiens
gcagggaaggggcatgctggag

SEQ ID NO: 7436367 - DNA, 22 bp, Homo sapiens
gcagggaaggggcatgctggag

SEQ ID NO: 7436368 - DNA, 22 bp, Homo sapiens
gcagggaaggggacggaaccag

SEQ ID NO: 7436369 - DNA, 22 bp, Homo sapiens
gcagggaagtttgatctttttc

SEQ ID NO: 7436370 - DNA, 22 bp, Homo sapiens
gcagggaagtttgatctttttc

SEQ ID NO: 7436371 - DNA, 22 bp, Homo sapiens
gcagggaagttgtaatgtaatg

SEQ ID NO: 7436372 - DNA, 22 bp, Homo sapiens
gcagggaagttgtaatgtaatg

SEQ ID NO: 7436373 - DNA, 22 bp, Homo sapiens
gcagggaaggggcatgctggag

SEQ ID NO: 7436374 - DNA, 22 bp, Homo sapiens
gcagggaaggggcatgctggag

SEQ ID NO: 7436375 - DNA, 22 bp, Homo sapiens
gcagggaagatcttggagctgc

SEQ ID NO: 7436376 - DNA, 22 bp, Homo sapiens
gcagggaagggaaacagagacc

SEQ ID NO: 7436377 - DNA, 22 bp, Homo sapiens
gcagggaagatcttggagctgc

SEQ ID NO: 7436378 - DNA, 22 bp, Homo sapiens
gcagggaagatcttggagctgc

SEQ ID NO: 7436379 - DNA, 22 bp, Homo sapiens
gcagggaagatcttggagctgc

SEQ ID NO: 7436380 - DNA, 22 bp, Homo sapiens
gcagggaagggaaacagagacc

SEQ ID NO: 7436381 - DNA, 22 bp, Homo sapiens
gcagggaagggaaacagagacc

SEQ ID NO: 7436382 - DNA, 22 bp, Homo sapiens
gcagggaagggaaacagagacc

SEQ ID NO: 7436383 - DNA, 22 bp, Homo sapiens
gcagggaagggaaacagagacc

SEQ ID NO: 7436384 - DNA, 22 bp, Homo sapiens
gcagggaagggaaacagagacc

SEQ ID NO: 7436385 - DNA, 22 bp, Homo sapiens
gcagggaagatcttggagctgc

SEQ ID NO: 7436386 - DNA, 22 bp, Homo sapiens
gcagggaagatcttggagctgc

SEQ ID NO: 7436387 - DNA, 22 bp, Homo sapiens
gcagggaagatcttggagctgc

SEQ ID NO: 7436388 - DNA, 22 bp, Homo sapiens
gcagggaagatcttggagctgc

SEQ ID NO: 7436389 - DNA, 22 bp, Homo sapiens
gcagggaagacccggagcagcg

SEQ ID NO: 7436390 - DNA, 22 bp, Homo sapiens
gcagggaagatcttggagctgc

SEQ ID NO: 7436391 - DNA, 22 bp, Homo sapiens
gcagggaagacccggagcagcg

SEQ ID NO: 7436392 - DNA, 22 bp, Homo sapiens
gcagggaagacccggagcagcg

SEQ ID NO: 7436393 - DNA, 22 bp, Homo sapiens
gcagggaagacccggagcagcg

SEQ ID NO: 7436394 - DNA, 22 bp, Homo sapiens
gcagggaagacccggagcagcg

SEQ ID NO: 7436395 - DNA, 22 bp, Homo sapiens
gcagggaagacccggagcagcg

SEQ ID NO: 7436396 - DNA, 22 bp, Homo sapiens
gcagggaagacccggagcagcg

SEQ ID NO: 7436397 - DNA, 22 bp, Homo sapiens
gcagggaagacccggagcagcg

SEQ ID NO: 7436398 - DNA, 22 bp, Homo sapiens
gcccagcttttcacttccacac

SEQ ID NO: 7436399 - DNA, 22 bp, Homo sapiens
gcccagcttttcacttccacac

SEQ ID NO: 7436400 - DNA, 22 bp, Homo sapiens
gcccagcttttcacttccacac

SEQ ID NO: 7436401 - DNA, 22 bp, Homo sapiens
gcccagctttttgaggcaggca

SEQ ID NO: 7436402 - DNA, 22 bp, Homo sapiens
gcccagcttttcacttccacac

SEQ ID NO: 7436403 - DNA, 22 bp, Homo sapiens
gcccagctttttgaggcaggca

SEQ ID NO: 7436404 - DNA, 22 bp, Homo sapiens
gcccagctttttgaggcaggca

SEQ ID NO: 7436405 - DNA, 22 bp, Homo sapiens
gcccagctttttgaggcaggca

SEQ ID NO: 7436406 - DNA, 22 bp, Homo sapiens
gcccagctggcttccagcacat

SEQ ID NO: 7436407 - DNA, 22 bp, Homo sapiens
gcccagctgtctggcagggatg

SEQ ID NO: 7436408 - DNA, 22 bp, Homo sapiens
gcccagctgtctggcagggatg

SEQ ID NO: 7436409 - DNA, 22 bp, Homo sapiens
gcccagctgtctggcagggatg

SEQ ID NO: 7436410 - DNA, 22 bp, Homo sapiens
gcccagctgtctggcagggatg

SEQ ID NO: 7436411 - DNA, 22 bp, Homo sapiens
gcccagctttttgaggcaggca

SEQ ID NO: 7436412 - DNA, 22 bp, Homo sapiens
gcccaggaaagatagggcctca

SEQ ID NO: 7436413 - DNA, 22 bp, Homo sapiens
gcccaggaaagatagggcctca

SEQ ID NO: 7436414 - DNA, 22 bp, Homo sapiens
gcccaggaaagatagggcctca

SEQ ID NO: 7436415 - DNA, 22 bp, Homo sapiens
gcccaggaaagatagggcctca

SEQ ID NO: 7436416 - DNA, 22 bp, Homo sapiens
gcccaggaaagatagggcctca

SEQ ID NO: 7436417 - DNA, 22 bp, Homo sapiens
gcccaggaaagatagggcctca

SEQ ID NO: 7436418 - DNA, 22 bp, Homo sapiens
gcccaggaaagatagggcctca

SEQ ID NO: 7436419 - DNA, 22 bp, Homo sapiens
gcccaggaaagatagggcctca

SEQ ID NO: 7436420 - DNA, 22 bp, Homo sapiens
gcccaggaaatgccccgtggtg

SEQ ID NO: 7436421 - DNA, 22 bp, Homo sapiens
gcccaggaaatgccccgtggtg

SEQ ID NO: 7436422 - DNA, 22 bp, Homo sapiens
gcccaggaaatgccccgtggtg

SEQ ID NO: 7436423 - DNA, 22 bp, Homo sapiens
gcccaggaaatgccccgtggtg

SEQ ID NO: 7436424 - DNA, 22 bp, Homo sapiens
gcccaggaaataaaagtgggct

SEQ ID NO: 7436425 - DNA, 22 bp, Homo sapiens
gcccaggaaataaaagtgggct

SEQ ID NO: 7436426 - DNA, 22 bp, Homo sapiens
gcccaggaaataaaagtgggct

SEQ ID NO: 7436427 - DNA, 22 bp, Homo sapiens
gcccaggaaataaaagtgggct

SEQ ID NO: 7436428 - DNA, 22 bp, Homo sapiens
gcccaggaaataaaagtgggct

SEQ ID NO: 7436429 - DNA, 17 bp, Homo sapiens
gcccaggaaggacggcc

SEQ ID NO: 7436430 - DNA, 17 bp, Homo sapiens
gcccaggaaggacggcc

SEQ ID NO: 7436431 - DNA, 17 bp, Homo sapiens
gcccaggaaggacggcc

SEQ ID NO: 7436432 - DNA, 17 bp, Homo sapiens
gcccaggaaggacggcc

SEQ ID NO: 7436433 - DNA, 22 bp, Homo sapiens
gcccaggaagtgactcagatgt

SEQ ID NO: 7436434 - DNA, 22 bp, Homo sapiens
gcccaggaagtgactcagatgt

SEQ ID NO: 7436435 - DNA, 22 bp, Homo sapiens
gcccaggaagtgactcagatgt

SEQ ID NO: 7436436 - DNA, 22 bp, Homo sapiens
gcccaggaagtgactcagatgt

SEQ ID NO: 7436437 - DNA, 22 bp, Homo sapiens
gcccaggaagtgactcagatgt

SEQ ID NO: 7436438 - DNA, 22 bp, Homo sapiens
gcccaggaagtgactcagatgt

SEQ ID NO: 7436439 - DNA, 17 bp, Homo sapiens
gcccaggaaggacggcc

SEQ ID NO: 7436440 - DNA, 17 bp, Homo sapiens
gcccaggaaggacggcc

SEQ ID NO: 7436441 - DNA, 17 bp, Homo sapiens
gcccaggaaggacggcc

SEQ ID NO: 7436442 - DNA, 17 bp, Homo sapiens
gcccaggaaggacggcc

SEQ ID NO: 7436443 - DNA, 17 bp, Homo sapiens
gcccaggaaggacggcc

SEQ ID NO: 7436444 - DNA, 22 bp, Homo sapiens
gcccaggaagccaccgggaagt

SEQ ID NO: 7436445 - DNA, 22 bp, Homo sapiens
gcccaggaaatgccccgtggtg

SEQ ID NO: 7436446 - DNA, 22 bp, Homo sapiens
gcccaggaaatgccccgtggtg

SEQ ID NO: 7436447 - DNA, 22 bp, Homo sapiens
gcccaggaagccaccgggaagt

SEQ ID NO: 7436448 - DNA, 22 bp, Homo sapiens
gcccaggaagccaccgggaagt

SEQ ID NO: 7436449 - DNA, 22 bp, Homo sapiens
gcccaggaagccaccgggaagt

SEQ ID NO: 7436450 - DNA, 22 bp, Homo sapiens
gcccaggaagttgaggctgccg

SEQ ID NO: 7436451 - DNA, 22 bp, Homo sapiens
gcccaggaagttgaggctgccg

SEQ ID NO: 7436452 - DNA, 22 bp, Homo sapiens
gcccaggaagttgaggctgccg

SEQ ID NO: 7436453 - DNA, 22 bp, Homo sapiens
gcccaggaagttgaggctgccg

SEQ ID NO: 7436454 - DNA, 22 bp, Homo sapiens
gcccaggaagttgaggctgccg

SEQ ID NO: 7436455 - DNA, 22 bp, Homo sapiens
gcccaggaagttgaggctgccg

SEQ ID NO: 7436456 - DNA, 22 bp, Homo sapiens
gcccaggaagttgaggctgccg

SEQ ID NO: 7436457 - DNA, 22 bp, Homo sapiens
gcccaggaagttgaggctgccg

SEQ ID NO: 7436458 - DNA, 22 bp, Homo sapiens
gcccaggaagttgaggctgccg

SEQ ID NO: 7436459 - DNA, 22 bp, Homo sapiens
gcccaggaagttgaggctgccg

SEQ ID NO: 7436460 - DNA, 22 bp, Homo sapiens
gcccaggaagttgaggctgccg

SEQ ID NO: 7436461 - DNA, 20 bp, Homo sapiens
gcccaggaatttgcatttct

SEQ ID NO: 7436462 - DNA, 20 bp, Homo sapiens
gcccaggaatttgcatttct

SEQ ID NO: 7436463 - DNA, 22 bp, Homo sapiens
gcccaggaagttgaggctgccg

SEQ ID NO: 7436464 - DNA, 22 bp, Homo sapiens
gcccaggaagttgaggctgccg

SEQ ID NO: 7436465 - DNA, 20 bp, Homo sapiens
gcccaggaatttgcatttct

SEQ ID NO: 7436466 - DNA, 20 bp, Homo sapiens
gcccaggaatttgcatttct

SEQ ID NO: 7436467 - DNA, 16 bp, Homo sapiens
gcccaggacgggaggc

SEQ ID NO: 7436468 - DNA, 20 bp, Homo sapiens
gcccaggaatttgcatttct

SEQ ID NO: 7436469 - DNA, 16 bp, Homo sapiens
gcccaggacgggaggc

SEQ ID NO: 7436470 - DNA, 16 bp, Homo sapiens
gcccaggacgggaggc

SEQ ID NO: 7436471 - DNA, 16 bp, Homo sapiens
gcccaggacgggaggc

SEQ ID NO: 7436472 - DNA, 16 bp, Homo sapiens
gcccaggacgggaggc

SEQ ID NO: 7436473 - DNA, 22 bp, Homo sapiens
gccccacagcctgcggtctcag

SEQ ID NO: 7436474 - DNA, 22 bp, Homo sapiens
gccccaagtccctatgtttcca

SEQ ID NO: 7436475 - DNA, 22 bp, Homo sapiens
gcccattgagtgcccgtgagcc

SEQ ID NO: 7436476 - DNA, 22 bp, Homo sapiens
gccccaagggagcccagcacac

SEQ ID NO: 7436477 - DNA, 22 bp, Homo sapiens
gcccatttttagtagatttagt

SEQ ID NO: 7436478 - DNA, 22 bp, Homo sapiens
gcccatggttacttttctggct

SEQ ID NO: 7436479 - DNA, 22 bp, Homo sapiens
gcccatggttacttttctggct

SEQ ID NO: 7436480 - DNA, 22 bp, Homo sapiens
gcccatggttacttttctggct

SEQ ID NO: 7436481 - DNA, 22 bp, Homo sapiens
gcccatgtgatttcctgggagt

SEQ ID NO: 7436482 - DNA, 22 bp, Homo sapiens
gcccatgtagtatttcctttgt

SEQ ID NO: 7436483 - DNA, 22 bp, Homo sapiens
gcccatgtctgacagggtgggg

SEQ ID NO: 7436484 - DNA, 22 bp, Homo sapiens
gcccatgtctgacagggtgggg

SEQ ID NO: 7436485 - DNA, 22 bp, Homo sapiens
gcccatttagagggtgaagaag

SEQ ID NO: 7436486 - DNA, 22 bp, Homo sapiens
gcccatgttcagtcccaggagg

SEQ ID NO: 7436487 - DNA, 22 bp, Homo sapiens
gcccatgtgatttcctgggagt

SEQ ID NO: 7436488 - DNA, 22 bp, Homo sapiens
gcccatgtgatttcctgggagt

SEQ ID NO: 7436489 - DNA, 21 bp, Homo sapiens
gcccatgtgggaggggtagaa

SEQ ID NO: 7436490 - DNA, 22 bp, Homo sapiens
gcccatggtggcgttcggtgca

SEQ ID NO: 7436491 - DNA, 22 bp, Homo sapiens
gcccatggtgaggttgttggtg

SEQ ID NO: 7436492 - DNA, 22 bp, Homo sapiens
gcccatggtgaggttgttggtg

SEQ ID NO: 7436493 - DNA, 22 bp, Homo sapiens
gcccatggtccaggaagacaga

SEQ ID NO: 7436494 - DNA, 22 bp, Homo sapiens
gcccatggtcagggaggcaggg

SEQ ID NO: 7436495 - DNA, 22 bp, Homo sapiens
gcccatggtcagggaggcaggg

SEQ ID NO: 7436496 - DNA, 22 bp, Homo sapiens
gcccatggtcagggaggcaggg

SEQ ID NO: 7436497 - DNA, 22 bp, Homo sapiens
gcccatggtcagggaggcaggg

SEQ ID NO: 7436498 - DNA, 22 bp, Homo sapiens
gcccatggtcagggaggcaggg

SEQ ID NO: 7436499 - DNA, 22 bp, Homo sapiens
gccccaccgagggtgcagtcct

SEQ ID NO: 7436500 - DNA, 22 bp, Homo sapiens
gccccaccgagggtgcagtcct

SEQ ID NO: 7436501 - DNA, 22 bp, Homo sapiens
gccccaccgagggtgcagtcct

SEQ ID NO: 7436502 - DNA, 22 bp, Homo sapiens
gccccaccgagggtgcagtcct

SEQ ID NO: 7436503 - DNA, 22 bp, Homo sapiens
gccccacagcctgcggtctcag

SEQ ID NO: 7436504 - DNA, 22 bp, Homo sapiens
gccccacctgctaccttccagc

SEQ ID NO: 7436505 - DNA, 22 bp, Homo sapiens
gccccacctgctaccttccagc

SEQ ID NO: 7436506 - DNA, 22 bp, Homo sapiens
gccccaccgagggtgcagtcct

SEQ ID NO: 7436507 - DNA, 22 bp, Homo sapiens
gccccaccgagggtgcagtcct

SEQ ID NO: 7436508 - DNA, 22 bp, Homo sapiens
gccccactttcctaggcagtat

SEQ ID NO: 7436509 - DNA, 22 bp, Homo sapiens
gccccactgtggaacctaagtc

SEQ ID NO: 7436510 - DNA, 22 bp, Homo sapiens
gccccactgtggaacctaagtc

SEQ ID NO: 7436511 - DNA, 22 bp, Homo sapiens
gccccaccttgagagcagaaac

SEQ ID NO: 7436512 - DNA, 22 bp, Homo sapiens
gccccaccttgagagcagaaac

SEQ ID NO: 7436513 - DNA, 22 bp, Homo sapiens
gccccacctgctaccttccagc

SEQ ID NO: 7436514 - DNA, 22 bp, Homo sapiens
gccccacctgctaccttccagc

SEQ ID NO: 7436515 - DNA, 22 bp, Homo sapiens
gccccacctgctaccttccagc

SEQ ID NO: 7436516 - DNA, 22 bp, Homo sapiens
gcccaggagaggccagggctga

SEQ ID NO: 7436517 - DNA, 22 bp, Homo sapiens
gcccaggagaggccagggctga

SEQ ID NO: 7436518 - DNA, 22 bp, Homo sapiens
gcccaggagaggccagggctga

SEQ ID NO: 7436519 - DNA, 22 bp, Homo sapiens
gcccaggagaggccagggctga

SEQ ID NO: 7436520 - DNA, 22 bp, Homo sapiens
gcccaggagaggccagggctga

SEQ ID NO: 7436521 - DNA, 22 bp, Homo sapiens
gcccaggagaggccagggctga

SEQ ID NO: 7436522 - DNA, 16 bp, Homo sapiens
gcccaggacgggaggc

SEQ ID NO: 7436523 - DNA, 22 bp, Homo sapiens
gcccaggactcagggtgtcgcg

SEQ ID NO: 7436524 - DNA, 22 bp, Homo sapiens
gcccaggactcagggtgtcgcg

SEQ ID NO: 7436525 - DNA, 22 bp, Homo sapiens
gcccaggactcagggtgtcgcg

SEQ ID NO: 7436526 - DNA, 22 bp, Homo sapiens
gcccaggactcagggtgtcgcg

SEQ ID NO: 7436527 - DNA, 22 bp, Homo sapiens
gcccaggagcctggagatgtgt

SEQ ID NO: 7436528 - DNA, 22 bp, Homo sapiens
gcccaggagaggccagggctga

SEQ ID NO: 7436529 - DNA, 22 bp, Homo sapiens
gcccaggagaggccagggctga

SEQ ID NO: 7436530 - DNA, 22 bp, Homo sapiens
gcccaggagaggccagggctga

SEQ ID NO: 7436531 - DNA, 22 bp, Homo sapiens
gcccaggagaggccagggctga

SEQ ID NO: 7436532 - DNA, 22 bp, Homo sapiens
gcccaggagaggccagggctga

SEQ ID NO: 7436533 - DNA, 22 bp, Homo sapiens
gcccaggagcctggagatgtgt

SEQ ID NO: 7436534 - DNA, 22 bp, Homo sapiens
gcccaggagcctggagatgtgt

SEQ ID NO: 7436535 - DNA, 22 bp, Homo sapiens
gcccaggagcctggagatgtgt

SEQ ID NO: 7436536 - DNA, 22 bp, Homo sapiens
gcccaggagcctggagatgtgt

SEQ ID NO: 7436537 - DNA, 22 bp, Homo sapiens
gcccaggagcctggagatgtgt

SEQ ID NO: 7436538 - DNA, 22 bp, Homo sapiens
gcccatggcagaactgtgagca

SEQ ID NO: 7436539 - DNA, 22 bp, Homo sapiens
gcccatggcagaactgtgagca

SEQ ID NO: 7436540 - DNA, 22 bp, Homo sapiens
gcccatggcttccctaggcaca

SEQ ID NO: 7436541 - DNA, 22 bp, Homo sapiens
gcccatggcttccctaggcaca

SEQ ID NO: 7436542 - DNA, 22 bp, Homo sapiens
gcccatggcttccctaggcaca

SEQ ID NO: 7436543 - DNA, 22 bp, Homo sapiens
gcccaggagcctggagatgtgt

SEQ ID NO: 7436544 - DNA, 22 bp, Homo sapiens
gcccaggaggagaggctgcagt

SEQ ID NO: 7436545 - DNA, 22 bp, Homo sapiens
gcccaggaggagaggctgcagt

SEQ ID NO: 7436546 - DNA, 22 bp, Homo sapiens
gcccaggaggagaggctgcagt

SEQ ID NO: 7436547 - DNA, 22 bp, Homo sapiens
gcccaggaggagaggctgcagt

SEQ ID NO: 7436548 - DNA, 22 bp, Homo sapiens
gcccatgggctccagacctggg

SEQ ID NO: 7436549 - DNA, 22 bp, Homo sapiens
gcccatgggcctgaggccctag

SEQ ID NO: 7436550 - DNA, 22 bp, Homo sapiens
gcccatggtcagggaggcaggg

SEQ ID NO: 7436551 - DNA, 18 bp, Homo sapiens
gcccatggtaaatgctgt

SEQ ID NO: 7436552 - DNA, 22 bp, Homo sapiens
gcccatggcttccctaggcaca

SEQ ID NO: 7436553 - DNA, 22 bp, Homo sapiens
gcccatggcttccctaggcaca

SEQ ID NO: 7436554 - DNA, 22 bp, Homo sapiens
gcccatgggcctgaggccctag

SEQ ID NO: 7436555 - DNA, 22 bp, Homo sapiens
gcccatgggcctgaggccctag

SEQ ID NO: 7436556 - DNA, 22 bp, Homo sapiens
gcccatgggcctgaggccctag

SEQ ID NO: 7436557 - DNA, 22 bp, Homo sapiens
gcccagcctccaagctccaagg

SEQ ID NO: 7436558 - DNA, 22 bp, Homo sapiens
gcccagcctccaagctccaagg

SEQ ID NO: 7436559 - DNA, 22 bp, Homo sapiens
gcccagcgagcagaggtggacg

SEQ ID NO: 7436560 - DNA, 22 bp, Homo sapiens
gcccagctccattcttggtgag

SEQ ID NO: 7436561 - DNA, 22 bp, Homo sapiens
gcccagcctccaagctccaagg

SEQ ID NO: 7436562 - DNA, 22 bp, Homo sapiens
gcccagccctgaggtcacagct

SEQ ID NO: 7436563 - DNA, 22 bp, Homo sapiens
gcccagccctgaggtcacagct

SEQ ID NO: 7436564 - DNA, 22 bp, Homo sapiens
gcccagccctgaggtcacagct

SEQ ID NO: 7436565 - DNA, 22 bp, Homo sapiens
gcccagcctccaagctccaagg

SEQ ID NO: 7436566 - DNA, 22 bp, Homo sapiens
gcccagcctccaagctccaagg

SEQ ID NO: 7436567 - DNA, 22 bp, Homo sapiens
gcccagccctgaggtcacagct

SEQ ID NO: 7436568 - DNA, 22 bp, Homo sapiens
gcccagccctgaggtcacagct

SEQ ID NO: 7436569 - DNA, 22 bp, Homo sapiens
gcccagctcctctgcagaccct

SEQ ID NO: 7436570 - DNA, 22 bp, Homo sapiens
gcccagctgagaagcgcggggc

SEQ ID NO: 7436571 - DNA, 22 bp, Homo sapiens
gcccagcgagcagaggtggacg

SEQ ID NO: 7436572 - DNA, 22 bp, Homo sapiens
gcccagcgagcagaggtggacg

SEQ ID NO: 7436573 - DNA, 22 bp, Homo sapiens
gcccagctccattcttggtgag

SEQ ID NO: 7436574 - DNA, 22 bp, Homo sapiens
gcccagctccattcttggtgag

SEQ ID NO: 7436575 - DNA, 22 bp, Homo sapiens
gcccagctcctctgcagaccct

SEQ ID NO: 7436576 - DNA, 22 bp, Homo sapiens
gcccagctcctctgcagaccct

SEQ ID NO: 7436577 - DNA, 22 bp, Homo sapiens
gcccagctcctctgcagaccct

SEQ ID NO: 7436578 - DNA, 22 bp, Homo sapiens
gcccagctccattcttggtgag

SEQ ID NO: 7436579 - DNA, 22 bp, Homo sapiens
gcccagctgagaagcgcggggc

SEQ ID NO: 7436580 - DNA, 22 bp, Homo sapiens
gcccagctgagaagcgcggggc

SEQ ID NO: 7436581 - DNA, 22 bp, Homo sapiens
gcccagctgagaagcgcggggc

SEQ ID NO: 7436582 - DNA, 22 bp, Homo sapiens
gcccagctgagaagcgcggggc

SEQ ID NO: 7436583 - DNA, 22 bp, Homo sapiens
gcccagctgcaccctggtgggt

SEQ ID NO: 7436584 - DNA, 22 bp, Homo sapiens
gcccagctgcaccctggtgggt

SEQ ID NO: 7436585 - DNA, 22 bp, Homo sapiens
gcccagctggcttccagcacat

SEQ ID NO: 7436586 - DNA, 22 bp, Homo sapiens
gcccagctggcttccagcacat

SEQ ID NO: 7436587 - DNA, 22 bp, Homo sapiens
gcccagctggcttccagcacat

SEQ ID NO: 7436588 - DNA, 22 bp, Homo sapiens
gcccagctgcaccctggtgggt

SEQ ID NO: 7436589 - DNA, 22 bp, Homo sapiens
gcccagctgcaccctggtgggt

SEQ ID NO: 7436590 - DNA, 22 bp, Homo sapiens
gcccagcagctggtggagaagg

SEQ ID NO: 7436591 - DNA, 22 bp, Homo sapiens
gcccagcagctggtggagaagg

SEQ ID NO: 7436592 - DNA, 22 bp, Homo sapiens
gcccagcagctggtggagaagg

SEQ ID NO: 7436593 - DNA, 22 bp, Homo sapiens
gcccagccctgaggtcacagct

SEQ ID NO: 7436594 - DNA, 22 bp, Homo sapiens
gcccagcagctggtggagaagg

SEQ ID NO: 7436595 - DNA, 22 bp, Homo sapiens
gcccagccctgaggtcacagct

SEQ ID NO: 7436596 - DNA, 22 bp, Homo sapiens
gcccagccctgaggtcacagct

SEQ ID NO: 7436597 - DNA, 22 bp, Homo sapiens
gcccagccctgaggtcacagct

SEQ ID NO: 7436598 - DNA, 22 bp, Homo sapiens
gcccagcagatctcagtgtctc

SEQ ID NO: 7436599 - DNA, 22 bp, Homo sapiens
gcccagcagatctcagtgtctc

SEQ ID NO: 7436600 - DNA, 22 bp, Homo sapiens
gcccagcagatctcagtgtctc

SEQ ID NO: 7436601 - DNA, 22 bp, Homo sapiens
gcccagcagctccacttggctt

SEQ ID NO: 7436602 - DNA, 22 bp, Homo sapiens
gcccagcagctccacttggctt

SEQ ID NO: 7436603 - DNA, 22 bp, Homo sapiens
gcccagcagatctcagtgtctc

SEQ ID NO: 7436604 - DNA, 22 bp, Homo sapiens
gcccagcagatctcagtgtctc

SEQ ID NO: 7436605 - DNA, 22 bp, Homo sapiens
gcccagcactcctctctgacat

SEQ ID NO: 7436606 - DNA, 22 bp, Homo sapiens
gcccagcactcctctctgacat

SEQ ID NO: 7436607 - DNA, 22 bp, Homo sapiens
gcccagcactcctctctgacat

SEQ ID NO: 7436608 - DNA, 22 bp, Homo sapiens
gcccagcactaaaagctttgct

SEQ ID NO: 7436609 - DNA, 22 bp, Homo sapiens
gcccagcactaaaagctttgct

SEQ ID NO: 7436610 - DNA, 22 bp, Homo sapiens
gcccagcactcctctctgacat

SEQ ID NO: 7436611 - DNA, 22 bp, Homo sapiens
gcccagcactaaaagctttgct

SEQ ID NO: 7436612 - DNA, 22 bp, Homo sapiens
gcccagcacctctctcagggtt

SEQ ID NO: 7436613 - DNA, 22 bp, Homo sapiens
gcccagcacctctctcagggtt

SEQ ID NO: 7436614 - DNA, 22 bp, Homo sapiens
gcccagcacctctctcagggtt

SEQ ID NO: 7436615 - DNA, 22 bp, Homo sapiens
gcccagcacctctctcagggtt

SEQ ID NO: 7436616 - DNA, 22 bp, Homo sapiens
gcccagcacctctctcagggtt

SEQ ID NO: 7436617 - DNA, 22 bp, Homo sapiens
gcccagcacctctctcagggtt

SEQ ID NO: 7436618 - DNA, 22 bp, Homo sapiens
gcccagcacctctctcagggtt

SEQ ID NO: 7436619 - DNA, 22 bp, Homo sapiens
gcccagcacctctctcagggtt

SEQ ID NO: 7436620 - DNA, 22 bp, Homo sapiens
gccagggtggcagaaggcccca

SEQ ID NO: 7436621 - DNA, 22 bp, Homo sapiens
gccagggtgagggctgagaggt

SEQ ID NO: 7436622 - DNA, 22 bp, Homo sapiens
gccagggtgagggctgagaggt

SEQ ID NO: 7436623 - DNA, 22 bp, Homo sapiens
gccagggtggcagaaggcccca

SEQ ID NO: 7436624 - DNA, 22 bp, Homo sapiens
gccagggtgtgcagggacagga

SEQ ID NO: 7436625 - DNA, 22 bp, Homo sapiens
gccaggggtgcccacccaagga

SEQ ID NO: 7436626 - DNA, 22 bp, Homo sapiens
gccaggggtgcccacccaagga

SEQ ID NO: 7436627 - DNA, 22 bp, Homo sapiens
gccaggggtgcccacccaagga

SEQ ID NO: 7436628 - DNA, 22 bp, Homo sapiens
gccagggtgtgcagggacagga

SEQ ID NO: 7436629 - DNA, 22 bp, Homo sapiens
gccagggtgtgcagggacagga

SEQ ID NO: 7436630 - DNA, 22 bp, Homo sapiens
gccagggttcgaatccgtatgg

SEQ ID NO: 7436631 - DNA, 22 bp, Homo sapiens
gccagggttcgaatccgtatgg

SEQ ID NO: 7436632 - DNA, 22 bp, Homo sapiens
gccagggttcgaatccgtatgg

SEQ ID NO: 7436633 - DNA, 22 bp, Homo sapiens
gccagggttcgaatccgtatgg

SEQ ID NO: 7436634 - DNA, 22 bp, Homo sapiens
gccagggttcgaatccgtatgg

SEQ ID NO: 7436635 - DNA, 22 bp, Homo sapiens
gccagggggtcagcaggcactt

SEQ ID NO: 7436636 - DNA, 22 bp, Homo sapiens
gccagggggtcagcaggcactt

SEQ ID NO: 7436637 - DNA, 22 bp, Homo sapiens
gccagggggtcagcaggcactt

SEQ ID NO: 7436638 - DNA, 22 bp, Homo sapiens
gccagggggtcagcaggcactt

SEQ ID NO: 7436639 - DNA, 22 bp, Homo sapiens
gccagggggtcagcaggcactt

SEQ ID NO: 7436640 - DNA, 22 bp, Homo sapiens
gccagggggtcagcaggcactt

SEQ ID NO: 7436641 - DNA, 22 bp, Homo sapiens
gccagggggtcagcaggcactt

SEQ ID NO: 7436642 - DNA, 22 bp, Homo sapiens
gccagggggtcagcaggcactt

SEQ ID NO: 7436643 - DNA, 22 bp, Homo sapiens
gccagggggtcagcaggcactt

SEQ ID NO: 7436644 - DNA, 22 bp, Homo sapiens
gccagggggtcagcaggcactt

SEQ ID NO: 7436645 - DNA, 22 bp, Homo sapiens
gccagggggtcagcaggcactt

SEQ ID NO: 7436646 - DNA, 22 bp, Homo sapiens
gccaggggacgcggagcgacga

SEQ ID NO: 7436647 - DNA, 22 bp, Homo sapiens
gccaggggacgcggagcgacga

SEQ ID NO: 7436648 - DNA, 22 bp, Homo sapiens
gccaggggacgcggagcgacga

SEQ ID NO: 7436649 - DNA, 22 bp, Homo sapiens
gccaggggacgcggagcgacga

SEQ ID NO: 7436650 - DNA, 22 bp, Homo sapiens
gccaggggacgcggagcgacga

SEQ ID NO: 7436651 - DNA, 22 bp, Homo sapiens
gccaggggacgcggagcgacga

SEQ ID NO: 7436652 - DNA, 22 bp, Homo sapiens
gccaggggacgcggagcgacga

SEQ ID NO: 7436653 - DNA, 22 bp, Homo sapiens
gccaggggacgcggagcgacga

SEQ ID NO: 7436654 - DNA, 22 bp, Homo sapiens
gccaggggacgcggagcgacga

SEQ ID NO: 7436655 - DNA, 22 bp, Homo sapiens
gccagggttgccaatgggggca

SEQ ID NO: 7436656 - DNA, 22 bp, Homo sapiens
gccagggttgccaatgggggca

SEQ ID NO: 7436657 - DNA, 22 bp, Homo sapiens
gccagggttgccaatgggggca

SEQ ID NO: 7436658 - DNA, 23 bp, Homo sapiens
gccaggtattctgataggcactg

SEQ ID NO: 7436659 - DNA, 21 bp, Homo sapiens
gcccagcaaggtgagaaggcc

SEQ ID NO: 7436660 - DNA, 21 bp, Homo sapiens
gcccagcaaggtgagaaggcc

SEQ ID NO: 7436661 - DNA, 21 bp, Homo sapiens
gcccagcaaggtgagaaggcc

SEQ ID NO: 7436662 - DNA, 23 bp, Homo sapiens
gccaggtattctgataggcactg

SEQ ID NO: 7436663 - DNA, 22 bp, Homo sapiens
gccaggtcacagggataaatgg

SEQ ID NO: 7436664 - DNA, 22 bp, Homo sapiens
gccaggtcacagggataaatgg

SEQ ID NO: 7436665 - DNA, 22 bp, Homo sapiens
gccaggtcacctcactcatcca

SEQ ID NO: 7436666 - DNA, 21 bp, Homo sapiens
gcccagcaaggtgagaaggcc

SEQ ID NO: 7436667 - DNA, 21 bp, Homo sapiens
gcccagcaaggtgagaaggcc

SEQ ID NO: 7436668 - DNA, 21 bp, Homo sapiens
gcccagcaaggtgagaaggcc

SEQ ID NO: 7436669 - DNA, 22 bp, Homo sapiens
gcccagcacagctggaagagtc

SEQ ID NO: 7436670 - DNA, 22 bp, Homo sapiens
gcccagcacagctggaagagtc

SEQ ID NO: 7436671 - DNA, 22 bp, Homo sapiens
gcccagcacagctggaagagtc

SEQ ID NO: 7436672 - DNA, 22 bp, Homo sapiens
gcccagcacagctggaagagtc

SEQ ID NO: 7436673 - DNA, 22 bp, Homo sapiens
gcccagcacatctggccttgaa

SEQ ID NO: 7436674 - DNA, 22 bp, Homo sapiens
gcccagcacatctggccttgaa

SEQ ID NO: 7436675 - DNA, 22 bp, Homo sapiens
gcccagcacattgctgaggacc

SEQ ID NO: 7436676 - DNA, 22 bp, Homo sapiens
gcccagcacagctggaagagtc

SEQ ID NO: 7436677 - DNA, 22 bp, Homo sapiens
gcccagcacatctggccttgaa

SEQ ID NO: 7436678 - DNA, 22 bp, Homo sapiens
gcccagcacatctggccttgaa

SEQ ID NO: 7436679 - DNA, 22 bp, Homo sapiens
gcccagcacagctggaagagtc

SEQ ID NO: 7436680 - DNA, 22 bp, Homo sapiens
gcccagcacagctggaagagtc

SEQ ID NO: 7436681 - DNA, 22 bp, Homo sapiens
gcccagcacattgctgaggacc

SEQ ID NO: 7436682 - DNA, 22 bp, Homo sapiens
gcccagcacattgctgaggacc

SEQ ID NO: 7436683 - DNA, 22 bp, Homo sapiens
gcccagcacattgctgaggacc

SEQ ID NO: 7436684 - DNA, 22 bp, Homo sapiens
gcccagcacattgctgaggacc

SEQ ID NO: 7436685 - DNA, 22 bp, Homo sapiens
gcccagcacattgctgaggacc

SEQ ID NO: 7436686 - DNA, 22 bp, Homo sapiens
gcccagcacattgctgaggacc

SEQ ID NO: 7436687 - DNA, 22 bp, Homo sapiens
gcccagcacattgctgaggacc

SEQ ID NO: 7436688 - DNA, 22 bp, Homo sapiens
gcccagcacattgctgaggacc

SEQ ID NO: 7436689 - DNA, 22 bp, Homo sapiens
gcccagcacattgctgaggacc

SEQ ID NO: 7436690 - DNA, 15 bp, Homo sapiens
gccccaggaatcaaa

SEQ ID NO: 7436691 - DNA, 15 bp, Homo sapiens
gccccaggaatcaaa

SEQ ID NO: 7436692 - DNA, 22 bp, Homo sapiens
gccccaggataaatttgtaaga

SEQ ID NO: 7436693 - DNA, 22 bp, Homo sapiens
gccccaggataaatttgtaaga

SEQ ID NO: 7436694 - DNA, 22 bp, Homo sapiens
gccccaggggaggtgccctgca

SEQ ID NO: 7436695 - DNA, 22 bp, Homo sapiens
gccccaggggaggtgccctgca

SEQ ID NO: 7436696 - DNA, 22 bp, Homo sapiens
gccccaggggaggtgccctgca

SEQ ID NO: 7436697 - DNA, 22 bp, Homo sapiens
gccccaggggaggtgccctgca

SEQ ID NO: 7436698 - DNA, 22 bp, Homo sapiens
gccccaggggaggtgccctgca

SEQ ID NO: 7436699 - DNA, 22 bp, Homo sapiens
gccccaggataaatttgtaaga

SEQ ID NO: 7436700 - DNA, 22 bp, Homo sapiens
gccccagctctgccacaactag

SEQ ID NO: 7436701 - DNA, 22 bp, Homo sapiens
gccccagcgtggctgtgttagg

SEQ ID NO: 7436702 - DNA, 22 bp, Homo sapiens
gccccagcctgggaactggagg

SEQ ID NO: 7436703 - DNA, 22 bp, Homo sapiens
gccccagcctgggaactggagg

SEQ ID NO: 7436704 - DNA, 22 bp, Homo sapiens
gccccagcctgggaactggagg

SEQ ID NO: 7436705 - DNA, 22 bp, Homo sapiens
gccccagcgtggctgtgttagg

SEQ ID NO: 7436706 - DNA, 17 bp, Homo sapiens
gccctggagccaggcta

SEQ ID NO: 7436707 - DNA, 17 bp, Homo sapiens
gccctggagccaggcta

SEQ ID NO: 7436708 - DNA, 17 bp, Homo sapiens
gccctggagccaggcta

SEQ ID NO: 7436709 - DNA, 20 bp, Homo sapiens
gccctggagccttgtcctgg

SEQ ID NO: 7436710 - DNA, 22 bp, Homo sapiens
gccctggagctagactaggaca

SEQ ID NO: 7436711 - DNA, 22 bp, Homo sapiens
gccctggagctagactaggaca

SEQ ID NO: 7436712 - DNA, 22 bp, Homo sapiens
gccctggagctagactaggaca

SEQ ID NO: 7436713 - DNA, 22 bp, Homo sapiens
gccctggagggccagcgactgg

SEQ ID NO: 7436714 - DNA, 22 bp, Homo sapiens
gccctggagggccagcgactgg

SEQ ID NO: 7436715 - DNA, 22 bp, Homo sapiens
gccctggagagggatatggcat

SEQ ID NO: 7436716 - DNA, 22 bp, Homo sapiens
gccccaggggaggtgccctgca

SEQ ID NO: 7436717 - DNA, 22 bp, Homo sapiens
gccccaggggaggtgccctgca

SEQ ID NO: 7436718 - DNA, 22 bp, Homo sapiens
gccccaggggaggtgccctgca

SEQ ID NO: 7436719 - DNA, 22 bp, Homo sapiens
gccccaggggaggtgccctgca

SEQ ID NO: 7436720 - DNA, 17 bp, Homo sapiens
gccctggagccaggcta

SEQ ID NO: 7436721 - DNA, 17 bp, Homo sapiens
gccctggagccaggcta

SEQ ID NO: 7436722 - DNA, 22 bp, Homo sapiens
gccctggagagggatatggcat

SEQ ID NO: 7436723 - DNA, 17 bp, Homo sapiens
gccctggagccaggcta

SEQ ID NO: 7436724 - DNA, 17 bp, Homo sapiens
gccctggagccaggcta

SEQ ID NO: 7436725 - DNA, 22 bp, Homo sapiens
gccccagcctcccgagtagctg

SEQ ID NO: 7436726 - DNA, 22 bp, Homo sapiens
gccccagcctagttttctttca

SEQ ID NO: 7436727 - DNA, 22 bp, Homo sapiens
gccccagcctagttttctttca

SEQ ID NO: 7436728 - DNA, 22 bp, Homo sapiens
gccccagccctgtggaccatgg

SEQ ID NO: 7436729 - DNA, 22 bp, Homo sapiens
gccccagccctgtggaccatgg

SEQ ID NO: 7436730 - DNA, 22 bp, Homo sapiens
gccccagccctgtggaccatgg

SEQ ID NO: 7436731 - DNA, 22 bp, Homo sapiens
gccccagccaaggtgacacgaa

SEQ ID NO: 7436732 - DNA, 22 bp, Homo sapiens
gccccagccaaggtgacacgaa

SEQ ID NO: 7436733 - DNA, 22 bp, Homo sapiens
gccccagccaaggtgacacgaa

SEQ ID NO: 7436734 - DNA, 22 bp, Homo sapiens
gccccagcctgggaactggagg

SEQ ID NO: 7436735 - DNA, 22 bp, Homo sapiens
gccccagcctcccgagtagctg

SEQ ID NO: 7436736 - DNA, 22 bp, Homo sapiens
gccccagcctcccgagtagctg

SEQ ID NO: 7436737 - DNA, 22 bp, Homo sapiens
gccccagcctcccgagtagctg

SEQ ID NO: 7436738 - DNA, 22 bp, Homo sapiens
gccccagcctcccgagtagctg

SEQ ID NO: 7436739 - DNA, 22 bp, Homo sapiens
gccccagcctcccgagtagctg

SEQ ID NO: 7436740 - DNA, 22 bp, Homo sapiens
gccccagcctcccgagtagctg

SEQ ID NO: 7436741 - DNA, 22 bp, Homo sapiens
gccccagcctcccgagtagctg

SEQ ID NO: 7436742 - DNA, 22 bp, Homo sapiens
gccccagccaaggtgacacgaa

SEQ ID NO: 7436743 - DNA, 22 bp, Homo sapiens
gccccagccaaggtgacacgaa

SEQ ID NO: 7436744 - DNA, 22 bp, Homo sapiens
gccccagccaaggtgacacgaa

SEQ ID NO: 7436745 - DNA, 22 bp, Homo sapiens
gccccagccaaggtgacacgaa

SEQ ID NO: 7436746 - DNA, 22 bp, Homo sapiens
gccccagcagcaatgcggttga

SEQ ID NO: 7436747 - DNA, 22 bp, Homo sapiens
gccccagcagcaatgcggttga

SEQ ID NO: 7436748 - DNA, 22 bp, Homo sapiens
gccccagacataagtagggggt

SEQ ID NO: 7436749 - DNA, 22 bp, Homo sapiens
gccccagacataagtagggggt

SEQ ID NO: 7436750 - DNA, 22 bp, Homo sapiens
gccccagatggaggaagctggg

SEQ ID NO: 7436751 - DNA, 22 bp, Homo sapiens
gccccagacataagtagggggt

SEQ ID NO: 7436752 - DNA, 22 bp, Homo sapiens
gccccagacataagtagggggt

SEQ ID NO: 7436753 - DNA, 22 bp, Homo sapiens
gccccagaaggggaaagcctgg

SEQ ID NO: 7436754 - DNA, 22 bp, Homo sapiens
gccccagatggaggaagctggg

SEQ ID NO: 7436755 - DNA, 22 bp, Homo sapiens
gccccagatggaggaagctggg

SEQ ID NO: 7436756 - DNA, 22 bp, Homo sapiens
gccccagaaggggaaagcctgg

SEQ ID NO: 7436757 - DNA, 22 bp, Homo sapiens
gccccagaaagttcaaggcaca

SEQ ID NO: 7436758 - DNA, 22 bp, Homo sapiens
gccccagaaagttcaaggcaca

SEQ ID NO: 7436759 - DNA, 22 bp, Homo sapiens
gccccagaaggggaaagcctgg

SEQ ID NO: 7436760 - DNA, 22 bp, Homo sapiens
gccccagaaagttcaaggcaca

SEQ ID NO: 7436761 - DNA, 22 bp, Homo sapiens
gccccagaaagttcaaggcaca

SEQ ID NO: 7436762 - DNA, 22 bp, Homo sapiens
gccccagaaagttcaaggcaca

SEQ ID NO: 7436763 - DNA, 22 bp, Homo sapiens
gccctgtggattaatgagcagg

SEQ ID NO: 7436764 - DNA, 22 bp, Homo sapiens
gccctgtggattaatgagcagg

SEQ ID NO: 7436765 - DNA, 22 bp, Homo sapiens
gccctgtggacccaggaactct

SEQ ID NO: 7436766 - DNA, 22 bp, Homo sapiens
gccctgtggacccaggaactct

SEQ ID NO: 7436767 - DNA, 22 bp, Homo sapiens
gccctgtggattaatgagcagg

SEQ ID NO: 7436768 - DNA, 22 bp, Homo sapiens
gccctgtggccccagtgggctc

SEQ ID NO: 7436769 - DNA, 22 bp, Homo sapiens
gccctgtggacccaggaactct

SEQ ID NO: 7436770 - DNA, 22 bp, Homo sapiens
gccctgtggacagtgagaagtg

SEQ ID NO: 7436771 - DNA, 22 bp, Homo sapiens
gccctgtggacagtgagaagtg

SEQ ID NO: 7436772 - DNA, 22 bp, Homo sapiens
gccctgtggacagtgagaagtg

SEQ ID NO: 7436773 - DNA, 22 bp, Homo sapiens
gccctgtgcttggatggcagat

SEQ ID NO: 7436774 - DNA, 22 bp, Homo sapiens
gccctgtgcttggatggcagat

SEQ ID NO: 7436775 - DNA, 22 bp, Homo sapiens
gccctgtgcttggatggcagat

SEQ ID NO: 7436776 - DNA, 22 bp, Homo sapiens
gccctgtgcttggatggcagat

SEQ ID NO: 7436777 - DNA, 22 bp, Homo sapiens
gccctgtgcttggatggcagat

SEQ ID NO: 7436778 - DNA, 22 bp, Homo sapiens
gccctgtgcttggatggcagat

SEQ ID NO: 7436779 - DNA, 22 bp, Homo sapiens
gccctgtgcttggatggcagat

SEQ ID NO: 7436780 - DNA, 22 bp, Homo sapiens
gccctgtgcttggatggcagat

SEQ ID NO: 7436781 - DNA, 22 bp, Homo sapiens
gccctgtgctcatgggaacatc

SEQ ID NO: 7436782 - DNA, 22 bp, Homo sapiens
gccctgtgctcatgggaacatc

SEQ ID NO: 7436783 - DNA, 22 bp, Homo sapiens
gccctgtgcgctgagttcaggg

SEQ ID NO: 7436784 - DNA, 22 bp, Homo sapiens
gccctgtgcgctgagttcaggg

SEQ ID NO: 7436785 - DNA, 22 bp, Homo sapiens
gccctgggattgggtggaggct

SEQ ID NO: 7436786 - DNA, 22 bp, Homo sapiens
gccctgggcaaggttctggcca

SEQ ID NO: 7436787 - DNA, 22 bp, Homo sapiens
gccctgggcaaggttctggcca

SEQ ID NO: 7436788 - DNA, 22 bp, Homo sapiens
gccctgggcaaggttctggcca

SEQ ID NO: 7436789 - DNA, 22 bp, Homo sapiens
gccctgggattgggtggaggct

SEQ ID NO: 7436790 - DNA, 22 bp, Homo sapiens
gccctgggattgggtggaggct

SEQ ID NO: 7436791 - DNA, 22 bp, Homo sapiens
gccctgggcaaggttctggcca

SEQ ID NO: 7436792 - DNA, 22 bp, Homo sapiens
gccctgggcaaggttctggcca

SEQ ID NO: 7436793 - DNA, 22 bp, Homo sapiens
gccctgggctccctgctccaca

SEQ ID NO: 7436794 - DNA, 22 bp, Homo sapiens
gccctgggctccctgctccaca

SEQ ID NO: 7436795 - DNA, 22 bp, Homo sapiens
gccctgggctccctgctccaca

SEQ ID NO: 7436796 - DNA, 22 bp, Homo sapiens
gccctgtgccagtcacgctgtg

SEQ ID NO: 7436797 - DNA, 22 bp, Homo sapiens
gccctgtgccagtcacgctgtg

SEQ ID NO: 7436798 - DNA, 22 bp, Homo sapiens
gccctgtgcgactctagaggtt

SEQ ID NO: 7436799 - DNA, 22 bp, Homo sapiens
gccctgtgcgactctagaggtt

SEQ ID NO: 7436800 - DNA, 22 bp, Homo sapiens
gccctgtgcgctgagttcaggg

SEQ ID NO: 7436801 - DNA, 22 bp, Homo sapiens
gccctgtgcgactctagaggtt

SEQ ID NO: 7436802 - DNA, 22 bp, Homo sapiens
gccctggatgtacaggcatgtt

SEQ ID NO: 7436803 - DNA, 22 bp, Homo sapiens
gccctggatgtacaggcatgtt

SEQ ID NO: 7436804 - DNA, 22 bp, Homo sapiens
gccctggagggccagcgactgg

SEQ ID NO: 7436805 - DNA, 22 bp, Homo sapiens
gccctggatgtacaggcatgtt

SEQ ID NO: 7436806 - DNA, 22 bp, Homo sapiens
gccctggcacctcgttgcccag

SEQ ID NO: 7436807 - DNA, 22 bp, Homo sapiens
gccctggcacctcgttgcccag

SEQ ID NO: 7436808 - DNA, 22 bp, Homo sapiens
gccctggatgtacaggcatgtt

SEQ ID NO: 7436809 - DNA, 22 bp, Homo sapiens
gccctggatgtacaggcatgtt

SEQ ID NO: 7436810 - DNA, 22 bp, Homo sapiens
gccctggatgtacaggcatgtt

SEQ ID NO: 7436811 - DNA, 22 bp, Homo sapiens
gccctggatgtacaggcatgtt

SEQ ID NO: 7436812 - DNA, 22 bp, Homo sapiens
gccctggatgctcatggcatca

SEQ ID NO: 7436813 - DNA, 22 bp, Homo sapiens
gccctggatgctcatggcatca

SEQ ID NO: 7436814 - DNA, 22 bp, Homo sapiens
gccctggatgctcatggcatca

SEQ ID NO: 7436815 - DNA, 22 bp, Homo sapiens
gccctggatgctcatggcatca

SEQ ID NO: 7436816 - DNA, 22 bp, Homo sapiens
gccctggagggccagcgactgg

SEQ ID NO: 7436817 - DNA, 22 bp, Homo sapiens
gccctggatggcaggagccatc

SEQ ID NO: 7436818 - DNA, 22 bp, Homo sapiens
gccctggatggcaggagccatc

SEQ ID NO: 7436819 - DNA, 22 bp, Homo sapiens
gccctggatggcaggagccatc

SEQ ID NO: 7436820 - DNA, 22 bp, Homo sapiens
gccctggatggcaggagccatc

SEQ ID NO: 7436821 - DNA, 22 bp, Homo sapiens
gccctggatggcaggagccatc

SEQ ID NO: 7436822 - DNA, 22 bp, Homo sapiens
gccctggatggcaggagccatc

SEQ ID NO: 7436823 - DNA, 22 bp, Homo sapiens
gccctggatggcaggagccatc

SEQ ID NO: 7436824 - DNA, 22 bp, Homo sapiens
gccctggccttcatctcagaca

SEQ ID NO: 7436825 - DNA, 22 bp, Homo sapiens
gccctggccttcatctcagaca

SEQ ID NO: 7436826 - DNA, 22 bp, Homo sapiens
gccctggcctggcgcgttgtca

SEQ ID NO: 7436827 - DNA, 22 bp, Homo sapiens
gccctggccttcatctcagaca

SEQ ID NO: 7436828 - DNA, 22 bp, Homo sapiens
gccctggccttcatctcagaca

SEQ ID NO: 7436829 - DNA, 22 bp, Homo sapiens
gccctggccttcatctcagaca

SEQ ID NO: 7436830 - DNA, 22 bp, Homo sapiens
gccctggcacctcgttgcccag

SEQ ID NO: 7436831 - DNA, 22 bp, Homo sapiens
gccctggcacctcgttgcccag

SEQ ID NO: 7436832 - DNA, 22 bp, Homo sapiens
gccctggcacctcgttgcccag

SEQ ID NO: 7436833 - DNA, 22 bp, Homo sapiens
gccctggcctcctggaacaggc

SEQ ID NO: 7436834 - DNA, 22 bp, Homo sapiens
gccctggcctcctggaacaggc

SEQ ID NO: 7436835 - DNA, 22 bp, Homo sapiens
gccctggcctcctggaacaggc

SEQ ID NO: 7436836 - DNA, 22 bp, Homo sapiens
gccctggcctggcgcgttgtca

SEQ ID NO: 7436837 - DNA, 22 bp, Homo sapiens
gccctggcctggcgcgttgtca

SEQ ID NO: 7436838 - DNA, 22 bp, Homo sapiens
gccctggcctggcgcgttgtca

SEQ ID NO: 7436839 - DNA, 22 bp, Homo sapiens
gccctggcctcctggaacaggc

SEQ ID NO: 7436840 - DNA, 22 bp, Homo sapiens
gccctggcctcctggaacaggc

SEQ ID NO: 7436841 - DNA, 22 bp, Homo sapiens
gccctgggattgggtggaggct

SEQ ID NO: 7436842 - DNA, 22 bp, Homo sapiens
gccctgggattgggtggaggct

SEQ ID NO: 7436843 - DNA, 22 bp, Homo sapiens
gccctgggattgggtggaggct

SEQ ID NO: 7436844 - DNA, 22 bp, Homo sapiens
gccctgggattgggtggaggct

SEQ ID NO: 7436845 - DNA, 22 bp, Homo sapiens
gccctgggattgggtggaggct

SEQ ID NO: 7436846 - DNA, 22 bp, Homo sapiens
gccctggccttcatctcagaca

SEQ ID NO: 7436847 - DNA, 22 bp, Homo sapiens
gccctgggattgggtggaggct

SEQ ID NO: 7436848 - DNA, 22 bp, Homo sapiens
gccctgggattgggtggaggct

SEQ ID NO: 7436849 - DNA, 22 bp, Homo sapiens
gcctccggagtcacagtgtctt

SEQ ID NO: 7436850 - DNA, 22 bp, Homo sapiens
gcctccggagtcacagtgtctt

SEQ ID NO: 7436851 - DNA, 22 bp, Homo sapiens
gcctccggagtcacagtgtctt

SEQ ID NO: 7436852 - DNA, 22 bp, Homo sapiens
gcctccggagtcacagtgtctt

SEQ ID NO: 7436853 - DNA, 22 bp, Homo sapiens
gcctccggagtcacagtgtctt

SEQ ID NO: 7436854 - DNA, 22 bp, Homo sapiens
gcctccggagtcacagtgtctt

SEQ ID NO: 7436855 - DNA, 22 bp, Homo sapiens
gcctccggagttgcagtgtctt

SEQ ID NO: 7436856 - DNA, 22 bp, Homo sapiens
gcctccggagttgcagtgtctt

SEQ ID NO: 7436857 - DNA, 22 bp, Homo sapiens
gcctccggagttgcagtgtctt

SEQ ID NO: 7436858 - DNA, 22 bp, Homo sapiens
gcctccggagttgcagtgtctt

SEQ ID NO: 7436859 - DNA, 22 bp, Homo sapiens
gcctccggagttgcagtgtctt

SEQ ID NO: 7436860 - DNA, 22 bp, Homo sapiens
gcctccggagttgcagtgtctt

SEQ ID NO: 7436861 - DNA, 22 bp, Homo sapiens
gccctgtgtatcccctgtgctt

SEQ ID NO: 7436862 - DNA, 22 bp, Homo sapiens
gccctgtgtatcccctgtgctt

SEQ ID NO: 7436863 - DNA, 22 bp, Homo sapiens
gccctgtgtatcccctgtgctt

SEQ ID NO: 7436864 - DNA, 22 bp, Homo sapiens
gccctgtgtatcccctgtgctt

SEQ ID NO: 7436865 - DNA, 22 bp, Homo sapiens
gccctgtggttccaggaagcaa

SEQ ID NO: 7436866 - DNA, 22 bp, Homo sapiens
gccctgtggttccaggaagcaa

SEQ ID NO: 7436867 - DNA, 22 bp, Homo sapiens
gccctgtgtatcccctgtgctt

SEQ ID NO: 7436868 - DNA, 22 bp, Homo sapiens
gccctgtgtatcccctgtgctt

SEQ ID NO: 7436869 - DNA, 22 bp, Homo sapiens
gccctgtgtatcccctgtgctt

SEQ ID NO: 7436870 - DNA, 22 bp, Homo sapiens
gccctgtgtgatcacatgaaca

SEQ ID NO: 7436871 - DNA, 22 bp, Homo sapiens
gccctgtgtgatcacatgaaca

SEQ ID NO: 7436872 - DNA, 22 bp, Homo sapiens
gccctgtgtatcccctgtgctt

SEQ ID NO: 7436873 - DNA, 22 bp, Homo sapiens
gccctgtgtgatcacatgaaca

SEQ ID NO: 7436874 - DNA, 22 bp, Homo sapiens
gccctgtgtgtttgcactgatt

SEQ ID NO: 7436875 - DNA, 22 bp, Homo sapiens
gccctgtgtgtttgcactgatt

SEQ ID NO: 7436876 - DNA, 22 bp, Homo sapiens
gccctgtgtgtttgcactgatt

SEQ ID NO: 7436877 - DNA, 22 bp, Homo sapiens
gccctgtgtgatctgctgttag

SEQ ID NO: 7436878 - DNA, 22 bp, Homo sapiens
gccctgtgtgtttgcactgatt

SEQ ID NO: 7436879 - DNA, 22 bp, Homo sapiens
gccctgtgtgtttgcactgatt

SEQ ID NO: 7436880 - DNA, 22 bp, Homo sapiens
gccctgtgtgatctgctgttag

SEQ ID NO: 7436881 - DNA, 22 bp, Homo sapiens
gccctgttatccagatgaggat

SEQ ID NO: 7436882 - DNA, 22 bp, Homo sapiens
gcctcccttggtgtctcccggg

SEQ ID NO: 7436883 - DNA, 22 bp, Homo sapiens
gcctcccttggtgtctcccggg

SEQ ID NO: 7436884 - DNA, 22 bp, Homo sapiens
gccctgtgtgtttgcactgatt

SEQ ID NO: 7436885 - DNA, 22 bp, Homo sapiens
gccctgtgtgtttgcactgatt

SEQ ID NO: 7436886 - DNA, 22 bp, Homo sapiens
gccctgtgtgtttgcactgatt

SEQ ID NO: 7436887 - DNA, 22 bp, Homo sapiens
gcctcctcttgagggtcaggga

SEQ ID NO: 7436888 - DNA, 22 bp, Homo sapiens
gcctcctgaaaggaagagctcc

SEQ ID NO: 7436889 - DNA, 22 bp, Homo sapiens
gcctcctgaaaggaagagctcc

SEQ ID NO: 7436890 - DNA, 22 bp, Homo sapiens
gcctcctgaaaggaagagctcc

SEQ ID NO: 7436891 - DNA, 22 bp, Homo sapiens
gcctcctgaaaggaagagctcc

SEQ ID NO: 7436892 - DNA, 22 bp, Homo sapiens
gcctcctgaaaggaagagctcc

SEQ ID NO: 7436893 - DNA, 22 bp, Homo sapiens
gcctcctgaaaggaagagctcc

SEQ ID NO: 7436894 - DNA, 22 bp, Homo sapiens
gcctcctgaagtgctgggatta

SEQ ID NO: 7436895 - DNA, 22 bp, Homo sapiens
gcctcctgaagtgctgggatta

SEQ ID NO: 7436896 - DNA, 22 bp, Homo sapiens
gcctcctgaagtgctgggatta

SEQ ID NO: 7436897 - DNA, 22 bp, Homo sapiens
gcctcctgaagtgctgggatta

SEQ ID NO: 7436898 - DNA, 22 bp, Homo sapiens
gcctcctgacttacactgagct

SEQ ID NO: 7436899 - DNA, 22 bp, Homo sapiens
gcctcctgacttacactgagct

SEQ ID NO: 7436900 - DNA, 22 bp, Homo sapiens
gcctcctgacttacactgagct

SEQ ID NO: 7436901 - DNA, 22 bp, Homo sapiens
gcctcctgacttacactgagct

SEQ ID NO: 7436902 - DNA, 22 bp, Homo sapiens
gcctcctgaagtgctgggatta

SEQ ID NO: 7436903 - DNA, 22 bp, Homo sapiens
gcctcctgaagtgctgggatta

SEQ ID NO: 7436904 - DNA, 22 bp, Homo sapiens
gcctcctcttgagggtcaggga

SEQ ID NO: 7436905 - DNA, 22 bp, Homo sapiens
gcctcctccttcccgagggtct

SEQ ID NO: 7436906 - DNA, 22 bp, Homo sapiens
gcctcctccttcccgagggtct

SEQ ID NO: 7436907 - DNA, 22 bp, Homo sapiens
gcctcctcacaatgtacccacg

SEQ ID NO: 7436908 - DNA, 22 bp, Homo sapiens
gcctcctcacaatgtacccacg

SEQ ID NO: 7436909 - DNA, 22 bp, Homo sapiens
gcctcctcacaatgtacccacg

SEQ ID NO: 7436910 - DNA, 22 bp, Homo sapiens
gcctcctccttcccgagggtct

SEQ ID NO: 7436911 - DNA, 22 bp, Homo sapiens
gcctcctcacaatgtacccacg

SEQ ID NO: 7436912 - DNA, 22 bp, Homo sapiens
gcctcctaattgccactctgga

SEQ ID NO: 7436913 - DNA, 22 bp, Homo sapiens
gcctcctaattgccactctgga

SEQ ID NO: 7436914 - DNA, 22 bp, Homo sapiens
gcctcctagagctccagggact

SEQ ID NO: 7436915 - DNA, 22 bp, Homo sapiens
gcctcctagagctccagggact

SEQ ID NO: 7436916 - DNA, 22 bp, Homo sapiens
gcctcctaccacaccctcagtc

SEQ ID NO: 7436917 - DNA, 22 bp, Homo sapiens
gcctcctaccacaccctcagtc

SEQ ID NO: 7436918 - DNA, 23 bp, Homo sapiens
gcctcctagcagtaaacatgtta

SEQ ID NO: 7436919 - DNA, 22 bp, Homo sapiens
gcctcctatggggccatcgcag

SEQ ID NO: 7436920 - DNA, 22 bp, Homo sapiens
gcctcctatggggccatcgcag

SEQ ID NO: 7436921 - DNA, 22 bp, Homo sapiens
gcctcctatcatttccttgctt

SEQ ID NO: 7436922 - DNA, 22 bp, Homo sapiens
gcctcctatcatttccttgctt

SEQ ID NO: 7436923 - DNA, 22 bp, Homo sapiens
gcctcctattaaaatttacctt

SEQ ID NO: 7436924 - DNA, 22 bp, Homo sapiens
gcctcctcacaatgtacccacg

SEQ ID NO: 7436925 - DNA, 22 bp, Homo sapiens
gcctcctgagaagccacaggct

SEQ ID NO: 7436926 - DNA, 22 bp, Homo sapiens
gcctcctgagaagccacaggct

SEQ ID NO: 7436927 - DNA, 22 bp, Homo sapiens
gcctcctgagaagccacaggct

SEQ ID NO: 7436928 - DNA, 22 bp, Homo sapiens
gcctcctgagaagccacaggct

SEQ ID NO: 7436929 - DNA, 22 bp, Homo sapiens
gcctcctgagaagccacaggct

SEQ ID NO: 7436930 - DNA, 22 bp, Homo sapiens
gcctcctgagtagctgggattg

SEQ ID NO: 7436931 - DNA, 22 bp, Homo sapiens
gcctcctgagtagctgggattg

SEQ ID NO: 7436932 - DNA, 22 bp, Homo sapiens
gcctcctgagtagctgggattg

SEQ ID NO: 7436933 - DNA, 22 bp, Homo sapiens
gcctcctgagtagctgggattg

SEQ ID NO: 7436934 - DNA, 22 bp, Homo sapiens
gcctcctgacttacactgagct

SEQ ID NO: 7436935 - DNA, 22 bp, Homo sapiens
gcctcctgacttacactgagct

SEQ ID NO: 7436936 - DNA, 22 bp, Homo sapiens
gcctcctgacttacactgagct

SEQ ID NO: 7436937 - DNA, 22 bp, Homo sapiens
gcctcctgagaagccacaggct

SEQ ID NO: 7436938 - DNA, 22 bp, Homo sapiens
gcctcctgagaagccacaggct

SEQ ID NO: 7436939 - DNA, 22 bp, Homo sapiens
gcctcctgagaagccacaggct

SEQ ID NO: 7436940 - DNA, 22 bp, Homo sapiens
gcctcctgagaagccacaggct

SEQ ID NO: 7436941 - DNA, 22 bp, Homo sapiens
gcctcctggattttagtgccat

SEQ ID NO: 7436942 - DNA, 22 bp, Homo sapiens
gcctcctggattttagtgccat

SEQ ID NO: 7436943 - DNA, 22 bp, Homo sapiens
gcctcctggcctttgctcctca

SEQ ID NO: 7436944 - DNA, 22 bp, Homo sapiens
gcctcctggcctttgctcctca

SEQ ID NO: 7436945 - DNA, 22 bp, Homo sapiens
gcctcctggattttagtgccat

SEQ ID NO: 7436946 - DNA, 22 bp, Homo sapiens
gcctcctggattttagtgccat

SEQ ID NO: 7436947 - DNA, 22 bp, Homo sapiens
gcctcctgcccagatgagtgat

SEQ ID NO: 7436948 - DNA, 22 bp, Homo sapiens
gcctcctggaagtcacatgttt

SEQ ID NO: 7436949 - DNA, 22 bp, Homo sapiens
gcctcctggaagtcacatgttt

SEQ ID NO: 7436950 - DNA, 22 bp, Homo sapiens
gcctcctgcccagatgagtgat

SEQ ID NO: 7436951 - DNA, 22 bp, Homo sapiens
gcctcctgagtagctgggattg

SEQ ID NO: 7436952 - DNA, 22 bp, Homo sapiens
gcctcctgagtagctgggattg

SEQ ID NO: 7436953 - DNA, 22 bp, Homo sapiens
gcctcctggggtgccatcatct

SEQ ID NO: 7436954 - DNA, 22 bp, Homo sapiens
gcctcctggggtgccatcatct

SEQ ID NO: 7436955 - DNA, 22 bp, Homo sapiens
gcctcctggggtgccatcatct

SEQ ID NO: 7436956 - DNA, 22 bp, Homo sapiens
gcctcctggcctttgctcctca

SEQ ID NO: 7436957 - DNA, 22 bp, Homo sapiens
gcctcctggcctttgctcctca

SEQ ID NO: 7436958 - DNA, 22 bp, Homo sapiens
gcctctggagtcgcagcgtctt

SEQ ID NO: 7436959 - DNA, 22 bp, Homo sapiens
gcctctggagtcgcagcgtctt

SEQ ID NO: 7436960 - DNA, 22 bp, Homo sapiens
gcctctggagtcgcagcgtctt

SEQ ID NO: 7436961 - DNA, 22 bp, Homo sapiens
gcctcctggttgcttctccaac

SEQ ID NO: 7436962 - DNA, 22 bp, Homo sapiens
gcctcctggttgcttctccaac

SEQ ID NO: 7436963 - DNA, 22 bp, Homo sapiens
gcctcctggttgcttctccaac

SEQ ID NO: 7436964 - DNA, 22 bp, Homo sapiens
gcctcctggttgcttctccaac

SEQ ID NO: 7436965 - DNA, 22 bp, Homo sapiens
gcctcctgggttcatgccattc

SEQ ID NO: 7436966 - DNA, 22 bp, Homo sapiens
gcctcctgggttcatgccattc

SEQ ID NO: 7436967 - DNA, 22 bp, Homo sapiens
gcctctggagttgcttgtaaat

SEQ ID NO: 7436968 - DNA, 22 bp, Homo sapiens
gcctctggagtcgcagcgtctt

SEQ ID NO: 7436969 - DNA, 22 bp, Homo sapiens
gcctctggagtcgcagcgtctt

SEQ ID NO: 7436970 - DNA, 22 bp, Homo sapiens
gcctctggcttctgcatcagtg

SEQ ID NO: 7436971 - DNA, 22 bp, Homo sapiens
gcctctggcttctgcatcagtg

SEQ ID NO: 7436972 - DNA, 22 bp, Homo sapiens
gcctctggagttgcttgtaaat

SEQ ID NO: 7436973 - DNA, 22 bp, Homo sapiens
gcctctggagttgcttgtaaat

SEQ ID NO: 7436974 - DNA, 22 bp, Homo sapiens
gcctctggagttgcttgtaaat

SEQ ID NO: 7436975 - DNA, 22 bp, Homo sapiens
gcctctgggctctgcccctggc

SEQ ID NO: 7436976 - DNA, 22 bp, Homo sapiens
gcctctgggctctgcccctggc

SEQ ID NO: 7436977 - DNA, 22 bp, Homo sapiens
gcctctgggctctgcccctggc

SEQ ID NO: 7436978 - DNA, 22 bp, Homo sapiens
gcctctggcttctgcatcagtg

SEQ ID NO: 7436979 - DNA, 22 bp, Homo sapiens
gcctctggcttctgcatcagtg

SEQ ID NO: 7436980 - DNA, 22 bp, Homo sapiens
gcctctgggctctgcccctggc

SEQ ID NO: 7436981 - DNA, 22 bp, Homo sapiens
gcctctgggctctgcccctggc

SEQ ID NO: 7436982 - DNA, 22 bp, Homo sapiens
gcctctgggctctgcccctggc

SEQ ID NO: 7436983 - DNA, 22 bp, Homo sapiens
gcctctgggctctgcccctggc

SEQ ID NO: 7436984 - DNA, 17 bp, Homo sapiens
gccagggagaggaagcc

SEQ ID NO: 7436985 - DNA, 22 bp, Homo sapiens
gccagggaggctgtagggtcct

SEQ ID NO: 7436986 - DNA, 22 bp, Homo sapiens
gccagggaggctgtagggtcct

SEQ ID NO: 7436987 - DNA, 22 bp, Homo sapiens
gccagggaggctgtagggtcct

SEQ ID NO: 7436988 - DNA, 22 bp, Homo sapiens
gccagggaggctgtagggtcct

SEQ ID NO: 7436989 - DNA, 22 bp, Homo sapiens
gccagggaggctgtagggtcct

SEQ ID NO: 7436990 - DNA, 22 bp, Homo sapiens
gccagggaggctgtagggtcct

SEQ ID NO: 7436991 - DNA, 21 bp, Homo sapiens
gccagggaagagagttggctg

SEQ ID NO: 7436992 - DNA, 21 bp, Homo sapiens
gccagggaagagagttggctg

SEQ ID NO: 7436993 - DNA, 21 bp, Homo sapiens
gccagggaagagagttggctg

SEQ ID NO: 7436994 - DNA, 21 bp, Homo sapiens
gccagggaagagagttggctg

SEQ ID NO: 7436995 - DNA, 21 bp, Homo sapiens
gccagggaagagagttggctg

SEQ ID NO: 7436996 - DNA, 21 bp, Homo sapiens
gccagggaagagagttggctg

SEQ ID NO: 7436997 - DNA, 21 bp, Homo sapiens
gccagggaagagagttggctg

SEQ ID NO: 7436998 - DNA, 17 bp, Homo sapiens
gccagggagaggaagcc

SEQ ID NO: 7436999 - DNA, 17 bp, Homo sapiens
gccagggagaggaagcc

SEQ ID NO: 7437000 - DNA, 17 bp, Homo sapiens
gccagggagaggaagcc

SEQ ID NO: 7437001 - DNA, 17 bp, Homo sapiens
gccagggagaggaagcc

SEQ ID NO: 7437002 - DNA, 17 bp, Homo sapiens
gccagggagaggaagcc

SEQ ID NO: 7437003 - DNA, 21 bp, Homo sapiens
gccagggaagagagttggctg

SEQ ID NO: 7437004 - DNA, 22 bp, Homo sapiens
gccagggaacccaagggcctca

SEQ ID NO: 7437005 - DNA, 22 bp, Homo sapiens
gccagggaacccaagggcctca

SEQ ID NO: 7437006 - DNA, 22 bp, Homo sapiens
gccagggaacccaagggcctca

SEQ ID NO: 7437007 - DNA, 22 bp, Homo sapiens
gccagggaacccaagggcctca

SEQ ID NO: 7437008 - DNA, 22 bp, Homo sapiens
gccagggaacccaagggcctca

SEQ ID NO: 7437009 - DNA, 22 bp, Homo sapiens
gccagggaacccaagggcctca

SEQ ID NO: 7437010 - DNA, 22 bp, Homo sapiens
gccagggaacccaagggcctca

SEQ ID NO: 7437011 - DNA, 22 bp, Homo sapiens
gccagggaacccaagggcctca

SEQ ID NO: 7437012 - DNA, 22 bp, Homo sapiens
gccagggaacccaagggcctca

SEQ ID NO: 7437013 - DNA, 22 bp, Homo sapiens
gccagggaacccaagggcctca

SEQ ID NO: 7437014 - DNA, 22 bp, Homo sapiens
gccaggcatgtcctctgcagaa

SEQ ID NO: 7437015 - DNA, 22 bp, Homo sapiens
gccaggcatgtcctctgcagaa

SEQ ID NO: 7437016 - DNA, 22 bp, Homo sapiens
gccaggcatgtcctctgcagaa

SEQ ID NO: 7437017 - DNA, 22 bp, Homo sapiens
gccaggcatgtcctctgcagaa

SEQ ID NO: 7437018 - DNA, 22 bp, Homo sapiens
gccaggcatgtcctctgcagaa

SEQ ID NO: 7437019 - DNA, 22 bp, Homo sapiens
gccaggcatgggcttctgggcg

SEQ ID NO: 7437020 - DNA, 22 bp, Homo sapiens
gccaggcatgggcttctgggcg

SEQ ID NO: 7437021 - DNA, 22 bp, Homo sapiens
gccaggcatgggcttctgggcg

SEQ ID NO: 7437022 - DNA, 22 bp, Homo sapiens
gccaggcatgggcttctgggcg

SEQ ID NO: 7437023 - DNA, 22 bp, Homo sapiens
gccagggcaggggagcatctgc

SEQ ID NO: 7437024 - DNA, 22 bp, Homo sapiens
gccagggcaggggagcatctgc

SEQ ID NO: 7437025 - DNA, 22 bp, Homo sapiens
gccagggcaggggagcatctgc

SEQ ID NO: 7437026 - DNA, 22 bp, Homo sapiens
gccagggcaggggagcatctgc

SEQ ID NO: 7437027 - DNA, 22 bp, Homo sapiens
gccagggcaggggagcatctgc

SEQ ID NO: 7437028 - DNA, 21 bp, Homo sapiens
gccagggagttaaagagtctt

SEQ ID NO: 7437029 - DNA, 21 bp, Homo sapiens
gccagggagttaaagagtctt

SEQ ID NO: 7437030 - DNA, 22 bp, Homo sapiens
gccagggagtctgggccacaga

SEQ ID NO: 7437031 - DNA, 22 bp, Homo sapiens
gccagggagtctgggccacaga

SEQ ID NO: 7437032 - DNA, 21 bp, Homo sapiens
gccagggagttaaagagtctt

SEQ ID NO: 7437033 - DNA, 21 bp, Homo sapiens
gccagggagttaaagagtctt

SEQ ID NO: 7437034 - DNA, 21 bp, Homo sapiens
gccagggagttaaagagtctt

SEQ ID NO: 7437035 - DNA, 22 bp, Homo sapiens
gccagggagtctgggccacaga

SEQ ID NO: 7437036 - DNA, 22 bp, Homo sapiens
gccagggagtctgggccacaga

SEQ ID NO: 7437037 - DNA, 22 bp, Homo sapiens
gccagggagtctgggccacaga

SEQ ID NO: 7437038 - DNA, 22 bp, Homo sapiens
gccagggctgtgcaggtttgtt

SEQ ID NO: 7437039 - DNA, 22 bp, Homo sapiens
gccagggctgtgcaggtttgtt

SEQ ID NO: 7437040 - DNA, 22 bp, Homo sapiens
gccagggctgtgcaggtttgtt

SEQ ID NO: 7437041 - DNA, 22 bp, Homo sapiens
gccagggctgtgcaggtttgtt

SEQ ID NO: 7437042 - DNA, 22 bp, Homo sapiens
gccagggctgtgcaggtttgtt

SEQ ID NO: 7437043 - DNA, 22 bp, Homo sapiens
gccagggctgtgcaggtttgtt

SEQ ID NO: 7437044 - DNA, 22 bp, Homo sapiens
gccagggctcgcggtccctcgt

SEQ ID NO: 7437045 - DNA, 22 bp, Homo sapiens
gccagggctcgcggtccctcgt

SEQ ID NO: 7437046 - DNA, 22 bp, Homo sapiens
gccagggctcgcggtccctcgt

SEQ ID NO: 7437047 - DNA, 22 bp, Homo sapiens
gccagggctcgcggtccctcgt

SEQ ID NO: 7437048 - DNA, 22 bp, Homo sapiens
gccagggcaggggagcatctgc

SEQ ID NO: 7437049 - DNA, 22 bp, Homo sapiens
gccagggctcgcggtccctcgt

SEQ ID NO: 7437050 - DNA, 22 bp, Homo sapiens
gccaggcagccaccctctgcga

SEQ ID NO: 7437051 - DNA, 22 bp, Homo sapiens
gccaggcagccaccctctgcga

SEQ ID NO: 7437052 - DNA, 22 bp, Homo sapiens
gccaggcagccaccctctgcga

SEQ ID NO: 7437053 - DNA, 22 bp, Homo sapiens
gccaggcagccaccctctgcga

SEQ ID NO: 7437054 - DNA, 22 bp, Homo sapiens
gccaggcagccaccctctgcga

SEQ ID NO: 7437055 - DNA, 22 bp, Homo sapiens
gccaggcagccaccctctgcga

SEQ ID NO: 7437056 - DNA, 22 bp, Homo sapiens
gccaggcagcagcgaggatggt

SEQ ID NO: 7437057 - DNA, 22 bp, Homo sapiens
gccaggcagcagcgaggatggt

SEQ ID NO: 7437058 - DNA, 22 bp, Homo sapiens
gccaggcagcagcgaggatggt

SEQ ID NO: 7437059 - DNA, 22 bp, Homo sapiens
gccaggcagcagcgaggatggt

SEQ ID NO: 7437060 - DNA, 22 bp, Homo sapiens
gccaggcagcaggaagccagtg

SEQ ID NO: 7437061 - DNA, 22 bp, Homo sapiens
gccaggcagcagcgaggatggt

SEQ ID NO: 7437062 - DNA, 22 bp, Homo sapiens
gccaggcagcaggaagccagtg

SEQ ID NO: 7437063 - DNA, 22 bp, Homo sapiens
gccaggcagatatgtgagctta

SEQ ID NO: 7437064 - DNA, 22 bp, Homo sapiens
gccaggcagatatgtgagctta

SEQ ID NO: 7437065 - DNA, 22 bp, Homo sapiens
gccaggcagatatgtgagctta

SEQ ID NO: 7437066 - DNA, 22 bp, Homo sapiens
gccaggcagagccccgtgcagc

SEQ ID NO: 7437067 - DNA, 22 bp, Homo sapiens
gccaggcagatatgtgagctta

SEQ ID NO: 7437068 - DNA, 22 bp, Homo sapiens
gccaggcagatatgtgagctta

SEQ ID NO: 7437069 - DNA, 22 bp, Homo sapiens
gccaggcagatatgtgagctta

SEQ ID NO: 7437070 - DNA, 22 bp, Homo sapiens
gccaggcagatatgtgagctta

SEQ ID NO: 7437071 - DNA, 22 bp, Homo sapiens
gccaggcagcagcgaggatggt

SEQ ID NO: 7437072 - DNA, 22 bp, Homo sapiens
gccaggcagcagcgaggatggt

SEQ ID NO: 7437073 - DNA, 22 bp, Homo sapiens
gccaggcagatatgtgagctta

SEQ ID NO: 7437074 - DNA, 22 bp, Homo sapiens
gccaggcagcagcgaggatggt

SEQ ID NO: 7437075 - DNA, 22 bp, Homo sapiens
gccaggcagcagcgaggatggt

SEQ ID NO: 7437076 - DNA, 22 bp, Homo sapiens
gccaggcagatatgtgagctta

SEQ ID NO: 7437077 - DNA, 22 bp, Homo sapiens
gccaggcagatatgtgagctta

SEQ ID NO: 7437078 - DNA, 22 bp, Homo sapiens
gccaggcagatatgtgagctta

SEQ ID NO: 7437079 - DNA, 22 bp, Homo sapiens
gccaggcaggccacgctgtgtt

SEQ ID NO: 7437080 - DNA, 22 bp, Homo sapiens
gccaggcagctgggagggtgcc

SEQ ID NO: 7437081 - DNA, 22 bp, Homo sapiens
gccaggcagctgggagggtgcc

SEQ ID NO: 7437082 - DNA, 22 bp, Homo sapiens
gccaggcaggccacgctgtgtt

SEQ ID NO: 7437083 - DNA, 22 bp, Homo sapiens
gccaggcaggccacgctgtgtt

SEQ ID NO: 7437084 - DNA, 22 bp, Homo sapiens
gccaggcaggccacgctgtgtt

SEQ ID NO: 7437085 - DNA, 22 bp, Homo sapiens
gccaggcagctagcaacccctg

SEQ ID NO: 7437086 - DNA, 22 bp, Homo sapiens
gccaggcagctagcaacccctg

SEQ ID NO: 7437087 - DNA, 22 bp, Homo sapiens
gccaggcagctagcaacccctg

SEQ ID NO: 7437088 - DNA, 22 bp, Homo sapiens
gccaggcagctagcaacccctg

SEQ ID NO: 7437089 - DNA, 22 bp, Homo sapiens
gccaggcagctgggagggtgcc

SEQ ID NO: 7437090 - DNA, 22 bp, Homo sapiens
gccaggcagctgggagggtgcc

SEQ ID NO: 7437091 - DNA, 22 bp, Homo sapiens
gccaggcagctgggagggtgcc

SEQ ID NO: 7437092 - DNA, 22 bp, Homo sapiens
gccaggcagctgggagggtgcc

SEQ ID NO: 7437093 - DNA, 22 bp, Homo sapiens
gccaggcagttcaagtacacca

SEQ ID NO: 7437094 - DNA, 22 bp, Homo sapiens
gccaggcaggtgtcggagccct

SEQ ID NO: 7437095 - DNA, 22 bp, Homo sapiens
gccaggcagttcaagtacacca

SEQ ID NO: 7437096 - DNA, 22 bp, Homo sapiens
gccaggcagttcaagtacacca

SEQ ID NO: 7437097 - DNA, 22 bp, Homo sapiens
gccaggcagttcaagtacacca

SEQ ID NO: 7437098 - DNA, 22 bp, Homo sapiens
gccaggcaggtgtcggagccct

SEQ ID NO: 7437099 - DNA, 22 bp, Homo sapiens
gccaggcaggtgtcggagccct

SEQ ID NO: 7437100 - DNA, 18 bp, Homo sapiens
gccaggcagggtggggaa

SEQ ID NO: 7437101 - DNA, 22 bp, Homo sapiens
gccaggcaggtgtcggagccct

SEQ ID NO: 7437102 - DNA, 18 bp, Homo sapiens
gccaggcagggtggggaa

SEQ ID NO: 7437103 - DNA, 18 bp, Homo sapiens
gccaggcagggtggggaa

SEQ ID NO: 7437104 - DNA, 18 bp, Homo sapiens
gccaggcagggtggggaa

SEQ ID NO: 7437105 - DNA, 18 bp, Homo sapiens
gccaggcagggtggggaa

SEQ ID NO: 7437106 - DNA, 18 bp, Homo sapiens
gccaggcagggtggggaa

SEQ ID NO: 7437107 - DNA, 22 bp, Homo sapiens
gccaggcaggtgtcggagccct

SEQ ID NO: 7437108 - DNA, 18 bp, Homo sapiens
gccaggcagggtggggaa

SEQ ID NO: 7437109 - DNA, 18 bp, Homo sapiens
gccaggcagggtggggaa

SEQ ID NO: 7437110 - DNA, 18 bp, Homo sapiens
gccaggcagggtggggaa

SEQ ID NO: 7437111 - DNA, 22 bp, Homo sapiens
gccagctcccaagtgagcccct

SEQ ID NO: 7437112 - DNA, 22 bp, Homo sapiens
gccagctccgcaggatggcgcg

SEQ ID NO: 7437113 - DNA, 22 bp, Homo sapiens
gccagctcccaagtgagcccct

SEQ ID NO: 7437114 - DNA, 22 bp, Homo sapiens
gccagctcagtttcaaagtagg

SEQ ID NO: 7437115 - DNA, 22 bp, Homo sapiens
gccagctcagtgccaggcccct

SEQ ID NO: 7437116 - DNA, 22 bp, Homo sapiens
gccagctcccaagtgagcccct

SEQ ID NO: 7437117 - DNA, 22 bp, Homo sapiens
gccagctcccaagtgagcccct

SEQ ID NO: 7437118 - DNA, 22 bp, Homo sapiens
gccagctcccaagtgagcccct

SEQ ID NO: 7437119 - DNA, 22 bp, Homo sapiens
gccagctcttgatgggtgggta

SEQ ID NO: 7437120 - DNA, 22 bp, Homo sapiens
gccagctcttgatgggtgggta

SEQ ID NO: 7437121 - DNA, 22 bp, Homo sapiens
gccagctctgtggctgtacttg

SEQ ID NO: 7437122 - DNA, 22 bp, Homo sapiens
gccagctctgtggctgtacttg

SEQ ID NO: 7437123 - DNA, 22 bp, Homo sapiens
gccagctctgtggctgtacttg

SEQ ID NO: 7437124 - DNA, 22 bp, Homo sapiens
gccagctctgtggctgtacttg

SEQ ID NO: 7437125 - DNA, 22 bp, Homo sapiens
gccagctccgcaggatggcgcg

SEQ ID NO: 7437126 - DNA, 22 bp, Homo sapiens
gccagctctcattgtataggct

SEQ ID NO: 7437127 - DNA, 22 bp, Homo sapiens
gccagctccgcaggatggcgcg

SEQ ID NO: 7437128 - DNA, 22 bp, Homo sapiens
gccagctccgcaggatggcgcg

SEQ ID NO: 7437129 - DNA, 21 bp, Homo sapiens
gccagcggccgccctccagga

SEQ ID NO: 7437130 - DNA, 22 bp, Homo sapiens
gccagctaactcatctaaagaa

SEQ ID NO: 7437131 - DNA, 23 bp, Homo sapiens
gccagccttgctctcctgcagcc

SEQ ID NO: 7437132 - DNA, 23 bp, Homo sapiens
gccagccttgctctcctgcagcc

SEQ ID NO: 7437133 - DNA, 23 bp, Homo sapiens
gccagccttgctctcctgcagcc

SEQ ID NO: 7437134 - DNA, 22 bp, Homo sapiens
gccagctagcggggaggaaatg

SEQ ID NO: 7437135 - DNA, 22 bp, Homo sapiens
gccagctcagatgcaggaagga

SEQ ID NO: 7437136 - DNA, 22 bp, Homo sapiens
gccagctcagatgcaggaagga

SEQ ID NO: 7437137 - DNA, 22 bp, Homo sapiens
gccagctagctagttgctgggt

SEQ ID NO: 7437138 - DNA, 22 bp, Homo sapiens
gccagctcagatgcaggaagga

SEQ ID NO: 7437139 - DNA, 22 bp, Homo sapiens
gccagctcagtgccaggcccct

SEQ ID NO: 7437140 - DNA, 22 bp, Homo sapiens
gccagctcagtttcaaagtagg

SEQ ID NO: 7437141 - DNA, 22 bp, Homo sapiens
gccagctcagtgccaggcccct

SEQ ID NO: 7437142 - DNA, 22 bp, Homo sapiens
gccagctcagtgccaggcccct

SEQ ID NO: 7437143 - DNA, 22 bp, Homo sapiens
gccagctcagtgccaggcccct

SEQ ID NO: 7437144 - DNA, 22 bp, Homo sapiens
gccagctcagtgccaggcccct

SEQ ID NO: 7437145 - DNA, 22 bp, Homo sapiens
gccagctcagatgcaggaagga

SEQ ID NO: 7437146 - DNA, 22 bp, Homo sapiens
gccagctcagatgcaggaagga

SEQ ID NO: 7437147 - DNA, 22 bp, Homo sapiens
gccagctcagatgcaggaagga

SEQ ID NO: 7437148 - DNA, 22 bp, Homo sapiens
gccagctcagatgcaggaagga

SEQ ID NO: 7437149 - DNA, 22 bp, Homo sapiens
gccaggcagacaggtcatcagg

SEQ ID NO: 7437150 - DNA, 22 bp, Homo sapiens
gccaggcagacaggtcatcagg

SEQ ID NO: 7437151 - DNA, 22 bp, Homo sapiens
gccaggcagacaggtcatcagg

SEQ ID NO: 7437152 - DNA, 22 bp, Homo sapiens
gccaggcagacaggtcatcagg

SEQ ID NO: 7437153 - DNA, 22 bp, Homo sapiens
gccaggcagagccccgtgcagc

SEQ ID NO: 7437154 - DNA, 22 bp, Homo sapiens
gccaggcagagccccgtgcagc

SEQ ID NO: 7437155 - DNA, 22 bp, Homo sapiens
gccaggcagagccccgtgcagc

SEQ ID NO: 7437156 - DNA, 20 bp, Homo sapiens
gccaggcactgttctcaata

SEQ ID NO: 7437157 - DNA, 22 bp, Homo sapiens
gccaggcactgctctaagccct

SEQ ID NO: 7437158 - DNA, 20 bp, Homo sapiens
gccaggcactgttctcaata

SEQ ID NO: 7437159 - DNA, 20 bp, Homo sapiens
gccaggcactgttctcaata

SEQ ID NO: 7437160 - DNA, 22 bp, Homo sapiens
gccaggcactgctctaagccct

SEQ ID NO: 7437161 - DNA, 22 bp, Homo sapiens
gccaggcactgctctaagccct

SEQ ID NO: 7437162 - DNA, 22 bp, Homo sapiens
gccaggcactgctctaagccct

SEQ ID NO: 7437163 - DNA, 22 bp, Homo sapiens
gccaggcactgctctaagccct

SEQ ID NO: 7437164 - DNA, 22 bp, Homo sapiens
gccagctgacaccttgattttg

SEQ ID NO: 7437165 - DNA, 22 bp, Homo sapiens
gccaggcactgctctaagccct

SEQ ID NO: 7437166 - DNA, 22 bp, Homo sapiens
gccagctgaatttccaactgtt

SEQ ID NO: 7437167 - DNA, 22 bp, Homo sapiens
gccagctgaatttccaactgtt

SEQ ID NO: 7437168 - DNA, 22 bp, Homo sapiens
gccagctgacaccttgattttg

SEQ ID NO: 7437169 - DNA, 22 bp, Homo sapiens
gccagctgacaccttgattttg

SEQ ID NO: 7437170 - DNA, 22 bp, Homo sapiens
gccagctgaatttccaactgtt

SEQ ID NO: 7437171 - DNA, 22 bp, Homo sapiens
gccagctgaatttccaactgtt

SEQ ID NO: 7437172 - DNA, 22 bp, Homo sapiens
gccagctgaagggaagctcctg

SEQ ID NO: 7437173 - DNA, 22 bp, Homo sapiens
gccagctgaagggaagctcctg

SEQ ID NO: 7437174 - DNA, 22 bp, Homo sapiens
gccagctgaagccctggtggaa

SEQ ID NO: 7437175 - DNA, 22 bp, Homo sapiens
gccagctgaagggaagctcctg

SEQ ID NO: 7437176 - DNA, 22 bp, Homo sapiens
gccagctgaagggaagctcctg

SEQ ID NO: 7437177 - DNA, 22 bp, Homo sapiens
gccagctgaagggaagctcctg

SEQ ID NO: 7437178 - DNA, 22 bp, Homo sapiens
gccagctgaagccctggtggaa

SEQ ID NO: 7437179 - DNA, 22 bp, Homo sapiens
gccagctgaagccctggtggaa

SEQ ID NO: 7437180 - DNA, 22 bp, Homo sapiens
gccagctgaaatttcagttctg

SEQ ID NO: 7437181 - DNA, 22 bp, Homo sapiens
gccagctgaagccctggtggaa

SEQ ID NO: 7437182 - DNA, 22 bp, Homo sapiens
gccagctgaaatttcagttctg

SEQ ID NO: 7437183 - DNA, 22 bp, Homo sapiens
gccagctgaaatttcagttctg

SEQ ID NO: 7437184 - DNA, 22 bp, Homo sapiens
gccagctgaaatttcagttctg

SEQ ID NO: 7437185 - DNA, 21 bp, Homo sapiens
gccagcctgtttacctgtggt

SEQ ID NO: 7437186 - DNA, 21 bp, Homo sapiens
gccagcctgtttacctgtggt

SEQ ID NO: 7437187 - DNA, 21 bp, Homo sapiens
gccagcctgtttacctgtggt

SEQ ID NO: 7437188 - DNA, 21 bp, Homo sapiens
gccagcctgtttacctgtggt

SEQ ID NO: 7437189 - DNA, 22 bp, Homo sapiens
gccagcctgtgggggctctgtg

SEQ ID NO: 7437190 - DNA, 22 bp, Homo sapiens
gccagcctgtgggggctctgtg

SEQ ID NO: 7437191 - DNA, 22 bp, Homo sapiens
gccagcctgtgggggctctgtg

SEQ ID NO: 7437192 - DNA, 22 bp, Homo sapiens
gccagcctgtgcttggccaggc

SEQ ID NO: 7437193 - DNA, 22 bp, Homo sapiens
gccagcctgtgggggctctgtg

SEQ ID NO: 7437194 - DNA, 22 bp, Homo sapiens
gccagcctgtgggggctctgtg

SEQ ID NO: 7437195 - DNA, 22 bp, Homo sapiens
gccagcctgtgcttggccaggc

SEQ ID NO: 7437196 - DNA, 22 bp, Homo sapiens
gccagcctgtgcttggccaggc

SEQ ID NO: 7437197 - DNA, 22 bp, Homo sapiens
gccagcctgtgcttggccaggc

SEQ ID NO: 7437198 - DNA, 22 bp, Homo sapiens
gccagcctgtgcttggccaggc

SEQ ID NO: 7437199 - DNA, 22 bp, Homo sapiens
gccagccttctgtggcctgcaa

SEQ ID NO: 7437200 - DNA, 22 bp, Homo sapiens
gccagccttctgtggcctgcaa

SEQ ID NO: 7437201 - DNA, 22 bp, Homo sapiens
gccagccttctgtggcctgcaa

SEQ ID NO: 7437202 - DNA, 22 bp, Homo sapiens
gccagccttctgtggcctgcaa

SEQ ID NO: 7437203 - DNA, 21 bp, Homo sapiens
gccagcctgtttacctgtggt

SEQ ID NO: 7437204 - DNA, 21 bp, Homo sapiens
gccagcctgtttacctgtggt

SEQ ID NO: 7437205 - DNA, 21 bp, Homo sapiens
gccagcctgtttacctgtggt

SEQ ID NO: 7437206 - DNA, 22 bp, Homo sapiens
gccagccttctgtggcctgcaa

SEQ ID NO: 7437207 - DNA, 22 bp, Homo sapiens
gccagccttctgtggcctgcaa

SEQ ID NO: 7437208 - DNA, 23 bp, Homo sapiens
gccagccttgctctcctgcagcc

SEQ ID NO: 7437209 - DNA, 23 bp, Homo sapiens
gccagccttgctctcctgcagcc

SEQ ID NO: 7437210 - DNA, 22 bp, Homo sapiens
gccagccttctgtggcctgcaa

SEQ ID NO: 7437211 - DNA, 23 bp, Homo sapiens
gccagccttgctctcctgcagcc

SEQ ID NO: 7437212 - DNA, 20 bp, Homo sapiens
gccagccctgacacaggagc

SEQ ID NO: 7437213 - DNA, 20 bp, Homo sapiens
gccagccctgacacaggagc

SEQ ID NO: 7437214 - DNA, 18 bp, Homo sapiens
gccagccctccaacctcc

SEQ ID NO: 7437215 - DNA, 18 bp, Homo sapiens
gccagccctccaacctcc

SEQ ID NO: 7437216 - DNA, 18 bp, Homo sapiens
gccagccctccaacctcc

SEQ ID NO: 7437217 - DNA, 18 bp, Homo sapiens
gccagccctccaacctcc

SEQ ID NO: 7437218 - DNA, 18 bp, Homo sapiens
gccagccctccaacctcc

SEQ ID NO: 7437219 - DNA, 22 bp, Homo sapiens
gccagcctgtgcttggccaggc

SEQ ID NO: 7437220 - DNA, 22 bp, Homo sapiens
gccagccctgggagacttatgg

SEQ ID NO: 7437221 - DNA, 22 bp, Homo sapiens
gccagccctgggagacttatgg

SEQ ID NO: 7437222 - DNA, 20 bp, Homo sapiens
gccagccctgacacaggagc

SEQ ID NO: 7437223 - DNA, 20 bp, Homo sapiens
gccagccctgacacaggagc

SEQ ID NO: 7437224 - DNA, 22 bp, Homo sapiens
gccagccctgggagacttatgg

SEQ ID NO: 7437225 - DNA, 20 bp, Homo sapiens
gccagccctgacacaggagc

SEQ ID NO: 7437226 - DNA, 20 bp, Homo sapiens
gccagccctgacacaggagc

SEQ ID NO: 7437227 - DNA, 20 bp, Homo sapiens
gccagccctgacacaggagc

SEQ ID NO: 7437228 - DNA, 22 bp, Homo sapiens
gccaccagtgggggcctgggca

SEQ ID NO: 7437229 - DNA, 22 bp, Homo sapiens
gccaccccaacctccctaagtt

SEQ ID NO: 7437230 - DNA, 22 bp, Homo sapiens
gccaccccaacctccctaagtt

SEQ ID NO: 7437231 - DNA, 21 bp, Homo sapiens
gccacccctggcacaggtgct

SEQ ID NO: 7437232 - DNA, 21 bp, Homo sapiens
gccacccctggcacaggtgct

SEQ ID NO: 7437233 - DNA, 22 bp, Homo sapiens
gccaccccataggtgttaggtg

SEQ ID NO: 7437234 - DNA, 22 bp, Homo sapiens
gccacccccaagtaggtggtct

SEQ ID NO: 7437235 - DNA, 22 bp, Homo sapiens
gccaccccaacctccctaagtt

SEQ ID NO: 7437236 - DNA, 22 bp, Homo sapiens
gcatggccatggcactatggac

SEQ ID NO: 7437237 - DNA, 22 bp, Homo sapiens
gcatggccaggaaaggtagaaa

SEQ ID NO: 7437238 - DNA, 22 bp, Homo sapiens
gcatggcctctgtgcttgttgc

SEQ ID NO: 7437239 - DNA, 22 bp, Homo sapiens
gcatggcctccagccaacagca

SEQ ID NO: 7437240 - DNA, 22 bp, Homo sapiens
gcatggcctccagccaacagca

SEQ ID NO: 7437241 - DNA, 22 bp, Homo sapiens
gcatggccttgctgtagtggta

SEQ ID NO: 7437242 - DNA, 22 bp, Homo sapiens
gcatggccttcagggacagctg

SEQ ID NO: 7437243 - DNA, 22 bp, Homo sapiens
gcatggccttcagggacagctg

SEQ ID NO: 7437244 - DNA, 22 bp, Homo sapiens
gcatggcctctgtgcttgttgc

SEQ ID NO: 7437245 - DNA, 22 bp, Homo sapiens
gcatggccttcagggacagctg

SEQ ID NO: 7437246 - DNA, 20 bp, Homo sapiens
gcatggctaatctgtactga

SEQ ID NO: 7437247 - DNA, 22 bp, Homo sapiens
gcatggccttgtgctccttctc

SEQ ID NO: 7437248 - DNA, 22 bp, Homo sapiens
gcatggccttgtgctccttctc

SEQ ID NO: 7437249 - DNA, 22 bp, Homo sapiens
gcatggccttgctgtagtggta

SEQ ID NO: 7437250 - DNA, 22 bp, Homo sapiens
gcatggccttgctgtagtggta

SEQ ID NO: 7437251 - DNA, 22 bp, Homo sapiens
gcatggccttgctgtagtggta

SEQ ID NO: 7437252 - DNA, 22 bp, Homo sapiens
gcatggctattatgaggcagaa

SEQ ID NO: 7437253 - DNA, 20 bp, Homo sapiens
gcatggctaatctgtactga

SEQ ID NO: 7437254 - DNA, 22 bp, Homo sapiens
gcatggctattatgaggcagaa

SEQ ID NO: 7437255 - DNA, 22 bp, Homo sapiens
gcatggctattatgaggcagaa

SEQ ID NO: 7437256 - DNA, 22 bp, Homo sapiens
gcatggctgttgaagtcagctc

SEQ ID NO: 7437257 - DNA, 22 bp, Homo sapiens
gcatggctgttgaagtcagctc

SEQ ID NO: 7437258 - DNA, 22 bp, Homo sapiens
gcatggctgtgagcaccctgcc

SEQ ID NO: 7437259 - DNA, 22 bp, Homo sapiens
gcatggctgtgagcaccctgcc

SEQ ID NO: 7437260 - DNA, 22 bp, Homo sapiens
gcatggctggtgtcctgaggga

SEQ ID NO: 7437261 - DNA, 22 bp, Homo sapiens
gcatggcttacagaggctgcag

SEQ ID NO: 7437262 - DNA, 22 bp, Homo sapiens
gcatggcttacagaggctgcag

SEQ ID NO: 7437263 - DNA, 22 bp, Homo sapiens
gcatggcttacagaggctgcag

SEQ ID NO: 7437264 - DNA, 22 bp, Homo sapiens
gcatggcttccaaaagtgctaa

SEQ ID NO: 7437265 - DNA, 22 bp, Homo sapiens
gcatggcttccaaaagtgctaa

SEQ ID NO: 7437266 - DNA, 22 bp, Homo sapiens
gcatggctattctaactcacat

SEQ ID NO: 7437267 - DNA, 22 bp, Homo sapiens
gcatggctattatgaggcagaa

SEQ ID NO: 7437268 - DNA, 22 bp, Homo sapiens
gcatggctctggcctcagtgtg

SEQ ID NO: 7437269 - DNA, 22 bp, Homo sapiens
gcatggctctggcctcagtgtg

SEQ ID NO: 7437270 - DNA, 22 bp, Homo sapiens
gcatggctgctccctggctgca

SEQ ID NO: 7437271 - DNA, 22 bp, Homo sapiens
gcatggctgctccctggctgca

SEQ ID NO: 7437272 - DNA, 22 bp, Homo sapiens
gcatggctgctccctggctgca

SEQ ID NO: 7437273 - DNA, 22 bp, Homo sapiens
gcatggctgctccctggctgca

SEQ ID NO: 7437274 - DNA, 22 bp, Homo sapiens
gcatggctggtgtcctgaggga

SEQ ID NO: 7437275 - DNA, 22 bp, Homo sapiens
gcatggctgctccctggctgca

SEQ ID NO: 7437276 - DNA, 21 bp, Homo sapiens
gcatgcctgcatcttagtgtt

SEQ ID NO: 7437277 - DNA, 21 bp, Homo sapiens
gcatgcctgcatcttagtgtt

SEQ ID NO: 7437278 - DNA, 22 bp, Homo sapiens
gcatgcatttgtacttgatttt

SEQ ID NO: 7437279 - DNA, 22 bp, Homo sapiens
gcatgcatttgtacttgatttt

SEQ ID NO: 7437280 - DNA, 22 bp, Homo sapiens
gcatgcattttctgagagtcag

SEQ ID NO: 7437281 - DNA, 22 bp, Homo sapiens
gcatgcattttctgagagtcag

SEQ ID NO: 7437282 - DNA, 21 bp, Homo sapiens
gcatgcctgcatcttagtgtt

SEQ ID NO: 7437283 - DNA, 22 bp, Homo sapiens
gcatgctgagcccacgcctggg

SEQ ID NO: 7437284 - DNA, 22 bp, Homo sapiens
gcatgctgagcccacgcctggg

SEQ ID NO: 7437285 - DNA, 22 bp, Homo sapiens
gcatgctgcaccagagcctctc

SEQ ID NO: 7437286 - DNA, 22 bp, Homo sapiens
gcatgctgctgaggctggaata

SEQ ID NO: 7437287 - DNA, 22 bp, Homo sapiens
gcatgctgctgaggctggaata

SEQ ID NO: 7437288 - DNA, 22 bp, Homo sapiens
gcatgctgcccagggactctct

SEQ ID NO: 7437289 - DNA, 22 bp, Homo sapiens
gcatgctgcaccagagcctctc

SEQ ID NO: 7437290 - DNA, 22 bp, Homo sapiens
gcatgctgcaccagagcctctc

SEQ ID NO: 7437291 - DNA, 22 bp, Homo sapiens
gcatgcattacatgggatatgc

SEQ ID NO: 7437292 - DNA, 22 bp, Homo sapiens
gcatgcattacatgggatatgc

SEQ ID NO: 7437293 - DNA, 22 bp, Homo sapiens
gcatgcatttcactaggtatgt

SEQ ID NO: 7437294 - DNA, 22 bp, Homo sapiens
gcatgcatttcactaggtatgt

SEQ ID NO: 7437295 - DNA, 22 bp, Homo sapiens
gcatgcatttccattctcacat

SEQ ID NO: 7437296 - DNA, 22 bp, Homo sapiens
gcatgcatttccattctcacat

SEQ ID NO: 7437297 - DNA, 22 bp, Homo sapiens
gcatgcatgatgttggcagtgg

SEQ ID NO: 7437298 - DNA, 22 bp, Homo sapiens
gcatgcatgatgttggcagtgg

SEQ ID NO: 7437299 - DNA, 22 bp, Homo sapiens
gcatgcatggtttgtgactgtg

SEQ ID NO: 7437300 - DNA, 22 bp, Homo sapiens
gcatgcatgtgtgcagacagtc

SEQ ID NO: 7437301 - DNA, 22 bp, Homo sapiens
gcatgcatgtgtgcagacagtc

SEQ ID NO: 7437302 - DNA, 22 bp, Homo sapiens
gcatgcatggtttgtgactgtg

SEQ ID NO: 7437303 - DNA, 22 bp, Homo sapiens
gcatgcatgatgttggcagtgg

SEQ ID NO: 7437304 - DNA, 22 bp, Homo sapiens
gcatgcatggtttgtgactgtg

SEQ ID NO: 7437305 - DNA, 22 bp, Homo sapiens
gcatgcagtcaaccagtaaggg

SEQ ID NO: 7437306 - DNA, 22 bp, Homo sapiens
gcatgcagtcaaccagtaaggg

SEQ ID NO: 7437307 - DNA, 22 bp, Homo sapiens
gcatgcagtcaaccagtaaggg

SEQ ID NO: 7437308 - DNA, 22 bp, Homo sapiens
gcatgcatctagatatgcagac

SEQ ID NO: 7437309 - DNA, 22 bp, Homo sapiens
gcatgcagtgcaattcaatgta

SEQ ID NO: 7437310 - DNA, 22 bp, Homo sapiens
gcatgcatctagatatgcagac

SEQ ID NO: 7437311 - DNA, 22 bp, Homo sapiens
gcatgcagtaaaattcagcaac

SEQ ID NO: 7437312 - DNA, 22 bp, Homo sapiens
gcatgcagtaaaattcagcaac

SEQ ID NO: 7437313 - DNA, 22 bp, Homo sapiens
gcatgcagtaaaattcagcaac

SEQ ID NO: 7437314 - DNA, 22 bp, Homo sapiens
gcatgcagtaaaattcagcaac

SEQ ID NO: 7437315 - DNA, 22 bp, Homo sapiens
gcatgcagtaaaattcagcaac

SEQ ID NO: 7437316 - DNA, 22 bp, Homo sapiens
gcatgcagtaaaattcagcaac

SEQ ID NO: 7437317 - DNA, 22 bp, Homo sapiens
gcatgcagtcaaccagtaaggg

SEQ ID NO: 7437318 - DNA, 22 bp, Homo sapiens
gccaccagtgggggcctgggca

SEQ ID NO: 7437319 - DNA, 22 bp, Homo sapiens
gccaccagtgggggcctgggca

SEQ ID NO: 7437320 - DNA, 22 bp, Homo sapiens
gccaccagtgggggcctgggca

SEQ ID NO: 7437321 - DNA, 22 bp, Homo sapiens
gccaccagtgggggcctgggca

SEQ ID NO: 7437322 - DNA, 22 bp, Homo sapiens
gccaccagtgggggcctgggca

SEQ ID NO: 7437323 - DNA, 22 bp, Homo sapiens
gccaccagtgggggcctgggca

SEQ ID NO: 7437324 - DNA, 22 bp, Homo sapiens
gccaccagtagctaacaacagt

SEQ ID NO: 7437325 - DNA, 22 bp, Homo sapiens
gccaccagtgggggcctgggca

SEQ ID NO: 7437326 - DNA, 22 bp, Homo sapiens
gccaccagtagctaacaacagt

SEQ ID NO: 7437327 - DNA, 22 bp, Homo sapiens
gccaccaggttctgggttaagc

SEQ ID NO: 7437328 - DNA, 22 bp, Homo sapiens
gccaccagtagctaacaacagt

SEQ ID NO: 7437329 - DNA, 22 bp, Homo sapiens
gccaccaggttctgggttaagc

SEQ ID NO: 7437330 - DNA, 22 bp, Homo sapiens
gccaccaggttagatccagcct

SEQ ID NO: 7437331 - DNA, 22 bp, Homo sapiens
gccaccaggttagatccagcct

SEQ ID NO: 7437332 - DNA, 22 bp, Homo sapiens
gccaccagggggtgcaaggtcc

SEQ ID NO: 7437333 - DNA, 22 bp, Homo sapiens
gccaccaggttagatccagcct

SEQ ID NO: 7437334 - DNA, 22 bp, Homo sapiens
gccaccaggttagatccagcct

SEQ ID NO: 7437335 - DNA, 22 bp, Homo sapiens
gccaccagggggtgcaaggtcc

SEQ ID NO: 7437336 - DNA, 22 bp, Homo sapiens
gccaccagggggtgcaaggtcc

SEQ ID NO: 7437337 - DNA, 22 bp, Homo sapiens
gccaccagggggtgcaaggtcc

SEQ ID NO: 7437338 - DNA, 22 bp, Homo sapiens
gccaccagggggctccagtgag

SEQ ID NO: 7437339 - DNA, 22 bp, Homo sapiens
gccaccagggggctccagtgag

SEQ ID NO: 7437340 - DNA, 22 bp, Homo sapiens
gccaccagggggctccagtgag

SEQ ID NO: 7437341 - DNA, 22 bp, Homo sapiens
gccaccagggggctccagtgag

SEQ ID NO: 7437342 - DNA, 22 bp, Homo sapiens
gccaccagggggctccagtgag

SEQ ID NO: 7437343 - DNA, 22 bp, Homo sapiens
gccaccaggagcccagtccaaa

SEQ ID NO: 7437344 - DNA, 22 bp, Homo sapiens
gccaccagggggctccagtgag

SEQ ID NO: 7437345 - DNA, 22 bp, Homo sapiens
gccaccagggggctccagtgag

SEQ ID NO: 7437346 - DNA, 22 bp, Homo sapiens
gccaccaggagcccagtccaaa

SEQ ID NO: 7437347 - DNA, 22 bp, Homo sapiens
gccaccaggagcccagtccaaa

SEQ ID NO: 7437348 - DNA, 22 bp, Homo sapiens
gccaccaggagcccagtccaaa

SEQ ID NO: 7437349 - DNA, 22 bp, Homo sapiens
gccaccagccccatgcgctgtg

SEQ ID NO: 7437350 - DNA, 22 bp, Homo sapiens
gccaccaggagcccagtccaaa

SEQ ID NO: 7437351 - DNA, 22 bp, Homo sapiens
gccaccaggagcccagtccaaa

SEQ ID NO: 7437352 - DNA, 22 bp, Homo sapiens
gccaccaggagcccagtccaaa

SEQ ID NO: 7437353 - DNA, 22 bp, Homo sapiens
gccaccaggagcccagtccaaa

SEQ ID NO: 7437354 - DNA, 22 bp, Homo sapiens
gccacatgcaattgcagcacgt

SEQ ID NO: 7437355 - DNA, 22 bp, Homo sapiens
gccacatgtcatgtgctcagta

SEQ ID NO: 7437356 - DNA, 22 bp, Homo sapiens
gccacatgtcatgtgctcagta

SEQ ID NO: 7437357 - DNA, 22 bp, Homo sapiens
gccacatgtcatgtgctcagta

SEQ ID NO: 7437358 - DNA, 22 bp, Homo sapiens
gccacatgcaattgcagcacgt

SEQ ID NO: 7437359 - DNA, 22 bp, Homo sapiens
gccacatgtcatgtgctcagta

SEQ ID NO: 7437360 - DNA, 22 bp, Homo sapiens
gccacatgtcatgtgctcagta

SEQ ID NO: 7437361 - DNA, 22 bp, Homo sapiens
gccacatgcaattgcagcacgt

SEQ ID NO: 7437362 - DNA, 22 bp, Homo sapiens
gccacatgcaattgcagcacgt

SEQ ID NO: 7437363 - DNA, 22 bp, Homo sapiens
gccacattagccctcaccatct

SEQ ID NO: 7437364 - DNA, 22 bp, Homo sapiens
gccacattagccctcaccatct

SEQ ID NO: 7437365 - DNA, 19 bp, Homo sapiens
gccacattcttccaggtgt

SEQ ID NO: 7437366 - DNA, 22 bp, Homo sapiens
gccacattagccctcaccatct

SEQ ID NO: 7437367 - DNA, 22 bp, Homo sapiens
gccaccagcagaaaaggggcca

SEQ ID NO: 7437368 - DNA, 22 bp, Homo sapiens
gccaccagcagaaaaggggcca

SEQ ID NO: 7437369 - DNA, 22 bp, Homo sapiens
gccacattgcgctaaacccact

SEQ ID NO: 7437370 - DNA, 22 bp, Homo sapiens
gccacatttgtgcctttatgaa

SEQ ID NO: 7437371 - DNA, 22 bp, Homo sapiens
gccaccagcagaaaaggggcca

SEQ ID NO: 7437372 - DNA, 22 bp, Homo sapiens
gccaccagcagaaaaggggcca

SEQ ID NO: 7437373 - DNA, 22 bp, Homo sapiens
gccacaggcttaggagggaggt

SEQ ID NO: 7437374 - DNA, 22 bp, Homo sapiens
gccacaggcttaggagggaggt

SEQ ID NO: 7437375 - DNA, 22 bp, Homo sapiens
gccacaggcttaggagggaggt

SEQ ID NO: 7437376 - DNA, 22 bp, Homo sapiens
gccacaggcttaggagggaggt

SEQ ID NO: 7437377 - DNA, 22 bp, Homo sapiens
gccacaggcttaggagggaggt

SEQ ID NO: 7437378 - DNA, 22 bp, Homo sapiens
gcatggcttcggggtgctgcct

SEQ ID NO: 7437379 - DNA, 22 bp, Homo sapiens
gccacaggcttaggagggaggt

SEQ ID NO: 7437380 - DNA, 22 bp, Homo sapiens
gccacaggcttaggagggaggt

SEQ ID NO: 7437381 - DNA, 22 bp, Homo sapiens
gccacaggcttaggagggaggt

SEQ ID NO: 7437382 - DNA, 22 bp, Homo sapiens
gccacaggcttaggagggaggt

SEQ ID NO: 7437383 - DNA, 22 bp, Homo sapiens
gccacatccttcagaaagcttt

SEQ ID NO: 7437384 - DNA, 19 bp, Homo sapiens
gccacatcttttccagagt

SEQ ID NO: 7437385 - DNA, 22 bp, Homo sapiens
gccacaggcttaggagggaggt

SEQ ID NO: 7437386 - DNA, 22 bp, Homo sapiens
gccacatagaggaggatattaa

SEQ ID NO: 7437387 - DNA, 22 bp, Homo sapiens
gccacatccaggtggatcaaat

SEQ ID NO: 7437388 - DNA, 22 bp, Homo sapiens
gccacaggcttaggagggaggt

SEQ ID NO: 7437389 - DNA, 22 bp, Homo sapiens
gccacaggcttaggagggaggt

SEQ ID NO: 7437390 - DNA, 22 bp, Homo sapiens
gccacaggcttaggagggaggt

SEQ ID NO: 7437391 - DNA, 22 bp, Homo sapiens
gccacagggaggcgttttcagg

SEQ ID NO: 7437392 - DNA, 20 bp, Homo sapiens
gccacagttttctcactgca

SEQ ID NO: 7437393 - DNA, 22 bp, Homo sapiens
gcagtggcaccgctggctctgg

SEQ ID NO: 7437394 - DNA, 22 bp, Homo sapiens
gcagtggcaccgctggctctgg

SEQ ID NO: 7437395 - DNA, 22 bp, Homo sapiens
gcagtggcagagacagcaccaa

SEQ ID NO: 7437396 - DNA, 22 bp, Homo sapiens
gcagtggcagagacagcaccaa

SEQ ID NO: 7437397 - DNA, 22 bp, Homo sapiens
gcagtggcagctgagggggtat

SEQ ID NO: 7437398 - DNA, 22 bp, Homo sapiens
gcagtggcagctgagggggtat

SEQ ID NO: 7437399 - DNA, 22 bp, Homo sapiens
gcagtggcagagacagcaccaa

SEQ ID NO: 7437400 - DNA, 22 bp, Homo sapiens
gcagtggcagctgagggggtat

SEQ ID NO: 7437401 - DNA, 22 bp, Homo sapiens
gcagtggcatgatgtgggctca

SEQ ID NO: 7437402 - DNA, 22 bp, Homo sapiens
gcagtggcagctgagggggtat

SEQ ID NO: 7437403 - DNA, 22 bp, Homo sapiens
gcagtggcatgatgtgggctca

SEQ ID NO: 7437404 - DNA, 22 bp, Homo sapiens
gcagtggcatgatgtgggctca

SEQ ID NO: 7437405 - DNA, 22 bp, Homo sapiens
gcagtggcatgatgtgggctca

SEQ ID NO: 7437406 - DNA, 22 bp, Homo sapiens
gcagtggcatgatgtgggctca

SEQ ID NO: 7437407 - DNA, 22 bp, Homo sapiens
gcagtggatggccagcaggggc

SEQ ID NO: 7437408 - DNA, 22 bp, Homo sapiens
gcagtggatggccagcaggggc

SEQ ID NO: 7437409 - DNA, 22 bp, Homo sapiens
gcagtggatccaatggtatctt

SEQ ID NO: 7437410 - DNA, 22 bp, Homo sapiens
gcagtggatggccagcaggggc

SEQ ID NO: 7437411 - DNA, 22 bp, Homo sapiens
gcagtggatggccagcaggggc

SEQ ID NO: 7437412 - DNA, 22 bp, Homo sapiens
gcagtggatggccagcaggggc

SEQ ID NO: 7437413 - DNA, 22 bp, Homo sapiens
gcagtggcaccgctggctctgg

SEQ ID NO: 7437414 - DNA, 17 bp, Homo sapiens
gcagtggaggggtagtt

SEQ ID NO: 7437415 - DNA, 17 bp, Homo sapiens
gcagtggaggggtagtt

SEQ ID NO: 7437416 - DNA, 17 bp, Homo sapiens
gcagtggaggggtagtt

SEQ ID NO: 7437417 - DNA, 23 bp, Homo sapiens
gcagtggaatgtctctgtttgga

SEQ ID NO: 7437418 - DNA, 22 bp, Homo sapiens
gcagtggatggccagcaggggc

SEQ ID NO: 7437419 - DNA, 22 bp, Homo sapiens
gcagtggatccaatggtatctt

SEQ ID NO: 7437420 - DNA, 22 bp, Homo sapiens
gcaggggagtggcaggcccgga

SEQ ID NO: 7437421 - DNA, 22 bp, Homo sapiens
gcaggggagtggcaggcccgga

SEQ ID NO: 7437422 - DNA, 22 bp, Homo sapiens
gcaggggagtggatgatggatt

SEQ ID NO: 7437423 - DNA, 22 bp, Homo sapiens
gcaggggagtggcaggcccgga

SEQ ID NO: 7437424 - DNA, 22 bp, Homo sapiens
gcaggggagtggcaggcccgga

SEQ ID NO: 7437425 - DNA, 22 bp, Homo sapiens
gcaggggagtggatgatggatt

SEQ ID NO: 7437426 - DNA, 22 bp, Homo sapiens
gcaggggagtggatgatggatt

SEQ ID NO: 7437427 - DNA, 22 bp, Homo sapiens
gcaggggagtggatgatggatt

SEQ ID NO: 7437428 - DNA, 22 bp, Homo sapiens
gcaggggagtccactctatgca

SEQ ID NO: 7437429 - DNA, 22 bp, Homo sapiens
gcaggggagtggatgatggatt

SEQ ID NO: 7437430 - DNA, 22 bp, Homo sapiens
gcaggggagtggatgatggatt

SEQ ID NO: 7437431 - DNA, 22 bp, Homo sapiens
gcaggggagtggatgatggatt

SEQ ID NO: 7437432 - DNA, 22 bp, Homo sapiens
gcaggggagtggatgatggatt

SEQ ID NO: 7437433 - DNA, 22 bp, Homo sapiens
gcaggggagtggatgatggatt

SEQ ID NO: 7437434 - DNA, 22 bp, Homo sapiens
gcagtgaatctggcaagaattt

SEQ ID NO: 7437435 - DNA, 22 bp, Homo sapiens
gcagtgaatctggcaagaattt

SEQ ID NO: 7437436 - DNA, 22 bp, Homo sapiens
gcagtgaatctggcaagaattt

SEQ ID NO: 7437437 - DNA, 22 bp, Homo sapiens
gcagtgaagccagatctgaaat

SEQ ID NO: 7437438 - DNA, 22 bp, Homo sapiens
gcagtgaagccagatctgaaat

SEQ ID NO: 7437439 - DNA, 22 bp, Homo sapiens
gcagtgaagccagatctgaaat

SEQ ID NO: 7437440 - DNA, 22 bp, Homo sapiens
gcagtgaagccagatctgaaat

SEQ ID NO: 7437441 - DNA, 22 bp, Homo sapiens
gcagtgacagacaactgtttga

SEQ ID NO: 7437442 - DNA, 22 bp, Homo sapiens
gcagtgacagggctgctgcctt

SEQ ID NO: 7437443 - DNA, 22 bp, Homo sapiens
gcagtgacagggctgctgcctt

SEQ ID NO: 7437444 - DNA, 22 bp, Homo sapiens
gcagtgaatttaacactcagat

SEQ ID NO: 7437445 - DNA, 22 bp, Homo sapiens
gcagtgacatacctggagggca

SEQ ID NO: 7437446 - DNA, 22 bp, Homo sapiens
gcagtgacatacctggagggca

SEQ ID NO: 7437447 - DNA, 22 bp, Homo sapiens
gcagtgacatacctggagggca

SEQ ID NO: 7437448 - DNA, 18 bp, Homo sapiens
gcagtgactatggggatc

SEQ ID NO: 7437449 - DNA, 22 bp, Homo sapiens
gcagtggaagcctctttaagca

SEQ ID NO: 7437450 - DNA, 22 bp, Homo sapiens
gcagtggaagcctctttaagca

SEQ ID NO: 7437451 - DNA, 18 bp, Homo sapiens
gcagtgactatggggatc

SEQ ID NO: 7437452 - DNA, 22 bp, Homo sapiens
gcagtgagttatgatcatgcca

SEQ ID NO: 7437453 - DNA, 22 bp, Homo sapiens
gcagtgataactttactctttt

SEQ ID NO: 7437454 - DNA, 22 bp, Homo sapiens
gcagtgattggatcagagatgg

SEQ ID NO: 7437455 - DNA, 20 bp, Homo sapiens
gcagtgatctcatcggtctg

SEQ ID NO: 7437456 - DNA, 22 bp, Homo sapiens
gcagtgatggggatctcactgg

SEQ ID NO: 7437457 - DNA, 22 bp, Homo sapiens
gcatgcagggagggtctggctg

SEQ ID NO: 7437458 - DNA, 22 bp, Homo sapiens
gcatgcagggagggtctggctg

SEQ ID NO: 7437459 - DNA, 22 bp, Homo sapiens
gcatgcagggagggtctggctg

SEQ ID NO: 7437460 - DNA, 22 bp, Homo sapiens
gcatgcaggataggttgagctc

SEQ ID NO: 7437461 - DNA, 22 bp, Homo sapiens
gcatgcagggagggtctggctg

SEQ ID NO: 7437462 - DNA, 22 bp, Homo sapiens
gcatgcagggagggtctggctg

SEQ ID NO: 7437463 - DNA, 22 bp, Homo sapiens
gcatgcagggagggtctggctg

SEQ ID NO: 7437464 - DNA, 22 bp, Homo sapiens
gcatgcaggagagaaagacggc

SEQ ID NO: 7437465 - DNA, 22 bp, Homo sapiens
gcatgcaggataggttgagctc

SEQ ID NO: 7437466 - DNA, 22 bp, Homo sapiens
gcatgcaggataggttgagctc

SEQ ID NO: 7437467 - DNA, 22 bp, Homo sapiens
gcatgcaggataggttgagctc

SEQ ID NO: 7437468 - DNA, 22 bp, Homo sapiens
gcatgcaggaagggcttgggga

SEQ ID NO: 7437469 - DNA, 22 bp, Homo sapiens
gcatgcaggaagttttttggga

SEQ ID NO: 7437470 - DNA, 22 bp, Homo sapiens
gcatgcaggagagaaagacggc

SEQ ID NO: 7437471 - DNA, 22 bp, Homo sapiens
gcatgcaggagagaaagacggc

SEQ ID NO: 7437472 - DNA, 19 bp, Homo sapiens
gcatgcagagtaagaaggt

SEQ ID NO: 7437473 - DNA, 22 bp, Homo sapiens
gcatgcagagtccctctgcatt

SEQ ID NO: 7437474 - DNA, 22 bp, Homo sapiens
gcatgcagagtccctctgcatt

SEQ ID NO: 7437475 - DNA, 22 bp, Homo sapiens
gcatgcaggaagggcttgggga

SEQ ID NO: 7437476 - DNA, 22 bp, Homo sapiens
gcatgcaggaagggcttgggga

SEQ ID NO: 7437477 - DNA, 22 bp, Homo sapiens
gcatgcaggaagggcttgggga

SEQ ID NO: 7437478 - DNA, 22 bp, Homo sapiens
gcatgcagagaatacctgtgat

SEQ ID NO: 7437479 - DNA, 19 bp, Homo sapiens
gcatgcagagtaagaaggt

SEQ ID NO: 7437480 - DNA, 22 bp, Homo sapiens
gcatgcagagaatacctgtgat

SEQ ID NO: 7437481 - DNA, 22 bp, Homo sapiens
gcatgcagagaatacctgtgat

SEQ ID NO: 7437482 - DNA, 22 bp, Homo sapiens
gcatgcagacagtctgagacca

SEQ ID NO: 7437483 - DNA, 22 bp, Homo sapiens
gcatgcaattatggtattagat

SEQ ID NO: 7437484 - DNA, 22 bp, Homo sapiens
gcatgcacacactttctcacta

SEQ ID NO: 7437485 - DNA, 22 bp, Homo sapiens
gcatgcacacactttctcacta

SEQ ID NO: 7437486 - DNA, 22 bp, Homo sapiens
gcatgcacacctgtgcacattt

SEQ ID NO: 7437487 - DNA, 22 bp, Homo sapiens
gcatgcacacctgtgcacattt

SEQ ID NO: 7437488 - DNA, 22 bp, Homo sapiens
gcatgcacagtttttcacctca

SEQ ID NO: 7437489 - DNA, 22 bp, Homo sapiens
gcatgcacagtttttcacctca

SEQ ID NO: 7437490 - DNA, 22 bp, Homo sapiens
gcatgcacggggcatatgggac

SEQ ID NO: 7437491 - DNA, 22 bp, Homo sapiens
gcatgcacgggcacatatgcta

SEQ ID NO: 7437492 - DNA, 22 bp, Homo sapiens
gcatgcacggggcatatgggac

SEQ ID NO: 7437493 - DNA, 22 bp, Homo sapiens
gcatgcagacagtctgagacca

SEQ ID NO: 7437494 - DNA, 22 bp, Homo sapiens
gcatgcagacagtctgagacca

SEQ ID NO: 7437495 - DNA, 22 bp, Homo sapiens
gcatgcagaaaatgaacaacga

SEQ ID NO: 7437496 - DNA, 22 bp, Homo sapiens
gcatgcacggggcatatgggac

SEQ ID NO: 7437497 - DNA, 22 bp, Homo sapiens
gcatgcactgtatttaagtatc

SEQ ID NO: 7437498 - DNA, 22 bp, Homo sapiens
gcatgcactgtatttaagtatc

SEQ ID NO: 7437499 - DNA, 22 bp, Homo sapiens
gcatgcagaaaatgaacaacga

SEQ ID NO: 7437500 - DNA, 22 bp, Homo sapiens
gcatgcagaaaatgaacaacga

SEQ ID NO: 7437501 - DNA, 22 bp, Homo sapiens
gcatgcagaaaatgaacaacga

SEQ ID NO: 7437502 - DNA, 23 bp, Homo sapiens
gcatgcaacttgcagtagtattc

SEQ ID NO: 7437503 - DNA, 22 bp, Homo sapiens
gcatgcaaggaccaagggagca

SEQ ID NO: 7437504 - DNA, 22 bp, Homo sapiens
gcatgcaaggaccaagggagca

SEQ ID NO: 7437505 - DNA, 22 bp, Homo sapiens
gcatgcaaggggtgtgaagtga

SEQ ID NO: 7437506 - DNA, 22 bp, Homo sapiens
gcatgcaattatggtattagat

SEQ ID NO: 7437507 - DNA, 22 bp, Homo sapiens
gcatgcaattatggtattagat

SEQ ID NO: 7437508 - DNA, 22 bp, Homo sapiens
gcatgcaatctatccttaggaa

SEQ ID NO: 7437509 - DNA, 22 bp, Homo sapiens
gcatgcaatctatccttaggaa

SEQ ID NO: 7437510 - DNA, 22 bp, Homo sapiens
gcatgcaatgtatcagtgatag

SEQ ID NO: 7437511 - DNA, 22 bp, Homo sapiens
gcatgcaatgtatcagtgatag

SEQ ID NO: 7437512 - DNA, 22 bp, Homo sapiens
gcagtggctaggagtctggcgt

SEQ ID NO: 7437513 - DNA, 22 bp, Homo sapiens
gcagtggctaggagtctggcgt

SEQ ID NO: 7437514 - DNA, 22 bp, Homo sapiens
gcagtggctaggagtctggcgt

SEQ ID NO: 7437515 - DNA, 22 bp, Homo sapiens
gcagtggctaggagtctggcgt

SEQ ID NO: 7437516 - DNA, 22 bp, Homo sapiens
gcagtgggaaggttggcacatg

SEQ ID NO: 7437517 - DNA, 22 bp, Homo sapiens
gcagtgggaaggttggcacatg

SEQ ID NO: 7437518 - DNA, 22 bp, Homo sapiens
gcagtgggaaggttggcacatg

SEQ ID NO: 7437519 - DNA, 22 bp, Homo sapiens
gcagtgggagcttaggcagtgc

SEQ ID NO: 7437520 - DNA, 22 bp, Homo sapiens
gcagtgggaaggttggcacatg

SEQ ID NO: 7437521 - DNA, 22 bp, Homo sapiens
gcagtgggagcttaggcagtgc

SEQ ID NO: 7437522 - DNA, 22 bp, Homo sapiens
gcagtgggagcttaggcagtgc

SEQ ID NO: 7437523 - DNA, 22 bp, Homo sapiens
gcagtgggagcttaggcagtgc

SEQ ID NO: 7437524 - DNA, 22 bp, Homo sapiens
gcagtgggagcttaggcagtgc

SEQ ID NO: 7437525 - DNA, 22 bp, Homo sapiens
gcagtgggagcttaggcagtgc

SEQ ID NO: 7437526 - DNA, 22 bp, Homo sapiens
gcagtgggagcttaggcagtgc

SEQ ID NO: 7437527 - DNA, 22 bp, Homo sapiens
gcagtggccacatggaggagga

SEQ ID NO: 7437528 - DNA, 22 bp, Homo sapiens
gcagtggccacatggaggagga

SEQ ID NO: 7437529 - DNA, 22 bp, Homo sapiens
gcagtggccacatggaggagga

SEQ ID NO: 7437530 - DNA, 22 bp, Homo sapiens
gcagtggccacatggaggagga

SEQ ID NO: 7437531 - DNA, 22 bp, Homo sapiens
gcagtggcatgatgtgggctca

SEQ ID NO: 7437532 - DNA, 22 bp, Homo sapiens
gcagtggcccagcttgcaggct

SEQ ID NO: 7437533 - DNA, 22 bp, Homo sapiens
gcagtggccacatggaggagga

SEQ ID NO: 7437534 - DNA, 22 bp, Homo sapiens
gcagtggccacatggaggagga

SEQ ID NO: 7437535 - DNA, 22 bp, Homo sapiens
gcagtggccacatggaggagga

SEQ ID NO: 7437536 - DNA, 22 bp, Homo sapiens
gcagtggcccagcttgcaggct

SEQ ID NO: 7437537 - DNA, 22 bp, Homo sapiens
gcagtggccacatggaggagga

SEQ ID NO: 7437538 - DNA, 22 bp, Homo sapiens
gcagtggctaggagtctggcgt

SEQ ID NO: 7437539 - DNA, 22 bp, Homo sapiens
gcagtggctaagctcgcatgca

SEQ ID NO: 7437540 - DNA, 22 bp, Homo sapiens
ggggaagatggccctccatgtg

SEQ ID NO: 7437541 - DNA, 22 bp, Homo sapiens
ggggaagatttttaattagtaa

SEQ ID NO: 7437542 - DNA, 22 bp, Homo sapiens
ggggaagatttttaattagtaa

SEQ ID NO: 7437543 - DNA, 22 bp, Homo sapiens
ggggaagatggccctccatgtg

SEQ ID NO: 7437544 - DNA, 22 bp, Homo sapiens
ggggaagatggccctccatgtg

SEQ ID NO: 7437545 - DNA, 22 bp, Homo sapiens
ggggaaggaaagttattagcag

SEQ ID NO: 7437546 - DNA, 22 bp, Homo sapiens
ggggaagatttttaattagtaa

SEQ ID NO: 7437547 - DNA, 22 bp, Homo sapiens
ggggaaggatatgattagacta

SEQ ID NO: 7437548 - DNA, 22 bp, Homo sapiens
ggggaaggaaagttattagcag

SEQ ID NO: 7437549 - DNA, 22 bp, Homo sapiens
ggggaaggaaagttattagcag

SEQ ID NO: 7437550 - DNA, 22 bp, Homo sapiens
ggggaaggaaagttattagcag

SEQ ID NO: 7437551 - DNA, 22 bp, Homo sapiens
ggggaaggaaagttattagcag

SEQ ID NO: 7437552 - DNA, 22 bp, Homo sapiens
ggggccgaccgcggttcaggcc

SEQ ID NO: 7437553 - DNA, 22 bp, Homo sapiens
ggggccgaccgcggttcaggcc

SEQ ID NO: 7437554 - DNA, 22 bp, Homo sapiens
ggggccgaccgcggttcaggcc

SEQ ID NO: 7437555 - DNA, 22 bp, Homo sapiens
ggggccgaccgcggttcaggcc

SEQ ID NO: 7437556 - DNA, 22 bp, Homo sapiens
ggggccgaccgcggttcaggcc

SEQ ID NO: 7437557 - DNA, 22 bp, Homo sapiens
ggggccgaccgcggttcaggcc

SEQ ID NO: 7437558 - DNA, 22 bp, Homo sapiens
ggggccgaccgcggttcaggcc

SEQ ID NO: 7437559 - DNA, 22 bp, Homo sapiens
ggggccgaccgcggttcaggcc

SEQ ID NO: 7437560 - DNA, 22 bp, Homo sapiens
ggggaaggatatgattagacta

SEQ ID NO: 7437561 - DNA, 22 bp, Homo sapiens
ggggaaggaaagttattagcag

SEQ ID NO: 7437562 - DNA, 22 bp, Homo sapiens
ggggaaggatatgattagacta

SEQ ID NO: 7437563 - DNA, 22 bp, Homo sapiens
ggggaaggatatgattagacta

SEQ ID NO: 7437564 - DNA, 22 bp, Homo sapiens
ggggaaggatatgattagacta

SEQ ID NO: 7437565 - DNA, 22 bp, Homo sapiens
ggggaaggatatgattagacta

SEQ ID NO: 7437566 - DNA, 22 bp, Homo sapiens
ggggaaggatatgattagacta

SEQ ID NO: 7437567 - DNA, 22 bp, Homo sapiens
ggggaaggattgagttgaccca

SEQ ID NO: 7437568 - DNA, 22 bp, Homo sapiens
ggggcggggctctgagaagcat

SEQ ID NO: 7437569 - DNA, 21 bp, Homo sapiens
ggggcgtggcctgccagttgc

SEQ ID NO: 7437570 - DNA, 21 bp, Homo sapiens
ggggcgtggcctgccagttgc

SEQ ID NO: 7437571 - DNA, 22 bp, Homo sapiens
ggggcctcgccgccgcctctgc

SEQ ID NO: 7437572 - DNA, 22 bp, Homo sapiens
ggggcctcgccgccgcctctgc

SEQ ID NO: 7437573 - DNA, 22 bp, Homo sapiens
ggggcggggctctgagaagcat

SEQ ID NO: 7437574 - DNA, 22 bp, Homo sapiens
ggggcggggctctgagaagcat

SEQ ID NO: 7437575 - DNA, 22 bp, Homo sapiens
ggggctcaggggaagtgtccag

SEQ ID NO: 7437576 - DNA, 22 bp, Homo sapiens
ggggctcacacctccctaaggg

SEQ ID NO: 7437577 - DNA, 22 bp, Homo sapiens
ggggctcacacctccctaaggg

SEQ ID NO: 7437578 - DNA, 22 bp, Homo sapiens
ggggctcacacctccctaaggg

SEQ ID NO: 7437579 - DNA, 22 bp, Homo sapiens
ggggctaactttctgagggtag

SEQ ID NO: 7437580 - DNA, 22 bp, Homo sapiens
ggggcctccagcactaggcagc

SEQ ID NO: 7437581 - DNA, 22 bp, Homo sapiens
ggggcctccagcactaggcagc

SEQ ID NO: 7437582 - DNA, 22 bp, Homo sapiens
ggggcctccagcactaggcagc

SEQ ID NO: 7437583 - DNA, 22 bp, Homo sapiens
ggggcctccagcactaggcagc

SEQ ID NO: 7437584 - DNA, 22 bp, Homo sapiens
ggggcctccagcactaggcagc

SEQ ID NO: 7437585 - DNA, 22 bp, Homo sapiens
ggggccgccagagagagccttg

SEQ ID NO: 7437586 - DNA, 22 bp, Homo sapiens
ggggccgaccgcggttcaggcc

SEQ ID NO: 7437587 - DNA, 22 bp, Homo sapiens
ggggccgaccgcggttcaggcc

SEQ ID NO: 7437588 - DNA, 22 bp, Homo sapiens
ggggccgaccgcggttcaggcc

SEQ ID NO: 7437589 - DNA, 22 bp, Homo sapiens
ggggccgaccgcggttcaggcc

SEQ ID NO: 7437590 - DNA, 22 bp, Homo sapiens
ggggccgaccgcggttcaggcc

SEQ ID NO: 7437591 - DNA, 22 bp, Homo sapiens
ggggccgaccgcggttcaggcc

SEQ ID NO: 7437592 - DNA, 22 bp, Homo sapiens
ggggccgaccgcggttcaggcc

SEQ ID NO: 7437593 - DNA, 22 bp, Homo sapiens
ggggaagagcattgcacggtgt

SEQ ID NO: 7437594 - DNA, 22 bp, Homo sapiens
ggggaagaggcgtgatggatcc

SEQ ID NO: 7437595 - DNA, 22 bp, Homo sapiens
ggggaagaggcgtgatggatcc

SEQ ID NO: 7437596 - DNA, 22 bp, Homo sapiens
ggggaagaggcgtgatggatcc

SEQ ID NO: 7437597 - DNA, 22 bp, Homo sapiens
ggggaagaggcgtgatggatcc

SEQ ID NO: 7437598 - DNA, 22 bp, Homo sapiens
ggggaagacctggcactacagc

SEQ ID NO: 7437599 - DNA, 22 bp, Homo sapiens
ggggaagaatggcagaaaacat

SEQ ID NO: 7437600 - DNA, 22 bp, Homo sapiens
ggggaagacctggcactacagc

SEQ ID NO: 7437601 - DNA, 22 bp, Homo sapiens
ggggaagacctggcactacagc

SEQ ID NO: 7437602 - DNA, 22 bp, Homo sapiens
ggggaagacctggcactacagc

SEQ ID NO: 7437603 - DNA, 22 bp, Homo sapiens
ggggaagagcattgcacggtgt

SEQ ID NO: 7437604 - DNA, 22 bp, Homo sapiens
ggggaagagcattgcacggtgt

SEQ ID NO: 7437605 - DNA, 22 bp, Homo sapiens
ggggaagaggcgtgatggatcc

SEQ ID NO: 7437606 - DNA, 22 bp, Homo sapiens
ggggaagaggcgtgatggatcc

SEQ ID NO: 7437607 - DNA, 22 bp, Homo sapiens
ggggaagatggccctccatgtg

SEQ ID NO: 7437608 - DNA, 22 bp, Homo sapiens
ggggaagatggccctccatgtg

SEQ ID NO: 7437609 - DNA, 22 bp, Homo sapiens
ggggaagatggccctccatgtg

SEQ ID NO: 7437610 - DNA, 22 bp, Homo sapiens
ggggaagatggccctccatgtg

SEQ ID NO: 7437611 - DNA, 22 bp, Homo sapiens
ggggaagatggccctccatgtg

SEQ ID NO: 7437612 - DNA, 22 bp, Homo sapiens
ggggaagatggccctccatgtg

SEQ ID NO: 7437613 - DNA, 22 bp, Homo sapiens
ggggaagatggccctccatgtg

SEQ ID NO: 7437614 - DNA, 22 bp, Homo sapiens
ggggaagatggccctccatgtg

SEQ ID NO: 7437615 - DNA, 22 bp, Homo sapiens
ggggaagaatgctctctagaga

SEQ ID NO: 7437616 - DNA, 17 bp, Homo sapiens
gggctttaggtggtgta

SEQ ID NO: 7437617 - DNA, 22 bp, Homo sapiens
gggctttatgagattgagatct

SEQ ID NO: 7437618 - DNA, 22 bp, Homo sapiens
gggctttatgagattgagatct

SEQ ID NO: 7437619 - DNA, 22 bp, Homo sapiens
gggctttagattgcagaggatt

SEQ ID NO: 7437620 - DNA, 22 bp, Homo sapiens
gggctttaggggccagtgacca

SEQ ID NO: 7437621 - DNA, 22 bp, Homo sapiens
gggctttaggggccagtgacca

SEQ ID NO: 7437622 - DNA, 17 bp, Homo sapiens
gggctttaggtggtgta

SEQ ID NO: 7437623 - DNA, 22 bp, Homo sapiens
ggggaagaatggcagaaaacat

SEQ ID NO: 7437624 - DNA, 22 bp, Homo sapiens
ggggaagaatggcagaaaacat

SEQ ID NO: 7437625 - DNA, 22 bp, Homo sapiens
ggggaagaatggcagaaaacat

SEQ ID NO: 7437626 - DNA, 22 bp, Homo sapiens
ggggaagaatggcagaaaacat

SEQ ID NO: 7437627 - DNA, 22 bp, Homo sapiens
ggggaagaatggcagaaaacat

SEQ ID NO: 7437628 - DNA, 22 bp, Homo sapiens
ggggaagaatgctctctagaga

SEQ ID NO: 7437629 - DNA, 22 bp, Homo sapiens
gggcttgtggtaaagaatgggg

SEQ ID NO: 7437630 - DNA, 22 bp, Homo sapiens
gggctttaacacccagtcaggg

SEQ ID NO: 7437631 - DNA, 22 bp, Homo sapiens
gggctttaacacccagtcaggg

SEQ ID NO: 7437632 - DNA, 22 bp, Homo sapiens
gggcttggtggagagaatgctg

SEQ ID NO: 7437633 - DNA, 22 bp, Homo sapiens
gggcttggtggagagaatgctg

SEQ ID NO: 7437634 - DNA, 22 bp, Homo sapiens
gggcttggtggagagaatgctg

SEQ ID NO: 7437635 - DNA, 22 bp, Homo sapiens
gggctttaacacccagtcaggg

SEQ ID NO: 7437636 - DNA, 22 bp, Homo sapiens
gggctttaatcttgttaactag

SEQ ID NO: 7437637 - DNA, 22 bp, Homo sapiens
gggctttaatcttgttaactag

SEQ ID NO: 7437638 - DNA, 22 bp, Homo sapiens
gggctttaatcttgttaactag

SEQ ID NO: 7437639 - DNA, 18 bp, Homo sapiens
gggctttacagagtggag

SEQ ID NO: 7437640 - DNA, 18 bp, Homo sapiens
gggctttacagagtggag

SEQ ID NO: 7437641 - DNA, 19 bp, Homo sapiens
gggctttactccaagtggg

SEQ ID NO: 7437642 - DNA, 19 bp, Homo sapiens
gggctttactccaagtggg

SEQ ID NO: 7437643 - DNA, 22 bp, Homo sapiens
gggctttagattgcagaggatt

SEQ ID NO: 7437644 - DNA, 20 bp, Homo sapiens
ggggctgcatgcagagaaga

SEQ ID NO: 7437645 - DNA, 22 bp, Homo sapiens
ggggctgctcccacccctgagg

SEQ ID NO: 7437646 - DNA, 22 bp, Homo sapiens
ggggctgctcccacccctgagg

SEQ ID NO: 7437647 - DNA, 22 bp, Homo sapiens
ggggctgctcccacccctgagg

SEQ ID NO: 7437648 - DNA, 20 bp, Homo sapiens
ggggctgcatgcagagaaga

SEQ ID NO: 7437649 - DNA, 20 bp, Homo sapiens
ggggctgcatgcagagaaga

SEQ ID NO: 7437650 - DNA, 20 bp, Homo sapiens
ggggctgcatgcagagaaga

SEQ ID NO: 7437651 - DNA, 22 bp, Homo sapiens
ggggctgatggaactcaggcct

SEQ ID NO: 7437652 - DNA, 20 bp, Homo sapiens
ggggctgcatgcagagaaga

SEQ ID NO: 7437653 - DNA, 22 bp, Homo sapiens
ggggctgagtcagtgggaagag

SEQ ID NO: 7437654 - DNA, 22 bp, Homo sapiens
ggggctgacgggcatgtggctt

SEQ ID NO: 7437655 - DNA, 22 bp, Homo sapiens
ggggctgagtcagtgggaagag

SEQ ID NO: 7437656 - DNA, 22 bp, Homo sapiens
ggggctgagtcagtgggaagag

SEQ ID NO: 7437657 - DNA, 22 bp, Homo sapiens
ggggctgagtcagtgggaagag

SEQ ID NO: 7437658 - DNA, 22 bp, Homo sapiens
ggggctgagaattcagtctcgg

SEQ ID NO: 7437659 - DNA, 22 bp, Homo sapiens
ggggctgatggaactcaggcct

SEQ ID NO: 7437660 - DNA, 22 bp, Homo sapiens
ggggctgatggaactcaggcct

SEQ ID NO: 7437661 - DNA, 22 bp, Homo sapiens
ggggctgatggaactcaggcct

SEQ ID NO: 7437662 - DNA, 22 bp, Homo sapiens
ggggctgatggaactcaggcct

SEQ ID NO: 7437663 - DNA, 22 bp, Homo sapiens
ggggctgatggaactcaggcct

SEQ ID NO: 7437664 - DNA, 22 bp, Homo sapiens
ggggctgatggaactcaggcct

SEQ ID NO: 7437665 - DNA, 22 bp, Homo sapiens
ggggctgatggaactcaggcct

SEQ ID NO: 7437666 - DNA, 22 bp, Homo sapiens
ggggctgatggaactcaggcct

SEQ ID NO: 7437667 - DNA, 22 bp, Homo sapiens
ggggctggctcactaagagact

SEQ ID NO: 7437668 - DNA, 22 bp, Homo sapiens
ggggctggctcactaagagact

SEQ ID NO: 7437669 - DNA, 22 bp, Homo sapiens
ggggctggctcactaagagact

SEQ ID NO: 7437670 - DNA, 22 bp, Homo sapiens
ggggctggctcactaagagact

SEQ ID NO: 7437671 - DNA, 22 bp, Homo sapiens
ggggctggctcactaagagact

SEQ ID NO: 7437672 - DNA, 22 bp, Homo sapiens
ggggctgggatttgaacccagg

SEQ ID NO: 7437673 - DNA, 22 bp, Homo sapiens
ggggctgggatttgaacccagg

SEQ ID NO: 7437674 - DNA, 22 bp, Homo sapiens
ggggctgggatttgaacccagg

SEQ ID NO: 7437675 - DNA, 22 bp, Homo sapiens
ggggctggctcactaagagact

SEQ ID NO: 7437676 - DNA, 22 bp, Homo sapiens
ggggctgctggtatttccagtt

SEQ ID NO: 7437677 - DNA, 22 bp, Homo sapiens
ggggctgctggtatttccagtt

SEQ ID NO: 7437678 - DNA, 22 bp, Homo sapiens
ggggctgctggtatttccagtt

SEQ ID NO: 7437679 - DNA, 22 bp, Homo sapiens
ggggctgctcgccgcgcgtttc

SEQ ID NO: 7437680 - DNA, 22 bp, Homo sapiens
ggggctgcttcacctttttacg

SEQ ID NO: 7437681 - DNA, 22 bp, Homo sapiens
ggggctggctcactaagagact

SEQ ID NO: 7437682 - DNA, 22 bp, Homo sapiens
ggggctggctcactaagagact

SEQ ID NO: 7437683 - DNA, 22 bp, Homo sapiens
ggggctggctcactaagagact

SEQ ID NO: 7437684 - DNA, 22 bp, Homo sapiens
ggggctggctcactaagagact

SEQ ID NO: 7437685 - DNA, 22 bp, Homo sapiens
ggggctggctcactaagagact

SEQ ID NO: 7437686 - DNA, 22 bp, Homo sapiens
ggggctcagttcggacagcctg

SEQ ID NO: 7437687 - DNA, 22 bp, Homo sapiens
ggggctcagttcggacagcctg

SEQ ID NO: 7437688 - DNA, 22 bp, Homo sapiens
ggggctcagttcggacagcctg

SEQ ID NO: 7437689 - DNA, 22 bp, Homo sapiens
ggggctcaggggaagtgtccag

SEQ ID NO: 7437690 - DNA, 22 bp, Homo sapiens
ggggctcaggggaagtgtccag

SEQ ID NO: 7437691 - DNA, 22 bp, Homo sapiens
ggggctcaggggaagtgtccag

SEQ ID NO: 7437692 - DNA, 22 bp, Homo sapiens
ggggctcagttcggacagcctg

SEQ ID NO: 7437693 - DNA, 22 bp, Homo sapiens
ggggctcagttcggacagcctg

SEQ ID NO: 7437694 - DNA, 22 bp, Homo sapiens
ggggctctgcctctcccacgcc

SEQ ID NO: 7437695 - DNA, 22 bp, Homo sapiens
ggggctctcaggtctccccaaa

SEQ ID NO: 7437696 - DNA, 22 bp, Homo sapiens
ggggctccagtcttcacatttt

SEQ ID NO: 7437697 - DNA, 22 bp, Homo sapiens
ggggctcatgctgtttggtctt

SEQ ID NO: 7437698 - DNA, 22 bp, Homo sapiens
ggggctccagtcttcacatttt

SEQ ID NO: 7437699 - DNA, 22 bp, Homo sapiens
ggggctccagtcttcacatttt

SEQ ID NO: 7437700 - DNA, 22 bp, Homo sapiens
ggggctcttagagagcctagtg

SEQ ID NO: 7437701 - DNA, 22 bp, Homo sapiens
ggggctgaacctggaggtggtc

SEQ ID NO: 7437702 - DNA, 22 bp, Homo sapiens
ggggctgaacctggaggtggtc

SEQ ID NO: 7437703 - DNA, 22 bp, Homo sapiens
ggggctctgctctgagccgtgt

SEQ ID NO: 7437704 - DNA, 22 bp, Homo sapiens
ggggctctgctctgagccgtgt

SEQ ID NO: 7437705 - DNA, 22 bp, Homo sapiens
ggggctgaacctggaggtggtc

SEQ ID NO: 7437706 - DNA, 22 bp, Homo sapiens
ggggctgaacctggaggtggtc

SEQ ID NO: 7437707 - DNA, 22 bp, Homo sapiens
ggggctgaacctggaggtggtc

SEQ ID NO: 7437708 - DNA, 22 bp, Homo sapiens
ggggctgacgggcatgtggctt

SEQ ID NO: 7437709 - DNA, 22 bp, Homo sapiens
ggggctgacgggcatgtggctt

SEQ ID NO: 7437710 - DNA, 22 bp, Homo sapiens
ggggctgacgggcatgtggctt

SEQ ID NO: 7437711 - DNA, 22 bp, Homo sapiens
ggggctgagaattcagtctcgg

SEQ ID NO: 7437712 - DNA, 22 bp, Homo sapiens
ggggctgacgggcatgtggctt

SEQ ID NO: 7437713 - DNA, 22 bp, Homo sapiens
ggggctgacgggcatgtggctt

SEQ ID NO: 7437714 - DNA, 22 bp, Homo sapiens
gggtaggcaaagcaatgacgtt

SEQ ID NO: 7437715 - DNA, 22 bp, Homo sapiens
gggtaggcagtgcgtcctgcct

SEQ ID NO: 7437716 - DNA, 22 bp, Homo sapiens
gggtaggcaaagcaatgacgtt

SEQ ID NO: 7437717 - DNA, 22 bp, Homo sapiens
gggtaggatggtagaagggacc

SEQ ID NO: 7437718 - DNA, 22 bp, Homo sapiens
gggtaggatggtagaagggacc

SEQ ID NO: 7437719 - DNA, 22 bp, Homo sapiens
gggtaggcaaagcaatgacgtt

SEQ ID NO: 7437720 - DNA, 22 bp, Homo sapiens
gggtaggatggtagaagggacc

SEQ ID NO: 7437721 - DNA, 22 bp, Homo sapiens
gggtaggatggtagaagggacc

SEQ ID NO: 7437722 - DNA, 22 bp, Homo sapiens
gggtaggatggtagaagggacc

SEQ ID NO: 7437723 - DNA, 22 bp, Homo sapiens
gggtaggagaggtgtctgtgtg

SEQ ID NO: 7437724 - DNA, 22 bp, Homo sapiens
gggtaggagaggtgtctgtgtg

SEQ ID NO: 7437725 - DNA, 22 bp, Homo sapiens
gggtaggagaggtgtctgtgtg

SEQ ID NO: 7437726 - DNA, 22 bp, Homo sapiens
gggtaggagaggtgtctgtgtg

SEQ ID NO: 7437727 - DNA, 22 bp, Homo sapiens
gggtaggaaatccagaggtggc

SEQ ID NO: 7437728 - DNA, 22 bp, Homo sapiens
gggtaggaaatccagaggtggc

SEQ ID NO: 7437729 - DNA, 22 bp, Homo sapiens
gggtaggaaatccagaggtggc

SEQ ID NO: 7437730 - DNA, 22 bp, Homo sapiens
gggtaggaaatccagaggtggc

SEQ ID NO: 7437731 - DNA, 22 bp, Homo sapiens
gggtaggagaggtgtctgtgtg

SEQ ID NO: 7437732 - DNA, 22 bp, Homo sapiens
gggtaggatggtagaagggacc

SEQ ID NO: 7437733 - DNA, 22 bp, Homo sapiens
gggtaggatggtagaagggacc

SEQ ID NO: 7437734 - DNA, 22 bp, Homo sapiens
gggtaggatggtagaagggacc

SEQ ID NO: 7437735 - DNA, 22 bp, Homo sapiens
gggtaggagaggtgtctgtgtg

SEQ ID NO: 7437736 - DNA, 22 bp, Homo sapiens
gggtaggagaggtgtctgtgtg

SEQ ID NO: 7437737 - DNA, 22 bp, Homo sapiens
gggtaggagaggtgtctgtgtg

SEQ ID NO: 7437738 - DNA, 22 bp, Homo sapiens
gggtaggagaggtgtctgtgtg

SEQ ID NO: 7437739 - DNA, 22 bp, Homo sapiens
gggtagggtgacttaggctggc

SEQ ID NO: 7437740 - DNA, 22 bp, Homo sapiens
gggtagggtgacttaggctggc

SEQ ID NO: 7437741 - DNA, 22 bp, Homo sapiens
gggtagggtgacttaggctggc

SEQ ID NO: 7437742 - DNA, 22 bp, Homo sapiens
gggtagggtgacttaggctggc

SEQ ID NO: 7437743 - DNA, 22 bp, Homo sapiens
gggtagggtgacttaggctggc

SEQ ID NO: 7437744 - DNA, 22 bp, Homo sapiens
gggtaggctgctcctggggccc

SEQ ID NO: 7437745 - DNA, 22 bp, Homo sapiens
gggtaggctgctcctggggccc

SEQ ID NO: 7437746 - DNA, 22 bp, Homo sapiens
gggtaggctctgcaggctgggt

SEQ ID NO: 7437747 - DNA, 22 bp, Homo sapiens
gggtaggctctgcaggctgggt

SEQ ID NO: 7437748 - DNA, 22 bp, Homo sapiens
gggtaggccagaagggcctgga

SEQ ID NO: 7437749 - DNA, 22 bp, Homo sapiens
gggtaggctctgcaggctgggt

SEQ ID NO: 7437750 - DNA, 22 bp, Homo sapiens
gggtaggctctgcaggctgggt

SEQ ID NO: 7437751 - DNA, 22 bp, Homo sapiens
gggtaggccgtgggtcaccagg

SEQ ID NO: 7437752 - DNA, 22 bp, Homo sapiens
gggtggagcctgagaatttgca

SEQ ID NO: 7437753 - DNA, 22 bp, Homo sapiens
gggtggagcctgagaatttgca

SEQ ID NO: 7437754 - DNA, 22 bp, Homo sapiens
gggtggagcctgagaatttgca

SEQ ID NO: 7437755 - DNA, 22 bp, Homo sapiens
gggtagtaactacacagcgaag

SEQ ID NO: 7437756 - DNA, 22 bp, Homo sapiens
gggtagtaactacacagcgaag

SEQ ID NO: 7437757 - DNA, 22 bp, Homo sapiens
gggtagtgtggtctctgggctg

SEQ ID NO: 7437758 - DNA, 22 bp, Homo sapiens
gggtggagcttggacaccagta

SEQ ID NO: 7437759 - DNA, 22 bp, Homo sapiens
gggtggagcttggacaccagta

SEQ ID NO: 7437760 - DNA, 22 bp, Homo sapiens
gggtggagcttggacaccagta

SEQ ID NO: 7437761 - DNA, 22 bp, Homo sapiens
gggtggagcttggacaccagta

SEQ ID NO: 7437762 - DNA, 22 bp, Homo sapiens
gggtggaggagaacaggcccca

SEQ ID NO: 7437763 - DNA, 22 bp, Homo sapiens
gggtggaggagaacaggcccca

SEQ ID NO: 7437764 - DNA, 22 bp, Homo sapiens
gggtggaggagaacaggcccca

SEQ ID NO: 7437765 - DNA, 22 bp, Homo sapiens
gggtggagcttggacaccagta

SEQ ID NO: 7437766 - DNA, 22 bp, Homo sapiens
gggtggagcttggacaccagta

SEQ ID NO: 7437767 - DNA, 22 bp, Homo sapiens
gggtggaggagaacaggcccca

SEQ ID NO: 7437768 - DNA, 22 bp, Homo sapiens
gggtggaggagaacaggcccca

SEQ ID NO: 7437769 - DNA, 22 bp, Homo sapiens
gggtggaggagaacaggcccca

SEQ ID NO: 7437770 - DNA, 22 bp, Homo sapiens
gggtggaggtgggttttgagat

SEQ ID NO: 7437771 - DNA, 22 bp, Homo sapiens
gggtggaggtgggttttgagat

SEQ ID NO: 7437772 - DNA, 22 bp, Homo sapiens
gggtggaggtgggttttgagat

SEQ ID NO: 7437773 - DNA, 22 bp, Homo sapiens
gggtggagtagaaagatgaatt

SEQ ID NO: 7437774 - DNA, 22 bp, Homo sapiens
gggtggagtagaaagatgaatt

SEQ ID NO: 7437775 - DNA, 22 bp, Homo sapiens
gggtggagtagaaagatgaatt

SEQ ID NO: 7437776 - DNA, 22 bp, Homo sapiens
gggtggagtagaaagatgaatt

SEQ ID NO: 7437777 - DNA, 22 bp, Homo sapiens
gggtggagtgtgaaatctggct

SEQ ID NO: 7437778 - DNA, 22 bp, Homo sapiens
gggtggagtgtgaaatctggct

SEQ ID NO: 7437779 - DNA, 22 bp, Homo sapiens
gggtggagtgtgaaatctggct

SEQ ID NO: 7437780 - DNA, 22 bp, Homo sapiens
gggtggagtgtgaaatctggct

SEQ ID NO: 7437781 - DNA, 22 bp, Homo sapiens
gggtggagtagaaagatgaatt

SEQ ID NO: 7437782 - DNA, 22 bp, Homo sapiens
gggtggagtagaaagatgaatt

SEQ ID NO: 7437783 - DNA, 22 bp, Homo sapiens
gggtggagtgtgaaatctggct

SEQ ID NO: 7437784 - DNA, 22 bp, Homo sapiens
gggtggagtgtgaaatctggct

SEQ ID NO: 7437785 - DNA, 20 bp, Homo sapiens
gggtggagttgcggtctgtg

SEQ ID NO: 7437786 - DNA, 20 bp, Homo sapiens
gggtggagttgcggtctgtg

SEQ ID NO: 7437787 - DNA, 20 bp, Homo sapiens
gggtggagttgcggtctgtg

SEQ ID NO: 7437788 - DNA, 22 bp, Homo sapiens
ggggttaacagtattgctcatg

SEQ ID NO: 7437789 - DNA, 22 bp, Homo sapiens
ggggttgatcacagaggggtct

SEQ ID NO: 7437790 - DNA, 22 bp, Homo sapiens
ggggttgatcacagaggggtct

SEQ ID NO: 7437791 - DNA, 21 bp, Homo sapiens
ggggttggcaagagcagagac

SEQ ID NO: 7437792 - DNA, 22 bp, Homo sapiens
gggtaggaaatccagaggtggc

SEQ ID NO: 7437793 - DNA, 21 bp, Homo sapiens
ggggttggcaagagcagagac

SEQ ID NO: 7437794 - DNA, 21 bp, Homo sapiens
ggggttggcaagagcagagac

SEQ ID NO: 7437795 - DNA, 21 bp, Homo sapiens
ggggttggcaagagcagagac

SEQ ID NO: 7437796 - DNA, 22 bp, Homo sapiens
ggggtgtgtctgacaatggtat

SEQ ID NO: 7437797 - DNA, 22 bp, Homo sapiens
ggggtgtggacggctgtgccag

SEQ ID NO: 7437798 - DNA, 22 bp, Homo sapiens
ggggtgtggacggctgtgccag

SEQ ID NO: 7437799 - DNA, 22 bp, Homo sapiens
ggggtgtgagtagagctgggga

SEQ ID NO: 7437800 - DNA, 22 bp, Homo sapiens
ggggtgtggacggctgtgccag

SEQ ID NO: 7437801 - DNA, 22 bp, Homo sapiens
ggggtgtggacggctgtgccag

SEQ ID NO: 7437802 - DNA, 22 bp, Homo sapiens
ggggtgtggacggctgtgccag

SEQ ID NO: 7437803 - DNA, 22 bp, Homo sapiens
ggggtggggttactcattgtgc

SEQ ID NO: 7437804 - DNA, 22 bp, Homo sapiens
ggggtgtcagcaccagcccctg

SEQ ID NO: 7437805 - DNA, 22 bp, Homo sapiens
ggggtgtctgtgttcttcagtt

SEQ ID NO: 7437806 - DNA, 22 bp, Homo sapiens
ggggtggggttactcattgtgc

SEQ ID NO: 7437807 - DNA, 22 bp, Homo sapiens
ggggtggggttactcattgtgc

SEQ ID NO: 7437808 - DNA, 22 bp, Homo sapiens
ggggtgtgagtagagctgggga

SEQ ID NO: 7437809 - DNA, 22 bp, Homo sapiens
ggggtgtgagtagagctgggga

SEQ ID NO: 7437810 - DNA, 22 bp, Homo sapiens
ggggtgtgagtagagctgggga

SEQ ID NO: 7437811 - DNA, 22 bp, Homo sapiens
ggggtgtgagtagagctgggga

SEQ ID NO: 7437812 - DNA, 22 bp, Homo sapiens
ggggtgtgagtagagctgggga

SEQ ID NO: 7437813 - DNA, 22 bp, Homo sapiens
ggggtgggcgtgcagggacacc

SEQ ID NO: 7437814 - DNA, 22 bp, Homo sapiens
ggggtggggttactcattgtgc

SEQ ID NO: 7437815 - DNA, 22 bp, Homo sapiens
ggggtggggttactcattgtgc

SEQ ID NO: 7437816 - DNA, 22 bp, Homo sapiens
ggggtggggttactcattgtgc

SEQ ID NO: 7437817 - DNA, 22 bp, Homo sapiens
ggggtggggttactcattgtgc

SEQ ID NO: 7437818 - DNA, 22 bp, Homo sapiens
ggggtggggttactcattgtgc

SEQ ID NO: 7437819 - DNA, 22 bp, Homo sapiens
ggggtggggttactcattgtgc

SEQ ID NO: 7437820 - DNA, 22 bp, Homo sapiens
ggggtggggttactcattgtgc

SEQ ID NO: 7437821 - DNA, 22 bp, Homo sapiens
ggggtggggttactcattgtgc

SEQ ID NO: 7437822 - DNA, 22 bp, Homo sapiens
ggggtgggcgtgcagggacacc

SEQ ID NO: 7437823 - DNA, 22 bp, Homo sapiens
ggggtgggcgtgcagggacacc

SEQ ID NO: 7437824 - DNA, 22 bp, Homo sapiens
ggggtgggcgtgcagggacacc

SEQ ID NO: 7437825 - DNA, 22 bp, Homo sapiens
ggggtgggcgtgcagggacacc

SEQ ID NO: 7437826 - DNA, 22 bp, Homo sapiens
ggggtgggcgtgcagggacacc

SEQ ID NO: 7437827 - DNA, 22 bp, Homo sapiens
ggggtgggcgtgcagggacacc

SEQ ID NO: 7437828 - DNA, 22 bp, Homo sapiens
ggggtgggcgtgcagggacacc

SEQ ID NO: 7437829 - DNA, 22 bp, Homo sapiens
ggggtgggcgtgcagggacacc

SEQ ID NO: 7437830 - DNA, 22 bp, Homo sapiens
ggggtgggcgtgcagggacacc

SEQ ID NO: 7437831 - DNA, 22 bp, Homo sapiens
ggggtgggcgtgcagggacacc

SEQ ID NO: 7437832 - DNA, 22 bp, Homo sapiens
ggggtgggcgtgcagggacacc

SEQ ID NO: 7437833 - DNA, 22 bp, Homo sapiens
ggggtgggcgtgcagggacacc

SEQ ID NO: 7437834 - DNA, 22 bp, Homo sapiens
ggggtgggcgtgcagggacacc

SEQ ID NO: 7437835 - DNA, 22 bp, Homo sapiens
ggggctggtggtggtttctcca

SEQ ID NO: 7437836 - DNA, 22 bp, Homo sapiens
ggggctggtggtggtttctcca

SEQ ID NO: 7437837 - DNA, 22 bp, Homo sapiens
ggggctgggatttgaacccagg

SEQ ID NO: 7437838 - DNA, 22 bp, Homo sapiens
ggggctggtggtggtttctcca

SEQ ID NO: 7437839 - DNA, 22 bp, Homo sapiens
ggggctggtggtggtttctcca

SEQ ID NO: 7437840 - DNA, 22 bp, Homo sapiens
ggggctgggatttgaacccagg

SEQ ID NO: 7437841 - DNA, 22 bp, Homo sapiens
ggggctgggatttgaacccagg

SEQ ID NO: 7437842 - DNA, 22 bp, Homo sapiens
ggggctgggatttgaacccagg

SEQ ID NO: 7437843 - DNA, 22 bp, Homo sapiens
ggggctgggatttgaacccagg

SEQ ID NO: 7437844 - DNA, 22 bp, Homo sapiens
ggggctggtggtggtttctcca

SEQ ID NO: 7437845 - DNA, 22 bp, Homo sapiens
ggggctgggatttgaacccagg

SEQ ID NO: 7437846 - DNA, 22 bp, Homo sapiens
ggggtgggcgtgcagggacacc

SEQ ID NO: 7437847 - DNA, 22 bp, Homo sapiens
ggggtgggcgtgcagggacacc

SEQ ID NO: 7437848 - DNA, 22 bp, Homo sapiens
ggggtgggcgtgcagggacacc

SEQ ID NO: 7437849 - DNA, 22 bp, Homo sapiens
ggggtgggcgtgcagggacacc

SEQ ID NO: 7437850 - DNA, 22 bp, Homo sapiens
ggggtgggcgtgcagggacacc

SEQ ID NO: 7437851 - DNA, 22 bp, Homo sapiens
ggggtgggcgtgcagggacacc

SEQ ID NO: 7437852 - DNA, 22 bp, Homo sapiens
ggggtgggcgtgcagggacacc

SEQ ID NO: 7437853 - DNA, 22 bp, Homo sapiens
ggggtgggcgtgcagggacacc

SEQ ID NO: 7437854 - DNA, 22 bp, Homo sapiens
ggggtgggcgtgcagggacacc

SEQ ID NO: 7437855 - DNA, 22 bp, Homo sapiens
ggggtgggcgtgcagggacacc

SEQ ID NO: 7437856 - DNA, 22 bp, Homo sapiens
ggggctggtggtggtttctcca

SEQ ID NO: 7437857 - DNA, 22 bp, Homo sapiens
ggggctggtggtggtttctcca

SEQ ID NO: 7437858 - DNA, 22 bp, Homo sapiens
ggggctggtggtggtttctcca

SEQ ID NO: 7437859 - DNA, 22 bp, Homo sapiens
gggccaagggtgcgtggcagga

SEQ ID NO: 7437860 - DNA, 22 bp, Homo sapiens
gggccaaggggagctggaaggg

SEQ ID NO: 7437861 - DNA, 22 bp, Homo sapiens
gggccaaggggagctggaaggg

SEQ ID NO: 7437862 - DNA, 22 bp, Homo sapiens
gggccaagggtgcgtggcagga

SEQ ID NO: 7437863 - DNA, 22 bp, Homo sapiens
gggccaagggtgcgtggcagga

SEQ ID NO: 7437864 - DNA, 22 bp, Homo sapiens
gggccaagggtgcgtggcagga

SEQ ID NO: 7437865 - DNA, 22 bp, Homo sapiens
gggccaagggtgcgtggcagga

SEQ ID NO: 7437866 - DNA, 22 bp, Homo sapiens
gggccacacagggcagctccct

SEQ ID NO: 7437867 - DNA, 22 bp, Homo sapiens
gggccacacagaacctcctggt

SEQ ID NO: 7437868 - DNA, 22 bp, Homo sapiens
gggccacacagaacctcctggt

SEQ ID NO: 7437869 - DNA, 22 bp, Homo sapiens
gggccacacagaacctcctggt

SEQ ID NO: 7437870 - DNA, 21 bp, Homo sapiens
gggccacaccttctgcagacc

SEQ ID NO: 7437871 - DNA, 22 bp, Homo sapiens
gggccacacagggcagctccct

SEQ ID NO: 7437872 - DNA, 22 bp, Homo sapiens
gggccacacagggcagctccct

SEQ ID NO: 7437873 - DNA, 22 bp, Homo sapiens
gggccacacagggcagctccct

SEQ ID NO: 7437874 - DNA, 22 bp, Homo sapiens
gggccacacagggcagctccct

SEQ ID NO: 7437875 - DNA, 22 bp, Homo sapiens
gggcatgtaggaatccatggag

SEQ ID NO: 7437876 - DNA, 22 bp, Homo sapiens
gggcatgtaggaatccatggag

SEQ ID NO: 7437877 - DNA, 22 bp, Homo sapiens
gggcatgtagtgtgcatagaga

SEQ ID NO: 7437878 - DNA, 22 bp, Homo sapiens
gggcatggtggtgcacacctgt

SEQ ID NO: 7437879 - DNA, 22 bp, Homo sapiens
gggcatggtggtgcacacctgt

SEQ ID NO: 7437880 - DNA, 22 bp, Homo sapiens
gggcatggtggcaggcacctgt

SEQ ID NO: 7437881 - DNA, 22 bp, Homo sapiens
gggcatggtggcaggcacctgt

SEQ ID NO: 7437882 - DNA, 22 bp, Homo sapiens
gggccaaggggagctggaaggg

SEQ ID NO: 7437883 - DNA, 22 bp, Homo sapiens
gggccaaggggagctggaaggg

SEQ ID NO: 7437884 - DNA, 22 bp, Homo sapiens
gggccaaggggagctggaaggg

SEQ ID NO: 7437885 - DNA, 22 bp, Homo sapiens
gggccaaggggagctggaaggg

SEQ ID NO: 7437886 - DNA, 22 bp, Homo sapiens
gggccaaggggagctggaaggg

SEQ ID NO: 7437887 - DNA, 22 bp, Homo sapiens
gggccaaggggagctggaaggg

SEQ ID NO: 7437888 - DNA, 22 bp, Homo sapiens
gggcatgtcccgctgtgcaccg

SEQ ID NO: 7437889 - DNA, 22 bp, Homo sapiens
gggcatgtctctaggctggcta

SEQ ID NO: 7437890 - DNA, 22 bp, Homo sapiens
gggcatttcttgtcaatgtagg

SEQ ID NO: 7437891 - DNA, 22 bp, Homo sapiens
gggcatttaaacaagcatacaa

SEQ ID NO: 7437892 - DNA, 22 bp, Homo sapiens
gggcattgcaactggtccagac

SEQ ID NO: 7437893 - DNA, 22 bp, Homo sapiens
gggcatggcgtgtgctggattc

SEQ ID NO: 7437894 - DNA, 22 bp, Homo sapiens
gggcatggccaggtgaggggtc

SEQ ID NO: 7437895 - DNA, 22 bp, Homo sapiens
gggcatggcgtgtgctggattc

SEQ ID NO: 7437896 - DNA, 22 bp, Homo sapiens
gggcatggccaggtgaggggtc

SEQ ID NO: 7437897 - DNA, 22 bp, Homo sapiens
gggcatggccaggtgaggggtc

SEQ ID NO: 7437898 - DNA, 22 bp, Homo sapiens
gggcatggccaggtgaggggtc

SEQ ID NO: 7437899 - DNA, 22 bp, Homo sapiens
gggcatggccaggtgaggggtc

SEQ ID NO: 7437900 - DNA, 22 bp, Homo sapiens
gggcatggccaggtgaggggtc

SEQ ID NO: 7437901 - DNA, 18 bp, Homo sapiens
gggcatggatgcagcatc

SEQ ID NO: 7437902 - DNA, 18 bp, Homo sapiens
gggcatggatgcagcatc

SEQ ID NO: 7437903 - DNA, 18 bp, Homo sapiens
gggcatggatgcagcatc

SEQ ID NO: 7437904 - DNA, 22 bp, Homo sapiens
gggcatggccaggtgaggggtc

SEQ ID NO: 7437905 - DNA, 22 bp, Homo sapiens
gggcatggccaggtgaggggtc

SEQ ID NO: 7437906 - DNA, 22 bp, Homo sapiens
gggcatggccaggtgaggggtc

SEQ ID NO: 7437907 - DNA, 22 bp, Homo sapiens
gggcatggccaggtgaggggtc

SEQ ID NO: 7437908 - DNA, 22 bp, Homo sapiens
gggcatggccaggtgaggggtc

SEQ ID NO: 7437909 - DNA, 22 bp, Homo sapiens
gggcatggccaggtgaggggtc

SEQ ID NO: 7437910 - DNA, 22 bp, Homo sapiens
gggcatggccaggtgaggggtc

SEQ ID NO: 7437911 - DNA, 22 bp, Homo sapiens
gggcatggtgctggtgttcatg

SEQ ID NO: 7437912 - DNA, 22 bp, Homo sapiens
gggcatggtgatgtgcacctgt

SEQ ID NO: 7437913 - DNA, 22 bp, Homo sapiens
gggcatggtgatgtgcacctgt

SEQ ID NO: 7437914 - DNA, 22 bp, Homo sapiens
gggcatggtgatgtgcacctgt

SEQ ID NO: 7437915 - DNA, 22 bp, Homo sapiens
gggcatggtgatgtgcacctgt

SEQ ID NO: 7437916 - DNA, 22 bp, Homo sapiens
gggcatggtggcaggcacctgt

SEQ ID NO: 7437917 - DNA, 22 bp, Homo sapiens
gggcatggtggcaggcacctgt

SEQ ID NO: 7437918 - DNA, 22 bp, Homo sapiens
gggcatggtggcaggcacctgt

SEQ ID NO: 7437919 - DNA, 22 bp, Homo sapiens
gggcatggtggcaggcacctgt

SEQ ID NO: 7437920 - DNA, 22 bp, Homo sapiens
gggcatggtgctggtgttcatg

SEQ ID NO: 7437921 - DNA, 22 bp, Homo sapiens
gggcatggtgctggtgttcatg

SEQ ID NO: 7437922 - DNA, 22 bp, Homo sapiens
gggcatggtgctggtgttcatg

SEQ ID NO: 7437923 - DNA, 22 bp, Homo sapiens
gggcatggggcggacctggttc

SEQ ID NO: 7437924 - DNA, 22 bp, Homo sapiens
gggcatggcgtgtgctggattc

SEQ ID NO: 7437925 - DNA, 22 bp, Homo sapiens
gggcatggggcggacctggttc

SEQ ID NO: 7437926 - DNA, 22 bp, Homo sapiens
gggcatggcgtgtgctggattc

SEQ ID NO: 7437927 - DNA, 22 bp, Homo sapiens
gggcatggcgtgtgctggattc

SEQ ID NO: 7437928 - DNA, 22 bp, Homo sapiens
gggcatggcgtgtgctggattc

SEQ ID NO: 7437929 - DNA, 22 bp, Homo sapiens
gggcatggcgtgtgctggattc

SEQ ID NO: 7437930 - DNA, 22 bp, Homo sapiens
gggcatggcgtgtgctggattc

SEQ ID NO: 7437931 - DNA, 22 bp, Homo sapiens
gggcatggtgagggatatgaag

SEQ ID NO: 7437932 - DNA, 22 bp, Homo sapiens
gggcatggtgagggatatgaag

SEQ ID NO: 7437933 - DNA, 22 bp, Homo sapiens
gggcatggggcggacctggttc

SEQ ID NO: 7437934 - DNA, 22 bp, Homo sapiens
gggcatggtgatgtgcacctgt

SEQ ID NO: 7437935 - DNA, 22 bp, Homo sapiens
gggcatggtgagggatatgaag

SEQ ID NO: 7437936 - DNA, 22 bp, Homo sapiens
gggcatggggcggacctggttc

SEQ ID NO: 7437937 - DNA, 22 bp, Homo sapiens
gggcatggggcggacctggttc

SEQ ID NO: 7437938 - DNA, 22 bp, Homo sapiens
gggctgagagctggaatctgag

SEQ ID NO: 7437939 - DNA, 22 bp, Homo sapiens
gggctgagagctggaatctgag

SEQ ID NO: 7437940 - DNA, 22 bp, Homo sapiens
gggctgagagctggaatctgag

SEQ ID NO: 7437941 - DNA, 22 bp, Homo sapiens
gggctgagagctggaatctgag

SEQ ID NO: 7437942 - DNA, 22 bp, Homo sapiens
gggctgagagctggaatctgag

SEQ ID NO: 7437943 - DNA, 21 bp, Homo sapiens
gggccacaccttctgcagacc

SEQ ID NO: 7437944 - DNA, 21 bp, Homo sapiens
gggccacaccttctgcagacc

SEQ ID NO: 7437945 - DNA, 21 bp, Homo sapiens
gggccacaccttctgcagacc

SEQ ID NO: 7437946 - DNA, 22 bp, Homo sapiens
gggctgagagctggaatctgag

SEQ ID NO: 7437947 - DNA, 22 bp, Homo sapiens
gggctgagagctggaatctgag

SEQ ID NO: 7437948 - DNA, 22 bp, Homo sapiens
gggctgagagctggaatctgag

SEQ ID NO: 7437949 - DNA, 22 bp, Homo sapiens
gggctgagagctggaatctgag

SEQ ID NO: 7437950 - DNA, 22 bp, Homo sapiens
gggctgagagtgactgttctgt

SEQ ID NO: 7437951 - DNA, 22 bp, Homo sapiens
gggctgagagctggaatctgag

SEQ ID NO: 7437952 - DNA, 22 bp, Homo sapiens
gggctgagagctggaatctgag

SEQ ID NO: 7437953 - DNA, 22 bp, Homo sapiens
gggctgagagctggaatctgag

SEQ ID NO: 7437954 - DNA, 22 bp, Homo sapiens
gggctgagagctggaatctgag

SEQ ID NO: 7437955 - DNA, 22 bp, Homo sapiens
gggctgagagctggaatctgag

SEQ ID NO: 7437956 - DNA, 22 bp, Homo sapiens
gggctgagagctggaatctgag

SEQ ID NO: 7437957 - DNA, 22 bp, Homo sapiens
gggctgagattggtgccctgtc

SEQ ID NO: 7437958 - DNA, 22 bp, Homo sapiens
gggctgagattggtgccctgtc

SEQ ID NO: 7437959 - DNA, 22 bp, Homo sapiens
gggctgagattggtgccctgtc

SEQ ID NO: 7437960 - DNA, 22 bp, Homo sapiens
gggctgagattggtgccctgtc

SEQ ID NO: 7437961 - DNA, 22 bp, Homo sapiens
gggctgagattggtgccctgtc

SEQ ID NO: 7437962 - DNA, 22 bp, Homo sapiens
gggctgagagctggaatctgag

SEQ ID NO: 7437963 - DNA, 22 bp, Homo sapiens
gggctgagagtgactgttctgt

SEQ ID NO: 7437964 - DNA, 22 bp, Homo sapiens
gggctgagagtgactgttctgt

SEQ ID NO: 7437965 - DNA, 22 bp, Homo sapiens
gggctgagagtgactgttctgt

SEQ ID NO: 7437966 - DNA, 22 bp, Homo sapiens
gggctgagagtgactgttctgt

SEQ ID NO: 7437967 - DNA, 22 bp, Homo sapiens
gggctgagattggtgccctgtc

SEQ ID NO: 7437968 - DNA, 22 bp, Homo sapiens
gggctgagattggtgccctgtc

SEQ ID NO: 7437969 - DNA, 22 bp, Homo sapiens
gggctgagattggtgccctgtc

SEQ ID NO: 7437970 - DNA, 22 bp, Homo sapiens
gggctgagattggtgccctgtc

SEQ ID NO: 7437971 - DNA, 22 bp, Homo sapiens
gggctgagcacatactgacagc

SEQ ID NO: 7437972 - DNA, 22 bp, Homo sapiens
gggctgagattggtgccctgtc

SEQ ID NO: 7437973 - DNA, 22 bp, Homo sapiens
gggctgagcacatactgacagc

SEQ ID NO: 7437974 - DNA, 22 bp, Homo sapiens
gggctgagcacatactgacagc

SEQ ID NO: 7437975 - DNA, 22 bp, Homo sapiens
gggctgaggaacatattttgtt

SEQ ID NO: 7437976 - DNA, 22 bp, Homo sapiens
gggctgaggaacatattttgtt

SEQ ID NO: 7437977 - DNA, 22 bp, Homo sapiens
gggctgaggaacatattttgtt

SEQ ID NO: 7437978 - DNA, 22 bp, Homo sapiens
gggctgaggctaccactggtct

SEQ ID NO: 7437979 - DNA, 22 bp, Homo sapiens
gggctgaggctaccactggtct

SEQ ID NO: 7437980 - DNA, 22 bp, Homo sapiens
gggctgagctgttctgagttta

SEQ ID NO: 7437981 - DNA, 22 bp, Homo sapiens
gggctgagctgttctgagttta

SEQ ID NO: 7437982 - DNA, 22 bp, Homo sapiens
gggctgaggaacatattttgtt

SEQ ID NO: 7437983 - DNA, 22 bp, Homo sapiens
gggctgagctgttctgagttta

SEQ ID NO: 7437984 - DNA, 22 bp, Homo sapiens
gggctgagctgttctgagttta

SEQ ID NO: 7437985 - DNA, 22 bp, Homo sapiens
gggctgagctgttctgagttta

SEQ ID NO: 7437986 - DNA, 22 bp, Homo sapiens
gggctgagctaagctgggttga

SEQ ID NO: 7437987 - DNA, 22 bp, Homo sapiens
gggctgagctaagctgggttga

SEQ ID NO: 7437988 - DNA, 22 bp, Homo sapiens
gggctgagctaagctgggttga

SEQ ID NO: 7437989 - DNA, 22 bp, Homo sapiens
gggctgagctaagctgggttga

SEQ ID NO: 7437990 - DNA, 22 bp, Homo sapiens
gggctgagctaagctgggttga

SEQ ID NO: 7437991 - DNA, 22 bp, Homo sapiens
gggctgagctaagctgggttga

SEQ ID NO: 7437992 - DNA, 22 bp, Homo sapiens
gggctgagccacagcttttgtt

SEQ ID NO: 7437993 - DNA, 22 bp, Homo sapiens
gggctgagccatttgaaccttg

SEQ ID NO: 7437994 - DNA, 22 bp, Homo sapiens
gggctgagccatttgaaccttg

SEQ ID NO: 7437995 - DNA, 22 bp, Homo sapiens
gggctgagccatttgaaccttg

SEQ ID NO: 7437996 - DNA, 22 bp, Homo sapiens
gggctgagccatttgaaccttg

SEQ ID NO: 7437997 - DNA, 22 bp, Homo sapiens
gggctgagctaagctgggttga

SEQ ID NO: 7437998 - DNA, 22 bp, Homo sapiens
gggctgagccatttgaaccttg

SEQ ID NO: 7437999 - DNA, 22 bp, Homo sapiens
gggctgagccatttgaaccttg

SEQ ID NO: 7438000 - DNA, 22 bp, Homo sapiens
gggctgagcacatactgacagc

SEQ ID NO: 7438001 - DNA, 22 bp, Homo sapiens
gggctgagcacatactgacagc

SEQ ID NO: 7438002 - DNA, 22 bp, Homo sapiens
gggctgagcacatactgacagc

SEQ ID NO: 7438003 - DNA, 22 bp, Homo sapiens
gggctgagcacatactgacagc

SEQ ID NO: 7438004 - DNA, 22 bp, Homo sapiens
gggctgagcacatactgacagc

SEQ ID NO: 7438005 - DNA, 22 bp, Homo sapiens
gggctgagccacagcttttgtt

SEQ ID NO: 7438006 - DNA, 22 bp, Homo sapiens
gggctgagccacagcttttgtt

SEQ ID NO: 7438007 - DNA, 22 bp, Homo sapiens
gggctgagccacagcttttgtt

SEQ ID NO: 7438008 - DNA, 22 bp, Homo sapiens
gggcttggagtaggctgatgaa

SEQ ID NO: 7438009 - DNA, 22 bp, Homo sapiens
gggcttggagtaggctgatgaa

SEQ ID NO: 7438010 - DNA, 22 bp, Homo sapiens
gggcttggagtaggctgatgaa

SEQ ID NO: 7438011 - DNA, 20 bp, Homo sapiens
gggcttggaggactcgaggg

SEQ ID NO: 7438012 - DNA, 20 bp, Homo sapiens
gggcttggaggactcgaggg

SEQ ID NO: 7438013 - DNA, 22 bp, Homo sapiens
gggcttgcttaaggtcacccgg

SEQ ID NO: 7438014 - DNA, 22 bp, Homo sapiens
gggcttgctgtttagttccatt

SEQ ID NO: 7438015 - DNA, 20 bp, Homo sapiens
gggcttggaggactcgaggg

SEQ ID NO: 7438016 - DNA, 22 bp, Homo sapiens
gggcttgctgtttagttccatt

SEQ ID NO: 7438017 - DNA, 22 bp, Homo sapiens
gggcttgcttaaggtcacccgg

SEQ ID NO: 7438018 - DNA, 22 bp, Homo sapiens
gggcttgctgatttgggcagga

SEQ ID NO: 7438019 - DNA, 22 bp, Homo sapiens
gggcttggcacatgggctcagc

SEQ ID NO: 7438020 - DNA, 22 bp, Homo sapiens
gggcttggcacatgggctcagc

SEQ ID NO: 7438021 - DNA, 22 bp, Homo sapiens
gggcttggcacatgggctcagc

SEQ ID NO: 7438022 - DNA, 22 bp, Homo sapiens
gggcttggcacatgggctcagc

SEQ ID NO: 7438023 - DNA, 22 bp, Homo sapiens
gggcttggcacatgggctcagc

SEQ ID NO: 7438024 - DNA, 22 bp, Homo sapiens
gggcttggagtaggctgatgaa

SEQ ID NO: 7438025 - DNA, 22 bp, Homo sapiens
gggcttggagtaggctgatgaa

SEQ ID NO: 7438026 - DNA, 22 bp, Homo sapiens
gggcttggagtaggctgatgaa

SEQ ID NO: 7438027 - DNA, 22 bp, Homo sapiens
gggcttggagtaggctgatgaa

SEQ ID NO: 7438028 - DNA, 19 bp, Homo sapiens
gggcttggggctgaagcct

SEQ ID NO: 7438029 - DNA, 22 bp, Homo sapiens
gggcttgggtattgtgagaggt

SEQ ID NO: 7438030 - DNA, 22 bp, Homo sapiens
gggcttgggtattgtgagaggt

SEQ ID NO: 7438031 - DNA, 22 bp, Homo sapiens
gggcttgggtattgtgagaggt

SEQ ID NO: 7438032 - DNA, 22 bp, Homo sapiens
gggcttgggtattgtgagaggt

SEQ ID NO: 7438033 - DNA, 22 bp, Homo sapiens
gggcttgggtattgtgagaggt

SEQ ID NO: 7438034 - DNA, 22 bp, Homo sapiens
gggcttgggtattgtgagaggt

SEQ ID NO: 7438035 - DNA, 22 bp, Homo sapiens
gggcttgggtattgtgagaggt

SEQ ID NO: 7438036 - DNA, 22 bp, Homo sapiens
gggcttggctggggccaccaga

SEQ ID NO: 7438037 - DNA, 22 bp, Homo sapiens
gggcttggctcataagtggatg

SEQ ID NO: 7438038 - DNA, 22 bp, Homo sapiens
gggcttggctcataagtggatg

SEQ ID NO: 7438039 - DNA, 22 bp, Homo sapiens
gggcttggctcataagtggatg

SEQ ID NO: 7438040 - DNA, 22 bp, Homo sapiens
gggcttggctcataagtggatg

SEQ ID NO: 7438041 - DNA, 22 bp, Homo sapiens
gggcttggccccagaagagcta

SEQ ID NO: 7438042 - DNA, 22 bp, Homo sapiens
gggcttggccccagaagagcta

SEQ ID NO: 7438043 - DNA, 22 bp, Homo sapiens
gggcttggccccagaagagcta

SEQ ID NO: 7438044 - DNA, 22 bp, Homo sapiens
gggctgctgctgccagcgacac

SEQ ID NO: 7438045 - DNA, 22 bp, Homo sapiens
gggctgctgctgccagcgacac

SEQ ID NO: 7438046 - DNA, 22 bp, Homo sapiens
gggctgctgctgccagcgacac

SEQ ID NO: 7438047 - DNA, 22 bp, Homo sapiens
gggctgctgctgccagcgacac

SEQ ID NO: 7438048 - DNA, 22 bp, Homo sapiens
gggctgctgtagagaacatgtt

SEQ ID NO: 7438049 - DNA, 22 bp, Homo sapiens
gggctgctgtagagaacatgtt

SEQ ID NO: 7438050 - DNA, 22 bp, Homo sapiens
gggctgctgtagagaacatgtt

SEQ ID NO: 7438051 - DNA, 22 bp, Homo sapiens
gggctgctgggcaagaaacatt

SEQ ID NO: 7438052 - DNA, 22 bp, Homo sapiens
gggctgctgcccaggaggcacc

SEQ ID NO: 7438053 - DNA, 22 bp, Homo sapiens
gggctgctgcccaggaggcacc

SEQ ID NO: 7438054 - DNA, 22 bp, Homo sapiens
gggctgctgcccaggaggcacc

SEQ ID NO: 7438055 - DNA, 22 bp, Homo sapiens
gggctgctgcccaggaggcacc

SEQ ID NO: 7438056 - DNA, 22 bp, Homo sapiens
gggctgctgcccaggaggcacc

SEQ ID NO: 7438057 - DNA, 22 bp, Homo sapiens
gggctgctgccaccaggtggat

SEQ ID NO: 7438058 - DNA, 22 bp, Homo sapiens
gggctgctgccaccaggtggat

SEQ ID NO: 7438059 - DNA, 22 bp, Homo sapiens
gggctgctgccaatcacagcct

SEQ ID NO: 7438060 - DNA, 22 bp, Homo sapiens
gggctgctgccaccaggtggat

SEQ ID NO: 7438061 - DNA, 22 bp, Homo sapiens
gggctgctgccaccaggtggat

SEQ ID NO: 7438062 - DNA, 22 bp, Homo sapiens
gggctgctgccaccaggtggat

SEQ ID NO: 7438063 - DNA, 22 bp, Homo sapiens
gggcttgctgatttgggcagga

SEQ ID NO: 7438064 - DNA, 17 bp, Homo sapiens
gggcttgctgagtgtgt

SEQ ID NO: 7438065 - DNA, 22 bp, Homo sapiens
gggcttgctaagaagagcgcat

SEQ ID NO: 7438066 - DNA, 22 bp, Homo sapiens
gggcttgctaagaagagcgcat

SEQ ID NO: 7438067 - DNA, 22 bp, Homo sapiens
gggcttgaggtgaaggtaggga

SEQ ID NO: 7438068 - DNA, 22 bp, Homo sapiens
gggcttgaggtgaaggtaggga

SEQ ID NO: 7438069 - DNA, 22 bp, Homo sapiens
gggcttcttgccatggggacgg

SEQ ID NO: 7438070 - DNA, 22 bp, Homo sapiens
gggcttgaacaacttggaggtg

SEQ ID NO: 7438071 - DNA, 22 bp, Homo sapiens
gggcttgaggtgaaggtaggga

SEQ ID NO: 7438072 - DNA, 22 bp, Homo sapiens
gggcttcttgagctgccggccc

SEQ ID NO: 7438073 - DNA, 22 bp, Homo sapiens
gggcttcttgcaggggcaacat

SEQ ID NO: 7438074 - DNA, 22 bp, Homo sapiens
gggctgctgtgttcctgaggca

SEQ ID NO: 7438075 - DNA, 22 bp, Homo sapiens
gggctgctgtgttcctgaggca

SEQ ID NO: 7438076 - DNA, 22 bp, Homo sapiens
gggctgctgtgttcctgaggca

SEQ ID NO: 7438077 - DNA, 22 bp, Homo sapiens
gggctgctgtgttcctgaggca

SEQ ID NO: 7438078 - DNA, 22 bp, Homo sapiens
gggctgctgtgttcctgaggca

SEQ ID NO: 7438079 - DNA, 22 bp, Homo sapiens
gggctgcctttcttctgggagc

SEQ ID NO: 7438080 - DNA, 22 bp, Homo sapiens
gggctgcctttcttctgggagc

SEQ ID NO: 7438081 - DNA, 22 bp, Homo sapiens
gggctgcctttcttctgggagc

SEQ ID NO: 7438082 - DNA, 22 bp, Homo sapiens
gggctgcctgagcatctcctcc

SEQ ID NO: 7438083 - DNA, 22 bp, Homo sapiens
gggctgcctttcttctgggagc

SEQ ID NO: 7438084 - DNA, 22 bp, Homo sapiens
gggctgcctttcttctgggagc

SEQ ID NO: 7438085 - DNA, 22 bp, Homo sapiens
gggctgccaagcctgcctgcct

SEQ ID NO: 7438086 - DNA, 22 bp, Homo sapiens
gggctgcctgagcatctcctcc

SEQ ID NO: 7438087 - DNA, 22 bp, Homo sapiens
gggctgcgtgtggaggatgtaa

SEQ ID NO: 7438088 - DNA, 22 bp, Homo sapiens
gggctgctacgagaactgaata

SEQ ID NO: 7438089 - DNA, 22 bp, Homo sapiens
gggctgctataacaagatacct

SEQ ID NO: 7438090 - DNA, 23 bp, Homo sapiens
gggctgctccaggccaaggctgg

SEQ ID NO: 7438091 - DNA, 22 bp, Homo sapiens
gggctgctgccaatcacagcct

SEQ ID NO: 7438092 - DNA, 22 bp, Homo sapiens
gggctgctgccaatcacagcct

SEQ ID NO: 7438093 - DNA, 22 bp, Homo sapiens
gggctgctacgagaactgaata

SEQ ID NO: 7438094 - DNA, 23 bp, Homo sapiens
gggctgctccaggccaaggctgg

SEQ ID NO: 7438095 - DNA, 22 bp, Homo sapiens
gggctgctataacaagatacct

SEQ ID NO: 7438096 - DNA, 22 bp, Homo sapiens
gggctgcacgtattctgctcac

SEQ ID NO: 7438097 - DNA, 22 bp, Homo sapiens
gggctgcacgtattctgctcac

SEQ ID NO: 7438098 - DNA, 22 bp, Homo sapiens
gggctgcacgtattctgctcac

SEQ ID NO: 7438099 - DNA, 22 bp, Homo sapiens
gggctgcacgtattctgctcac

SEQ ID NO: 7438100 - DNA, 22 bp, Homo sapiens
gggctgattcgatgggggtaga

SEQ ID NO: 7438101 - DNA, 22 bp, Homo sapiens
gggctgattcgatgggggtaga

SEQ ID NO: 7438102 - DNA, 22 bp, Homo sapiens
gggctgcacagatcttcaaggg

SEQ ID NO: 7438103 - DNA, 22 bp, Homo sapiens
gggctgcaatgcttcagttgtt

SEQ ID NO: 7438104 - DNA, 22 bp, Homo sapiens
gggctgcaatgcttcagttgtt

SEQ ID NO: 7438105 - DNA, 22 bp, Homo sapiens
gggctgcaatgcttcagttgtt

SEQ ID NO: 7438106 - DNA, 22 bp, Homo sapiens
gggctgcatcagcaggacccgg

SEQ ID NO: 7438107 - DNA, 22 bp, Homo sapiens
gggctgcactagggcaaggtga

SEQ ID NO: 7438108 - DNA, 22 bp, Homo sapiens
gggctgcactagggcaaggtga

SEQ ID NO: 7438109 - DNA, 22 bp, Homo sapiens
gggctgcactagggcaaggtga

SEQ ID NO: 7438110 - DNA, 22 bp, Homo sapiens
gggctgccaagcctgcctgcct

SEQ ID NO: 7438111 - DNA, 22 bp, Homo sapiens
gggctgccaagcctgcctgcct

SEQ ID NO: 7438112 - DNA, 22 bp, Homo sapiens
gggctgccaagcctgcctgcct

SEQ ID NO: 7438113 - DNA, 22 bp, Homo sapiens
gggctgagtgtcccaggccgaa

SEQ ID NO: 7438114 - DNA, 22 bp, Homo sapiens
gggctgagttcctgcctcactc

SEQ ID NO: 7438115 - DNA, 22 bp, Homo sapiens
gggctgagttcctgcctcactc

SEQ ID NO: 7438116 - DNA, 22 bp, Homo sapiens
gggctgagttcctgcctcactc

SEQ ID NO: 7438117 - DNA, 22 bp, Homo sapiens
gggctgagttcctgcctcactc

SEQ ID NO: 7438118 - DNA, 22 bp, Homo sapiens
gggctgagtgtcccaggccgaa

SEQ ID NO: 7438119 - DNA, 22 bp, Homo sapiens
gggctgagtgtcccaggccgaa

SEQ ID NO: 7438120 - DNA, 22 bp, Homo sapiens
gggctgagtgtcccaggccgaa

SEQ ID NO: 7438121 - DNA, 22 bp, Homo sapiens
gggctgagtgtcccaggccgaa

SEQ ID NO: 7438122 - DNA, 22 bp, Homo sapiens
gggctgagttcctgcctcactc

SEQ ID NO: 7438123 - DNA, 22 bp, Homo sapiens
gggctgagttcctgcctcactc

SEQ ID NO: 7438124 - DNA, 22 bp, Homo sapiens
gggctgagttcctgcctcactc

SEQ ID NO: 7438125 - DNA, 22 bp, Homo sapiens
gggctgagttcctgcctcactc

SEQ ID NO: 7438126 - DNA, 22 bp, Homo sapiens
gggctgatcgcttgagctcagg

SEQ ID NO: 7438127 - DNA, 22 bp, Homo sapiens
gggctgatcgcttgagctcagg

SEQ ID NO: 7438128 - DNA, 22 bp, Homo sapiens
gggctgatgatgagcagaggtg

SEQ ID NO: 7438129 - DNA, 22 bp, Homo sapiens
gggctgatgatgagcagaggtg

SEQ ID NO: 7438130 - DNA, 22 bp, Homo sapiens
gggctgatgatgagcagaggtg

SEQ ID NO: 7438131 - DNA, 22 bp, Homo sapiens
gggctgatgtgacagaactctc

SEQ ID NO: 7438132 - DNA, 22 bp, Homo sapiens
gggctgatgtgctcccaggtgg

SEQ ID NO: 7438133 - DNA, 22 bp, Homo sapiens
gggctgatgtgctcccaggtgg

SEQ ID NO: 7438134 - DNA, 22 bp, Homo sapiens
gggctgaggctaccactggtct

SEQ ID NO: 7438135 - DNA, 22 bp, Homo sapiens
gggctgaggctaccactggtct

SEQ ID NO: 7438136 - DNA, 22 bp, Homo sapiens
gggctgagggccaattcctact

SEQ ID NO: 7438137 - DNA, 22 bp, Homo sapiens
gggctgagggccaattcctact

SEQ ID NO: 7438138 - DNA, 22 bp, Homo sapiens
gggctgaggctaccactggtct

SEQ ID NO: 7438139 - DNA, 22 bp, Homo sapiens
gggctgagtgtcccaggccgaa

SEQ ID NO: 7438140 - DNA, 22 bp, Homo sapiens
gggctgagtgtcccaggccgaa

SEQ ID NO: 7438141 - DNA, 22 bp, Homo sapiens
gggctgagtgggcctcttactt

SEQ ID NO: 7438142 - DNA, 22 bp, Homo sapiens
gggctgagtgtcccaggccgaa

SEQ ID NO: 7438143 - DNA, 22 bp, Homo sapiens
gggctgagtgtcccaggccgaa

SEQ ID NO: 7438144 - DNA, 22 bp, Homo sapiens
gggctgagtgtcccaggccgaa

SEQ ID NO: 7438145 - DNA, 22 bp, Homo sapiens
gggctgagggccaattcctact

SEQ ID NO: 7438146 - DNA, 22 bp, Homo sapiens
gggctgagggccaattcctact

SEQ ID NO: 7438147 - DNA, 22 bp, Homo sapiens
gggctgagggccaattcctact

SEQ ID NO: 7438148 - DNA, 22 bp, Homo sapiens
gggctgagtgtcccaggccgaa

SEQ ID NO: 7438149 - DNA, 22 bp, Homo sapiens
ggtggcctctgcaggcctcgac

SEQ ID NO: 7438150 - DNA, 22 bp, Homo sapiens
ggtggcctctgcaggcctcgac

SEQ ID NO: 7438151 - DNA, 22 bp, Homo sapiens
ggtggcctgaattagctcaggg

SEQ ID NO: 7438152 - DNA, 22 bp, Homo sapiens
ggtggcctctgcaggcctcgac

SEQ ID NO: 7438153 - DNA, 22 bp, Homo sapiens
ggtggcctcttgtttagccagc

SEQ ID NO: 7438154 - DNA, 22 bp, Homo sapiens
ggtggcctctcatgcaaggtag

SEQ ID NO: 7438155 - DNA, 22 bp, Homo sapiens
ggtggcctctcatgcaaggtag

SEQ ID NO: 7438156 - DNA, 22 bp, Homo sapiens
ggtggcctcggtggtgcacagg

SEQ ID NO: 7438157 - DNA, 22 bp, Homo sapiens
ggtggcctcggtggtgcacagg

SEQ ID NO: 7438158 - DNA, 22 bp, Homo sapiens
ggtggcctcggtggtgcacagg

SEQ ID NO: 7438159 - DNA, 22 bp, Homo sapiens
ggtggcctcggtggtgcacagg

SEQ ID NO: 7438160 - DNA, 22 bp, Homo sapiens
ggtggcctcgccgcggctctgc

SEQ ID NO: 7438161 - DNA, 22 bp, Homo sapiens
ggtggcctcagcaaggctggca

SEQ ID NO: 7438162 - DNA, 22 bp, Homo sapiens
ggtggcctcagcaaggctggca

SEQ ID NO: 7438163 - DNA, 22 bp, Homo sapiens
ggtggcctccagggcataggtg

SEQ ID NO: 7438164 - DNA, 22 bp, Homo sapiens
ggtggcctccagggcataggtg

SEQ ID NO: 7438165 - DNA, 22 bp, Homo sapiens
ggtggcctccagggcataggtg

SEQ ID NO: 7438166 - DNA, 22 bp, Homo sapiens
ggtggcctccagggcataggtg

SEQ ID NO: 7438167 - DNA, 22 bp, Homo sapiens
ggtggccttggacaagtaacct

SEQ ID NO: 7438168 - DNA, 21 bp, Homo sapiens
ggtggccttggtgagagacct

SEQ ID NO: 7438169 - DNA, 22 bp, Homo sapiens
ggtggcctttcagtggatcagg

SEQ ID NO: 7438170 - DNA, 22 bp, Homo sapiens
ggtggccttttatgagcagggt

SEQ ID NO: 7438171 - DNA, 22 bp, Homo sapiens
ggtggccttttatgagcagggt

SEQ ID NO: 7438172 - DNA, 22 bp, Homo sapiens
ggtggcctggaatcttaacaag

SEQ ID NO: 7438173 - DNA, 22 bp, Homo sapiens
ggtggcctgccctgatccctgg

SEQ ID NO: 7438174 - DNA, 22 bp, Homo sapiens
ggtggcctgccctgatccctgg

SEQ ID NO: 7438175 - DNA, 18 bp, Homo sapiens
ggtggccttgacttctct

SEQ ID NO: 7438176 - DNA, 22 bp, Homo sapiens
ggtggcctgttttcaggtttgc

SEQ ID NO: 7438177 - DNA, 22 bp, Homo sapiens
ggtggcctggctctcaccttgg

SEQ ID NO: 7438178 - DNA, 17 bp, Homo sapiens
ggtggcctgcagtggct

SEQ ID NO: 7438179 - DNA, 17 bp, Homo sapiens
ggtggcctgcagtggct

SEQ ID NO: 7438180 - DNA, 17 bp, Homo sapiens
ggtggcctgcagtggct

SEQ ID NO: 7438181 - DNA, 17 bp, Homo sapiens
ggtggcctgcagtggct

SEQ ID NO: 7438182 - DNA, 17 bp, Homo sapiens
ggtggcctgcagtggct

SEQ ID NO: 7438183 - DNA, 17 bp, Homo sapiens
ggtggcctgcagtggct

SEQ ID NO: 7438184 - DNA, 22 bp, Homo sapiens
ggtggcctgcaagtgcagatgg

SEQ ID NO: 7438185 - DNA, 22 bp, Homo sapiens
ggtggcctgaattagctcaggg

SEQ ID NO: 7438186 - DNA, 22 bp, Homo sapiens
ggtggcctgaattagctcaggg

SEQ ID NO: 7438187 - DNA, 22 bp, Homo sapiens
ggtggcctgaattagctcaggg

SEQ ID NO: 7438188 - DNA, 22 bp, Homo sapiens
ggtggcctgaattagctcaggg

SEQ ID NO: 7438189 - DNA, 22 bp, Homo sapiens
ggtggctcatttgatcttcata

SEQ ID NO: 7438190 - DNA, 22 bp, Homo sapiens
ggtggctcatttgatcttcata

SEQ ID NO: 7438191 - DNA, 22 bp, Homo sapiens
ggtggctcccacccagctttga

SEQ ID NO: 7438192 - DNA, 22 bp, Homo sapiens
ggtggctcccacccagctttga

SEQ ID NO: 7438193 - DNA, 22 bp, Homo sapiens
ggtggctccgcttccatgggct

SEQ ID NO: 7438194 - DNA, 22 bp, Homo sapiens
ggtggctccgcttccatgggct

SEQ ID NO: 7438195 - DNA, 22 bp, Homo sapiens
ggtggctccgcttccatgggct

SEQ ID NO: 7438196 - DNA, 22 bp, Homo sapiens
ggtggctcccacccagctttga

SEQ ID NO: 7438197 - DNA, 22 bp, Homo sapiens
ggtggctcagtgtcaggccctg

SEQ ID NO: 7438198 - DNA, 22 bp, Homo sapiens
ggtggctcagtgtcaggccctg

SEQ ID NO: 7438199 - DNA, 22 bp, Homo sapiens
ggtggctcagtgtcaggccctg

SEQ ID NO: 7438200 - DNA, 22 bp, Homo sapiens
ggtggctcagtgtcaggccctg

SEQ ID NO: 7438201 - DNA, 22 bp, Homo sapiens
ggtggctcagtgtcaggccctg

SEQ ID NO: 7438202 - DNA, 22 bp, Homo sapiens
ggtggctcagtgtcaggccctg

SEQ ID NO: 7438203 - DNA, 22 bp, Homo sapiens
ggtggctcagtgtcaggccctg

SEQ ID NO: 7438204 - DNA, 22 bp, Homo sapiens
ggtggctcagggctccaagcat

SEQ ID NO: 7438205 - DNA, 19 bp, Homo sapiens
ggtggctcagggcccagcc

SEQ ID NO: 7438206 - DNA, 19 bp, Homo sapiens
ggtggctcagggcccagcc

SEQ ID NO: 7438207 - DNA, 22 bp, Homo sapiens
ggtggctcagggctccaagcat

SEQ ID NO: 7438208 - DNA, 22 bp, Homo sapiens
ggtggctcagggctccaagcat

SEQ ID NO: 7438209 - DNA, 22 bp, Homo sapiens
ggtggctcagggctccaagcat

SEQ ID NO: 7438210 - DNA, 22 bp, Homo sapiens
ggtggctcagggctccaagcat

SEQ ID NO: 7438211 - DNA, 18 bp, Homo sapiens
ggtggctcagtcatgggg

SEQ ID NO: 7438212 - DNA, 18 bp, Homo sapiens
ggtggctcagtcatgggg

SEQ ID NO: 7438213 - DNA, 18 bp, Homo sapiens
ggtggctcagtcatgggg

SEQ ID NO: 7438214 - DNA, 22 bp, Homo sapiens
ggtggctcagggctccaagcat

SEQ ID NO: 7438215 - DNA, 18 bp, Homo sapiens
ggtggctcagtcatgggg

SEQ ID NO: 7438216 - DNA, 22 bp, Homo sapiens
ggtggctcaaagagagcacaga

SEQ ID NO: 7438217 - DNA, 22 bp, Homo sapiens
ggtggctcaaagagagcacaga

SEQ ID NO: 7438218 - DNA, 22 bp, Homo sapiens
ggtggctcaaagagagcacaga

SEQ ID NO: 7438219 - DNA, 22 bp, Homo sapiens
ggtggctcacgcctgtaagccc

SEQ ID NO: 7438220 - DNA, 22 bp, Homo sapiens
ggtggctcacgcctgtaagccc

SEQ ID NO: 7438221 - DNA, 21 bp, Homo sapiens
ggtggctcacctgattggata

SEQ ID NO: 7438222 - DNA, 21 bp, Homo sapiens
ggtggctcacctgattggata

SEQ ID NO: 7438223 - DNA, 19 bp, Homo sapiens
ggtggctcagggcccagcc

SEQ ID NO: 7438224 - DNA, 19 bp, Homo sapiens
ggtggctcagggcccagcc

SEQ ID NO: 7438225 - DNA, 19 bp, Homo sapiens
ggtggctcagggcccagcc

SEQ ID NO: 7438226 - DNA, 22 bp, Homo sapiens
ggtggctcacgcctgtaagccc

SEQ ID NO: 7438227 - DNA, 19 bp, Homo sapiens
ggtggctcagggcccagcc

SEQ ID NO: 7438228 - DNA, 19 bp, Homo sapiens
ggtggctcagggcccagcc

SEQ ID NO: 7438229 - DNA, 18 bp, Homo sapiens
ggtggcggggatggaggt

SEQ ID NO: 7438230 - DNA, 18 bp, Homo sapiens
ggtggcggggatggaggt

SEQ ID NO: 7438231 - DNA, 22 bp, Homo sapiens
ggtggccttttatgagcagggt

SEQ ID NO: 7438232 - DNA, 22 bp, Homo sapiens
ggtggcggccacttcagccctg

SEQ ID NO: 7438233 - DNA, 22 bp, Homo sapiens
ggtggcggccacttcagccctg

SEQ ID NO: 7438234 - DNA, 22 bp, Homo sapiens
ggtggcggccacttcagccctg

SEQ ID NO: 7438235 - DNA, 22 bp, Homo sapiens
ggtggctcaaagagagcacaga

SEQ ID NO: 7438236 - DNA, 18 bp, Homo sapiens
ggtggcggggatggaggt

SEQ ID NO: 7438237 - DNA, 18 bp, Homo sapiens
ggtggcggggatggaggt

SEQ ID NO: 7438238 - DNA, 18 bp, Homo sapiens
ggtggcggggatggaggt

SEQ ID NO: 7438239 - DNA, 22 bp, Homo sapiens
ggtggcctagggcccagcctgt

SEQ ID NO: 7438240 - DNA, 22 bp, Homo sapiens
ggtggcctagaggttaaagtag

SEQ ID NO: 7438241 - DNA, 22 bp, Homo sapiens
ggtggcctagggcccagcctgt

SEQ ID NO: 7438242 - DNA, 22 bp, Homo sapiens
ggtggcctcagcaaggctggca

SEQ ID NO: 7438243 - DNA, 22 bp, Homo sapiens
ggtggcctagggcccagcctgt

SEQ ID NO: 7438244 - DNA, 22 bp, Homo sapiens
ggtggcctcagcaaggctggca

SEQ ID NO: 7438245 - DNA, 22 bp, Homo sapiens
ggtggcctagaagataagggga

SEQ ID NO: 7438246 - DNA, 22 bp, Homo sapiens
ggtctggcctccgggcaggtgg

SEQ ID NO: 7438247 - DNA, 22 bp, Homo sapiens
ggtctggcctccgggcaggtgg

SEQ ID NO: 7438248 - DNA, 22 bp, Homo sapiens
ggtctggattttgaacaaaatt

SEQ ID NO: 7438249 - DNA, 22 bp, Homo sapiens
ggtctggcactcatgcagcagg

SEQ ID NO: 7438250 - DNA, 22 bp, Homo sapiens
ggtctggcactcatgcagcagg

SEQ ID NO: 7438251 - DNA, 22 bp, Homo sapiens
ggtctggcactcatgcagcagg

SEQ ID NO: 7438252 - DNA, 22 bp, Homo sapiens
ggtctggcaggtgaggactcag

SEQ ID NO: 7438253 - DNA, 22 bp, Homo sapiens
ggtctggcctccgggcaggtgg

SEQ ID NO: 7438254 - DNA, 22 bp, Homo sapiens
ggtctggcctccgggcaggtgg

SEQ ID NO: 7438255 - DNA, 22 bp, Homo sapiens
ggtctggccaatagacagcccc

SEQ ID NO: 7438256 - DNA, 22 bp, Homo sapiens
ggtctggcctccgggcaggtgg

SEQ ID NO: 7438257 - DNA, 22 bp, Homo sapiens
ggtctggcaggtgaggactcag

SEQ ID NO: 7438258 - DNA, 22 bp, Homo sapiens
ggtctggcaggtgaggactcag

SEQ ID NO: 7438259 - DNA, 22 bp, Homo sapiens
ggtctggcaggtgaggactcag

SEQ ID NO: 7438260 - DNA, 22 bp, Homo sapiens
ggtctggattttatctactgta

SEQ ID NO: 7438261 - DNA, 22 bp, Homo sapiens
ggtctggattttatctactgta

SEQ ID NO: 7438262 - DNA, 22 bp, Homo sapiens
ggtctggatttctgcttctttc

SEQ ID NO: 7438263 - DNA, 22 bp, Homo sapiens
ggtctggataattccagtacct

SEQ ID NO: 7438264 - DNA, 22 bp, Homo sapiens
ggtctggatattcaccagggcc

SEQ ID NO: 7438265 - DNA, 22 bp, Homo sapiens
ggtctggatgctgaggttccca

SEQ ID NO: 7438266 - DNA, 22 bp, Homo sapiens
ggtctggagtagatgagtcatg

SEQ ID NO: 7438267 - DNA, 22 bp, Homo sapiens
ggtctggagcttggctaaggga

SEQ ID NO: 7438268 - DNA, 22 bp, Homo sapiens
ggtctggagcttggctaaggga

SEQ ID NO: 7438269 - DNA, 22 bp, Homo sapiens
ggtctggagtaggatgatggct

SEQ ID NO: 7438270 - DNA, 22 bp, Homo sapiens
ggtctggataattccagtacct

SEQ ID NO: 7438271 - DNA, 22 bp, Homo sapiens
ggtctggataattccagtacct

SEQ ID NO: 7438272 - DNA, 22 bp, Homo sapiens
ggtctggataattccagtacct

SEQ ID NO: 7438273 - DNA, 22 bp, Homo sapiens
ggtctggataattccagtacct

SEQ ID NO: 7438274 - DNA, 23 bp, Homo sapiens
ggtctggaattcgcggagttaac

SEQ ID NO: 7438275 - DNA, 22 bp, Homo sapiens
ggtctggaatggagtaggggtg

SEQ ID NO: 7438276 - DNA, 22 bp, Homo sapiens
ggtctggaatggagtaggggtg

SEQ ID NO: 7438277 - DNA, 22 bp, Homo sapiens
ggtctgaattccagcccctctg

SEQ ID NO: 7438278 - DNA, 22 bp, Homo sapiens
ggtctgaaatgtgacttttgaa

SEQ ID NO: 7438279 - DNA, 22 bp, Homo sapiens
ggtctggaccctcctggagtgg

SEQ ID NO: 7438280 - DNA, 22 bp, Homo sapiens
ggtctggaccctcctggagtgg

SEQ ID NO: 7438281 - DNA, 22 bp, Homo sapiens
ggtctggaccctcctggagtgg

SEQ ID NO: 7438282 - DNA, 22 bp, Homo sapiens
ggtctggacagaatgtgacact

SEQ ID NO: 7438283 - DNA, 22 bp, Homo sapiens
ggtctggaccatggacgccggg

SEQ ID NO: 7438284 - DNA, 22 bp, Homo sapiens
ggtctctgttgcctccatcaag

SEQ ID NO: 7438285 - DNA, 22 bp, Homo sapiens
ggtctcttagtgcaacatacta

SEQ ID NO: 7438286 - DNA, 22 bp, Homo sapiens
ggtctcttagtgcaacatacta

SEQ ID NO: 7438287 - DNA, 22 bp, Homo sapiens
ggtctcttcaggagcttgagcg

SEQ ID NO: 7438288 - DNA, 22 bp, Homo sapiens
ggtctctgttgcctccatcaag

SEQ ID NO: 7438289 - DNA, 22 bp, Homo sapiens
ggtctctgtttggggctggcaa

SEQ ID NO: 7438290 - DNA, 22 bp, Homo sapiens
ggtctctgtttggggctggcaa

SEQ ID NO: 7438291 - DNA, 22 bp, Homo sapiens
ggtctcttcaggagcttgagcg

SEQ ID NO: 7438292 - DNA, 21 bp, Homo sapiens
ggtctcttcatctgtaacctg

SEQ ID NO: 7438293 - DNA, 21 bp, Homo sapiens
ggtctcttcatctgtaacctg

SEQ ID NO: 7438294 - DNA, 22 bp, Homo sapiens
ggtctcttccagctttatcact

SEQ ID NO: 7438295 - DNA, 22 bp, Homo sapiens
ggtctcttgtccaaggtcacac

SEQ ID NO: 7438296 - DNA, 22 bp, Homo sapiens
ggtctctttccttggcttgcac

SEQ ID NO: 7438297 - DNA, 22 bp, Homo sapiens
ggtctctttgcttcagctacag

SEQ ID NO: 7438298 - DNA, 22 bp, Homo sapiens
ggtctctttgcttcagctacag

SEQ ID NO: 7438299 - DNA, 22 bp, Homo sapiens
ggtctctttgcttcagctacag

SEQ ID NO: 7438300 - DNA, 22 bp, Homo sapiens
ggtctctttgcttcagctacag

SEQ ID NO: 7438301 - DNA, 22 bp, Homo sapiens
ggtgtgggcagatgccctactt

SEQ ID NO: 7438302 - DNA, 22 bp, Homo sapiens
ggtgtgggcagatgccctactt

SEQ ID NO: 7438303 - DNA, 21 bp, Homo sapiens
ggtgtgggatggactgaacca

SEQ ID NO: 7438304 - DNA, 22 bp, Homo sapiens
ggtgtgggagagattctttcct

SEQ ID NO: 7438305 - DNA, 22 bp, Homo sapiens
ggtgtgggccctgatgtcagca

SEQ ID NO: 7438306 - DNA, 22 bp, Homo sapiens
ggtgtgggccctgatgtcagca

SEQ ID NO: 7438307 - DNA, 22 bp, Homo sapiens
ggtgtgggccctgatgtcagca

SEQ ID NO: 7438308 - DNA, 22 bp, Homo sapiens
ggtggctctcttaagggcagcg

SEQ ID NO: 7438309 - DNA, 22 bp, Homo sapiens
ggtgtggatcatctgaggtcag

SEQ ID NO: 7438310 - DNA, 22 bp, Homo sapiens
ggtgtggatcatctgaggtcag

SEQ ID NO: 7438311 - DNA, 22 bp, Homo sapiens
ggtgtggatcatctgaggtcag

SEQ ID NO: 7438312 - DNA, 22 bp, Homo sapiens
ggtgtccttgcagaaggcggcg

SEQ ID NO: 7438313 - DNA, 22 bp, Homo sapiens
ggtgtgggaactacaggttttt

SEQ ID NO: 7438314 - DNA, 22 bp, Homo sapiens
ggtgtgggaactacaggttttt

SEQ ID NO: 7438315 - DNA, 22 bp, Homo sapiens
ggtgtgggaactacaggttttt

SEQ ID NO: 7438316 - DNA, 22 bp, Homo sapiens
ggtgtggcagtggacctgtgaa

SEQ ID NO: 7438317 - DNA, 22 bp, Homo sapiens
ggtgtggtttgaagggagatgg

SEQ ID NO: 7438318 - DNA, 22 bp, Homo sapiens
ggtgtgggtccttgtgcttgct

SEQ ID NO: 7438319 - DNA, 22 bp, Homo sapiens
ggtgtgggtccttgtgcttgct

SEQ ID NO: 7438320 - DNA, 22 bp, Homo sapiens
ggtgtgggtccttgtgcttgct

SEQ ID NO: 7438321 - DNA, 22 bp, Homo sapiens
ggtgtgggggcagctctgatat

SEQ ID NO: 7438322 - DNA, 22 bp, Homo sapiens
ggtgtgggggcagctctgatat

SEQ ID NO: 7438323 - DNA, 22 bp, Homo sapiens
ggtgtgggggcaagtttgagat

SEQ ID NO: 7438324 - DNA, 22 bp, Homo sapiens
ggtgtggggaggttctgcttct

SEQ ID NO: 7438325 - DNA, 22 bp, Homo sapiens
ggtgtgggggcaagtttgagat

SEQ ID NO: 7438326 - DNA, 22 bp, Homo sapiens
ggtgtggggaggttctgcttct

SEQ ID NO: 7438327 - DNA, 22 bp, Homo sapiens
ggtgtggggaggttctgcttct

SEQ ID NO: 7438328 - DNA, 22 bp, Homo sapiens
ggtgtgggccctgatgtcagca

SEQ ID NO: 7438329 - DNA, 22 bp, Homo sapiens
ggtgtccttagaaagcagacct

SEQ ID NO: 7438330 - DNA, 22 bp, Homo sapiens
ggtggctctcttaagggcagcg

SEQ ID NO: 7438331 - DNA, 22 bp, Homo sapiens
ggtgtccttcgtccgctggcat

SEQ ID NO: 7438332 - DNA, 22 bp, Homo sapiens
ggtgtccttgctccttcagctt

SEQ ID NO: 7438333 - DNA, 22 bp, Homo sapiens
ggtggctctccctggactcagc

SEQ ID NO: 7438334 - DNA, 22 bp, Homo sapiens
ggtggctctccctggactcagc

SEQ ID NO: 7438335 - DNA, 22 bp, Homo sapiens
ggtggctctccctggactcagc

SEQ ID NO: 7438336 - DNA, 22 bp, Homo sapiens
ggtggctctctgtcagtgacag

SEQ ID NO: 7438337 - DNA, 22 bp, Homo sapiens
ggtggctctctgtcagtgacag

SEQ ID NO: 7438338 - DNA, 22 bp, Homo sapiens
ggtggctctctgtcagtgacag

SEQ ID NO: 7438339 - DNA, 22 bp, Homo sapiens
ggtggctctctgtcagtgacag

SEQ ID NO: 7438340 - DNA, 22 bp, Homo sapiens
ggtggctctcttaagggcagcg

SEQ ID NO: 7438341 - DNA, 22 bp, Homo sapiens
ggtggctctcttaagggcagcg

SEQ ID NO: 7438342 - DNA, 22 bp, Homo sapiens
ggtggctctcttaagggcagcg

SEQ ID NO: 7438343 - DNA, 22 bp, Homo sapiens
ggtggctctctgtcagtgacag

SEQ ID NO: 7438344 - DNA, 22 bp, Homo sapiens
ggtggctctctgtcagtgacag

SEQ ID NO: 7438345 - DNA, 17 bp, Homo sapiens
ggtggctcgggcgcggc

SEQ ID NO: 7438346 - DNA, 22 bp, Homo sapiens
ggtggctcgtttttcttgaaag

SEQ ID NO: 7438347 - DNA, 22 bp, Homo sapiens
ggtggctcggccagtgcaggcc

SEQ ID NO: 7438348 - DNA, 22 bp, Homo sapiens
ggtggctcggccagtgcaggcc

SEQ ID NO: 7438349 - DNA, 22 bp, Homo sapiens
ggtggctcggccagtgcaggcc

SEQ ID NO: 7438350 - DNA, 22 bp, Homo sapiens
ggtggctccgcttccatgggct

SEQ ID NO: 7438351 - DNA, 22 bp, Homo sapiens
ggtggctcggccagtgcaggcc

SEQ ID NO: 7438352 - DNA, 22 bp, Homo sapiens
ggtggctcggccagtgcaggcc

SEQ ID NO: 7438353 - DNA, 22 bp, Homo sapiens
ggtggctccgcttccatgggct

SEQ ID NO: 7438354 - DNA, 22 bp, Homo sapiens
ggtggctcggccagtgcaggcc

SEQ ID NO: 7438355 - DNA, 19 bp, Homo sapiens
ggtggctctccctcaggga

SEQ ID NO: 7438356 - DNA, 22 bp, Homo sapiens
ggtggctctccctggactcagc

SEQ ID NO: 7438357 - DNA, 19 bp, Homo sapiens
ggtggctctccctcaggga

SEQ ID NO: 7438358 - DNA, 19 bp, Homo sapiens
ggtggctctccctcaggga

SEQ ID NO: 7438359 - DNA, 19 bp, Homo sapiens
ggtggctctccctcaggga

SEQ ID NO: 7438360 - DNA, 19 bp, Homo sapiens
ggtggctctccctcaggga

SEQ ID NO: 7438361 - DNA, 19 bp, Homo sapiens
ggtggctctccctcaggga

SEQ ID NO: 7438362 - DNA, 19 bp, Homo sapiens
ggtggctctccctcaggga

SEQ ID NO: 7438363 - DNA, 19 bp, Homo sapiens
ggtggctctccctcaggga

SEQ ID NO: 7438364 - DNA, 19 bp, Homo sapiens
ggtggctctccctcaggga

SEQ ID NO: 7438365 - DNA, 19 bp, Homo sapiens
ggtggctctccctcaggga

SEQ ID NO: 7438366 - DNA, 22 bp, Homo sapiens
ggtggctctcaggcttctcgga

SEQ ID NO: 7438367 - DNA, 22 bp, Homo sapiens
ggtggctctcaggcttctcgga

SEQ ID NO: 7438368 - DNA, 22 bp, Homo sapiens
ggtggctctcaggcttctcgga

SEQ ID NO: 7438369 - DNA, 22 bp, Homo sapiens
ggtggctctcaggcttctcgga

SEQ ID NO: 7438370 - DNA, 19 bp, Homo sapiens
ggtgtgtgctggggcctgt

SEQ ID NO: 7438371 - DNA, 19 bp, Homo sapiens
ggtgtgtgctggggcctgt

SEQ ID NO: 7438372 - DNA, 19 bp, Homo sapiens
ggtgtgtgctggggcctgt

SEQ ID NO: 7438373 - DNA, 22 bp, Homo sapiens
ggtgtgtgaggagtcacttagt

SEQ ID NO: 7438374 - DNA, 19 bp, Homo sapiens
ggtgtgtgctggggcctgt

SEQ ID NO: 7438375 - DNA, 19 bp, Homo sapiens
ggtgtgtgctggggcctgt

SEQ ID NO: 7438376 - DNA, 19 bp, Homo sapiens
ggtgtgtgctggggcctgt

SEQ ID NO: 7438377 - DNA, 19 bp, Homo sapiens
ggtgtgtgctggggcctgt

SEQ ID NO: 7438378 - DNA, 19 bp, Homo sapiens
ggtgtgtgctggggcctgt

SEQ ID NO: 7438379 - DNA, 22 bp, Homo sapiens
ggtgtggtttgaagggagatgg

SEQ ID NO: 7438380 - DNA, 22 bp, Homo sapiens
ggtgtggtttgaagggagatgg

SEQ ID NO: 7438381 - DNA, 22 bp, Homo sapiens
ggtgtgtctgccaggaactgca

SEQ ID NO: 7438382 - DNA, 22 bp, Homo sapiens
ggtgtgtagcatgtttaagacc

SEQ ID NO: 7438383 - DNA, 22 bp, Homo sapiens
ggtgtgtctgccaggaactgca

SEQ ID NO: 7438384 - DNA, 22 bp, Homo sapiens
ggtgtgtgaggagtcacttagt

SEQ ID NO: 7438385 - DNA, 22 bp, Homo sapiens
ggtgtgtgaggagtcacttagt

SEQ ID NO: 7438386 - DNA, 22 bp, Homo sapiens
ggtgtgtgaggagtcacttagt

SEQ ID NO: 7438387 - DNA, 22 bp, Homo sapiens
ggtgtgtgtggattagcatgcc

SEQ ID NO: 7438388 - DNA, 22 bp, Homo sapiens
ggtgtgtgtggattagcatgcc

SEQ ID NO: 7438389 - DNA, 22 bp, Homo sapiens
ggtgtgtgtggattagcatgcc

SEQ ID NO: 7438390 - DNA, 22 bp, Homo sapiens
ggtgtgtggttttgatacagtc

SEQ ID NO: 7438391 - DNA, 20 bp, Homo sapiens
ggtgtgttggttcagcatgg

SEQ ID NO: 7438392 - DNA, 22 bp, Homo sapiens
ggtgtgtgtggattagcatgcc

SEQ ID NO: 7438393 - DNA, 22 bp, Homo sapiens
ggtgtgtgtggattagcatgcc

SEQ ID NO: 7438394 - DNA, 22 bp, Homo sapiens
ggtgtgtggttttgatacagtc

SEQ ID NO: 7438395 - DNA, 22 bp, Homo sapiens
ggtgtgtggttttgatacagtc

SEQ ID NO: 7438396 - DNA, 22 bp, Homo sapiens
ggtgtgtggttttgatacagtc

SEQ ID NO: 7438397 - DNA, 22 bp, Homo sapiens
ggtgtgtggtcctctcacttag

SEQ ID NO: 7438398 - DNA, 22 bp, Homo sapiens
ggtgtgtggtcctctcacttag

SEQ ID NO: 7438399 - DNA, 22 bp, Homo sapiens
ggtgtgtggtcctctcacttag

SEQ ID NO: 7438400 - DNA, 22 bp, Homo sapiens
ggtttaattacctgcatctcaa

SEQ ID NO: 7438401 - DNA, 22 bp, Homo sapiens
ggtgttgggagagctggttttg

SEQ ID NO: 7438402 - DNA, 22 bp, Homo sapiens
ggtgttgggctcactggtcctt

SEQ ID NO: 7438403 - DNA, 22 bp, Homo sapiens
ggtgttgcagttgaagactggt

SEQ ID NO: 7438404 - DNA, 22 bp, Homo sapiens
ggtgttcaaatgaacacatgca

SEQ ID NO: 7438405 - DNA, 22 bp, Homo sapiens
ggtgttcttagtggcactggca

SEQ ID NO: 7438406 - DNA, 22 bp, Homo sapiens
ggtgttcttagtggcactggca

SEQ ID NO: 7438407 - DNA, 22 bp, Homo sapiens
ggtgttaacttgtttatgacaa

SEQ ID NO: 7438408 - DNA, 22 bp, Homo sapiens
ggtgttgcagttgaagactggt

SEQ ID NO: 7438409 - DNA, 22 bp, Homo sapiens
ggtgttggaacatggtgagatt

SEQ ID NO: 7438410 - DNA, 22 bp, Homo sapiens
ggtgttgcagttgaagactggt

SEQ ID NO: 7438411 - DNA, 22 bp, Homo sapiens
ggtgttgcagttgaagactggt

SEQ ID NO: 7438412 - DNA, 22 bp, Homo sapiens
ggtttaattggtccaggatggg

SEQ ID NO: 7438413 - DNA, 19 bp, Homo sapiens
ggtttatctgtttcttctc

SEQ ID NO: 7438414 - DNA, 22 bp, Homo sapiens
ggtttatcaatacatattgcta

SEQ ID NO: 7438415 - DNA, 22 bp, Homo sapiens
ggtttattaatgtgaactgtat

SEQ ID NO: 7438416 - DNA, 22 bp, Homo sapiens
ggtttattaatgtgaactgtat

SEQ ID NO: 7438417 - DNA, 22 bp, Homo sapiens
ggtttattgaaggccaccccac

SEQ ID NO: 7438418 - DNA, 22 bp, Homo sapiens
ggtttattaatgtgaactgtat

SEQ ID NO: 7438419 - DNA, 22 bp, Homo sapiens
ggtttcaaattaaagtcttaag

SEQ ID NO: 7438420 - DNA, 22 bp, Homo sapiens
ggtttattgttaataagtttga

SEQ ID NO: 7438421 - DNA, 22 bp, Homo sapiens
ggtttattgaaggccaccccac

SEQ ID NO: 7438422 - DNA, 22 bp, Homo sapiens
ggtttattgttaataagtttga

SEQ ID NO: 7438423 - DNA, 22 bp, Homo sapiens
ggtttattgttaataagtttga

SEQ ID NO: 7438424 - DNA, 22 bp, Homo sapiens
ggtttattgttaataagtttga

SEQ ID NO: 7438425 - DNA, 22 bp, Homo sapiens
ggtttattgaaggccaccccac

SEQ ID NO: 7438426 - DNA, 22 bp, Homo sapiens
gggtggcaggattggcaggagt

SEQ ID NO: 7438427 - DNA, 22 bp, Homo sapiens
gggtggcagctgttgccaaggt

SEQ ID NO: 7438428 - DNA, 22 bp, Homo sapiens
gggtggcagctgttgccaaggt

SEQ ID NO: 7438429 - DNA, 22 bp, Homo sapiens
gggtggcaggattggcaggagt

SEQ ID NO: 7438430 - DNA, 22 bp, Homo sapiens
gggtggcaggattggcaggagt

SEQ ID NO: 7438431 - DNA, 22 bp, Homo sapiens
gggtggcaggattggcaggagt

SEQ ID NO: 7438432 - DNA, 22 bp, Homo sapiens
gggtggcaggattggcaggagt

SEQ ID NO: 7438433 - DNA, 22 bp, Homo sapiens
gggtggcaggattggcaggagt

SEQ ID NO: 7438434 - DNA, 22 bp, Homo sapiens
gggtggcaggattggcaggagt

SEQ ID NO: 7438435 - DNA, 22 bp, Homo sapiens
gggtggcaggattggcaggagt

SEQ ID NO: 7438436 - DNA, 22 bp, Homo sapiens
gggtggcaggattggcaggagt

SEQ ID NO: 7438437 - DNA, 22 bp, Homo sapiens
gggtggcagctgttgccaaggt

SEQ ID NO: 7438438 - DNA, 22 bp, Homo sapiens
gggtggcagctgttgccaaggt

SEQ ID NO: 7438439 - DNA, 22 bp, Homo sapiens
gggtggcagctgttgccaaggt

SEQ ID NO: 7438440 - DNA, 22 bp, Homo sapiens
gggtggcactgataatgagacg

SEQ ID NO: 7438441 - DNA, 22 bp, Homo sapiens
gggtggcacaggtgcagagggt

SEQ ID NO: 7438442 - DNA, 22 bp, Homo sapiens
gggtggcacaggtgcagagggt

SEQ ID NO: 7438443 - DNA, 22 bp, Homo sapiens
gggtggcacaggtgcagagggt

SEQ ID NO: 7438444 - DNA, 22 bp, Homo sapiens
gggtggcacaggtgcagagggt

SEQ ID NO: 7438445 - DNA, 22 bp, Homo sapiens
gggtggcacaggtgcagagggt

SEQ ID NO: 7438446 - DNA, 22 bp, Homo sapiens
gggtggcacaggtgcagagggt

SEQ ID NO: 7438447 - DNA, 22 bp, Homo sapiens
gggtggcacaggtgcagagggt

SEQ ID NO: 7438448 - DNA, 22 bp, Homo sapiens
gggtggcacaggtgcagagggt

SEQ ID NO: 7438449 - DNA, 22 bp, Homo sapiens
gggtggcacaggtgcagagggt

SEQ ID NO: 7438450 - DNA, 22 bp, Homo sapiens
gggtggcacaggtgcagagggt

SEQ ID NO: 7438451 - DNA, 22 bp, Homo sapiens
gggtggcacaggtgcagagggt

SEQ ID NO: 7438452 - DNA, 22 bp, Homo sapiens
gggtggcacaggtgcagagggt

SEQ ID NO: 7438453 - DNA, 22 bp, Homo sapiens
gggtggcacaggtgcagagggt

SEQ ID NO: 7438454 - DNA, 22 bp, Homo sapiens
gggtggcacaggtgcagagggt

SEQ ID NO: 7438455 - DNA, 22 bp, Homo sapiens
gggtggcacaggtgcagagggt

SEQ ID NO: 7438456 - DNA, 22 bp, Homo sapiens
gggtggcaaaggcgctgaaagg

SEQ ID NO: 7438457 - DNA, 22 bp, Homo sapiens
gggtggcacaggtgcagagggt

SEQ ID NO: 7438458 - DNA, 20 bp, Homo sapiens
gggtggagttgcggtctgtg

SEQ ID NO: 7438459 - DNA, 20 bp, Homo sapiens
gggtggagttgcggtctgtg

SEQ ID NO: 7438460 - DNA, 20 bp, Homo sapiens
gggtggagttgcggtctgtg

SEQ ID NO: 7438461 - DNA, 22 bp, Homo sapiens
ggtagggcaaagtagggcacct

SEQ ID NO: 7438462 - DNA, 22 bp, Homo sapiens
ggtagggcaaagtagggcacct

SEQ ID NO: 7438463 - DNA, 22 bp, Homo sapiens
ggtagggcaaagtagggcacct

SEQ ID NO: 7438464 - DNA, 22 bp, Homo sapiens
gggtggctgagaacaggacccc

SEQ ID NO: 7438465 - DNA, 22 bp, Homo sapiens
ggtaggggaagacaagtgaaaa

SEQ ID NO: 7438466 - DNA, 22 bp, Homo sapiens
ggtaggggcagggccaagctgt

SEQ ID NO: 7438467 - DNA, 22 bp, Homo sapiens
ggtaggggaagacaagtgaaaa

SEQ ID NO: 7438468 - DNA, 22 bp, Homo sapiens
ggtaggggcagggccaagctgt

SEQ ID NO: 7438469 - DNA, 22 bp, Homo sapiens
ggtaggggaagacaagtgaaaa

SEQ ID NO: 7438470 - DNA, 22 bp, Homo sapiens
ggtaggggaagacaagtgaaaa

SEQ ID NO: 7438471 - DNA, 22 bp, Homo sapiens
ggtaggggaagacaagtgaaaa

SEQ ID NO: 7438472 - DNA, 22 bp, Homo sapiens
ggtagggctgcaatggtagtga

SEQ ID NO: 7438473 - DNA, 22 bp, Homo sapiens
ggtaggggaagacaagtgaaaa

SEQ ID NO: 7438474 - DNA, 22 bp, Homo sapiens
ggtaggggaagacaagtgaaaa

SEQ ID NO: 7438475 - DNA, 22 bp, Homo sapiens
gggtggctcctatgggcatagc

SEQ ID NO: 7438476 - DNA, 22 bp, Homo sapiens
gggtggctcctatgggcatagc

SEQ ID NO: 7438477 - DNA, 22 bp, Homo sapiens
gggtggctcctatgggcatagc

SEQ ID NO: 7438478 - DNA, 22 bp, Homo sapiens
gggtggctcctatgggcatagc

SEQ ID NO: 7438479 - DNA, 22 bp, Homo sapiens
gggtggctgactgttttgtgga

SEQ ID NO: 7438480 - DNA, 22 bp, Homo sapiens
gggtggccttcatagctcaggg

SEQ ID NO: 7438481 - DNA, 22 bp, Homo sapiens
gggtggctaggtatcccccatt

SEQ ID NO: 7438482 - DNA, 22 bp, Homo sapiens
gggtggctcctatgggcatagc

SEQ ID NO: 7438483 - DNA, 22 bp, Homo sapiens
gggtggccttcatagctcaggg

SEQ ID NO: 7438484 - DNA, 22 bp, Homo sapiens
gggtggctaggtatcccccatt

SEQ ID NO: 7438485 - DNA, 22 bp, Homo sapiens
gggtggctaggtatcccccatt

SEQ ID NO: 7438486 - DNA, 21 bp, Homo sapiens
gggtggccgcatgggtgcgtg

SEQ ID NO: 7438487 - DNA, 21 bp, Homo sapiens
gggtggccgcatgggtgcgtg

SEQ ID NO: 7438488 - DNA, 21 bp, Homo sapiens
gggtggccgcatgggtgcgtg

SEQ ID NO: 7438489 - DNA, 22 bp, Homo sapiens
gggtggccttcatagctcaggg

SEQ ID NO: 7438490 - DNA, 22 bp, Homo sapiens
gggtggccttcatagctcaggg

SEQ ID NO: 7438491 - DNA, 22 bp, Homo sapiens
gggtggccttcatagctcaggg

SEQ ID NO: 7438492 - DNA, 22 bp, Homo sapiens
gggtggccttcatagctcaggg

SEQ ID NO: 7438493 - DNA, 22 bp, Homo sapiens
gggtggccttcatagctcaggg

SEQ ID NO: 7438494 - DNA, 22 bp, Homo sapiens
gggtggccttcatagctcaggg

SEQ ID NO: 7438495 - DNA, 22 bp, Homo sapiens
gggtggccttaggcaagtcact

SEQ ID NO: 7438496 - DNA, 22 bp, Homo sapiens
gggtggccttaggcaagtcact

SEQ ID NO: 7438497 - DNA, 22 bp, Homo sapiens
gggtggcatctctctgagctgt

SEQ ID NO: 7438498 - DNA, 22 bp, Homo sapiens
gggtggcatctctctgagctgt

SEQ ID NO: 7438499 - DNA, 22 bp, Homo sapiens
gggtggcatctctctgagctgt

SEQ ID NO: 7438500 - DNA, 22 bp, Homo sapiens
gggtggcatagggtgatggctt

SEQ ID NO: 7438501 - DNA, 22 bp, Homo sapiens
gggtggcatagggtgatggctt

SEQ ID NO: 7438502 - DNA, 22 bp, Homo sapiens
gggtggcatagggtgatggctt

SEQ ID NO: 7438503 - DNA, 22 bp, Homo sapiens
gggtggcatagggtgatggctt

SEQ ID NO: 7438504 - DNA, 22 bp, Homo sapiens
gggtggcatagggtgatggctt

SEQ ID NO: 7438505 - DNA, 22 bp, Homo sapiens
gggtggcatagggtgatggctt

SEQ ID NO: 7438506 - DNA, 22 bp, Homo sapiens
gggtggcatagggtgatggctt

SEQ ID NO: 7438507 - DNA, 22 bp, Homo sapiens
ggtcacccatgatcacatcacc

SEQ ID NO: 7438508 - DNA, 22 bp, Homo sapiens
ggtcacccatgatcacatcacc

SEQ ID NO: 7438509 - DNA, 22 bp, Homo sapiens
ggtcacattctgaggaatcagg

SEQ ID NO: 7438510 - DNA, 22 bp, Homo sapiens
ggtcacattctgaggtattagg

SEQ ID NO: 7438511 - DNA, 22 bp, Homo sapiens
ggtcacattctgaggtattagg

SEQ ID NO: 7438512 - DNA, 22 bp, Homo sapiens
ggtcacattctgaggaatcagg

SEQ ID NO: 7438513 - DNA, 22 bp, Homo sapiens
ggtcacatgtgatttgagccaa

SEQ ID NO: 7438514 - DNA, 23 bp, Homo sapiens
ggtcacatgtgagattaaacttg

SEQ ID NO: 7438515 - DNA, 22 bp, Homo sapiens
ggtcacatgtgatttgagccaa

SEQ ID NO: 7438516 - DNA, 23 bp, Homo sapiens
ggtcacatgtgagattaaacttg

SEQ ID NO: 7438517 - DNA, 22 bp, Homo sapiens
ggtcacatgcggggctgtagcc

SEQ ID NO: 7438518 - DNA, 22 bp, Homo sapiens
ggtcacatggttgagcttgatc

SEQ ID NO: 7438519 - DNA, 22 bp, Homo sapiens
ggtcacatggttgagcttgatc

SEQ ID NO: 7438520 - DNA, 22 bp, Homo sapiens
ggtcacatgcggggctgtagcc

SEQ ID NO: 7438521 - DNA, 22 bp, Homo sapiens
ggtcacatctaaatggagcatt

SEQ ID NO: 7438522 - DNA, 22 bp, Homo sapiens
ggtcacatgagatgctgccctc

SEQ ID NO: 7438523 - DNA, 22 bp, Homo sapiens
ggtaggggcagggccaagctgt

SEQ ID NO: 7438524 - DNA, 22 bp, Homo sapiens
ggtaggggcagggccaagctgt

SEQ ID NO: 7438525 - DNA, 22 bp, Homo sapiens
ggtagtacatggaagagtacac

SEQ ID NO: 7438526 - DNA, 22 bp, Homo sapiens
ggtagtcatggatagctatgag

SEQ ID NO: 7438527 - DNA, 22 bp, Homo sapiens
ggtagtagaaggtatgctttaa

SEQ ID NO: 7438528 - DNA, 22 bp, Homo sapiens
ggtagtatggattccctctctc

SEQ ID NO: 7438529 - DNA, 22 bp, Homo sapiens
ggtagtcagtgttagtttgatt

SEQ ID NO: 7438530 - DNA, 22 bp, Homo sapiens
ggtcacatctaaatggagcatt

SEQ ID NO: 7438531 - DNA, 22 bp, Homo sapiens
ggtcacatgagatgctgccctc

SEQ ID NO: 7438532 - DNA, 22 bp, Homo sapiens
ggtcacatctaaatggagcatt

SEQ ID NO: 7438533 - DNA, 21 bp, Homo sapiens
ggtagtattatgtctctctgt

SEQ ID NO: 7438534 - DNA, 22 bp, Homo sapiens
ggtcacatatcctcggtttgga

SEQ ID NO: 7438535 - DNA, 19 bp, Homo sapiens
ggtcacaggggttacaagg

SEQ ID NO: 7438536 - DNA, 19 bp, Homo sapiens
ggtcacaggggttacaagg

SEQ ID NO: 7438537 - DNA, 22 bp, Homo sapiens
ggtcacatatcctcggtttgga

SEQ ID NO: 7438538 - DNA, 19 bp, Homo sapiens
ggtcacaggggttacaagg

SEQ ID NO: 7438539 - DNA, 22 bp, Homo sapiens
ggtcactgagctgtaattctgt

SEQ ID NO: 7438540 - DNA, 18 bp, Homo sapiens
ggtcactgagatgctact

SEQ ID NO: 7438541 - DNA, 18 bp, Homo sapiens
ggtcactgagatgctact

SEQ ID NO: 7438542 - DNA, 18 bp, Homo sapiens
ggtcactgagatgctact

SEQ ID NO: 7438543 - DNA, 22 bp, Homo sapiens
ggtcacgtgaccgcacctgcct

SEQ ID NO: 7438544 - DNA, 22 bp, Homo sapiens
ggtcactccaccttctccacct

SEQ ID NO: 7438545 - DNA, 22 bp, Homo sapiens
ggtcactgatgtgttccctggg

SEQ ID NO: 7438546 - DNA, 22 bp, Homo sapiens
ggtcactgagctgtaattctgt

SEQ ID NO: 7438547 - DNA, 22 bp, Homo sapiens
ggtcactgagctgtaattctgt

SEQ ID NO: 7438548 - DNA, 22 bp, Homo sapiens
ggtcactgccctcccttttgca

SEQ ID NO: 7438549 - DNA, 22 bp, Homo sapiens
ggtcactgccctcccttttgca

SEQ ID NO: 7438550 - DNA, 22 bp, Homo sapiens
ggtcactgatgtgttccctggg

SEQ ID NO: 7438551 - DNA, 22 bp, Homo sapiens
ggtcactgtcttctgggctctg

SEQ ID NO: 7438552 - DNA, 22 bp, Homo sapiens
ggtcactggtctctgcttccat

SEQ ID NO: 7438553 - DNA, 20 bp, Homo sapiens
ggtcactgtggctgcaggat

SEQ ID NO: 7438554 - DNA, 22 bp, Homo sapiens
ggtcactgtctgaggtactgga

SEQ ID NO: 7438555 - DNA, 22 bp, Homo sapiens
ggtcactggtctctgcttccat

SEQ ID NO: 7438556 - DNA, 23 bp, Homo sapiens
ggtcactggcaagcagtgcagag

SEQ ID NO: 7438557 - DNA, 23 bp, Homo sapiens
ggtcactggcaagcagtgcagag

SEQ ID NO: 7438558 - DNA, 22 bp, Homo sapiens
ggtcactggtctctgcttccat

SEQ ID NO: 7438559 - DNA, 22 bp, Homo sapiens
ggtcactggtctctgcttccat

SEQ ID NO: 7438560 - DNA, 22 bp, Homo sapiens
ggtcagaggggattccttggga

SEQ ID NO: 7438561 - DNA, 22 bp, Homo sapiens
ggtcagaggggattccttggga

SEQ ID NO: 7438562 - DNA, 22 bp, Homo sapiens
ggtcagaggaggaataggacat

SEQ ID NO: 7438563 - DNA, 22 bp, Homo sapiens
ggtcagaggaggaataggacat

SEQ ID NO: 7438564 - DNA, 22 bp, Homo sapiens
ggtcagaggaggaataggacat

SEQ ID NO: 7438565 - DNA, 22 bp, Homo sapiens
ggtcagagggtgggctgcctgt

SEQ ID NO: 7438566 - DNA, 22 bp, Homo sapiens
ggtcagagggtgggctgcctgt

SEQ ID NO: 7438567 - DNA, 22 bp, Homo sapiens
ggtcagagggtgggctgcctgt

SEQ ID NO: 7438568 - DNA, 22 bp, Homo sapiens
ggtcagagccgttagcattcag

SEQ ID NO: 7438569 - DNA, 22 bp, Homo sapiens
ggtcagagccgttagcattcag

SEQ ID NO: 7438570 - DNA, 22 bp, Homo sapiens
ggtcagagccgttagcattcag

SEQ ID NO: 7438571 - DNA, 22 bp, Homo sapiens
ggtcagagccatggagcaactg

SEQ ID NO: 7438572 - DNA, 22 bp, Homo sapiens
ggtcagagccatggagcaactg

SEQ ID NO: 7438573 - DNA, 22 bp, Homo sapiens
ggtcagagccatggagcaactg

SEQ ID NO: 7438574 - DNA, 22 bp, Homo sapiens
ggtcagagctggagagataggg

SEQ ID NO: 7438575 - DNA, 22 bp, Homo sapiens
ggtcagagctggagagataggg

SEQ ID NO: 7438576 - DNA, 22 bp, Homo sapiens
ggtcagagctggagagataggg

SEQ ID NO: 7438577 - DNA, 22 bp, Homo sapiens
ggtcagagctggagagataggg

SEQ ID NO: 7438578 - DNA, 22 bp, Homo sapiens
ggtcagagaaaagtagggtgtt

SEQ ID NO: 7438579 - DNA, 22 bp, Homo sapiens
ggtcagagaaaagtagggtgtt

SEQ ID NO: 7438580 - DNA, 22 bp, Homo sapiens
ggtcagaattaggtctagagta

SEQ ID NO: 7438581 - DNA, 22 bp, Homo sapiens
ggtcagagaaaagtagggtgtt

SEQ ID NO: 7438582 - DNA, 22 bp, Homo sapiens
ggtcagagaaaagtagggtgtt

SEQ ID NO: 7438583 - DNA, 19 bp, Homo sapiens
ggtcagagagatccaggct

SEQ ID NO: 7438584 - DNA, 19 bp, Homo sapiens
ggtcagagagatccaggct

SEQ ID NO: 7438585 - DNA, 22 bp, Homo sapiens
ggtcagagaaagtggtagtaga

SEQ ID NO: 7438586 - DNA, 19 bp, Homo sapiens
ggtcagagagatccaggct

SEQ ID NO: 7438587 - DNA, 22 bp, Homo sapiens
ggtcagaagtgcaaaatcagtt

SEQ ID NO: 7438588 - DNA, 22 bp, Homo sapiens
ggtcagaagtgcaaaatcagtt

SEQ ID NO: 7438589 - DNA, 22 bp, Homo sapiens
ggtcagaaggcctcggcaggaa

SEQ ID NO: 7438590 - DNA, 22 bp, Homo sapiens
ggtcactttaccccttggagcc

SEQ ID NO: 7438591 - DNA, 22 bp, Homo sapiens
ggtcagaacaagggtaaataaa

SEQ ID NO: 7438592 - DNA, 22 bp, Homo sapiens
ggtcagaacaagcaaataatag

SEQ ID NO: 7438593 - DNA, 22 bp, Homo sapiens
ggtcacttcagataactggtgt

SEQ ID NO: 7438594 - DNA, 22 bp, Homo sapiens
ggtcacttctttcatcgaaact

SEQ ID NO: 7438595 - DNA, 22 bp, Homo sapiens
ggtcagaaggcagttaaacaaa

SEQ ID NO: 7438596 - DNA, 22 bp, Homo sapiens
ggtcagaaggattctgggaaat

SEQ ID NO: 7438597 - DNA, 20 bp, Homo sapiens
ggtccttgtcacaaggagag

SEQ ID NO: 7438598 - DNA, 22 bp, Homo sapiens
ggtccttgggtctcctgtgttt

SEQ ID NO: 7438599 - DNA, 22 bp, Homo sapiens
ggtccttgggtctcctgtgttt

SEQ ID NO: 7438600 - DNA, 22 bp, Homo sapiens
ggtccttgggtctcctgtgttt

SEQ ID NO: 7438601 - DNA, 22 bp, Homo sapiens
ggtcgagtcacttgttgccttt

SEQ ID NO: 7438602 - DNA, 22 bp, Homo sapiens
ggtcctttgccatctctccacc

SEQ ID NO: 7438603 - DNA, 22 bp, Homo sapiens
ggtcgagtcacttgttgccttt

SEQ ID NO: 7438604 - DNA, 22 bp, Homo sapiens
ggtccttgtgtctctatggccc

SEQ ID NO: 7438605 - DNA, 22 bp, Homo sapiens
ggtcctttgaaaggggtgtgtc

SEQ ID NO: 7438606 - DNA, 22 bp, Homo sapiens
ggtcctttgccatctctccacc

SEQ ID NO: 7438607 - DNA, 22 bp, Homo sapiens
ggtcgctgtgtaggttcagcta

SEQ ID NO: 7438608 - DNA, 22 bp, Homo sapiens
ggtcgctgtgtaggttcagcta

SEQ ID NO: 7438609 - DNA, 22 bp, Homo sapiens
ggtcgccagccctagtctgctg

SEQ ID NO: 7438610 - DNA, 22 bp, Homo sapiens
ggtcgccagccctagtctgctg

SEQ ID NO: 7438611 - DNA, 22 bp, Homo sapiens
ggtcgcggctccggagacgccc

SEQ ID NO: 7438612 - DNA, 22 bp, Homo sapiens
ggtcgctccttcactttcacaa

SEQ ID NO: 7438613 - DNA, 22 bp, Homo sapiens
ggtcgctgagctagcatctgca

SEQ ID NO: 7438614 - DNA, 22 bp, Homo sapiens
ggtcgctgtgtaggttcagcta

SEQ ID NO: 7438615 - DNA, 22 bp, Homo sapiens
ggtcgctgtgtaggttcagcta

SEQ ID NO: 7438616 - DNA, 22 bp, Homo sapiens
ggtcgctgtgtaggttcagcta

SEQ ID NO: 7438617 - DNA, 22 bp, Homo sapiens
ggtcgctgtgtaggttcagcta

SEQ ID NO: 7438618 - DNA, 22 bp, Homo sapiens
ggtcgctgtgtaggttcagcta

SEQ ID NO: 7438619 - DNA, 22 bp, Homo sapiens
ggtctcagactggcaggcagtg

SEQ ID NO: 7438620 - DNA, 22 bp, Homo sapiens
ggtctcagactggcaggcagtg

SEQ ID NO: 7438621 - DNA, 22 bp, Homo sapiens
ggtctcagactggcaggcagtg

SEQ ID NO: 7438622 - DNA, 22 bp, Homo sapiens
ggtctagatcaagaacagaact

SEQ ID NO: 7438623 - DNA, 22 bp, Homo sapiens
ggtctaggtgtaattgtttact

SEQ ID NO: 7438624 - DNA, 22 bp, Homo sapiens
ggtctcaaggaatataatgagt

SEQ ID NO: 7438625 - DNA, 22 bp, Homo sapiens
ggtctagatttctgttataggg

SEQ ID NO: 7438626 - DNA, 22 bp, Homo sapiens
ggtctagatgaaattaaatgtt

SEQ ID NO: 7438627 - DNA, 22 bp, Homo sapiens
ggtctagacgaattcctatcag

SEQ ID NO: 7438628 - DNA, 22 bp, Homo sapiens
ggtctagagcttgattggcagc

SEQ ID NO: 7438629 - DNA, 22 bp, Homo sapiens
ggtctagagtggggcctggaaa

SEQ ID NO: 7438630 - DNA, 22 bp, Homo sapiens
ggtctagaggatgttcctttcc

SEQ ID NO: 7438631 - DNA, 22 bp, Homo sapiens
ggtcggggatggccaggctccc

SEQ ID NO: 7438632 - DNA, 22 bp, Homo sapiens
ggtcgtctgccctgtccaacgt

SEQ ID NO: 7438633 - DNA, 22 bp, Homo sapiens
ggtctaaaatgagtcttcctag

SEQ ID NO: 7438634 - DNA, 22 bp, Homo sapiens
ggtcggggatggccaggctccc

SEQ ID NO: 7438635 - DNA, 22 bp, Homo sapiens
ggtcggggatggccaggctccc

SEQ ID NO: 7438636 - DNA, 22 bp, Homo sapiens
ggtcgggcactctccagggctg

SEQ ID NO: 7438637 - DNA, 22 bp, Homo sapiens
ggtcggggatggccaggctccc

SEQ ID NO: 7438638 - DNA, 22 bp, Homo sapiens
ggtcggggatggccaggctccc

SEQ ID NO: 7438639 - DNA, 22 bp, Homo sapiens
ggtcggggatggccaggctccc

SEQ ID NO: 7438640 - DNA, 18 bp, Homo sapiens
ggtcctgggcctggctca

SEQ ID NO: 7438641 - DNA, 18 bp, Homo sapiens
ggtcctgggcctggctca

SEQ ID NO: 7438642 - DNA, 20 bp, Homo sapiens
ggtcctgtactctcattgaa

SEQ ID NO: 7438643 - DNA, 22 bp, Homo sapiens
ggtccctgggtcttcttacgtc

SEQ ID NO: 7438644 - DNA, 22 bp, Homo sapiens
ggtccctggttccctctgagct

SEQ ID NO: 7438645 - DNA, 22 bp, Homo sapiens
ggtccctggggaactaggctgt

SEQ ID NO: 7438646 - DNA, 22 bp, Homo sapiens
ggtccctgggtcttcttacgtc

SEQ ID NO: 7438647 - DNA, 22 bp, Homo sapiens
ggtccctggttccctctgagct

SEQ ID NO: 7438648 - DNA, 22 bp, Homo sapiens
ggtccctggttccctctgagct

SEQ ID NO: 7438649 - DNA, 19 bp, Homo sapiens
ggtcagcagtttagggtct

SEQ ID NO: 7438650 - DNA, 22 bp, Homo sapiens
ggtccctggggaactaggctgt

SEQ ID NO: 7438651 - DNA, 22 bp, Homo sapiens
ggtccctggggaactaggctgt

SEQ ID NO: 7438652 - DNA, 22 bp, Homo sapiens
ggtccctggaagtccctcttct

SEQ ID NO: 7438653 - DNA, 22 bp, Homo sapiens
ggtcagcagtgcagggcagagc

SEQ ID NO: 7438654 - DNA, 22 bp, Homo sapiens
ggtcagcagtgcagggcagagc

SEQ ID NO: 7438655 - DNA, 22 bp, Homo sapiens
ggtcagcagtgcagggcagagc

SEQ ID NO: 7438656 - DNA, 19 bp, Homo sapiens
ggtcagcagtttagggtct

SEQ ID NO: 7438657 - DNA, 22 bp, Homo sapiens
ggtcagcagtttctttgaattt

SEQ ID NO: 7438658 - DNA, 22 bp, Homo sapiens
ggtcagcagtgcagggcagagc

SEQ ID NO: 7438659 - DNA, 22 bp, Homo sapiens
ggtcagcagtgcagggcagagc

SEQ ID NO: 7438660 - DNA, 22 bp, Homo sapiens
ggtcagcaggtccagccagtgc

SEQ ID NO: 7438661 - DNA, 22 bp, Homo sapiens
ggtcagcaggtccagccagtgc

SEQ ID NO: 7438662 - DNA, 22 bp, Homo sapiens
ggtcagcagccatgccatgaat

SEQ ID NO: 7438663 - DNA, 22 bp, Homo sapiens
ggtcagaggtcacaagctggca

SEQ ID NO: 7438664 - DNA, 22 bp, Homo sapiens
ggtcagaggtcccagaagaagc

SEQ ID NO: 7438665 - DNA, 22 bp, Homo sapiens
ggtcagcagccatgccatgaat

SEQ ID NO: 7438666 - DNA, 22 bp, Homo sapiens
ggtcagcagccatgccatgaat

SEQ ID NO: 7438667 - DNA, 22 bp, Homo sapiens
ggtcagaggtcccagaagaagc

SEQ ID NO: 7438668 - DNA, 22 bp, Homo sapiens
ggtctcctgggttgaccagctg

SEQ ID NO: 7438669 - DNA, 22 bp, Homo sapiens
ggtctctctgctttcccccaga

SEQ ID NO: 7438670 - DNA, 22 bp, Homo sapiens
ggtctctctgctttcccccaga

SEQ ID NO: 7438671 - DNA, 22 bp, Homo sapiens
ggtctctgaacttccactgcgc

SEQ ID NO: 7438672 - DNA, 22 bp, Homo sapiens
ggtctctgaacttccactgcgc

SEQ ID NO: 7438673 - DNA, 20 bp, Homo sapiens
ggtctctgacagctggttgc

SEQ ID NO: 7438674 - DNA, 20 bp, Homo sapiens
ggtctctgacagctggttgc

SEQ ID NO: 7438675 - DNA, 22 bp, Homo sapiens
ggtctccattccttcatctcac

SEQ ID NO: 7438676 - DNA, 22 bp, Homo sapiens
ggtctccattccttcatctcac

SEQ ID NO: 7438677 - DNA, 22 bp, Homo sapiens
ggtctcccttgctggttggctg

SEQ ID NO: 7438678 - DNA, 22 bp, Homo sapiens
ggtctccagctgggaccctgca

SEQ ID NO: 7438679 - DNA, 22 bp, Homo sapiens
ggtctccagctgggaccctgca

SEQ ID NO: 7438680 - DNA, 22 bp, Homo sapiens
ggtctcctgaggctgccacacc

SEQ ID NO: 7438681 - DNA, 22 bp, Homo sapiens
ggtctcctgaggctgccacacc

SEQ ID NO: 7438682 - DNA, 22 bp, Homo sapiens
ggtctcctgaggctgccacacc

SEQ ID NO: 7438683 - DNA, 22 bp, Homo sapiens
ggtctcctgaggctgccacacc

SEQ ID NO: 7438684 - DNA, 22 bp, Homo sapiens
ggtctcctgacctttagtccct

SEQ ID NO: 7438685 - DNA, 22 bp, Homo sapiens
ggtctctgttgcctccatcaag

SEQ ID NO: 7438686 - DNA, 22 bp, Homo sapiens
ggtctctgtcactgagtggccc

SEQ ID NO: 7438687 - DNA, 22 bp, Homo sapiens
ggtctctgtcactgagtggccc

SEQ ID NO: 7438688 - DNA, 22 bp, Homo sapiens
ggtctctgctcagatgccactt

SEQ ID NO: 7438689 - DNA, 22 bp, Homo sapiens
ggtctctgctcagatgccactt

SEQ ID NO: 7438690 - DNA, 22 bp, Homo sapiens
ggtctctggccttggagattga

SEQ ID NO: 7438691 - DNA, 22 bp, Homo sapiens
ggtctctgagtgaggacctggg

SEQ ID NO: 7438692 - DNA, 22 bp, Homo sapiens
ggtctctgagtgaggacctggg

SEQ ID NO: 7438693 - DNA, 22 bp, Homo sapiens
ggtctctgagtgaggacctggg

SEQ ID NO: 7438694 - DNA, 22 bp, Homo sapiens
ggtctctgacttagagatggat

SEQ ID NO: 7438695 - DNA, 22 bp, Homo sapiens
ggtctctgacttagagatggat

SEQ ID NO: 7438696 - DNA, 22 bp, Homo sapiens
ggtctctgacttagagatggat

SEQ ID NO: 7438697 - DNA, 19 bp, Homo sapiens
ggtctcagtgcagctgcag

SEQ ID NO: 7438698 - DNA, 19 bp, Homo sapiens
ggtctcagtgcagctgcag

SEQ ID NO: 7438699 - DNA, 19 bp, Homo sapiens
ggtctcagtgcagctgcag

SEQ ID NO: 7438700 - DNA, 22 bp, Homo sapiens
ggtctcagtgaaggagtgtgct

SEQ ID NO: 7438701 - DNA, 22 bp, Homo sapiens
ggtctcagtgaaggagtgtgct

SEQ ID NO: 7438702 - DNA, 22 bp, Homo sapiens
ggtctcaggtagggcctaggaa

SEQ ID NO: 7438703 - DNA, 22 bp, Homo sapiens
ggtctcaggtagggcctaggaa

SEQ ID NO: 7438704 - DNA, 22 bp, Homo sapiens
ggtctcaggtagggcctaggaa

SEQ ID NO: 7438705 - DNA, 22 bp, Homo sapiens
ggtctcaggtagggcctaggaa

SEQ ID NO: 7438706 - DNA, 22 bp, Homo sapiens
ggtctccaaagcttaggactac

SEQ ID NO: 7438707 - DNA, 22 bp, Homo sapiens
ggtctccaaagcttaggactac

SEQ ID NO: 7438708 - DNA, 22 bp, Homo sapiens
ggtctccaaagcttaggactac

SEQ ID NO: 7438709 - DNA, 22 bp, Homo sapiens
ggtctccaaagctgcattgatg

SEQ ID NO: 7438710 - DNA, 22 bp, Homo sapiens
ggtctccaaagctgcattgatg

SEQ ID NO: 7438711 - DNA, 22 bp, Homo sapiens
ggtctcatgtcctatgtgctta

SEQ ID NO: 7438712 - DNA, 22 bp, Homo sapiens
ggtctcatctttcagcgtcgag

SEQ ID NO: 7438713 - DNA, 19 bp, Homo sapiens
ggtctcagtgcagctgcag

SEQ ID NO: 7438714 - DNA, 22 bp, Homo sapiens
ggtctcagcagttgctttgact

SEQ ID NO: 7438715 - DNA, 22 bp, Homo sapiens
ggtctcagccctcgccagcagc

SEQ ID NO: 7438716 - DNA, 22 bp, Homo sapiens
ggtctcagccctcgccagcagc

SEQ ID NO: 7438717 - DNA, 22 bp, Homo sapiens
ggtctcagccctcgccagcagc

SEQ ID NO: 7438718 - DNA, 22 bp, Homo sapiens
ggtctcagccctcgccagcagc

SEQ ID NO: 7438719 - DNA, 22 bp, Homo sapiens
ggtctcagatctttattaaggc

SEQ ID NO: 7438720 - DNA, 22 bp, Homo sapiens
ggtctcagaggtttctgctcag

SEQ ID NO: 7438721 - DNA, 22 bp, Homo sapiens
ggtctcagaggtttctgctcag

SEQ ID NO: 7438722 - DNA, 22 bp, Homo sapiens
ggtctcagaggtttctgctcag

SEQ ID NO: 7438723 - DNA, 22 bp, Homo sapiens
ggtctcagctggagtccttggt

SEQ ID NO: 7438724 - DNA, 22 bp, Homo sapiens
ggtctcagctggagtccttggt

SEQ ID NO: 7438725 - DNA, 22 bp, Homo sapiens
ggtctcagctggagtccttggt

SEQ ID NO: 7438726 - DNA, 22 bp, Homo sapiens
ggtctcagctggagtccttggt

SEQ ID NO: 7438727 - DNA, 22 bp, Homo sapiens
ggtctcaggagactggagagca

SEQ ID NO: 7438728 - DNA, 22 bp, Homo sapiens
ggtctcaggagactggagagca

SEQ ID NO: 7438729 - DNA, 22 bp, Homo sapiens
ggtctcaggagactggagagca

SEQ ID NO: 7438730 - DNA, 22 bp, Homo sapiens
ggtctcaggtagggcctaggaa

SEQ ID NO: 7438731 - DNA, 22 bp, Homo sapiens
ggtctcaggtagggcctaggaa

SEQ ID NO: 7438732 - DNA, 22 bp, Homo sapiens
gtgcagttcccaaggtcacaca

SEQ ID NO: 7438733 - DNA, 22 bp, Homo sapiens
gtgcagttgaagcatggggaga

SEQ ID NO: 7438734 - DNA, 19 bp, Homo sapiens
gtgcagttcagagttcaat

SEQ ID NO: 7438735 - DNA, 22 bp, Homo sapiens
gtgcagtgtgtaatccaggaac

SEQ ID NO: 7438736 - DNA, 22 bp, Homo sapiens
gtgcagtgtgtaatccaggaac

SEQ ID NO: 7438737 - DNA, 22 bp, Homo sapiens
gtgcagttcccaaggtcacaca

SEQ ID NO: 7438738 - DNA, 22 bp, Homo sapiens
gtgcagttgagacaataggctg

SEQ ID NO: 7438739 - DNA, 22 bp, Homo sapiens
gtgcagttgtggacatgacaac

SEQ ID NO: 7438740 - DNA, 22 bp, Homo sapiens
gtgcagttgatagttttagtga

SEQ ID NO: 7438741 - DNA, 22 bp, Homo sapiens
gtgcagttgaagcatggggaga

SEQ ID NO: 7438742 - DNA, 22 bp, Homo sapiens
gtgcagttgagacaataggctg

SEQ ID NO: 7438743 - DNA, 22 bp, Homo sapiens
gtgcagttcttgtaacatgctg

SEQ ID NO: 7438744 - DNA, 22 bp, Homo sapiens
gtgcagttcttgtaacatgctg

SEQ ID NO: 7438745 - DNA, 22 bp, Homo sapiens
gtgcataatttggcaatagaat

SEQ ID NO: 7438746 - DNA, 22 bp, Homo sapiens
gtgcataatttggcaatagaat

SEQ ID NO: 7438747 - DNA, 22 bp, Homo sapiens
gtgcataaatagcagagctgtg

SEQ ID NO: 7438748 - DNA, 22 bp, Homo sapiens
gtgcataaatagcagagctgtg

SEQ ID NO: 7438749 - DNA, 22 bp, Homo sapiens
gtgcataaatagcagagctgtg

SEQ ID NO: 7438750 - DNA, 22 bp, Homo sapiens
gtgcatactttattttaatact

SEQ ID NO: 7438751 - DNA, 22 bp, Homo sapiens
gtgcatatatatgggagggagc

SEQ ID NO: 7438752 - DNA, 22 bp, Homo sapiens
gtgcatatatgcacatatgtgt

SEQ ID NO: 7438753 - DNA, 22 bp, Homo sapiens
gtgcatatatgcacatatgtgt

SEQ ID NO: 7438754 - DNA, 22 bp, Homo sapiens
gtgcatatatgtgcagcatcaa

SEQ ID NO: 7438755 - DNA, 22 bp, Homo sapiens
gtgcatatggttacagcaccgc

SEQ ID NO: 7438756 - DNA, 22 bp, Homo sapiens
gtgcatatgtgtgtatacaaac

SEQ ID NO: 7438757 - DNA, 19 bp, Homo sapiens
gtgcattccaaagcaccat

SEQ ID NO: 7438758 - DNA, 22 bp, Homo sapiens
gtgcatatgtgtgtatacaaac

SEQ ID NO: 7438759 - DNA, 22 bp, Homo sapiens
gtgcatatgtacctgtgatcat

SEQ ID NO: 7438760 - DNA, 22 bp, Homo sapiens
gtgcatatatgtgcagcatcaa

SEQ ID NO: 7438761 - DNA, 22 bp, Homo sapiens
gtgcatatgtgtgtatacaaac

SEQ ID NO: 7438762 - DNA, 22 bp, Homo sapiens
gtgcattccaccgtgcaggttg

SEQ ID NO: 7438763 - DNA, 22 bp, Homo sapiens
gtgcattccaaggcactttaga

SEQ ID NO: 7438764 - DNA, 22 bp, Homo sapiens
gtgcattctatcaaatggtaca

SEQ ID NO: 7438765 - DNA, 22 bp, Homo sapiens
gtgcattctctgattttcacaa

SEQ ID NO: 7438766 - DNA, 22 bp, Homo sapiens
gtgcatttaggtcacatgatgt

SEQ ID NO: 7438767 - DNA, 22 bp, Homo sapiens
gtgcatttatatttgcctttgg

SEQ ID NO: 7438768 - DNA, 22 bp, Homo sapiens
gtgcatttaggtcacatgatgt

SEQ ID NO: 7438769 - DNA, 22 bp, Homo sapiens
gtgccaatgatatcctataatg

SEQ ID NO: 7438770 - DNA, 22 bp, Homo sapiens
gtgccaaggtgctaagggcatg

SEQ ID NO: 7438771 - DNA, 22 bp, Homo sapiens
gtgccaatcgtgcattatattg

SEQ ID NO: 7438772 - DNA, 22 bp, Homo sapiens
gtgccaatccccaaaccctgct

SEQ ID NO: 7438773 - DNA, 19 bp, Homo sapiens
gtgccaaatgtgttataca

SEQ ID NO: 7438774 - DNA, 22 bp, Homo sapiens
gtgccaaagaacataaggctga

SEQ ID NO: 7438775 - DNA, 22 bp, Homo sapiens
gtgcatttgtgcatgcacatgt

SEQ ID NO: 7438776 - DNA, 22 bp, Homo sapiens
gtgccaaaagctataatttggt

SEQ ID NO: 7438777 - DNA, 22 bp, Homo sapiens
gtgccacagaccaccgtgctgg

SEQ ID NO: 7438778 - DNA, 22 bp, Homo sapiens
gtgccaattccacacccaatac

SEQ ID NO: 7438779 - DNA, 22 bp, Homo sapiens
gtgccaatgcactctagcctgg

SEQ ID NO: 7438780 - DNA, 22 bp, Homo sapiens
gtgccacatggcctaatagaga

SEQ ID NO: 7438781 - DNA, 22 bp, Homo sapiens
gtgccacatggcctaatagaga

SEQ ID NO: 7438782 - DNA, 22 bp, Homo sapiens
gtgccacatggtccatgtatca

SEQ ID NO: 7438783 - DNA, 22 bp, Homo sapiens
gtgccaccagatgctgttgcta

SEQ ID NO: 7438784 - DNA, 22 bp, Homo sapiens
gtgccaccagatgctgttgcta

SEQ ID NO: 7438785 - DNA, 22 bp, Homo sapiens
gtgccacctctgccccagaggg

SEQ ID NO: 7438786 - DNA, 22 bp, Homo sapiens
gtgccacctctgccccagaggg

SEQ ID NO: 7438787 - DNA, 22 bp, Homo sapiens
gtgctagggttggagtggggct

SEQ ID NO: 7438788 - DNA, 22 bp, Homo sapiens
gtgctagggacaaagcagtgaa

SEQ ID NO: 7438789 - DNA, 22 bp, Homo sapiens
gtgctagggacaaagcagtgaa

SEQ ID NO: 7438790 - DNA, 22 bp, Homo sapiens
gtgctagggttggagtggggct

SEQ ID NO: 7438791 - DNA, 22 bp, Homo sapiens
gtgctaggtactttgatcggtt

SEQ ID NO: 7438792 - DNA, 22 bp, Homo sapiens
gtgctaggtgttggagatacag

SEQ ID NO: 7438793 - DNA, 22 bp, Homo sapiens
gtgctagggacaaagcagtgaa

SEQ ID NO: 7438794 - DNA, 22 bp, Homo sapiens
gtgctaggattacaggcatggg

SEQ ID NO: 7438795 - DNA, 22 bp, Homo sapiens
gtgccacctctgccccagaggg

SEQ ID NO: 7438796 - DNA, 22 bp, Homo sapiens
gtgctaggattacaggcatggg

SEQ ID NO: 7438797 - DNA, 22 bp, Homo sapiens
gtgcatttgtgcatgcacatgt

SEQ ID NO: 7438798 - DNA, 22 bp, Homo sapiens
gtgcatttgtgcatgcacatgt

SEQ ID NO: 7438799 - DNA, 22 bp, Homo sapiens
gtgcatttggtgactctcaccc

SEQ ID NO: 7438800 - DNA, 22 bp, Homo sapiens
gtgcatttggtgactctcaccc

SEQ ID NO: 7438801 - DNA, 22 bp, Homo sapiens
gtgcatttggtgactctcaccc

SEQ ID NO: 7438802 - DNA, 22 bp, Homo sapiens
gtgcatttgacgaatactcact

SEQ ID NO: 7438803 - DNA, 22 bp, Homo sapiens
gtgcatttgacgaatactcact

SEQ ID NO: 7438804 - DNA, 22 bp, Homo sapiens
gtgcatttctcatacactaaat

SEQ ID NO: 7438805 - DNA, 22 bp, Homo sapiens
gtgcatttctcatacactaaat

SEQ ID NO: 7438806 - DNA, 22 bp, Homo sapiens
gtgcatttatatttgcctttgg

SEQ ID NO: 7438807 - DNA, 22 bp, Homo sapiens
gtgcatttctcatacactaaat

SEQ ID NO: 7438808 - DNA, 22 bp, Homo sapiens
gtgcatttcaaggcacagctaa

SEQ ID NO: 7438809 - DNA, 20 bp, Homo sapiens
gtgcatttcacctgtactgt

SEQ ID NO: 7438810 - DNA, 20 bp, Homo sapiens
gtgcatttcacctgtactgt

SEQ ID NO: 7438811 - DNA, 22 bp, Homo sapiens
gtgcagaggacgtggcggcctc

SEQ ID NO: 7438812 - DNA, 22 bp, Homo sapiens
gtgcagaggacgtggcggcctc

SEQ ID NO: 7438813 - DNA, 22 bp, Homo sapiens
gtgcagaggacgtggcggcctc

SEQ ID NO: 7438814 - DNA, 22 bp, Homo sapiens
gtgcagaggacgtggcggcctc

SEQ ID NO: 7438815 - DNA, 22 bp, Homo sapiens
gtgcagaggacgtggcggcctc

SEQ ID NO: 7438816 - DNA, 22 bp, Homo sapiens
gtgcagaggacgtggcggcctc

SEQ ID NO: 7438817 - DNA, 21 bp, Homo sapiens
gtgcagaggaatgtagggggc

SEQ ID NO: 7438818 - DNA, 21 bp, Homo sapiens
gtgcagaggaatgtagggggc

SEQ ID NO: 7438819 - DNA, 21 bp, Homo sapiens
gtgcagaggaatgtagggggc

SEQ ID NO: 7438820 - DNA, 22 bp, Homo sapiens
gtgcagagcaagggctgagggc

SEQ ID NO: 7438821 - DNA, 22 bp, Homo sapiens
gtgcagagcaagggctgagggc

SEQ ID NO: 7438822 - DNA, 21 bp, Homo sapiens
gtgcagaggaatgtagggggc

SEQ ID NO: 7438823 - DNA, 21 bp, Homo sapiens
gtgcagaggaatgtagggggc

SEQ ID NO: 7438824 - DNA, 22 bp, Homo sapiens
gtgcagagcaagggctgagggc

SEQ ID NO: 7438825 - DNA, 22 bp, Homo sapiens
gtgcagagcaagggctgagggc

SEQ ID NO: 7438826 - DNA, 22 bp, Homo sapiens
gtgcagagcaagggctgagggc

SEQ ID NO: 7438827 - DNA, 22 bp, Homo sapiens
gtgcagagcaagggctgagggc

SEQ ID NO: 7438828 - DNA, 20 bp, Homo sapiens
gtgcagaggcagcctgtggg

SEQ ID NO: 7438829 - DNA, 20 bp, Homo sapiens
gtgcagaggcagcctgtggg

SEQ ID NO: 7438830 - DNA, 20 bp, Homo sapiens
gtgcagaggcagcctgtggg

SEQ ID NO: 7438831 - DNA, 20 bp, Homo sapiens
gtgcagaggcagcctgtggg

SEQ ID NO: 7438832 - DNA, 22 bp, Homo sapiens
gtgcagagtgctacattttatt

SEQ ID NO: 7438833 - DNA, 22 bp, Homo sapiens
gtgcagaggtcacaaaagtgaa

SEQ ID NO: 7438834 - DNA, 22 bp, Homo sapiens
gtgcagaggtcacaaaagtgaa

SEQ ID NO: 7438835 - DNA, 22 bp, Homo sapiens
gtgcagaggtcacaaaagtgaa

SEQ ID NO: 7438836 - DNA, 22 bp, Homo sapiens
gtgcagatcctgattgcagttc

SEQ ID NO: 7438837 - DNA, 20 bp, Homo sapiens
gtgcagatgtcctttcacac

SEQ ID NO: 7438838 - DNA, 22 bp, Homo sapiens
gtgcagatgttatgtttcaaaa

SEQ ID NO: 7438839 - DNA, 22 bp, Homo sapiens
gtgcagattcccgggcctctcc

SEQ ID NO: 7438840 - DNA, 22 bp, Homo sapiens
gtgcagagtgtctgtggactga

SEQ ID NO: 7438841 - DNA, 22 bp, Homo sapiens
gtgcagagtgtctgtggactga

SEQ ID NO: 7438842 - DNA, 22 bp, Homo sapiens
gtgcagatcctgattgcagttc

SEQ ID NO: 7438843 - DNA, 22 bp, Homo sapiens
gtgcagatcctgattgcagttc

SEQ ID NO: 7438844 - DNA, 22 bp, Homo sapiens
gtgcagtgagcagtgcagcacc

SEQ ID NO: 7438845 - DNA, 22 bp, Homo sapiens
gtgcagtgagcagtgcagcacc

SEQ ID NO: 7438846 - DNA, 22 bp, Homo sapiens
gtgcagtgagcagtgcagcacc

SEQ ID NO: 7438847 - DNA, 22 bp, Homo sapiens
gtgcagtgagcagtgcagcacc

SEQ ID NO: 7438848 - DNA, 22 bp, Homo sapiens
gtgcagtgaccctggagagctg

SEQ ID NO: 7438849 - DNA, 22 bp, Homo sapiens
gtgcagtgaccctggagagctg

SEQ ID NO: 7438850 - DNA, 22 bp, Homo sapiens
gtgcagtgaccctggagagctg

SEQ ID NO: 7438851 - DNA, 22 bp, Homo sapiens
gtgcagtgaccctggagagctg

SEQ ID NO: 7438852 - DNA, 22 bp, Homo sapiens
gtgcagtgaccctggagagctg

SEQ ID NO: 7438853 - DNA, 22 bp, Homo sapiens
gtgcagtactagagcaccagga

SEQ ID NO: 7438854 - DNA, 22 bp, Homo sapiens
gtgcagtgaaaaaagaatgtcc

SEQ ID NO: 7438855 - DNA, 22 bp, Homo sapiens
gtgcagggtagcgacggcagga

SEQ ID NO: 7438856 - DNA, 22 bp, Homo sapiens
gtgcaggtggatttgggctcaa

SEQ ID NO: 7438857 - DNA, 22 bp, Homo sapiens
gtgcaggtggatttgggctcaa

SEQ ID NO: 7438858 - DNA, 22 bp, Homo sapiens
gtgcaggtggctggtggcaccc

SEQ ID NO: 7438859 - DNA, 22 bp, Homo sapiens
gtgcaggtggctggtggcaccc

SEQ ID NO: 7438860 - DNA, 22 bp, Homo sapiens
gtgcaggtgttttggctgccag

SEQ ID NO: 7438861 - DNA, 22 bp, Homo sapiens
gtgcaggtgttttggctgccag

SEQ ID NO: 7438862 - DNA, 22 bp, Homo sapiens
gtgcaggtggttggcccagccg

SEQ ID NO: 7438863 - DNA, 22 bp, Homo sapiens
gtgcaggtgttttggctgccag

SEQ ID NO: 7438864 - DNA, 22 bp, Homo sapiens
gtgcaggtgttttggctgccag

SEQ ID NO: 7438865 - DNA, 23 bp, Homo sapiens
gtgagcagcccactaggaatgcc

SEQ ID NO: 7438866 - DNA, 22 bp, Homo sapiens
gtgagagaaattggagggaatg

SEQ ID NO: 7438867 - DNA, 23 bp, Homo sapiens
gtgagcagcccactaggaatgcc

SEQ ID NO: 7438868 - DNA, 22 bp, Homo sapiens
gtgagagaatttgagttaaatt

SEQ ID NO: 7438869 - DNA, 22 bp, Homo sapiens
gtgagagatcccccactcatct

SEQ ID NO: 7438870 - DNA, 22 bp, Homo sapiens
gtgagagatcccccactcatct

SEQ ID NO: 7438871 - DNA, 22 bp, Homo sapiens
gtgagagaaattggagggaatg

SEQ ID NO: 7438872 - DNA, 22 bp, Homo sapiens
gtgagagaaattggagggaatg

SEQ ID NO: 7438873 - DNA, 22 bp, Homo sapiens
gtgagagaaattggagggaatg

SEQ ID NO: 7438874 - DNA, 22 bp, Homo sapiens
gtgagagaaattggagggaatg

SEQ ID NO: 7438875 - DNA, 22 bp, Homo sapiens
gtgagactcgcctttgtgtagc

SEQ ID NO: 7438876 - DNA, 22 bp, Homo sapiens
gtgagactcgcctttgtgtagc

SEQ ID NO: 7438877 - DNA, 22 bp, Homo sapiens
gtgagacctccttgggctgact

SEQ ID NO: 7438878 - DNA, 22 bp, Homo sapiens
gtgagacacccaagagtcagat

SEQ ID NO: 7438879 - DNA, 22 bp, Homo sapiens
gtgagacacccaagagtcagat

SEQ ID NO: 7438880 - DNA, 22 bp, Homo sapiens
gtgagacatcttgggaagtgat

SEQ ID NO: 7438881 - DNA, 19 bp, Homo sapiens
gtgagaccctgcatagggc

SEQ ID NO: 7438882 - DNA, 19 bp, Homo sapiens
gtgagaccctgcatagggc

SEQ ID NO: 7438883 - DNA, 22 bp, Homo sapiens
gtgagcagcctcacctgagggt

SEQ ID NO: 7438884 - DNA, 22 bp, Homo sapiens
gtgagcagcctcacctgagggt

SEQ ID NO: 7438885 - DNA, 23 bp, Homo sapiens
gtgagcagcccactaggaatgcc

SEQ ID NO: 7438886 - DNA, 22 bp, Homo sapiens
gtgagcagcctcacctgagggt

SEQ ID NO: 7438887 - DNA, 23 bp, Homo sapiens
gtgagcagcccactaggaatgcc

SEQ ID NO: 7438888 - DNA, 23 bp, Homo sapiens
gtgagcagcccactaggaatgcc

SEQ ID NO: 7438889 - DNA, 22 bp, Homo sapiens
gtgagcagcctcacctgagggt

SEQ ID NO: 7438890 - DNA, 22 bp, Homo sapiens
gtgagcagctcagggtggtctc

SEQ ID NO: 7438891 - DNA, 22 bp, Homo sapiens
gtgagcagcctcacctgagggt

SEQ ID NO: 7438892 - DNA, 22 bp, Homo sapiens
gtgagcagcctcacctgagggt

SEQ ID NO: 7438893 - DNA, 22 bp, Homo sapiens
gtgagcaggataggggctccct

SEQ ID NO: 7438894 - DNA, 22 bp, Homo sapiens
gtgagcaggataggggctccct

SEQ ID NO: 7438895 - DNA, 22 bp, Homo sapiens
gtgagcaggataggggctccct

SEQ ID NO: 7438896 - DNA, 22 bp, Homo sapiens
gtgagcaggataggggctccct

SEQ ID NO: 7438897 - DNA, 22 bp, Homo sapiens
gtgagcaggataggggctccct

SEQ ID NO: 7438898 - DNA, 22 bp, Homo sapiens
gtgagcaggataggggctccct

SEQ ID NO: 7438899 - DNA, 22 bp, Homo sapiens
gtgagcaggataggggctccct

SEQ ID NO: 7438900 - DNA, 22 bp, Homo sapiens
gtgagcaggataggggctccct

SEQ ID NO: 7438901 - DNA, 22 bp, Homo sapiens
gtgagcagctcagggtggtctc

SEQ ID NO: 7438902 - DNA, 22 bp, Homo sapiens
gtgagcagctcagggtggtctc

SEQ ID NO: 7438903 - DNA, 22 bp, Homo sapiens
gtgagcagctcagggtggtctc

SEQ ID NO: 7438904 - DNA, 22 bp, Homo sapiens
gtgactgttgtttgctacgtgc

SEQ ID NO: 7438905 - DNA, 22 bp, Homo sapiens
gtgactgttgtttgctacgtgc

SEQ ID NO: 7438906 - DNA, 22 bp, Homo sapiens
gtgactgtaattaccttagcaa

SEQ ID NO: 7438907 - DNA, 18 bp, Homo sapiens
gtgactgccccaaaaggc

SEQ ID NO: 7438908 - DNA, 22 bp, Homo sapiens
gtgactgtaattaccttagcaa

SEQ ID NO: 7438909 - DNA, 22 bp, Homo sapiens
gtgactctcactttacctgact

SEQ ID NO: 7438910 - DNA, 22 bp, Homo sapiens
gtgacgtgaggggctcctgttg

SEQ ID NO: 7438911 - DNA, 22 bp, Homo sapiens
gtgactatttcacatagtcttt

SEQ ID NO: 7438912 - DNA, 22 bp, Homo sapiens
gtgactcacacaggcctgggct

SEQ ID NO: 7438913 - DNA, 21 bp, Homo sapiens
gtgacctgcgcggggcgcagc

SEQ ID NO: 7438914 - DNA, 22 bp, Homo sapiens
gtgaccttggcaatctctcaga

SEQ ID NO: 7438915 - DNA, 22 bp, Homo sapiens
gtgagaaattgaatggctccca

SEQ ID NO: 7438916 - DNA, 22 bp, Homo sapiens
gtgagaaatggaacttcatacg

SEQ ID NO: 7438917 - DNA, 22 bp, Homo sapiens
gtgagaaatggaacttcatacg

SEQ ID NO: 7438918 - DNA, 22 bp, Homo sapiens
gtgagaaattgaatggctccca

SEQ ID NO: 7438919 - DNA, 22 bp, Homo sapiens
gtgagaagataagtattgcaaa

SEQ ID NO: 7438920 - DNA, 22 bp, Homo sapiens
gtgagaaaattgcctaattttg

SEQ ID NO: 7438921 - DNA, 22 bp, Homo sapiens
gtgagaaaattgcctaattttg

SEQ ID NO: 7438922 - DNA, 22 bp, Homo sapiens
gtgagaaatgacaaatgtgtcg

SEQ ID NO: 7438923 - DNA, 22 bp, Homo sapiens
gtgagaaaattgcctaattttg

SEQ ID NO: 7438924 - DNA, 22 bp, Homo sapiens
gtgagaaatggaacttcatacg

SEQ ID NO: 7438925 - DNA, 22 bp, Homo sapiens
gtgagaaatgacaaatgtgtcg

SEQ ID NO: 7438926 - DNA, 22 bp, Homo sapiens
gtgagaaatgacaaatgtgtcg

SEQ ID NO: 7438927 - DNA, 22 bp, Homo sapiens
gtgagacaagatttgtaggcag

SEQ ID NO: 7438928 - DNA, 22 bp, Homo sapiens
gtgagacaattcctcagtagac

SEQ ID NO: 7438929 - DNA, 22 bp, Homo sapiens
gtgagaatgagattggaatgta

SEQ ID NO: 7438930 - DNA, 22 bp, Homo sapiens
gtgagaataccagcagtgagaa

SEQ ID NO: 7438931 - DNA, 22 bp, Homo sapiens
gtgagaataccagcagtgagaa

SEQ ID NO: 7438932 - DNA, 22 bp, Homo sapiens
gtgagaataccagcagtgagaa

SEQ ID NO: 7438933 - DNA, 22 bp, Homo sapiens
gtgagaaattgaatggctccca

SEQ ID NO: 7438934 - DNA, 22 bp, Homo sapiens
gtgcagaagtaacaattaaaga

SEQ ID NO: 7438935 - DNA, 22 bp, Homo sapiens
gtgcagaagtaacaattaaaga

SEQ ID NO: 7438936 - DNA, 22 bp, Homo sapiens
gtgcagaagtaacaattaaaga

SEQ ID NO: 7438937 - DNA, 22 bp, Homo sapiens
gtgcactttgggagtctcagtg

SEQ ID NO: 7438938 - DNA, 22 bp, Homo sapiens
gtgcactttgggagtctcagtg

SEQ ID NO: 7438939 - DNA, 22 bp, Homo sapiens
gtgcagaatcagtacagaacga

SEQ ID NO: 7438940 - DNA, 22 bp, Homo sapiens
gtgcagacccacgtccagggcc

SEQ ID NO: 7438941 - DNA, 22 bp, Homo sapiens
gtgcagaatcagtacagaacga

SEQ ID NO: 7438942 - DNA, 22 bp, Homo sapiens
gtgcagaccttccagaaagaac

SEQ ID NO: 7438943 - DNA, 22 bp, Homo sapiens
gtgcagaccttagttcaagcca

SEQ ID NO: 7438944 - DNA, 22 bp, Homo sapiens
gtgcagacccacgtccagggcc

SEQ ID NO: 7438945 - DNA, 22 bp, Homo sapiens
gtgcacttgatctagacagatt

SEQ ID NO: 7438946 - DNA, 22 bp, Homo sapiens
gtgcactgtctggtcaagagca

SEQ ID NO: 7438947 - DNA, 22 bp, Homo sapiens
gtgcacccccaaggaggtggag

SEQ ID NO: 7438948 - DNA, 19 bp, Homo sapiens
gtgcactgtcactttgctc

SEQ ID NO: 7438949 - DNA, 22 bp, Homo sapiens
gtgcactgtctggtcaagagca

SEQ ID NO: 7438950 - DNA, 22 bp, Homo sapiens
gtgcactgtctggtcaagagca

SEQ ID NO: 7438951 - DNA, 22 bp, Homo sapiens
gtgcacatcgtgcaggtttgtt

SEQ ID NO: 7438952 - DNA, 22 bp, Homo sapiens
gtgcacctgaataccacatact

SEQ ID NO: 7438953 - DNA, 22 bp, Homo sapiens
gtgcaccccggggccctgctcc

SEQ ID NO: 7438954 - DNA, 22 bp, Homo sapiens
gtgcactggagttcgtacagat

SEQ ID NO: 7438955 - DNA, 22 bp, Homo sapiens
gtgcactggagttcgtacagat

SEQ ID NO: 7438956 - DNA, 22 bp, Homo sapiens
gtgcacccccaaggaggtggag

SEQ ID NO: 7438957 - DNA, 22 bp, Homo sapiens
gtgcaccccggggccctgctcc

SEQ ID NO: 7438958 - DNA, 22 bp, Homo sapiens
gtgcagagaaggagcagtagtt

SEQ ID NO: 7438959 - DNA, 22 bp, Homo sapiens
gtgcagagaaggagcagtagtt

SEQ ID NO: 7438960 - DNA, 22 bp, Homo sapiens
gtgcagagaaggagcagtagtt

SEQ ID NO: 7438961 - DNA, 22 bp, Homo sapiens
gtgcagagaaggagcagtagtt

SEQ ID NO: 7438962 - DNA, 22 bp, Homo sapiens
gtgcagagaaggagcagtagtt

SEQ ID NO: 7438963 - DNA, 22 bp, Homo sapiens
gtgcagagaaggagcagtagtt

SEQ ID NO: 7438964 - DNA, 22 bp, Homo sapiens
gtgcagacttacagattatccc

SEQ ID NO: 7438965 - DNA, 22 bp, Homo sapiens
gtgcagaatcagtacagaacga

SEQ ID NO: 7438966 - DNA, 22 bp, Homo sapiens
gtgcagagaaatgagaagtcga

SEQ ID NO: 7438967 - DNA, 22 bp, Homo sapiens
gtgcagagaaatgagaagtcga

SEQ ID NO: 7438968 - DNA, 22 bp, Homo sapiens
gtgcagagaaatgagaagtcga

SEQ ID NO: 7438969 - DNA, 22 bp, Homo sapiens
gtgcagagaggaccttggggag

SEQ ID NO: 7438970 - DNA, 22 bp, Homo sapiens
gtgcagagaaggagcagtagtt

SEQ ID NO: 7438971 - DNA, 22 bp, Homo sapiens
gtgcagagaggaccttggggag

SEQ ID NO: 7438972 - DNA, 22 bp, Homo sapiens
gtgcagagaggtggagggactt

SEQ ID NO: 7438973 - DNA, 22 bp, Homo sapiens
gtgcagagaggtggagggactt

SEQ ID NO: 7438974 - DNA, 22 bp, Homo sapiens
gtgcagagcaagggctgagggc

SEQ ID NO: 7438975 - DNA, 22 bp, Homo sapiens
gtgcagagaggtggagggactt

SEQ ID NO: 7438976 - DNA, 22 bp, Homo sapiens
gtgcagagaggtggagggactt

SEQ ID NO: 7438977 - DNA, 22 bp, Homo sapiens
gtgcagagaggtggagggactt

SEQ ID NO: 7438978 - DNA, 22 bp, Homo sapiens
gtgcacagattcagaggttttg

SEQ ID NO: 7438979 - DNA, 22 bp, Homo sapiens
gtgcacagattcagaggttttg

SEQ ID NO: 7438980 - DNA, 22 bp, Homo sapiens
gtgcacagagcccagggccgcg

SEQ ID NO: 7438981 - DNA, 22 bp, Homo sapiens
gtgcacagagcccagggccgcg

SEQ ID NO: 7438982 - DNA, 22 bp, Homo sapiens
gtgcacagagcccagggccgcg

SEQ ID NO: 7438983 - DNA, 22 bp, Homo sapiens
gtgagcagggcaggactgggga

SEQ ID NO: 7438984 - DNA, 22 bp, Homo sapiens
gtgcacagaagcagaagctaga

SEQ ID NO: 7438985 - DNA, 22 bp, Homo sapiens
gtgagcaggatttcatggtgta

SEQ ID NO: 7438986 - DNA, 22 bp, Homo sapiens
gtgagcaggatttcatggtgta

SEQ ID NO: 7438987 - DNA, 22 bp, Homo sapiens
gtgagcaggatttcatggtgta

SEQ ID NO: 7438988 - DNA, 22 bp, Homo sapiens
gtgagcagggcaggactgggga

SEQ ID NO: 7438989 - DNA, 22 bp, Homo sapiens
gtgagcagggcaggactgggga

SEQ ID NO: 7438990 - DNA, 22 bp, Homo sapiens
gtgagcagggcaggactgggga

SEQ ID NO: 7438991 - DNA, 22 bp, Homo sapiens
gtgcacagaaattggtaagact

SEQ ID NO: 7438992 - DNA, 22 bp, Homo sapiens
gtgagcaggatttcatggtgta

SEQ ID NO: 7438993 - DNA, 22 bp, Homo sapiens
gtgagcaggatttcatggtgta

SEQ ID NO: 7438994 - DNA, 22 bp, Homo sapiens
gtgcacaggtgggaaaatgagt

SEQ ID NO: 7438995 - DNA, 22 bp, Homo sapiens
gtgcacaggtgggaaaatgagt

SEQ ID NO: 7438996 - DNA, 22 bp, Homo sapiens
gtgcacagatttaattttattc

SEQ ID NO: 7438997 - DNA, 21 bp, Homo sapiens
gtgcacagtcctgcacacagg

SEQ ID NO: 7438998 - DNA, 23 bp, Homo sapiens
gtgcacagtcaagcccagcttag

SEQ ID NO: 7438999 - DNA, 23 bp, Homo sapiens
gtgcacagtcaagcccagcttag

SEQ ID NO: 7439000 - DNA, 23 bp, Homo sapiens
gtgcacagtcaagcccagcttag

SEQ ID NO: 7439001 - DNA, 22 bp, Homo sapiens
gtgcacatcgtgcaggtttgtt

SEQ ID NO: 7439002 - DNA, 22 bp, Homo sapiens
gtgcacatcgtgcaggtttgtt

SEQ ID NO: 7439003 - DNA, 22 bp, Homo sapiens
gtgcacatcgtgcaggtttgtt

SEQ ID NO: 7439004 - DNA, 22 bp, Homo sapiens
gtgcacatcgtgcaggtttgtt

SEQ ID NO: 7439005 - DNA, 22 bp, Homo sapiens
gtgcacagatttaattttattc

SEQ ID NO: 7439006 - DNA, 22 bp, Homo sapiens
gtgcacatatttgtgcatgcat

SEQ ID NO: 7439007 - DNA, 21 bp, Homo sapiens
gtgcacagtcctgcacacagg

SEQ ID NO: 7439008 - DNA, 22 bp, Homo sapiens
gtgcacatatttgtgcatgcat

SEQ ID NO: 7439009 - DNA, 22 bp, Homo sapiens
gtgcacatcgtgcaggtttgtt

SEQ ID NO: 7439010 - DNA, 22 bp, Homo sapiens
gtgcacatcgtgcaggtttgtt

SEQ ID NO: 7439011 - DNA, 21 bp, Homo sapiens
gtgcacagtcctgcacacagg

SEQ ID NO: 7439012 - DNA, 22 bp, Homo sapiens
gtctgcccggccttcctccacc

SEQ ID NO: 7439013 - DNA, 22 bp, Homo sapiens
gtctgccctcacatgcactctt

SEQ ID NO: 7439014 - DNA, 22 bp, Homo sapiens
gtctgccctcacatgcactctt

SEQ ID NO: 7439015 - DNA, 22 bp, Homo sapiens
gtctgccctcacatgcactctt

SEQ ID NO: 7439016 - DNA, 22 bp, Homo sapiens
gtctgccctgagctcccagtgc

SEQ ID NO: 7439017 - DNA, 22 bp, Homo sapiens
gtctgccctcacgccagctggg

SEQ ID NO: 7439018 - DNA, 22 bp, Homo sapiens
gtctgccctcacgccagctggg

SEQ ID NO: 7439019 - DNA, 22 bp, Homo sapiens
gtctgccctgcagacatgcctc

SEQ ID NO: 7439020 - DNA, 22 bp, Homo sapiens
gtctgccctgcagacatgcctc

SEQ ID NO: 7439021 - DNA, 22 bp, Homo sapiens
gtctgccctgctgatctcaccc

SEQ ID NO: 7439022 - DNA, 22 bp, Homo sapiens
gtctgccctgctgatctcaccc

SEQ ID NO: 7439023 - DNA, 22 bp, Homo sapiens
gtctgccctggggcatcagttt

SEQ ID NO: 7439024 - DNA, 22 bp, Homo sapiens
gtctgcccttcctctccacgat

SEQ ID NO: 7439025 - DNA, 22 bp, Homo sapiens
gtctgcccttcctctccacgat

SEQ ID NO: 7439026 - DNA, 22 bp, Homo sapiens
gtctgcccttggcctgggactt

SEQ ID NO: 7439027 - DNA, 22 bp, Homo sapiens
gtctgcccttggcctgggactt

SEQ ID NO: 7439028 - DNA, 22 bp, Homo sapiens
gtctgccccagaccctgaccca

SEQ ID NO: 7439029 - DNA, 22 bp, Homo sapiens
gtctgcccggccttcctccacc

SEQ ID NO: 7439030 - DNA, 22 bp, Homo sapiens
gtctgccccacaggctcagttg

SEQ ID NO: 7439031 - DNA, 20 bp, Homo sapiens
gtctgcccaggccaccacgg

SEQ ID NO: 7439032 - DNA, 22 bp, Homo sapiens
gtctgcccatctccgggcgggg

SEQ ID NO: 7439033 - DNA, 22 bp, Homo sapiens
gtcctggggattatagagtgtt

SEQ ID NO: 7439034 - DNA, 22 bp, Homo sapiens
gtcctgggggcagctgtgtcca

SEQ ID NO: 7439035 - DNA, 22 bp, Homo sapiens
gtcctgggggcagctgtgtcca

SEQ ID NO: 7439036 - DNA, 22 bp, Homo sapiens
gtcctgggggcagctgtgtcca

SEQ ID NO: 7439037 - DNA, 22 bp, Homo sapiens
gtcctgggggcagctgtgtcca

SEQ ID NO: 7439038 - DNA, 22 bp, Homo sapiens
gtcctgggggcagctgtgtcca

SEQ ID NO: 7439039 - DNA, 22 bp, Homo sapiens
gtcctgggcggagggctgctgt

SEQ ID NO: 7439040 - DNA, 22 bp, Homo sapiens
gtcctgggcggagggctgctgt

SEQ ID NO: 7439041 - DNA, 22 bp, Homo sapiens
gtcctgggcggagggctgctgt

SEQ ID NO: 7439042 - DNA, 22 bp, Homo sapiens
gtcctggggaatacagaagccg

SEQ ID NO: 7439043 - DNA, 22 bp, Homo sapiens
gtcctggggaatacagaagccg

SEQ ID NO: 7439044 - DNA, 22 bp, Homo sapiens
gtcctggggaatacagaagccg

SEQ ID NO: 7439045 - DNA, 22 bp, Homo sapiens
gtcctgggcctgctgaggctga

SEQ ID NO: 7439046 - DNA, 22 bp, Homo sapiens
gtcctgggcggagggctgctgt

SEQ ID NO: 7439047 - DNA, 22 bp, Homo sapiens
gtcctgggcggagggctgctgt

SEQ ID NO: 7439048 - DNA, 22 bp, Homo sapiens
gtcctgggcctgctgaggctga

SEQ ID NO: 7439049 - DNA, 22 bp, Homo sapiens
gtcctgggcctgctgaggctga

SEQ ID NO: 7439050 - DNA, 22 bp, Homo sapiens
gtcctggggatacagaagtgaa

SEQ ID NO: 7439051 - DNA, 22 bp, Homo sapiens
gtcctggggatacagaagtgaa

SEQ ID NO: 7439052 - DNA, 22 bp, Homo sapiens
gtcctggggattatagagtgtt

SEQ ID NO: 7439053 - DNA, 22 bp, Homo sapiens
gtcctggggattatagagtgtt

SEQ ID NO: 7439054 - DNA, 22 bp, Homo sapiens
gtcctggggattatagagtgtt

SEQ ID NO: 7439055 - DNA, 22 bp, Homo sapiens
gtcctggggattatagagtgtt

SEQ ID NO: 7439056 - DNA, 22 bp, Homo sapiens
gtcctggggatacagaagtgaa

SEQ ID NO: 7439057 - DNA, 22 bp, Homo sapiens
gtcctggggatacagaagtgaa

SEQ ID NO: 7439058 - DNA, 22 bp, Homo sapiens
gtcctggggatacagaagtgaa

SEQ ID NO: 7439059 - DNA, 22 bp, Homo sapiens
gtcctggggaatacagaagccg

SEQ ID NO: 7439060 - DNA, 22 bp, Homo sapiens
gtcctggggaatacagaagccg

SEQ ID NO: 7439061 - DNA, 22 bp, Homo sapiens
gtcctggggaatacagaagccg

SEQ ID NO: 7439062 - DNA, 22 bp, Homo sapiens
gtctgctgtgccttggggaaaa

SEQ ID NO: 7439063 - DNA, 22 bp, Homo sapiens
gtctgctgtgccttggggaaaa

SEQ ID NO: 7439064 - DNA, 22 bp, Homo sapiens
gtctgctgtgggtccccaggag

SEQ ID NO: 7439065 - DNA, 22 bp, Homo sapiens
gtctgctgtaggtaggacagca

SEQ ID NO: 7439066 - DNA, 22 bp, Homo sapiens
gtctgctgtaggtaggacagca

SEQ ID NO: 7439067 - DNA, 22 bp, Homo sapiens
gtctgctggtgcctggcctgcg

SEQ ID NO: 7439068 - DNA, 22 bp, Homo sapiens
gtctgctggtgcctggcctgcg

SEQ ID NO: 7439069 - DNA, 22 bp, Homo sapiens
gtctgctgtaggtaggacagca

SEQ ID NO: 7439070 - DNA, 22 bp, Homo sapiens
gtctgctgtaggtaggacagca

SEQ ID NO: 7439071 - DNA, 22 bp, Homo sapiens
gtctgctgtaggtaggacagca

SEQ ID NO: 7439072 - DNA, 22 bp, Homo sapiens
gtctgctgtaggtaggacagca

SEQ ID NO: 7439073 - DNA, 22 bp, Homo sapiens
gtctgctggcacgtcacagata

SEQ ID NO: 7439074 - DNA, 22 bp, Homo sapiens
gtctgctggcacgtcacagata

SEQ ID NO: 7439075 - DNA, 22 bp, Homo sapiens
gtctgctggcacgtcacagata

SEQ ID NO: 7439076 - DNA, 22 bp, Homo sapiens
gtctgctgcttctgttgaagca

SEQ ID NO: 7439077 - DNA, 22 bp, Homo sapiens
gtctgctgcttctgttgaagca

SEQ ID NO: 7439078 - DNA, 22 bp, Homo sapiens
gtctgctgcagtcgtggctcta

SEQ ID NO: 7439079 - DNA, 22 bp, Homo sapiens
gtctgctgcagtcgtggctcta

SEQ ID NO: 7439080 - DNA, 22 bp, Homo sapiens
gtctgctggtgcctggcctgcg

SEQ ID NO: 7439081 - DNA, 22 bp, Homo sapiens
gtctgctggtgcctggcctgcg

SEQ ID NO: 7439082 - DNA, 22 bp, Homo sapiens
gtctgctggcacgtcacagata

SEQ ID NO: 7439083 - DNA, 22 bp, Homo sapiens
gtctgctggtgcctggcctgcg

SEQ ID NO: 7439084 - DNA, 22 bp, Homo sapiens
gtctgctggtgcctggcctgcg

SEQ ID NO: 7439085 - DNA, 22 bp, Homo sapiens
gtctggaggcactttctcatga

SEQ ID NO: 7439086 - DNA, 22 bp, Homo sapiens
gtctggaggcactttctcatga

SEQ ID NO: 7439087 - DNA, 22 bp, Homo sapiens
gtctggaggcccgtcagcccta

SEQ ID NO: 7439088 - DNA, 22 bp, Homo sapiens
gtctggaggcccgtcagcccta

SEQ ID NO: 7439089 - DNA, 22 bp, Homo sapiens
gtctggaggaggaagaaggcac

SEQ ID NO: 7439090 - DNA, 22 bp, Homo sapiens
gtctggaggagggctctgcggc

SEQ ID NO: 7439091 - DNA, 22 bp, Homo sapiens
gtctggaggagggctctgcggc

SEQ ID NO: 7439092 - DNA, 22 bp, Homo sapiens
gtctggaggagggctctgcggc

SEQ ID NO: 7439093 - DNA, 22 bp, Homo sapiens
gtctggaggcactttctcatga

SEQ ID NO: 7439094 - DNA, 22 bp, Homo sapiens
gtctgctgttcagagatgttgc

SEQ ID NO: 7439095 - DNA, 22 bp, Homo sapiens
gtctggagcctgggtccctgct

SEQ ID NO: 7439096 - DNA, 22 bp, Homo sapiens
gtctggaggaggaagaaggcac

SEQ ID NO: 7439097 - DNA, 22 bp, Homo sapiens
gtctggaggaaaaggttaaatg

SEQ ID NO: 7439098 - DNA, 22 bp, Homo sapiens
gtctggaggaaaaggttaaatg

SEQ ID NO: 7439099 - DNA, 22 bp, Homo sapiens
gtctggaggaggaagaaggcac

SEQ ID NO: 7439100 - DNA, 22 bp, Homo sapiens
gtctggaggaggaagaaggcac

SEQ ID NO: 7439101 - DNA, 22 bp, Homo sapiens
gtctgcctgctagtggctgcct

SEQ ID NO: 7439102 - DNA, 22 bp, Homo sapiens
gtctgcctgctagtggctgcct

SEQ ID NO: 7439103 - DNA, 22 bp, Homo sapiens
gtctgcctgcaatccagagact

SEQ ID NO: 7439104 - DNA, 22 bp, Homo sapiens
gtctgcctggaggcagctgctg

SEQ ID NO: 7439105 - DNA, 22 bp, Homo sapiens
gtctgcctctttctttctgggt

SEQ ID NO: 7439106 - DNA, 22 bp, Homo sapiens
gtctgcctgcaatccagagact

SEQ ID NO: 7439107 - DNA, 22 bp, Homo sapiens
gtctgcctgcaatccagagact

SEQ ID NO: 7439108 - DNA, 22 bp, Homo sapiens
gtctgcctggaggcagctgctg

SEQ ID NO: 7439109 - DNA, 22 bp, Homo sapiens
gtctgcctggaggcagctgctg

SEQ ID NO: 7439110 - DNA, 22 bp, Homo sapiens
gtctgcctggaggcagctgctg

SEQ ID NO: 7439111 - DNA, 22 bp, Homo sapiens
gtctgcctgggacgctgggagt

SEQ ID NO: 7439112 - DNA, 22 bp, Homo sapiens
gtctgcctgggacgctgggagt

SEQ ID NO: 7439113 - DNA, 22 bp, Homo sapiens
gtctgcctctttctttctgggt

SEQ ID NO: 7439114 - DNA, 22 bp, Homo sapiens
gtctgcctctttctttctgggt

SEQ ID NO: 7439115 - DNA, 22 bp, Homo sapiens
gtctgcctctattgcctacctg

SEQ ID NO: 7439116 - DNA, 22 bp, Homo sapiens
gtctgcctctattgcctacctg

SEQ ID NO: 7439117 - DNA, 22 bp, Homo sapiens
gtctgcctctattgcctacctg

SEQ ID NO: 7439118 - DNA, 22 bp, Homo sapiens
gtctgcctctattgcctacctg

SEQ ID NO: 7439119 - DNA, 22 bp, Homo sapiens
gtctgcctcagccgggggccgc

SEQ ID NO: 7439120 - DNA, 22 bp, Homo sapiens
gtctgcctcagccgggggccgc

SEQ ID NO: 7439121 - DNA, 22 bp, Homo sapiens
gtctgcccttggctcagccata

SEQ ID NO: 7439122 - DNA, 22 bp, Homo sapiens
gtctgcccttggctcagccata

SEQ ID NO: 7439123 - DNA, 22 bp, Homo sapiens
gtctgcccttggctcagccata

SEQ ID NO: 7439124 - DNA, 22 bp, Homo sapiens
gtctgctgcagagcatggcttt

SEQ ID NO: 7439125 - DNA, 22 bp, Homo sapiens
gtctgctgcagagcatggcttt

SEQ ID NO: 7439126 - DNA, 22 bp, Homo sapiens
gtctgctgcagagcatggcttt

SEQ ID NO: 7439127 - DNA, 22 bp, Homo sapiens
gtctgctgcagagcatggcttt

SEQ ID NO: 7439128 - DNA, 22 bp, Homo sapiens
gtctgctgacagagcatggacc

SEQ ID NO: 7439129 - DNA, 22 bp, Homo sapiens
gtctgctgacagagcatggacc

SEQ ID NO: 7439130 - DNA, 22 bp, Homo sapiens
gtctgctgacagagcatggacc

SEQ ID NO: 7439131 - DNA, 22 bp, Homo sapiens
gtctgctgcagagcatggcttt

SEQ ID NO: 7439132 - DNA, 22 bp, Homo sapiens
gtctgctcgctgctcagccctg

SEQ ID NO: 7439133 - DNA, 22 bp, Homo sapiens
gtctgctgcagagcatggcttt

SEQ ID NO: 7439134 - DNA, 22 bp, Homo sapiens
gtctgctgcagtcgtggctcta

SEQ ID NO: 7439135 - DNA, 22 bp, Homo sapiens
gtctgctgcagtcgtggctcta

SEQ ID NO: 7439136 - DNA, 22 bp, Homo sapiens
gtctgctgcagtcgtggctcta

SEQ ID NO: 7439137 - DNA, 22 bp, Homo sapiens
gtctgctcatgctaccgcgggc

SEQ ID NO: 7439138 - DNA, 22 bp, Homo sapiens
gtctgcctttatcatctcctta

SEQ ID NO: 7439139 - DNA, 18 bp, Homo sapiens
gtctgccttctcccttcc

SEQ ID NO: 7439140 - DNA, 22 bp, Homo sapiens
gtctgcctttatcatctcctta

SEQ ID NO: 7439141 - DNA, 18 bp, Homo sapiens
gtctgccttctcccttcc

SEQ ID NO: 7439142 - DNA, 22 bp, Homo sapiens
gtctgcctgtctggatgacaga

SEQ ID NO: 7439143 - DNA, 22 bp, Homo sapiens
gtctgcctgtctggatgacaga

SEQ ID NO: 7439144 - DNA, 22 bp, Homo sapiens
gtctgctcatgctaccgcgggc

SEQ ID NO: 7439145 - DNA, 22 bp, Homo sapiens
gtctgctcatgctaccgcgggc

SEQ ID NO: 7439146 - DNA, 22 bp, Homo sapiens
gtctgctcatgctaccgcgggc

SEQ ID NO: 7439147 - DNA, 22 bp, Homo sapiens
gtctgctcatgctaccgcgggc

SEQ ID NO: 7439148 - DNA, 22 bp, Homo sapiens
gtctgctcatgctaccgcgggc

SEQ ID NO: 7439149 - DNA, 22 bp, Homo sapiens
gtgaacctctgaaaggcagtga

SEQ ID NO: 7439150 - DNA, 22 bp, Homo sapiens
gtgaactattgggtatcataaa

SEQ ID NO: 7439151 - DNA, 22 bp, Homo sapiens
gtgaactaaggattcaaacttc

SEQ ID NO: 7439152 - DNA, 22 bp, Homo sapiens
gtgaacattttcttgcaaattg

SEQ ID NO: 7439153 - DNA, 22 bp, Homo sapiens
gtgaacattgaggcagaaagga

SEQ ID NO: 7439154 - DNA, 22 bp, Homo sapiens
gtgaacattgaggcagaaagga

SEQ ID NO: 7439155 - DNA, 22 bp, Homo sapiens
gtgaacatcagattacatgaga

SEQ ID NO: 7439156 - DNA, 22 bp, Homo sapiens
gtgaacatcagattacatgaga

SEQ ID NO: 7439157 - DNA, 22 bp, Homo sapiens
gtgaacagttcattttatcatg

SEQ ID NO: 7439158 - DNA, 22 bp, Homo sapiens
gtgaacagttcattttatcatg

SEQ ID NO: 7439159 - DNA, 22 bp, Homo sapiens
gtgaacagataatagaaatgaa

SEQ ID NO: 7439160 - DNA, 22 bp, Homo sapiens
gtgaacaaaatagcacatatta

SEQ ID NO: 7439161 - DNA, 22 bp, Homo sapiens
gtgaacaaaatagcacatatta

SEQ ID NO: 7439162 - DNA, 22 bp, Homo sapiens
gtgaacaaaatagcacatatta

SEQ ID NO: 7439163 - DNA, 22 bp, Homo sapiens
gtgaacaaggagactacaactt

SEQ ID NO: 7439164 - DNA, 22 bp, Homo sapiens
gtgaacaaggagactacaactt

SEQ ID NO: 7439165 - DNA, 22 bp, Homo sapiens
gtgaacagactgttctctacag

SEQ ID NO: 7439166 - DNA, 22 bp, Homo sapiens
gtgaacagataatagaaatgaa

SEQ ID NO: 7439167 - DNA, 22 bp, Homo sapiens
gtgaaatgaatctggaaatatt

SEQ ID NO: 7439168 - DNA, 22 bp, Homo sapiens
gtgaaatctgaggcccatgatg

SEQ ID NO: 7439169 - DNA, 22 bp, Homo sapiens
gtgaaatgaatctggaaatatt

SEQ ID NO: 7439170 - DNA, 22 bp, Homo sapiens
gtgaaattgtatttggcattga

SEQ ID NO: 7439171 - DNA, 22 bp, Homo sapiens
gtgaaatattttgtttatgtca

SEQ ID NO: 7439172 - DNA, 22 bp, Homo sapiens
gtgaaatattttgtttatgtca

SEQ ID NO: 7439173 - DNA, 22 bp, Homo sapiens
gtgaaatattttgtttatgtca

SEQ ID NO: 7439174 - DNA, 22 bp, Homo sapiens
gtgaaatattttgtttatgtca

SEQ ID NO: 7439175 - DNA, 22 bp, Homo sapiens
gtgaaatatttaacgtccaggt

SEQ ID NO: 7439176 - DNA, 22 bp, Homo sapiens
gtgaaatatttaacgtccaggt

SEQ ID NO: 7439177 - DNA, 22 bp, Homo sapiens
gtgaaatatttaacgtccaggt

SEQ ID NO: 7439178 - DNA, 22 bp, Homo sapiens
gtgaaatatttaacgtccaggt

SEQ ID NO: 7439179 - DNA, 18 bp, Homo sapiens
gtgaaagagacagggcag

SEQ ID NO: 7439180 - DNA, 18 bp, Homo sapiens
gtgaaagagacagggcag

SEQ ID NO: 7439181 - DNA, 22 bp, Homo sapiens
gtgaaagacagcattaatggct

SEQ ID NO: 7439182 - DNA, 22 bp, Homo sapiens
gtgaaagagatgcagcataatg

SEQ ID NO: 7439183 - DNA, 22 bp, Homo sapiens
gtgaaagagatgcagcataatg

SEQ ID NO: 7439184 - DNA, 22 bp, Homo sapiens
gtgaaagagatgcagcataatg

SEQ ID NO: 7439185 - DNA, 22 bp, Homo sapiens
gtgaaagagatgcagcataatg

SEQ ID NO: 7439186 - DNA, 22 bp, Homo sapiens
gtgaaagtaagaaagtaggact

SEQ ID NO: 7439187 - DNA, 22 bp, Homo sapiens
gtgaaagtaagaaagtaggact

SEQ ID NO: 7439188 - DNA, 22 bp, Homo sapiens
gtgaaaataaggctggttcttg

SEQ ID NO: 7439189 - DNA, 22 bp, Homo sapiens
gtgaaaataaggctggttcttg

SEQ ID NO: 7439190 - DNA, 22 bp, Homo sapiens
gtgaaaataaggctggttcttg

SEQ ID NO: 7439191 - DNA, 22 bp, Homo sapiens
gtgaaacaccctccaatgcaca

SEQ ID NO: 7439192 - DNA, 22 bp, Homo sapiens
gtgaaacaccctccaatgcaca

SEQ ID NO: 7439193 - DNA, 22 bp, Homo sapiens
gtgaaacaccctccaatgcaca

SEQ ID NO: 7439194 - DNA, 22 bp, Homo sapiens
gtgaaacagaagctcctggaat

SEQ ID NO: 7439195 - DNA, 22 bp, Homo sapiens
gtgaaactgctttgtaaactgt

SEQ ID NO: 7439196 - DNA, 22 bp, Homo sapiens
gtgaaacaccctccaatgcaca

SEQ ID NO: 7439197 - DNA, 22 bp, Homo sapiens
gtgaaacagaagctcctggaat

SEQ ID NO: 7439198 - DNA, 22 bp, Homo sapiens
gtgaaactgctttgtaaactgt

SEQ ID NO: 7439199 - DNA, 22 bp, Homo sapiens
gtgaaacttcacattttgatag

SEQ ID NO: 7439200 - DNA, 22 bp, Homo sapiens
gtgaaacttcacattttgatag

SEQ ID NO: 7439201 - DNA, 22 bp, Homo sapiens
gtctggagtggtggatttaaag

SEQ ID NO: 7439202 - DNA, 22 bp, Homo sapiens
gtgaaaagagagcctgtgtcag

SEQ ID NO: 7439203 - DNA, 22 bp, Homo sapiens
gtgaaaagagagcctgtgtcag

SEQ ID NO: 7439204 - DNA, 22 bp, Homo sapiens
gtgaaaagcaacattgtggacc

SEQ ID NO: 7439205 - DNA, 22 bp, Homo sapiens
gtgaaaagcaacattgtggacc

SEQ ID NO: 7439206 - DNA, 22 bp, Homo sapiens
gtgaaaataaggctggttcttg

SEQ ID NO: 7439207 - DNA, 22 bp, Homo sapiens
gtctggagtggggcctgagaat

SEQ ID NO: 7439208 - DNA, 22 bp, Homo sapiens
gtctggagtggggcctgagaat

SEQ ID NO: 7439209 - DNA, 22 bp, Homo sapiens
gtctggagtggggcctgagaat

SEQ ID NO: 7439210 - DNA, 22 bp, Homo sapiens
gtctggagtaccataaaaagga

SEQ ID NO: 7439211 - DNA, 17 bp, Homo sapiens
gtctggagtggccttca

SEQ ID NO: 7439212 - DNA, 17 bp, Homo sapiens
gtctggagtggccttca

SEQ ID NO: 7439213 - DNA, 18 bp, Homo sapiens
gtctggaggtcaggagct

SEQ ID NO: 7439214 - DNA, 18 bp, Homo sapiens
gtctggaggtcaggagct

SEQ ID NO: 7439215 - DNA, 18 bp, Homo sapiens
gtctggaggtcaggagct

SEQ ID NO: 7439216 - DNA, 18 bp, Homo sapiens
gtctggaggtcaggagct

SEQ ID NO: 7439217 - DNA, 22 bp, Homo sapiens
gtctggagggaagagatgtcag

SEQ ID NO: 7439218 - DNA, 22 bp, Homo sapiens
gtctggagggaagagatgtcag

SEQ ID NO: 7439219 - DNA, 22 bp, Homo sapiens
gtctggagggaagagatgtcag

SEQ ID NO: 7439220 - DNA, 22 bp, Homo sapiens
gtctggaggggagatttgggtt

SEQ ID NO: 7439221 - DNA, 22 bp, Homo sapiens
gtctggaggggagatttgggtt

SEQ ID NO: 7439222 - DNA, 22 bp, Homo sapiens
gtctggaggggagatttgggtt

SEQ ID NO: 7439223 - DNA, 22 bp, Homo sapiens
gtctggagggtgggtagagacc

SEQ ID NO: 7439224 - DNA, 22 bp, Homo sapiens
gtctggagggtgggtagagacc

SEQ ID NO: 7439225 - DNA, 22 bp, Homo sapiens
gtgaactgctgagttttatcat

SEQ ID NO: 7439226 - DNA, 22 bp, Homo sapiens
gtgaacttccagatgataaaca

SEQ ID NO: 7439227 - DNA, 22 bp, Homo sapiens
gtgaagaaggcaatacaaagaa

SEQ ID NO: 7439228 - DNA, 22 bp, Homo sapiens
gtgaagaaggcaatacaaagaa

SEQ ID NO: 7439229 - DNA, 22 bp, Homo sapiens
gtgaagaccagggaacgctggc

SEQ ID NO: 7439230 - DNA, 22 bp, Homo sapiens
gtgaagagctgttgcagagatt

SEQ ID NO: 7439231 - DNA, 22 bp, Homo sapiens
gtgaagagctgttgcagagatt

SEQ ID NO: 7439232 - DNA, 22 bp, Homo sapiens
gtgaagagctgttgcagagatt

SEQ ID NO: 7439233 - DNA, 22 bp, Homo sapiens
gtgaagagctgttgcagagatt

SEQ ID NO: 7439234 - DNA, 17 bp, Homo sapiens
gtgaagagtcattgaat

SEQ ID NO: 7439235 - DNA, 22 bp, Homo sapiens
gtgaagagctgttgcagagatt

SEQ ID NO: 7439236 - DNA, 22 bp, Homo sapiens
gtgaagatctgagccctcaggt

SEQ ID NO: 7439237 - DNA, 17 bp, Homo sapiens
gtgaagagtcattgaat

SEQ ID NO: 7439238 - DNA, 22 bp, Homo sapiens
gtgaagcatatgcttctctgcc

SEQ ID NO: 7439239 - DNA, 22 bp, Homo sapiens
gtgaagcataactgaaggattt

SEQ ID NO: 7439240 - DNA, 22 bp, Homo sapiens
gtgaagcatatgcttctctgcc

SEQ ID NO: 7439241 - DNA, 22 bp, Homo sapiens
gtgaagcataactgaaggattt

SEQ ID NO: 7439242 - DNA, 22 bp, Homo sapiens
gtgaagcagttgcgtgggttcc

SEQ ID NO: 7439243 - DNA, 22 bp, Homo sapiens
gtgaagcagttgcgtgggttcc

SEQ ID NO: 7439244 - DNA, 22 bp, Homo sapiens
gtgaagcagggaaggaaaggat

SEQ ID NO: 7439245 - DNA, 22 bp, Homo sapiens
gtgaagcagttgcgtgggttcc

SEQ ID NO: 7439246 - DNA, 22 bp, Homo sapiens
gtgaagcagagtgtggaagcaa

SEQ ID NO: 7439247 - DNA, 22 bp, Homo sapiens
gtgaagcagggaaggaaaggat

SEQ ID NO: 7439248 - DNA, 22 bp, Homo sapiens
gtgaagcagggaaggaaaggat

SEQ ID NO: 7439249 - DNA, 22 bp, Homo sapiens
gtgaagcagagtgtggaagcaa

SEQ ID NO: 7439250 - DNA, 22 bp, Homo sapiens
gtgaagcacgctgccgcactgg

SEQ ID NO: 7439251 - DNA, 22 bp, Homo sapiens
gtgaagcagggaaggaaaggat

SEQ ID NO: 7439252 - DNA, 22 bp, Homo sapiens
gtgaagcacgctgccgcactgg

SEQ ID NO: 7439253 - DNA, 22 bp, Homo sapiens
gtgaagcacatgggcgttgggt

SEQ ID NO: 7439254 - DNA, 22 bp, Homo sapiens
gtgaagatgcctcaggtgaccc

SEQ ID NO: 7439255 - DNA, 23 bp, Homo sapiens
gtgaagatgtattatggattggc

SEQ ID NO: 7439256 - DNA, 22 bp, Homo sapiens
gtgaagcacatgggcgttgggt

SEQ ID NO: 7439257 - DNA, 22 bp, Homo sapiens
gtgaagataaggatgctgcagt

SEQ ID NO: 7439258 - DNA, 22 bp, Homo sapiens
gtgaagatgcctcaggtgaccc

SEQ ID NO: 7439259 - DNA, 23 bp, Homo sapiens
gtgacccaaggaccttccagaat

SEQ ID NO: 7439260 - DNA, 22 bp, Homo sapiens
gtgaccatttgacatatccttg

SEQ ID NO: 7439261 - DNA, 22 bp, Homo sapiens
gtgacccaggacactgtgtatc

SEQ ID NO: 7439262 - DNA, 22 bp, Homo sapiens
gtgaccatcatctcagctagtt

SEQ ID NO: 7439263 - DNA, 22 bp, Homo sapiens
gtgaccatcatctcagctagtt

SEQ ID NO: 7439264 - DNA, 22 bp, Homo sapiens
gtgaccatcctggtaatgaatc

SEQ ID NO: 7439265 - DNA, 22 bp, Homo sapiens
gtgaccatttgacatatccttg

SEQ ID NO: 7439266 - DNA, 22 bp, Homo sapiens
gtgaccatttgacatatccttg

SEQ ID NO: 7439267 - DNA, 22 bp, Homo sapiens
gtgaaggagttatcagtggtta

SEQ ID NO: 7439268 - DNA, 22 bp, Homo sapiens
gtgaaggagttatcagtggtta

SEQ ID NO: 7439269 - DNA, 22 bp, Homo sapiens
gtgaaggataaggatctaaatt

SEQ ID NO: 7439270 - DNA, 22 bp, Homo sapiens
gtgaaggattggagggcatctt

SEQ ID NO: 7439271 - DNA, 22 bp, Homo sapiens
gtgaccataatagattatgagt

SEQ ID NO: 7439272 - DNA, 22 bp, Homo sapiens
gtgaccatcatctcagctagtt

SEQ ID NO: 7439273 - DNA, 22 bp, Homo sapiens
gtgaccatcatctcagctagtt

SEQ ID NO: 7439274 - DNA, 22 bp, Homo sapiens
gtgaccatcatctcagctagtt

SEQ ID NO: 7439275 - DNA, 22 bp, Homo sapiens
gtgaccataatagattatgagt

SEQ ID NO: 7439276 - DNA, 22 bp, Homo sapiens
gtgaccatcagagaataacaaa

SEQ ID NO: 7439277 - DNA, 22 bp, Homo sapiens
gtgaccatcagagaataacaaa

SEQ ID NO: 7439278 - DNA, 22 bp, Homo sapiens
gtgaaggactgaatgaaaatgt

SEQ ID NO: 7439279 - DNA, 22 bp, Homo sapiens
gtgaaggactagcatggagggc

SEQ ID NO: 7439280 - DNA, 22 bp, Homo sapiens
gtgaaggaggggccacagatat

SEQ ID NO: 7439281 - DNA, 22 bp, Homo sapiens
gtgaaggaggggccacagatat

SEQ ID NO: 7439282 - DNA, 22 bp, Homo sapiens
gtgaagccacagagccacgccg

SEQ ID NO: 7439283 - DNA, 22 bp, Homo sapiens
gtgaagcatatgcttctctgcc

SEQ ID NO: 7439284 - DNA, 22 bp, Homo sapiens
gtgaaggaccaatatgactcat

SEQ ID NO: 7439285 - DNA, 22 bp, Homo sapiens
gtatttaattccattaagttag

SEQ ID NO: 7439286 - DNA, 22 bp, Homo sapiens
gtattgtatttatttatgtgac

SEQ ID NO: 7439287 - DNA, 22 bp, Homo sapiens
gtatttaattccattaagttag

SEQ ID NO: 7439288 - DNA, 22 bp, Homo sapiens
gtatttaattccattaagttag

SEQ ID NO: 7439289 - DNA, 22 bp, Homo sapiens
gtatttaattccattaagttag

SEQ ID NO: 7439290 - DNA, 22 bp, Homo sapiens
gtattgtatatttgcaaataca

SEQ ID NO: 7439291 - DNA, 22 bp, Homo sapiens
gtattgtattgaacacatgtga

SEQ ID NO: 7439292 - DNA, 22 bp, Homo sapiens
gtattgtatatttgcaaataca

SEQ ID NO: 7439293 - DNA, 22 bp, Homo sapiens
gtatttaattctgtgcttctag

SEQ ID NO: 7439294 - DNA, 22 bp, Homo sapiens
gtatttataggggaatgagagt

SEQ ID NO: 7439295 - DNA, 22 bp, Homo sapiens
gtatttataggggaatgagagt

SEQ ID NO: 7439296 - DNA, 22 bp, Homo sapiens
gtatttataggggaatgagagt

SEQ ID NO: 7439297 - DNA, 23 bp, Homo sapiens
gtatttcagcattctcagttaaa

SEQ ID NO: 7439298 - DNA, 22 bp, Homo sapiens
gtatttcacatatggatatgct

SEQ ID NO: 7439299 - DNA, 22 bp, Homo sapiens
gtatttcacatatggatatgct

SEQ ID NO: 7439300 - DNA, 22 bp, Homo sapiens
gtatttataggggaatgagagt

SEQ ID NO: 7439301 - DNA, 22 bp, Homo sapiens
gtatttataggggaatgagagt

SEQ ID NO: 7439302 - DNA, 22 bp, Homo sapiens
gtattgggattatgggtgtgag

SEQ ID NO: 7439303 - DNA, 22 bp, Homo sapiens
gtattgctagcgggagaagtgg

SEQ ID NO: 7439304 - DNA, 22 bp, Homo sapiens
gtattgcttgagcccaggagtt

SEQ ID NO: 7439305 - DNA, 22 bp, Homo sapiens
gtattgcttgagcccaggagtt

SEQ ID NO: 7439306 - DNA, 20 bp, Homo sapiens
gtattggggcctggaggaag

SEQ ID NO: 7439307 - DNA, 22 bp, Homo sapiens
gtattgggtgagggcaaagggt

SEQ ID NO: 7439308 - DNA, 22 bp, Homo sapiens
gtattgtagctacaatagacgt

SEQ ID NO: 7439309 - DNA, 22 bp, Homo sapiens
gtattgcattgtttcaagctgt

SEQ ID NO: 7439310 - DNA, 22 bp, Homo sapiens
gtattgcattttaatatgtgca

SEQ ID NO: 7439311 - DNA, 22 bp, Homo sapiens
gtattgcattttgaatgcatgg

SEQ ID NO: 7439312 - DNA, 23 bp, Homo sapiens
gtattgctgctggacatgtaatt

SEQ ID NO: 7439313 - DNA, 22 bp, Homo sapiens
gtattgcttatgaaaacaggtc

SEQ ID NO: 7439314 - DNA, 22 bp, Homo sapiens
gtattgccggaggcacctcctt

SEQ ID NO: 7439315 - DNA, 22 bp, Homo sapiens
gtattgcattttgaatgcatgg

SEQ ID NO: 7439316 - DNA, 21 bp, Homo sapiens
gtattgcagagttatgtgctc

SEQ ID NO: 7439317 - DNA, 22 bp, Homo sapiens
gtattgcatagacctgggatga

SEQ ID NO: 7439318 - DNA, 22 bp, Homo sapiens
gtattgcatagacctgggatga

SEQ ID NO: 7439319 - DNA, 21 bp, Homo sapiens
gtattgcagagttatgtgctc

SEQ ID NO: 7439320 - DNA, 22 bp, Homo sapiens
gtattgcaattactcttcttct

SEQ ID NO: 7439321 - DNA, 17 bp, Homo sapiens
gtattctttgccttcca

SEQ ID NO: 7439322 - DNA, 22 bp, Homo sapiens
gtattgcaattactcttcttct

SEQ ID NO: 7439323 - DNA, 22 bp, Homo sapiens
gtattcttatactcagtgagct

SEQ ID NO: 7439324 - DNA, 22 bp, Homo sapiens
gtattcttaaggattgagcaaa

SEQ ID NO: 7439325 - DNA, 22 bp, Homo sapiens
gtattcttaaggattgagcaaa

SEQ ID NO: 7439326 - DNA, 20 bp, Homo sapiens
gtattctgtattctgctcag

SEQ ID NO: 7439327 - DNA, 22 bp, Homo sapiens
gtattctgtttacagtgagcaa

SEQ ID NO: 7439328 - DNA, 22 bp, Homo sapiens
gtattctgggccgattacaaaa

SEQ ID NO: 7439329 - DNA, 21 bp, Homo sapiens
gtattctttatgaagtgaaaa

SEQ ID NO: 7439330 - DNA, 21 bp, Homo sapiens
gtattctttatgaagtgaaaa

SEQ ID NO: 7439331 - DNA, 22 bp, Homo sapiens
gtattcttggttatcaaaatac

SEQ ID NO: 7439332 - DNA, 22 bp, Homo sapiens
gtattcttggttatcaaaatac

SEQ ID NO: 7439333 - DNA, 22 bp, Homo sapiens
gtattcatttatttactcatcc

SEQ ID NO: 7439334 - DNA, 22 bp, Homo sapiens
gtattcagtttgattgtctaca

SEQ ID NO: 7439335 - DNA, 22 bp, Homo sapiens
gtattcatattaaacatatcaa

SEQ ID NO: 7439336 - DNA, 22 bp, Homo sapiens
gtattattgtcatgaaataata

SEQ ID NO: 7439337 - DNA, 22 bp, Homo sapiens
gtattcagaaggatgatctagt

SEQ ID NO: 7439338 - DNA, 22 bp, Homo sapiens
gtattcagaaggatgatctagt

SEQ ID NO: 7439339 - DNA, 22 bp, Homo sapiens
gtattcagtttgattgtctaca

SEQ ID NO: 7439340 - DNA, 22 bp, Homo sapiens
gtattcagggctagtcagagga

SEQ ID NO: 7439341 - DNA, 22 bp, Homo sapiens
gtattcagggctagtcagagga

SEQ ID NO: 7439342 - DNA, 22 bp, Homo sapiens
gtattcacctaaatgtagtttg

SEQ ID NO: 7439343 - DNA, 22 bp, Homo sapiens
gtattcacatggtggtagattg

SEQ ID NO: 7439344 - DNA, 22 bp, Homo sapiens
gtattcaagcgagcagatgtct

SEQ ID NO: 7439345 - DNA, 22 bp, Homo sapiens
gtattcaaggattttgttctac

SEQ ID NO: 7439346 - DNA, 22 bp, Homo sapiens
gtattcctaagtcatgacaaat

SEQ ID NO: 7439347 - DNA, 22 bp, Homo sapiens
gtattcctaagtcatgacaaat

SEQ ID NO: 7439348 - DNA, 22 bp, Homo sapiens
gtattcctaagtcatgacaaat

SEQ ID NO: 7439349 - DNA, 22 bp, Homo sapiens
gtattccattagtgttaatatc

SEQ ID NO: 7439350 - DNA, 22 bp, Homo sapiens
gtattccattagtgttaatatc

SEQ ID NO: 7439351 - DNA, 22 bp, Homo sapiens
gtattccattagtgttaatatc

SEQ ID NO: 7439352 - DNA, 22 bp, Homo sapiens
gtattcatttatttactcatcc

SEQ ID NO: 7439353 - DNA, 22 bp, Homo sapiens
gtattccttcagaagacgttta

SEQ ID NO: 7439354 - DNA, 22 bp, Homo sapiens
gtattcctgcaaatagcagtga

SEQ ID NO: 7439355 - DNA, 22 bp, Homo sapiens
gtattccttcagaagacgttta

SEQ ID NO: 7439356 - DNA, 22 bp, Homo sapiens
gtattctgggccgattacaaaa

SEQ ID NO: 7439357 - DNA, 22 bp, Homo sapiens
gtattctgggccgattacaaaa

SEQ ID NO: 7439358 - DNA, 22 bp, Homo sapiens
gtattattgtcatgaaataata

SEQ ID NO: 7439359 - DNA, 22 bp, Homo sapiens
gtattattgggtagtatggtaa

SEQ ID NO: 7439360 - DNA, 22 bp, Homo sapiens
gtattattgtcatgaaataata

SEQ ID NO: 7439361 - DNA, 22 bp, Homo sapiens
gtattattgtcatgaaataata

SEQ ID NO: 7439362 - DNA, 22 bp, Homo sapiens
gtattattctcagctttgggat

SEQ ID NO: 7439363 - DNA, 22 bp, Homo sapiens
gtattattgggtagtatggtaa

SEQ ID NO: 7439364 - DNA, 22 bp, Homo sapiens
gtattattgggtagtatggtaa

SEQ ID NO: 7439365 - DNA, 22 bp, Homo sapiens
gtattattctcagctttgggat

SEQ ID NO: 7439366 - DNA, 22 bp, Homo sapiens
gtattattctcagctttgggat

SEQ ID NO: 7439367 - DNA, 22 bp, Homo sapiens
gtattattaagtgtatttgacc

SEQ ID NO: 7439368 - DNA, 22 bp, Homo sapiens
gtattattaagtgtatttgacc

SEQ ID NO: 7439369 - DNA, 22 bp, Homo sapiens
gtattattaagtgtatttgacc

SEQ ID NO: 7439370 - DNA, 22 bp, Homo sapiens
gtattattaagtgtatttgacc

SEQ ID NO: 7439371 - DNA, 22 bp, Homo sapiens
gtattagtcaattacagtgggg

SEQ ID NO: 7439372 - DNA, 18 bp, Homo sapiens
gtattagttttcagagag

SEQ ID NO: 7439373 - DNA, 22 bp, Homo sapiens
gtattagttatctactgctgtg

SEQ ID NO: 7439374 - DNA, 22 bp, Homo sapiens
gtattagtcaattacagtgggg

SEQ ID NO: 7439375 - DNA, 22 bp, Homo sapiens
gtagacaagcacaggactcaga

SEQ ID NO: 7439376 - DNA, 22 bp, Homo sapiens
gtagacaaatttcttctctcaa

SEQ ID NO: 7439377 - DNA, 23 bp, Homo sapiens
gtagacagatgggccaaggtaat

SEQ ID NO: 7439378 - DNA, 22 bp, Homo sapiens
gtagacagaaagcggaatcata

SEQ ID NO: 7439379 - DNA, 22 bp, Homo sapiens
gtagacagaaagcggaatcata

SEQ ID NO: 7439380 - DNA, 23 bp, Homo sapiens
gtagacagatgggccaaggtaat

SEQ ID NO: 7439381 - DNA, 22 bp, Homo sapiens
gtagacagcaaccaaaccaggt

SEQ ID NO: 7439382 - DNA, 22 bp, Homo sapiens
gtattacatttagtaattaggc

SEQ ID NO: 7439383 - DNA, 22 bp, Homo sapiens
gtattagaagaaattataggta

SEQ ID NO: 7439384 - DNA, 22 bp, Homo sapiens
gtattagctggataaagtaggt

SEQ ID NO: 7439385 - DNA, 22 bp, Homo sapiens
gtattagactgagaaatggagt

SEQ ID NO: 7439386 - DNA, 22 bp, Homo sapiens
gtattagactgagaaatggagt

SEQ ID NO: 7439387 - DNA, 22 bp, Homo sapiens
gtagaaattccatttactttga

SEQ ID NO: 7439388 - DNA, 22 bp, Homo sapiens
gtagaaattccatttactttga

SEQ ID NO: 7439389 - DNA, 22 bp, Homo sapiens
gtagaaattccatttactttga

SEQ ID NO: 7439390 - DNA, 22 bp, Homo sapiens
gtagaaattccatttactttga

SEQ ID NO: 7439391 - DNA, 22 bp, Homo sapiens
gtagaaatgtaaccaggagata

SEQ ID NO: 7439392 - DNA, 22 bp, Homo sapiens
gtagaaatgtaaccaggagata

SEQ ID NO: 7439393 - DNA, 22 bp, Homo sapiens
gtagaaatgtaaccaggagata

SEQ ID NO: 7439394 - DNA, 22 bp, Homo sapiens
gtagaacatggtagggcaggtg

SEQ ID NO: 7439395 - DNA, 22 bp, Homo sapiens
gtagaacactggggctctgttg

SEQ ID NO: 7439396 - DNA, 22 bp, Homo sapiens
gtagaaattccatttactttga

SEQ ID NO: 7439397 - DNA, 22 bp, Homo sapiens
gtagaaatggtgtgtttcttct

SEQ ID NO: 7439398 - DNA, 22 bp, Homo sapiens
gtactaaaaaatgatcagtttg

SEQ ID NO: 7439399 - DNA, 22 bp, Homo sapiens
gtagaaatggtgtgtttcttct

SEQ ID NO: 7439400 - DNA, 22 bp, Homo sapiens
gtagaaatggtgtgtttcttct

SEQ ID NO: 7439401 - DNA, 22 bp, Homo sapiens
gtagaaatgtaaccaggagata

SEQ ID NO: 7439402 - DNA, 22 bp, Homo sapiens
gtagaaatgtaaccaggagata

SEQ ID NO: 7439403 - DNA, 22 bp, Homo sapiens
gtagaaatgtaaccaggagata

SEQ ID NO: 7439404 - DNA, 22 bp, Homo sapiens
gtacgtgcatgcacgtgtgcct

SEQ ID NO: 7439405 - DNA, 22 bp, Homo sapiens
gtacctatctcaccgagtcgtt

SEQ ID NO: 7439406 - DNA, 22 bp, Homo sapiens
gtactaaaaaatgatcagtttg

SEQ ID NO: 7439407 - DNA, 22 bp, Homo sapiens
gtacctatgtgtatgacagcat

SEQ ID NO: 7439408 - DNA, 22 bp, Homo sapiens
gtacctgagcacgcggtccgag

SEQ ID NO: 7439409 - DNA, 22 bp, Homo sapiens
gtacctgggggatccacttctt

SEQ ID NO: 7439410 - DNA, 22 bp, Homo sapiens
gtagacaaatttcttctctcaa

SEQ ID NO: 7439411 - DNA, 22 bp, Homo sapiens
gtagaattttaataatggagat

SEQ ID NO: 7439412 - DNA, 22 bp, Homo sapiens
gtagaattacctctctatgtcc

SEQ ID NO: 7439413 - DNA, 22 bp, Homo sapiens
gtagaatcccagtggctatatt

SEQ ID NO: 7439414 - DNA, 22 bp, Homo sapiens
gtagaatattttgttctactat

SEQ ID NO: 7439415 - DNA, 22 bp, Homo sapiens
gtagaatatatggttagtattg

SEQ ID NO: 7439416 - DNA, 22 bp, Homo sapiens
gtagaactccagttctgtggca

SEQ ID NO: 7439417 - DNA, 22 bp, Homo sapiens
gtagaactaggacttcaggtat

SEQ ID NO: 7439418 - DNA, 22 bp, Homo sapiens
gtagaactctttcctgcgtggg

SEQ ID NO: 7439419 - DNA, 22 bp, Homo sapiens
gtagaagtgatgtcatgttata

SEQ ID NO: 7439420 - DNA, 22 bp, Homo sapiens
gtagaataaatgtacacatctg

SEQ ID NO: 7439421 - DNA, 22 bp, Homo sapiens
gtagaataaatgtacacatctg

SEQ ID NO: 7439422 - DNA, 22 bp, Homo sapiens
gtagaataaatgtacacatctg

SEQ ID NO: 7439423 - DNA, 22 bp, Homo sapiens
gtagaataaatgtacacatctg

SEQ ID NO: 7439424 - DNA, 22 bp, Homo sapiens
gtagaataggggtattgcttca

SEQ ID NO: 7439425 - DNA, 22 bp, Homo sapiens
gtagaataggggtattgcttca

SEQ ID NO: 7439426 - DNA, 22 bp, Homo sapiens
ggtttccaaagatagagtagta

SEQ ID NO: 7439427 - DNA, 22 bp, Homo sapiens
ggtttccaagtggttgaaaagt

SEQ ID NO: 7439428 - DNA, 22 bp, Homo sapiens
ggtttccaagtggttgaaaagt

SEQ ID NO: 7439429 - DNA, 22 bp, Homo sapiens
ggtttccaatgacaaacactgt

SEQ ID NO: 7439430 - DNA, 22 bp, Homo sapiens
ggtttccaaagatagagtagta

SEQ ID NO: 7439431 - DNA, 22 bp, Homo sapiens
ggtttcattttccagtttgcct

SEQ ID NO: 7439432 - DNA, 22 bp, Homo sapiens
ggtttccaaagatagagtagta

SEQ ID NO: 7439433 - DNA, 22 bp, Homo sapiens
ggtttccaaagatagagtagta

SEQ ID NO: 7439434 - DNA, 22 bp, Homo sapiens
ggtttcaatgagaagtgcttgt

SEQ ID NO: 7439435 - DNA, 22 bp, Homo sapiens
ggtttcaactaaatcaagaagg

SEQ ID NO: 7439436 - DNA, 22 bp, Homo sapiens
ggtttcaacttcaacctctcca

SEQ ID NO: 7439437 - DNA, 22 bp, Homo sapiens
ggtttcctggtcagctgaggca

SEQ ID NO: 7439438 - DNA, 14 bp, Homo sapiens
ggtttccattttta

SEQ ID NO: 7439439 - DNA, 22 bp, Homo sapiens
ggtttcctttgcttctcctgag

SEQ ID NO: 7439440 - DNA, 22 bp, Homo sapiens
ggtttctagcagagtctcttta

SEQ ID NO: 7439441 - DNA, 22 bp, Homo sapiens
ggtttccaggagaagagatttg

SEQ ID NO: 7439442 - DNA, 22 bp, Homo sapiens
ggtttccattattttatgggtg

SEQ ID NO: 7439443 - DNA, 14 bp, Homo sapiens
ggtttccattttta

SEQ ID NO: 7439444 - DNA, 22 bp, Homo sapiens
ggtttcctgcattgggaaattt

SEQ ID NO: 7439445 - DNA, 22 bp, Homo sapiens
ggtttccaatgacaaacactgt

SEQ ID NO: 7439446 - DNA, 22 bp, Homo sapiens
ggtttccacatccatggaatgg

SEQ ID NO: 7439447 - DNA, 22 bp, Homo sapiens
ggtttccacatccatggaatgg

SEQ ID NO: 7439448 - DNA, 22 bp, Homo sapiens
ggtttccaccttgctatgagaa

SEQ ID NO: 7439449 - DNA, 22 bp, Homo sapiens
ggtttccaccttgctatgagaa

SEQ ID NO: 7439450 - DNA, 22 bp, Homo sapiens
ggtttccacttgctgaagaaag

SEQ ID NO: 7439451 - DNA, 22 bp, Homo sapiens
ggtttccacttgctgaagaaag

SEQ ID NO: 7439452 - DNA, 22 bp, Homo sapiens
ggtttccacttgctgaagaaag

SEQ ID NO: 7439453 - DNA, 22 bp, Homo sapiens
ggtttccaggagaagagatttg

SEQ ID NO: 7439454 - DNA, 22 bp, Homo sapiens
ggtttccattattttatgggtg

SEQ ID NO: 7439455 - DNA, 22 bp, Homo sapiens
ggtttccattattttatgggtg

SEQ ID NO: 7439456 - DNA, 22 bp, Homo sapiens
ggtttgacagcttggggctgtc

SEQ ID NO: 7439457 - DNA, 22 bp, Homo sapiens
ggtttgacagcttggggctgtc

SEQ ID NO: 7439458 - DNA, 22 bp, Homo sapiens
ggtttgcatgtgatgttgggca

SEQ ID NO: 7439459 - DNA, 22 bp, Homo sapiens
ggtttctagcagagtctcttta

SEQ ID NO: 7439460 - DNA, 22 bp, Homo sapiens
ggtttctcaccttcagcactac

SEQ ID NO: 7439461 - DNA, 22 bp, Homo sapiens
ggtttggttctgagagttggca

SEQ ID NO: 7439462 - DNA, 22 bp, Homo sapiens
ggtttggttttggccatcttcc

SEQ ID NO: 7439463 - DNA, 22 bp, Homo sapiens
ggtttggttttggccatcttcc

SEQ ID NO: 7439464 - DNA, 19 bp, Homo sapiens
ggtttgtagaattgcttaa

SEQ ID NO: 7439465 - DNA, 22 bp, Homo sapiens
ggtttggttctgagagttggca

SEQ ID NO: 7439466 - DNA, 22 bp, Homo sapiens
ggtttgtggagctggaaacact

SEQ ID NO: 7439467 - DNA, 22 bp, Homo sapiens
ggtttgttggggtccaggccca

SEQ ID NO: 7439468 - DNA, 22 bp, Homo sapiens
ggtttgttggggtccaggccca

SEQ ID NO: 7439469 - DNA, 22 bp, Homo sapiens
ggttttaaccattcacaagtga

SEQ ID NO: 7439470 - DNA, 22 bp, Homo sapiens
ggttttaaccattcacaagtga

SEQ ID NO: 7439471 - DNA, 22 bp, Homo sapiens
ggttttaactacagaattgcaa

SEQ ID NO: 7439472 - DNA, 22 bp, Homo sapiens
ggttttaaccattcacaagtga

SEQ ID NO: 7439473 - DNA, 22 bp, Homo sapiens
ggttttccaaccggctatcatc

SEQ ID NO: 7439474 - DNA, 22 bp, Homo sapiens
ggttttctccccctcttctcag

SEQ ID NO: 7439475 - DNA, 22 bp, Homo sapiens
ggttttctgctgaagatttcac

SEQ ID NO: 7439476 - DNA, 22 bp, Homo sapiens
ggttttctccccctcttctcag

SEQ ID NO: 7439477 - DNA, 22 bp, Homo sapiens
ggttttgcaaatgagctaatga

SEQ ID NO: 7439478 - DNA, 22 bp, Homo sapiens
ggttttctgctgaagatttcac

SEQ ID NO: 7439479 - DNA, 22 bp, Homo sapiens
ggttttggaagtataaagatgt

SEQ ID NO: 7439480 - DNA, 22 bp, Homo sapiens
ggttttggaagtataaagatgt

SEQ ID NO: 7439481 - DNA, 22 bp, Homo sapiens
ggttttcacctccagaatgtgc

SEQ ID NO: 7439482 - DNA, 22 bp, Homo sapiens
ggttttattaccccttaaacac

SEQ ID NO: 7439483 - DNA, 22 bp, Homo sapiens
ggttttcaaagaggcatttcat

SEQ ID NO: 7439484 - DNA, 22 bp, Homo sapiens
ggttttattaactttaacatca

SEQ ID NO: 7439485 - DNA, 22 bp, Homo sapiens
ggttttattaactttaacatca

SEQ ID NO: 7439486 - DNA, 22 bp, Homo sapiens
ggttttattaccccttaaacac

SEQ ID NO: 7439487 - DNA, 22 bp, Homo sapiens
ggttttattaactttaacatca

SEQ ID NO: 7439488 - DNA, 22 bp, Homo sapiens
ggttttattaccccttaaacac

SEQ ID NO: 7439489 - DNA, 22 bp, Homo sapiens
ggttttatagcagtactatcag

SEQ ID NO: 7439490 - DNA, 22 bp, Homo sapiens
ggttttaactacagaattgcaa

SEQ ID NO: 7439491 - DNA, 22 bp, Homo sapiens
ggttttatagcagtactatcag

SEQ ID NO: 7439492 - DNA, 22 bp, Homo sapiens
ggttttatagcagtactatcag

SEQ ID NO: 7439493 - DNA, 22 bp, Homo sapiens
ggttttatcctacccacacagc

SEQ ID NO: 7439494 - DNA, 22 bp, Homo sapiens
ggttttatcctacccacacagc

SEQ ID NO: 7439495 - DNA, 22 bp, Homo sapiens
ggttttatcctacccacacagc

SEQ ID NO: 7439496 - DNA, 22 bp, Homo sapiens
ggttttatagcagtactatcag

SEQ ID NO: 7439497 - DNA, 22 bp, Homo sapiens
gtaaaacaagctttatggttcc

SEQ ID NO: 7439498 - DNA, 22 bp, Homo sapiens
gtaaaacaagctttatggttcc

SEQ ID NO: 7439499 - DNA, 22 bp, Homo sapiens
ggttttggctagaaatgcttaa

SEQ ID NO: 7439500 - DNA, 22 bp, Homo sapiens
gtaaaaaggccaagcccttgtg

SEQ ID NO: 7439501 - DNA, 22 bp, Homo sapiens
gtaaaaaggccaagcccttgtg

SEQ ID NO: 7439502 - DNA, 22 bp, Homo sapiens
gtaaaaaggccaagcccttgtg

SEQ ID NO: 7439503 - DNA, 22 bp, Homo sapiens
ggttttggctagaaatgcttaa

SEQ ID NO: 7439504 - DNA, 22 bp, Homo sapiens
ggttttggagcatggagagcct

SEQ ID NO: 7439505 - DNA, 18 bp, Homo sapiens
ggttttggcatgtgtgcc

SEQ ID NO: 7439506 - DNA, 22 bp, Homo sapiens
gtaaaaaggccaagcccttgtg

SEQ ID NO: 7439507 - DNA, 18 bp, Homo sapiens
ggttttggcatgtgtgcc

SEQ ID NO: 7439508 - DNA, 22 bp, Homo sapiens
ggttttggagcatggagagcct

SEQ ID NO: 7439509 - DNA, 22 bp, Homo sapiens
ggttttggaagtgtgtctgcag

SEQ ID NO: 7439510 - DNA, 22 bp, Homo sapiens
ggttttattaactttaacatca

SEQ ID NO: 7439511 - DNA, 22 bp, Homo sapiens
ggttttggaagtgtgtctgcag

SEQ ID NO: 7439512 - DNA, 22 bp, Homo sapiens
gtaaaacatgttttaactagga

SEQ ID NO: 7439513 - DNA, 22 bp, Homo sapiens
gtaaaacatgttttaactagga

SEQ ID NO: 7439514 - DNA, 22 bp, Homo sapiens
gtaaaacatgttttaactagga

SEQ ID NO: 7439515 - DNA, 22 bp, Homo sapiens
gtaaaacatgttttaactagga

SEQ ID NO: 7439516 - DNA, 22 bp, Homo sapiens
gtaaaacaagctttatggttcc

SEQ ID NO: 7439517 - DNA, 22 bp, Homo sapiens
gtaaaacaagctttatggttcc

SEQ ID NO: 7439518 - DNA, 22 bp, Homo sapiens
gtaaaacatgttttaactagga

SEQ ID NO: 7439519 - DNA, 22 bp, Homo sapiens
gtaaaacaagctttatggttcc

SEQ ID NO: 7439520 - DNA, 22 bp, Homo sapiens
gtaaaacaagctttatggttcc

SEQ ID NO: 7439521 - DNA, 22 bp, Homo sapiens
gtacatttctcccaacactaaa

SEQ ID NO: 7439522 - DNA, 22 bp, Homo sapiens
gtacatttctcccaacactaaa

SEQ ID NO: 7439523 - DNA, 22 bp, Homo sapiens
gtacatttctcccaacactaaa

SEQ ID NO: 7439524 - DNA, 22 bp, Homo sapiens
gtacatttctcccaacactaaa

SEQ ID NO: 7439525 - DNA, 22 bp, Homo sapiens
gtacatttctcccaacactaaa

SEQ ID NO: 7439526 - DNA, 22 bp, Homo sapiens
gtacatttctcccaacactaaa

SEQ ID NO: 7439527 - DNA, 22 bp, Homo sapiens
gtacatttctcttgttcttatt

SEQ ID NO: 7439528 - DNA, 22 bp, Homo sapiens
gtacatttctcttgttcttatt

SEQ ID NO: 7439529 - DNA, 22 bp, Homo sapiens
gtacatttctcttgttcttatt

SEQ ID NO: 7439530 - DNA, 22 bp, Homo sapiens
gtacatttctcttgttcttatt

SEQ ID NO: 7439531 - DNA, 22 bp, Homo sapiens
gtacatttctcttgttcttatt

SEQ ID NO: 7439532 - DNA, 22 bp, Homo sapiens
gtacatttctcttgttcttatt

SEQ ID NO: 7439533 - DNA, 22 bp, Homo sapiens
gtacatttctcttgttcttatt

SEQ ID NO: 7439534 - DNA, 20 bp, Homo sapiens
gtacattttcaggaggggat

SEQ ID NO: 7439535 - DNA, 22 bp, Homo sapiens
gtacattttactttgtttgaat

SEQ ID NO: 7439536 - DNA, 22 bp, Homo sapiens
gtacattttactttgtttgaat

SEQ ID NO: 7439537 - DNA, 22 bp, Homo sapiens
gtacattttactttgtttgaat

SEQ ID NO: 7439538 - DNA, 22 bp, Homo sapiens
gtacattttactttgtttgaat

SEQ ID NO: 7439539 - DNA, 22 bp, Homo sapiens
gtacattttactttgtttgaat

SEQ ID NO: 7439540 - DNA, 22 bp, Homo sapiens
gtacatttctcttgttcttatt

SEQ ID NO: 7439541 - DNA, 22 bp, Homo sapiens
gtacattttactttgtttgaat

SEQ ID NO: 7439542 - DNA, 22 bp, Homo sapiens
gtacattttactttgtttgaat

SEQ ID NO: 7439543 - DNA, 20 bp, Homo sapiens
gtaccagatataagtggaat

SEQ ID NO: 7439544 - DNA, 22 bp, Homo sapiens
gtaccagtctctgtgggcacct

SEQ ID NO: 7439545 - DNA, 22 bp, Homo sapiens
gtacattttgaggttaaaacaa

SEQ ID NO: 7439546 - DNA, 22 bp, Homo sapiens
gtacattttgaggttaaaacaa

SEQ ID NO: 7439547 - DNA, 22 bp, Homo sapiens
gtacattttgaggttaaaacaa

SEQ ID NO: 7439548 - DNA, 22 bp, Homo sapiens
gtacattttgaggttaaaacaa

SEQ ID NO: 7439549 - DNA, 22 bp, Homo sapiens
gtacattttgaggttaaaacaa

SEQ ID NO: 7439550 - DNA, 22 bp, Homo sapiens
gtacattttgaggttaaaacaa

SEQ ID NO: 7439551 - DNA, 22 bp, Homo sapiens
gtacattttgaggttaaaacaa

SEQ ID NO: 7439552 - DNA, 22 bp, Homo sapiens
gtacattttgaggttaaaacaa

SEQ ID NO: 7439553 - DNA, 22 bp, Homo sapiens
gtacattttgaggttaaaacaa

SEQ ID NO: 7439554 - DNA, 22 bp, Homo sapiens
gtacattttgaggttaaaacaa

SEQ ID NO: 7439555 - DNA, 22 bp, Homo sapiens
gtacccaaagcccattgggcca

SEQ ID NO: 7439556 - DNA, 22 bp, Homo sapiens
gtaccatgttgtttggaaggct

SEQ ID NO: 7439557 - DNA, 22 bp, Homo sapiens
gtaccatgggatctagggccca

SEQ ID NO: 7439558 - DNA, 22 bp, Homo sapiens
gtaccatgagcatcatgttttt

SEQ ID NO: 7439559 - DNA, 22 bp, Homo sapiens
gtaccagtcttcggagggacag

SEQ ID NO: 7439560 - DNA, 22 bp, Homo sapiens
gtaccataatgagtctcttaaa

SEQ ID NO: 7439561 - DNA, 22 bp, Homo sapiens
gtaccaaatctgtattaggaaa

SEQ ID NO: 7439562 - DNA, 22 bp, Homo sapiens
gtaccagtctctgtgggcacct

SEQ ID NO: 7439563 - DNA, 22 bp, Homo sapiens
gtaccctggggacttcctttta

SEQ ID NO: 7439564 - DNA, 22 bp, Homo sapiens
gtaccctgtggccagccagcca

SEQ ID NO: 7439565 - DNA, 22 bp, Homo sapiens
gtaccctgtggccagccagcca

SEQ ID NO: 7439566 - DNA, 22 bp, Homo sapiens
gtacatttaggattcattgaaa

SEQ ID NO: 7439567 - DNA, 23 bp, Homo sapiens
gtaaaatacgcagtgcagtgtga

SEQ ID NO: 7439568 - DNA, 22 bp, Homo sapiens
gtacatttaggattcattgaaa

SEQ ID NO: 7439569 - DNA, 22 bp, Homo sapiens
gtacatttatttttgcagcata

SEQ ID NO: 7439570 - DNA, 23 bp, Homo sapiens
gtaaaatacgcagtgcagtgtga

SEQ ID NO: 7439571 - DNA, 23 bp, Homo sapiens
gtaaaatacgcagtgcagtgtga

SEQ ID NO: 7439572 - DNA, 23 bp, Homo sapiens
gtaaaatacgcagtgcagtgtga

SEQ ID NO: 7439573 - DNA, 23 bp, Homo sapiens
gtaaaatacgcagtgcagtgtga

SEQ ID NO: 7439574 - DNA, 23 bp, Homo sapiens
gtaaaatacgcagtgcagtgtga

SEQ ID NO: 7439575 - DNA, 22 bp, Homo sapiens
gtaaaactgtctaatggtatat

SEQ ID NO: 7439576 - DNA, 22 bp, Homo sapiens
gtaaaactgtctaatggtatat

SEQ ID NO: 7439577 - DNA, 22 bp, Homo sapiens
gtaaaactgtctaatggtatat

SEQ ID NO: 7439578 - DNA, 22 bp, Homo sapiens
gtaaaactgtctaatggtatat

SEQ ID NO: 7439579 - DNA, 22 bp, Homo sapiens
gtaaaactgcagaacttggagg

SEQ ID NO: 7439580 - DNA, 22 bp, Homo sapiens
gtaaaacctgcttttcaacacc

SEQ ID NO: 7439581 - DNA, 22 bp, Homo sapiens
gtaaaacatgttttaactagga

SEQ ID NO: 7439582 - DNA, 22 bp, Homo sapiens
gtaaaactgcagaacttggagg

SEQ ID NO: 7439583 - DNA, 22 bp, Homo sapiens
gtacatttcatttaaatgatgt

SEQ ID NO: 7439584 - DNA, 22 bp, Homo sapiens
gtacatttcatttaaatgatgt

SEQ ID NO: 7439585 - DNA, 22 bp, Homo sapiens
gtacatttcatttaaatgatgt

SEQ ID NO: 7439586 - DNA, 22 bp, Homo sapiens
gtacatttcatttaaatgatgt

SEQ ID NO: 7439587 - DNA, 22 bp, Homo sapiens
gtacatttcatttaaatgatgt

SEQ ID NO: 7439588 - DNA, 22 bp, Homo sapiens
gtacatttcatttaaatgatgt

SEQ ID NO: 7439589 - DNA, 22 bp, Homo sapiens
gtacatttcatttaaatgatgt

SEQ ID NO: 7439590 - DNA, 22 bp, Homo sapiens
gtacatttcatttaaatgatgt

SEQ ID NO: 7439591 - DNA, 22 bp, Homo sapiens
gtacatttcagtttccttaaga

SEQ ID NO: 7439592 - DNA, 22 bp, Homo sapiens
gtacatttcagtttccttaaga

SEQ ID NO: 7439593 - DNA, 22 bp, Homo sapiens
gtacatttcagtttccttaaga

SEQ ID NO: 7439594 - DNA, 22 bp, Homo sapiens
gtacatttcagtttccttaaga

SEQ ID NO: 7439595 - DNA, 22 bp, Homo sapiens
gtacatttatttttgcagcata

SEQ ID NO: 7439596 - DNA, 22 bp, Homo sapiens
gtacatttatttttgcagcata

SEQ ID NO: 7439597 - DNA, 22 bp, Homo sapiens
gtacatttatttttgcagcata

SEQ ID NO: 7439598 - DNA, 22 bp, Homo sapiens
gtccaaaagagccagccgggcg

SEQ ID NO: 7439599 - DNA, 22 bp, Homo sapiens
gtccaaaagagccagccgggcg

SEQ ID NO: 7439600 - DNA, 22 bp, Homo sapiens
gtccaaaagagccagccgggcg

SEQ ID NO: 7439601 - DNA, 22 bp, Homo sapiens
gtcatttttttcgtaatagtgg

SEQ ID NO: 7439602 - DNA, 22 bp, Homo sapiens
gtcatttttttcgtaatagtgg

SEQ ID NO: 7439603 - DNA, 22 bp, Homo sapiens
gtccaaaagagccagccgggcg

SEQ ID NO: 7439604 - DNA, 22 bp, Homo sapiens
gtccaaaagagccagccgggcg

SEQ ID NO: 7439605 - DNA, 22 bp, Homo sapiens
gtccaaacaggtcaaaatatta

SEQ ID NO: 7439606 - DNA, 22 bp, Homo sapiens
gtccaaataagttgcaaaatag

SEQ ID NO: 7439607 - DNA, 22 bp, Homo sapiens
gtccaagagtcaagaagggggc

SEQ ID NO: 7439608 - DNA, 22 bp, Homo sapiens
gtccaagagtcaagaagggggc

SEQ ID NO: 7439609 - DNA, 22 bp, Homo sapiens
gtccaagagaactgaaatagga

SEQ ID NO: 7439610 - DNA, 22 bp, Homo sapiens
gtccaagagatgtaacgaagaa

SEQ ID NO: 7439611 - DNA, 22 bp, Homo sapiens
gtccaagagaactgaaatagga

SEQ ID NO: 7439612 - DNA, 22 bp, Homo sapiens
gtccaagagatgtaacgaagaa

SEQ ID NO: 7439613 - DNA, 22 bp, Homo sapiens
gtccaagagtcaagaagggggc

SEQ ID NO: 7439614 - DNA, 22 bp, Homo sapiens
gtccaagagtcaagaagggggc

SEQ ID NO: 7439615 - DNA, 22 bp, Homo sapiens
gtccaagagtcaagaagggggc

SEQ ID NO: 7439616 - DNA, 22 bp, Homo sapiens
gtccaagagtcaagaagggggc

SEQ ID NO: 7439617 - DNA, 22 bp, Homo sapiens
gtccaagagtcaagaagggggc

SEQ ID NO: 7439618 - DNA, 22 bp, Homo sapiens
gtccaagagtcaagaagggggc

SEQ ID NO: 7439619 - DNA, 22 bp, Homo sapiens
gtccacaacatcagactaactg

SEQ ID NO: 7439620 - DNA, 22 bp, Homo sapiens
gtccacaacatcagactaactg

SEQ ID NO: 7439621 - DNA, 22 bp, Homo sapiens
gtccacaaaattactatcttac

SEQ ID NO: 7439622 - DNA, 22 bp, Homo sapiens
gtccacactgaggccttctcca

SEQ ID NO: 7439623 - DNA, 22 bp, Homo sapiens
gtccacactgaggccttctcca

SEQ ID NO: 7439624 - DNA, 22 bp, Homo sapiens
gtccacaagcaggaagtgagcc

SEQ ID NO: 7439625 - DNA, 22 bp, Homo sapiens
gtccacaacatcagactaactg

SEQ ID NO: 7439626 - DNA, 22 bp, Homo sapiens
gtccaaggtctttggagataga

SEQ ID NO: 7439627 - DNA, 22 bp, Homo sapiens
gtccaaggtctttggagataga

SEQ ID NO: 7439628 - DNA, 22 bp, Homo sapiens
gtccaaggtctttggagataga

SEQ ID NO: 7439629 - DNA, 22 bp, Homo sapiens
gtccacaaaattactatcttac

SEQ ID NO: 7439630 - DNA, 22 bp, Homo sapiens
gtccaatggtaaatccaaataa

SEQ ID NO: 7439631 - DNA, 22 bp, Homo sapiens
gtccaaggatggggtctcccag

SEQ ID NO: 7439632 - DNA, 22 bp, Homo sapiens
gtccaaggatggggtctcccag

SEQ ID NO: 7439633 - DNA, 22 bp, Homo sapiens
gtccaaggatggggtctcccag

SEQ ID NO: 7439634 - DNA, 22 bp, Homo sapiens
gtccaaggatgcaggatgctgt

SEQ ID NO: 7439635 - DNA, 22 bp, Homo sapiens
gtccaaggatgcaggatgctgt

SEQ ID NO: 7439636 - DNA, 22 bp, Homo sapiens
gtccaagggtgcacaactagta

SEQ ID NO: 7439637 - DNA, 22 bp, Homo sapiens
gtccaaggtctttggagataga

SEQ ID NO: 7439638 - DNA, 22 bp, Homo sapiens
gtccaagggtgcacaactagta

SEQ ID NO: 7439639 - DNA, 22 bp, Homo sapiens
gtccaagggtgcacaactagta

SEQ ID NO: 7439640 - DNA, 22 bp, Homo sapiens
gtccaaggcaagtgtgcagagt

SEQ ID NO: 7439641 - DNA, 22 bp, Homo sapiens
gtccaaggcaagtgtgcagagt

SEQ ID NO: 7439642 - DNA, 22 bp, Homo sapiens
gtccaaggatgcaggatgctgt

SEQ ID NO: 7439643 - DNA, 22 bp, Homo sapiens
gtcatttttcactgcatataga

SEQ ID NO: 7439644 - DNA, 22 bp, Homo sapiens
gtcatttttgactttgaagtga

SEQ ID NO: 7439645 - DNA, 22 bp, Homo sapiens
gtcatttttgactttgaagtga

SEQ ID NO: 7439646 - DNA, 22 bp, Homo sapiens
gtcatttttttcgtaatagtgg

SEQ ID NO: 7439647 - DNA, 22 bp, Homo sapiens
gtcatttttgactttgaagtga

SEQ ID NO: 7439648 - DNA, 22 bp, Homo sapiens
gtcatttttgactttgaagtga

SEQ ID NO: 7439649 - DNA, 22 bp, Homo sapiens
gtcattttgctgcatatttaga

SEQ ID NO: 7439650 - DNA, 22 bp, Homo sapiens
gtcattttgctgcatatttaga

SEQ ID NO: 7439651 - DNA, 22 bp, Homo sapiens
gtcattttgctgcatatttaga

SEQ ID NO: 7439652 - DNA, 22 bp, Homo sapiens
gtcattttctagaattatttga

SEQ ID NO: 7439653 - DNA, 22 bp, Homo sapiens
gtcattttctagaattatttga

SEQ ID NO: 7439654 - DNA, 22 bp, Homo sapiens
gtcattttgctgcatatttaga

SEQ ID NO: 7439655 - DNA, 22 bp, Homo sapiens
gtcatttttcactgcatataga

SEQ ID NO: 7439656 - DNA, 22 bp, Homo sapiens
gtcattttctagaattatttga

SEQ ID NO: 7439657 - DNA, 22 bp, Homo sapiens
gtcattttctagaattatttga

SEQ ID NO: 7439658 - DNA, 22 bp, Homo sapiens
gtcattttatgggaacagattt

SEQ ID NO: 7439659 - DNA, 22 bp, Homo sapiens
gtcattttctagaattatttga

SEQ ID NO: 7439660 - DNA, 22 bp, Homo sapiens
gtatttcatcttgaaaaccagt

SEQ ID NO: 7439661 - DNA, 22 bp, Homo sapiens
gtatttccattagtgtgtgcac

SEQ ID NO: 7439662 - DNA, 22 bp, Homo sapiens
gtatttcatcttgaaaaccagt

SEQ ID NO: 7439663 - DNA, 22 bp, Homo sapiens
gtatttcatcttgaaaaccagt

SEQ ID NO: 7439664 - DNA, 22 bp, Homo sapiens
gtatttcatcttgaaaaccagt

SEQ ID NO: 7439665 - DNA, 22 bp, Homo sapiens
gtatttcagttcctcttgtgac

SEQ ID NO: 7439666 - DNA, 22 bp, Homo sapiens
gtatttcagttcctcttgtgac

SEQ ID NO: 7439667 - DNA, 19 bp, Homo sapiens
gtatttcaggacaagacgt

SEQ ID NO: 7439668 - DNA, 19 bp, Homo sapiens
gtatttcaggacaagacgt

SEQ ID NO: 7439669 - DNA, 23 bp, Homo sapiens
gtatttcagcattctcagttaaa

SEQ ID NO: 7439670 - DNA, 23 bp, Homo sapiens
gtatttcagcattctcagttaaa

SEQ ID NO: 7439671 - DNA, 22 bp, Homo sapiens
gtccccaaaattacaagacaca

SEQ ID NO: 7439672 - DNA, 22 bp, Homo sapiens
gtccccagaaaggtgaggcagg

SEQ ID NO: 7439673 - DNA, 22 bp, Homo sapiens
gtccccagaaaggtgaggcagg

SEQ ID NO: 7439674 - DNA, 22 bp, Homo sapiens
gtccccagaaaggtgaggcagg

SEQ ID NO: 7439675 - DNA, 22 bp, Homo sapiens
gtccccagagctggtggtggtt

SEQ ID NO: 7439676 - DNA, 22 bp, Homo sapiens
gtccccagagctggtggtggtt

SEQ ID NO: 7439677 - DNA, 22 bp, Homo sapiens
gtccccagaaaggtgaggcagg

SEQ ID NO: 7439678 - DNA, 22 bp, Homo sapiens
gtccccagagctggtggtggtt

SEQ ID NO: 7439679 - DNA, 22 bp, Homo sapiens
gtccccagagctggtggtggtt

SEQ ID NO: 7439680 - DNA, 22 bp, Homo sapiens
gtccccagagctggtggtggtt

SEQ ID NO: 7439681 - DNA, 22 bp, Homo sapiens
gtccccagagctggtggtggtt

SEQ ID NO: 7439682 - DNA, 22 bp, Homo sapiens
gtccccagctaatctctttgcc

SEQ ID NO: 7439683 - DNA, 22 bp, Homo sapiens
gtccccagctaatctctttgcc

SEQ ID NO: 7439684 - DNA, 22 bp, Homo sapiens
gtccccagagctggtggtggtt

SEQ ID NO: 7439685 - DNA, 22 bp, Homo sapiens
gtccccagctaatctctttgcc

SEQ ID NO: 7439686 - DNA, 22 bp, Homo sapiens
gtccccagaaaggtgaggcagg

SEQ ID NO: 7439687 - DNA, 22 bp, Homo sapiens
gtccccagaaaggtgaggcagg

SEQ ID NO: 7439688 - DNA, 22 bp, Homo sapiens
gtccccagaaaggtgaggcagg

SEQ ID NO: 7439689 - DNA, 22 bp, Homo sapiens
gtccccagaaaggtgaggcagg

SEQ ID NO: 7439690 - DNA, 22 bp, Homo sapiens
gtccactctctgccgtgcctgt

SEQ ID NO: 7439691 - DNA, 22 bp, Homo sapiens
gtccactgctgtgtgcttcacc

SEQ ID NO: 7439692 - DNA, 22 bp, Homo sapiens
gtccactgctgtgtgcttcacc

SEQ ID NO: 7439693 - DNA, 22 bp, Homo sapiens
gtccactgctgtgtgcttcacc

SEQ ID NO: 7439694 - DNA, 22 bp, Homo sapiens
gtccagaagcagtgcacatcac

SEQ ID NO: 7439695 - DNA, 23 bp, Homo sapiens
gtccagaacccaggctggggtgg

SEQ ID NO: 7439696 - DNA, 23 bp, Homo sapiens
gtccagaacccaggctggggtgg

SEQ ID NO: 7439697 - DNA, 23 bp, Homo sapiens
gtccagaacccaggctggggtgg

SEQ ID NO: 7439698 - DNA, 22 bp, Homo sapiens
gtccagaagcagtgcacatcac

SEQ ID NO: 7439699 - DNA, 22 bp, Homo sapiens
gtccagaagcagtgcacatcac

SEQ ID NO: 7439700 - DNA, 22 bp, Homo sapiens
gtcccatcccccttggcactca

SEQ ID NO: 7439701 - DNA, 22 bp, Homo sapiens
gtccagaaagggcagtgatttg

SEQ ID NO: 7439702 - DNA, 22 bp, Homo sapiens
gtccagaaagggcagtgatttg

SEQ ID NO: 7439703 - DNA, 22 bp, Homo sapiens
gtccagaaagggcagtgatttg

SEQ ID NO: 7439704 - DNA, 23 bp, Homo sapiens
gtccagaacccaggctggggtgg

SEQ ID NO: 7439705 - DNA, 22 bp, Homo sapiens
gtccacagagggctgggcaggc

SEQ ID NO: 7439706 - DNA, 22 bp, Homo sapiens
gtccacagagggctgggcaggc

SEQ ID NO: 7439707 - DNA, 22 bp, Homo sapiens
gtccacagagggctgggcaggc

SEQ ID NO: 7439708 - DNA, 22 bp, Homo sapiens
gtccacagagggctgggcaggc

SEQ ID NO: 7439709 - DNA, 22 bp, Homo sapiens
gtccacagatctcttgttgacc

SEQ ID NO: 7439710 - DNA, 22 bp, Homo sapiens
gtccacagatctcttgttgacc

SEQ ID NO: 7439711 - DNA, 18 bp, Homo sapiens
gtccacagccctcacagc

SEQ ID NO: 7439712 - DNA, 18 bp, Homo sapiens
gtccacagccctcacagc

SEQ ID NO: 7439713 - DNA, 18 bp, Homo sapiens
gtccacagattcttcact

SEQ ID NO: 7439714 - DNA, 18 bp, Homo sapiens
gtccacagattcttcact

SEQ ID NO: 7439715 - DNA, 18 bp, Homo sapiens
gtccacagattcttcact

SEQ ID NO: 7439716 - DNA, 22 bp, Homo sapiens
gtccacagctggccagggcctc

SEQ ID NO: 7439717 - DNA, 22 bp, Homo sapiens
gtccacagctggccagggcctc

SEQ ID NO: 7439718 - DNA, 22 bp, Homo sapiens
gtccacagctggccagggcctc

SEQ ID NO: 7439719 - DNA, 22 bp, Homo sapiens
gtccacagctggccagggcctc

SEQ ID NO: 7439720 - DNA, 22 bp, Homo sapiens
gtccacagctggccagggcctc

SEQ ID NO: 7439721 - DNA, 22 bp, Homo sapiens
gtccacagctctgaggtctccc

SEQ ID NO: 7439722 - DNA, 22 bp, Homo sapiens
gtccacagctctgaggtctccc

SEQ ID NO: 7439723 - DNA, 22 bp, Homo sapiens
gtccacagctctgaggtctccc

SEQ ID NO: 7439724 - DNA, 22 bp, Homo sapiens
gtccacagctctgaggtctccc

SEQ ID NO: 7439725 - DNA, 22 bp, Homo sapiens
gtccacagctctgaggtctccc

SEQ ID NO: 7439726 - DNA, 18 bp, Homo sapiens
gtccacagccctcacagc

SEQ ID NO: 7439727 - DNA, 22 bp, Homo sapiens
gtccactcccagtgcctgaggc

SEQ ID NO: 7439728 - DNA, 22 bp, Homo sapiens
gtccactcccagtgcctgaggc

SEQ ID NO: 7439729 - DNA, 22 bp, Homo sapiens
gtccaccttcttggtcaggccc

SEQ ID NO: 7439730 - DNA, 22 bp, Homo sapiens
gtccaccatagggagggcgtgg

SEQ ID NO: 7439731 - DNA, 22 bp, Homo sapiens
gtccacattttaaacttatgga

SEQ ID NO: 7439732 - DNA, 22 bp, Homo sapiens
gtccacccatgacacctgcctg

SEQ ID NO: 7439733 - DNA, 22 bp, Homo sapiens
gtccacccatgacacctgcctg

SEQ ID NO: 7439734 - DNA, 22 bp, Homo sapiens
gtccacagtgaggtgtttaaat

SEQ ID NO: 7439735 - DNA, 22 bp, Homo sapiens
gtccacagtgaggtgtttaaat

SEQ ID NO: 7439736 - DNA, 21 bp, Homo sapiens
gtccacaggggtttgtcctgg

SEQ ID NO: 7439737 - DNA, 21 bp, Homo sapiens
gtccacaggggtttgtcctgg

SEQ ID NO: 7439738 - DNA, 22 bp, Homo sapiens
gtccacagggatggccacacat

SEQ ID NO: 7439739 - DNA, 22 bp, Homo sapiens
gtccacagggatggccacacat

SEQ ID NO: 7439740 - DNA, 22 bp, Homo sapiens
gtccacagggatggccacacat

SEQ ID NO: 7439741 - DNA, 22 bp, Homo sapiens
gtccacagctggccagggcctc

SEQ ID NO: 7439742 - DNA, 22 bp, Homo sapiens
gtccctctgctctagagagcca

SEQ ID NO: 7439743 - DNA, 22 bp, Homo sapiens
gtccctctgctctagagagcca

SEQ ID NO: 7439744 - DNA, 22 bp, Homo sapiens
gtccctctgctctagagagcca

SEQ ID NO: 7439745 - DNA, 22 bp, Homo sapiens
gtccctctgcctgtggttctct

SEQ ID NO: 7439746 - DNA, 22 bp, Homo sapiens
gtccctctgggccatcaggtcc

SEQ ID NO: 7439747 - DNA, 22 bp, Homo sapiens
gtccctctgctctagagagcca

SEQ ID NO: 7439748 - DNA, 22 bp, Homo sapiens
gtccctctgctctagagagcca

SEQ ID NO: 7439749 - DNA, 22 bp, Homo sapiens
gtccctctgtgtccctgcagtc

SEQ ID NO: 7439750 - DNA, 22 bp, Homo sapiens
gtccctctgtgtccctgcagtc

SEQ ID NO: 7439751 - DNA, 22 bp, Homo sapiens
gtccctctgtgtccctgcagtc

SEQ ID NO: 7439752 - DNA, 22 bp, Homo sapiens
gtccctgcatcaccacgggact

SEQ ID NO: 7439753 - DNA, 22 bp, Homo sapiens
gtccctgcatcaccacgggact

SEQ ID NO: 7439754 - DNA, 22 bp, Homo sapiens
gtccctctgtgtccctgcagtc

SEQ ID NO: 7439755 - DNA, 22 bp, Homo sapiens
gtccctgagcctggcatttccc

SEQ ID NO: 7439756 - DNA, 22 bp, Homo sapiens
gtccctgacacccgggtggagg

SEQ ID NO: 7439757 - DNA, 23 bp, Homo sapiens
gtccctcacccctaggcaatgcc

SEQ ID NO: 7439758 - DNA, 22 bp, Homo sapiens
gtccctcagtagtgcacagtgg

SEQ ID NO: 7439759 - DNA, 22 bp, Homo sapiens
gtccctcactggaccatatgaa

SEQ ID NO: 7439760 - DNA, 22 bp, Homo sapiens
gtccctcactggaccatatgaa

SEQ ID NO: 7439761 - DNA, 22 bp, Homo sapiens
gtccctcactggaccatatgaa

SEQ ID NO: 7439762 - DNA, 22 bp, Homo sapiens
gtccctcactggaccatatgaa

SEQ ID NO: 7439763 - DNA, 22 bp, Homo sapiens
gtccctcagtagtgcacagtgg

SEQ ID NO: 7439764 - DNA, 22 bp, Homo sapiens
gtccctctgcctgtggttctct

SEQ ID NO: 7439765 - DNA, 22 bp, Homo sapiens
gtccctctcaaatttatatgct

SEQ ID NO: 7439766 - DNA, 22 bp, Homo sapiens
gtccctcagtagtgcacagtgg

SEQ ID NO: 7439767 - DNA, 22 bp, Homo sapiens
gtccctcagtagtgcacagtgg

SEQ ID NO: 7439768 - DNA, 23 bp, Homo sapiens
gtccctcacccctaggcaatgcc

SEQ ID NO: 7439769 - DNA, 23 bp, Homo sapiens
gtccctcacccctaggcaatgcc

SEQ ID NO: 7439770 - DNA, 22 bp, Homo sapiens
gtccctcaaggtccagtcatgg

SEQ ID NO: 7439771 - DNA, 22 bp, Homo sapiens
gtccctcacccagatgctccca

SEQ ID NO: 7439772 - DNA, 22 bp, Homo sapiens
gtccctcaaggtccagtcatgg

SEQ ID NO: 7439773 - DNA, 22 bp, Homo sapiens
gtccctcaaggtccagtcatgg

SEQ ID NO: 7439774 - DNA, 22 bp, Homo sapiens
gtccctagtggaaagacatgat

SEQ ID NO: 7439775 - DNA, 22 bp, Homo sapiens
gtcccgcattgggcattcctgg

SEQ ID NO: 7439776 - DNA, 22 bp, Homo sapiens
gtccccagctgtgacgagagcc

SEQ ID NO: 7439777 - DNA, 22 bp, Homo sapiens
gtccccagctgtgacgagagcc

SEQ ID NO: 7439778 - DNA, 22 bp, Homo sapiens
gtccccagctgtgacgagagcc

SEQ ID NO: 7439779 - DNA, 22 bp, Homo sapiens
gtccccagctaatctctttgcc

SEQ ID NO: 7439780 - DNA, 22 bp, Homo sapiens
gtccccagctaatctctttgcc

SEQ ID NO: 7439781 - DNA, 22 bp, Homo sapiens
gtccccagctgtgacgagagcc

SEQ ID NO: 7439782 - DNA, 22 bp, Homo sapiens
gtcccccacacttccatgtcac

SEQ ID NO: 7439783 - DNA, 22 bp, Homo sapiens
gtcccccacacttccatgtcac

SEQ ID NO: 7439784 - DNA, 22 bp, Homo sapiens
gtccccagctgtgacgagagcc

SEQ ID NO: 7439785 - DNA, 22 bp, Homo sapiens
gtccccagctgtgacgagagcc

SEQ ID NO: 7439786 - DNA, 22 bp, Homo sapiens
gtccccagctgtgacgagagcc

SEQ ID NO: 7439787 - DNA, 22 bp, Homo sapiens
gtccccagctgtgacgagagcc

SEQ ID NO: 7439788 - DNA, 22 bp, Homo sapiens
gtccccgacgtttggcttgatg

SEQ ID NO: 7439789 - DNA, 22 bp, Homo sapiens
gtccccgacgtttggcttgatg

SEQ ID NO: 7439790 - DNA, 22 bp, Homo sapiens
gtcccccacacttccatgtcac

SEQ ID NO: 7439791 - DNA, 22 bp, Homo sapiens
gtccccagctgtgacgagagcc

SEQ ID NO: 7439792 - DNA, 22 bp, Homo sapiens
gtcccctcaaaattcatatgtt

SEQ ID NO: 7439793 - DNA, 22 bp, Homo sapiens
gtccccgccgtcgctcaggctg

SEQ ID NO: 7439794 - DNA, 22 bp, Homo sapiens
gtcccctcaaaattcatatgtt

SEQ ID NO: 7439795 - DNA, 22 bp, Homo sapiens
gtcccctcagccacccatgggg

SEQ ID NO: 7439796 - DNA, 22 bp, Homo sapiens
gtcccctcagccacccatgggg

SEQ ID NO: 7439797 - DNA, 22 bp, Homo sapiens
gtcccctcagccacccatgggg

SEQ ID NO: 7439798 - DNA, 22 bp, Homo sapiens
gtcccctcagccacccatgggg

SEQ ID NO: 7439799 - DNA, 22 bp, Homo sapiens
gtcccctcattttagagaaaga

SEQ ID NO: 7439800 - DNA, 22 bp, Homo sapiens
gtcccctcattttagagaaaga

SEQ ID NO: 7439801 - DNA, 22 bp, Homo sapiens
gtcccctgctggtgttgctgct

SEQ ID NO: 7439802 - DNA, 22 bp, Homo sapiens
gtcccctggcccccagcgtcgg

SEQ ID NO: 7439803 - DNA, 22 bp, Homo sapiens
gtcccctggcccccagcgtcgg

SEQ ID NO: 7439804 - DNA, 22 bp, Homo sapiens
gtcccctggcccccagcgtcgg

SEQ ID NO: 7439805 - DNA, 22 bp, Homo sapiens
gtcccctgtccagggccagcca

SEQ ID NO: 7439806 - DNA, 22 bp, Homo sapiens
gtcccctgtccagggccagcca

SEQ ID NO: 7439807 - DNA, 22 bp, Homo sapiens
gtccccttaaacatgctctctt

SEQ ID NO: 7439808 - DNA, 22 bp, Homo sapiens
gtcccctgtccagggccagcca

SEQ ID NO: 7439809 - DNA, 22 bp, Homo sapiens
gtcccctgtccagggccagcca

SEQ ID NO: 7439810 - DNA, 22 bp, Homo sapiens
gtcccctgtccagggccagcca

SEQ ID NO: 7439811 - DNA, 22 bp, Homo sapiens
gtcccctggtggctggagctgc

SEQ ID NO: 7439812 - DNA, 22 bp, Homo sapiens
gtcccctggtggctggagctgc

SEQ ID NO: 7439813 - DNA, 22 bp, Homo sapiens
gtcccctggtggctggagctgc

SEQ ID NO: 7439814 - DNA, 22 bp, Homo sapiens
gtcccctggcccccagcgtcgg

SEQ ID NO: 7439815 - DNA, 22 bp, Homo sapiens
gtcccctgctggtgttgctgct

SEQ ID NO: 7439816 - DNA, 22 bp, Homo sapiens
gtcccctgctggtgttgctgct

SEQ ID NO: 7439817 - DNA, 22 bp, Homo sapiens
gtcccctggcccccagcgtcgg

SEQ ID NO: 7439818 - DNA, 17 bp, Homo sapiens
gtcctgggaggagagag

SEQ ID NO: 7439819 - DNA, 17 bp, Homo sapiens
gtcctgggaggagagag

SEQ ID NO: 7439820 - DNA, 17 bp, Homo sapiens
gtcctgggaggagagag

SEQ ID NO: 7439821 - DNA, 17 bp, Homo sapiens
gtcctgggaggagagag

SEQ ID NO: 7439822 - DNA, 17 bp, Homo sapiens
gtcctgggaggagagag

SEQ ID NO: 7439823 - DNA, 22 bp, Homo sapiens
gtcctgggaggggctggtcctg

SEQ ID NO: 7439824 - DNA, 22 bp, Homo sapiens
gtcctgggaggggctggtcctg

SEQ ID NO: 7439825 - DNA, 22 bp, Homo sapiens
gtcctgggaggggctggtcctg

SEQ ID NO: 7439826 - DNA, 17 bp, Homo sapiens
gtcctgggaggagagag

SEQ ID NO: 7439827 - DNA, 22 bp, Homo sapiens
gtcctgggcctgctgaggctga

SEQ ID NO: 7439828 - DNA, 22 bp, Homo sapiens
gtcctgggcctgctgaggctga

SEQ ID NO: 7439829 - DNA, 22 bp, Homo sapiens
gtcctgggcctgctgaggctga

SEQ ID NO: 7439830 - DNA, 22 bp, Homo sapiens
gtcctgggcccaggggctgcct

SEQ ID NO: 7439831 - DNA, 22 bp, Homo sapiens
gtcctgggcccaggggctgcct

SEQ ID NO: 7439832 - DNA, 22 bp, Homo sapiens
gtcctgggcccaggggctgcct

SEQ ID NO: 7439833 - DNA, 22 bp, Homo sapiens
gtcctgggcccaggggctgcct

SEQ ID NO: 7439834 - DNA, 22 bp, Homo sapiens
gtcctgggcccaggggctgcct

SEQ ID NO: 7439835 - DNA, 22 bp, Homo sapiens
gtcctgggaggggctggtcctg

SEQ ID NO: 7439836 - DNA, 22 bp, Homo sapiens
gtcctgggcatgcagggctttc

SEQ ID NO: 7439837 - DNA, 22 bp, Homo sapiens
gtcctgggcatgcagggctttc

SEQ ID NO: 7439838 - DNA, 22 bp, Homo sapiens
gtccctgccctcctgggactca

SEQ ID NO: 7439839 - DNA, 22 bp, Homo sapiens
gtccctgccctcctgggactca

SEQ ID NO: 7439840 - DNA, 22 bp, Homo sapiens
gtccctgccctcctgggactca

SEQ ID NO: 7439841 - DNA, 22 bp, Homo sapiens
gtccctggaaaagagctggtga

SEQ ID NO: 7439842 - DNA, 22 bp, Homo sapiens
gtccctgccctcctgggactca

SEQ ID NO: 7439843 - DNA, 22 bp, Homo sapiens
gtccctgcatctgcaggccatg

SEQ ID NO: 7439844 - DNA, 22 bp, Homo sapiens
gtccctgcatctgcaggccatg

SEQ ID NO: 7439845 - DNA, 22 bp, Homo sapiens
gtccctgcatctgcaggccatg

SEQ ID NO: 7439846 - DNA, 22 bp, Homo sapiens
gtccctgcatctgcaggccatg

SEQ ID NO: 7439847 - DNA, 22 bp, Homo sapiens
gtccctgcatctgcaggccatg

SEQ ID NO: 7439848 - DNA, 22 bp, Homo sapiens
gtccctgcatctgcaggccatg

SEQ ID NO: 7439849 - DNA, 22 bp, Homo sapiens
gtccctgcatcaccacgggact

SEQ ID NO: 7439850 - DNA, 22 bp, Homo sapiens
gtccctggaaaagagctggtga

SEQ ID NO: 7439851 - DNA, 22 bp, Homo sapiens
gtccctggaatggactctgcgc

SEQ ID NO: 7439852 - DNA, 22 bp, Homo sapiens
gtccctggaatggactctgcgc

SEQ ID NO: 7439853 - DNA, 22 bp, Homo sapiens
gtcctgggaactggacagctaa

SEQ ID NO: 7439854 - DNA, 22 bp, Homo sapiens
gtcctgggaactggacagctaa

SEQ ID NO: 7439855 - DNA, 22 bp, Homo sapiens
gtccctggaatggactctgcgc

SEQ ID NO: 7439856 - DNA, 22 bp, Homo sapiens
gtcctgggaaggaagccaggga

SEQ ID NO: 7439857 - DNA, 22 bp, Homo sapiens
gtcctgggaaggaagccaggga

SEQ ID NO: 7439858 - DNA, 22 bp, Homo sapiens
gtcctgggaaggaagccaggga

SEQ ID NO: 7439859 - DNA, 22 bp, Homo sapiens
gtcctgggaaggaagccaggga

SEQ ID NO: 7439860 - DNA, 22 bp, Homo sapiens
gtcctgggaaggaagccaggga

SEQ ID NO: 7439861 - DNA, 20 bp, Homo sapiens
gtcctgggagccacagcaca

SEQ ID NO: 7439862 - DNA, 20 bp, Homo sapiens
gtcctgggagccacagcaca

SEQ ID NO: 7439863 - DNA, 20 bp, Homo sapiens
gtcctgggagccacagcaca

SEQ ID NO: 7439864 - DNA, 20 bp, Homo sapiens
gtcctgggagccacagcaca

SEQ ID NO: 7439865 - DNA, 20 bp, Homo sapiens
gtcctgggagccacagcaca

SEQ ID NO: 7439866 - DNA, 20 bp, Homo sapiens
gtcctgggagccacagcaca

SEQ ID NO: 7439867 - DNA, 22 bp, Homo sapiens
gtcctgggagatgggaccctga

SEQ ID NO: 7439868 - DNA, 22 bp, Homo sapiens
ggagtccatgcagcttgagaca

SEQ ID NO: 7439869 - DNA, 22 bp, Homo sapiens
ggagtccatgcagcttgagaca

SEQ ID NO: 7439870 - DNA, 22 bp, Homo sapiens
ggagtcccagcaaagccttccc

SEQ ID NO: 7439871 - DNA, 22 bp, Homo sapiens
ggagtcctggactccatctcac

SEQ ID NO: 7439872 - DNA, 22 bp, Homo sapiens
ggagtcctggactccatctcac

SEQ ID NO: 7439873 - DNA, 22 bp, Homo sapiens
ggagtccaacgtgcagccagga

SEQ ID NO: 7439874 - DNA, 21 bp, Homo sapiens
ggagtccaaaaattagccatg

SEQ ID NO: 7439875 - DNA, 18 bp, Homo sapiens
ggagtctcaggagaggaa

SEQ ID NO: 7439876 - DNA, 22 bp, Homo sapiens
ggagtctagggtcctgggcctg

SEQ ID NO: 7439877 - DNA, 22 bp, Homo sapiens
ggagtctagggtcctgggcctg

SEQ ID NO: 7439878 - DNA, 22 bp, Homo sapiens
ggagtctgacccttagagatga

SEQ ID NO: 7439879 - DNA, 18 bp, Homo sapiens
ggagtctcaggagaggaa

SEQ ID NO: 7439880 - DNA, 22 bp, Homo sapiens
ggagtctgacccttagagatga

SEQ ID NO: 7439881 - DNA, 22 bp, Homo sapiens
ggagtctgacccttagagatga

SEQ ID NO: 7439882 - DNA, 22 bp, Homo sapiens
ggagtcctggactccatctcac

SEQ ID NO: 7439883 - DNA, 18 bp, Homo sapiens
ggagtctcaggagaggaa

SEQ ID NO: 7439884 - DNA, 22 bp, Homo sapiens
ggagtcctgtgtcttccaggaa

SEQ ID NO: 7439885 - DNA, 22 bp, Homo sapiens
ggagtctacgacctgcttcagg

SEQ ID NO: 7439886 - DNA, 22 bp, Homo sapiens
ggagtctacgacctgcttcagg

SEQ ID NO: 7439887 - DNA, 22 bp, Homo sapiens
ggagtgaggcatttgtagctga

SEQ ID NO: 7439888 - DNA, 22 bp, Homo sapiens
ggagtgagcaaatagagatttg

SEQ ID NO: 7439889 - DNA, 22 bp, Homo sapiens
ggagtgaggcatttgtagctga

SEQ ID NO: 7439890 - DNA, 22 bp, Homo sapiens
ggagtgaggcatttgtagctga

SEQ ID NO: 7439891 - DNA, 21 bp, Homo sapiens
ggagtctgaggaagaaaactg

SEQ ID NO: 7439892 - DNA, 22 bp, Homo sapiens
ggagtgaggcatttgtagctga

SEQ ID NO: 7439893 - DNA, 22 bp, Homo sapiens
ggagtgaggcatttgtagctga

SEQ ID NO: 7439894 - DNA, 22 bp, Homo sapiens
ggagtctgattttttatgggtg

SEQ ID NO: 7439895 - DNA, 22 bp, Homo sapiens
ggagtgaggcatttgtagctga

SEQ ID NO: 7439896 - DNA, 22 bp, Homo sapiens
ggagtctgagtcctcatagaca

SEQ ID NO: 7439897 - DNA, 22 bp, Homo sapiens
ggagtctgatactgagttcctc

SEQ ID NO: 7439898 - DNA, 22 bp, Homo sapiens
ggagtctgacccttagagatga

SEQ ID NO: 7439899 - DNA, 21 bp, Homo sapiens
ggagtctgaggaagaaaactg

SEQ ID NO: 7439900 - DNA, 22 bp, Homo sapiens
ggagtctgagtcctcatagaca

SEQ ID NO: 7439901 - DNA, 19 bp, Homo sapiens
ggagtctgagcccaggtat

SEQ ID NO: 7439902 - DNA, 22 bp, Homo sapiens
ggagtctgagcttgtgtcctgg

SEQ ID NO: 7439903 - DNA, 19 bp, Homo sapiens
ggagtctgagcccaggtat

SEQ ID NO: 7439904 - DNA, 22 bp, Homo sapiens
ggagtctgactctgaccctgga

SEQ ID NO: 7439905 - DNA, 22 bp, Homo sapiens
ggagtcaggagcaggctgggct

SEQ ID NO: 7439906 - DNA, 22 bp, Homo sapiens
ggagtcaggagcaggctgggct

SEQ ID NO: 7439907 - DNA, 22 bp, Homo sapiens
ggagtcaggatcctggggatgg

SEQ ID NO: 7439908 - DNA, 22 bp, Homo sapiens
ggagtcaggatcctggggatgg

SEQ ID NO: 7439909 - DNA, 22 bp, Homo sapiens
ggagtcaggagcaggctgggct

SEQ ID NO: 7439910 - DNA, 22 bp, Homo sapiens
ggagtcaggcagacctagttat

SEQ ID NO: 7439911 - DNA, 21 bp, Homo sapiens
ggagtcagggtctggctgggg

SEQ ID NO: 7439912 - DNA, 22 bp, Homo sapiens
ggagtcagtgatcgcgtgtctc

SEQ ID NO: 7439913 - DNA, 22 bp, Homo sapiens
ggagtcagaggaaggcttgctc

SEQ ID NO: 7439914 - DNA, 22 bp, Homo sapiens
ggagtcagaggaaggcttgctc

SEQ ID NO: 7439915 - DNA, 22 bp, Homo sapiens
ggagtcagaggaaggcttgctc

SEQ ID NO: 7439916 - DNA, 22 bp, Homo sapiens
ggagtcagcctgtcagagtgta

SEQ ID NO: 7439917 - DNA, 22 bp, Homo sapiens
ggagtcagcctgtcagagtgta

SEQ ID NO: 7439918 - DNA, 22 bp, Homo sapiens
ggagtcagcctgtcagagtgta

SEQ ID NO: 7439919 - DNA, 22 bp, Homo sapiens
ggagtcagcctgtcagagtgta

SEQ ID NO: 7439920 - DNA, 22 bp, Homo sapiens
ggagtcagcctgtcagagtgta

SEQ ID NO: 7439921 - DNA, 22 bp, Homo sapiens
ggagtcagcctgtcagagtgta

SEQ ID NO: 7439922 - DNA, 22 bp, Homo sapiens
ggagtcagcctgtcagagtgta

SEQ ID NO: 7439923 - DNA, 22 bp, Homo sapiens
ggagtcagcctgtcagagtgta

SEQ ID NO: 7439924 - DNA, 22 bp, Homo sapiens
ggagtcagcctgtcagagtgta

SEQ ID NO: 7439925 - DNA, 22 bp, Homo sapiens
ggagtcaccaagtaggagtctt

SEQ ID NO: 7439926 - DNA, 22 bp, Homo sapiens
ggagtcaccaagtaggagtctt

SEQ ID NO: 7439927 - DNA, 20 bp, Homo sapiens
ggagtcaccaagagagaccc

SEQ ID NO: 7439928 - DNA, 22 bp, Homo sapiens
ggagtcacacaggaagaaggac

SEQ ID NO: 7439929 - DNA, 22 bp, Homo sapiens
ggagtcacctgggaggactggg

SEQ ID NO: 7439930 - DNA, 22 bp, Homo sapiens
ggagtcaccaagtaggagtctt

SEQ ID NO: 7439931 - DNA, 22 bp, Homo sapiens
ggagtcagaacccaggcttcta

SEQ ID NO: 7439932 - DNA, 22 bp, Homo sapiens
ggagtcagaacccaggcttcta

SEQ ID NO: 7439933 - DNA, 22 bp, Homo sapiens
ggagtcagaatggcagggtggt

SEQ ID NO: 7439934 - DNA, 22 bp, Homo sapiens
ggagtcagaacccaggcttcta

SEQ ID NO: 7439935 - DNA, 19 bp, Homo sapiens
ggagtcactagaagccatc

SEQ ID NO: 7439936 - DNA, 19 bp, Homo sapiens
ggagtcactagaagccatc

SEQ ID NO: 7439937 - DNA, 22 bp, Homo sapiens
ggagtcagaatggcagggtggt

SEQ ID NO: 7439938 - DNA, 22 bp, Homo sapiens
ggagtcagaatggcagggtggt

SEQ ID NO: 7439939 - DNA, 22 bp, Homo sapiens
ggagtcagaggaaggcttgctc

SEQ ID NO: 7439940 - DNA, 22 bp, Homo sapiens
ggagtcagaatggcagggtggt

SEQ ID NO: 7439941 - DNA, 22 bp, Homo sapiens
ggagtcagaatggcagggtggt

SEQ ID NO: 7439942 - DNA, 22 bp, Homo sapiens
ggagccagagtctgcagtgtaa

SEQ ID NO: 7439943 - DNA, 22 bp, Homo sapiens
ggagccagagtctgcagtgtaa

SEQ ID NO: 7439944 - DNA, 22 bp, Homo sapiens
ggagccagagggatgcagttga

SEQ ID NO: 7439945 - DNA, 22 bp, Homo sapiens
ggagccagagggatgcagttga

SEQ ID NO: 7439946 - DNA, 22 bp, Homo sapiens
ggagccagagggatgcagttga

SEQ ID NO: 7439947 - DNA, 22 bp, Homo sapiens
ggagccagagtctgcagtgtaa

SEQ ID NO: 7439948 - DNA, 22 bp, Homo sapiens
ggagccagagtctgcagtgtaa

SEQ ID NO: 7439949 - DNA, 22 bp, Homo sapiens
ggagccagagtctgcagtgtaa

SEQ ID NO: 7439950 - DNA, 22 bp, Homo sapiens
ggagccagagtctgcagtgtaa

SEQ ID NO: 7439951 - DNA, 22 bp, Homo sapiens
ggagccagagtttaatgtggag

SEQ ID NO: 7439952 - DNA, 22 bp, Homo sapiens
ggagccagagtctgcagtgtaa

SEQ ID NO: 7439953 - DNA, 22 bp, Homo sapiens
ggagccagagtttaatgtggag

SEQ ID NO: 7439954 - DNA, 22 bp, Homo sapiens
ggagccagagtttaatgtggag

SEQ ID NO: 7439955 - DNA, 22 bp, Homo sapiens
ggagccagagtttaatgtggag

SEQ ID NO: 7439956 - DNA, 22 bp, Homo sapiens
ggagccagattgtataaaaaag

SEQ ID NO: 7439957 - DNA, 22 bp, Homo sapiens
ggagccagaggctgctgctgtg

SEQ ID NO: 7439958 - DNA, 22 bp, Homo sapiens
ggagccagaggctgctgctgtg

SEQ ID NO: 7439959 - DNA, 22 bp, Homo sapiens
ggagccagaggctgctgctgtg

SEQ ID NO: 7439960 - DNA, 22 bp, Homo sapiens
ggagccagaggctgctgctgtg

SEQ ID NO: 7439961 - DNA, 22 bp, Homo sapiens
ggagccagaggctgctgctgtg

SEQ ID NO: 7439962 - DNA, 22 bp, Homo sapiens
ggagccagaggctgctgctgtg

SEQ ID NO: 7439963 - DNA, 22 bp, Homo sapiens
ggagccagaggctgctgctgtg

SEQ ID NO: 7439964 - DNA, 22 bp, Homo sapiens
ggagccagaggctgctgctgtg

SEQ ID NO: 7439965 - DNA, 22 bp, Homo sapiens
ggagccagaggctgctgctgtg

SEQ ID NO: 7439966 - DNA, 22 bp, Homo sapiens
ggagccagaggctgctgctgtg

SEQ ID NO: 7439967 - DNA, 22 bp, Homo sapiens
ggagccagaggctgctgctgtg

SEQ ID NO: 7439968 - DNA, 22 bp, Homo sapiens
ggagccagagcactggggagcc

SEQ ID NO: 7439969 - DNA, 22 bp, Homo sapiens
ggagccagagcactggggagcc

SEQ ID NO: 7439970 - DNA, 22 bp, Homo sapiens
ggagccagagcactggggagcc

SEQ ID NO: 7439971 - DNA, 22 bp, Homo sapiens
ggagccagagcactggggagcc

SEQ ID NO: 7439972 - DNA, 22 bp, Homo sapiens
ggagccagagcactggggagcc

SEQ ID NO: 7439973 - DNA, 22 bp, Homo sapiens
ggagccagagcactggggagcc

SEQ ID NO: 7439974 - DNA, 22 bp, Homo sapiens
ggagccagcagggtgacactga

SEQ ID NO: 7439975 - DNA, 22 bp, Homo sapiens
ggagccagcagggtgacactga

SEQ ID NO: 7439976 - DNA, 22 bp, Homo sapiens
ggagccagcagggtgacactga

SEQ ID NO: 7439977 - DNA, 22 bp, Homo sapiens
ggagccagcagggtgacactga

SEQ ID NO: 7439978 - DNA, 23 bp, Homo sapiens
ggagccagcctgtggggagcggg

SEQ ID NO: 7439979 - DNA, 23 bp, Homo sapiens
ggagccagcctgtggggagcggg

SEQ ID NO: 7439980 - DNA, 22 bp, Homo sapiens
ggagccagcagggtgacactga

SEQ ID NO: 7439981 - DNA, 22 bp, Homo sapiens
ggagccagcagggtgacactga

SEQ ID NO: 7439982 - DNA, 22 bp, Homo sapiens
ggagccagcagggtgacactga

SEQ ID NO: 7439983 - DNA, 23 bp, Homo sapiens
ggagccagcctgtggggagcggg

SEQ ID NO: 7439984 - DNA, 23 bp, Homo sapiens
ggagccagcctgtggggagcggg

SEQ ID NO: 7439985 - DNA, 19 bp, Homo sapiens
ggagccagctgtggaaggc

SEQ ID NO: 7439986 - DNA, 22 bp, Homo sapiens
ggagccagctccctccttgtga

SEQ ID NO: 7439987 - DNA, 22 bp, Homo sapiens
ggagccagctccctccttgtga

SEQ ID NO: 7439988 - DNA, 22 bp, Homo sapiens
ggagtaggccccgggagagagt

SEQ ID NO: 7439989 - DNA, 22 bp, Homo sapiens
ggagtaggccccgggagagagt

SEQ ID NO: 7439990 - DNA, 17 bp, Homo sapiens
ggagccaggagcccacc

SEQ ID NO: 7439991 - DNA, 22 bp, Homo sapiens
ggagtcacacagagaagataag

SEQ ID NO: 7439992 - DNA, 22 bp, Homo sapiens
ggagtaggccccgggagagagt

SEQ ID NO: 7439993 - DNA, 22 bp, Homo sapiens
ggagtatatcgtgtatcatatg

SEQ ID NO: 7439994 - DNA, 22 bp, Homo sapiens
ggagtcaaggaaggctctgtga

SEQ ID NO: 7439995 - DNA, 19 bp, Homo sapiens
ggagccagctgtggaaggc

SEQ ID NO: 7439996 - DNA, 19 bp, Homo sapiens
ggagccagctgtggaaggc

SEQ ID NO: 7439997 - DNA, 19 bp, Homo sapiens
ggagccagctgtggaaggc

SEQ ID NO: 7439998 - DNA, 19 bp, Homo sapiens
ggagccagctgtggaaggc

SEQ ID NO: 7439999 - DNA, 19 bp, Homo sapiens
ggagccagctgtggaaggc

SEQ ID NO: 7440000 - DNA, 17 bp, Homo sapiens
ggagccaggagcccacc

SEQ ID NO: 7440001 - DNA, 17 bp, Homo sapiens
ggagccaggagcccacc

SEQ ID NO: 7440002 - DNA, 19 bp, Homo sapiens
ggagccagctgtggaaggc

SEQ ID NO: 7440003 - DNA, 19 bp, Homo sapiens
ggagccagctgtggaaggc

SEQ ID NO: 7440004 - DNA, 22 bp, Homo sapiens
ggcaaaaacagcaatgactttt

SEQ ID NO: 7440005 - DNA, 22 bp, Homo sapiens
ggcaaaaacagcaatgactttt

SEQ ID NO: 7440006 - DNA, 22 bp, Homo sapiens
ggcaaaaaccacaattactttt

SEQ ID NO: 7440007 - DNA, 22 bp, Homo sapiens
ggcaaaaaccacaattactttt

SEQ ID NO: 7440008 - DNA, 22 bp, Homo sapiens
ggcaaaaaccacaattactttt

SEQ ID NO: 7440009 - DNA, 22 bp, Homo sapiens
ggagtgctccgcgagagggatg

SEQ ID NO: 7440010 - DNA, 22 bp, Homo sapiens
ggagtgctccgcgagagggatg

SEQ ID NO: 7440011 - DNA, 22 bp, Homo sapiens
ggagtgctcctctccccagtgc

SEQ ID NO: 7440012 - DNA, 22 bp, Homo sapiens
ggagtgctgggccgctgccaac

SEQ ID NO: 7440013 - DNA, 22 bp, Homo sapiens
ggattttagagtacctaagtgt

SEQ ID NO: 7440014 - DNA, 22 bp, Homo sapiens
ggcaaaaacagcaatgactttt

SEQ ID NO: 7440015 - DNA, 22 bp, Homo sapiens
ggcaaaaacagcaatgactttt

SEQ ID NO: 7440016 - DNA, 22 bp, Homo sapiens
ggcaaaaaccgcaataacttct

SEQ ID NO: 7440017 - DNA, 22 bp, Homo sapiens
ggcaaaaaccgcaataacttct

SEQ ID NO: 7440018 - DNA, 22 bp, Homo sapiens
ggcaaaaaccgcaataacttct

SEQ ID NO: 7440019 - DNA, 22 bp, Homo sapiens
ggcaaaaagttcccatcagtgt

SEQ ID NO: 7440020 - DNA, 22 bp, Homo sapiens
ggcaaaaagttcccatcagtgt

SEQ ID NO: 7440021 - DNA, 22 bp, Homo sapiens
ggcaaaaagttcccatcagtgt

SEQ ID NO: 7440022 - DNA, 22 bp, Homo sapiens
ggcaaaaaccataattactttt

SEQ ID NO: 7440023 - DNA, 22 bp, Homo sapiens
ggcaaaaaccacaattactttt

SEQ ID NO: 7440024 - DNA, 22 bp, Homo sapiens
ggcaaaaaccgcaataacttct

SEQ ID NO: 7440025 - DNA, 22 bp, Homo sapiens
ggcaaaaaccataattactttt

SEQ ID NO: 7440026 - DNA, 22 bp, Homo sapiens
ggcaaaaaccataattactttt

SEQ ID NO: 7440027 - DNA, 22 bp, Homo sapiens
ggcaaaaaccataattactttt

SEQ ID NO: 7440028 - DNA, 22 bp, Homo sapiens
ggcaaacaggagagtaaagaga

SEQ ID NO: 7440029 - DNA, 22 bp, Homo sapiens
ggcaaacaggagagtaaagaga

SEQ ID NO: 7440030 - DNA, 22 bp, Homo sapiens
ggcaaacaggagagtaaagaga

SEQ ID NO: 7440031 - DNA, 22 bp, Homo sapiens
ggcaaacaggagagtaaagaga

SEQ ID NO: 7440032 - DNA, 22 bp, Homo sapiens
ggcaaagagacatgcatcgggg

SEQ ID NO: 7440033 - DNA, 22 bp, Homo sapiens
ggcaaagagatgatctttgcaa

SEQ ID NO: 7440034 - DNA, 22 bp, Homo sapiens
ggcaaagccctgcctggttcaa

SEQ ID NO: 7440035 - DNA, 22 bp, Homo sapiens
ggcaaagccttccagctgttac

SEQ ID NO: 7440036 - DNA, 22 bp, Homo sapiens
ggcaaacacacctcggtgagaa

SEQ ID NO: 7440037 - DNA, 22 bp, Homo sapiens
ggcaaacacacctcggtgagaa

SEQ ID NO: 7440038 - DNA, 22 bp, Homo sapiens
ggcaaacacacctcggtgagaa

SEQ ID NO: 7440039 - DNA, 22 bp, Homo sapiens
ggcaaacacacctcggtgagaa

SEQ ID NO: 7440040 - DNA, 22 bp, Homo sapiens
ggcaaacaccaggcgagggagc

SEQ ID NO: 7440041 - DNA, 22 bp, Homo sapiens
ggcaaaagtattatctctttaa

SEQ ID NO: 7440042 - DNA, 22 bp, Homo sapiens
ggcaaaagtattatctctttaa

SEQ ID NO: 7440043 - DNA, 22 bp, Homo sapiens
ggcaaaaatcacccctggttca

SEQ ID NO: 7440044 - DNA, 22 bp, Homo sapiens
ggcaaaaatcacccctggttca

SEQ ID NO: 7440045 - DNA, 22 bp, Homo sapiens
ggcaaaaatcacccctggttca

SEQ ID NO: 7440046 - DNA, 22 bp, Homo sapiens
ggcaaacaccaggcgagggagc

SEQ ID NO: 7440047 - DNA, 22 bp, Homo sapiens
ggcaaacaccaggcgagggagc

SEQ ID NO: 7440048 - DNA, 22 bp, Homo sapiens
ggcaaacagacttgaccatctt

SEQ ID NO: 7440049 - DNA, 22 bp, Homo sapiens
ggcaaacagacttgaccatctt

SEQ ID NO: 7440050 - DNA, 22 bp, Homo sapiens
ggcaaacagacttgaccatctt

SEQ ID NO: 7440051 - DNA, 22 bp, Homo sapiens
ggcaaacagacttgaccatctt

SEQ ID NO: 7440052 - DNA, 22 bp, Homo sapiens
ggcaaacagacttgaccatctt

SEQ ID NO: 7440053 - DNA, 23 bp, Homo sapiens
ggagtgcaatggcgccatctcgg

SEQ ID NO: 7440054 - DNA, 23 bp, Homo sapiens
ggagtgcaatggcgccatctcgg

SEQ ID NO: 7440055 - DNA, 23 bp, Homo sapiens
ggagtgcaatggcgccatctcgg

SEQ ID NO: 7440056 - DNA, 23 bp, Homo sapiens
ggagtgcaatggcgccatctcgg

SEQ ID NO: 7440057 - DNA, 23 bp, Homo sapiens
ggagtgcaatggcgccatctcgg

SEQ ID NO: 7440058 - DNA, 22 bp, Homo sapiens
ggagtgatggaaagtgcttggc

SEQ ID NO: 7440059 - DNA, 22 bp, Homo sapiens
ggagtgagtggccttgtcactg

SEQ ID NO: 7440060 - DNA, 22 bp, Homo sapiens
ggagtgatgcttgctgcctcca

SEQ ID NO: 7440061 - DNA, 22 bp, Homo sapiens
ggagtgatgcttgctgcctcca

SEQ ID NO: 7440062 - DNA, 23 bp, Homo sapiens
ggagtgcaatggcgccatctcgg

SEQ ID NO: 7440063 - DNA, 23 bp, Homo sapiens
ggagtgcaatggcgccatctcgg

SEQ ID NO: 7440064 - DNA, 23 bp, Homo sapiens
ggagtgcaatggcgccatctcgg

SEQ ID NO: 7440065 - DNA, 23 bp, Homo sapiens
ggagtgcaatggcgccatctcgg

SEQ ID NO: 7440066 - DNA, 23 bp, Homo sapiens
ggagtgcaatggcgccatctcgg

SEQ ID NO: 7440067 - DNA, 22 bp, Homo sapiens
ggagtgagtactggagtagctg

SEQ ID NO: 7440068 - DNA, 22 bp, Homo sapiens
ggagtgagtactggagtagctg

SEQ ID NO: 7440069 - DNA, 22 bp, Homo sapiens
ggagtgagtactggagtagctg

SEQ ID NO: 7440070 - DNA, 22 bp, Homo sapiens
ggagtgagtactggagtagctg

SEQ ID NO: 7440071 - DNA, 22 bp, Homo sapiens
ggagtgagtactggagtagctg

SEQ ID NO: 7440072 - DNA, 22 bp, Homo sapiens
ggagtgagtactggagtagctg

SEQ ID NO: 7440073 - DNA, 22 bp, Homo sapiens
ggagtgagtactggagtagctg

SEQ ID NO: 7440074 - DNA, 22 bp, Homo sapiens
ggagtgagtggccttgtcactg

SEQ ID NO: 7440075 - DNA, 22 bp, Homo sapiens
ggagtgagtggccttgtcactg

SEQ ID NO: 7440076 - DNA, 22 bp, Homo sapiens
ggagtgagtggccttgtcactg

SEQ ID NO: 7440077 - DNA, 22 bp, Homo sapiens
ggagtgagtactggagtagctg

SEQ ID NO: 7440078 - DNA, 22 bp, Homo sapiens
ggagtgagtactggagtagctg

SEQ ID NO: 7440079 - DNA, 23 bp, Homo sapiens
ggagtgcaatggcgccatctcgg

SEQ ID NO: 7440080 - DNA, 23 bp, Homo sapiens
ggagtgcaatggcgccatctcgg

SEQ ID NO: 7440081 - DNA, 22 bp, Homo sapiens
ggagtgcagctcacaggacatc

SEQ ID NO: 7440082 - DNA, 23 bp, Homo sapiens
ggagtgcaatggcgccatctcgg

SEQ ID NO: 7440083 - DNA, 22 bp, Homo sapiens
ggagtgcagtggtgggatctca

SEQ ID NO: 7440084 - DNA, 22 bp, Homo sapiens
ggagtgcagtggtgggatctca

SEQ ID NO: 7440085 - DNA, 22 bp, Homo sapiens
ggagtgccgaggtgttcaagga

SEQ ID NO: 7440086 - DNA, 22 bp, Homo sapiens
ggagtgcagtggtgggatctca

SEQ ID NO: 7440087 - DNA, 22 bp, Homo sapiens
ggagtgcggtggcaccatctca

SEQ ID NO: 7440088 - DNA, 22 bp, Homo sapiens
ggagtgctcagcgccaacctgg

SEQ ID NO: 7440089 - DNA, 22 bp, Homo sapiens
ggagtgctcagcgccaacctgg

SEQ ID NO: 7440090 - DNA, 22 bp, Homo sapiens
ggagtgcggtggcaccatctca

SEQ ID NO: 7440091 - DNA, 22 bp, Homo sapiens
ggagtgcaggtagcacaggaaa

SEQ ID NO: 7440092 - DNA, 22 bp, Homo sapiens
ggagtgcagtggcgtgagctcg

SEQ ID NO: 7440093 - DNA, 19 bp, Homo sapiens
ggcaagcacaaaagctttg

SEQ ID NO: 7440094 - DNA, 21 bp, Homo sapiens
ggcaagcctatgagatttcgc

SEQ ID NO: 7440095 - DNA, 22 bp, Homo sapiens
ggcaaggaagaagccatgatgt

SEQ ID NO: 7440096 - DNA, 22 bp, Homo sapiens
ggcaagctcaggcctcaggtgt

SEQ ID NO: 7440097 - DNA, 22 bp, Homo sapiens
ggcacagcaggagctatgtgaa

SEQ ID NO: 7440098 - DNA, 22 bp, Homo sapiens
ggcacagcaggagctatgtgaa

SEQ ID NO: 7440099 - DNA, 22 bp, Homo sapiens
ggcaaggaagaagccatgatgt

SEQ ID NO: 7440100 - DNA, 22 bp, Homo sapiens
ggcaaggaagaagccatgatgt

SEQ ID NO: 7440101 - DNA, 22 bp, Homo sapiens
ggcaagagttgaagctccagga

SEQ ID NO: 7440102 - DNA, 22 bp, Homo sapiens
ggcaagagttgaagctccagga

SEQ ID NO: 7440103 - DNA, 22 bp, Homo sapiens
ggcaagagtgaggagtgtctct

SEQ ID NO: 7440104 - DNA, 22 bp, Homo sapiens
ggcaagagtgaggagtgtctct

SEQ ID NO: 7440105 - DNA, 20 bp, Homo sapiens
ggcaagcaactgagggagga

SEQ ID NO: 7440106 - DNA, 22 bp, Homo sapiens
ggcaagagttgaagctccagga

SEQ ID NO: 7440107 - DNA, 20 bp, Homo sapiens
ggcaagcaactgagggagga

SEQ ID NO: 7440108 - DNA, 22 bp, Homo sapiens
ggcaagatccaaggggctagga

SEQ ID NO: 7440109 - DNA, 22 bp, Homo sapiens
ggcaagagggcagatggagtgc

SEQ ID NO: 7440110 - DNA, 22 bp, Homo sapiens
ggcaagaggtccaagaggtctc

SEQ ID NO: 7440111 - DNA, 22 bp, Homo sapiens
ggcaagaggtccaagaggtctc

SEQ ID NO: 7440112 - DNA, 22 bp, Homo sapiens
ggcaagaggtccaagaggtctc

SEQ ID NO: 7440113 - DNA, 22 bp, Homo sapiens
ggcaagagggcagatggagtgc

SEQ ID NO: 7440114 - DNA, 22 bp, Homo sapiens
ggcaagagggcagatggagtgc

SEQ ID NO: 7440115 - DNA, 22 bp, Homo sapiens
ggcaagaggtccaagaggtctc

SEQ ID NO: 7440116 - DNA, 22 bp, Homo sapiens
ggcaagaggtccaagaggtctc

SEQ ID NO: 7440117 - DNA, 22 bp, Homo sapiens
ggcaagaggtccaagaggtctc

SEQ ID NO: 7440118 - DNA, 22 bp, Homo sapiens
ggcaagaggtccaagaggtctc

SEQ ID NO: 7440119 - DNA, 22 bp, Homo sapiens
ggcaagaggtccaagaggtctc

SEQ ID NO: 7440120 - DNA, 22 bp, Homo sapiens
ggcaagaggtccaagaggtctc

SEQ ID NO: 7440121 - DNA, 22 bp, Homo sapiens
ggcaagaggtccaagaggtctc

SEQ ID NO: 7440122 - DNA, 22 bp, Homo sapiens
ggcaagaggtccaagaggtctc

SEQ ID NO: 7440123 - DNA, 22 bp, Homo sapiens
ggcaagaggtccaagaggtctc

SEQ ID NO: 7440124 - DNA, 22 bp, Homo sapiens
ggcaagagtgaggagtgtctct

SEQ ID NO: 7440125 - DNA, 22 bp, Homo sapiens
ggcaagagtgaggagtgtctct

SEQ ID NO: 7440126 - DNA, 22 bp, Homo sapiens
ggcaagagtgaggagtgtctct

SEQ ID NO: 7440127 - DNA, 22 bp, Homo sapiens
ggcaagagtgaggagtgtctct

SEQ ID NO: 7440128 - DNA, 22 bp, Homo sapiens
ggcaagagggcagatggagtgc

SEQ ID NO: 7440129 - DNA, 22 bp, Homo sapiens
ggcaagaaggcttcaggtagct

SEQ ID NO: 7440130 - DNA, 22 bp, Homo sapiens
ggcaagaaggcttcaggtagct

SEQ ID NO: 7440131 - DNA, 22 bp, Homo sapiens
ggcaagaacctcaattaccttt

SEQ ID NO: 7440132 - DNA, 22 bp, Homo sapiens
ggcaagaaccacaattactttt

SEQ ID NO: 7440133 - DNA, 22 bp, Homo sapiens
ggcaacattctccagatccttt

SEQ ID NO: 7440134 - DNA, 22 bp, Homo sapiens
ggcaacatgggaaaattaacct

SEQ ID NO: 7440135 - DNA, 17 bp, Homo sapiens
ggcaacatgttcttctg

SEQ ID NO: 7440136 - DNA, 22 bp, Homo sapiens
ggcaacatgatgtcaaccagga

SEQ ID NO: 7440137 - DNA, 21 bp, Homo sapiens
ggcaagaaacacaatcaagta

SEQ ID NO: 7440138 - DNA, 21 bp, Homo sapiens
ggcaagaaacacaatcaagta

SEQ ID NO: 7440139 - DNA, 22 bp, Homo sapiens
ggcaacctgagcttgtggagaa

SEQ ID NO: 7440140 - DNA, 22 bp, Homo sapiens
ggcaacctgagcttgtggagaa

SEQ ID NO: 7440141 - DNA, 22 bp, Homo sapiens
ggcaactcttcttgcaatgggg

SEQ ID NO: 7440142 - DNA, 22 bp, Homo sapiens
ggcaaatattatctttgctggt

SEQ ID NO: 7440143 - DNA, 18 bp, Homo sapiens
ggcaaatgcaattcaaag

SEQ ID NO: 7440144 - DNA, 19 bp, Homo sapiens
ggcaaattgaggccagtca

SEQ ID NO: 7440145 - DNA, 22 bp, Homo sapiens
ggcaacaactggacatagctgg

SEQ ID NO: 7440146 - DNA, 22 bp, Homo sapiens
ggcaacaactggacatagctgg

SEQ ID NO: 7440147 - DNA, 22 bp, Homo sapiens
ggcaacaactggacatagctgg

SEQ ID NO: 7440148 - DNA, 22 bp, Homo sapiens
ggcaaagttttcatctcataac

SEQ ID NO: 7440149 - DNA, 22 bp, Homo sapiens
ggcaaaggaaaacgtctcagct

SEQ ID NO: 7440150 - DNA, 22 bp, Homo sapiens
ggcaaaggaaaacgtctcagct

SEQ ID NO: 7440151 - DNA, 22 bp, Homo sapiens
ggcaaagccttccagctgttac

SEQ ID NO: 7440152 - DNA, 22 bp, Homo sapiens
ggcaaagcggccctgtggccag

SEQ ID NO: 7440153 - DNA, 22 bp, Homo sapiens
ggcaaagcggccctgtggccag

SEQ ID NO: 7440154 - DNA, 22 bp, Homo sapiens
ggcaaagcggccctgtggccag

SEQ ID NO: 7440155 - DNA, 22 bp, Homo sapiens
ggcaggcaccagctcagcaata

SEQ ID NO: 7440156 - DNA, 22 bp, Homo sapiens
ggcaggcaccagctcagcaata

SEQ ID NO: 7440157 - DNA, 22 bp, Homo sapiens
ggcaggcactgtgatagattct

SEQ ID NO: 7440158 - DNA, 22 bp, Homo sapiens
ggcaggcaccagctcagcaata

SEQ ID NO: 7440159 - DNA, 22 bp, Homo sapiens
ggcaggcaccagctcagcaata

SEQ ID NO: 7440160 - DNA, 22 bp, Homo sapiens
ggcaggcaccagctcagcaata

SEQ ID NO: 7440161 - DNA, 22 bp, Homo sapiens
ggcaggcaccagctcagcaata

SEQ ID NO: 7440162 - DNA, 22 bp, Homo sapiens
ggcaggcacatttgggggccgt

SEQ ID NO: 7440163 - DNA, 22 bp, Homo sapiens
ggcaggcacatttgggggccgt

SEQ ID NO: 7440164 - DNA, 22 bp, Homo sapiens
ggcaggcacatttgggggccgt

SEQ ID NO: 7440165 - DNA, 22 bp, Homo sapiens
ggcaggcacatttgggggccgt

SEQ ID NO: 7440166 - DNA, 22 bp, Homo sapiens
ggcaggcacagtaatacatgtt

SEQ ID NO: 7440167 - DNA, 22 bp, Homo sapiens
ggcaggcacagtaatacatgtt

SEQ ID NO: 7440168 - DNA, 22 bp, Homo sapiens
ggcaggcaatgaggatgggaag

SEQ ID NO: 7440169 - DNA, 22 bp, Homo sapiens
ggcaggcaatgaggatgggaag

SEQ ID NO: 7440170 - DNA, 22 bp, Homo sapiens
ggcaggcactgtgctaggcgct

SEQ ID NO: 7440171 - DNA, 22 bp, Homo sapiens
ggcaggcactgtgctaggcgct

SEQ ID NO: 7440172 - DNA, 22 bp, Homo sapiens
ggcaggcactgtgctaggcgct

SEQ ID NO: 7440173 - DNA, 22 bp, Homo sapiens
ggcaggcactgtgctaggcgct

SEQ ID NO: 7440174 - DNA, 22 bp, Homo sapiens
ggcaggcactgtgatagattct

SEQ ID NO: 7440175 - DNA, 22 bp, Homo sapiens
ggcaggcactgtgctaggcgct

SEQ ID NO: 7440176 - DNA, 22 bp, Homo sapiens
ggcaggcactgtgctaggcgct

SEQ ID NO: 7440177 - DNA, 22 bp, Homo sapiens
ggcaggcactgtgctaggcgct

SEQ ID NO: 7440178 - DNA, 22 bp, Homo sapiens
ggcaggcactgtgctaggcgct

SEQ ID NO: 7440179 - DNA, 22 bp, Homo sapiens
ggcaggcagaaaaatagaatat

SEQ ID NO: 7440180 - DNA, 22 bp, Homo sapiens
ggcaggcagaggctgagacagg

SEQ ID NO: 7440181 - DNA, 22 bp, Homo sapiens
ggcaggcagaaaaatagaatat

SEQ ID NO: 7440182 - DNA, 22 bp, Homo sapiens
ggcaggcactgtgttttgtgtt

SEQ ID NO: 7440183 - DNA, 22 bp, Homo sapiens
ggcaggcactgtgttttgtgtt

SEQ ID NO: 7440184 - DNA, 22 bp, Homo sapiens
ggcaggcaatgaggatgggaag

SEQ ID NO: 7440185 - DNA, 22 bp, Homo sapiens
ggcaggcaatgaggatgggaag

SEQ ID NO: 7440186 - DNA, 22 bp, Homo sapiens
ggcaggcaatgaggatgggaag

SEQ ID NO: 7440187 - DNA, 22 bp, Homo sapiens
ggcaggcaatgaggatgggaag

SEQ ID NO: 7440188 - DNA, 22 bp, Homo sapiens
ggcaggcaatgaggatgggaag

SEQ ID NO: 7440189 - DNA, 22 bp, Homo sapiens
ggcaggcaatgaggatgggaag

SEQ ID NO: 7440190 - DNA, 22 bp, Homo sapiens
ggcaggcaagtctgctctgtga

SEQ ID NO: 7440191 - DNA, 22 bp, Homo sapiens
ggcaggcaagtctgctctgtga

SEQ ID NO: 7440192 - DNA, 22 bp, Homo sapiens
ggcaggcaagtctgctctgtga

SEQ ID NO: 7440193 - DNA, 22 bp, Homo sapiens
ggcaggcaagtctgctctgtga

SEQ ID NO: 7440194 - DNA, 22 bp, Homo sapiens
ggcaggcaagtctgctctgtga

SEQ ID NO: 7440195 - DNA, 22 bp, Homo sapiens
ggcaggcaaggcagcctggtga

SEQ ID NO: 7440196 - DNA, 22 bp, Homo sapiens
ggcaggcaaggcagcctggtga

SEQ ID NO: 7440197 - DNA, 22 bp, Homo sapiens
ggcaggcaaggcagcctggtga

SEQ ID NO: 7440198 - DNA, 22 bp, Homo sapiens
ggcaggcaaggcagcctggtga

SEQ ID NO: 7440199 - DNA, 22 bp, Homo sapiens
ggcaggcaacggaccactagtc

SEQ ID NO: 7440200 - DNA, 18 bp, Homo sapiens
ggcaggatttcaactttc

SEQ ID NO: 7440201 - DNA, 22 bp, Homo sapiens
ggcaggcaacggaccactagtc

SEQ ID NO: 7440202 - DNA, 22 bp, Homo sapiens
ggcaggcaacggaccactagtc

SEQ ID NO: 7440203 - DNA, 22 bp, Homo sapiens
ggcaggcaaggcagcctggtga

SEQ ID NO: 7440204 - DNA, 22 bp, Homo sapiens
ggcaggcaaggcagcctggtga

SEQ ID NO: 7440205 - DNA, 22 bp, Homo sapiens
ggcaggcaaggcagcctggtga

SEQ ID NO: 7440206 - DNA, 22 bp, Homo sapiens
ggcaggcaacggaccactagtc

SEQ ID NO: 7440207 - DNA, 22 bp, Homo sapiens
ggcaggcaacggaccactagtc

SEQ ID NO: 7440208 - DNA, 21 bp, Homo sapiens
ggcaggatggcagtggacccc

SEQ ID NO: 7440209 - DNA, 22 bp, Homo sapiens
ggcaggaggtgagtggcgggtg

SEQ ID NO: 7440210 - DNA, 22 bp, Homo sapiens
ggcaggaggtgagtggcgggtg

SEQ ID NO: 7440211 - DNA, 21 bp, Homo sapiens
ggcaggatggcagtggacccc

SEQ ID NO: 7440212 - DNA, 21 bp, Homo sapiens
ggcaggatggcagtggacccc

SEQ ID NO: 7440213 - DNA, 18 bp, Homo sapiens
ggcaggatttcaactttc

SEQ ID NO: 7440214 - DNA, 18 bp, Homo sapiens
ggcaggatttcaactttc

SEQ ID NO: 7440215 - DNA, 18 bp, Homo sapiens
ggcaggatttcaactttc

SEQ ID NO: 7440216 - DNA, 22 bp, Homo sapiens
ggcaggcaacggaccactagtc

SEQ ID NO: 7440217 - DNA, 22 bp, Homo sapiens
ggcaggagggcggacaatgacc

SEQ ID NO: 7440218 - DNA, 22 bp, Homo sapiens
ggcaggaggtgagtggcgggtg

SEQ ID NO: 7440219 - DNA, 22 bp, Homo sapiens
ggcaggaggtgagtggcgggtg

SEQ ID NO: 7440220 - DNA, 22 bp, Homo sapiens
ggcaggaggtgagtggcgggtg

SEQ ID NO: 7440221 - DNA, 22 bp, Homo sapiens
ggcaggagggcggacaatgacc

SEQ ID NO: 7440222 - DNA, 22 bp, Homo sapiens
ggcaggagggcggacaatgacc

SEQ ID NO: 7440223 - DNA, 22 bp, Homo sapiens
ggcaggaggtgagtggcgggtg

SEQ ID NO: 7440224 - DNA, 22 bp, Homo sapiens
ggcaggaggtgagtggcgggtg

SEQ ID NO: 7440225 - DNA, 22 bp, Homo sapiens
ggcaggaggtgagtggcgggtg

SEQ ID NO: 7440226 - DNA, 22 bp, Homo sapiens
ggcaggaggtgagtggcgggtg

SEQ ID NO: 7440227 - DNA, 22 bp, Homo sapiens
ggcaggaggtgagtggcgggtg

SEQ ID NO: 7440228 - DNA, 22 bp, Homo sapiens
ggcaggaggtgagtggcgggtg

SEQ ID NO: 7440229 - DNA, 22 bp, Homo sapiens
ggcaggaggtgagtggcgggtg

SEQ ID NO: 7440230 - DNA, 22 bp, Homo sapiens
ggcaggaggtgagtggcgggtg

SEQ ID NO: 7440231 - DNA, 22 bp, Homo sapiens
ggcaggaggtgagtggcgggtg

SEQ ID NO: 7440232 - DNA, 22 bp, Homo sapiens
ggcaggaggtgagtggcgggtg

SEQ ID NO: 7440233 - DNA, 22 bp, Homo sapiens
ggcaggaggtgagtggcgggtg

SEQ ID NO: 7440234 - DNA, 22 bp, Homo sapiens
ggcaggagggcggacaatgacc

SEQ ID NO: 7440235 - DNA, 22 bp, Homo sapiens
ggcaggagggcggacaatgacc

SEQ ID NO: 7440236 - DNA, 22 bp, Homo sapiens
ggcaggagggcggacaatgacc

SEQ ID NO: 7440237 - DNA, 22 bp, Homo sapiens
ggcaggagggcggacaatgacc

SEQ ID NO: 7440238 - DNA, 22 bp, Homo sapiens
ggcaggaggaagagttagcacc

SEQ ID NO: 7440239 - DNA, 22 bp, Homo sapiens
ggcaggagggcggacaatgacc

SEQ ID NO: 7440240 - DNA, 22 bp, Homo sapiens
ggcaggaggaagagttagcacc

SEQ ID NO: 7440241 - DNA, 22 bp, Homo sapiens
ggcagaggtagctggaaccagg

SEQ ID NO: 7440242 - DNA, 22 bp, Homo sapiens
ggcagaggtagctggaaccagg

SEQ ID NO: 7440243 - DNA, 22 bp, Homo sapiens
ggcagaggtagctggaaccagg

SEQ ID NO: 7440244 - DNA, 22 bp, Homo sapiens
ggcagaggtagctggaaccagg

SEQ ID NO: 7440245 - DNA, 22 bp, Homo sapiens
ggcaggaggaagagttagcacc

SEQ ID NO: 7440246 - DNA, 22 bp, Homo sapiens
ggcagaggtgaagttcacaagg

SEQ ID NO: 7440247 - DNA, 22 bp, Homo sapiens
ggcagaggtagctggaaccagg

SEQ ID NO: 7440248 - DNA, 22 bp, Homo sapiens
ggcaggaggaagagttagcacc

SEQ ID NO: 7440249 - DNA, 22 bp, Homo sapiens
ggcagaggtagctggaaccagg

SEQ ID NO: 7440250 - DNA, 22 bp, Homo sapiens
ggcagaggtagctggaaccagg

SEQ ID NO: 7440251 - DNA, 22 bp, Homo sapiens
ggcagaggtagctggaaccagg

SEQ ID NO: 7440252 - DNA, 22 bp, Homo sapiens
ggcagaggtagctggaaccagg

SEQ ID NO: 7440253 - DNA, 22 bp, Homo sapiens
ggcagaggtagctggaaccagg

SEQ ID NO: 7440254 - DNA, 22 bp, Homo sapiens
ggcagaggtagctggaaccagg

SEQ ID NO: 7440255 - DNA, 22 bp, Homo sapiens
ggcagaggtagctggaaccagg

SEQ ID NO: 7440256 - DNA, 22 bp, Homo sapiens
ggcagaggtagctggaaccagg

SEQ ID NO: 7440257 - DNA, 22 bp, Homo sapiens
ggcagaggtagctggaaccagg

SEQ ID NO: 7440258 - DNA, 22 bp, Homo sapiens
ggcagaggtagctggaaccagg

SEQ ID NO: 7440259 - DNA, 22 bp, Homo sapiens
ggcagaggtagctggaaccagg

SEQ ID NO: 7440260 - DNA, 22 bp, Homo sapiens
ggcagaggtagctggaaccagg

SEQ ID NO: 7440261 - DNA, 22 bp, Homo sapiens
ggcagaggtagctggaaccagg

SEQ ID NO: 7440262 - DNA, 22 bp, Homo sapiens
ggcagaggtagctggaaccagg

SEQ ID NO: 7440263 - DNA, 22 bp, Homo sapiens
ggcagaggtagctggaaccagg

SEQ ID NO: 7440264 - DNA, 22 bp, Homo sapiens
ggcagaggtagctggaaccagg

SEQ ID NO: 7440265 - DNA, 22 bp, Homo sapiens
ggcagaggtagctggaaccagg

SEQ ID NO: 7440266 - DNA, 22 bp, Homo sapiens
ggcagaggtagctggaaccagg

SEQ ID NO: 7440267 - DNA, 22 bp, Homo sapiens
ggcagaggtagctggaaccagg

SEQ ID NO: 7440268 - DNA, 22 bp, Homo sapiens
ggcagaggtagctggaaccagg

SEQ ID NO: 7440269 - DNA, 22 bp, Homo sapiens
ggcagaggtagctggaaccagg

SEQ ID NO: 7440270 - DNA, 20 bp, Homo sapiens
ggcagagggcctgggagaag

SEQ ID NO: 7440271 - DNA, 20 bp, Homo sapiens
ggcagagggcctgggagaag

SEQ ID NO: 7440272 - DNA, 20 bp, Homo sapiens
ggcagagggcctgggagaag

SEQ ID NO: 7440273 - DNA, 20 bp, Homo sapiens
ggcagagggcctgggagaag

SEQ ID NO: 7440274 - DNA, 20 bp, Homo sapiens
ggcagagggcctgggagaag

SEQ ID NO: 7440275 - DNA, 20 bp, Homo sapiens
ggcagagggcctgggagaag

SEQ ID NO: 7440276 - DNA, 20 bp, Homo sapiens
ggcagagggcctgggagaag

SEQ ID NO: 7440277 - DNA, 20 bp, Homo sapiens
ggcagagggcctgggagaag

SEQ ID NO: 7440278 - DNA, 20 bp, Homo sapiens
ggcagagggcctgggagaag

SEQ ID NO: 7440279 - DNA, 22 bp, Homo sapiens
ggcagaggtagctggaaccagg

SEQ ID NO: 7440280 - DNA, 22 bp, Homo sapiens
ggcagaggtagctggaaccagg

SEQ ID NO: 7440281 - DNA, 22 bp, Homo sapiens
ggcagaggtagctggaaccagg

SEQ ID NO: 7440282 - DNA, 20 bp, Homo sapiens
ggcagagggcctgggagaag

SEQ ID NO: 7440283 - DNA, 20 bp, Homo sapiens
ggcagagggcctgggagaag

SEQ ID NO: 7440284 - DNA, 20 bp, Homo sapiens
ggcagagggcctgggagaag

SEQ ID NO: 7440285 - DNA, 20 bp, Homo sapiens
ggcagagggcctgggagaag

SEQ ID NO: 7440286 - DNA, 20 bp, Homo sapiens
ggcagagggcctgggagaag

SEQ ID NO: 7440287 - DNA, 20 bp, Homo sapiens
ggcagagggcctgggagaag

SEQ ID NO: 7440288 - DNA, 20 bp, Homo sapiens
ggcagagggcctgggagaag

SEQ ID NO: 7440289 - DNA, 20 bp, Homo sapiens
ggcagagggcctgggagaag

SEQ ID NO: 7440290 - DNA, 20 bp, Homo sapiens
ggcagagggcctgggagaag

SEQ ID NO: 7440291 - DNA, 20 bp, Homo sapiens
ggcagagggcctgggagaag

SEQ ID NO: 7440292 - DNA, 20 bp, Homo sapiens
ggcagagggcctgggagaag

SEQ ID NO: 7440293 - DNA, 20 bp, Homo sapiens
ggcagagggcctgggagaag

SEQ ID NO: 7440294 - DNA, 22 bp, Homo sapiens
ggcagaggaggggtgaatttgc

SEQ ID NO: 7440295 - DNA, 22 bp, Homo sapiens
ggcagaggaggggtgaatttgc

SEQ ID NO: 7440296 - DNA, 22 bp, Homo sapiens
ggcagaggaggggtgaatttgc

SEQ ID NO: 7440297 - DNA, 20 bp, Homo sapiens
ggcagagggcctgggagaag

SEQ ID NO: 7440298 - DNA, 22 bp, Homo sapiens
ggcagaggaggggtgaatttgc

SEQ ID NO: 7440299 - DNA, 22 bp, Homo sapiens
ggcagaggaggggtgaatttgc

SEQ ID NO: 7440300 - DNA, 22 bp, Homo sapiens
ggcagaggagctggaaacatgg

SEQ ID NO: 7440301 - DNA, 22 bp, Homo sapiens
ggcagaggaggggtgaatttgc

SEQ ID NO: 7440302 - DNA, 22 bp, Homo sapiens
ggcagaggaggggtgaatttgc

SEQ ID NO: 7440303 - DNA, 22 bp, Homo sapiens
ggcagaggagctggaaacatgg

SEQ ID NO: 7440304 - DNA, 22 bp, Homo sapiens
ggcagaggagctggaaacatgg

SEQ ID NO: 7440305 - DNA, 22 bp, Homo sapiens
ggcagaggagctggaaacatgg

SEQ ID NO: 7440306 - DNA, 22 bp, Homo sapiens
ggcagaggagctggaaacatgg

SEQ ID NO: 7440307 - DNA, 22 bp, Homo sapiens
ggcagaggagctggaaacatgg

SEQ ID NO: 7440308 - DNA, 22 bp, Homo sapiens
ggcagaggagctggaaacatgg

SEQ ID NO: 7440309 - DNA, 22 bp, Homo sapiens
ggcagaggaggggtgaatttgc

SEQ ID NO: 7440310 - DNA, 22 bp, Homo sapiens
ggcagaggagctggaaacatgg

SEQ ID NO: 7440311 - DNA, 22 bp, Homo sapiens
ggcagaggagctggaaacatgg

SEQ ID NO: 7440312 - DNA, 22 bp, Homo sapiens
ggcagaggagctggaaacatgg

SEQ ID NO: 7440313 - DNA, 22 bp, Homo sapiens
ggcagaggagctggaaacatgg

SEQ ID NO: 7440314 - DNA, 22 bp, Homo sapiens
ggcagaggagctggaaacatgg

SEQ ID NO: 7440315 - DNA, 22 bp, Homo sapiens
ggcagaggagctggaaacatgg

SEQ ID NO: 7440316 - DNA, 22 bp, Homo sapiens
ggcagaggagctggaaacatgg

SEQ ID NO: 7440317 - DNA, 22 bp, Homo sapiens
ggcagaggagctggaaacatgg

SEQ ID NO: 7440318 - DNA, 22 bp, Homo sapiens
ggcagaggagctggaaacatgg

SEQ ID NO: 7440319 - DNA, 22 bp, Homo sapiens
ggcagaggagctggaaacatgg

SEQ ID NO: 7440320 - DNA, 22 bp, Homo sapiens
ggcagaggaaggatgaattcac

SEQ ID NO: 7440321 - DNA, 22 bp, Homo sapiens
ggcagaggaaggatgaattcac

SEQ ID NO: 7440322 - DNA, 22 bp, Homo sapiens
ggcagaggaaggatgaattcac

SEQ ID NO: 7440323 - DNA, 22 bp, Homo sapiens
ggcagaggaaggatgaattcac

SEQ ID NO: 7440324 - DNA, 22 bp, Homo sapiens
ggcagaggaaggatgaattcac

SEQ ID NO: 7440325 - DNA, 22 bp, Homo sapiens
ggcagaggaaggatgaattcac

SEQ ID NO: 7440326 - DNA, 22 bp, Homo sapiens
ggcagaggagctggaaacatgg

SEQ ID NO: 7440327 - DNA, 22 bp, Homo sapiens
ggcagaggaagctggaagtggg

SEQ ID NO: 7440328 - DNA, 22 bp, Homo sapiens
ggcagaggaaggatgaattcac

SEQ ID NO: 7440329 - DNA, 22 bp, Homo sapiens
ggcagaggaagctggaagtggg

SEQ ID NO: 7440330 - DNA, 22 bp, Homo sapiens
ggcagaggaaggatgaattcac

SEQ ID NO: 7440331 - DNA, 22 bp, Homo sapiens
ggcagaggaagctggaagtggg

SEQ ID NO: 7440332 - DNA, 22 bp, Homo sapiens
ggcagaggaaggatgaattcac

SEQ ID NO: 7440333 - DNA, 22 bp, Homo sapiens
ggcagaggaagctggaagtggg

SEQ ID NO: 7440334 - DNA, 22 bp, Homo sapiens
ggcaccaggctgggcataggcc

SEQ ID NO: 7440335 - DNA, 22 bp, Homo sapiens
ggcaccaggctgggcataggcc

SEQ ID NO: 7440336 - DNA, 22 bp, Homo sapiens
ggcaccaggctgggcataggcc

SEQ ID NO: 7440337 - DNA, 22 bp, Homo sapiens
ggcaccaggctgggcataggcc

SEQ ID NO: 7440338 - DNA, 20 bp, Homo sapiens
ggcaccaggctaggattgga

SEQ ID NO: 7440339 - DNA, 20 bp, Homo sapiens
ggcaccaggctaggattgga

SEQ ID NO: 7440340 - DNA, 20 bp, Homo sapiens
ggcaccaggctaggattgga

SEQ ID NO: 7440341 - DNA, 20 bp, Homo sapiens
ggcaccaggctaggattgga

SEQ ID NO: 7440342 - DNA, 22 bp, Homo sapiens
ggcaccaggatcagtctgtcat

SEQ ID NO: 7440343 - DNA, 23 bp, Homo sapiens
ggcaccaggccatggagcgggag

SEQ ID NO: 7440344 - DNA, 22 bp, Homo sapiens
ggcaccaggatcagtctgtcat

SEQ ID NO: 7440345 - DNA, 22 bp, Homo sapiens
ggcaccaggacatgactcccag

SEQ ID NO: 7440346 - DNA, 22 bp, Homo sapiens
ggcaccaggacatgactcccag

SEQ ID NO: 7440347 - DNA, 22 bp, Homo sapiens
ggcaccaggacatgactcccag

SEQ ID NO: 7440348 - DNA, 22 bp, Homo sapiens
ggcaccaggacatgactcccag

SEQ ID NO: 7440349 - DNA, 22 bp, Homo sapiens
ggcaccaggacatgactcccag

SEQ ID NO: 7440350 - DNA, 22 bp, Homo sapiens
ggcaccaggacatgactcccag

SEQ ID NO: 7440351 - DNA, 23 bp, Homo sapiens
ggcaccaggccatggagcgggag

SEQ ID NO: 7440352 - DNA, 23 bp, Homo sapiens
ggcaccaggccatggagcgggag

SEQ ID NO: 7440353 - DNA, 23 bp, Homo sapiens
ggcaccaggccatggagcgggag

SEQ ID NO: 7440354 - DNA, 22 bp, Homo sapiens
ggcaccaggatcagtctgtcat

SEQ ID NO: 7440355 - DNA, 22 bp, Homo sapiens
ggcacagctgatgcagacacac

SEQ ID NO: 7440356 - DNA, 22 bp, Homo sapiens
ggcacagctgatgcagacacac

SEQ ID NO: 7440357 - DNA, 22 bp, Homo sapiens
ggcacagctgatgcagacacac

SEQ ID NO: 7440358 - DNA, 22 bp, Homo sapiens
ggcacagctgatgcagacacac

SEQ ID NO: 7440359 - DNA, 22 bp, Homo sapiens
ggcacagctgatgcagacacac

SEQ ID NO: 7440360 - DNA, 22 bp, Homo sapiens
ggcacagctcaggtcccagctc

SEQ ID NO: 7440361 - DNA, 22 bp, Homo sapiens
ggcacagctcaggtcccagctc

SEQ ID NO: 7440362 - DNA, 22 bp, Homo sapiens
ggcacagctcaggtcccagctc

SEQ ID NO: 7440363 - DNA, 22 bp, Homo sapiens
ggcacagctcaggtcccagctc

SEQ ID NO: 7440364 - DNA, 22 bp, Homo sapiens
ggcacagctcaggtcccagctc

SEQ ID NO: 7440365 - DNA, 22 bp, Homo sapiens
ggcacagctacttgctcactct

SEQ ID NO: 7440366 - DNA, 22 bp, Homo sapiens
ggcacaggaatctgtgaagtgc

SEQ ID NO: 7440367 - DNA, 22 bp, Homo sapiens
ggcacaggaatctgtgaagtgc

SEQ ID NO: 7440368 - DNA, 22 bp, Homo sapiens
ggcacaggaatctgtgaagtgc

SEQ ID NO: 7440369 - DNA, 22 bp, Homo sapiens
ggcacaggaatctgtgaagtgc

SEQ ID NO: 7440370 - DNA, 22 bp, Homo sapiens
ggcacaggaatctgtgaagtgc

SEQ ID NO: 7440371 - DNA, 22 bp, Homo sapiens
ggcacaggaatctgtgaagtgc

SEQ ID NO: 7440372 - DNA, 22 bp, Homo sapiens
ggcacagctgatgcagacacac

SEQ ID NO: 7440373 - DNA, 22 bp, Homo sapiens
ggcacagctgatgcagacacac

SEQ ID NO: 7440374 - DNA, 22 bp, Homo sapiens
ggcacaggaatctgtgaagtgc

SEQ ID NO: 7440375 - DNA, 22 bp, Homo sapiens
ggcacaggaatctgtgaagtgc

SEQ ID NO: 7440376 - DNA, 22 bp, Homo sapiens
ggcacagctgatgcagacacac

SEQ ID NO: 7440377 - DNA, 22 bp, Homo sapiens
ggcacaggaatctgtgaagtgc

SEQ ID NO: 7440378 - DNA, 22 bp, Homo sapiens
ggcacaggagctagtcaaagcc

SEQ ID NO: 7440379 - DNA, 22 bp, Homo sapiens
ggcacaggagctagtcaaagcc

SEQ ID NO: 7440380 - DNA, 22 bp, Homo sapiens
ggcacaggagctagtcaaagcc

SEQ ID NO: 7440381 - DNA, 22 bp, Homo sapiens
ggcacaggagctagtcaaagcc

SEQ ID NO: 7440382 - DNA, 22 bp, Homo sapiens
ggcacaggagctagtcaaagcc

SEQ ID NO: 7440383 - DNA, 17 bp, Homo sapiens
ggcaccagacggagagt

SEQ ID NO: 7440384 - DNA, 23 bp, Homo sapiens
ggcaccaacctctgctccctctt

SEQ ID NO: 7440385 - DNA, 17 bp, Homo sapiens
ggcaccagacggagagt

SEQ ID NO: 7440386 - DNA, 17 bp, Homo sapiens
ggcaccagacggagagt

SEQ ID NO: 7440387 - DNA, 17 bp, Homo sapiens
ggcaccagacggagagt

SEQ ID NO: 7440388 - DNA, 22 bp, Homo sapiens
ggcaccagcaggcaccgatgcc

SEQ ID NO: 7440389 - DNA, 22 bp, Homo sapiens
ggcaccagcaggcaccgatgcc

SEQ ID NO: 7440390 - DNA, 22 bp, Homo sapiens
ggcaccagccacctatttctag

SEQ ID NO: 7440391 - DNA, 22 bp, Homo sapiens
ggcaccagcacttgggatggct

SEQ ID NO: 7440392 - DNA, 22 bp, Homo sapiens
ggcaccagcacttgggatggct

SEQ ID NO: 7440393 - DNA, 17 bp, Homo sapiens
ggcaccagacggagagt

SEQ ID NO: 7440394 - DNA, 22 bp, Homo sapiens
ggcaccagcacttgggatggct

SEQ ID NO: 7440395 - DNA, 22 bp, Homo sapiens
ggcaccagcacttgggatggct

SEQ ID NO: 7440396 - DNA, 22 bp, Homo sapiens
ggcacagctcaggtcccagctc

SEQ ID NO: 7440397 - DNA, 22 bp, Homo sapiens
ggcacagctcaggtcccagctc

SEQ ID NO: 7440398 - DNA, 22 bp, Homo sapiens
ggcacagctcaggtcccagctc

SEQ ID NO: 7440399 - DNA, 22 bp, Homo sapiens
ggcacagctacttgctcactct

SEQ ID NO: 7440400 - DNA, 22 bp, Homo sapiens
ggcacagctacttgctcactct

SEQ ID NO: 7440401 - DNA, 22 bp, Homo sapiens
ggcacagctacttgctcactct

SEQ ID NO: 7440402 - DNA, 22 bp, Homo sapiens
ggcacagctacttgctcactct

SEQ ID NO: 7440403 - DNA, 22 bp, Homo sapiens
ggcacagctacttgctcactct

SEQ ID NO: 7440404 - DNA, 22 bp, Homo sapiens
ggcacagctacttgctcactct

SEQ ID NO: 7440405 - DNA, 22 bp, Homo sapiens
ggcacagcgactaccatcgaaa

SEQ ID NO: 7440406 - DNA, 22 bp, Homo sapiens
ggcacagcgactaccatcgaaa

SEQ ID NO: 7440407 - DNA, 22 bp, Homo sapiens
ggcacagcgactaccatcgaaa

SEQ ID NO: 7440408 - DNA, 22 bp, Homo sapiens
ggcacagcgactaccatcgaaa

SEQ ID NO: 7440409 - DNA, 22 bp, Homo sapiens
ggcacagcgactaccatcgaaa

SEQ ID NO: 7440410 - DNA, 21 bp, Homo sapiens
ggcacagcctgaaatgcctca

SEQ ID NO: 7440411 - DNA, 21 bp, Homo sapiens
ggcacagcctgaaatgcctca

SEQ ID NO: 7440412 - DNA, 22 bp, Homo sapiens
ggcacagcgactaccatcgaaa

SEQ ID NO: 7440413 - DNA, 22 bp, Homo sapiens
ggcacagcgactaccatcgaaa

SEQ ID NO: 7440414 - DNA, 22 bp, Homo sapiens
ggcacagcgactaccatcgaaa

SEQ ID NO: 7440415 - DNA, 22 bp, Homo sapiens
ggcacagcgactaccatcgaaa

SEQ ID NO: 7440416 - DNA, 22 bp, Homo sapiens
ggcacagcaggagctatgtgaa

SEQ ID NO: 7440417 - DNA, 22 bp, Homo sapiens
ggcacagcaggagctatgtgaa

SEQ ID NO: 7440418 - DNA, 22 bp, Homo sapiens
ggcacagcaggagctatgtgaa

SEQ ID NO: 7440419 - DNA, 22 bp, Homo sapiens
ggcacagccactttggagaact

SEQ ID NO: 7440420 - DNA, 22 bp, Homo sapiens
ggcaaggaagaagccatgatgt

SEQ ID NO: 7440421 - DNA, 22 bp, Homo sapiens
ggcacagccactttggagaact

SEQ ID NO: 7440422 - DNA, 22 bp, Homo sapiens
ggcacagcaggagctatgtgaa

SEQ ID NO: 7440423 - DNA, 22 bp, Homo sapiens
ggcacagccactttggagaact

SEQ ID NO: 7440424 - DNA, 22 bp, Homo sapiens
ggcacagccactttggagaact

SEQ ID NO: 7440425 - DNA, 22 bp, Homo sapiens
ggcacagccactttggagaact

SEQ ID NO: 7440426 - DNA, 22 bp, Homo sapiens
ggcacagccactttggagaact

SEQ ID NO: 7440427 - DNA, 22 bp, Homo sapiens
ggcacagccctctctgtggaca

SEQ ID NO: 7440428 - DNA, 22 bp, Homo sapiens
ggcacagccctctctgtggaca

SEQ ID NO: 7440429 - DNA, 22 bp, Homo sapiens
ggcacagccctctctgtggaca

SEQ ID NO: 7440430 - DNA, 22 bp, Homo sapiens
ggcacagccctctctgtggaca

SEQ ID NO: 7440431 - DNA, 22 bp, Homo sapiens
ggcacagccctctctgtggaca

SEQ ID NO: 7440432 - DNA, 21 bp, Homo sapiens
ggcacagcctgaaatgcctca

SEQ ID NO: 7440433 - DNA, 21 bp, Homo sapiens
ggcacagcctgaaatgcctca

SEQ ID NO: 7440434 - DNA, 22 bp, Homo sapiens
ggcacagccctctctgtggaca

SEQ ID NO: 7440435 - DNA, 22 bp, Homo sapiens
ggcacagccctctctgtggaca

SEQ ID NO: 7440436 - DNA, 22 bp, Homo sapiens
ggccatgcctggtctggcacca

SEQ ID NO: 7440437 - DNA, 22 bp, Homo sapiens
ggccatgcctgtgggtgcaggc

SEQ ID NO: 7440438 - DNA, 22 bp, Homo sapiens
ggccatgcaggtcagaggtggg

SEQ ID NO: 7440439 - DNA, 22 bp, Homo sapiens
ggccatgccaggctgcctggga

SEQ ID NO: 7440440 - DNA, 22 bp, Homo sapiens
ggccatgccaggctgcctggga

SEQ ID NO: 7440441 - DNA, 19 bp, Homo sapiens
ggccatctctgccccagca

SEQ ID NO: 7440442 - DNA, 22 bp, Homo sapiens
ggccagtttccatgcactattt

SEQ ID NO: 7440443 - DNA, 21 bp, Homo sapiens
ggccatcctgggaagggctgc

SEQ ID NO: 7440444 - DNA, 22 bp, Homo sapiens
ggccagtgtgggagtagttctt

SEQ ID NO: 7440445 - DNA, 22 bp, Homo sapiens
ggccatgcaggtcagaggtggg

SEQ ID NO: 7440446 - DNA, 22 bp, Homo sapiens
ggccatgagaatgtgcaggtcc

SEQ ID NO: 7440447 - DNA, 21 bp, Homo sapiens
ggccatcctgggaagggctgc

SEQ ID NO: 7440448 - DNA, 19 bp, Homo sapiens
ggccatctctgccccagca

SEQ ID NO: 7440449 - DNA, 22 bp, Homo sapiens
ggccagtcccctaatccagggc

SEQ ID NO: 7440450 - DNA, 22 bp, Homo sapiens
ggccagtcccctaatccagggc

SEQ ID NO: 7440451 - DNA, 22 bp, Homo sapiens
ggccagtctgggccacggtcgg

SEQ ID NO: 7440452 - DNA, 22 bp, Homo sapiens
ggccagtctgggccacggtcgg

SEQ ID NO: 7440453 - DNA, 22 bp, Homo sapiens
ggccagtctgggccacggtcgg

SEQ ID NO: 7440454 - DNA, 22 bp, Homo sapiens
ggccagtgaccagtaaccagtg

SEQ ID NO: 7440455 - DNA, 22 bp, Homo sapiens
ggccagtcccctaatccagggc

SEQ ID NO: 7440456 - DNA, 22 bp, Homo sapiens
ggccagtaagagataggaggca

SEQ ID NO: 7440457 - DNA, 18 bp, Homo sapiens
ggccagtagtgatgatag

SEQ ID NO: 7440458 - DNA, 22 bp, Homo sapiens
ggccagtattgaggctatatat

SEQ ID NO: 7440459 - DNA, 22 bp, Homo sapiens
ggccagtcccctaatccagggc

SEQ ID NO: 7440460 - DNA, 22 bp, Homo sapiens
ggccaggttgggtggaagtggc

SEQ ID NO: 7440461 - DNA, 22 bp, Homo sapiens
ggccagtggctctgtgcttggg

SEQ ID NO: 7440462 - DNA, 22 bp, Homo sapiens
ggccagtctgggccacggtcgg

SEQ ID NO: 7440463 - DNA, 22 bp, Homo sapiens
ggccagtggctctgtgcttggg

SEQ ID NO: 7440464 - DNA, 22 bp, Homo sapiens
ggccagtggctctgtgcttggg

SEQ ID NO: 7440465 - DNA, 22 bp, Homo sapiens
ggccagtggctctgtgcttggg

SEQ ID NO: 7440466 - DNA, 22 bp, Homo sapiens
ggccagtgtgcaggtcagagat

SEQ ID NO: 7440467 - DNA, 22 bp, Homo sapiens
ggccagtgtgcaggtcagagat

SEQ ID NO: 7440468 - DNA, 22 bp, Homo sapiens
ggccagtggctctgtgcttggg

SEQ ID NO: 7440469 - DNA, 22 bp, Homo sapiens
ggccaggtggctgtcctggcgt

SEQ ID NO: 7440470 - DNA, 22 bp, Homo sapiens
ggccaggtggctgtcctggcgt

SEQ ID NO: 7440471 - DNA, 23 bp, Homo sapiens
ggccaggtgcaccttagagagcc

SEQ ID NO: 7440472 - DNA, 22 bp, Homo sapiens
ggccaggtgcggtggctcacac

SEQ ID NO: 7440473 - DNA, 22 bp, Homo sapiens
ggccaggtgcggtggctcacac

SEQ ID NO: 7440474 - DNA, 22 bp, Homo sapiens
ggccaggtgcggtggctcacac

SEQ ID NO: 7440475 - DNA, 22 bp, Homo sapiens
ggccagggggcttcagactcca

SEQ ID NO: 7440476 - DNA, 22 bp, Homo sapiens
ggccagggggcttcagactcca

SEQ ID NO: 7440477 - DNA, 22 bp, Homo sapiens
ggccagggggcttcagactcca

SEQ ID NO: 7440478 - DNA, 22 bp, Homo sapiens
ggccaggtccagtggaaggccc

SEQ ID NO: 7440479 - DNA, 22 bp, Homo sapiens
ggccagggggcttcagactcca

SEQ ID NO: 7440480 - DNA, 22 bp, Homo sapiens
ggccagggggcttcagactcca

SEQ ID NO: 7440481 - DNA, 22 bp, Homo sapiens
ggccagggggcttcagactcca

SEQ ID NO: 7440482 - DNA, 22 bp, Homo sapiens
ggccagggggcttcagactcca

SEQ ID NO: 7440483 - DNA, 22 bp, Homo sapiens
ggccagggggcttcagactcca

SEQ ID NO: 7440484 - DNA, 22 bp, Homo sapiens
ggccagggggcttcagactcca

SEQ ID NO: 7440485 - DNA, 22 bp, Homo sapiens
ggccagggggcttcagactcca

SEQ ID NO: 7440486 - DNA, 22 bp, Homo sapiens
ggccagggcctggggactgtcc

SEQ ID NO: 7440487 - DNA, 22 bp, Homo sapiens
ggccagggcctggggactgtcc

SEQ ID NO: 7440488 - DNA, 22 bp, Homo sapiens
ggccagggcctggggactgtcc

SEQ ID NO: 7440489 - DNA, 19 bp, Homo sapiens
ggccaggctgactgtggtc

SEQ ID NO: 7440490 - DNA, 19 bp, Homo sapiens
ggccaggctgactgtggtc

SEQ ID NO: 7440491 - DNA, 19 bp, Homo sapiens
ggccaggctgactgtggtc

SEQ ID NO: 7440492 - DNA, 22 bp, Homo sapiens
ggccagggcctggggactgtcc

SEQ ID NO: 7440493 - DNA, 22 bp, Homo sapiens
ggccagggcctggggactgtcc

SEQ ID NO: 7440494 - DNA, 22 bp, Homo sapiens
ggcatgtttcatcacatcaaga

SEQ ID NO: 7440495 - DNA, 22 bp, Homo sapiens
ggccaaggatggtggctctggt

SEQ ID NO: 7440496 - DNA, 20 bp, Homo sapiens
ggcattagattttaaatgtc

SEQ ID NO: 7440497 - DNA, 22 bp, Homo sapiens
ggcattagcgtctgcctcgtcc

SEQ ID NO: 7440498 - DNA, 22 bp, Homo sapiens
ggcattagcgttgaattttatt

SEQ ID NO: 7440499 - DNA, 22 bp, Homo sapiens
ggcatgtgttgggaacagcatg

SEQ ID NO: 7440500 - DNA, 22 bp, Homo sapiens
ggcatgttgtttatgtttctgg

SEQ ID NO: 7440501 - DNA, 22 bp, Homo sapiens
ggcattaactctgtttcaattt

SEQ ID NO: 7440502 - DNA, 22 bp, Homo sapiens
ggccaaggctcttgagggctga

SEQ ID NO: 7440503 - DNA, 22 bp, Homo sapiens
ggccaaggctcttgagggctga

SEQ ID NO: 7440504 - DNA, 22 bp, Homo sapiens
ggccaaggctcttgagggctga

SEQ ID NO: 7440505 - DNA, 22 bp, Homo sapiens
ggccaaggctcttgagggctga

SEQ ID NO: 7440506 - DNA, 22 bp, Homo sapiens
ggccaaggctcttgagggctga

SEQ ID NO: 7440507 - DNA, 22 bp, Homo sapiens
ggccaaggtggagaaggcactg

SEQ ID NO: 7440508 - DNA, 22 bp, Homo sapiens
ggccaaggtggagaaggcactg

SEQ ID NO: 7440509 - DNA, 22 bp, Homo sapiens
ggccaaggtggagaaggcactg

SEQ ID NO: 7440510 - DNA, 22 bp, Homo sapiens
ggccaaggtggagaaggcactg

SEQ ID NO: 7440511 - DNA, 22 bp, Homo sapiens
ggccaaggtggagaaggcactg

SEQ ID NO: 7440512 - DNA, 20 bp, Homo sapiens
ggcatgggtggggctcccag

SEQ ID NO: 7440513 - DNA, 20 bp, Homo sapiens
ggcatgggtggggctcccag

SEQ ID NO: 7440514 - DNA, 22 bp, Homo sapiens
ggcatggggtgtatgtggcacg

SEQ ID NO: 7440515 - DNA, 22 bp, Homo sapiens
ggcatggggtgtatgtggcacg

SEQ ID NO: 7440516 - DNA, 20 bp, Homo sapiens
ggcatgggtggggctcccag

SEQ ID NO: 7440517 - DNA, 20 bp, Homo sapiens
ggcatgggtggggctcccag

SEQ ID NO: 7440518 - DNA, 19 bp, Homo sapiens
ggcatggtcggaagagctc

SEQ ID NO: 7440519 - DNA, 19 bp, Homo sapiens
ggcatggtcggaagagctc

SEQ ID NO: 7440520 - DNA, 22 bp, Homo sapiens
ggcatggtctttgcttgcagga

SEQ ID NO: 7440521 - DNA, 18 bp, Homo sapiens
ggcatgtgagtgctgagg

SEQ ID NO: 7440522 - DNA, 22 bp, Homo sapiens
ggcatgtctgatggcccaagtc

SEQ ID NO: 7440523 - DNA, 18 bp, Homo sapiens
ggcatgtgagtgctgagg

SEQ ID NO: 7440524 - DNA, 22 bp, Homo sapiens
ggcatggtttaagtggtgggga

SEQ ID NO: 7440525 - DNA, 18 bp, Homo sapiens
ggcatgtataagaagtag

SEQ ID NO: 7440526 - DNA, 22 bp, Homo sapiens
ggcatggtggtacacatctgta

SEQ ID NO: 7440527 - DNA, 22 bp, Homo sapiens
ggcatggtttaagtggtgggga

SEQ ID NO: 7440528 - DNA, 22 bp, Homo sapiens
ggcatgtgcctgaggtcacaca

SEQ ID NO: 7440529 - DNA, 18 bp, Homo sapiens
ggcatgtgagtgctgagg

SEQ ID NO: 7440530 - DNA, 18 bp, Homo sapiens
ggcatgtgagtgctgagg

SEQ ID NO: 7440531 - DNA, 22 bp, Homo sapiens
ggccaaggtgttctgatatgcc

SEQ ID NO: 7440532 - DNA, 22 bp, Homo sapiens
ggccaaggtgttctgatatgcc

SEQ ID NO: 7440533 - DNA, 22 bp, Homo sapiens
ggccaaggtgttctgatatgcc

SEQ ID NO: 7440534 - DNA, 22 bp, Homo sapiens
ggccaaggtggagaaggcactg

SEQ ID NO: 7440535 - DNA, 22 bp, Homo sapiens
ggccaattccaggagccggcgg

SEQ ID NO: 7440536 - DNA, 23 bp, Homo sapiens
ggccacaaatagtctcccctggc

SEQ ID NO: 7440537 - DNA, 22 bp, Homo sapiens
ggccacaacttgctcctagccc

SEQ ID NO: 7440538 - DNA, 22 bp, Homo sapiens
ggccaatgggaatggccagtag

SEQ ID NO: 7440539 - DNA, 22 bp, Homo sapiens
ggccaataagacctaagcacaa

SEQ ID NO: 7440540 - DNA, 22 bp, Homo sapiens
ggccaattccaggagccggcgg

SEQ ID NO: 7440541 - DNA, 22 bp, Homo sapiens
ggccacacagatgactgctttc

SEQ ID NO: 7440542 - DNA, 22 bp, Homo sapiens
ggccacacagatgactgctttc

SEQ ID NO: 7440543 - DNA, 22 bp, Homo sapiens
ggccacacggagaggctggtct

SEQ ID NO: 7440544 - DNA, 22 bp, Homo sapiens
ggccacacggagaggctggtct

SEQ ID NO: 7440545 - DNA, 22 bp, Homo sapiens
ggccacacggagaggctggtct

SEQ ID NO: 7440546 - DNA, 22 bp, Homo sapiens
ggccacacggagaggctggtct

SEQ ID NO: 7440547 - DNA, 22 bp, Homo sapiens
ggccacactctggtagaggtga

SEQ ID NO: 7440548 - DNA, 21 bp, Homo sapiens
ggccacaagcggaggagccgc

SEQ ID NO: 7440549 - DNA, 22 bp, Homo sapiens
ggccacaacttgctcctagccc

SEQ ID NO: 7440550 - DNA, 22 bp, Homo sapiens
ggccacacagatgactgctttc

SEQ ID NO: 7440551 - DNA, 22 bp, Homo sapiens
ggccacaagtggtcctgagtcc

SEQ ID NO: 7440552 - DNA, 21 bp, Homo sapiens
ggccacaagcggaggagccgc

SEQ ID NO: 7440553 - DNA, 19 bp, Homo sapiens
ggccaggctgactgtggtc

SEQ ID NO: 7440554 - DNA, 19 bp, Homo sapiens
ggccaggctgactgtggtc

SEQ ID NO: 7440555 - DNA, 19 bp, Homo sapiens
ggccaggctgactgtggtc

SEQ ID NO: 7440556 - DNA, 19 bp, Homo sapiens
ggccaggctgactgtggtc

SEQ ID NO: 7440557 - DNA, 19 bp, Homo sapiens
ggccaggctgactgtggtc

SEQ ID NO: 7440558 - DNA, 17 bp, Homo sapiens
ggccacagagcttgggg

SEQ ID NO: 7440559 - DNA, 22 bp, Homo sapiens
ggccacagaacagctacaggac

SEQ ID NO: 7440560 - DNA, 22 bp, Homo sapiens
ggccacagaacagctacaggac

SEQ ID NO: 7440561 - DNA, 19 bp, Homo sapiens
ggccaggctgactgtggtc

SEQ ID NO: 7440562 - DNA, 22 bp, Homo sapiens
ggccacactctggtagaggtga

SEQ ID NO: 7440563 - DNA, 22 bp, Homo sapiens
ggccacagaacagctacaggac

SEQ ID NO: 7440564 - DNA, 22 bp, Homo sapiens
ggccacagaacagctacaggac

SEQ ID NO: 7440565 - DNA, 22 bp, Homo sapiens
ggccacagaacagctacaggac

SEQ ID NO: 7440566 - DNA, 22 bp, Homo sapiens
ggccacagaacagctacaggac

SEQ ID NO: 7440567 - DNA, 22 bp, Homo sapiens
ggccacagaacagctacaggac

SEQ ID NO: 7440568 - DNA, 22 bp, Homo sapiens
ggccacagaacagctacaggac

SEQ ID NO: 7440569 - DNA, 22 bp, Homo sapiens
ggccacagaacagctacaggac

SEQ ID NO: 7440570 - DNA, 22 bp, Homo sapiens
ggcatggacgtctctgaggcca

SEQ ID NO: 7440571 - DNA, 22 bp, Homo sapiens
ggcatggacgtctctgaggcca

SEQ ID NO: 7440572 - DNA, 20 bp, Homo sapiens
ggcatggcaaatgttcttgc

SEQ ID NO: 7440573 - DNA, 22 bp, Homo sapiens
ggcatggacgtctctgaggcca

SEQ ID NO: 7440574 - DNA, 21 bp, Homo sapiens
ggcatggcacctctgggcagg

SEQ ID NO: 7440575 - DNA, 22 bp, Homo sapiens
ggcatggacgtctctgaggcca

SEQ ID NO: 7440576 - DNA, 20 bp, Homo sapiens
ggcatggcaaatgttcttgc

SEQ ID NO: 7440577 - DNA, 22 bp, Homo sapiens
ggcagtgaatgaaacagaggct

SEQ ID NO: 7440578 - DNA, 22 bp, Homo sapiens
ggcagtgaatgaaacagaggct

SEQ ID NO: 7440579 - DNA, 22 bp, Homo sapiens
ggcagtgaatgaaacagaggct

SEQ ID NO: 7440580 - DNA, 22 bp, Homo sapiens
ggcagtgaatgaaacagaggct

SEQ ID NO: 7440581 - DNA, 22 bp, Homo sapiens
ggcagtgaatgaaacagaggct

SEQ ID NO: 7440582 - DNA, 22 bp, Homo sapiens
ggcagtgaatctgagagcctgg

SEQ ID NO: 7440583 - DNA, 22 bp, Homo sapiens
ggcagtgaacagaaatgcagaa

SEQ ID NO: 7440584 - DNA, 22 bp, Homo sapiens
ggcagtgaatctgagagcctgg

SEQ ID NO: 7440585 - DNA, 22 bp, Homo sapiens
ggcagtgaatctgagagcctgg

SEQ ID NO: 7440586 - DNA, 22 bp, Homo sapiens
ggcagtgaatctgagagcctgg

SEQ ID NO: 7440587 - DNA, 22 bp, Homo sapiens
ggcagtctagtgtccttgggcc

SEQ ID NO: 7440588 - DNA, 22 bp, Homo sapiens
ggcagtctagtgtccttgggcc

SEQ ID NO: 7440589 - DNA, 19 bp, Homo sapiens
ggcagtctcaagcagcaca

SEQ ID NO: 7440590 - DNA, 19 bp, Homo sapiens
ggcagtctcaagcagcaca

SEQ ID NO: 7440591 - DNA, 22 bp, Homo sapiens
ggcagtctagctaggatgtcac

SEQ ID NO: 7440592 - DNA, 22 bp, Homo sapiens
ggcagtctagctaggatgtcac

SEQ ID NO: 7440593 - DNA, 22 bp, Homo sapiens
ggcagtcccaggctgcatgttg

SEQ ID NO: 7440594 - DNA, 22 bp, Homo sapiens
ggcagtccccatttggtgtttt

SEQ ID NO: 7440595 - DNA, 22 bp, Homo sapiens
ggcagtctgcaatttcattagc

SEQ ID NO: 7440596 - DNA, 22 bp, Homo sapiens
ggcagtctcctgccctctaacc

SEQ ID NO: 7440597 - DNA, 22 bp, Homo sapiens
ggcagtctcctgccctctaacc

SEQ ID NO: 7440598 - DNA, 22 bp, Homo sapiens
ggcagtcttatcagcattggac

SEQ ID NO: 7440599 - DNA, 22 bp, Homo sapiens
ggcagtcttatcagcattggac

SEQ ID NO: 7440600 - DNA, 22 bp, Homo sapiens
ggcagtcttatcagcattggac

SEQ ID NO: 7440601 - DNA, 22 bp, Homo sapiens
ggcagtctttcccttgagctct

SEQ ID NO: 7440602 - DNA, 22 bp, Homo sapiens
ggcagtgaacagaaatgcagaa

SEQ ID NO: 7440603 - DNA, 22 bp, Homo sapiens
ggcagtgaaaaagtatgtttcc

SEQ ID NO: 7440604 - DNA, 22 bp, Homo sapiens
ggcagtgaaaaagtatgtttcc

SEQ ID NO: 7440605 - DNA, 22 bp, Homo sapiens
ggcagtgaacagaaatgcagaa

SEQ ID NO: 7440606 - DNA, 22 bp, Homo sapiens
ggcagtgaaaaagtatgtttcc

SEQ ID NO: 7440607 - DNA, 22 bp, Homo sapiens
ggcatgggagtgagcaacctta

SEQ ID NO: 7440608 - DNA, 22 bp, Homo sapiens
ggcatgggagtgagcaacctta

SEQ ID NO: 7440609 - DNA, 22 bp, Homo sapiens
ggcatgggagtgagcaacctta

SEQ ID NO: 7440610 - DNA, 22 bp, Homo sapiens
ggcatggctgttggggatagag

SEQ ID NO: 7440611 - DNA, 22 bp, Homo sapiens
ggcatgggccgaggtgcctcct

SEQ ID NO: 7440612 - DNA, 22 bp, Homo sapiens
ggcatggctgttggggatagag

SEQ ID NO: 7440613 - DNA, 22 bp, Homo sapiens
ggcatggctgttggggatagag

SEQ ID NO: 7440614 - DNA, 22 bp, Homo sapiens
ggcatggctgttggggatagag

SEQ ID NO: 7440615 - DNA, 22 bp, Homo sapiens
ggcatggctgttggggatagag

SEQ ID NO: 7440616 - DNA, 22 bp, Homo sapiens
ggcatggctgttggggatagag

SEQ ID NO: 7440617 - DNA, 22 bp, Homo sapiens
ggcatggctgggttctggtgag

SEQ ID NO: 7440618 - DNA, 21 bp, Homo sapiens
ggcatggcacctctgggcagg

SEQ ID NO: 7440619 - DNA, 21 bp, Homo sapiens
ggcatggcacctctgggcagg

SEQ ID NO: 7440620 - DNA, 21 bp, Homo sapiens
ggcatggcacctctgggcagg

SEQ ID NO: 7440621 - DNA, 22 bp, Homo sapiens
ggcatggctcggagtcagaaca

SEQ ID NO: 7440622 - DNA, 22 bp, Homo sapiens
ggcatggctcggagtcagaaca

SEQ ID NO: 7440623 - DNA, 22 bp, Homo sapiens
ggcatggcctgtaagacggaga

SEQ ID NO: 7440624 - DNA, 22 bp, Homo sapiens
ggcatggcctgtaagacggaga

SEQ ID NO: 7440625 - DNA, 22 bp, Homo sapiens
ggcatggcctgtaagacggaga

SEQ ID NO: 7440626 - DNA, 19 bp, Homo sapiens
ggcatggggtccggggacc

SEQ ID NO: 7440627 - DNA, 22 bp, Homo sapiens
ggcatgggccgaggtgcctcct

SEQ ID NO: 7440628 - DNA, 22 bp, Homo sapiens
ggcatgggccgaggtgcctcct

SEQ ID NO: 7440629 - DNA, 22 bp, Homo sapiens
ggcatgggccgaggtgcctcct

SEQ ID NO: 7440630 - DNA, 22 bp, Homo sapiens
ggcatgggccgaggtgcctcct

SEQ ID NO: 7440631 - DNA, 22 bp, Homo sapiens
ggcatgggagtgagcaacctta

SEQ ID NO: 7440632 - DNA, 22 bp, Homo sapiens
ggcatgggccgaggtgcctcct

SEQ ID NO: 7440633 - DNA, 22 bp, Homo sapiens
ggcatgggccgaggtgcctcct

SEQ ID NO: 7440634 - DNA, 22 bp, Homo sapiens
ggcatggggtgtatgtggcacg

SEQ ID NO: 7440635 - DNA, 22 bp, Homo sapiens
ggcatggggtgtatgtggcacg

SEQ ID NO: 7440636 - DNA, 22 bp, Homo sapiens
ggcatggggtgtatgtggcacg

SEQ ID NO: 7440637 - DNA, 22 bp, Homo sapiens
ggcatggggtgtatgtggcacg

SEQ ID NO: 7440638 - DNA, 22 bp, Homo sapiens
ggcatggggtgtatgtggcacg

SEQ ID NO: 7440639 - DNA, 21 bp, Homo sapiens
ggcaggtgggtctctgttgct

SEQ ID NO: 7440640 - DNA, 21 bp, Homo sapiens
ggcaggtgggtctctgttgct

SEQ ID NO: 7440641 - DNA, 21 bp, Homo sapiens
ggcaggtgggtctctgttgct

SEQ ID NO: 7440642 - DNA, 22 bp, Homo sapiens
ggcaggtgggaaccctccccac

SEQ ID NO: 7440643 - DNA, 22 bp, Homo sapiens
ggcaggtgggaaccctccccac

SEQ ID NO: 7440644 - DNA, 22 bp, Homo sapiens
ggcaggtgggaaccctccccac

SEQ ID NO: 7440645 - DNA, 22 bp, Homo sapiens
ggcaggtggccaagtgtctaag

SEQ ID NO: 7440646 - DNA, 22 bp, Homo sapiens
ggcaggtggccaagtgtctaag

SEQ ID NO: 7440647 - DNA, 22 bp, Homo sapiens
ggcaggtggccaagtgtctaag

SEQ ID NO: 7440648 - DNA, 22 bp, Homo sapiens
ggcaggtggccaagtgtctaag

SEQ ID NO: 7440649 - DNA, 22 bp, Homo sapiens
ggcaggtggcactgctgctccc

SEQ ID NO: 7440650 - DNA, 22 bp, Homo sapiens
ggcaggtggcactgctgctccc

SEQ ID NO: 7440651 - DNA, 22 bp, Homo sapiens
ggcagtcagtttggagatggat

SEQ ID NO: 7440652 - DNA, 22 bp, Homo sapiens
ggcagtcatcccacttggaacc

SEQ ID NO: 7440653 - DNA, 22 bp, Homo sapiens
ggcagtcagtttggagatggat

SEQ ID NO: 7440654 - DNA, 22 bp, Homo sapiens
ggcagtcagtgtggttcataaa

SEQ ID NO: 7440655 - DNA, 22 bp, Homo sapiens
ggcagtcatttaatccctgcat

SEQ ID NO: 7440656 - DNA, 22 bp, Homo sapiens
ggcagtcatttaatccctgcat

SEQ ID NO: 7440657 - DNA, 22 bp, Homo sapiens
ggcagtcccagcccagaggcgc

SEQ ID NO: 7440658 - DNA, 22 bp, Homo sapiens
ggcagtcccaggctgcatgttg

SEQ ID NO: 7440659 - DNA, 22 bp, Homo sapiens
ggcagtcccagcccagaggcgc

SEQ ID NO: 7440660 - DNA, 22 bp, Homo sapiens
ggcagtcccagcccagaggcgc

SEQ ID NO: 7440661 - DNA, 22 bp, Homo sapiens
ggcaggtggtaaggatttcata

SEQ ID NO: 7440662 - DNA, 22 bp, Homo sapiens
ggcaggtgtgagatcgaggcca

SEQ ID NO: 7440663 - DNA, 22 bp, Homo sapiens
ggcaggtggtaaggatttcata

SEQ ID NO: 7440664 - DNA, 22 bp, Homo sapiens
ggcaggtgtgagatcgaggcca

SEQ ID NO: 7440665 - DNA, 22 bp, Homo sapiens
ggcaggtgtgagatcgaggcca

SEQ ID NO: 7440666 - DNA, 22 bp, Homo sapiens
ggcaggtgtgagatcgaggcca

SEQ ID NO: 7440667 - DNA, 22 bp, Homo sapiens
ggcagtcacttttgcttgtgcc

SEQ ID NO: 7440668 - DNA, 22 bp, Homo sapiens
ggcaggcagaggctgagacagg

SEQ ID NO: 7440669 - DNA, 22 bp, Homo sapiens
ggcaggcagaggctgagacagg

SEQ ID NO: 7440670 - DNA, 22 bp, Homo sapiens
ggcaggcagaggctgagacagg

SEQ ID NO: 7440671 - DNA, 22 bp, Homo sapiens
ggcaggcagaggctgagacagg

SEQ ID NO: 7440672 - DNA, 22 bp, Homo sapiens
ggcaggcagaggctgagacagg

SEQ ID NO: 7440673 - DNA, 22 bp, Homo sapiens
ggcaggcagaggctgagacagg

SEQ ID NO: 7440674 - DNA, 22 bp, Homo sapiens
ggcaggcagaggctgagacagg

SEQ ID NO: 7440675 - DNA, 22 bp, Homo sapiens
ggcaggcagaggctgagacagg

SEQ ID NO: 7440676 - DNA, 22 bp, Homo sapiens
ggcaggcagaggctgagacagg

SEQ ID NO: 7440677 - DNA, 22 bp, Homo sapiens
ggcaggtggaagttggcagagc

SEQ ID NO: 7440678 - DNA, 22 bp, Homo sapiens
ggcaggtggaagttggcagagc

SEQ ID NO: 7440679 - DNA, 22 bp, Homo sapiens
ggcaggtggaagttggcagagc

SEQ ID NO: 7440680 - DNA, 22 bp, Homo sapiens
ggcaggtggaagttggcagagc

SEQ ID NO: 7440681 - DNA, 22 bp, Homo sapiens
ggcaggcagatggctgcaccaa

SEQ ID NO: 7440682 - DNA, 22 bp, Homo sapiens
ggcaggcagaggctgagacagg

SEQ ID NO: 7440683 - DNA, 22 bp, Homo sapiens
ggcaggcagatggctgcaccaa

SEQ ID NO: 7440684 - DNA, 22 bp, Homo sapiens
ggcaggtggaagttggcagagc

SEQ ID NO: 7440685 - DNA, 22 bp, Homo sapiens
ggcaggtggaagttggcagagc

SEQ ID NO: 7440686 - DNA, 22 bp, Homo sapiens
ggcaggtggaagttggcagagc

SEQ ID NO: 7440687 - DNA, 22 bp, Homo sapiens
ggcaggcagatggctgcaccaa

SEQ ID NO: 7440688 - DNA, 22 bp, Homo sapiens
ggcaggtggcactgctgctccc

SEQ ID NO: 7440689 - DNA, 22 bp, Homo sapiens
ggcaggtggcactgctgctccc

SEQ ID NO: 7440690 - DNA, 22 bp, Homo sapiens
ggcaggtggcactgctgctccc

SEQ ID NO: 7440691 - DNA, 22 bp, Homo sapiens
ggcaggtggcactgctgctccc

SEQ ID NO: 7440692 - DNA, 22 bp, Homo sapiens
ggcaggtggacgtgctaaagct

SEQ ID NO: 7440693 - DNA, 22 bp, Homo sapiens
ggcaggtggaagttggcagagc

SEQ ID NO: 7440694 - DNA, 22 bp, Homo sapiens
ggcaggtggacgtgctaaagct

SEQ ID NO: 7440695 - DNA, 22 bp, Homo sapiens
ggcaggtggacgtgctaaagct

SEQ ID NO: 7440696 - DNA, 22 bp, Homo sapiens
ggcaggtggacgtgctaaagct

SEQ ID NO: 7440697 - DNA, 22 bp, Homo sapiens
ggcaggtggaagttggcagagc

SEQ ID NO: 7440698 - DNA, 22 bp, Homo sapiens
ggcaggtggaagttggcagagc

SEQ ID NO: 7440699 - DNA, 22 bp, Homo sapiens
ggcaggtggacgtgctaaagct

SEQ ID NO: 7440700 - DNA, 21 bp, Homo sapiens
ggcctcagccacctggctctg

SEQ ID NO: 7440701 - DNA, 21 bp, Homo sapiens
ggcctcagccacctggctctg

SEQ ID NO: 7440702 - DNA, 18 bp, Homo sapiens
ggcctcagcctggccgga

SEQ ID NO: 7440703 - DNA, 18 bp, Homo sapiens
ggcctcagcctggccgga

SEQ ID NO: 7440704 - DNA, 21 bp, Homo sapiens
ggcctcagccacctggctctg

SEQ ID NO: 7440705 - DNA, 21 bp, Homo sapiens
ggcctcagccacctggctctg

SEQ ID NO: 7440706 - DNA, 22 bp, Homo sapiens
ggcctcagaggaggtgtgagtc

SEQ ID NO: 7440707 - DNA, 22 bp, Homo sapiens
ggcctcagaggaggtgtgagtc

SEQ ID NO: 7440708 - DNA, 22 bp, Homo sapiens
ggcctcagaggaggtgtgagtc

SEQ ID NO: 7440709 - DNA, 22 bp, Homo sapiens
ggcctcagaggaggtgtgagtc

SEQ ID NO: 7440710 - DNA, 21 bp, Homo sapiens
ggcctcagccacctggctctg

SEQ ID NO: 7440711 - DNA, 21 bp, Homo sapiens
ggcctcagccacctggctctg

SEQ ID NO: 7440712 - DNA, 21 bp, Homo sapiens
ggcctcagccacctggctctg

SEQ ID NO: 7440713 - DNA, 22 bp, Homo sapiens
ggcctcagggttgggcccatta

SEQ ID NO: 7440714 - DNA, 22 bp, Homo sapiens
ggcctcagggttgggcccatta

SEQ ID NO: 7440715 - DNA, 22 bp, Homo sapiens
ggcctcagggttgggcccatta

SEQ ID NO: 7440716 - DNA, 22 bp, Homo sapiens
ggcctcagggttgggcccatta

SEQ ID NO: 7440717 - DNA, 22 bp, Homo sapiens
ggcctcagggttgggcccatta

SEQ ID NO: 7440718 - DNA, 22 bp, Homo sapiens
ggcctcagggttgggcccatta

SEQ ID NO: 7440719 - DNA, 22 bp, Homo sapiens
ggcctcagggtcactctgtaga

SEQ ID NO: 7440720 - DNA, 22 bp, Homo sapiens
ggcctcagggtcactctgtaga

SEQ ID NO: 7440721 - DNA, 22 bp, Homo sapiens
ggcctcagggtcactctgtaga

SEQ ID NO: 7440722 - DNA, 22 bp, Homo sapiens
ggcctcagggtcactctgtaga

SEQ ID NO: 7440723 - DNA, 22 bp, Homo sapiens
ggcctcagggtcactctgtaga

SEQ ID NO: 7440724 - DNA, 23 bp, Homo sapiens
ggcctcagcgcacagaaactgct

SEQ ID NO: 7440725 - DNA, 23 bp, Homo sapiens
ggcctcagcgcacagaaactgct

SEQ ID NO: 7440726 - DNA, 23 bp, Homo sapiens
ggcctcagcgcacagaaactgct

SEQ ID NO: 7440727 - DNA, 22 bp, Homo sapiens
ggcctcagggtcactctgtaga

SEQ ID NO: 7440728 - DNA, 23 bp, Homo sapiens
ggcctcagcgcacagaaactgct

SEQ ID NO: 7440729 - DNA, 18 bp, Homo sapiens
ggcctcagcctggccgga

SEQ ID NO: 7440730 - DNA, 18 bp, Homo sapiens
ggcctcagcctggccgga

SEQ ID NO: 7440731 - DNA, 21 bp, Homo sapiens
ggcctcagccacctggctctg

SEQ ID NO: 7440732 - DNA, 18 bp, Homo sapiens
ggcctcagcctggccgga

SEQ ID NO: 7440733 - DNA, 18 bp, Homo sapiens
ggcctcagcctggccgga

SEQ ID NO: 7440734 - DNA, 23 bp, Homo sapiens
ggccatggagacttagaatgggc

SEQ ID NO: 7440735 - DNA, 22 bp, Homo sapiens
ggccatggaccccgagctgacc

SEQ ID NO: 7440736 - DNA, 23 bp, Homo sapiens
ggccatggagacttagaatgggc

SEQ ID NO: 7440737 - DNA, 22 bp, Homo sapiens
ggccatggaccccgagctgacc

SEQ ID NO: 7440738 - DNA, 22 bp, Homo sapiens
ggccatgctgttgcctgctggt

SEQ ID NO: 7440739 - DNA, 22 bp, Homo sapiens
ggccatgctgttgcctgctggt

SEQ ID NO: 7440740 - DNA, 22 bp, Homo sapiens
ggccatgctcgtggctggactg

SEQ ID NO: 7440741 - DNA, 22 bp, Homo sapiens
ggccatgcctgtgggtgcaggc

SEQ ID NO: 7440742 - DNA, 22 bp, Homo sapiens
ggcctcagaccggagctggcca

SEQ ID NO: 7440743 - DNA, 22 bp, Homo sapiens
ggcctcagaccggagctggcca

SEQ ID NO: 7440744 - DNA, 22 bp, Homo sapiens
ggcctcagaccggagctggcca

SEQ ID NO: 7440745 - DNA, 22 bp, Homo sapiens
ggcctcagaccggagctggcca

SEQ ID NO: 7440746 - DNA, 22 bp, Homo sapiens
ggcctcagaccggagctggcca

SEQ ID NO: 7440747 - DNA, 22 bp, Homo sapiens
ggcctcagaccggagctggcca

SEQ ID NO: 7440748 - DNA, 22 bp, Homo sapiens
ggccatggcgggagccggcgtc

SEQ ID NO: 7440749 - DNA, 22 bp, Homo sapiens
ggccatggcgggagccggcgtc

SEQ ID NO: 7440750 - DNA, 19 bp, Homo sapiens
ggccatggcgggggtcaca

SEQ ID NO: 7440751 - DNA, 19 bp, Homo sapiens
ggccatggcgggggtcaca

SEQ ID NO: 7440752 - DNA, 22 bp, Homo sapiens
ggcctcagagaaggctgtgcgg

SEQ ID NO: 7440753 - DNA, 22 bp, Homo sapiens
ggcctcagagaaggctgtgcgg

SEQ ID NO: 7440754 - DNA, 22 bp, Homo sapiens
ggcctcagagaaggctgtgcgg

SEQ ID NO: 7440755 - DNA, 22 bp, Homo sapiens
ggcctcagagaaggctgtgcgg

SEQ ID NO: 7440756 - DNA, 22 bp, Homo sapiens
ggcctcagagaaggctgtgcgg

SEQ ID NO: 7440757 - DNA, 22 bp, Homo sapiens
ggcctcagagaaggctgtgcgg

SEQ ID NO: 7440758 - DNA, 22 bp, Homo sapiens
ggcctcagagaaggctgtgcgg

SEQ ID NO: 7440759 - DNA, 22 bp, Homo sapiens
ggcctcagagaaggctgtgcgg

SEQ ID NO: 7440760 - DNA, 22 bp, Homo sapiens
ggcctcagagaaggctgtgcgg

SEQ ID NO: 7440761 - DNA, 22 bp, Homo sapiens
ggcctcagtttctccatgggtt

SEQ ID NO: 7440762 - DNA, 22 bp, Homo sapiens
ggcctcagtttcttcaactgta

SEQ ID NO: 7440763 - DNA, 22 bp, Homo sapiens
ggcctcagtttcttcaactgta

SEQ ID NO: 7440764 - DNA, 22 bp, Homo sapiens
ggcctcagtttcttcaactgta

SEQ ID NO: 7440765 - DNA, 22 bp, Homo sapiens
ggcctcagtttcttcaactgta

SEQ ID NO: 7440766 - DNA, 22 bp, Homo sapiens
ggcctcagtttcttcaactgta

SEQ ID NO: 7440767 - DNA, 22 bp, Homo sapiens
ggcctcagtttcttcaactgta

SEQ ID NO: 7440768 - DNA, 22 bp, Homo sapiens
ggcctcatcacagtgcattagt

SEQ ID NO: 7440769 - DNA, 20 bp, Homo sapiens
ggcctcagtgtccttgtttg

SEQ ID NO: 7440770 - DNA, 22 bp, Homo sapiens
ggcctcagtttctccatgggtt

SEQ ID NO: 7440771 - DNA, 22 bp, Homo sapiens
ggcctcagtttctccatgggtt

SEQ ID NO: 7440772 - DNA, 22 bp, Homo sapiens
ggcctcagtttctccatgggtt

SEQ ID NO: 7440773 - DNA, 22 bp, Homo sapiens
ggcctcagtttctccatgggtt

SEQ ID NO: 7440774 - DNA, 20 bp, Homo sapiens
ggcctcagtgtccttgtttg

SEQ ID NO: 7440775 - DNA, 22 bp, Homo sapiens
ggcctcagtttctccatgggtt

SEQ ID NO: 7440776 - DNA, 22 bp, Homo sapiens
ggcctcagtttctccatgggtt

SEQ ID NO: 7440777 - DNA, 22 bp, Homo sapiens
ggcctcagtgggccgctgcagg

SEQ ID NO: 7440778 - DNA, 22 bp, Homo sapiens
ggcctcagggttgggcccatta

SEQ ID NO: 7440779 - DNA, 22 bp, Homo sapiens
ggcctcagtgggccgctgcagg

SEQ ID NO: 7440780 - DNA, 22 bp, Homo sapiens
ggcctcagtgggccgctgcagg

SEQ ID NO: 7440781 - DNA, 22 bp, Homo sapiens
ggcctcagtgggccgctgcagg

SEQ ID NO: 7440782 - DNA, 22 bp, Homo sapiens
ggcctcagtgggccgctgcagg

SEQ ID NO: 7440783 - DNA, 20 bp, Homo sapiens
ggcctcagtgtccttgtttg

SEQ ID NO: 7440784 - DNA, 22 bp, Homo sapiens
ggcctcagtgggccgctgcagg

SEQ ID NO: 7440785 - DNA, 22 bp, Homo sapiens
ggcctcagtgggccgctgcagg

SEQ ID NO: 7440786 - DNA, 22 bp, Homo sapiens
ggcctcagtgggccgctgcagg

SEQ ID NO: 7440787 - DNA, 22 bp, Homo sapiens
ggcctcagggttgggcccatta

SEQ ID NO: 7440788 - DNA, 22 bp, Homo sapiens
ggcctcagggttgggcccatta

SEQ ID NO: 7440789 - DNA, 22 bp, Homo sapiens
ggcctcagggttgggcccatta

SEQ ID NO: 7440790 - DNA, 22 bp, Homo sapiens
ggcctcagggttgggcccatta

SEQ ID NO: 7440791 - DNA, 23 bp, Homo sapiens
ggcctcagtgatgatgggttaaa

SEQ ID NO: 7440792 - DNA, 22 bp, Homo sapiens
ggcctcagtgggccgctgcagg

SEQ ID NO: 7440793 - DNA, 22 bp, Homo sapiens
ggcctcagtgggccgctgcagg

SEQ ID NO: 7440794 - DNA, 22 bp, Homo sapiens
ggcctcagtgggccgctgcagg

SEQ ID NO: 7440795 - DNA, 22 bp, Homo sapiens
ggcctcagggttgggcccatta

SEQ ID NO: 7440796 - DNA, 23 bp, Homo sapiens
ggcctcagtgatgatgggttaaa

SEQ ID NO: 7440797 - DNA, 21 bp, Homo sapiens
ggcctctgtcatcctgggaag

SEQ ID NO: 7440798 - DNA, 23 bp, Homo sapiens
ggcctctgtgttctgcccacatg

SEQ ID NO: 7440799 - DNA, 23 bp, Homo sapiens
ggcctctgtgttctgcccacatg

SEQ ID NO: 7440800 - DNA, 21 bp, Homo sapiens
ggcctctgtcatcctgggaag

SEQ ID NO: 7440801 - DNA, 21 bp, Homo sapiens
ggcctctgtcatcctgggaag

SEQ ID NO: 7440802 - DNA, 21 bp, Homo sapiens
ggcctctgtcatcctgggaag

SEQ ID NO: 7440803 - DNA, 22 bp, Homo sapiens
ggcctctggttcgtggtgacct

SEQ ID NO: 7440804 - DNA, 22 bp, Homo sapiens
ggcctctggttcgtggtgacct

SEQ ID NO: 7440805 - DNA, 22 bp, Homo sapiens
ggcctctggttcgtggtgacct

SEQ ID NO: 7440806 - DNA, 22 bp, Homo sapiens
ggcctctggttcgtggtgacct

SEQ ID NO: 7440807 - DNA, 22 bp, Homo sapiens
ggcctctggttcacagggagga

SEQ ID NO: 7440808 - DNA, 22 bp, Homo sapiens
ggcctctggttcacagggagga

SEQ ID NO: 7440809 - DNA, 22 bp, Homo sapiens
ggcctctggttcacagggagga

SEQ ID NO: 7440810 - DNA, 22 bp, Homo sapiens
ggcctcttatctggctcctgca

SEQ ID NO: 7440811 - DNA, 22 bp, Homo sapiens
ggcctcttagagttaactgctt

SEQ ID NO: 7440812 - DNA, 22 bp, Homo sapiens
ggcctcttatctggctcctgca

SEQ ID NO: 7440813 - DNA, 22 bp, Homo sapiens
ggcctctgtttggagccaggat

SEQ ID NO: 7440814 - DNA, 22 bp, Homo sapiens
ggcctctgtttggagccaggat

SEQ ID NO: 7440815 - DNA, 22 bp, Homo sapiens
ggcctctgtttggagccaggat

SEQ ID NO: 7440816 - DNA, 22 bp, Homo sapiens
ggcctctgtttggagccaggat

SEQ ID NO: 7440817 - DNA, 22 bp, Homo sapiens
ggcctctgttctgcattcctcc

SEQ ID NO: 7440818 - DNA, 23 bp, Homo sapiens
ggcctctgtgttctgcccacatg

SEQ ID NO: 7440819 - DNA, 22 bp, Homo sapiens
ggcctctgttctgcattcctcc

SEQ ID NO: 7440820 - DNA, 22 bp, Homo sapiens
ggcctctgttctgcattcctcc

SEQ ID NO: 7440821 - DNA, 23 bp, Homo sapiens
ggcctctgtgttctgcccacatg

SEQ ID NO: 7440822 - DNA, 23 bp, Homo sapiens
ggcctctgtgttctgcccacatg

SEQ ID NO: 7440823 - DNA, 22 bp, Homo sapiens
ggcctttgctggccctcaggct

SEQ ID NO: 7440824 - DNA, 22 bp, Homo sapiens
ggcctttgctggccctcaggct

SEQ ID NO: 7440825 - DNA, 22 bp, Homo sapiens
ggcctttaagcaattgaaaaga

SEQ ID NO: 7440826 - DNA, 22 bp, Homo sapiens
ggccttgtgtaagtaactttgg

SEQ ID NO: 7440827 - DNA, 22 bp, Homo sapiens
ggcctttagtggttctggagtc

SEQ ID NO: 7440828 - DNA, 22 bp, Homo sapiens
ggcctttagtggttctggagtc

SEQ ID NO: 7440829 - DNA, 22 bp, Homo sapiens
ggcctttgcgtccacgccgctt

SEQ ID NO: 7440830 - DNA, 22 bp, Homo sapiens
ggcctttgcgtccacgccgctt

SEQ ID NO: 7440831 - DNA, 19 bp, Homo sapiens
ggcctttcacctggatgct

SEQ ID NO: 7440832 - DNA, 22 bp, Homo sapiens
ggccttggttccaaagcaggca

SEQ ID NO: 7440833 - DNA, 22 bp, Homo sapiens
ggccttggtggctttgctgatg

SEQ ID NO: 7440834 - DNA, 22 bp, Homo sapiens
ggccttggttccaaagcaggca

SEQ ID NO: 7440835 - DNA, 22 bp, Homo sapiens
ggccttggttccaaagcaggca

SEQ ID NO: 7440836 - DNA, 22 bp, Homo sapiens
ggccttggtggctttgctgatg

SEQ ID NO: 7440837 - DNA, 22 bp, Homo sapiens
ggccttggtggctttgctgatg

SEQ ID NO: 7440838 - DNA, 22 bp, Homo sapiens
ggccttggttctgtcacagccg

SEQ ID NO: 7440839 - DNA, 22 bp, Homo sapiens
ggccttggttctgtcacagccg

SEQ ID NO: 7440840 - DNA, 22 bp, Homo sapiens
ggccttggttccaaagcaggca

SEQ ID NO: 7440841 - DNA, 22 bp, Homo sapiens
ggccttggttctgtcacagccg

SEQ ID NO: 7440842 - DNA, 22 bp, Homo sapiens
ggccttggttctgtcacagccg

SEQ ID NO: 7440843 - DNA, 22 bp, Homo sapiens
ggcgagcatgagtcactctggg

SEQ ID NO: 7440844 - DNA, 22 bp, Homo sapiens
ggcgagcatgagtcactctggg

SEQ ID NO: 7440845 - DNA, 22 bp, Homo sapiens
ggcgagcatgagtcactctggg

SEQ ID NO: 7440846 - DNA, 22 bp, Homo sapiens
ggcgaggccgggacaggctgga

SEQ ID NO: 7440847 - DNA, 20 bp, Homo sapiens
ggcgagctgggctctgtgca

SEQ ID NO: 7440848 - DNA, 22 bp, Homo sapiens
ggcgagcagttcccagggaggt

SEQ ID NO: 7440849 - DNA, 22 bp, Homo sapiens
ggcgagcagagccattgcctat

SEQ ID NO: 7440850 - DNA, 22 bp, Homo sapiens
ggcgagcagcgctgtgtcaggt

SEQ ID NO: 7440851 - DNA, 22 bp, Homo sapiens
ggcgagcagttcccagggaggt

SEQ ID NO: 7440852 - DNA, 22 bp, Homo sapiens
ggcgagcagcgctgtgtcaggt

SEQ ID NO: 7440853 - DNA, 22 bp, Homo sapiens
ggcgagcagcgctgtgtcaggt

SEQ ID NO: 7440854 - DNA, 22 bp, Homo sapiens
ggcgagcagagcactgccagga

SEQ ID NO: 7440855 - DNA, 22 bp, Homo sapiens
ggcgagcagagcactgccagga

SEQ ID NO: 7440856 - DNA, 22 bp, Homo sapiens
ggcgagcagagccattgcctat

SEQ ID NO: 7440857 - DNA, 22 bp, Homo sapiens
ggcgctggccacggtggctctg

SEQ ID NO: 7440858 - DNA, 22 bp, Homo sapiens
ggcgctggccacggtggctctg

SEQ ID NO: 7440859 - DNA, 22 bp, Homo sapiens
ggcgctggtggtcttgcgagcg

SEQ ID NO: 7440860 - DNA, 22 bp, Homo sapiens
ggcgctggtggtcttgcgagcg

SEQ ID NO: 7440861 - DNA, 22 bp, Homo sapiens
ggcgctggtggtcttgcgagcg

SEQ ID NO: 7440862 - DNA, 22 bp, Homo sapiens
ggcgctggccacggtggctctg

SEQ ID NO: 7440863 - DNA, 22 bp, Homo sapiens
ggcgctggccacggtggctctg

SEQ ID NO: 7440864 - DNA, 22 bp, Homo sapiens
ggcgctggccacggtggctctg

SEQ ID NO: 7440865 - DNA, 22 bp, Homo sapiens
ggcgaggccgggacaggctgga

SEQ ID NO: 7440866 - DNA, 22 bp, Homo sapiens
ggcgaggccgggacaggctgga

SEQ ID NO: 7440867 - DNA, 22 bp, Homo sapiens
ggccttgggcgagtccctcagt

SEQ ID NO: 7440868 - DNA, 22 bp, Homo sapiens
ggccttgggcagacacgtcaca

SEQ ID NO: 7440869 - DNA, 17 bp, Homo sapiens
ggccttgggctgctctt

SEQ ID NO: 7440870 - DNA, 22 bp, Homo sapiens
ggccttgggcgagtccctcagt

SEQ ID NO: 7440871 - DNA, 17 bp, Homo sapiens
ggccttgggctgctctt

SEQ ID NO: 7440872 - DNA, 22 bp, Homo sapiens
ggccttgggctggctgcagtat

SEQ ID NO: 7440873 - DNA, 22 bp, Homo sapiens
ggccttgggtataggtgggtat

SEQ ID NO: 7440874 - DNA, 22 bp, Homo sapiens
ggccttggggtggccttgtccc

SEQ ID NO: 7440875 - DNA, 22 bp, Homo sapiens
ggccttgggtataggtgggtat

SEQ ID NO: 7440876 - DNA, 22 bp, Homo sapiens
ggccttgggtataggtgggtat

SEQ ID NO: 7440877 - DNA, 20 bp, Homo sapiens
ggccttgggtttcgcctgtt

SEQ ID NO: 7440878 - DNA, 22 bp, Homo sapiens
ggccttggggtggccttgtccc

SEQ ID NO: 7440879 - DNA, 22 bp, Homo sapiens
ggccttggggtggccttgtccc

SEQ ID NO: 7440880 - DNA, 22 bp, Homo sapiens
ggccttggggtggccttgtccc

SEQ ID NO: 7440881 - DNA, 17 bp, Homo sapiens
ggccttggggcctcagt

SEQ ID NO: 7440882 - DNA, 19 bp, Homo sapiens
ggccttggggtcccaaagt

SEQ ID NO: 7440883 - DNA, 19 bp, Homo sapiens
ggccttggggtcccaaagt

SEQ ID NO: 7440884 - DNA, 22 bp, Homo sapiens
ggccttggggaggatggtgtcc

SEQ ID NO: 7440885 - DNA, 22 bp, Homo sapiens
ggccttggggaggatggtgtcc

SEQ ID NO: 7440886 - DNA, 22 bp, Homo sapiens
ggccttggggaggatggtgtcc

SEQ ID NO: 7440887 - DNA, 17 bp, Homo sapiens
ggccttggggcctcagt

SEQ ID NO: 7440888 - DNA, 22 bp, Homo sapiens
ggccttggtactgtaaaccgag

SEQ ID NO: 7440889 - DNA, 22 bp, Homo sapiens
ggccttggtgccatggccagtt

SEQ ID NO: 7440890 - DNA, 22 bp, Homo sapiens
ggccttggtgccatggccagtt

SEQ ID NO: 7440891 - DNA, 22 bp, Homo sapiens
ggccttggtggctttgctgatg

SEQ ID NO: 7440892 - DNA, 22 bp, Homo sapiens
ggccttggtgctctgtgttgca

SEQ ID NO: 7440893 - DNA, 22 bp, Homo sapiens
ggccttggtgctctgtgttgca

SEQ ID NO: 7440894 - DNA, 22 bp, Homo sapiens
ggccttggtgccatggccagtt

SEQ ID NO: 7440895 - DNA, 22 bp, Homo sapiens
ggccttggtgccatggccagtt

SEQ ID NO: 7440896 - DNA, 22 bp, Homo sapiens
ggccttggtaatgggggactgt

SEQ ID NO: 7440897 - DNA, 22 bp, Homo sapiens
ggccttggtaaattggcatttg

SEQ ID NO: 7440898 - DNA, 22 bp, Homo sapiens
ggccttggtaaagggatgcatg

SEQ ID NO: 7440899 - DNA, 20 bp, Homo sapiens
ggccttgggtttcgcctgtt

SEQ ID NO: 7440900 - DNA, 22 bp, Homo sapiens
ggccttggtaaagggatgcatg

SEQ ID NO: 7440901 - DNA, 22 bp, Homo sapiens
ggccttggtaaagggatgcatg

SEQ ID NO: 7440902 - DNA, 20 bp, Homo sapiens
ggccttgggtttcgcctgtt

SEQ ID NO: 7440903 - DNA, 21 bp, Homo sapiens
ggcctgagcacctgtccacct

SEQ ID NO: 7440904 - DNA, 21 bp, Homo sapiens
ggcctgagcacctgtccacct

SEQ ID NO: 7440905 - DNA, 21 bp, Homo sapiens
ggcctgagcacctgtccacct

SEQ ID NO: 7440906 - DNA, 21 bp, Homo sapiens
ggcctgagcacctgtccacct

SEQ ID NO: 7440907 - DNA, 22 bp, Homo sapiens
ggcctgaggcgtcccagctgtg

SEQ ID NO: 7440908 - DNA, 22 bp, Homo sapiens
ggcctgagaaccatggggccaa

SEQ ID NO: 7440909 - DNA, 22 bp, Homo sapiens
ggcctgagaatgtaccagatct

SEQ ID NO: 7440910 - DNA, 22 bp, Homo sapiens
ggcctgagaatgtaccagatct

SEQ ID NO: 7440911 - DNA, 22 bp, Homo sapiens
ggcctgagaatgtaccagatct

SEQ ID NO: 7440912 - DNA, 22 bp, Homo sapiens
ggcctgagaatgtaccagatct

SEQ ID NO: 7440913 - DNA, 22 bp, Homo sapiens
ggcctgagaatgtaccagatct

SEQ ID NO: 7440914 - DNA, 21 bp, Homo sapiens
ggcctgagtataggacaggcc

SEQ ID NO: 7440915 - DNA, 22 bp, Homo sapiens
ggcctgagggtgggctctcagt

SEQ ID NO: 7440916 - DNA, 21 bp, Homo sapiens
ggcctgagtataggacaggcc

SEQ ID NO: 7440917 - DNA, 22 bp, Homo sapiens
ggcctgagggtgggctctcagt

SEQ ID NO: 7440918 - DNA, 22 bp, Homo sapiens
ggcctgagggtgggctctcagt

SEQ ID NO: 7440919 - DNA, 22 bp, Homo sapiens
ggcctgagggtgggctctcagt

SEQ ID NO: 7440920 - DNA, 22 bp, Homo sapiens
ggcctgagggtgggctctcagt

SEQ ID NO: 7440921 - DNA, 22 bp, Homo sapiens
ggcctgagggtgggctctcagt

SEQ ID NO: 7440922 - DNA, 22 bp, Homo sapiens
ggcctgagggtgggctctcagt

SEQ ID NO: 7440923 - DNA, 22 bp, Homo sapiens
ggcctgaggcgtcccagctgtg

SEQ ID NO: 7440924 - DNA, 22 bp, Homo sapiens
ggcctgaggcgtcccagctgtg

SEQ ID NO: 7440925 - DNA, 22 bp, Homo sapiens
ggcctgaggcgtcccagctgtg

SEQ ID NO: 7440926 - DNA, 22 bp, Homo sapiens
ggcctgagaaccatggggccaa

SEQ ID NO: 7440927 - DNA, 22 bp, Homo sapiens
ggcctgagaaccatggggccaa

SEQ ID NO: 7440928 - DNA, 22 bp, Homo sapiens
ggcctgagaaccatggggccaa

SEQ ID NO: 7440929 - DNA, 22 bp, Homo sapiens
ggcctgagaaccatggggccaa

SEQ ID NO: 7440930 - DNA, 22 bp, Homo sapiens
ggcctgaatgcctgagtgtggg

SEQ ID NO: 7440931 - DNA, 22 bp, Homo sapiens
ggcctgaaatagctctgaggtt

SEQ ID NO: 7440932 - DNA, 22 bp, Homo sapiens
ggcctgaaatagctctgaggtt

SEQ ID NO: 7440933 - DNA, 22 bp, Homo sapiens
ggcctgaaatagctctgaggtt

SEQ ID NO: 7440934 - DNA, 22 bp, Homo sapiens
ggcctgaaataaagtagcagaa

SEQ ID NO: 7440935 - DNA, 21 bp, Homo sapiens
ggcctgaaaaagtgaatgctt

SEQ ID NO: 7440936 - DNA, 22 bp, Homo sapiens
ggcctcttctgctcatactttc

SEQ ID NO: 7440937 - DNA, 22 bp, Homo sapiens
ggcctcttatctggctcctgca

SEQ ID NO: 7440938 - DNA, 22 bp, Homo sapiens
ggcctcttatctggctcctgca

SEQ ID NO: 7440939 - DNA, 22 bp, Homo sapiens
ggccttgggatgtggctgcagc

SEQ ID NO: 7440940 - DNA, 19 bp, Homo sapiens
ggcctgcccaatgtctgct

SEQ ID NO: 7440941 - DNA, 18 bp, Homo sapiens
ggcctgcagtgaagcaag

SEQ ID NO: 7440942 - DNA, 22 bp, Homo sapiens
ggccttgggatgtggctgcagc

SEQ ID NO: 7440943 - DNA, 17 bp, Homo sapiens
ggcctgcaagaacgaga

SEQ ID NO: 7440944 - DNA, 22 bp, Homo sapiens
ggcctgcacagaggtggctcta

SEQ ID NO: 7440945 - DNA, 22 bp, Homo sapiens
ggcctgcacagaggtggctcta

SEQ ID NO: 7440946 - DNA, 22 bp, Homo sapiens
ggcctgcacagaggtggctcta

SEQ ID NO: 7440947 - DNA, 22 bp, Homo sapiens
ggcctgcacagaggtggctcta

SEQ ID NO: 7440948 - DNA, 22 bp, Homo sapiens
ggcctgcacagaggtggctcta

SEQ ID NO: 7440949 - DNA, 22 bp, Homo sapiens
ggcctgcacagaggtggctcta

SEQ ID NO: 7440950 - DNA, 22 bp, Homo sapiens
ggcctgcacagaggtggctcta

SEQ ID NO: 7440951 - DNA, 17 bp, Homo sapiens
ggcctgcacctcctgct

SEQ ID NO: 7440952 - DNA, 17 bp, Homo sapiens
ggcctgcacctcctgct

SEQ ID NO: 7440953 - DNA, 20 bp, Homo sapiens
ggcctgcagctcccagcaag

SEQ ID NO: 7440954 - DNA, 18 bp, Homo sapiens
ggcctgcagtgaagcaag

SEQ ID NO: 7440955 - DNA, 22 bp, Homo sapiens
ggcctgagtcacatcaggagag

SEQ ID NO: 7440956 - DNA, 22 bp, Homo sapiens
ggcctgagtcacatcaggagag

SEQ ID NO: 7440957 - DNA, 22 bp, Homo sapiens
ggcctgagtcacatcaggagag

SEQ ID NO: 7440958 - DNA, 22 bp, Homo sapiens
ggcctgagtcacatcaggagag

SEQ ID NO: 7440959 - DNA, 21 bp, Homo sapiens
ggcctgagtataggacaggcc

SEQ ID NO: 7440960 - DNA, 21 bp, Homo sapiens
ggcctgagtataggacaggcc

SEQ ID NO: 7440961 - DNA, 21 bp, Homo sapiens
ggcctgagtataggacaggcc

SEQ ID NO: 7440962 - DNA, 21 bp, Homo sapiens
ggcctgagtataggacaggcc

SEQ ID NO: 7440963 - DNA, 21 bp, Homo sapiens
ggcctgagtataggacaggcc

SEQ ID NO: 7440964 - DNA, 21 bp, Homo sapiens
ggcctgagtataggacaggcc

SEQ ID NO: 7440965 - DNA, 22 bp, Homo sapiens
ggcctgagtcccacctggctgt

SEQ ID NO: 7440966 - DNA, 22 bp, Homo sapiens
ggcctgagtcccacctggctgt

SEQ ID NO: 7440967 - DNA, 22 bp, Homo sapiens
ggcctgcaaatggcaccttttt

SEQ ID NO: 7440968 - DNA, 22 bp, Homo sapiens
ggcctgagtcacatcaggagag

SEQ ID NO: 7440969 - DNA, 22 bp, Homo sapiens
ggcctgagtcccacctggctgt

SEQ ID NO: 7440970 - DNA, 22 bp, Homo sapiens
ggcctgagtcccacctggctgt

SEQ ID NO: 7440971 - DNA, 22 bp, Homo sapiens
ggcctgagtcccacctggctgt

SEQ ID NO: 7440972 - DNA, 22 bp, Homo sapiens
ggcctgagtcccacctggctgt

SEQ ID NO: 7440973 - DNA, 22 bp, Homo sapiens
ggcctgagtcccacctggctgt

SEQ ID NO: 7440974 - DNA, 22 bp, Homo sapiens
ggcctgagtcccacctggctgt

SEQ ID NO: 7440975 - DNA, 22 bp, Homo sapiens
ggcctgagtcacatcaggagag

SEQ ID NO: 7440976 - DNA, 22 bp, Homo sapiens
gggacaggctgagacttgagct

SEQ ID NO: 7440977 - DNA, 22 bp, Homo sapiens
gggacaggctgagacttgagct

SEQ ID NO: 7440978 - DNA, 22 bp, Homo sapiens
gggacaggctgagacttgagct

SEQ ID NO: 7440979 - DNA, 22 bp, Homo sapiens
gggacaggctgagacttgagct

SEQ ID NO: 7440980 - DNA, 22 bp, Homo sapiens
gggacagtggctgtgtcagttt

SEQ ID NO: 7440981 - DNA, 22 bp, Homo sapiens
gggacagtgaggcacggggttt

SEQ ID NO: 7440982 - DNA, 22 bp, Homo sapiens
gggacagtggctgtgtcagttt

SEQ ID NO: 7440983 - DNA, 22 bp, Homo sapiens
gggacatctttctagtcagggt

SEQ ID NO: 7440984 - DNA, 22 bp, Homo sapiens
gggacatctttctagtcagggt

SEQ ID NO: 7440985 - DNA, 22 bp, Homo sapiens
gggacatgaggccatagtgatt

SEQ ID NO: 7440986 - DNA, 22 bp, Homo sapiens
gggacatgcccctcagtgggtg

SEQ ID NO: 7440987 - DNA, 22 bp, Homo sapiens
gggacatgcccctcagtgggtg

SEQ ID NO: 7440988 - DNA, 22 bp, Homo sapiens
gggacatctttctagtcagggt

SEQ ID NO: 7440989 - DNA, 22 bp, Homo sapiens
gggacatgaagcatcggaggca

SEQ ID NO: 7440990 - DNA, 22 bp, Homo sapiens
gggacatgaagcatcggaggca

SEQ ID NO: 7440991 - DNA, 22 bp, Homo sapiens
gggacaggctgagacttgagct

SEQ ID NO: 7440992 - DNA, 22 bp, Homo sapiens
gggacaggctgagacttgagct

SEQ ID NO: 7440993 - DNA, 22 bp, Homo sapiens
gggacaggctgagacttgagct

SEQ ID NO: 7440994 - DNA, 22 bp, Homo sapiens
gggacaggctgagacttgagct

SEQ ID NO: 7440995 - DNA, 22 bp, Homo sapiens
gggacaggctgagacttgagct

SEQ ID NO: 7440996 - DNA, 22 bp, Homo sapiens
gggacaggctgagacttgagct

SEQ ID NO: 7440997 - DNA, 22 bp, Homo sapiens
gggacaggctgagacttgagct

SEQ ID NO: 7440998 - DNA, 22 bp, Homo sapiens
gggacaggctgagacttgagct

SEQ ID NO: 7440999 - DNA, 22 bp, Homo sapiens
gggacaggctgagacttgagct

SEQ ID NO: 7441000 - DNA, 22 bp, Homo sapiens
gggacaggcaaaggtatgcttc

SEQ ID NO: 7441001 - DNA, 22 bp, Homo sapiens
gggacaggcccctcgctagctt

SEQ ID NO: 7441002 - DNA, 22 bp, Homo sapiens
gggacaggcccctcgctagctt

SEQ ID NO: 7441003 - DNA, 22 bp, Homo sapiens
gggacaggcccctcgctagctt

SEQ ID NO: 7441004 - DNA, 22 bp, Homo sapiens
gggacaggcccctcgctagctt

SEQ ID NO: 7441005 - DNA, 22 bp, Homo sapiens
gggacaggcccctcgctagctt

SEQ ID NO: 7441006 - DNA, 22 bp, Homo sapiens
gggacaggcccctcgctagctt

SEQ ID NO: 7441007 - DNA, 22 bp, Homo sapiens
gggacaggcccctcgctagctt

SEQ ID NO: 7441008 - DNA, 22 bp, Homo sapiens
gggacaggcccctcgctagctt

SEQ ID NO: 7441009 - DNA, 22 bp, Homo sapiens
gggacaggcccctcgctagctt

SEQ ID NO: 7441010 - DNA, 22 bp, Homo sapiens
gggagacaaaggtgaggttctt

SEQ ID NO: 7441011 - DNA, 22 bp, Homo sapiens
gggagacaaaggtgaggttctt

SEQ ID NO: 7441012 - DNA, 22 bp, Homo sapiens
gggagacaaaggtgaggttctt

SEQ ID NO: 7441013 - DNA, 22 bp, Homo sapiens
gggagacaaaggtgaggttctt

SEQ ID NO: 7441014 - DNA, 23 bp, Homo sapiens
gggagaatatgaggatgatggtg

SEQ ID NO: 7441015 - DNA, 22 bp, Homo sapiens
gggagaagtggaaatctcatta

SEQ ID NO: 7441016 - DNA, 22 bp, Homo sapiens
gggagaagtggaaatctcatta

SEQ ID NO: 7441017 - DNA, 23 bp, Homo sapiens
gggaccagctagggctgtgacct

SEQ ID NO: 7441018 - DNA, 22 bp, Homo sapiens
gggagaagtggaaatctcatta

SEQ ID NO: 7441019 - DNA, 23 bp, Homo sapiens
gggaccagctagggctgtgacct

SEQ ID NO: 7441020 - DNA, 22 bp, Homo sapiens
gggaccagaggctgtgcacaat

SEQ ID NO: 7441021 - DNA, 22 bp, Homo sapiens
gggaccagaggctgtgcacaat

SEQ ID NO: 7441022 - DNA, 22 bp, Homo sapiens
gggaccagaggctgtgcacaat

SEQ ID NO: 7441023 - DNA, 22 bp, Homo sapiens
gggaccagaggctgtgcacaat

SEQ ID NO: 7441024 - DNA, 22 bp, Homo sapiens
gggaccagaggctgtgcacaat

SEQ ID NO: 7441025 - DNA, 23 bp, Homo sapiens
gggaccagctagggctgtgacct

SEQ ID NO: 7441026 - DNA, 23 bp, Homo sapiens
gggaccagctagggctgtgacct

SEQ ID NO: 7441027 - DNA, 23 bp, Homo sapiens
gggaccagctagggctgtgacct

SEQ ID NO: 7441028 - DNA, 23 bp, Homo sapiens
gggaccagctagggctgtgacct

SEQ ID NO: 7441029 - DNA, 23 bp, Homo sapiens
gggaccagctagggctgtgacct

SEQ ID NO: 7441030 - DNA, 23 bp, Homo sapiens
gggaccagctagggctgtgacct

SEQ ID NO: 7441031 - DNA, 22 bp, Homo sapiens
gggacattgagatacctccaaa

SEQ ID NO: 7441032 - DNA, 22 bp, Homo sapiens
gggacatggaggcgcgcaggca

SEQ ID NO: 7441033 - DNA, 22 bp, Homo sapiens
gggacatgcccctcagtgggtg

SEQ ID NO: 7441034 - DNA, 22 bp, Homo sapiens
gggacatgcccctcagtgggtg

SEQ ID NO: 7441035 - DNA, 22 bp, Homo sapiens
gggaccagaagaaggatggtga

SEQ ID NO: 7441036 - DNA, 22 bp, Homo sapiens
gggaccagaagaaggatggtga

SEQ ID NO: 7441037 - DNA, 22 bp, Homo sapiens
gggaccagaggctgtgcacaat

SEQ ID NO: 7441038 - DNA, 22 bp, Homo sapiens
gggaccagaggctgtgcacaat

SEQ ID NO: 7441039 - DNA, 22 bp, Homo sapiens
gggaccagaagaaggatggtga

SEQ ID NO: 7441040 - DNA, 22 bp, Homo sapiens
gggaccagaagaaggatggtga

SEQ ID NO: 7441041 - DNA, 22 bp, Homo sapiens
gggaccagaagaaggatggtga

SEQ ID NO: 7441042 - DNA, 22 bp, Homo sapiens
gggaccactccgacatgtaggg

SEQ ID NO: 7441043 - DNA, 22 bp, Homo sapiens
gggacattgtcaatggtggtag

SEQ ID NO: 7441044 - DNA, 22 bp, Homo sapiens
ggcttggctgtctcccagccca

SEQ ID NO: 7441045 - DNA, 22 bp, Homo sapiens
ggcttggctgtctcccagccca

SEQ ID NO: 7441046 - DNA, 16 bp, Homo sapiens
ggcttggctccatggc

SEQ ID NO: 7441047 - DNA, 22 bp, Homo sapiens
ggcttggctgtagctttagcgc

SEQ ID NO: 7441048 - DNA, 20 bp, Homo sapiens
ggcttggctgcctggggagg

SEQ ID NO: 7441049 - DNA, 20 bp, Homo sapiens
ggcttggctgcctggggagg

SEQ ID NO: 7441050 - DNA, 22 bp, Homo sapiens
ggcttggctacaagccatgggc

SEQ ID NO: 7441051 - DNA, 22 bp, Homo sapiens
ggcttcttagaatttgacttac

SEQ ID NO: 7441052 - DNA, 22 bp, Homo sapiens
ggcttcttagaatttgacttac

SEQ ID NO: 7441053 - DNA, 22 bp, Homo sapiens
ggcttggctacaagccatgggc

SEQ ID NO: 7441054 - DNA, 22 bp, Homo sapiens
ggcttggctacaagccatgggc

SEQ ID NO: 7441055 - DNA, 20 bp, Homo sapiens
ggcttcttcaggtgtctatt

SEQ ID NO: 7441056 - DNA, 22 bp, Homo sapiens
ggcttcttaatcatgagagtga

SEQ ID NO: 7441057 - DNA, 22 bp, Homo sapiens
ggcttggcttgaaattaaggtt

SEQ ID NO: 7441058 - DNA, 22 bp, Homo sapiens
ggcttgggagcaggcatgtgac

SEQ ID NO: 7441059 - DNA, 22 bp, Homo sapiens
ggcttggcttgggctcagaggc

SEQ ID NO: 7441060 - DNA, 22 bp, Homo sapiens
ggcttggcttgggctcagaggc

SEQ ID NO: 7441061 - DNA, 22 bp, Homo sapiens
ggcttgggagcaggcatgtgac

SEQ ID NO: 7441062 - DNA, 22 bp, Homo sapiens
ggcttgggagcaggcatgtgac

SEQ ID NO: 7441063 - DNA, 22 bp, Homo sapiens
ggcttgggagcaggcatgtgac

SEQ ID NO: 7441064 - DNA, 22 bp, Homo sapiens
ggcttgggagcaggcatgtgac

SEQ ID NO: 7441065 - DNA, 22 bp, Homo sapiens
ggcttgggagcaggcatgtgac

SEQ ID NO: 7441066 - DNA, 19 bp, Homo sapiens
ggcttgtctcggcagccgc

SEQ ID NO: 7441067 - DNA, 19 bp, Homo sapiens
ggcttgtctcggcagccgc

SEQ ID NO: 7441068 - DNA, 22 bp, Homo sapiens
ggcttgtccttgggctgtgcat

SEQ ID NO: 7441069 - DNA, 22 bp, Homo sapiens
ggcttgtcatgttgatgttctt

SEQ ID NO: 7441070 - DNA, 22 bp, Homo sapiens
ggcttgtccttctggttgtctt

SEQ ID NO: 7441071 - DNA, 22 bp, Homo sapiens
ggcttgtccttctggttgtctt

SEQ ID NO: 7441072 - DNA, 22 bp, Homo sapiens
ggcttgtccttgggctgtgcat

SEQ ID NO: 7441073 - DNA, 21 bp, Homo sapiens
ggcttgtcaccatagctactg

SEQ ID NO: 7441074 - DNA, 22 bp, Homo sapiens
ggcttgtcatgttgatgttctt

SEQ ID NO: 7441075 - DNA, 22 bp, Homo sapiens
ggcttgggagcaggcatgtgac

SEQ ID NO: 7441076 - DNA, 22 bp, Homo sapiens
ggcttgggagcaggcatgtgac

SEQ ID NO: 7441077 - DNA, 20 bp, Homo sapiens
ggcttgtctgagtccctggc

SEQ ID NO: 7441078 - DNA, 20 bp, Homo sapiens
ggcttgtctgagtccctggc

SEQ ID NO: 7441079 - DNA, 22 bp, Homo sapiens
ggcttgttgaaacacagattgt

SEQ ID NO: 7441080 - DNA, 22 bp, Homo sapiens
ggcttgttgaaacacagattgt

SEQ ID NO: 7441081 - DNA, 22 bp, Homo sapiens
ggcttgtggcaagtgttttaag

SEQ ID NO: 7441082 - DNA, 22 bp, Homo sapiens
ggctttaaacactgaaattgca

SEQ ID NO: 7441083 - DNA, 21 bp, Homo sapiens
ggctttaaagcagaggagtga

SEQ ID NO: 7441084 - DNA, 21 bp, Homo sapiens
ggctttaaagcagaggagtga

SEQ ID NO: 7441085 - DNA, 22 bp, Homo sapiens
ggctttaacaacagaaatttat

SEQ ID NO: 7441086 - DNA, 22 bp, Homo sapiens
ggctttaacagcagctttgctg

SEQ ID NO: 7441087 - DNA, 19 bp, Homo sapiens
ggctttaactcttgtagct

SEQ ID NO: 7441088 - DNA, 22 bp, Homo sapiens
ggctttaaggagtaaaaatgcc

SEQ ID NO: 7441089 - DNA, 22 bp, Homo sapiens
gggacagcagaaagaaggcaag

SEQ ID NO: 7441090 - DNA, 22 bp, Homo sapiens
gggacagcagaaagaaggcaag

SEQ ID NO: 7441091 - DNA, 22 bp, Homo sapiens
gggacagcagaaagaaggcaag

SEQ ID NO: 7441092 - DNA, 22 bp, Homo sapiens
gggacagcagaaagaaggcaag

SEQ ID NO: 7441093 - DNA, 22 bp, Homo sapiens
gggacagcagaaagaaggcaag

SEQ ID NO: 7441094 - DNA, 22 bp, Homo sapiens
gggacagccatgtgcagatgcc

SEQ ID NO: 7441095 - DNA, 22 bp, Homo sapiens
gggacagccatgtgcagatgcc

SEQ ID NO: 7441096 - DNA, 22 bp, Homo sapiens
gggacagccatgtgcagatgcc

SEQ ID NO: 7441097 - DNA, 22 bp, Homo sapiens
gggacagccatgtgcagatgcc

SEQ ID NO: 7441098 - DNA, 22 bp, Homo sapiens
gggacagccatgtgcagatgcc

SEQ ID NO: 7441099 - DNA, 22 bp, Homo sapiens
gggacagccatgtgcagatgcc

SEQ ID NO: 7441100 - DNA, 22 bp, Homo sapiens
gggacagccatgtgcagatgcc

SEQ ID NO: 7441101 - DNA, 22 bp, Homo sapiens
gggacagccatgtgcagatgcc

SEQ ID NO: 7441102 - DNA, 22 bp, Homo sapiens
gggacagctgtagtgcttggct

SEQ ID NO: 7441103 - DNA, 22 bp, Homo sapiens
gggacagctgtagtgcttggct

SEQ ID NO: 7441104 - DNA, 22 bp, Homo sapiens
gggacagctgtagtgcttggct

SEQ ID NO: 7441105 - DNA, 22 bp, Homo sapiens
gggacagctggtctacctggta

SEQ ID NO: 7441106 - DNA, 22 bp, Homo sapiens
gggacaggcaaaggtatgcttc

SEQ ID NO: 7441107 - DNA, 22 bp, Homo sapiens
gggacaggcaaaggtatgcttc

SEQ ID NO: 7441108 - DNA, 22 bp, Homo sapiens
gggacagctggtctacctggta

SEQ ID NO: 7441109 - DNA, 22 bp, Homo sapiens
gggacagctggtctacctggta

SEQ ID NO: 7441110 - DNA, 22 bp, Homo sapiens
gggacaggcaaaggtatgcttc

SEQ ID NO: 7441111 - DNA, 22 bp, Homo sapiens
gggacaggcaaaggtatgcttc

SEQ ID NO: 7441112 - DNA, 22 bp, Homo sapiens
gggacaggcaaaggtatgcttc

SEQ ID NO: 7441113 - DNA, 22 bp, Homo sapiens
gggacaggcaaaggtatgcttc

SEQ ID NO: 7441114 - DNA, 22 bp, Homo sapiens
gggacaggcaaaggtatgcttc

SEQ ID NO: 7441115 - DNA, 22 bp, Homo sapiens
gggacaggcaaaggtatgcttc

SEQ ID NO: 7441116 - DNA, 22 bp, Homo sapiens
gggaatgtgaaacagtaaggga

SEQ ID NO: 7441117 - DNA, 22 bp, Homo sapiens
gggaatgtagcaaatctgcaat

SEQ ID NO: 7441118 - DNA, 22 bp, Homo sapiens
gggaatgtacagaggacacagg

SEQ ID NO: 7441119 - DNA, 22 bp, Homo sapiens
gggaatgtacagaggacacagg

SEQ ID NO: 7441120 - DNA, 22 bp, Homo sapiens
gggaatgtaattaatctccttc

SEQ ID NO: 7441121 - DNA, 22 bp, Homo sapiens
gggaatgtaattaatctccttc

SEQ ID NO: 7441122 - DNA, 22 bp, Homo sapiens
gggaatgtgcctggagtgttca

SEQ ID NO: 7441123 - DNA, 22 bp, Homo sapiens
gggacagcagaaagaaggcaag

SEQ ID NO: 7441124 - DNA, 20 bp, Homo sapiens
gggaatgtgccccttacccc

SEQ ID NO: 7441125 - DNA, 22 bp, Homo sapiens
gggaatgtgcaggatcgtgggc

SEQ ID NO: 7441126 - DNA, 22 bp, Homo sapiens
gggaatgtgcagccacagtgag

SEQ ID NO: 7441127 - DNA, 22 bp, Homo sapiens
gggaatgtgattgttgttttaa

SEQ ID NO: 7441128 - DNA, 22 bp, Homo sapiens
gggaatgtgagtagggtgagtt

SEQ ID NO: 7441129 - DNA, 22 bp, Homo sapiens
gggaatgtaatcatggaatgct

SEQ ID NO: 7441130 - DNA, 22 bp, Homo sapiens
ggctttatagggtagaggatca

SEQ ID NO: 7441131 - DNA, 17 bp, Homo sapiens
ggctttagggacaccac

SEQ ID NO: 7441132 - DNA, 22 bp, Homo sapiens
ggctttagggcaggcagtgtta

SEQ ID NO: 7441133 - DNA, 22 bp, Homo sapiens
ggctttaaggagtaaaaatgcc

SEQ ID NO: 7441134 - DNA, 22 bp, Homo sapiens
ggctttaaggtttaggaagcaa

SEQ ID NO: 7441135 - DNA, 22 bp, Homo sapiens
ggctttaaggtttaggaagcaa

SEQ ID NO: 7441136 - DNA, 22 bp, Homo sapiens
ggctttaaggtttaggaagcaa

SEQ ID NO: 7441137 - DNA, 22 bp, Homo sapiens
ggctttaatagataaggtttct

SEQ ID NO: 7441138 - DNA, 22 bp, Homo sapiens
ggctttaatagataaggtttct

SEQ ID NO: 7441139 - DNA, 16 bp, Homo sapiens
ggctttaatttatccc

SEQ ID NO: 7441140 - DNA, 22 bp, Homo sapiens
ggctttagggcaggcagtgtta

SEQ ID NO: 7441141 - DNA, 19 bp, Homo sapiens
gggagacagctctgggctg

SEQ ID NO: 7441142 - DNA, 22 bp, Homo sapiens
gggagacacttgctttagaggg

SEQ ID NO: 7441143 - DNA, 22 bp, Homo sapiens
gggagacacttgctttagaggg

SEQ ID NO: 7441144 - DNA, 19 bp, Homo sapiens
gggagacagctctgggctg

SEQ ID NO: 7441145 - DNA, 19 bp, Homo sapiens
gggagacagctctgggctg

SEQ ID NO: 7441146 - DNA, 22 bp, Homo sapiens
gggagacacttgctttagaggg

SEQ ID NO: 7441147 - DNA, 22 bp, Homo sapiens
gggagacacgctgcaggcataa

SEQ ID NO: 7441148 - DNA, 22 bp, Homo sapiens
gggagacacgctgcaggcataa

SEQ ID NO: 7441149 - DNA, 22 bp, Homo sapiens
gggagacacgctgcaggcataa

SEQ ID NO: 7441150 - DNA, 22 bp, Homo sapiens
gggagacacgctgcaggcataa

SEQ ID NO: 7441151 - DNA, 22 bp, Homo sapiens
gggagacacgctgcaggcataa

SEQ ID NO: 7441152 - DNA, 22 bp, Homo sapiens
gggagacaagaagtagcctgct

SEQ ID NO: 7441153 - DNA, 22 bp, Homo sapiens
gggagacaagaagtagcctgct

SEQ ID NO: 7441154 - DNA, 22 bp, Homo sapiens
gggagacaagaagtagcctgct

SEQ ID NO: 7441155 - DNA, 22 bp, Homo sapiens
gggagacaagaagtagcctgct

SEQ ID NO: 7441156 - DNA, 22 bp, Homo sapiens
gggagacacgctgcaggcataa

SEQ ID NO: 7441157 - DNA, 22 bp, Homo sapiens
gggagacacgctgcaggcataa

SEQ ID NO: 7441158 - DNA, 22 bp, Homo sapiens
gggagacacgctgcaggcataa

SEQ ID NO: 7441159 - DNA, 22 bp, Homo sapiens
gggagacacgctgcaggcataa

SEQ ID NO: 7441160 - DNA, 22 bp, Homo sapiens
gggagacacgctgcaggcataa

SEQ ID NO: 7441161 - DNA, 22 bp, Homo sapiens
gggagacacgctgcaggcataa

SEQ ID NO: 7441162 - DNA, 22 bp, Homo sapiens
gggagacaaggagaaccaaaga

SEQ ID NO: 7441163 - DNA, 22 bp, Homo sapiens
gggagacaaggagaaccaaaga

SEQ ID NO: 7441164 - DNA, 22 bp, Homo sapiens
gggagagaaattatagcaatga

SEQ ID NO: 7441165 - DNA, 22 bp, Homo sapiens
gggagagaaattatagcaatga

SEQ ID NO: 7441166 - DNA, 22 bp, Homo sapiens
gggagagaaattatagcaatga

SEQ ID NO: 7441167 - DNA, 22 bp, Homo sapiens
gggagagaaattatagcaatga

SEQ ID NO: 7441168 - DNA, 22 bp, Homo sapiens
gggagagaaattatagcaatga

SEQ ID NO: 7441169 - DNA, 22 bp, Homo sapiens
gggagagaagggcatgtacact

SEQ ID NO: 7441170 - DNA, 22 bp, Homo sapiens
gggagagaagggcatgtacact

SEQ ID NO: 7441171 - DNA, 22 bp, Homo sapiens
gggagagaagggcatgtacact

SEQ ID NO: 7441172 - DNA, 22 bp, Homo sapiens
gggagagaattattgccagacc

SEQ ID NO: 7441173 - DNA, 22 bp, Homo sapiens
gggagagaattattgccagacc

SEQ ID NO: 7441174 - DNA, 22 bp, Homo sapiens
gggagagaattattgccagacc

SEQ ID NO: 7441175 - DNA, 22 bp, Homo sapiens
gggagagaattattgccagacc

SEQ ID NO: 7441176 - DNA, 22 bp, Homo sapiens
gggagagaattattgccagacc

SEQ ID NO: 7441177 - DNA, 22 bp, Homo sapiens
gggagagaattattgccagacc

SEQ ID NO: 7441178 - DNA, 22 bp, Homo sapiens
gggagacccccaatgccaggtc

SEQ ID NO: 7441179 - DNA, 22 bp, Homo sapiens
gggagacccccaatgccaggtc

SEQ ID NO: 7441180 - DNA, 22 bp, Homo sapiens
gggagacagttcagatagtttc

SEQ ID NO: 7441181 - DNA, 22 bp, Homo sapiens
gggagacccccaatgccaggtc

SEQ ID NO: 7441182 - DNA, 20 bp, Homo sapiens
gggagacagggccagtgtcc

SEQ ID NO: 7441183 - DNA, 20 bp, Homo sapiens
gggagacagggccagtgtcc

SEQ ID NO: 7441184 - DNA, 19 bp, Homo sapiens
gggagacagctctgggctg

SEQ ID NO: 7441185 - DNA, 20 bp, Homo sapiens
gggagacagggccagtgtcc

SEQ ID NO: 7441186 - DNA, 20 bp, Homo sapiens
gggagacagggccagtgtcc

SEQ ID NO: 7441187 - DNA, 22 bp, Homo sapiens
gggagacagttcagatagtttc

SEQ ID NO: 7441188 - DNA, 22 bp, Homo sapiens
gggagacagttcagatagtttc

SEQ ID NO: 7441189 - DNA, 22 bp, Homo sapiens
gggagacagttcagatagtttc

SEQ ID NO: 7441190 - DNA, 22 bp, Homo sapiens
gggagagagagctcatgttgaa

SEQ ID NO: 7441191 - DNA, 22 bp, Homo sapiens
gggagagagagctcatgttgaa

SEQ ID NO: 7441192 - DNA, 22 bp, Homo sapiens
gggagagagagctcatgttgaa

SEQ ID NO: 7441193 - DNA, 22 bp, Homo sapiens
gggagagagagctcatgttgaa

SEQ ID NO: 7441194 - DNA, 22 bp, Homo sapiens
gggagagatgctgattgccaat

SEQ ID NO: 7441195 - DNA, 22 bp, Homo sapiens
gggagagatgctgattgccaat

SEQ ID NO: 7441196 - DNA, 19 bp, Homo sapiens
gggagagccaggctcaccc

SEQ ID NO: 7441197 - DNA, 19 bp, Homo sapiens
gggagagccaggctcaccc

SEQ ID NO: 7441198 - DNA, 19 bp, Homo sapiens
gggagagccaggctcaccc

SEQ ID NO: 7441199 - DNA, 19 bp, Homo sapiens
gggagagccaggctcaccc

SEQ ID NO: 7441200 - DNA, 19 bp, Homo sapiens
gggagagccaggctcaccc

SEQ ID NO: 7441201 - DNA, 22 bp, Homo sapiens
gggagagatgctgattgccaat

SEQ ID NO: 7441202 - DNA, 22 bp, Homo sapiens
gggagagatgctgattgccaat

SEQ ID NO: 7441203 - DNA, 22 bp, Homo sapiens
gggagagagaaaacgtggcgca

SEQ ID NO: 7441204 - DNA, 22 bp, Homo sapiens
gggagagagaaaacgtggcgca

SEQ ID NO: 7441205 - DNA, 22 bp, Homo sapiens
gggagagaattattgccagacc

SEQ ID NO: 7441206 - DNA, 22 bp, Homo sapiens
gggagagaattattgccagacc

SEQ ID NO: 7441207 - DNA, 22 bp, Homo sapiens
gggagagaattattgccagacc

SEQ ID NO: 7441208 - DNA, 22 bp, Homo sapiens
gggagagagagctcatgttgaa

SEQ ID NO: 7441209 - DNA, 22 bp, Homo sapiens
gggagagagagctcatgttgaa

SEQ ID NO: 7441210 - DNA, 22 bp, Homo sapiens
gggagagagagctcatgttgaa

SEQ ID NO: 7441211 - DNA, 22 bp, Homo sapiens
gggagagagaaaacgtggcgca

SEQ ID NO: 7441212 - DNA, 22 bp, Homo sapiens
gggagagagaaaacgtggcgca

SEQ ID NO: 7441213 - DNA, 22 bp, Homo sapiens
gggagagagaaaacgtggcgca

SEQ ID NO: 7441214 - DNA, 22 bp, Homo sapiens
gggagagcgggaggtgccacag

SEQ ID NO: 7441215 - DNA, 22 bp, Homo sapiens
gggagagcgggaggtgccacag

SEQ ID NO: 7441216 - DNA, 22 bp, Homo sapiens
gggagagcgggaggtgccacag

SEQ ID NO: 7441217 - DNA, 22 bp, Homo sapiens
gggagagcgggaggtgccacag

SEQ ID NO: 7441218 - DNA, 22 bp, Homo sapiens
gggagaggttacccgagcaact

SEQ ID NO: 7441219 - DNA, 22 bp, Homo sapiens
gggagaggttacccgagcaact

SEQ ID NO: 7441220 - DNA, 22 bp, Homo sapiens
gggagaggttacccgagcaact

SEQ ID NO: 7441221 - DNA, 22 bp, Homo sapiens
gggagagcgcgctagggccgag

SEQ ID NO: 7441222 - DNA, 22 bp, Homo sapiens
gggagagcgcgctagggccgag

SEQ ID NO: 7441223 - DNA, 22 bp, Homo sapiens
gggagagcgcgctagggccgag

SEQ ID NO: 7441224 - DNA, 22 bp, Homo sapiens
gggagagcgcgctagggccgag

SEQ ID NO: 7441225 - DNA, 22 bp, Homo sapiens
gggagagcgcgctagggccgag

SEQ ID NO: 7441226 - DNA, 19 bp, Homo sapiens
gggagagccaggctcaccc

SEQ ID NO: 7441227 - DNA, 22 bp, Homo sapiens
gggagagcgcgctagggccgag

SEQ ID NO: 7441228 - DNA, 22 bp, Homo sapiens
gggagaggttacccgagcaact

SEQ ID NO: 7441229 - DNA, 22 bp, Homo sapiens
gggagaggttacccgagcaact

SEQ ID NO: 7441230 - DNA, 22 bp, Homo sapiens
gggagaggttacccgagcaact

SEQ ID NO: 7441231 - DNA, 22 bp, Homo sapiens
gggagaggttacccgagcaact

SEQ ID NO: 7441232 - DNA, 22 bp, Homo sapiens
gggagaggttacccgagcaact

SEQ ID NO: 7441233 - DNA, 22 bp, Homo sapiens
gggagaggttacccgagcaact

SEQ ID NO: 7441234 - DNA, 22 bp, Homo sapiens
gggagaggttacccgagcaact

SEQ ID NO: 7441235 - DNA, 22 bp, Homo sapiens
gggagaggttacccgagcaact

SEQ ID NO: 7441236 - DNA, 22 bp, Homo sapiens
gggagaggttacccgagcaact

SEQ ID NO: 7441237 - DNA, 22 bp, Homo sapiens
gggagaggttacccgagcaact

SEQ ID NO: 7441238 - DNA, 22 bp, Homo sapiens
gggagaggttacccgagcaact

SEQ ID NO: 7441239 - DNA, 22 bp, Homo sapiens
gggagagtagctggaaggttct

SEQ ID NO: 7441240 - DNA, 22 bp, Homo sapiens
gggagagtagctggaaggttct

SEQ ID NO: 7441241 - DNA, 22 bp, Homo sapiens
gggagaggttacccgagcaact

SEQ ID NO: 7441242 - DNA, 22 bp, Homo sapiens
gggagaggttacccgagcaact

SEQ ID NO: 7441243 - DNA, 22 bp, Homo sapiens
gggagaggttacccgagcaact

SEQ ID NO: 7441244 - DNA, 22 bp, Homo sapiens
gggagaggttacccgagcaact

SEQ ID NO: 7441245 - DNA, 22 bp, Homo sapiens
gggagaggttacccgagcaact

SEQ ID NO: 7441246 - DNA, 22 bp, Homo sapiens
gggagaggttacccgagcaact

SEQ ID NO: 7441247 - DNA, 18 bp, Homo sapiens
gggagctgggaagctggt

SEQ ID NO: 7441248 - DNA, 18 bp, Homo sapiens
gggagctgggaagctggt

SEQ ID NO: 7441249 - DNA, 18 bp, Homo sapiens
gggagctgggaagctggt

SEQ ID NO: 7441250 - DNA, 18 bp, Homo sapiens
gggagctgggaagctggt

SEQ ID NO: 7441251 - DNA, 18 bp, Homo sapiens
gggagctgggaagctggt

SEQ ID NO: 7441252 - DNA, 22 bp, Homo sapiens
gggagatgaatcagaagtgatc

SEQ ID NO: 7441253 - DNA, 22 bp, Homo sapiens
gggagatgaatcagaagtgatc

SEQ ID NO: 7441254 - DNA, 22 bp, Homo sapiens
gggagatgaatcagaagtgatc

SEQ ID NO: 7441255 - DNA, 17 bp, Homo sapiens
gggagatgaagggatat

SEQ ID NO: 7441256 - DNA, 17 bp, Homo sapiens
gggagatgaagggatat

SEQ ID NO: 7441257 - DNA, 17 bp, Homo sapiens
gggagatgaagggatat

SEQ ID NO: 7441258 - DNA, 17 bp, Homo sapiens
gggagatgaagggatat

SEQ ID NO: 7441259 - DNA, 22 bp, Homo sapiens
gggagagtagctggaaggttct

SEQ ID NO: 7441260 - DNA, 17 bp, Homo sapiens
gggagatgaagggatat

SEQ ID NO: 7441261 - DNA, 17 bp, Homo sapiens
gggagatgaagggatat

SEQ ID NO: 7441262 - DNA, 22 bp, Homo sapiens
gggagctggttcctgccctcca

SEQ ID NO: 7441263 - DNA, 22 bp, Homo sapiens
gggagctggttcctgccctcca

SEQ ID NO: 7441264 - DNA, 22 bp, Homo sapiens
gggagctggttcctgccctcca

SEQ ID NO: 7441265 - DNA, 22 bp, Homo sapiens
gggagctgtaagggacaggtag

SEQ ID NO: 7441266 - DNA, 22 bp, Homo sapiens
gggagctgtaagggacaggtag

SEQ ID NO: 7441267 - DNA, 22 bp, Homo sapiens
gggagctgtaagggacaggtag

SEQ ID NO: 7441268 - DNA, 22 bp, Homo sapiens
gggagctgtaagggacaggtag

SEQ ID NO: 7441269 - DNA, 22 bp, Homo sapiens
gggagctgtaagggacaggtag

SEQ ID NO: 7441270 - DNA, 22 bp, Homo sapiens
gggagctggggcatttataccc

SEQ ID NO: 7441271 - DNA, 22 bp, Homo sapiens
gggagctggggcatttataccc

SEQ ID NO: 7441272 - DNA, 22 bp, Homo sapiens
gggagctggttcctgccctcca

SEQ ID NO: 7441273 - DNA, 22 bp, Homo sapiens
gggagctggttcctgccctcca

SEQ ID NO: 7441274 - DNA, 22 bp, Homo sapiens
gggagctggttcctgccctcca

SEQ ID NO: 7441275 - DNA, 22 bp, Homo sapiens
gggagctgggctggttttgctg

SEQ ID NO: 7441276 - DNA, 22 bp, Homo sapiens
gggagctgggctggttttgctg

SEQ ID NO: 7441277 - DNA, 18 bp, Homo sapiens
gggagctgggaagctggt

SEQ ID NO: 7441278 - DNA, 22 bp, Homo sapiens
gggagctgtagtccagataccg

SEQ ID NO: 7441279 - DNA, 22 bp, Homo sapiens
gggagctgtcatcagtgttgtc

SEQ ID NO: 7441280 - DNA, 22 bp, Homo sapiens
gggagctgtcatcagtgttgtc

SEQ ID NO: 7441281 - DNA, 22 bp, Homo sapiens
gggagctgtcatcagtgttgtc

SEQ ID NO: 7441282 - DNA, 19 bp, Homo sapiens
gggagctgtctgcccgtgg

SEQ ID NO: 7441283 - DNA, 19 bp, Homo sapiens
gggagctgtctgcccgtgg

SEQ ID NO: 7441284 - DNA, 19 bp, Homo sapiens
gggagctgtctgcccgtgg

SEQ ID NO: 7441285 - DNA, 22 bp, Homo sapiens
gggagctgtaagggacaggtag

SEQ ID NO: 7441286 - DNA, 22 bp, Homo sapiens
gggagctgtaagggacaggtag

SEQ ID NO: 7441287 - DNA, 22 bp, Homo sapiens
gggagctgtaagggacaggtag

SEQ ID NO: 7441288 - DNA, 22 bp, Homo sapiens
gggagctgtagtccagataccg

SEQ ID NO: 7441289 - DNA, 22 bp, Homo sapiens
gggagctgtagtccagataccg

SEQ ID NO: 7441290 - DNA, 22 bp, Homo sapiens
gggcaggagagggccacctgga

SEQ ID NO: 7441291 - DNA, 22 bp, Homo sapiens
gggcaggagagggccacctgga

SEQ ID NO: 7441292 - DNA, 22 bp, Homo sapiens
gggcaggagagggccacctgga

SEQ ID NO: 7441293 - DNA, 22 bp, Homo sapiens
gggcaggagagggccacctgga

SEQ ID NO: 7441294 - DNA, 22 bp, Homo sapiens
gggcaggagagaacagtcatgg

SEQ ID NO: 7441295 - DNA, 22 bp, Homo sapiens
gggcaggagagaacagtcatgg

SEQ ID NO: 7441296 - DNA, 22 bp, Homo sapiens
gggcaggagagaacagtcatgg

SEQ ID NO: 7441297 - DNA, 22 bp, Homo sapiens
gggcaggagagaacagtcatgg

SEQ ID NO: 7441298 - DNA, 22 bp, Homo sapiens
gggcaggagagaacagtcatgg

SEQ ID NO: 7441299 - DNA, 22 bp, Homo sapiens
gggcaggagagaacagtcatgg

SEQ ID NO: 7441300 - DNA, 22 bp, Homo sapiens
gggcaggagagaacagtcatgg

SEQ ID NO: 7441301 - DNA, 22 bp, Homo sapiens
gggcaggagagaacagtcatgg

SEQ ID NO: 7441302 - DNA, 22 bp, Homo sapiens
gggcaggaggctaattctgcat

SEQ ID NO: 7441303 - DNA, 22 bp, Homo sapiens
gggcaggaggctaattctgcat

SEQ ID NO: 7441304 - DNA, 22 bp, Homo sapiens
gggcaggaggctaattctgcat

SEQ ID NO: 7441305 - DNA, 22 bp, Homo sapiens
gggcaggaggctaattctgcat

SEQ ID NO: 7441306 - DNA, 22 bp, Homo sapiens
gggcaggagagggccacctgga

SEQ ID NO: 7441307 - DNA, 22 bp, Homo sapiens
gggcaggagagggccacctgga

SEQ ID NO: 7441308 - DNA, 22 bp, Homo sapiens
gggcaggagagggccacctgga

SEQ ID NO: 7441309 - DNA, 22 bp, Homo sapiens
gggcaggagagggccacctgga

SEQ ID NO: 7441310 - DNA, 22 bp, Homo sapiens
gggcaggagagggccacctgga

SEQ ID NO: 7441311 - DNA, 22 bp, Homo sapiens
gggcaggagagggccacctgga

SEQ ID NO: 7441312 - DNA, 22 bp, Homo sapiens
gggcaggagagaacagtcatgg

SEQ ID NO: 7441313 - DNA, 22 bp, Homo sapiens
gggcaggagagaacagtcatgg

SEQ ID NO: 7441314 - DNA, 22 bp, Homo sapiens
gggcaggagagaacagtcatgg

SEQ ID NO: 7441315 - DNA, 22 bp, Homo sapiens
gggcaggagagaacagtcatgg

SEQ ID NO: 7441316 - DNA, 22 bp, Homo sapiens
gggcaggagagaacagtcatgg

SEQ ID NO: 7441317 - DNA, 22 bp, Homo sapiens
gggcaggagaaggtggatgtcc

SEQ ID NO: 7441318 - DNA, 22 bp, Homo sapiens
gggcaggagaaggtggatgtcc

SEQ ID NO: 7441319 - DNA, 22 bp, Homo sapiens
gggcaggagaaggtggatgtcc

SEQ ID NO: 7441320 - DNA, 22 bp, Homo sapiens
gggcaggagaaggtggatgtcc

SEQ ID NO: 7441321 - DNA, 22 bp, Homo sapiens
gggcaggagaaggtggatgtcc

SEQ ID NO: 7441322 - DNA, 22 bp, Homo sapiens
gggcaggagaaggtggatgtcc

SEQ ID NO: 7441323 - DNA, 22 bp, Homo sapiens
gggcaggagaaggtggatgtcc

SEQ ID NO: 7441324 - DNA, 22 bp, Homo sapiens
gggcaggagaaggtggatgtcc

SEQ ID NO: 7441325 - DNA, 22 bp, Homo sapiens
gggcaggagaaggtggatgtcc

SEQ ID NO: 7441326 - DNA, 22 bp, Homo sapiens
gggcaggagaaggtggatgtcc

SEQ ID NO: 7441327 - DNA, 22 bp, Homo sapiens
gggcaggagaaggtggatgtcc

SEQ ID NO: 7441328 - DNA, 22 bp, Homo sapiens
gggcaggagaaggtggatgtcc

SEQ ID NO: 7441329 - DNA, 22 bp, Homo sapiens
gggcaggagaaggtggatgtcc

SEQ ID NO: 7441330 - DNA, 16 bp, Homo sapiens
gggcaggaatcagggt

SEQ ID NO: 7441331 - DNA, 16 bp, Homo sapiens
gggcaggaatcagggt

SEQ ID NO: 7441332 - DNA, 16 bp, Homo sapiens
gggcaggaatcagggt

SEQ ID NO: 7441333 - DNA, 16 bp, Homo sapiens
gggcaggaatcagggt

SEQ ID NO: 7441334 - DNA, 22 bp, Homo sapiens
gggcaggaacaaatcaaatgat

SEQ ID NO: 7441335 - DNA, 16 bp, Homo sapiens
gggcaggaatcagggt

SEQ ID NO: 7441336 - DNA, 22 bp, Homo sapiens
gggcaggctgagcatgtcacct

SEQ ID NO: 7441337 - DNA, 22 bp, Homo sapiens
gggcaggctgagcatgtcacct

SEQ ID NO: 7441338 - DNA, 22 bp, Homo sapiens
gggcaggctgagcatgtcacct

SEQ ID NO: 7441339 - DNA, 22 bp, Homo sapiens
gggcaggctgagcatgtcacct

SEQ ID NO: 7441340 - DNA, 22 bp, Homo sapiens
gggcaggctgagcatgtcacct

SEQ ID NO: 7441341 - DNA, 22 bp, Homo sapiens
gggcaggctgagcatgtcacct

SEQ ID NO: 7441342 - DNA, 22 bp, Homo sapiens
gggcaggatgcagtttcagaga

SEQ ID NO: 7441343 - DNA, 22 bp, Homo sapiens
gggcaggatgcagtttcagaga

SEQ ID NO: 7441344 - DNA, 22 bp, Homo sapiens
gggcaggatgcagtttcagaga

SEQ ID NO: 7441345 - DNA, 22 bp, Homo sapiens
gggcaggaggctaattctgcat

SEQ ID NO: 7441346 - DNA, 22 bp, Homo sapiens
gggcatgcctgcgcagtgcatg

SEQ ID NO: 7441347 - DNA, 19 bp, Homo sapiens
gggcatgctggctctagag

SEQ ID NO: 7441348 - DNA, 22 bp, Homo sapiens
gggcatgcctgcgcagtgcatg

SEQ ID NO: 7441349 - DNA, 22 bp, Homo sapiens
gggcatgcctgcgcagtgcatg

SEQ ID NO: 7441350 - DNA, 22 bp, Homo sapiens
gggcaggctgagcatgtcacct

SEQ ID NO: 7441351 - DNA, 17 bp, Homo sapiens
gggcagggactcctggg

SEQ ID NO: 7441352 - DNA, 22 bp, Homo sapiens
gggcaggctgagcatgtcacct

SEQ ID NO: 7441353 - DNA, 22 bp, Homo sapiens
gggcaggctgagcatgtcacct

SEQ ID NO: 7441354 - DNA, 22 bp, Homo sapiens
gggcatgcttccttgcttgctt

SEQ ID NO: 7441355 - DNA, 22 bp, Homo sapiens
gggcatgcttccttgcttgctt

SEQ ID NO: 7441356 - DNA, 22 bp, Homo sapiens
gggcatggaggtctgtctgcag

SEQ ID NO: 7441357 - DNA, 22 bp, Homo sapiens
gggcatggaggtctgtctgcag

SEQ ID NO: 7441358 - DNA, 23 bp, Homo sapiens
gggcatggagtgtaggtggaagg

SEQ ID NO: 7441359 - DNA, 22 bp, Homo sapiens
gggcatggaggtctgtctgcag

SEQ ID NO: 7441360 - DNA, 22 bp, Homo sapiens
gggcatggaggtctgtctgcag

SEQ ID NO: 7441361 - DNA, 23 bp, Homo sapiens
gggcatggagtgtaggtggaagg

SEQ ID NO: 7441362 - DNA, 23 bp, Homo sapiens
gggcatggagtgtaggtggaagg

SEQ ID NO: 7441363 - DNA, 23 bp, Homo sapiens
gggcatggagtgtaggtggaagg

SEQ ID NO: 7441364 - DNA, 23 bp, Homo sapiens
gggcatggagtgtaggtggaagg

SEQ ID NO: 7441365 - DNA, 19 bp, Homo sapiens
gggcatggatgagcttacc

SEQ ID NO: 7441366 - DNA, 19 bp, Homo sapiens
gggcatggatgagcttacc

SEQ ID NO: 7441367 - DNA, 23 bp, Homo sapiens
gggcatggagtgtaggtggaagg

SEQ ID NO: 7441368 - DNA, 19 bp, Homo sapiens
gggcatggatgagcttacc

SEQ ID NO: 7441369 - DNA, 19 bp, Homo sapiens
gggcatggatgagcttacc

SEQ ID NO: 7441370 - DNA, 19 bp, Homo sapiens
gggcatggatgagcttacc

SEQ ID NO: 7441371 - DNA, 18 bp, Homo sapiens
gggcatggatgcagcatc

SEQ ID NO: 7441372 - DNA, 18 bp, Homo sapiens
gggcatggatgcagcatc

SEQ ID NO: 7441373 - DNA, 18 bp, Homo sapiens
gggcatggatgcagcatc

SEQ ID NO: 7441374 - DNA, 18 bp, Homo sapiens
gggcatggatgcagcatc

SEQ ID NO: 7441375 - DNA, 22 bp, Homo sapiens
gggcagctgcccctctctgggc

SEQ ID NO: 7441376 - DNA, 22 bp, Homo sapiens
gggcagctgcccctctctgggc

SEQ ID NO: 7441377 - DNA, 22 bp, Homo sapiens
gggcagctgcccctctctgggc

SEQ ID NO: 7441378 - DNA, 22 bp, Homo sapiens
gggcagctgcccctctctgggc

SEQ ID NO: 7441379 - DNA, 22 bp, Homo sapiens
gggcagctgcccctctctgggc

SEQ ID NO: 7441380 - DNA, 22 bp, Homo sapiens
gggcagctgcccctctctgggc

SEQ ID NO: 7441381 - DNA, 22 bp, Homo sapiens
gggcagctgccagaggccatgg

SEQ ID NO: 7441382 - DNA, 22 bp, Homo sapiens
gggcagctgccagaggccatgg

SEQ ID NO: 7441383 - DNA, 22 bp, Homo sapiens
gggcagctgccagaggccatgg

SEQ ID NO: 7441384 - DNA, 22 bp, Homo sapiens
gggcagctgccagaggccatgg

SEQ ID NO: 7441385 - DNA, 22 bp, Homo sapiens
gggcagctgccagaggccatgg

SEQ ID NO: 7441386 - DNA, 22 bp, Homo sapiens
gggcagctgccagaggccatgg

SEQ ID NO: 7441387 - DNA, 22 bp, Homo sapiens
gggcagctgccagaggccatgg

SEQ ID NO: 7441388 - DNA, 22 bp, Homo sapiens
gggcagctgccagaggccatgg

SEQ ID NO: 7441389 - DNA, 22 bp, Homo sapiens
gggcagctgccaagtgcatcgc

SEQ ID NO: 7441390 - DNA, 22 bp, Homo sapiens
gggcagctgccaagtgcatcgc

SEQ ID NO: 7441391 - DNA, 22 bp, Homo sapiens
gggcagctgccactccgcttgc

SEQ ID NO: 7441392 - DNA, 22 bp, Homo sapiens
gggcagctgccactccgcttgc

SEQ ID NO: 7441393 - DNA, 22 bp, Homo sapiens
gggcagctgccactccgcttgc

SEQ ID NO: 7441394 - DNA, 22 bp, Homo sapiens
gggcagctgccactccgcttgc

SEQ ID NO: 7441395 - DNA, 22 bp, Homo sapiens
gggcagctgccaagtgcatcgc

SEQ ID NO: 7441396 - DNA, 22 bp, Homo sapiens
gggcagctgccaagtgcatcgc

SEQ ID NO: 7441397 - DNA, 22 bp, Homo sapiens
gggcagctgccaagtgcatcgc

SEQ ID NO: 7441398 - DNA, 22 bp, Homo sapiens
gggcagctgccaagtgcatcgc

SEQ ID NO: 7441399 - DNA, 22 bp, Homo sapiens
gggcagctgcagggatggtgac

SEQ ID NO: 7441400 - DNA, 22 bp, Homo sapiens
gggcagctgcagggatggtgac

SEQ ID NO: 7441401 - DNA, 22 bp, Homo sapiens
gggcagctgcagggatggtgac

SEQ ID NO: 7441402 - DNA, 22 bp, Homo sapiens
gggcagctgtatctgagcttat

SEQ ID NO: 7441403 - DNA, 22 bp, Homo sapiens
gggcagctgtatctgagcttat

SEQ ID NO: 7441404 - DNA, 22 bp, Homo sapiens
gggcagctgtatctgagcttat

SEQ ID NO: 7441405 - DNA, 22 bp, Homo sapiens
gggcagctgtatctgagcttat

SEQ ID NO: 7441406 - DNA, 22 bp, Homo sapiens
gggcagctgtcttggttctcaa

SEQ ID NO: 7441407 - DNA, 22 bp, Homo sapiens
gggcagctgtcttggttctcaa

SEQ ID NO: 7441408 - DNA, 22 bp, Homo sapiens
gggcagctgtcttggttctcaa

SEQ ID NO: 7441409 - DNA, 22 bp, Homo sapiens
gggcagctgtatctgagcttat

SEQ ID NO: 7441410 - DNA, 23 bp, Homo sapiens
gggcagcttaagcttgtttttct

SEQ ID NO: 7441411 - DNA, 23 bp, Homo sapiens
gggcagcttaagcttgtttttct

SEQ ID NO: 7441412 - DNA, 22 bp, Homo sapiens
gggcagctgtcttggttctcaa

SEQ ID NO: 7441413 - DNA, 22 bp, Homo sapiens
gggcaggaacaaatcaaatgat

SEQ ID NO: 7441414 - DNA, 22 bp, Homo sapiens
gggcaggaacaaatcaaatgat

SEQ ID NO: 7441415 - DNA, 23 bp, Homo sapiens
gggcagcttaagcttgtttttct

SEQ ID NO: 7441416 - DNA, 22 bp, Homo sapiens
gggcaggaacaaatcaaatgat

SEQ ID NO: 7441417 - DNA, 22 bp, Homo sapiens
gggcaggaacaaatcaaatgat

SEQ ID NO: 7441418 - DNA, 22 bp, Homo sapiens
gggcaggaacaaatcaaatgat

SEQ ID NO: 7441419 - DNA, 22 bp, Homo sapiens
gggcagctggcttataggtttg

SEQ ID NO: 7441420 - DNA, 22 bp, Homo sapiens
gggcagctggcttataggtttg

SEQ ID NO: 7441421 - DNA, 22 bp, Homo sapiens
gggcagctggcttataggtttg

SEQ ID NO: 7441422 - DNA, 22 bp, Homo sapiens
gggcagctggcttataggtttg

SEQ ID NO: 7441423 - DNA, 22 bp, Homo sapiens
gggcagctggcttataggtttg

SEQ ID NO: 7441424 - DNA, 22 bp, Homo sapiens
gggcagctggccaggtattctg

SEQ ID NO: 7441425 - DNA, 22 bp, Homo sapiens
gggcagctggccaggtattctg

SEQ ID NO: 7441426 - DNA, 22 bp, Homo sapiens
gggcagctggccaggtattctg

SEQ ID NO: 7441427 - DNA, 22 bp, Homo sapiens
gggcagctggatagttttaaat

SEQ ID NO: 7441428 - DNA, 22 bp, Homo sapiens
gggcagctggatagttttaaat

SEQ ID NO: 7441429 - DNA, 22 bp, Homo sapiens
gggcagctggccaggtattctg

SEQ ID NO: 7441430 - DNA, 22 bp, Homo sapiens
gggcagctggccaggtattctg

SEQ ID NO: 7441431 - DNA, 22 bp, Homo sapiens
gggcagctggccaggtattctg

SEQ ID NO: 7441432 - DNA, 22 bp, Homo sapiens
gggcagctgcccctctctgggc

SEQ ID NO: 7441433 - DNA, 22 bp, Homo sapiens
gggcagctggatagttttaaat

SEQ ID NO: 7441434 - DNA, 22 bp, Homo sapiens
gggcagctggatagttttaaat

SEQ ID NO: 7441435 - DNA, 22 bp, Homo sapiens
gggcagctgcagggatggtgac

SEQ ID NO: 7441436 - DNA, 22 bp, Homo sapiens
gggcagctgcagggatggtgac

SEQ ID NO: 7441437 - DNA, 22 bp, Homo sapiens
gggcagctgcagggatggtgac

SEQ ID NO: 7441438 - DNA, 22 bp, Homo sapiens
gggcagctgcagggatggtgac

SEQ ID NO: 7441439 - DNA, 22 bp, Homo sapiens
gggcagctgcagggatggtgac

SEQ ID NO: 7441440 - DNA, 22 bp, Homo sapiens
gggcagctgcagggatggtgac

SEQ ID NO: 7441441 - DNA, 21 bp, Homo sapiens
gggcagctctgttttattttc

SEQ ID NO: 7441442 - DNA, 21 bp, Homo sapiens
gggcagctctgttttattttc

SEQ ID NO: 7441443 - DNA, 22 bp, Homo sapiens
gggcagctctggctgtgggaag

SEQ ID NO: 7441444 - DNA, 22 bp, Homo sapiens
gggcagctctggctgtgggaag

SEQ ID NO: 7441445 - DNA, 22 bp, Homo sapiens
gggcagctctttggtatccttc

SEQ ID NO: 7441446 - DNA, 22 bp, Homo sapiens
gggcagctctttggtatccttc

SEQ ID NO: 7441447 - DNA, 22 bp, Homo sapiens
gggcagctctttggtatccttc

SEQ ID NO: 7441448 - DNA, 22 bp, Homo sapiens
gggcagctctgcccatcagagg

SEQ ID NO: 7441449 - DNA, 22 bp, Homo sapiens
gggcagctctggctgtgggaag

SEQ ID NO: 7441450 - DNA, 22 bp, Homo sapiens
gggcagctctggctgtgggaag

SEQ ID NO: 7441451 - DNA, 22 bp, Homo sapiens
gggcagctctgcccatcagagg

SEQ ID NO: 7441452 - DNA, 22 bp, Homo sapiens
gggcagctctgcccatcagagg

SEQ ID NO: 7441453 - DNA, 22 bp, Homo sapiens
gggcagctctgcccatcagagg

SEQ ID NO: 7441454 - DNA, 22 bp, Homo sapiens
gggcagctctcacagcagccaa

SEQ ID NO: 7441455 - DNA, 22 bp, Homo sapiens
gggcagctctggctgtgggaag

SEQ ID NO: 7441456 - DNA, 22 bp, Homo sapiens
gggcagctctggctgtgggaag

SEQ ID NO: 7441457 - DNA, 22 bp, Homo sapiens
gggcagctctggctgtgggaag

SEQ ID NO: 7441458 - DNA, 22 bp, Homo sapiens
gggcagctctggctgtgggaag

SEQ ID NO: 7441459 - DNA, 22 bp, Homo sapiens
gggcacaggagaaggatctggc

SEQ ID NO: 7441460 - DNA, 22 bp, Homo sapiens
gggcacaggagaaggatctggc

SEQ ID NO: 7441461 - DNA, 22 bp, Homo sapiens
gggcacaggagaaggatctggc

SEQ ID NO: 7441462 - DNA, 22 bp, Homo sapiens
gggcacaggagaaggatctggc

SEQ ID NO: 7441463 - DNA, 22 bp, Homo sapiens
gggcacaggagaaggatctggc

SEQ ID NO: 7441464 - DNA, 22 bp, Homo sapiens
gggcacaggagaaggatctggc

SEQ ID NO: 7441465 - DNA, 22 bp, Homo sapiens
gggcacaggaatttgggatgtg

SEQ ID NO: 7441466 - DNA, 22 bp, Homo sapiens
gggcacaggaatttgggatgtg

SEQ ID NO: 7441467 - DNA, 22 bp, Homo sapiens
gggcacagctgctacccagtgc

SEQ ID NO: 7441468 - DNA, 22 bp, Homo sapiens
gggcacaggaatttgggatgtg

SEQ ID NO: 7441469 - DNA, 22 bp, Homo sapiens
gggcacagctgctacccagtgc

SEQ ID NO: 7441470 - DNA, 22 bp, Homo sapiens
gggcacagctgctacccagtgc

SEQ ID NO: 7441471 - DNA, 22 bp, Homo sapiens
gggcacaggaatttgggatgtg

SEQ ID NO: 7441472 - DNA, 22 bp, Homo sapiens
gggcacaggaatttgggatgtg

SEQ ID NO: 7441473 - DNA, 22 bp, Homo sapiens
gggcacaggaatttgggatgtg

SEQ ID NO: 7441474 - DNA, 22 bp, Homo sapiens
gggcacaggaatttgggatgtg

SEQ ID NO: 7441475 - DNA, 22 bp, Homo sapiens
gggcacaggaatttgggatgtg

SEQ ID NO: 7441476 - DNA, 22 bp, Homo sapiens
gggcacaggaatttgggatgtg

SEQ ID NO: 7441477 - DNA, 19 bp, Homo sapiens
gggagctgtctgcccgtgg

SEQ ID NO: 7441478 - DNA, 19 bp, Homo sapiens
gggagctgtctgcccgtgg

SEQ ID NO: 7441479 - DNA, 22 bp, Homo sapiens
gggagctgtgggattggttgag

SEQ ID NO: 7441480 - DNA, 22 bp, Homo sapiens
gggagctgtgggattggttgag

SEQ ID NO: 7441481 - DNA, 22 bp, Homo sapiens
gggagctgtgggattggttgag

SEQ ID NO: 7441482 - DNA, 23 bp, Homo sapiens
gggagctgtggtgaaaagaggtg

SEQ ID NO: 7441483 - DNA, 23 bp, Homo sapiens
gggagctgtggtgaaaagaggtg

SEQ ID NO: 7441484 - DNA, 23 bp, Homo sapiens
gggagctgtggtgaaaagaggtg

SEQ ID NO: 7441485 - DNA, 22 bp, Homo sapiens
gggaggaaagagaagtggtcca

SEQ ID NO: 7441486 - DNA, 22 bp, Homo sapiens
gggaggaaagagaagtggtcca

SEQ ID NO: 7441487 - DNA, 22 bp, Homo sapiens
gggaggaaagagaagtggtcca

SEQ ID NO: 7441488 - DNA, 22 bp, Homo sapiens
gggaggaaatgtgcagcgaatt

SEQ ID NO: 7441489 - DNA, 22 bp, Homo sapiens
gggaggaaagagaagtggtcca

SEQ ID NO: 7441490 - DNA, 22 bp, Homo sapiens
gggaggaaagagaagtggtcca

SEQ ID NO: 7441491 - DNA, 22 bp, Homo sapiens
gggaggaaagagaagtggtcca

SEQ ID NO: 7441492 - DNA, 19 bp, Homo sapiens
gggagctttccatctgtcc

SEQ ID NO: 7441493 - DNA, 22 bp, Homo sapiens
gggagcttctggaaggcaggaa

SEQ ID NO: 7441494 - DNA, 22 bp, Homo sapiens
gggaggaaggcttgggtgagta

SEQ ID NO: 7441495 - DNA, 22 bp, Homo sapiens
gggaggaaggcttgggtgagta

SEQ ID NO: 7441496 - DNA, 22 bp, Homo sapiens
gggaggaatgcaacttatttag

SEQ ID NO: 7441497 - DNA, 22 bp, Homo sapiens
gggaggaaggcttgggtgagta

SEQ ID NO: 7441498 - DNA, 22 bp, Homo sapiens
gggaggaaggcttgggtgagta

SEQ ID NO: 7441499 - DNA, 22 bp, Homo sapiens
gggaggaaggcttgggtgagta

SEQ ID NO: 7441500 - DNA, 22 bp, Homo sapiens
gggaggaaggcttgggtgagta

SEQ ID NO: 7441501 - DNA, 22 bp, Homo sapiens
gggaggaaggcttgggtgagta

SEQ ID NO: 7441502 - DNA, 22 bp, Homo sapiens
gggaggaaggcttgggtgagta

SEQ ID NO: 7441503 - DNA, 21 bp, Homo sapiens
gggaggaagctgcttctctct

SEQ ID NO: 7441504 - DNA, 21 bp, Homo sapiens
gggaggaagctgcttctctct

SEQ ID NO: 7441505 - DNA, 22 bp, Homo sapiens
gggaggaaatgtgcagcgaatt

SEQ ID NO: 7441506 - DNA, 22 bp, Homo sapiens
gggaggaaatgtgcagcgaatt

SEQ ID NO: 7441507 - DNA, 22 bp, Homo sapiens
gggaggaaatgtgcagcgaatt

SEQ ID NO: 7441508 - DNA, 22 bp, Homo sapiens
gggaggaaggcttgggtgagta

SEQ ID NO: 7441509 - DNA, 22 bp, Homo sapiens
gggaggaaggcttgggtgagta

SEQ ID NO: 7441510 - DNA, 21 bp, Homo sapiens
gggaggaagctgcttctctct

SEQ ID NO: 7441511 - DNA, 22 bp, Homo sapiens
gggaggaaatgtgcagcgaatt

SEQ ID NO: 7441512 - DNA, 22 bp, Homo sapiens
gggaggaaatgtgcagcgaatt

SEQ ID NO: 7441513 - DNA, 22 bp, Homo sapiens
gggaggaaatgtgcagcgaatt

SEQ ID NO: 7441514 - DNA, 22 bp, Homo sapiens
gggaggaaatgtgcagcgaatt

SEQ ID NO: 7441515 - DNA, 22 bp, Homo sapiens
gggaggaaatgtgcagcgaatt

SEQ ID NO: 7441516 - DNA, 22 bp, Homo sapiens
gggaggaaatgtgcagcgaatt

SEQ ID NO: 7441517 - DNA, 22 bp, Homo sapiens
gggatggggagctggaaagggg

SEQ ID NO: 7441518 - DNA, 22 bp, Homo sapiens
gggatggggagctggaaagggg

SEQ ID NO: 7441519 - DNA, 22 bp, Homo sapiens
gggatggggagctggaaagggg

SEQ ID NO: 7441520 - DNA, 22 bp, Homo sapiens
gggatggggagctggaaagggg

SEQ ID NO: 7441521 - DNA, 22 bp, Homo sapiens
gggatggggagctggaaagggg

SEQ ID NO: 7441522 - DNA, 22 bp, Homo sapiens
gggatggggagctggaaagggg

SEQ ID NO: 7441523 - DNA, 22 bp, Homo sapiens
gggatggggagctggaaagggg

SEQ ID NO: 7441524 - DNA, 22 bp, Homo sapiens
gggatggggggaagcgtccatg

SEQ ID NO: 7441525 - DNA, 22 bp, Homo sapiens
gggatggggtcaacatgtacct

SEQ ID NO: 7441526 - DNA, 22 bp, Homo sapiens
gggatggggggaagcgtccatg

SEQ ID NO: 7441527 - DNA, 22 bp, Homo sapiens
gggatggggggaagcgtccatg

SEQ ID NO: 7441528 - DNA, 22 bp, Homo sapiens
gggatggggagctggaaagggg

SEQ ID NO: 7441529 - DNA, 22 bp, Homo sapiens
gggatggggggaagcgtccatg

SEQ ID NO: 7441530 - DNA, 22 bp, Homo sapiens
gggatggggggaagcgtccatg

SEQ ID NO: 7441531 - DNA, 22 bp, Homo sapiens
gggatggggggaagcgtccatg

SEQ ID NO: 7441532 - DNA, 22 bp, Homo sapiens
gggatggggggaagcgtccatg

SEQ ID NO: 7441533 - DNA, 22 bp, Homo sapiens
gggatggggggaagcgtccatg

SEQ ID NO: 7441534 - DNA, 22 bp, Homo sapiens
gggaggagctgagtgtgtgtgc

SEQ ID NO: 7441535 - DNA, 22 bp, Homo sapiens
gggaggagctgagtgtgtgtgc

SEQ ID NO: 7441536 - DNA, 22 bp, Homo sapiens
gggaggagcttggagattcact

SEQ ID NO: 7441537 - DNA, 22 bp, Homo sapiens
gggaggagcttggagattcact

SEQ ID NO: 7441538 - DNA, 22 bp, Homo sapiens
gggaggagcttggagattcact

SEQ ID NO: 7441539 - DNA, 22 bp, Homo sapiens
gggaggagcttggagattcact

SEQ ID NO: 7441540 - DNA, 22 bp, Homo sapiens
gggaggagcttggagattcact

SEQ ID NO: 7441541 - DNA, 22 bp, Homo sapiens
gggaggagcttggagattcact

SEQ ID NO: 7441542 - DNA, 22 bp, Homo sapiens
gggatggggagctggaaagggg

SEQ ID NO: 7441543 - DNA, 22 bp, Homo sapiens
gggaggacggtccagggcaaag

SEQ ID NO: 7441544 - DNA, 22 bp, Homo sapiens
gggaggacggtccagggcaaag

SEQ ID NO: 7441545 - DNA, 22 bp, Homo sapiens
gggaggacggtccagggcaaag

SEQ ID NO: 7441546 - DNA, 22 bp, Homo sapiens
gggaggacggtccagggcaaag

SEQ ID NO: 7441547 - DNA, 22 bp, Homo sapiens
gggaggagctgagtgtgtgtgc

SEQ ID NO: 7441548 - DNA, 22 bp, Homo sapiens
gggaggacggtccagggcaaag

SEQ ID NO: 7441549 - DNA, 22 bp, Homo sapiens
gggaggagctgagtgtgtgtgc

SEQ ID NO: 7441550 - DNA, 22 bp, Homo sapiens
gggaggagctgagtgtgtgtgc

SEQ ID NO: 7441551 - DNA, 22 bp, Homo sapiens
gggaggagctgagtgtgtgtgc

SEQ ID NO: 7441552 - DNA, 22 bp, Homo sapiens
gggaggagctgagtgtgtgtgc

SEQ ID NO: 7441553 - DNA, 22 bp, Homo sapiens
gggaggagctgagtgtgtgtgc

SEQ ID NO: 7441554 - DNA, 22 bp, Homo sapiens
gggcaaagtggtggaggcagtt

SEQ ID NO: 7441555 - DNA, 22 bp, Homo sapiens
gggcaaagtggtggaggcagtt

SEQ ID NO: 7441556 - DNA, 22 bp, Homo sapiens
gggcaaagtggtggaggcagtt

SEQ ID NO: 7441557 - DNA, 22 bp, Homo sapiens
gggcaaagtggtggaggcagtt

SEQ ID NO: 7441558 - DNA, 22 bp, Homo sapiens
gggcaacagagcgagggcctgt

SEQ ID NO: 7441559 - DNA, 22 bp, Homo sapiens
gggcaactgaaaaattgtattc

SEQ ID NO: 7441560 - DNA, 22 bp, Homo sapiens
gggcaagaagctggaagcattc

SEQ ID NO: 7441561 - DNA, 22 bp, Homo sapiens
gggcaagaagctggaagcattc

SEQ ID NO: 7441562 - DNA, 22 bp, Homo sapiens
gggcaagcacagcgagcgtgcg

SEQ ID NO: 7441563 - DNA, 22 bp, Homo sapiens
gggcaagaagctggaagcattc

SEQ ID NO: 7441564 - DNA, 22 bp, Homo sapiens
gggcaagcagtgaggacagcac

SEQ ID NO: 7441565 - DNA, 22 bp, Homo sapiens
gggcacagcccagtggggtccc

SEQ ID NO: 7441566 - DNA, 22 bp, Homo sapiens
gggcacagcccagtggggtccc

SEQ ID NO: 7441567 - DNA, 22 bp, Homo sapiens
gggcacagcccagtggggtccc

SEQ ID NO: 7441568 - DNA, 22 bp, Homo sapiens
gggcacagcccagtggggtccc

SEQ ID NO: 7441569 - DNA, 22 bp, Homo sapiens
gggcacagcctaactatggaga

SEQ ID NO: 7441570 - DNA, 22 bp, Homo sapiens
gggcacagcctaactatggaga

SEQ ID NO: 7441571 - DNA, 22 bp, Homo sapiens
gggcacagcctaactatggaga

SEQ ID NO: 7441572 - DNA, 22 bp, Homo sapiens
gggcacagcctaactatggaga

SEQ ID NO: 7441573 - DNA, 22 bp, Homo sapiens
gggcacagcctaactatggaga

SEQ ID NO: 7441574 - DNA, 22 bp, Homo sapiens
gggcacagcctaactatggaga

SEQ ID NO: 7441575 - DNA, 22 bp, Homo sapiens
gggcacagcctaactatggaga

SEQ ID NO: 7441576 - DNA, 22 bp, Homo sapiens
gggcacagcccagtggggtccc

SEQ ID NO: 7441577 - DNA, 22 bp, Homo sapiens
gggcacagcccagtggggtccc

SEQ ID NO: 7441578 - DNA, 22 bp, Homo sapiens
gggcacagcccagtggggtccc

SEQ ID NO: 7441579 - DNA, 22 bp, Homo sapiens
gggcacagcccagtggggtccc

SEQ ID NO: 7441580 - DNA, 22 bp, Homo sapiens
gggcacagcctaactatggaga

SEQ ID NO: 7441581 - DNA, 22 bp, Homo sapiens
gggcacagcctaactatggaga

SEQ ID NO: 7441582 - DNA, 19 bp, Homo sapiens
gggcacagcctccccccag

SEQ ID NO: 7441583 - DNA, 19 bp, Homo sapiens
gggcacagcctccccccag

SEQ ID NO: 7441584 - DNA, 22 bp, Homo sapiens
gggcacagctgctacccagtgc

SEQ ID NO: 7441585 - DNA, 22 bp, Homo sapiens
gggcacagctgctacccagtgc

SEQ ID NO: 7441586 - DNA, 22 bp, Homo sapiens
gggcacagctgctacccagtgc

SEQ ID NO: 7441587 - DNA, 19 bp, Homo sapiens
gggcacagcctccccccag

SEQ ID NO: 7441588 - DNA, 22 bp, Homo sapiens
gggcacagctgctacccagtgc

SEQ ID NO: 7441589 - DNA, 22 bp, Homo sapiens
gggcacagctgctacccagtgc

SEQ ID NO: 7441590 - DNA, 22 bp, Homo sapiens
gggatttgtgggatggccagtg

SEQ ID NO: 7441591 - DNA, 22 bp, Homo sapiens
gggatttgtgggatggccagtg

SEQ ID NO: 7441592 - DNA, 22 bp, Homo sapiens
gggatttgtgggatggccagtg

SEQ ID NO: 7441593 - DNA, 22 bp, Homo sapiens
gggcaaaacctgggcatcatga

SEQ ID NO: 7441594 - DNA, 22 bp, Homo sapiens
gggcaaaatacttataaaggct

SEQ ID NO: 7441595 - DNA, 22 bp, Homo sapiens
gggcaaaggcagaaagcggtgt

SEQ ID NO: 7441596 - DNA, 22 bp, Homo sapiens
gggatttagtaggatagtatac

SEQ ID NO: 7441597 - DNA, 22 bp, Homo sapiens
gggatttcaccatgttggttgg

SEQ ID NO: 7441598 - DNA, 22 bp, Homo sapiens
gggatttcaccatgttggttgg

SEQ ID NO: 7441599 - DNA, 22 bp, Homo sapiens
gggatttgaatcttgagttgag

SEQ ID NO: 7441600 - DNA, 22 bp, Homo sapiens
gggattacagatgtgagccatt

SEQ ID NO: 7441601 - DNA, 22 bp, Homo sapiens
gggattctgttgggttagtgtc

SEQ ID NO: 7441602 - DNA, 22 bp, Homo sapiens
gggatgtcgtgggtggcagctg

SEQ ID NO: 7441603 - DNA, 22 bp, Homo sapiens
gggatggggtcgggaccctgct

SEQ ID NO: 7441604 - DNA, 22 bp, Homo sapiens
gggatggggtcgggaccctgct

SEQ ID NO: 7441605 - DNA, 22 bp, Homo sapiens
gggatggggtcgggaccctgct

SEQ ID NO: 7441606 - DNA, 22 bp, Homo sapiens
gggatggggtcgggaccctgct

SEQ ID NO: 7441607 - DNA, 22 bp, Homo sapiens
gggatggggtcgggaccctgct

SEQ ID NO: 7441608 - DNA, 22 bp, Homo sapiens
gggatggggtcgggaccctgct

SEQ ID NO: 7441609 - DNA, 22 bp, Homo sapiens
gggatggtggcttgcatctgta

SEQ ID NO: 7441610 - DNA, 22 bp, Homo sapiens
gggatggggtcgggaccctgct

SEQ ID NO: 7441611 - DNA, 22 bp, Homo sapiens
gggatggggtcgggaccctgct

SEQ ID NO: 7441612 - DNA, 22 bp, Homo sapiens
gggatggggtcgggaccctgct

SEQ ID NO: 7441613 - DNA, 22 bp, Homo sapiens
gggatggggtcgggaccctgct

SEQ ID NO: 7441614 - DNA, 22 bp, Homo sapiens
gggatggggtcgggaccctgct

SEQ ID NO: 7441615 - DNA, 22 bp, Homo sapiens
gggatggggtcgggaccctgct

SEQ ID NO: 7441616 - DNA, 22 bp, Homo sapiens
gggatggggtcgggaccctgct

SEQ ID NO: 7441617 - DNA, 22 bp, Homo sapiens
gggatggggtcaacatgtacct

SEQ ID NO: 7441618 - DNA, 22 bp, Homo sapiens
gggatggggtcaacatgtacct

SEQ ID NO: 7441619 - DNA, 22 bp, Homo sapiens
gggatggggtcaacatgtacct

SEQ ID NO: 7441620 - DNA, 22 bp, Homo sapiens
gggatggggtcaacatgtacct

SEQ ID NO: 7441621 - DNA, 22 bp, Homo sapiens
gggatggggtcgggaccctgct

SEQ ID NO: 7441622 - DNA, 22 bp, Homo sapiens
gggatggggtcaacatgtacct

SEQ ID NO: 7441623 - DNA, 22 bp, Homo sapiens
gggatggggtcaacatgtacct

SEQ ID NO: 7441624 - DNA, 22 bp, Homo sapiens
ggctctttaacttgtctaaatt

SEQ ID NO: 7441625 - DNA, 22 bp, Homo sapiens
ggctctttaacttgtctaaatt

SEQ ID NO: 7441626 - DNA, 22 bp, Homo sapiens
ggctctttggcgggccttgaac

SEQ ID NO: 7441627 - DNA, 22 bp, Homo sapiens
ggctctttaacttgtctaaatt

SEQ ID NO: 7441628 - DNA, 22 bp, Homo sapiens
ggctctttggcgggccttgaac

SEQ ID NO: 7441629 - DNA, 22 bp, Homo sapiens
ggctctttggcgggccttgaac

SEQ ID NO: 7441630 - DNA, 22 bp, Homo sapiens
ggctgaaacagatttcaagaca

SEQ ID NO: 7441631 - DNA, 22 bp, Homo sapiens
ggctgaaaccgttatccactga

SEQ ID NO: 7441632 - DNA, 22 bp, Homo sapiens
ggctgaaagcgcgacttgcccc

SEQ ID NO: 7441633 - DNA, 22 bp, Homo sapiens
ggctgaaagcgcgacttgcccc

SEQ ID NO: 7441634 - DNA, 22 bp, Homo sapiens
ggctgaaaggtagtagtaggct

SEQ ID NO: 7441635 - DNA, 22 bp, Homo sapiens
ggctgaaaggtgggaggatggc

SEQ ID NO: 7441636 - DNA, 22 bp, Homo sapiens
ggctgaaggatgaaagctgcag

SEQ ID NO: 7441637 - DNA, 22 bp, Homo sapiens
ggctgaaggatgaaagctgcag

SEQ ID NO: 7441638 - DNA, 22 bp, Homo sapiens
ggctgaaggatgaaagctgcag

SEQ ID NO: 7441639 - DNA, 22 bp, Homo sapiens
ggctgaagaactgggagtctca

SEQ ID NO: 7441640 - DNA, 22 bp, Homo sapiens
ggctgaaattggatccttgggc

SEQ ID NO: 7441641 - DNA, 22 bp, Homo sapiens
ggctgaagaactgggagtctca

SEQ ID NO: 7441642 - DNA, 20 bp, Homo sapiens
ggctgaaagtagaaagtatt

SEQ ID NO: 7441643 - DNA, 22 bp, Homo sapiens
ggctgaaattcagagtaaattc

SEQ ID NO: 7441644 - DNA, 22 bp, Homo sapiens
ggctcttctggttgtcacattt

SEQ ID NO: 7441645 - DNA, 22 bp, Homo sapiens
ggctcttctgtggcagccaagg

SEQ ID NO: 7441646 - DNA, 22 bp, Homo sapiens
ggctcttctgtggcagccaagg

SEQ ID NO: 7441647 - DNA, 22 bp, Homo sapiens
ggctctgggccagagttggctt

SEQ ID NO: 7441648 - DNA, 22 bp, Homo sapiens
ggctctgggccagagttggctt

SEQ ID NO: 7441649 - DNA, 22 bp, Homo sapiens
ggctcttctacttcagatgggg

SEQ ID NO: 7441650 - DNA, 22 bp, Homo sapiens
ggctctgggccagagttggctt

SEQ ID NO: 7441651 - DNA, 22 bp, Homo sapiens
ggctctgggccagagttggctt

SEQ ID NO: 7441652 - DNA, 22 bp, Homo sapiens
ggctcttgggagctcagagttg

SEQ ID NO: 7441653 - DNA, 22 bp, Homo sapiens
ggctcttgcccgcccaggctgg

SEQ ID NO: 7441654 - DNA, 22 bp, Homo sapiens
ggctcttgttcgtaccatggct

SEQ ID NO: 7441655 - DNA, 22 bp, Homo sapiens
ggctcttctgtttcacaggcca

SEQ ID NO: 7441656 - DNA, 22 bp, Homo sapiens
ggctcttctgtttcacaggcca

SEQ ID NO: 7441657 - DNA, 22 bp, Homo sapiens
ggctcttctgtttcacaggcca

SEQ ID NO: 7441658 - DNA, 22 bp, Homo sapiens
ggctcttgaaatgtggctggcg

SEQ ID NO: 7441659 - DNA, 22 bp, Homo sapiens
ggctcttgagaggcacaggttt

SEQ ID NO: 7441660 - DNA, 22 bp, Homo sapiens
ggctgaagtgtagtggctcact

SEQ ID NO: 7441661 - DNA, 22 bp, Homo sapiens
ggctgaagtgtagtggctcact

SEQ ID NO: 7441662 - DNA, 22 bp, Homo sapiens
ggctgaagtgtagtggctcact

SEQ ID NO: 7441663 - DNA, 22 bp, Homo sapiens
ggctgaaggatgaaagctgcag

SEQ ID NO: 7441664 - DNA, 22 bp, Homo sapiens
ggctgaagtgtagtggctcact

SEQ ID NO: 7441665 - DNA, 22 bp, Homo sapiens
ggctgaagtgtagtggctcact

SEQ ID NO: 7441666 - DNA, 22 bp, Homo sapiens
ggctgaagtgtagtggctcact

SEQ ID NO: 7441667 - DNA, 22 bp, Homo sapiens
ggctgacttttatgcacactaa

SEQ ID NO: 7441668 - DNA, 22 bp, Homo sapiens
ggctgagaacaggcccagcctc

SEQ ID NO: 7441669 - DNA, 22 bp, Homo sapiens
ggctgagaaggagtgggtgagg

SEQ ID NO: 7441670 - DNA, 22 bp, Homo sapiens
ggctgagaaggagtgggtgagg

SEQ ID NO: 7441671 - DNA, 22 bp, Homo sapiens
ggctgagaagacagtggggtgg

SEQ ID NO: 7441672 - DNA, 22 bp, Homo sapiens
ggctgagaacaggcccagcctc

SEQ ID NO: 7441673 - DNA, 22 bp, Homo sapiens
ggctgagaagacagtggggtgg

SEQ ID NO: 7441674 - DNA, 22 bp, Homo sapiens
ggctgagaagacagtggggtgg

SEQ ID NO: 7441675 - DNA, 22 bp, Homo sapiens
ggctgagaaggagtgggtgagg

SEQ ID NO: 7441676 - DNA, 22 bp, Homo sapiens
ggctgagaaggagtgggtgagg

SEQ ID NO: 7441677 - DNA, 22 bp, Homo sapiens
ggctgagaaggagtgggtgagg

SEQ ID NO: 7441678 - DNA, 23 bp, Homo sapiens
ggctgagaagtcccatgataggt

SEQ ID NO: 7441679 - DNA, 22 bp, Homo sapiens
ggctgagacaacctgggaccca

SEQ ID NO: 7441680 - DNA, 22 bp, Homo sapiens
ggctgagacaacctgggaccca

SEQ ID NO: 7441681 - DNA, 22 bp, Homo sapiens
ggctgagaatcaacaacctgct

SEQ ID NO: 7441682 - DNA, 23 bp, Homo sapiens
ggctgagactacaggcgcttgcc

SEQ ID NO: 7441683 - DNA, 23 bp, Homo sapiens
ggctgagactacaggcgcttgcc

SEQ ID NO: 7441684 - DNA, 22 bp, Homo sapiens
ggctgagactagagtgaggcat

SEQ ID NO: 7441685 - DNA, 22 bp, Homo sapiens
ggctgagactagagtgaggcat

SEQ ID NO: 7441686 - DNA, 22 bp, Homo sapiens
ggctgagactagagtgaggcat

SEQ ID NO: 7441687 - DNA, 22 bp, Homo sapiens
ggctgagactagagtgaggcat

SEQ ID NO: 7441688 - DNA, 22 bp, Homo sapiens
ggctgagactagagtgaggcat

SEQ ID NO: 7441689 - DNA, 22 bp, Homo sapiens
ggctgagactagagtgaggcat

SEQ ID NO: 7441690 - DNA, 22 bp, Homo sapiens
ggctctggagacatgtggagag

SEQ ID NO: 7441691 - DNA, 22 bp, Homo sapiens
ggctctggagacatgtggagag

SEQ ID NO: 7441692 - DNA, 22 bp, Homo sapiens
ggctctggagacatgtggagag

SEQ ID NO: 7441693 - DNA, 22 bp, Homo sapiens
ggctctggagacatgtggagag

SEQ ID NO: 7441694 - DNA, 22 bp, Homo sapiens
ggctctggagacatgtggagag

SEQ ID NO: 7441695 - DNA, 22 bp, Homo sapiens
ggctctggagatgtccgacctg

SEQ ID NO: 7441696 - DNA, 22 bp, Homo sapiens
ggctctggagatgtccgacctg

SEQ ID NO: 7441697 - DNA, 22 bp, Homo sapiens
ggctctggagatgtccgacctg

SEQ ID NO: 7441698 - DNA, 22 bp, Homo sapiens
ggctctggagatgtccgacctg

SEQ ID NO: 7441699 - DNA, 22 bp, Homo sapiens
ggctctggagcacagacgtctg

SEQ ID NO: 7441700 - DNA, 22 bp, Homo sapiens
ggctctggagatgtccgacctg

SEQ ID NO: 7441701 - DNA, 22 bp, Homo sapiens
ggctctggagatgtccgacctg

SEQ ID NO: 7441702 - DNA, 22 bp, Homo sapiens
ggctctggagatgtccgacctg

SEQ ID NO: 7441703 - DNA, 22 bp, Homo sapiens
ggctctggagcacagacgtctg

SEQ ID NO: 7441704 - DNA, 22 bp, Homo sapiens
ggctctggagcacagacgtctg

SEQ ID NO: 7441705 - DNA, 22 bp, Homo sapiens
ggctctggagcacagacgtctg

SEQ ID NO: 7441706 - DNA, 22 bp, Homo sapiens
ggctctggcaaggggaggctac

SEQ ID NO: 7441707 - DNA, 22 bp, Homo sapiens
ggctctggcaaggggaggctac

SEQ ID NO: 7441708 - DNA, 22 bp, Homo sapiens
ggctctggcaaggggaggctac

SEQ ID NO: 7441709 - DNA, 22 bp, Homo sapiens
ggctctggcgagctttagtaca

SEQ ID NO: 7441710 - DNA, 22 bp, Homo sapiens
ggctctggcaaggggaggctac

SEQ ID NO: 7441711 - DNA, 22 bp, Homo sapiens
ggctctggcgagctttagtaca

SEQ ID NO: 7441712 - DNA, 22 bp, Homo sapiens
ggctctggcggctctttcaata

SEQ ID NO: 7441713 - DNA, 22 bp, Homo sapiens
ggctctggcggctctttcaata

SEQ ID NO: 7441714 - DNA, 22 bp, Homo sapiens
ggctctggcggctctttcaata

SEQ ID NO: 7441715 - DNA, 22 bp, Homo sapiens
ggctctggcgagctttagtaca

SEQ ID NO: 7441716 - DNA, 22 bp, Homo sapiens
ggctctggcaaggggaggctac

SEQ ID NO: 7441717 - DNA, 22 bp, Homo sapiens
ggctctggcaaggggaggctac

SEQ ID NO: 7441718 - DNA, 22 bp, Homo sapiens
ggctctggcaaggggaggctac

SEQ ID NO: 7441719 - DNA, 22 bp, Homo sapiens
ggctctggcaaggggaggctac

SEQ ID NO: 7441720 - DNA, 22 bp, Homo sapiens
ggctctggcaaggggaggctac

SEQ ID NO: 7441721 - DNA, 22 bp, Homo sapiens
ggctctggagcacagacgtctg

SEQ ID NO: 7441722 - DNA, 22 bp, Homo sapiens
ggctctggagcacagacgtctg

SEQ ID NO: 7441723 - DNA, 22 bp, Homo sapiens
ggctctggagcacagacgtctg

SEQ ID NO: 7441724 - DNA, 22 bp, Homo sapiens
ggctctggagcacagacgtctg

SEQ ID NO: 7441725 - DNA, 22 bp, Homo sapiens
ggctctgggcatagaaggaagc

SEQ ID NO: 7441726 - DNA, 22 bp, Homo sapiens
ggctctgggcatagaaggaagc

SEQ ID NO: 7441727 - DNA, 22 bp, Homo sapiens
ggctctgggccagagttggctt

SEQ ID NO: 7441728 - DNA, 22 bp, Homo sapiens
ggctctgggcatagaaggaagc

SEQ ID NO: 7441729 - DNA, 22 bp, Homo sapiens
ggctctgggccagagttggctt

SEQ ID NO: 7441730 - DNA, 22 bp, Homo sapiens
ggctctgggcatagaaggaagc

SEQ ID NO: 7441731 - DNA, 22 bp, Homo sapiens
ggctctgggaaatggtcttcct

SEQ ID NO: 7441732 - DNA, 22 bp, Homo sapiens
ggctctgggaaatggtcttcct

SEQ ID NO: 7441733 - DNA, 22 bp, Homo sapiens
ggctctggctactccaccctgt

SEQ ID NO: 7441734 - DNA, 22 bp, Homo sapiens
ggctctggctactccaccctgt

SEQ ID NO: 7441735 - DNA, 22 bp, Homo sapiens
ggctctggctcctggctttgtg

SEQ ID NO: 7441736 - DNA, 22 bp, Homo sapiens
ggctctggctcctggctttgtg

SEQ ID NO: 7441737 - DNA, 22 bp, Homo sapiens
ggctctggctcctggctttgtg

SEQ ID NO: 7441738 - DNA, 22 bp, Homo sapiens
ggctctggctcctggctttgtg

SEQ ID NO: 7441739 - DNA, 22 bp, Homo sapiens
ggctctgggaaatggtcttcct

SEQ ID NO: 7441740 - DNA, 19 bp, Homo sapiens
ggctctggcggctgtagcc

SEQ ID NO: 7441741 - DNA, 19 bp, Homo sapiens
ggctctggcggctgtagcc

SEQ ID NO: 7441742 - DNA, 19 bp, Homo sapiens
ggctctggcggctgtagcc

SEQ ID NO: 7441743 - DNA, 19 bp, Homo sapiens
ggctctggcggctgtagcc

SEQ ID NO: 7441744 - DNA, 19 bp, Homo sapiens
ggctctggcggctgtagcc

SEQ ID NO: 7441745 - DNA, 19 bp, Homo sapiens
ggctctggcggctgtagcc

SEQ ID NO: 7441746 - DNA, 22 bp, Homo sapiens
ggctctggcggctctttcaata

SEQ ID NO: 7441747 - DNA, 19 bp, Homo sapiens
ggctctggcggctgtagcc

SEQ ID NO: 7441748 - DNA, 19 bp, Homo sapiens
ggctctggcggctgtagcc

SEQ ID NO: 7441749 - DNA, 19 bp, Homo sapiens
ggctctggcggctgtagcc

SEQ ID NO: 7441750 - DNA, 19 bp, Homo sapiens
ggctctggcggctgtagcc

SEQ ID NO: 7441751 - DNA, 22 bp, Homo sapiens
ggctctggcgtccaatggagcg

SEQ ID NO: 7441752 - DNA, 22 bp, Homo sapiens
ggctctggcgtccaatggagcg

SEQ ID NO: 7441753 - DNA, 22 bp, Homo sapiens
ggctctggctactccaccctgt

SEQ ID NO: 7441754 - DNA, 22 bp, Homo sapiens
ggctctggctactccaccctgt

SEQ ID NO: 7441755 - DNA, 22 bp, Homo sapiens
ggctctggcgtccaatggagcg

SEQ ID NO: 7441756 - DNA, 22 bp, Homo sapiens
ggctctggcgtccaatggagcg

SEQ ID NO: 7441757 - DNA, 22 bp, Homo sapiens
ggctctggcgtccaatggagcg

SEQ ID NO: 7441758 - DNA, 22 bp, Homo sapiens
ggctccagatgtcccctggcaa

SEQ ID NO: 7441759 - DNA, 22 bp, Homo sapiens
ggctccagatgtcccctggcaa

SEQ ID NO: 7441760 - DNA, 22 bp, Homo sapiens
ggctccagatgtcccctggcaa

SEQ ID NO: 7441761 - DNA, 22 bp, Homo sapiens
ggctccagatgtcccctggcaa

SEQ ID NO: 7441762 - DNA, 22 bp, Homo sapiens
ggctccagatgtcccctggcaa

SEQ ID NO: 7441763 - DNA, 22 bp, Homo sapiens
ggctccagatgtctcctggcaa

SEQ ID NO: 7441764 - DNA, 22 bp, Homo sapiens
ggctccagatgtctcctggcaa

SEQ ID NO: 7441765 - DNA, 22 bp, Homo sapiens
ggctccagatgtctcctggcaa

SEQ ID NO: 7441766 - DNA, 22 bp, Homo sapiens
ggctccagatgtctcctggcaa

SEQ ID NO: 7441767 - DNA, 22 bp, Homo sapiens
ggctccagaggccttacctgca

SEQ ID NO: 7441768 - DNA, 22 bp, Homo sapiens
ggctccagaggccttacctgca

SEQ ID NO: 7441769 - DNA, 22 bp, Homo sapiens
ggctccagatgtcccctggcaa

SEQ ID NO: 7441770 - DNA, 22 bp, Homo sapiens
ggctccagatgtcccctggcaa

SEQ ID NO: 7441771 - DNA, 22 bp, Homo sapiens
ggctccagatgtcccctggcaa

SEQ ID NO: 7441772 - DNA, 22 bp, Homo sapiens
ggctccagatgtcccctggcaa

SEQ ID NO: 7441773 - DNA, 22 bp, Homo sapiens
ggctccagaggccttacctgca

SEQ ID NO: 7441774 - DNA, 22 bp, Homo sapiens
ggctccagaggccttacctgca

SEQ ID NO: 7441775 - DNA, 16 bp, Homo sapiens
ggctccagaatagcga

SEQ ID NO: 7441776 - DNA, 22 bp, Homo sapiens
ggctccagaggccttacctgca

SEQ ID NO: 7441777 - DNA, 22 bp, Homo sapiens
ggctccagaaatcatagagcag

SEQ ID NO: 7441778 - DNA, 22 bp, Homo sapiens
ggctccagaaatcatagagcag

SEQ ID NO: 7441779 - DNA, 22 bp, Homo sapiens
ggctccagaaacttcagtccat

SEQ ID NO: 7441780 - DNA, 22 bp, Homo sapiens
ggctccagaaacttcagtccat

SEQ ID NO: 7441781 - DNA, 22 bp, Homo sapiens
ggctccagaaacttcagtccat

SEQ ID NO: 7441782 - DNA, 22 bp, Homo sapiens
ggctccagaaatcatagagcag

SEQ ID NO: 7441783 - DNA, 22 bp, Homo sapiens
ggctccagaaatcatagagcag

SEQ ID NO: 7441784 - DNA, 22 bp, Homo sapiens
ggctccagaaatcatagagcag

SEQ ID NO: 7441785 - DNA, 22 bp, Homo sapiens
ggctccagaaatcatagagcag

SEQ ID NO: 7441786 - DNA, 16 bp, Homo sapiens
ggctccagaatagcga

SEQ ID NO: 7441787 - DNA, 16 bp, Homo sapiens
ggctccagaatagcga

SEQ ID NO: 7441788 - DNA, 22 bp, Homo sapiens
ggctccagaaacttcagtccat

SEQ ID NO: 7441789 - DNA, 22 bp, Homo sapiens
ggctccagaaacttcagtccat

SEQ ID NO: 7441790 - DNA, 22 bp, Homo sapiens
ggctccagaaacttcagtccat

SEQ ID NO: 7441791 - DNA, 22 bp, Homo sapiens
ggctccagaaacttcagtccat

SEQ ID NO: 7441792 - DNA, 22 bp, Homo sapiens
ggctccagaaacttcagtccat

SEQ ID NO: 7441793 - DNA, 22 bp, Homo sapiens
ggctccagaaacttcagtccat

SEQ ID NO: 7441794 - DNA, 22 bp, Homo sapiens
ggctccaccctgcttccagaag

SEQ ID NO: 7441795 - DNA, 22 bp, Homo sapiens
ggctccaccctgcttccagaag

SEQ ID NO: 7441796 - DNA, 22 bp, Homo sapiens
ggcgggagatggggccgttcag

SEQ ID NO: 7441797 - DNA, 22 bp, Homo sapiens
ggcgggagatggggccgttcag

SEQ ID NO: 7441798 - DNA, 22 bp, Homo sapiens
ggcgggagcagcagctctgagc

SEQ ID NO: 7441799 - DNA, 22 bp, Homo sapiens
ggcgggagcagcagctctgagc

SEQ ID NO: 7441800 - DNA, 22 bp, Homo sapiens
ggcgggaagttcttgcccactt

SEQ ID NO: 7441801 - DNA, 22 bp, Homo sapiens
ggcgggaagttcttgcccactt

SEQ ID NO: 7441802 - DNA, 22 bp, Homo sapiens
ggcggcgcgtagccggagactt

SEQ ID NO: 7441803 - DNA, 22 bp, Homo sapiens
ggcggcgcgtagccggagactt

SEQ ID NO: 7441804 - DNA, 22 bp, Homo sapiens
ggcggctactcctcctggtgag

SEQ ID NO: 7441805 - DNA, 22 bp, Homo sapiens
ggcggctactcctcctggtgag

SEQ ID NO: 7441806 - DNA, 21 bp, Homo sapiens
ggcggcgcagagctgcggctc

SEQ ID NO: 7441807 - DNA, 22 bp, Homo sapiens
ggcggcgcctgctgcgtgacct

SEQ ID NO: 7441808 - DNA, 22 bp, Homo sapiens
ggcggcctgtgggtcggcctca

SEQ ID NO: 7441809 - DNA, 22 bp, Homo sapiens
ggcggaggttgcagtaagccga

SEQ ID NO: 7441810 - DNA, 22 bp, Homo sapiens
ggcggccctgcacgtgctgagg

SEQ ID NO: 7441811 - DNA, 22 bp, Homo sapiens
ggcggaggttgcagtaagccga

SEQ ID NO: 7441812 - DNA, 22 bp, Homo sapiens
ggcggaggttgcagtaagccga

SEQ ID NO: 7441813 - DNA, 22 bp, Homo sapiens
ggcggaggttgcagtaagccga

SEQ ID NO: 7441814 - DNA, 22 bp, Homo sapiens
ggcgggggtccaggagcctgca

SEQ ID NO: 7441815 - DNA, 22 bp, Homo sapiens
ggcgggggtccaggagcctgca

SEQ ID NO: 7441816 - DNA, 22 bp, Homo sapiens
ggcggggcctcgcgaacggcct

SEQ ID NO: 7441817 - DNA, 22 bp, Homo sapiens
ggcgggggtccaggagcctgca

SEQ ID NO: 7441818 - DNA, 22 bp, Homo sapiens
ggcgggcagatgcggacacgcg

SEQ ID NO: 7441819 - DNA, 22 bp, Homo sapiens
ggcgggcagcgtcttgctggcc

SEQ ID NO: 7441820 - DNA, 23 bp, Homo sapiens
ggcggggataacagccccttgtc

SEQ ID NO: 7441821 - DNA, 22 bp, Homo sapiens
ggcggggcctcgcgaacggcct

SEQ ID NO: 7441822 - DNA, 22 bp, Homo sapiens
ggcggggcctcgcgaacggcct

SEQ ID NO: 7441823 - DNA, 22 bp, Homo sapiens
ggcggggcctcgcgaacggcct

SEQ ID NO: 7441824 - DNA, 22 bp, Homo sapiens
ggcgggcagatgcggacacgcg

SEQ ID NO: 7441825 - DNA, 22 bp, Homo sapiens
ggcgggcagatgcggacacgcg

SEQ ID NO: 7441826 - DNA, 22 bp, Homo sapiens
ggcgggaggctgaggagttggt

SEQ ID NO: 7441827 - DNA, 22 bp, Homo sapiens
ggcgggaggctgaggagttggt

SEQ ID NO: 7441828 - DNA, 22 bp, Homo sapiens
ggcgggaggctgaggagttggt

SEQ ID NO: 7441829 - DNA, 22 bp, Homo sapiens
ggcgggaggctgaggagttggt

SEQ ID NO: 7441830 - DNA, 22 bp, Homo sapiens
ggcgggaggctgaggagttggt

SEQ ID NO: 7441831 - DNA, 22 bp, Homo sapiens
ggcgggagcagcagctctgagc

SEQ ID NO: 7441832 - DNA, 22 bp, Homo sapiens
ggcgggaggctgaggagttggt

SEQ ID NO: 7441833 - DNA, 22 bp, Homo sapiens
ggcgggagcagcagctctgagc

SEQ ID NO: 7441834 - DNA, 22 bp, Homo sapiens
ggctccaggagatgctgggcag

SEQ ID NO: 7441835 - DNA, 22 bp, Homo sapiens
ggctccaggagggccttggcca

SEQ ID NO: 7441836 - DNA, 22 bp, Homo sapiens
ggctccaggagggccttggcca

SEQ ID NO: 7441837 - DNA, 22 bp, Homo sapiens
ggctccaggagggccttggcca

SEQ ID NO: 7441838 - DNA, 22 bp, Homo sapiens
ggctccaggagggccttggcca

SEQ ID NO: 7441839 - DNA, 22 bp, Homo sapiens
ggctccaggagatgctgggcag

SEQ ID NO: 7441840 - DNA, 22 bp, Homo sapiens
ggctccaggagatgctgggcag

SEQ ID NO: 7441841 - DNA, 22 bp, Homo sapiens
ggctccaggagatgctgggcag

SEQ ID NO: 7441842 - DNA, 22 bp, Homo sapiens
ggctccaggagatgctgggcag

SEQ ID NO: 7441843 - DNA, 22 bp, Homo sapiens
ggctccaggagggccttggcca

SEQ ID NO: 7441844 - DNA, 22 bp, Homo sapiens
ggctccaggagggccttggcca

SEQ ID NO: 7441845 - DNA, 22 bp, Homo sapiens
ggctccaggagggccttggcca

SEQ ID NO: 7441846 - DNA, 23 bp, Homo sapiens
ggctccaggcctgacgggcgcgg

SEQ ID NO: 7441847 - DNA, 23 bp, Homo sapiens
ggctccaggcctgacgggcgcgg

SEQ ID NO: 7441848 - DNA, 23 bp, Homo sapiens
ggctccaggcctgacgggcgcgg

SEQ ID NO: 7441849 - DNA, 23 bp, Homo sapiens
ggctccaggcctgacgggcgcgg

SEQ ID NO: 7441850 - DNA, 22 bp, Homo sapiens
ggctccaggagggccttggcca

SEQ ID NO: 7441851 - DNA, 22 bp, Homo sapiens
ggctctgctgcaagtcttcctc

SEQ ID NO: 7441852 - DNA, 22 bp, Homo sapiens
ggctctgctcctggtgccagtg

SEQ ID NO: 7441853 - DNA, 22 bp, Homo sapiens
ggctctgctcctggtgccagtg

SEQ ID NO: 7441854 - DNA, 22 bp, Homo sapiens
ggctctgctgcaagtcttcctc

SEQ ID NO: 7441855 - DNA, 22 bp, Homo sapiens
ggctctgctgcaagtcttcctc

SEQ ID NO: 7441856 - DNA, 22 bp, Homo sapiens
ggctctgctgcaagtcttcctc

SEQ ID NO: 7441857 - DNA, 22 bp, Homo sapiens
ggctctgctcctggtgccagtg

SEQ ID NO: 7441858 - DNA, 22 bp, Homo sapiens
ggctctgctgcaagtcttcctc

SEQ ID NO: 7441859 - DNA, 22 bp, Homo sapiens
ggctctgctcctggtgccagtg

SEQ ID NO: 7441860 - DNA, 22 bp, Homo sapiens
ggctctgctcctggtgccagtg

SEQ ID NO: 7441861 - DNA, 22 bp, Homo sapiens
ggctctgctcctggtgccagtg

SEQ ID NO: 7441862 - DNA, 22 bp, Homo sapiens
ggctctgctcctggtgccagtg

SEQ ID NO: 7441863 - DNA, 22 bp, Homo sapiens
ggctctgctcacagcccgcagc

SEQ ID NO: 7441864 - DNA, 22 bp, Homo sapiens
ggctctgctcacagcccgcagc

SEQ ID NO: 7441865 - DNA, 22 bp, Homo sapiens
ggctctgctcacagcccgcagc

SEQ ID NO: 7441866 - DNA, 22 bp, Homo sapiens
ggctctgctgcacccttggctc

SEQ ID NO: 7441867 - DNA, 22 bp, Homo sapiens
ggctctgctgcacccttggctc

SEQ ID NO: 7441868 - DNA, 22 bp, Homo sapiens
ggctctgctgcacccttggctc

SEQ ID NO: 7441869 - DNA, 22 bp, Homo sapiens
ggctctgctgcacccttggctc

SEQ ID NO: 7441870 - DNA, 22 bp, Homo sapiens
ggctctggaatgtgtagtcagg

SEQ ID NO: 7441871 - DNA, 22 bp, Homo sapiens
ggctctggagacatgtggagag

SEQ ID NO: 7441872 - DNA, 22 bp, Homo sapiens
ggctctggagacatgtggagag

SEQ ID NO: 7441873 - DNA, 22 bp, Homo sapiens
ggctctggagacatgtggagag

SEQ ID NO: 7441874 - DNA, 22 bp, Homo sapiens
ggctctggagacatgtggagag

SEQ ID NO: 7441875 - DNA, 22 bp, Homo sapiens
ggctctggagacatgtggagag

SEQ ID NO: 7441876 - DNA, 22 bp, Homo sapiens
ggctctggaatgtgtagtcagg

SEQ ID NO: 7441877 - DNA, 22 bp, Homo sapiens
ggctctggaatgtgtagtcagg

SEQ ID NO: 7441878 - DNA, 18 bp, Homo sapiens
ggctccaggacctaccca

SEQ ID NO: 7441879 - DNA, 18 bp, Homo sapiens
ggctccaggacctaccca

SEQ ID NO: 7441880 - DNA, 18 bp, Homo sapiens
ggctccaggacctaccca

SEQ ID NO: 7441881 - DNA, 18 bp, Homo sapiens
ggctccaggacctaccca

SEQ ID NO: 7441882 - DNA, 22 bp, Homo sapiens
ggctccaggaacctcctctcct

SEQ ID NO: 7441883 - DNA, 22 bp, Homo sapiens
ggctccaggagatgctgggcag

SEQ ID NO: 7441884 - DNA, 22 bp, Homo sapiens
ggctccaggagatgctgggcag

SEQ ID NO: 7441885 - DNA, 22 bp, Homo sapiens
ggctccaggagatgctgggcag

SEQ ID NO: 7441886 - DNA, 18 bp, Homo sapiens
ggctccaggacctaccca

SEQ ID NO: 7441887 - DNA, 22 bp, Homo sapiens
ggctccaggagatgctgggcag

SEQ ID NO: 7441888 - DNA, 22 bp, Homo sapiens
ggctccaggagatgctgggcag

SEQ ID NO: 7441889 - DNA, 22 bp, Homo sapiens
ggctccaggagatgctgggcag

SEQ ID NO: 7441890 - DNA, 22 bp, Homo sapiens
ggctccaggagatgctgggcag

SEQ ID NO: 7441891 - DNA, 18 bp, Homo sapiens
ggctccaggacctaccca

SEQ ID NO: 7441892 - DNA, 18 bp, Homo sapiens
ggctccaggacctaccca

SEQ ID NO: 7441893 - DNA, 18 bp, Homo sapiens
ggctccaggacctaccca

SEQ ID NO: 7441894 - DNA, 22 bp, Homo sapiens
ggctccaggaacctcctctcct

SEQ ID NO: 7441895 - DNA, 22 bp, Homo sapiens
ggctccaggaacctcctctcct

SEQ ID NO: 7441896 - DNA, 22 bp, Homo sapiens
ggctccaggaacctcctctcct

SEQ ID NO: 7441897 - DNA, 22 bp, Homo sapiens
ggctccaggaacctcctctcct

SEQ ID NO: 7441898 - DNA, 22 bp, Homo sapiens
ggctccaggaacctcctctcct

SEQ ID NO: 7441899 - DNA, 22 bp, Homo sapiens
ggctccaggaacctcctctcct

SEQ ID NO: 7441900 - DNA, 22 bp, Homo sapiens
ggctccaggaacctcctctcct

SEQ ID NO: 7441901 - DNA, 22 bp, Homo sapiens
ggctccagatgtctcctggcaa

SEQ ID NO: 7441902 - DNA, 22 bp, Homo sapiens
ggctccagatgtctcctggcaa

SEQ ID NO: 7441903 - DNA, 22 bp, Homo sapiens
ggctccagccctggctcttcac

SEQ ID NO: 7441904 - DNA, 22 bp, Homo sapiens
ggctccagccctggctcttcac

SEQ ID NO: 7441905 - DNA, 22 bp, Homo sapiens
ggctccagccctggctcttcac

SEQ ID NO: 7441906 - DNA, 22 bp, Homo sapiens
ggctccagatgtctcctggcaa

SEQ ID NO: 7441907 - DNA, 22 bp, Homo sapiens
ggctccagatgtctcctggcaa

SEQ ID NO: 7441908 - DNA, 22 bp, Homo sapiens
ggctccagatgtctcctggcaa

SEQ ID NO: 7441909 - DNA, 22 bp, Homo sapiens
ggctccagccctggctcttcac

SEQ ID NO: 7441910 - DNA, 22 bp, Homo sapiens
ggctccagccctggctcttcac

SEQ ID NO: 7441911 - DNA, 22 bp, Homo sapiens
ggctccagccctggctcttcac

SEQ ID NO: 7441912 - DNA, 22 bp, Homo sapiens
ggctccagccctggctcttcac

SEQ ID NO: 7441913 - DNA, 22 bp, Homo sapiens
ggctccagctaatggtttctat

SEQ ID NO: 7441914 - DNA, 22 bp, Homo sapiens
ggctccagctaatggtttctat

SEQ ID NO: 7441915 - DNA, 22 bp, Homo sapiens
ggctccagctaatggtttctat

SEQ ID NO: 7441916 - DNA, 22 bp, Homo sapiens
ggctccagctaatggtttctat

SEQ ID NO: 7441917 - DNA, 22 bp, Homo sapiens
ggctggcttggtgagctgtcac

SEQ ID NO: 7441918 - DNA, 22 bp, Homo sapiens
ggctggcttggtgagctgtcac

SEQ ID NO: 7441919 - DNA, 22 bp, Homo sapiens
ggctggcttggtgagctgtcac

SEQ ID NO: 7441920 - DNA, 22 bp, Homo sapiens
ggctggcttggtgagctgtcac

SEQ ID NO: 7441921 - DNA, 22 bp, Homo sapiens
ggctggcttggtgagctgtcac

SEQ ID NO: 7441922 - DNA, 22 bp, Homo sapiens
ggctggcttgcggagtcacaga

SEQ ID NO: 7441923 - DNA, 22 bp, Homo sapiens
ggctggcttgcggagtcacaga

SEQ ID NO: 7441924 - DNA, 22 bp, Homo sapiens
ggctggcttgcggagtcacaga

SEQ ID NO: 7441925 - DNA, 22 bp, Homo sapiens
ggctggcttgcggagtcacaga

SEQ ID NO: 7441926 - DNA, 22 bp, Homo sapiens
ggctggcttgcggagtcacaga

SEQ ID NO: 7441927 - DNA, 22 bp, Homo sapiens
ggctggcttggtgagctgtcac

SEQ ID NO: 7441928 - DNA, 22 bp, Homo sapiens
ggctggcttggtgagctgtcac

SEQ ID NO: 7441929 - DNA, 22 bp, Homo sapiens
ggctgctggggacgtgggagag

SEQ ID NO: 7441930 - DNA, 22 bp, Homo sapiens
ggctgctggggacgtgggagag

SEQ ID NO: 7441931 - DNA, 22 bp, Homo sapiens
ggctggcttgcggagtcacaga

SEQ ID NO: 7441932 - DNA, 21 bp, Homo sapiens
ggctgctgggagagctgcgtg

SEQ ID NO: 7441933 - DNA, 21 bp, Homo sapiens
ggctgctgggagagctgcgtg

SEQ ID NO: 7441934 - DNA, 21 bp, Homo sapiens
ggctgctgggagagctgcgtg

SEQ ID NO: 7441935 - DNA, 21 bp, Homo sapiens
ggctgctgggagagctgcgtg

SEQ ID NO: 7441936 - DNA, 21 bp, Homo sapiens
ggctgctgggagagctgcgtg

SEQ ID NO: 7441937 - DNA, 21 bp, Homo sapiens
ggctgggcaggacccacccct

SEQ ID NO: 7441938 - DNA, 21 bp, Homo sapiens
ggctgggcaggacccacccct

SEQ ID NO: 7441939 - DNA, 22 bp, Homo sapiens
ggctgggcagcagctgttaagc

SEQ ID NO: 7441940 - DNA, 22 bp, Homo sapiens
ggctgggcaaacaagactcttc

SEQ ID NO: 7441941 - DNA, 22 bp, Homo sapiens
ggctgggcagcagctgttaagc

SEQ ID NO: 7441942 - DNA, 22 bp, Homo sapiens
ggctgggcagcagctgttaagc

SEQ ID NO: 7441943 - DNA, 22 bp, Homo sapiens
ggctgggcagcagctgttaagc

SEQ ID NO: 7441944 - DNA, 22 bp, Homo sapiens
ggctgggcaaacaagactcttc

SEQ ID NO: 7441945 - DNA, 22 bp, Homo sapiens
ggctgggcaaacaagactcttc

SEQ ID NO: 7441946 - DNA, 22 bp, Homo sapiens
ggctgggcaaacaagactcttc

SEQ ID NO: 7441947 - DNA, 22 bp, Homo sapiens
ggctgggcaaacaagactcttc

SEQ ID NO: 7441948 - DNA, 22 bp, Homo sapiens
ggctgggcaaacaagactcttc

SEQ ID NO: 7441949 - DNA, 22 bp, Homo sapiens
ggctgggcaaacaagactcttc

SEQ ID NO: 7441950 - DNA, 22 bp, Homo sapiens
ggctgggaggccgtgctgacct

SEQ ID NO: 7441951 - DNA, 22 bp, Homo sapiens
ggctgggaggccgtgctgacct

SEQ ID NO: 7441952 - DNA, 22 bp, Homo sapiens
ggctgggaggccgtgctgacct

SEQ ID NO: 7441953 - DNA, 22 bp, Homo sapiens
ggctgggaggccgtgctgacct

SEQ ID NO: 7441954 - DNA, 22 bp, Homo sapiens
ggctgggaggccgtgctgacct

SEQ ID NO: 7441955 - DNA, 22 bp, Homo sapiens
ggctgggaggccgtgctgacct

SEQ ID NO: 7441956 - DNA, 22 bp, Homo sapiens
ggctgctggattgtgtatctgt

SEQ ID NO: 7441957 - DNA, 22 bp, Homo sapiens
ggctgctggcagatgtagttta

SEQ ID NO: 7441958 - DNA, 22 bp, Homo sapiens
ggctgctggcagatgtagttta

SEQ ID NO: 7441959 - DNA, 22 bp, Homo sapiens
ggctgctggcagatgtagttta

SEQ ID NO: 7441960 - DNA, 22 bp, Homo sapiens
ggctgctggagttgggtctctc

SEQ ID NO: 7441961 - DNA, 22 bp, Homo sapiens
ggctgctggagttgggtctctc

SEQ ID NO: 7441962 - DNA, 22 bp, Homo sapiens
ggctgctggagttgggtctctc

SEQ ID NO: 7441963 - DNA, 22 bp, Homo sapiens
ggctgctggagttgggtctctc

SEQ ID NO: 7441964 - DNA, 22 bp, Homo sapiens
ggctgctggagttgggtctctc

SEQ ID NO: 7441965 - DNA, 22 bp, Homo sapiens
ggctgctggagttgggtctctc

SEQ ID NO: 7441966 - DNA, 22 bp, Homo sapiens
ggctgctggagttgggtctctc

SEQ ID NO: 7441967 - DNA, 22 bp, Homo sapiens
ggctgctggagttgggtctctc

SEQ ID NO: 7441968 - DNA, 22 bp, Homo sapiens
ggctgctggcattgaggtaggt

SEQ ID NO: 7441969 - DNA, 22 bp, Homo sapiens
ggctgctggccagcctaggagt

SEQ ID NO: 7441970 - DNA, 22 bp, Homo sapiens
ggctgctggcattgaggtaggt

SEQ ID NO: 7441971 - DNA, 22 bp, Homo sapiens
ggctgctggcattgaggtaggt

SEQ ID NO: 7441972 - DNA, 22 bp, Homo sapiens
ggctgctggcattgaggtaggt

SEQ ID NO: 7441973 - DNA, 22 bp, Homo sapiens
ggctgctggcattgaggtaggt

SEQ ID NO: 7441974 - DNA, 22 bp, Homo sapiens
ggctgctggcattgaggtaggt

SEQ ID NO: 7441975 - DNA, 22 bp, Homo sapiens
ggctgctggcattgaggtaggt

SEQ ID NO: 7441976 - DNA, 22 bp, Homo sapiens
ggctgctggcattgaggtaggt

SEQ ID NO: 7441977 - DNA, 22 bp, Homo sapiens
ggctgctggcattgaggtaggt

SEQ ID NO: 7441978 - DNA, 22 bp, Homo sapiens
ggctgctgggaatatgccagct

SEQ ID NO: 7441979 - DNA, 22 bp, Homo sapiens
ggctgctgggaatatgccagct

SEQ ID NO: 7441980 - DNA, 22 bp, Homo sapiens
ggctgctgggaatatgccagct

SEQ ID NO: 7441981 - DNA, 22 bp, Homo sapiens
ggctgctgggaatatgccagct

SEQ ID NO: 7441982 - DNA, 22 bp, Homo sapiens
ggctgctgggaatatgccagct

SEQ ID NO: 7441983 - DNA, 22 bp, Homo sapiens
ggctgctgggaatatgccagct

SEQ ID NO: 7441984 - DNA, 22 bp, Homo sapiens
ggctgctgggaatatgccagct

SEQ ID NO: 7441985 - DNA, 22 bp, Homo sapiens
ggctgctgggaatatgccagct

SEQ ID NO: 7441986 - DNA, 22 bp, Homo sapiens
ggctgctgggaatatgccagct

SEQ ID NO: 7441987 - DNA, 22 bp, Homo sapiens
ggctgctggccagcctaggagt

SEQ ID NO: 7441988 - DNA, 22 bp, Homo sapiens
ggctgctggccagcctaggagt

SEQ ID NO: 7441989 - DNA, 22 bp, Homo sapiens
ggctgctggccagcctaggagt

SEQ ID NO: 7441990 - DNA, 22 bp, Homo sapiens
ggctgctggccagcctaggagt

SEQ ID NO: 7441991 - DNA, 22 bp, Homo sapiens
ggctgctggccagcctaggagt

SEQ ID NO: 7441992 - DNA, 22 bp, Homo sapiens
ggctgctggccagcctaggagt

SEQ ID NO: 7441993 - DNA, 22 bp, Homo sapiens
ggctgctggcctctccccggcc

SEQ ID NO: 7441994 - DNA, 22 bp, Homo sapiens
ggctgctggcctctccccggcc

SEQ ID NO: 7441995 - DNA, 22 bp, Homo sapiens
ggctgctggcctctccccggcc

SEQ ID NO: 7441996 - DNA, 22 bp, Homo sapiens
ggctgctggcctctccccggcc

SEQ ID NO: 7441997 - DNA, 22 bp, Homo sapiens
ggctgctgggaatatgccagct

SEQ ID NO: 7441998 - DNA, 22 bp, Homo sapiens
ggctgagcaattttgatgacat

SEQ ID NO: 7441999 - DNA, 22 bp, Homo sapiens
ggctgagcactttaggcaggag

SEQ ID NO: 7442000 - DNA, 22 bp, Homo sapiens
ggctgagcactttaggcaggag

SEQ ID NO: 7442001 - DNA, 22 bp, Homo sapiens
ggctgagcactttaggcaggag

SEQ ID NO: 7442002 - DNA, 22 bp, Homo sapiens
ggctgagcactttaggcaggag

SEQ ID NO: 7442003 - DNA, 22 bp, Homo sapiens
ggctgagcactttaggcaggag

SEQ ID NO: 7442004 - DNA, 22 bp, Homo sapiens
ggctgagcaattttgatgacat

SEQ ID NO: 7442005 - DNA, 22 bp, Homo sapiens
ggctgagcaattttgatgacat

SEQ ID NO: 7442006 - DNA, 21 bp, Homo sapiens
ggctgagatggcagaatcacc

SEQ ID NO: 7442007 - DNA, 22 bp, Homo sapiens
ggctgagagtttcctctggggc

SEQ ID NO: 7442008 - DNA, 21 bp, Homo sapiens
ggctgagatggcagaatcacc

SEQ ID NO: 7442009 - DNA, 22 bp, Homo sapiens
ggctgagagtggatcccaggga

SEQ ID NO: 7442010 - DNA, 22 bp, Homo sapiens
ggctgagagtttcctctggggc

SEQ ID NO: 7442011 - DNA, 22 bp, Homo sapiens
ggctgagagtttcctctggggc

SEQ ID NO: 7442012 - DNA, 22 bp, Homo sapiens
ggctgagagtttcctctggggc

SEQ ID NO: 7442013 - DNA, 22 bp, Homo sapiens
ggctgagaggacgtcgggctca

SEQ ID NO: 7442014 - DNA, 22 bp, Homo sapiens
ggctgagagtggatcccaggga

SEQ ID NO: 7442015 - DNA, 22 bp, Homo sapiens
ggctgagagtggatcccaggga

SEQ ID NO: 7442016 - DNA, 22 bp, Homo sapiens
ggctgagaggacgtcgggctca

SEQ ID NO: 7442017 - DNA, 19 bp, Homo sapiens
ggctgctgaagagaattac

SEQ ID NO: 7442018 - DNA, 22 bp, Homo sapiens
ggctgctgaagtgtggcaatct

SEQ ID NO: 7442019 - DNA, 22 bp, Homo sapiens
ggctgctgaagtgtggcaatct

SEQ ID NO: 7442020 - DNA, 22 bp, Homo sapiens
ggctgctgaagtgtggcaatct

SEQ ID NO: 7442021 - DNA, 22 bp, Homo sapiens
ggctgctgaagtgtggcaatct

SEQ ID NO: 7442022 - DNA, 22 bp, Homo sapiens
ggctgctgaagtgtggcaatct

SEQ ID NO: 7442023 - DNA, 19 bp, Homo sapiens
ggctgctgaagagaattac

SEQ ID NO: 7442024 - DNA, 19 bp, Homo sapiens
ggctgctgaagagaattac

SEQ ID NO: 7442025 - DNA, 22 bp, Homo sapiens
ggctgagcactttaggcaggag

SEQ ID NO: 7442026 - DNA, 22 bp, Homo sapiens
ggctgagcactttaggcaggag

SEQ ID NO: 7442027 - DNA, 22 bp, Homo sapiens
ggctgctgacaaacatgatcat

SEQ ID NO: 7442028 - DNA, 22 bp, Homo sapiens
ggctgctgacaaacatgatcat

SEQ ID NO: 7442029 - DNA, 22 bp, Homo sapiens
ggctgctgacaaacatgatcat

SEQ ID NO: 7442030 - DNA, 22 bp, Homo sapiens
ggctgctgacaaacatgatcat

SEQ ID NO: 7442031 - DNA, 22 bp, Homo sapiens
ggctgctgacaaacatgatcat

SEQ ID NO: 7442032 - DNA, 22 bp, Homo sapiens
ggctgctgacaaacatgatcat

SEQ ID NO: 7442033 - DNA, 22 bp, Homo sapiens
ggctgctgacttcatccagctt

SEQ ID NO: 7442034 - DNA, 22 bp, Homo sapiens
ggctgctgacttcatccagctt

SEQ ID NO: 7442035 - DNA, 22 bp, Homo sapiens
ggctgctgacttcatccagctt

SEQ ID NO: 7442036 - DNA, 22 bp, Homo sapiens
ggctgctgacttcatccagctt

SEQ ID NO: 7442037 - DNA, 22 bp, Homo sapiens
ggctgctgacttcatccagctt

SEQ ID NO: 7442038 - DNA, 22 bp, Homo sapiens
ggctgctgacttcatccagctt

SEQ ID NO: 7442039 - DNA, 22 bp, Homo sapiens
ggctgctgacaaacatgatcat

SEQ ID NO: 7442040 - DNA, 22 bp, Homo sapiens
ggctgctgccctcctaagtgca

SEQ ID NO: 7442041 - DNA, 22 bp, Homo sapiens
ggctgctgccctcctaagtgca

SEQ ID NO: 7442042 - DNA, 22 bp, Homo sapiens
ggctgctgccctcctaagtgca

SEQ ID NO: 7442043 - DNA, 22 bp, Homo sapiens
ggctgctgccctcctaagtgca

SEQ ID NO: 7442044 - DNA, 22 bp, Homo sapiens
ggctgctgcccacccctgcatg

SEQ ID NO: 7442045 - DNA, 22 bp, Homo sapiens
ggctgctgcccacccctgcatg

SEQ ID NO: 7442046 - DNA, 22 bp, Homo sapiens
ggctgctgcccacccctgcatg

SEQ ID NO: 7442047 - DNA, 22 bp, Homo sapiens
ggctgctgcccacccctgcatg

SEQ ID NO: 7442048 - DNA, 22 bp, Homo sapiens
ggctgctgcccacccctgcatg

SEQ ID NO: 7442049 - DNA, 22 bp, Homo sapiens
ggctgctgccctcctaagtgca

SEQ ID NO: 7442050 - DNA, 22 bp, Homo sapiens
ggctgctgctgtgtaggcctgt

SEQ ID NO: 7442051 - DNA, 22 bp, Homo sapiens
ggctgctgctgtgtaggcctgt

SEQ ID NO: 7442052 - DNA, 22 bp, Homo sapiens
ggctgctgctgtgtaggcctgt

SEQ ID NO: 7442053 - DNA, 22 bp, Homo sapiens
ggctgctgctgtgtaggcctgt

SEQ ID NO: 7442054 - DNA, 22 bp, Homo sapiens
ggctgctggaagactgaacaag

SEQ ID NO: 7442055 - DNA, 22 bp, Homo sapiens
ggctgctggaagactgaacaag

SEQ ID NO: 7442056 - DNA, 22 bp, Homo sapiens
ggctgctggaagactgaacaag

SEQ ID NO: 7442057 - DNA, 22 bp, Homo sapiens
ggctgctgagttggccaggaga

SEQ ID NO: 7442058 - DNA, 22 bp, Homo sapiens
ggctgctgagttggccaggaga

SEQ ID NO: 7442059 - DNA, 22 bp, Homo sapiens
ggctgctgagtcacgacagtga

SEQ ID NO: 7442060 - DNA, 22 bp, Homo sapiens
ggctgctgagttggccaggaga

SEQ ID NO: 7442061 - DNA, 22 bp, Homo sapiens
ggctgctgagttggccaggaga

SEQ ID NO: 7442062 - DNA, 22 bp, Homo sapiens
ggctgctgagttggccaggaga

SEQ ID NO: 7442063 - DNA, 22 bp, Homo sapiens
ggctgctgagtcacgacagtga

SEQ ID NO: 7442064 - DNA, 22 bp, Homo sapiens
ggctgctgagtcacgacagtga

SEQ ID NO: 7442065 - DNA, 22 bp, Homo sapiens
ggctgctgagtcacgacagtga

SEQ ID NO: 7442066 - DNA, 22 bp, Homo sapiens
ggctgctgacttcatccagctt

SEQ ID NO: 7442067 - DNA, 22 bp, Homo sapiens
ggctgctgagtcacgacagtga

SEQ ID NO: 7442068 - DNA, 22 bp, Homo sapiens
ggctgctgagtcacgacagtga

SEQ ID NO: 7442069 - DNA, 22 bp, Homo sapiens
ggctgctgagttggccaggaga

SEQ ID NO: 7442070 - DNA, 22 bp, Homo sapiens
ggctgctgagttggccaggaga

SEQ ID NO: 7442071 - DNA, 22 bp, Homo sapiens
ggctgctgagttggccaggaga

SEQ ID NO: 7442072 - DNA, 22 bp, Homo sapiens
ggctgctgagttggccaggaga

SEQ ID NO: 7442073 - DNA, 22 bp, Homo sapiens
ggctgctgcccacccctgcatg

SEQ ID NO: 7442074 - DNA, 22 bp, Homo sapiens
ggctgctgcccacccctgcatg

SEQ ID NO: 7442075 - DNA, 22 bp, Homo sapiens
ggctgctgcccacccctgcatg

SEQ ID NO: 7442076 - DNA, 22 bp, Homo sapiens
ggctgctgcccacccctgcatg

SEQ ID NO: 7442077 - DNA, 22 bp, Homo sapiens
ggctgctgcccacccctgcatg

SEQ ID NO: 7442078 - DNA, 22 bp, Homo sapiens
ggcttctctgtctagtttctac

SEQ ID NO: 7442079 - DNA, 22 bp, Homo sapiens
ggcttctgaaatctctgtgcgt

SEQ ID NO: 7442080 - DNA, 22 bp, Homo sapiens
ggcttctgaaatctctgtgcgt

SEQ ID NO: 7442081 - DNA, 22 bp, Homo sapiens
ggcttctgaaactgtattgaga

SEQ ID NO: 7442082 - DNA, 22 bp, Homo sapiens
ggcttctgaaatctctgtgcgt

SEQ ID NO: 7442083 - DNA, 22 bp, Homo sapiens
ggcttctgaaatctctgtgcgt

SEQ ID NO: 7442084 - DNA, 22 bp, Homo sapiens
ggcttctgaaatctctgtgcgt

SEQ ID NO: 7442085 - DNA, 22 bp, Homo sapiens
ggcttctgaaatctctgtgcgt

SEQ ID NO: 7442086 - DNA, 22 bp, Homo sapiens
ggcttctgaaccaggccctgga

SEQ ID NO: 7442087 - DNA, 22 bp, Homo sapiens
ggcttctgagtgctctgctgtt

SEQ ID NO: 7442088 - DNA, 22 bp, Homo sapiens
ggcttctgagtgctctgctgtt

SEQ ID NO: 7442089 - DNA, 22 bp, Homo sapiens
ggcttctgagtgctctgctgtt

SEQ ID NO: 7442090 - DNA, 22 bp, Homo sapiens
ggcttctgaaccaggccctgga

SEQ ID NO: 7442091 - DNA, 22 bp, Homo sapiens
ggcttctgaaccaggccctgga

SEQ ID NO: 7442092 - DNA, 22 bp, Homo sapiens
ggcttctgccacgagagggaag

SEQ ID NO: 7442093 - DNA, 22 bp, Homo sapiens
ggcttctgagtgctctgctgtt

SEQ ID NO: 7442094 - DNA, 22 bp, Homo sapiens
ggcttctgagtgctctgctgtt

SEQ ID NO: 7442095 - DNA, 22 bp, Homo sapiens
ggcttctgagtgctctgctgtt

SEQ ID NO: 7442096 - DNA, 22 bp, Homo sapiens
ggcttctgagtgctctgctgtt

SEQ ID NO: 7442097 - DNA, 22 bp, Homo sapiens
ggcttctgagtgctctgctgtt

SEQ ID NO: 7442098 - DNA, 22 bp, Homo sapiens
ggcttctgctcagcctgcacgc

SEQ ID NO: 7442099 - DNA, 22 bp, Homo sapiens
ggcttctgccttgccagttctt

SEQ ID NO: 7442100 - DNA, 22 bp, Homo sapiens
ggcttctgccttgccagttctt

SEQ ID NO: 7442101 - DNA, 22 bp, Homo sapiens
ggcttctgccacgagagggaag

SEQ ID NO: 7442102 - DNA, 22 bp, Homo sapiens
ggcttctgccacgagagggaag

SEQ ID NO: 7442103 - DNA, 22 bp, Homo sapiens
ggcttctgccttgccagttctt

SEQ ID NO: 7442104 - DNA, 22 bp, Homo sapiens
ggcttctgccttgccagttctt

SEQ ID NO: 7442105 - DNA, 22 bp, Homo sapiens
ggcttctgctcagcctgcacgc

SEQ ID NO: 7442106 - DNA, 22 bp, Homo sapiens
ggcttctgtctcaagcaccagc

SEQ ID NO: 7442107 - DNA, 22 bp, Homo sapiens
ggcttctgtcctctggatctgt

SEQ ID NO: 7442108 - DNA, 22 bp, Homo sapiens
ggcttcttaatcatgagagtga

SEQ ID NO: 7442109 - DNA, 22 bp, Homo sapiens
ggcttctgtcctctggatctgt

SEQ ID NO: 7442110 - DNA, 22 bp, Homo sapiens
ggcttctgtcctctggatctgt

SEQ ID NO: 7442111 - DNA, 22 bp, Homo sapiens
ggcttctggtgggagcatgact

SEQ ID NO: 7442112 - DNA, 22 bp, Homo sapiens
ggcttctggtgggagcatgact

SEQ ID NO: 7442113 - DNA, 22 bp, Homo sapiens
ggcttctggtaaagaccacacc

SEQ ID NO: 7442114 - DNA, 22 bp, Homo sapiens
ggcttctggtaaagaccacacc

SEQ ID NO: 7442115 - DNA, 18 bp, Homo sapiens
ggcttctgggacatttta

SEQ ID NO: 7442116 - DNA, 22 bp, Homo sapiens
ggcttctcccctttgagtcttc

SEQ ID NO: 7442117 - DNA, 22 bp, Homo sapiens
ggcttctcccctttgagtcttc

SEQ ID NO: 7442118 - DNA, 22 bp, Homo sapiens
ggcttctcccttcttctgattg

SEQ ID NO: 7442119 - DNA, 22 bp, Homo sapiens
ggcttctcccattcttcagggg

SEQ ID NO: 7442120 - DNA, 22 bp, Homo sapiens
ggcttctcccattcttcagggg

SEQ ID NO: 7442121 - DNA, 22 bp, Homo sapiens
ggcttctcccctttgagtcttc

SEQ ID NO: 7442122 - DNA, 22 bp, Homo sapiens
ggcttctcgtgccgaagcaaga

SEQ ID NO: 7442123 - DNA, 22 bp, Homo sapiens
ggcttctctcccccagctccac

SEQ ID NO: 7442124 - DNA, 22 bp, Homo sapiens
ggcttctctcttcacatggctt

SEQ ID NO: 7442125 - DNA, 22 bp, Homo sapiens
ggcttctctcttcacatggctt

SEQ ID NO: 7442126 - DNA, 22 bp, Homo sapiens
ggctgggctgcggctgtacctg

SEQ ID NO: 7442127 - DNA, 22 bp, Homo sapiens
ggctgggctgctgggtcagagc

SEQ ID NO: 7442128 - DNA, 22 bp, Homo sapiens
ggctgggctgctgggtcagagc

SEQ ID NO: 7442129 - DNA, 22 bp, Homo sapiens
ggctgggctgctgggtcagagc

SEQ ID NO: 7442130 - DNA, 22 bp, Homo sapiens
ggctgggctgctgggtcagagc

SEQ ID NO: 7442131 - DNA, 22 bp, Homo sapiens
ggctgggctgcggctgtacctg

SEQ ID NO: 7442132 - DNA, 22 bp, Homo sapiens
ggctgggctgcggctgtacctg

SEQ ID NO: 7442133 - DNA, 22 bp, Homo sapiens
ggctgggctgcggctgtacctg

SEQ ID NO: 7442134 - DNA, 22 bp, Homo sapiens
ggctgggctcgctgattggctg

SEQ ID NO: 7442135 - DNA, 22 bp, Homo sapiens
ggctgggctgcggctgtacctg

SEQ ID NO: 7442136 - DNA, 22 bp, Homo sapiens
ggctgggctgcggctgtacctg

SEQ ID NO: 7442137 - DNA, 22 bp, Homo sapiens
ggctgggctgctgggtcagagc

SEQ ID NO: 7442138 - DNA, 22 bp, Homo sapiens
ggcttctccaggtactgagcat

SEQ ID NO: 7442139 - DNA, 22 bp, Homo sapiens
ggctgggctgctgggtcagagc

SEQ ID NO: 7442140 - DNA, 22 bp, Homo sapiens
ggctgggctgctgggtcagagc

SEQ ID NO: 7442141 - DNA, 22 bp, Homo sapiens
ggctgggctgctgggtcagagc

SEQ ID NO: 7442142 - DNA, 22 bp, Homo sapiens
ggctgggctgctgggtcagagc

SEQ ID NO: 7442143 - DNA, 21 bp, Homo sapiens
ggctgggcaggacccacccct

SEQ ID NO: 7442144 - DNA, 21 bp, Homo sapiens
ggctgggcaggacccacccct

SEQ ID NO: 7442145 - DNA, 21 bp, Homo sapiens
ggctgggcaggacccacccct

SEQ ID NO: 7442146 - DNA, 21 bp, Homo sapiens
ggctgggcaggacccacccct

SEQ ID NO: 7442147 - DNA, 21 bp, Homo sapiens
ggctgggcaggacccacccct

SEQ ID NO: 7442148 - DNA, 22 bp, Homo sapiens
ggctgggcaggtctgcacaggg

SEQ ID NO: 7442149 - DNA, 22 bp, Homo sapiens
ggctgggcaggtctgcacaggg

SEQ ID NO: 7442150 - DNA, 22 bp, Homo sapiens
ggctgggcaggtctgcacaggg

SEQ ID NO: 7442151 - DNA, 22 bp, Homo sapiens
ggctgggcaggtctgcacaggg

SEQ ID NO: 7442152 - DNA, 22 bp, Homo sapiens
ggctgggcatccatccatgaga

SEQ ID NO: 7442153 - DNA, 22 bp, Homo sapiens
ggctgggcatccatccatgaga

SEQ ID NO: 7442154 - DNA, 22 bp, Homo sapiens
ggctgggcaggtctgcacaggg

SEQ ID NO: 7442155 - DNA, 22 bp, Homo sapiens
ggctgggcaggtctgcacaggg

SEQ ID NO: 7442156 - DNA, 22 bp, Homo sapiens
ggctgggcaggtctgcacaggg

SEQ ID NO: 7442157 - DNA, 22 bp, Homo sapiens
ggctgggcaggtctgcacaggg

SEQ ID NO: 7442158 - DNA, 22 bp, Homo sapiens
ggctgggcaggtctgcacaggg

SEQ ID NO: 7442159 - DNA, 22 bp, Homo sapiens
ggctgggccagggcctgtggac

SEQ ID NO: 7442160 - DNA, 22 bp, Homo sapiens
ggctgggccagggcctgtggac

SEQ ID NO: 7442161 - DNA, 19 bp, Homo sapiens
ggctgggccctgtttctcc

SEQ ID NO: 7442162 - DNA, 19 bp, Homo sapiens
ggctgggccctgtttctcc

SEQ ID NO: 7442163 - DNA, 19 bp, Homo sapiens
ggctgggccctgtttctcc

SEQ ID NO: 7442164 - DNA, 19 bp, Homo sapiens
ggctgggccctgtttctcc

SEQ ID NO: 7442165 - DNA, 22 bp, Homo sapiens
ggctgggccagggcctgtggac

SEQ ID NO: 7442166 - DNA, 22 bp, Homo sapiens
ggctgggccagggcctgtggac

SEQ ID NO: 7442167 - DNA, 22 bp, Homo sapiens
ggctgggccagggcctgtggac

SEQ ID NO: 7442168 - DNA, 22 bp, Homo sapiens
ggctgggcatccatccatgaga

SEQ ID NO: 7442169 - DNA, 22 bp, Homo sapiens
ggctgggcatccatccatgaga

SEQ ID NO: 7442170 - DNA, 22 bp, Homo sapiens
ggctgggcatccatccatgaga

SEQ ID NO: 7442171 - DNA, 22 bp, Homo sapiens
ggctgggcatccatccatgaga

SEQ ID NO: 7442172 - DNA, 22 bp, Homo sapiens
ggctgggccagggcctgtggac

SEQ ID NO: 7442173 - DNA, 22 bp, Homo sapiens
ggctgggccagggcctgtggac

SEQ ID NO: 7442174 - DNA, 22 bp, Homo sapiens
ggctgggccagggcctgtggac

SEQ ID NO: 7442175 - DNA, 22 bp, Homo sapiens
ggctgggccagggcctgtggac

SEQ ID NO: 7442176 - DNA, 22 bp, Homo sapiens
ggctgggcatccatccatgaga

SEQ ID NO: 7442177 - DNA, 22 bp, Homo sapiens
ggctgggcatccatccatgaga

SEQ ID NO: 7442178 - DNA, 22 bp, Homo sapiens
ggctgggctccgggagcatgcg

SEQ ID NO: 7442179 - DNA, 22 bp, Homo sapiens
ggctgggctccgggagcatgcg

SEQ ID NO: 7442180 - DNA, 22 bp, Homo sapiens
ggctgggcctctccctcagctg

SEQ ID NO: 7442181 - DNA, 22 bp, Homo sapiens
ggctgggcctctccctcagctg

SEQ ID NO: 7442182 - DNA, 22 bp, Homo sapiens
ggctgggcctctccctcagctg

SEQ ID NO: 7442183 - DNA, 22 bp, Homo sapiens
ggctgggcctctccctcagctg

SEQ ID NO: 7442184 - DNA, 22 bp, Homo sapiens
ggctgggcctctccctcagctg

SEQ ID NO: 7442185 - DNA, 22 bp, Homo sapiens
ggctgggcctctccctcagctg

SEQ ID NO: 7442186 - DNA, 22 bp, Homo sapiens
ggctgggccgcggctacccaga

SEQ ID NO: 7442187 - DNA, 19 bp, Homo sapiens
ggctgggccctgtttctcc

SEQ ID NO: 7442188 - DNA, 22 bp, Homo sapiens
ggctgggccgcggctacccaga

SEQ ID NO: 7442189 - DNA, 22 bp, Homo sapiens
ggctgggccgcggctacccaga

SEQ ID NO: 7442190 - DNA, 22 bp, Homo sapiens
ggctgggccgcggctacccaga

SEQ ID NO: 7442191 - DNA, 22 bp, Homo sapiens
ggctgggccgcggctacccaga

SEQ ID NO: 7442192 - DNA, 22 bp, Homo sapiens
ggctgggcctctccctcagctg

SEQ ID NO: 7442193 - DNA, 22 bp, Homo sapiens
ggctgggcctctccctcagctg

SEQ ID NO: 7442194 - DNA, 22 bp, Homo sapiens
ggctgggccgcggctacccaga

SEQ ID NO: 7442195 - DNA, 22 bp, Homo sapiens
ggctgggccgcggctacccaga

SEQ ID NO: 7442196 - DNA, 22 bp, Homo sapiens
ggctgggccgcggctacccaga

SEQ ID NO: 7442197 - DNA, 22 bp, Homo sapiens
ggctgggctccgggagcatgcg

SEQ ID NO: 7442198 - DNA, 22 bp, Homo sapiens
ggctgggctccgggagcatgcg

SEQ ID NO: 7442199 - DNA, 22 bp, Homo sapiens
ggctgggctccgggagcatgcg

SEQ ID NO: 7442200 - DNA, 22 bp, Homo sapiens
ggctgggctcgctgattggctg

SEQ ID NO: 7442201 - DNA, 22 bp, Homo sapiens
ggctgggctcgctgattggctg

SEQ ID NO: 7442202 - DNA, 22 bp, Homo sapiens
ggctgggctcgctgattggctg

SEQ ID NO: 7442203 - DNA, 22 bp, Homo sapiens
ggctgggctcgctgattggctg

SEQ ID NO: 7442204 - DNA, 22 bp, Homo sapiens
ggctgggctcgctgattggctg

SEQ ID NO: 7442205 - DNA, 22 bp, Homo sapiens
ggctgggctcgctgattggctg

SEQ ID NO: 7442206 - DNA, 22 bp, Homo sapiens
ggctgggctccgggagcatgcg

SEQ ID NO: 7442207 - DNA, 22 bp, Homo sapiens
ggctgggctccgggagcatgcg

SEQ ID NO: 7442208 - DNA, 22 bp, Homo sapiens
ggctgggctccgggagcatgcg

SEQ ID NO: 7442209 - DNA, 22 bp, Homo sapiens
ggctgggctccgggagcatgcg

SEQ ID NO: 7442210 - DNA, 22 bp, Homo sapiens
ggctgggctccgggagcatgcg

SEQ ID NO: 7442211 - DNA, 22 bp, Homo sapiens
ggctgggctccgggagcatgcg

SEQ ID NO: 7442212 - DNA, 22 bp, Homo sapiens
ggctgggctccgggagcatgcg

SEQ ID NO: 7442213 - DNA, 22 bp, Homo sapiens
ggctgggctccgggagcatgcg

SEQ ID NO: 7442214 - DNA, 22 bp, Homo sapiens
ggctgggctccgggagcatgcg

SEQ ID NO: 7442215 - DNA, 22 bp, Homo sapiens
gacaactgtcagtatattgtta

SEQ ID NO: 7442216 - DNA, 22 bp, Homo sapiens
gacaactgccccattttaaatg

SEQ ID NO: 7442217 - DNA, 22 bp, Homo sapiens
gacaagacacctctctccatcc

SEQ ID NO: 7442218 - DNA, 17 bp, Homo sapiens
gacaagacagaattcat

SEQ ID NO: 7442219 - DNA, 22 bp, Homo sapiens
gacaagacacctctctccatcc

SEQ ID NO: 7442220 - DNA, 22 bp, Homo sapiens
gacaagacagcttgcagacaac

SEQ ID NO: 7442221 - DNA, 22 bp, Homo sapiens
gacaagacagcttgcagacaac

SEQ ID NO: 7442222 - DNA, 22 bp, Homo sapiens
gacaagacagcttgcagacaac

SEQ ID NO: 7442223 - DNA, 17 bp, Homo sapiens
gacaagacagaattcat

SEQ ID NO: 7442224 - DNA, 22 bp, Homo sapiens
gacaactgtcagtatattgtta

SEQ ID NO: 7442225 - DNA, 22 bp, Homo sapiens
gacaagactatgtagaaagtat

SEQ ID NO: 7442226 - DNA, 22 bp, Homo sapiens
gacaagactatgtagaaagtat

SEQ ID NO: 7442227 - DNA, 22 bp, Homo sapiens
gacaagactatgtagaaagtat

SEQ ID NO: 7442228 - DNA, 22 bp, Homo sapiens
gacaagacattggtaaagatat

SEQ ID NO: 7442229 - DNA, 22 bp, Homo sapiens
gacaagacattggtaaagatat

SEQ ID NO: 7442230 - DNA, 22 bp, Homo sapiens
gacaagacatgtgatgacatca

SEQ ID NO: 7442231 - DNA, 22 bp, Homo sapiens
gacaagacatgtgatgacatca

SEQ ID NO: 7442232 - DNA, 22 bp, Homo sapiens
gacaagacatgtgatgacatca

SEQ ID NO: 7442233 - DNA, 22 bp, Homo sapiens
gacaagacattggtaaagatat

SEQ ID NO: 7442234 - DNA, 22 bp, Homo sapiens
gacaagcaagagtttgctgggc

SEQ ID NO: 7442235 - DNA, 22 bp, Homo sapiens
gacaagcaagagtttgctgggc

SEQ ID NO: 7442236 - DNA, 22 bp, Homo sapiens
gacaagatttagagtctgctaa

SEQ ID NO: 7442237 - DNA, 22 bp, Homo sapiens
gacaagctcccggtggccctcc

SEQ ID NO: 7442238 - DNA, 22 bp, Homo sapiens
gacaagctcgcctgccccggaa

SEQ ID NO: 7442239 - DNA, 22 bp, Homo sapiens
gacaagcaggctcctgaagaaa

SEQ ID NO: 7442240 - DNA, 22 bp, Homo sapiens
gacaagctcttgtttcatggtt

SEQ ID NO: 7442241 - DNA, 22 bp, Homo sapiens
gacaagctcttgtttcatggtt

SEQ ID NO: 7442242 - DNA, 22 bp, Homo sapiens
gacaagataatgaagtgcaatt

SEQ ID NO: 7442243 - DNA, 22 bp, Homo sapiens
gacaagataatgaagtgcaatt

SEQ ID NO: 7442244 - DNA, 22 bp, Homo sapiens
gacaagactggtttatttaagg

SEQ ID NO: 7442245 - DNA, 22 bp, Homo sapiens
gacaagactggtttatttaagg

SEQ ID NO: 7442246 - DNA, 22 bp, Homo sapiens
gacaagatgacatcatggcttc

SEQ ID NO: 7442247 - DNA, 22 bp, Homo sapiens
gacaagataatgaagtgcaatt

SEQ ID NO: 7442248 - DNA, 22 bp, Homo sapiens
gaatatgagtgtccctgaggtc

SEQ ID NO: 7442249 - DNA, 22 bp, Homo sapiens
gacaagatgagcagctcagtgt

SEQ ID NO: 7442250 - DNA, 22 bp, Homo sapiens
gacaagattaaccatagttaag

SEQ ID NO: 7442251 - DNA, 22 bp, Homo sapiens
gacaactgccccattttaaatg

SEQ ID NO: 7442252 - DNA, 22 bp, Homo sapiens
gacaactgccccattttaaatg

SEQ ID NO: 7442253 - DNA, 22 bp, Homo sapiens
gacaactgccccattttaaatg

SEQ ID NO: 7442254 - DNA, 22 bp, Homo sapiens
gacaactgatgtgcttgtggga

SEQ ID NO: 7442255 - DNA, 22 bp, Homo sapiens
gacaactgagcagaggaaatga

SEQ ID NO: 7442256 - DNA, 22 bp, Homo sapiens
gacaactgatgtgcttgtggga

SEQ ID NO: 7442257 - DNA, 20 bp, Homo sapiens
gacaacatgcagaaagtata

SEQ ID NO: 7442258 - DNA, 22 bp, Homo sapiens
gacaaccgagcagctgtgggaa

SEQ ID NO: 7442259 - DNA, 22 bp, Homo sapiens
gacaactgagcagaggaaatga

SEQ ID NO: 7442260 - DNA, 22 bp, Homo sapiens
gaatattagtatcagttatacc

SEQ ID NO: 7442261 - DNA, 22 bp, Homo sapiens
gaatattagtatcagttatacc

SEQ ID NO: 7442262 - DNA, 22 bp, Homo sapiens
gaatattagtatcagttatacc

SEQ ID NO: 7442263 - DNA, 22 bp, Homo sapiens
gaatattagtatcagttatacc

SEQ ID NO: 7442264 - DNA, 22 bp, Homo sapiens
gaatatgaccttatttggagat

SEQ ID NO: 7442265 - DNA, 22 bp, Homo sapiens
gaatatcttgtacatctaagta

SEQ ID NO: 7442266 - DNA, 22 bp, Homo sapiens
gaatatgagtgtccctgaggtc

SEQ ID NO: 7442267 - DNA, 22 bp, Homo sapiens
gaatatgaactattcctagccc

SEQ ID NO: 7442268 - DNA, 22 bp, Homo sapiens
gaatatgaccttatttggagat

SEQ ID NO: 7442269 - DNA, 22 bp, Homo sapiens
gaatatgtgcatttatgagtgt

SEQ ID NO: 7442270 - DNA, 22 bp, Homo sapiens
gaatatgttctggaagttcttg

SEQ ID NO: 7442271 - DNA, 22 bp, Homo sapiens
gaatatgttctggaagttcttg

SEQ ID NO: 7442272 - DNA, 22 bp, Homo sapiens
gaatatgtttgacatttagttg

SEQ ID NO: 7442273 - DNA, 22 bp, Homo sapiens
gaatatgttctggaagttcttg

SEQ ID NO: 7442274 - DNA, 18 bp, Homo sapiens
gaatatctagcacatagt

SEQ ID NO: 7442275 - DNA, 22 bp, Homo sapiens
gaatatcccgctatgcaaagta

SEQ ID NO: 7442276 - DNA, 18 bp, Homo sapiens
gaatatctagcacatagt

SEQ ID NO: 7442277 - DNA, 22 bp, Homo sapiens
gaatatctgggagtgggaagct

SEQ ID NO: 7442278 - DNA, 22 bp, Homo sapiens
gaatatctgggagtgggaagct

SEQ ID NO: 7442279 - DNA, 22 bp, Homo sapiens
gaatatcccgctatgcaaagta

SEQ ID NO: 7442280 - DNA, 22 bp, Homo sapiens
gaatatcccgctatgcaaagta

SEQ ID NO: 7442281 - DNA, 22 bp, Homo sapiens
gaatatcccgctatgcaaagta

SEQ ID NO: 7442282 - DNA, 22 bp, Homo sapiens
gaatatcccgctatgcaaagta

SEQ ID NO: 7442283 - DNA, 22 bp, Homo sapiens
gaatatcccgctatgcaaagta

SEQ ID NO: 7442284 - DNA, 22 bp, Homo sapiens
gaatatcccgctatgcaaagta

SEQ ID NO: 7442285 - DNA, 22 bp, Homo sapiens
gaatatatttctcttaccttta

SEQ ID NO: 7442286 - DNA, 22 bp, Homo sapiens
gaatatcccgctatgcaaagta

SEQ ID NO: 7442287 - DNA, 22 bp, Homo sapiens
gaatatcccgctatgcaaagta

SEQ ID NO: 7442288 - DNA, 22 bp, Homo sapiens
gaatatcccgctatgcaaagta

SEQ ID NO: 7442289 - DNA, 22 bp, Homo sapiens
gaatatatttctcttaccttta

SEQ ID NO: 7442290 - DNA, 22 bp, Homo sapiens
gaatatatttctcttaccttta

SEQ ID NO: 7442291 - DNA, 22 bp, Homo sapiens
gaatatatttctcttaccttta

SEQ ID NO: 7442292 - DNA, 22 bp, Homo sapiens
gaatacattggaaatcagaata

SEQ ID NO: 7442293 - DNA, 22 bp, Homo sapiens
gaatacattggaaatcagaata

SEQ ID NO: 7442294 - DNA, 22 bp, Homo sapiens
gaatacattggaaatcagaata

SEQ ID NO: 7442295 - DNA, 22 bp, Homo sapiens
gaatacattggaaatcagaata

SEQ ID NO: 7442296 - DNA, 22 bp, Homo sapiens
gaatacatttgccgtggttctc

SEQ ID NO: 7442297 - DNA, 22 bp, Homo sapiens
gaatacctggtcccacatctca

SEQ ID NO: 7442298 - DNA, 22 bp, Homo sapiens
gaatacatttgccgtggttctc

SEQ ID NO: 7442299 - DNA, 22 bp, Homo sapiens
gaatacatttgccgtggttctc

SEQ ID NO: 7442300 - DNA, 22 bp, Homo sapiens
gaatacatttgccgtggttctc

SEQ ID NO: 7442301 - DNA, 22 bp, Homo sapiens
gaatactgacactcaggtggga

SEQ ID NO: 7442302 - DNA, 22 bp, Homo sapiens
gaatactgacactcaggtggga

SEQ ID NO: 7442303 - DNA, 18 bp, Homo sapiens
gaatactgagagcacaaa

SEQ ID NO: 7442304 - DNA, 18 bp, Homo sapiens
gaatactgagagcacaaa

SEQ ID NO: 7442305 - DNA, 22 bp, Homo sapiens
gaatactgatgctcagccccct

SEQ ID NO: 7442306 - DNA, 22 bp, Homo sapiens
gaatactgatgctcagccccct

SEQ ID NO: 7442307 - DNA, 18 bp, Homo sapiens
gaatactgagagcacaaa

SEQ ID NO: 7442308 - DNA, 22 bp, Homo sapiens
gaatactggaaaactcatttta

SEQ ID NO: 7442309 - DNA, 22 bp, Homo sapiens
gaatactggaaaactcatttta

SEQ ID NO: 7442310 - DNA, 22 bp, Homo sapiens
gaatacttgggtctggagtcaa

SEQ ID NO: 7442311 - DNA, 22 bp, Homo sapiens
gaatacttttgttaggaaaacg

SEQ ID NO: 7442312 - DNA, 22 bp, Homo sapiens
gaatacttgggtctggagtcaa

SEQ ID NO: 7442313 - DNA, 22 bp, Homo sapiens
gaatacttttgttaggaaaacg

SEQ ID NO: 7442314 - DNA, 22 bp, Homo sapiens
gaatacatgtgtgtatagaggt

SEQ ID NO: 7442315 - DNA, 22 bp, Homo sapiens
gaatacatgtgtgtatagaggt

SEQ ID NO: 7442316 - DNA, 22 bp, Homo sapiens
gaatacatgtgtgtatagaggt

SEQ ID NO: 7442317 - DNA, 22 bp, Homo sapiens
gaatacatgtgtgtatagaggt

SEQ ID NO: 7442318 - DNA, 22 bp, Homo sapiens
gaatacatgtgtgtatagaggt

SEQ ID NO: 7442319 - DNA, 22 bp, Homo sapiens
gaatacattggaaatcagaata

SEQ ID NO: 7442320 - DNA, 22 bp, Homo sapiens
gaatacattggaaatcagaata

SEQ ID NO: 7442321 - DNA, 22 bp, Homo sapiens
gaatacattggaaatcagaata

SEQ ID NO: 7442322 - DNA, 22 bp, Homo sapiens
gaatacattggaaatcagaata

SEQ ID NO: 7442323 - DNA, 22 bp, Homo sapiens
gaatacattggaaatcagaata

SEQ ID NO: 7442324 - DNA, 22 bp, Homo sapiens
gaatacatgttgtttccctgga

SEQ ID NO: 7442325 - DNA, 22 bp, Homo sapiens
gaatacatgttgtttccctgga

SEQ ID NO: 7442326 - DNA, 22 bp, Homo sapiens
gaatacatgattaaagtttgat

SEQ ID NO: 7442327 - DNA, 22 bp, Homo sapiens
gaatacatgattaaagtttgat

SEQ ID NO: 7442328 - DNA, 22 bp, Homo sapiens
gaatacatgattaaagtttgat

SEQ ID NO: 7442329 - DNA, 22 bp, Homo sapiens
gaatacatgcacgacacggggg

SEQ ID NO: 7442330 - DNA, 22 bp, Homo sapiens
gaatacatgcacgacacggggg

SEQ ID NO: 7442331 - DNA, 22 bp, Homo sapiens
gaatacatgtgtgtatagaggt

SEQ ID NO: 7442332 - DNA, 22 bp, Homo sapiens
gaatacatgtgtgtatagaggt

SEQ ID NO: 7442333 - DNA, 22 bp, Homo sapiens
gaatacatgtgtgtatagaggt

SEQ ID NO: 7442334 - DNA, 22 bp, Homo sapiens
gaatacatggcagggagtcatc

SEQ ID NO: 7442335 - DNA, 22 bp, Homo sapiens
gaatacatggcagggagtcatc

SEQ ID NO: 7442336 - DNA, 22 bp, Homo sapiens
gaatacatggcagggagtcatc

SEQ ID NO: 7442337 - DNA, 22 bp, Homo sapiens
gaatatattggtgaaaatagtt

SEQ ID NO: 7442338 - DNA, 22 bp, Homo sapiens
gaatatattggtgaaaatagtt

SEQ ID NO: 7442339 - DNA, 22 bp, Homo sapiens
gaatatattggtgaaaatagtt

SEQ ID NO: 7442340 - DNA, 22 bp, Homo sapiens
gaatatattggtgaaaatagtt

SEQ ID NO: 7442341 - DNA, 22 bp, Homo sapiens
gaatatattggtgaaaatagtt

SEQ ID NO: 7442342 - DNA, 22 bp, Homo sapiens
gaatatattggtgaaaatagtt

SEQ ID NO: 7442343 - DNA, 22 bp, Homo sapiens
gaatatatttctcttaccttta

SEQ ID NO: 7442344 - DNA, 22 bp, Homo sapiens
gaatatattggtgaaaatagtt

SEQ ID NO: 7442345 - DNA, 22 bp, Homo sapiens
gaatatattggtgaaaatagtt

SEQ ID NO: 7442346 - DNA, 22 bp, Homo sapiens
gaatatattggtgaaaatagtt

SEQ ID NO: 7442347 - DNA, 22 bp, Homo sapiens
gaatatattggtgaaaatagtt

SEQ ID NO: 7442348 - DNA, 22 bp, Homo sapiens
gaatatattattcagcttttca

SEQ ID NO: 7442349 - DNA, 22 bp, Homo sapiens
gaatatattattcagcttttca

SEQ ID NO: 7442350 - DNA, 22 bp, Homo sapiens
gaatatattattcagcttttca

SEQ ID NO: 7442351 - DNA, 21 bp, Homo sapiens
gaatagttctgtggcagcagt

SEQ ID NO: 7442352 - DNA, 22 bp, Homo sapiens
gaatatattattcagcttttca

SEQ ID NO: 7442353 - DNA, 22 bp, Homo sapiens
gaatatattattcagcttttca

SEQ ID NO: 7442354 - DNA, 22 bp, Homo sapiens
gaatatattggtgaaaatagtt

SEQ ID NO: 7442355 - DNA, 22 bp, Homo sapiens
gaatatattggtgaaaatagtt

SEQ ID NO: 7442356 - DNA, 21 bp, Homo sapiens
gaataggaacctgatcatggg

SEQ ID NO: 7442357 - DNA, 22 bp, Homo sapiens
gaatagttctatggctgcaggg

SEQ ID NO: 7442358 - DNA, 22 bp, Homo sapiens
gaatagcttgacaattattttt

SEQ ID NO: 7442359 - DNA, 22 bp, Homo sapiens
gaatagctgtaggctagtgtct

SEQ ID NO: 7442360 - DNA, 22 bp, Homo sapiens
gaatagattagaaagagtatgt

SEQ ID NO: 7442361 - DNA, 22 bp, Homo sapiens
gaatagattatacttgaagcat

SEQ ID NO: 7442362 - DNA, 22 bp, Homo sapiens
gaatagatgaaagtgtctctta

SEQ ID NO: 7442363 - DNA, 22 bp, Homo sapiens
gaatagatcctcatttattgat

SEQ ID NO: 7442364 - DNA, 22 bp, Homo sapiens
gaatagatcctcatttattgat

SEQ ID NO: 7442365 - DNA, 22 bp, Homo sapiens
gaatagatatccttgagggtct

SEQ ID NO: 7442366 - DNA, 22 bp, Homo sapiens
gaatagatagcttggatggttg

SEQ ID NO: 7442367 - DNA, 22 bp, Homo sapiens
gaatacttttgttaggaaaacg

SEQ ID NO: 7442368 - DNA, 22 bp, Homo sapiens
gaatagataagtgactatttgg

SEQ ID NO: 7442369 - DNA, 22 bp, Homo sapiens
gaaggaaaggtctcatgccttt

SEQ ID NO: 7442370 - DNA, 22 bp, Homo sapiens
gaaggaaaggtctcatgccttt

SEQ ID NO: 7442371 - DNA, 22 bp, Homo sapiens
gaaggaaaggtctcatgccttt

SEQ ID NO: 7442372 - DNA, 22 bp, Homo sapiens
gaaggaaaggtctcatgccttt

SEQ ID NO: 7442373 - DNA, 22 bp, Homo sapiens
gaaggaaaggtctcatgccttt

SEQ ID NO: 7442374 - DNA, 22 bp, Homo sapiens
gaaggaaatctgtgatttatgc

SEQ ID NO: 7442375 - DNA, 22 bp, Homo sapiens
gaaggaaatctgtgatttatgc

SEQ ID NO: 7442376 - DNA, 22 bp, Homo sapiens
gaaggaaaggtctcatgccttt

SEQ ID NO: 7442377 - DNA, 22 bp, Homo sapiens
gaaggaaatctgtgatttatgc

SEQ ID NO: 7442378 - DNA, 22 bp, Homo sapiens
gaaggaaatctgtgatttatgc

SEQ ID NO: 7442379 - DNA, 22 bp, Homo sapiens
gaaggaaatctgtgatttatgc

SEQ ID NO: 7442380 - DNA, 22 bp, Homo sapiens
gaaggaaatctgtgatttatgc

SEQ ID NO: 7442381 - DNA, 22 bp, Homo sapiens
gaaggaagattctgttggaatc

SEQ ID NO: 7442382 - DNA, 22 bp, Homo sapiens
gaaggaagactggtttaaatgt

SEQ ID NO: 7442383 - DNA, 22 bp, Homo sapiens
gaaggaagattctgttggaatc

SEQ ID NO: 7442384 - DNA, 22 bp, Homo sapiens
gaaggaagattctgttggaatc

SEQ ID NO: 7442385 - DNA, 22 bp, Homo sapiens
gaagttctgaaataaaatcctg

SEQ ID NO: 7442386 - DNA, 22 bp, Homo sapiens
gaagttctgaccatatggccaa

SEQ ID NO: 7442387 - DNA, 22 bp, Homo sapiens
gaagttctgaccatatggccaa

SEQ ID NO: 7442388 - DNA, 22 bp, Homo sapiens
gaagttctgggagtggcgccct

SEQ ID NO: 7442389 - DNA, 22 bp, Homo sapiens
gaagttctgggatttccacagt

SEQ ID NO: 7442390 - DNA, 22 bp, Homo sapiens
gaagttgatatctactctcatg

SEQ ID NO: 7442391 - DNA, 22 bp, Homo sapiens
gaagttgatagagtacatgatt

SEQ ID NO: 7442392 - DNA, 22 bp, Homo sapiens
gaagtttacctctgccttgctt

SEQ ID NO: 7442393 - DNA, 22 bp, Homo sapiens
gaagtttagaagtgacaggttt

SEQ ID NO: 7442394 - DNA, 22 bp, Homo sapiens
gaagtttagaagtgacaggttt

SEQ ID NO: 7442395 - DNA, 22 bp, Homo sapiens
gaagtttagaagtgacaggttt

SEQ ID NO: 7442396 - DNA, 22 bp, Homo sapiens
gaagtttagagtgttgtaattt

SEQ ID NO: 7442397 - DNA, 22 bp, Homo sapiens
gaagtttagagtgttgtaattt

SEQ ID NO: 7442398 - DNA, 22 bp, Homo sapiens
gaagtttagagtgttgtaattt

SEQ ID NO: 7442399 - DNA, 23 bp, Homo sapiens
gaagttctttcttctcatgctgt

SEQ ID NO: 7442400 - DNA, 22 bp, Homo sapiens
gaagttcttatgaaaacttgag

SEQ ID NO: 7442401 - DNA, 22 bp, Homo sapiens
gaagttctttatagcagtgtga

SEQ ID NO: 7442402 - DNA, 23 bp, Homo sapiens
gaagttctgttcagccagacaag

SEQ ID NO: 7442403 - DNA, 22 bp, Homo sapiens
gaagttcttagtctcatttgca

SEQ ID NO: 7442404 - DNA, 22 bp, Homo sapiens
gaagttctggtgtatgtgataa

SEQ ID NO: 7442405 - DNA, 22 bp, Homo sapiens
gaagttcttagtctcatttgca

SEQ ID NO: 7442406 - DNA, 22 bp, Homo sapiens
gaagctttgtcttgtctcctgg

SEQ ID NO: 7442407 - DNA, 22 bp, Homo sapiens
gaagctttgagagcagaagccc

SEQ ID NO: 7442408 - DNA, 22 bp, Homo sapiens
gaaggaaaaatactctgtaagg

SEQ ID NO: 7442409 - DNA, 22 bp, Homo sapiens
gaaggaaaaatactctgtaagg

SEQ ID NO: 7442410 - DNA, 22 bp, Homo sapiens
gaaggaaaaatactctgtaagg

SEQ ID NO: 7442411 - DNA, 22 bp, Homo sapiens
gaaggaaaaatactctgtaagg

SEQ ID NO: 7442412 - DNA, 22 bp, Homo sapiens
gaaggaaaaatactctgtaagg

SEQ ID NO: 7442413 - DNA, 22 bp, Homo sapiens
gaaggaaaaatactctgtaagg

SEQ ID NO: 7442414 - DNA, 22 bp, Homo sapiens
gaaggaaaaatactctgtaagg

SEQ ID NO: 7442415 - DNA, 22 bp, Homo sapiens
gaaggaaaacagatctgcctga

SEQ ID NO: 7442416 - DNA, 22 bp, Homo sapiens
gaaggaaaacagatctgcctga

SEQ ID NO: 7442417 - DNA, 22 bp, Homo sapiens
gaaggaaaacagatctgcctga

SEQ ID NO: 7442418 - DNA, 22 bp, Homo sapiens
gaaggaaaacagatctgcctga

SEQ ID NO: 7442419 - DNA, 22 bp, Homo sapiens
gaaggaaaacagatctgcctga

SEQ ID NO: 7442420 - DNA, 22 bp, Homo sapiens
gaaggaaaacagatctgcctga

SEQ ID NO: 7442421 - DNA, 22 bp, Homo sapiens
gaaggaaaacagatctgcctga

SEQ ID NO: 7442422 - DNA, 22 bp, Homo sapiens
gaaggaaaacagatctgcctga

SEQ ID NO: 7442423 - DNA, 22 bp, Homo sapiens
gaagcctcaacatctctgcgtc

SEQ ID NO: 7442424 - DNA, 22 bp, Homo sapiens
gaagcctcaacatctctgcgtc

SEQ ID NO: 7442425 - DNA, 22 bp, Homo sapiens
gaagcctcaacatctctgcgtc

SEQ ID NO: 7442426 - DNA, 22 bp, Homo sapiens
gaagcctcaacatctctgcgtc

SEQ ID NO: 7442427 - DNA, 22 bp, Homo sapiens
gaagcctcattgacctccactg

SEQ ID NO: 7442428 - DNA, 19 bp, Homo sapiens
gaagcctgaaataaagtga

SEQ ID NO: 7442429 - DNA, 22 bp, Homo sapiens
gaagcctgaacatttttgtcag

SEQ ID NO: 7442430 - DNA, 22 bp, Homo sapiens
gaagctgtgttgatggcatgga

SEQ ID NO: 7442431 - DNA, 22 bp, Homo sapiens
gaagctgtgttgatggcatgga

SEQ ID NO: 7442432 - DNA, 22 bp, Homo sapiens
gaagcctcaacatctctgcgtc

SEQ ID NO: 7442433 - DNA, 22 bp, Homo sapiens
gaagctttgagagcagaagccc

SEQ ID NO: 7442434 - DNA, 22 bp, Homo sapiens
gaagcttggtgttgtcttaagt

SEQ ID NO: 7442435 - DNA, 22 bp, Homo sapiens
gaagctttattgcaagtgaggc

SEQ ID NO: 7442436 - DNA, 22 bp, Homo sapiens
gaagcttgaacagggccaggct

SEQ ID NO: 7442437 - DNA, 22 bp, Homo sapiens
gaagcttgagaactactgtcct

SEQ ID NO: 7442438 - DNA, 22 bp, Homo sapiens
gaagcttgaacagggccaggct

SEQ ID NO: 7442439 - DNA, 22 bp, Homo sapiens
gaagcttcgaaagagtgatttc

SEQ ID NO: 7442440 - DNA, 22 bp, Homo sapiens
gaagcttcgtggctcttcaaat

SEQ ID NO: 7442441 - DNA, 22 bp, Homo sapiens
gaagtttttgtagagacagggt

SEQ ID NO: 7442442 - DNA, 22 bp, Homo sapiens
gaataaactcctcagcttcctt

SEQ ID NO: 7442443 - DNA, 22 bp, Homo sapiens
gaagttttctgaggctgtagct

SEQ ID NO: 7442444 - DNA, 22 bp, Homo sapiens
gaagttttctgaggctgtagct

SEQ ID NO: 7442445 - DNA, 22 bp, Homo sapiens
gaagttttagtcaaaatgtaga

SEQ ID NO: 7442446 - DNA, 22 bp, Homo sapiens
gaagttttagtcaaaatgtaga

SEQ ID NO: 7442447 - DNA, 22 bp, Homo sapiens
gaagttttagtcaaaatgtaga

SEQ ID NO: 7442448 - DNA, 22 bp, Homo sapiens
gaagtttgatttttctcctaga

SEQ ID NO: 7442449 - DNA, 22 bp, Homo sapiens
gaataacagcaagtttgcaggc

SEQ ID NO: 7442450 - DNA, 22 bp, Homo sapiens
gaataaactcctcagcttcctt

SEQ ID NO: 7442451 - DNA, 22 bp, Homo sapiens
gaataacagcaagtttgcaggc

SEQ ID NO: 7442452 - DNA, 22 bp, Homo sapiens
gaataacattggaaccctgaag

SEQ ID NO: 7442453 - DNA, 22 bp, Homo sapiens
gaataacattttttcctttaca

SEQ ID NO: 7442454 - DNA, 22 bp, Homo sapiens
gaatacaagccaggcacaaggc

SEQ ID NO: 7442455 - DNA, 22 bp, Homo sapiens
gaagtttatttcaatctattca

SEQ ID NO: 7442456 - DNA, 22 bp, Homo sapiens
gaagtttatttcaatctattca

SEQ ID NO: 7442457 - DNA, 22 bp, Homo sapiens
gaagtttatggtgcttgtaagg

SEQ ID NO: 7442458 - DNA, 22 bp, Homo sapiens
gaagtttatggtgcttgtaagg

SEQ ID NO: 7442459 - DNA, 22 bp, Homo sapiens
gaagtttatggtgcttgtaagg

SEQ ID NO: 7442460 - DNA, 22 bp, Homo sapiens
gaagtttattttacacatccat

SEQ ID NO: 7442461 - DNA, 22 bp, Homo sapiens
gaagtttattttacacatccat

SEQ ID NO: 7442462 - DNA, 22 bp, Homo sapiens
gaagtttattttacacatccat

SEQ ID NO: 7442463 - DNA, 22 bp, Homo sapiens
gaagtttagagtgttgtaattt

SEQ ID NO: 7442464 - DNA, 22 bp, Homo sapiens
gaagtttagagtgttgtaattt

SEQ ID NO: 7442465 - DNA, 22 bp, Homo sapiens
gaagtttagagtgttgtaattt

SEQ ID NO: 7442466 - DNA, 22 bp, Homo sapiens
gaagtttagagtgttgtaattt

SEQ ID NO: 7442467 - DNA, 22 bp, Homo sapiens
gaagtttaggttcttatgttta

SEQ ID NO: 7442468 - DNA, 22 bp, Homo sapiens
gaagtttagagtttggagtcct

SEQ ID NO: 7442469 - DNA, 22 bp, Homo sapiens
gaagtttagagtttggagtcct

SEQ ID NO: 7442470 - DNA, 22 bp, Homo sapiens
gaagtttaggttcttatgttta

SEQ ID NO: 7442471 - DNA, 22 bp, Homo sapiens
gaatacatatcagatgtgtttc

SEQ ID NO: 7442472 - DNA, 22 bp, Homo sapiens
gaatacaggcaggtggctgtgc

SEQ ID NO: 7442473 - DNA, 22 bp, Homo sapiens
gaatacatatcagatgtgtttc

SEQ ID NO: 7442474 - DNA, 22 bp, Homo sapiens
gaatacatatcagatgtgtttc

SEQ ID NO: 7442475 - DNA, 22 bp, Homo sapiens
gaatacatatcagatgtgtttc

SEQ ID NO: 7442476 - DNA, 22 bp, Homo sapiens
gaatacatatcagatgtgtttc

SEQ ID NO: 7442477 - DNA, 19 bp, Homo sapiens
gaatacagataataagcag

SEQ ID NO: 7442478 - DNA, 22 bp, Homo sapiens
gaatacatgatacatgaactgc

SEQ ID NO: 7442479 - DNA, 22 bp, Homo sapiens
gaatacatgatacatgaactgc

SEQ ID NO: 7442480 - DNA, 22 bp, Homo sapiens
gaatacatgatacatgaactgc

SEQ ID NO: 7442481 - DNA, 22 bp, Homo sapiens
gaatacatgatacatgaactgc

SEQ ID NO: 7442482 - DNA, 22 bp, Homo sapiens
gaatacatgatacatgaactgc

SEQ ID NO: 7442483 - DNA, 22 bp, Homo sapiens
gaatacatgaaccctcctgtgg

SEQ ID NO: 7442484 - DNA, 22 bp, Homo sapiens
gaatacatctgaaggctatgaa

SEQ ID NO: 7442485 - DNA, 22 bp, Homo sapiens
gaatacatccagagcagggctg

SEQ ID NO: 7442486 - DNA, 22 bp, Homo sapiens
gaatacatccagagcagggctg

SEQ ID NO: 7442487 - DNA, 22 bp, Homo sapiens
gaatacatctgaaggctatgaa

SEQ ID NO: 7442488 - DNA, 22 bp, Homo sapiens
gaatacatctgaaggctatgaa

SEQ ID NO: 7442489 - DNA, 22 bp, Homo sapiens
gaatacatgaaccctcctgtgg

SEQ ID NO: 7442490 - DNA, 23 bp, Homo sapiens
gaatacagagataaatagaacac

SEQ ID NO: 7442491 - DNA, 23 bp, Homo sapiens
gaatacagagataaatagaacac

SEQ ID NO: 7442492 - DNA, 19 bp, Homo sapiens
gaatacagataataagcag

SEQ ID NO: 7442493 - DNA, 23 bp, Homo sapiens
gaatacagagataaatagaacac

SEQ ID NO: 7442494 - DNA, 22 bp, Homo sapiens
gaatacacgcacgacacggggg

SEQ ID NO: 7442495 - DNA, 22 bp, Homo sapiens
gaatacacgcacgacacggggg

SEQ ID NO: 7442496 - DNA, 22 bp, Homo sapiens
gaatacacgaatagagcatggt

SEQ ID NO: 7442497 - DNA, 22 bp, Homo sapiens
gaatacacgaatagagcatggt

SEQ ID NO: 7442498 - DNA, 22 bp, Homo sapiens
gaatacacgaaggcaagagtcc

SEQ ID NO: 7442499 - DNA, 22 bp, Homo sapiens
gaatacaccaaggaatcagaat

SEQ ID NO: 7442500 - DNA, 22 bp, Homo sapiens
gaatacacgaaggcaagagtcc

SEQ ID NO: 7442501 - DNA, 22 bp, Homo sapiens
gaatacacgaaggcaagagtcc

SEQ ID NO: 7442502 - DNA, 22 bp, Homo sapiens
gaatacacgaatagagcatggt

SEQ ID NO: 7442503 - DNA, 22 bp, Homo sapiens
gaatacaccaaggaatcagaat

SEQ ID NO: 7442504 - DNA, 22 bp, Homo sapiens
gaatacaagcctgccacctgga

SEQ ID NO: 7442505 - DNA, 22 bp, Homo sapiens
gaatacaccaaggaatcagaat

SEQ ID NO: 7442506 - DNA, 22 bp, Homo sapiens
gaatacaccaaggaatcagaat

SEQ ID NO: 7442507 - DNA, 22 bp, Homo sapiens
gaatacaagcctgccacctgga

SEQ ID NO: 7442508 - DNA, 22 bp, Homo sapiens
gaatacaagcctgccacctgga

SEQ ID NO: 7442509 - DNA, 22 bp, Homo sapiens
gaatacaagcctgccacctgga

SEQ ID NO: 7442510 - DNA, 22 bp, Homo sapiens
gaatacaagcctgccacctgga

SEQ ID NO: 7442511 - DNA, 22 bp, Homo sapiens
gaatacaagccaggcacaaggc

SEQ ID NO: 7442512 - DNA, 22 bp, Homo sapiens
gaatacaagcctgccacctgga

SEQ ID NO: 7442513 - DNA, 22 bp, Homo sapiens
gaatacaagcctgccacctgga

SEQ ID NO: 7442514 - DNA, 22 bp, Homo sapiens
gaatacaagccaggcacaaggc

SEQ ID NO: 7442515 - DNA, 22 bp, Homo sapiens
gaatacaagccaggcacaaggc

SEQ ID NO: 7442516 - DNA, 22 bp, Homo sapiens
gaatacaagccaggcacaaggc

SEQ ID NO: 7442517 - DNA, 22 bp, Homo sapiens
gaatacaagccaggcacaaggc

SEQ ID NO: 7442518 - DNA, 22 bp, Homo sapiens
gaatacaagccaggcacaaggc

SEQ ID NO: 7442519 - DNA, 22 bp, Homo sapiens
gaatacaagccaggcacaaggc

SEQ ID NO: 7442520 - DNA, 22 bp, Homo sapiens
gacaaggcgcccagcctgccaa

SEQ ID NO: 7442521 - DNA, 22 bp, Homo sapiens
gacaaggcgcccagcctgccaa

SEQ ID NO: 7442522 - DNA, 22 bp, Homo sapiens
gacaagggttctgcagagcctg

SEQ ID NO: 7442523 - DNA, 22 bp, Homo sapiens
gacaaggcgcccagcctgccaa

SEQ ID NO: 7442524 - DNA, 22 bp, Homo sapiens
gacaaggcgcccagcctgccaa

SEQ ID NO: 7442525 - DNA, 22 bp, Homo sapiens
gacaaggcaaccagggaggctt

SEQ ID NO: 7442526 - DNA, 22 bp, Homo sapiens
gacaaggcaaccagggaggctt

SEQ ID NO: 7442527 - DNA, 22 bp, Homo sapiens
gacaagctcttgtttcatggtt

SEQ ID NO: 7442528 - DNA, 22 bp, Homo sapiens
gacaaggagccaccagtcacgt

SEQ ID NO: 7442529 - DNA, 22 bp, Homo sapiens
gacaagtcatctggggcctgtg

SEQ ID NO: 7442530 - DNA, 22 bp, Homo sapiens
gacaagtgatgattataattca

SEQ ID NO: 7442531 - DNA, 22 bp, Homo sapiens
gacaagggttctgcagagcctg

SEQ ID NO: 7442532 - DNA, 22 bp, Homo sapiens
gacaagggttctgcagagcctg

SEQ ID NO: 7442533 - DNA, 22 bp, Homo sapiens
gacaagtgggctgcagcttttg

SEQ ID NO: 7442534 - DNA, 22 bp, Homo sapiens
gacaagtgggctgcagcttttg

SEQ ID NO: 7442535 - DNA, 22 bp, Homo sapiens
gacaagttacacctgtgcttga

SEQ ID NO: 7442536 - DNA, 22 bp, Homo sapiens
gacaagtgctgatttatctccc

SEQ ID NO: 7442537 - DNA, 16 bp, Homo sapiens
gacaagtggaggggcc

SEQ ID NO: 7442538 - DNA, 22 bp, Homo sapiens
gacaagtgcatgatttctatct

SEQ ID NO: 7442539 - DNA, 22 bp, Homo sapiens
gacaagtgcccattattcttta

SEQ ID NO: 7442540 - DNA, 22 bp, Homo sapiens
gacaataaaatgatcttacagt

SEQ ID NO: 7442541 - DNA, 22 bp, Homo sapiens
gacaataaaatgatcttacagt

SEQ ID NO: 7442542 - DNA, 22 bp, Homo sapiens
gacacagaaggtcacatgttca

SEQ ID NO: 7442543 - DNA, 22 bp, Homo sapiens
gacacagaaggtcacatgttca

SEQ ID NO: 7442544 - DNA, 22 bp, Homo sapiens
gacacagaaggtcacatgttca

SEQ ID NO: 7442545 - DNA, 22 bp, Homo sapiens
gacacagaaggtcacatgttca

SEQ ID NO: 7442546 - DNA, 22 bp, Homo sapiens
gacacagaaggtcacatgttca

SEQ ID NO: 7442547 - DNA, 22 bp, Homo sapiens
gacacagaatgggtgctcagta

SEQ ID NO: 7442548 - DNA, 22 bp, Homo sapiens
gacacagaatgggtgctcagta

SEQ ID NO: 7442549 - DNA, 22 bp, Homo sapiens
gacacagaattcccctccaagt

SEQ ID NO: 7442550 - DNA, 22 bp, Homo sapiens
gacaggccccctcaggactgat

SEQ ID NO: 7442551 - DNA, 22 bp, Homo sapiens
gacaggccccctcaggactgat

SEQ ID NO: 7442552 - DNA, 22 bp, Homo sapiens
gacaggccccctcaggactgat

SEQ ID NO: 7442553 - DNA, 22 bp, Homo sapiens
gacaggccccctcaggactgat

SEQ ID NO: 7442554 - DNA, 22 bp, Homo sapiens
gacaggccaggggctgaggtgg

SEQ ID NO: 7442555 - DNA, 22 bp, Homo sapiens
gacaggccaggggctgaggtgg

SEQ ID NO: 7442556 - DNA, 22 bp, Homo sapiens
gacaggccaggggctgaggtgg

SEQ ID NO: 7442557 - DNA, 22 bp, Homo sapiens
gacaggccaggggctgaggtgg

SEQ ID NO: 7442558 - DNA, 22 bp, Homo sapiens
gacaggccaggggctgaggtgg

SEQ ID NO: 7442559 - DNA, 22 bp, Homo sapiens
gacacagagataggcctgtgtt

SEQ ID NO: 7442560 - DNA, 22 bp, Homo sapiens
gacaggctaggttgctgtcctc

SEQ ID NO: 7442561 - DNA, 17 bp, Homo sapiens
gacaggctcagtgacga

SEQ ID NO: 7442562 - DNA, 22 bp, Homo sapiens
gacaggctaggttgctgtcctc

SEQ ID NO: 7442563 - DNA, 22 bp, Homo sapiens
gacaggctaggttgctgtcctc

SEQ ID NO: 7442564 - DNA, 22 bp, Homo sapiens
gacaggcccgagtagctgatga

SEQ ID NO: 7442565 - DNA, 22 bp, Homo sapiens
gacaggccccctcaggactgat

SEQ ID NO: 7442566 - DNA, 22 bp, Homo sapiens
gacaggcccgagtagctgatga

SEQ ID NO: 7442567 - DNA, 22 bp, Homo sapiens
gacaggcccgagtagctgatga

SEQ ID NO: 7442568 - DNA, 22 bp, Homo sapiens
gacaggcccgagtagctgatga

SEQ ID NO: 7442569 - DNA, 22 bp, Homo sapiens
gacaggcctagattcactgctg

SEQ ID NO: 7442570 - DNA, 22 bp, Homo sapiens
gacaggcctagattcactgctg

SEQ ID NO: 7442571 - DNA, 22 bp, Homo sapiens
gacacagacagttagaggtaat

SEQ ID NO: 7442572 - DNA, 22 bp, Homo sapiens
gacacagacagttagaggtaat

SEQ ID NO: 7442573 - DNA, 22 bp, Homo sapiens
gacacagacagttagaggtaat

SEQ ID NO: 7442574 - DNA, 22 bp, Homo sapiens
gacacagacagttagaggtaat

SEQ ID NO: 7442575 - DNA, 22 bp, Homo sapiens
gacacagacagttagaggtaat

SEQ ID NO: 7442576 - DNA, 22 bp, Homo sapiens
gacacagaattcccctccaagt

SEQ ID NO: 7442577 - DNA, 22 bp, Homo sapiens
gacacagaatttactcccgata

SEQ ID NO: 7442578 - DNA, 22 bp, Homo sapiens
gacacagaatttactcccgata

SEQ ID NO: 7442579 - DNA, 22 bp, Homo sapiens
gacacagagataggcctgtgtt

SEQ ID NO: 7442580 - DNA, 22 bp, Homo sapiens
gacacagagacttgcagttgta

SEQ ID NO: 7442581 - DNA, 22 bp, Homo sapiens
gacacagagacttgcagttgta

SEQ ID NO: 7442582 - DNA, 22 bp, Homo sapiens
gacacagaccaccaggccctgg

SEQ ID NO: 7442583 - DNA, 22 bp, Homo sapiens
gacacagaccaccaggccctgg

SEQ ID NO: 7442584 - DNA, 22 bp, Homo sapiens
gacacagagacttgcagttgta

SEQ ID NO: 7442585 - DNA, 22 bp, Homo sapiens
gacacagagacttgcagttgta

SEQ ID NO: 7442586 - DNA, 22 bp, Homo sapiens
gacaggggtccctctgggctgt

SEQ ID NO: 7442587 - DNA, 22 bp, Homo sapiens
gacaggggtccctctgggctgt

SEQ ID NO: 7442588 - DNA, 22 bp, Homo sapiens
gacaggggctttgcatgcttta

SEQ ID NO: 7442589 - DNA, 22 bp, Homo sapiens
gacaggggtccctctgggctgt

SEQ ID NO: 7442590 - DNA, 22 bp, Homo sapiens
gacaggggtccctctgggctgt

SEQ ID NO: 7442591 - DNA, 22 bp, Homo sapiens
gacaggggtccctctgggctgt

SEQ ID NO: 7442592 - DNA, 22 bp, Homo sapiens
gacaggggtccctctgggctgt

SEQ ID NO: 7442593 - DNA, 22 bp, Homo sapiens
gacaggggtccctctgggctgt

SEQ ID NO: 7442594 - DNA, 22 bp, Homo sapiens
gacaggggtccctctgggctgt

SEQ ID NO: 7442595 - DNA, 22 bp, Homo sapiens
gacaggggtccctctgggctgt

SEQ ID NO: 7442596 - DNA, 22 bp, Homo sapiens
gacaggggctttgcatgcttta

SEQ ID NO: 7442597 - DNA, 21 bp, Homo sapiens
gacaggggccatgggtttcta

SEQ ID NO: 7442598 - DNA, 21 bp, Homo sapiens
gacaggggccatgggtttcta

SEQ ID NO: 7442599 - DNA, 21 bp, Homo sapiens
gacaggggccatgggtttcta

SEQ ID NO: 7442600 - DNA, 21 bp, Homo sapiens
gacaggggccatgggtttcta

SEQ ID NO: 7442601 - DNA, 21 bp, Homo sapiens
gacaggggaagaagcaaggag

SEQ ID NO: 7442602 - DNA, 21 bp, Homo sapiens
gacaggggaagaagcaaggag

SEQ ID NO: 7442603 - DNA, 21 bp, Homo sapiens
gacaggggaagaagcaaggag

SEQ ID NO: 7442604 - DNA, 21 bp, Homo sapiens
gacaggggaagaagcaaggag

SEQ ID NO: 7442605 - DNA, 22 bp, Homo sapiens
gacagggctgtgggaggagcag

SEQ ID NO: 7442606 - DNA, 21 bp, Homo sapiens
gacaggggaagaagcaaggag

SEQ ID NO: 7442607 - DNA, 21 bp, Homo sapiens
gacaggggaagaagcaaggag

SEQ ID NO: 7442608 - DNA, 21 bp, Homo sapiens
gacaggggaagaagcaaggag

SEQ ID NO: 7442609 - DNA, 22 bp, Homo sapiens
gacagggctgtgggaggagcag

SEQ ID NO: 7442610 - DNA, 22 bp, Homo sapiens
gacagggctgtgggaggagcag

SEQ ID NO: 7442611 - DNA, 22 bp, Homo sapiens
gacagggctgtgggaggagcag

SEQ ID NO: 7442612 - DNA, 22 bp, Homo sapiens
gacagggctgtgggaggagcag

SEQ ID NO: 7442613 - DNA, 22 bp, Homo sapiens
gacagggctgtgggaggagcag

SEQ ID NO: 7442614 - DNA, 22 bp, Homo sapiens
gacagggctgtgggaggagcag

SEQ ID NO: 7442615 - DNA, 22 bp, Homo sapiens
gacagggctgtgggaggagcag

SEQ ID NO: 7442616 - DNA, 22 bp, Homo sapiens
gacagggctgtgggaggagcag

SEQ ID NO: 7442617 - DNA, 23 bp, Homo sapiens
gacagggctgacttggcagctgc

SEQ ID NO: 7442618 - DNA, 22 bp, Homo sapiens
gacagggacacagccagtgagg

SEQ ID NO: 7442619 - DNA, 22 bp, Homo sapiens
gacagggacacagccagtgagg

SEQ ID NO: 7442620 - DNA, 22 bp, Homo sapiens
gacagggacgaggcttcaggca

SEQ ID NO: 7442621 - DNA, 22 bp, Homo sapiens
gacagggaacttcattagctgt

SEQ ID NO: 7442622 - DNA, 22 bp, Homo sapiens
gacagggacacagccagtgagg

SEQ ID NO: 7442623 - DNA, 22 bp, Homo sapiens
gacagggacacagccagtgagg

SEQ ID NO: 7442624 - DNA, 22 bp, Homo sapiens
gacaggctattttcttacgggt

SEQ ID NO: 7442625 - DNA, 17 bp, Homo sapiens
gacaggctcagtgacga

SEQ ID NO: 7442626 - DNA, 22 bp, Homo sapiens
gacaggctggcaatgccctgct

SEQ ID NO: 7442627 - DNA, 22 bp, Homo sapiens
gacaggctggcaatgccctgct

SEQ ID NO: 7442628 - DNA, 22 bp, Homo sapiens
gacaggctggcaatgccctgct

SEQ ID NO: 7442629 - DNA, 22 bp, Homo sapiens
gacaggctgtgatggccgggag

SEQ ID NO: 7442630 - DNA, 22 bp, Homo sapiens
gacaggctgtgatggccgggag

SEQ ID NO: 7442631 - DNA, 22 bp, Homo sapiens
gacaggcttagggagggtgctc

SEQ ID NO: 7442632 - DNA, 22 bp, Homo sapiens
gacaggcttagggagggtgctc

SEQ ID NO: 7442633 - DNA, 22 bp, Homo sapiens
gacaggcttcatcctcagagtt

SEQ ID NO: 7442634 - DNA, 22 bp, Homo sapiens
gacaggcttcatcctcagagtt

SEQ ID NO: 7442635 - DNA, 22 bp, Homo sapiens
gacaggcttagggagggtgctc

SEQ ID NO: 7442636 - DNA, 22 bp, Homo sapiens
gacaggcttcatcctcagagtt

SEQ ID NO: 7442637 - DNA, 22 bp, Homo sapiens
gacaggcttagggagggtgctc

SEQ ID NO: 7442638 - DNA, 22 bp, Homo sapiens
gacaggctttctcaggatgagc

SEQ ID NO: 7442639 - DNA, 22 bp, Homo sapiens
gacaggctttctcaggatgagc

SEQ ID NO: 7442640 - DNA, 22 bp, Homo sapiens
gacaggcttcctaagtgccaga

SEQ ID NO: 7442641 - DNA, 22 bp, Homo sapiens
gacaggcttcctaagtgccaga

SEQ ID NO: 7442642 - DNA, 22 bp, Homo sapiens
gacaggcttcctaagtgccaga

SEQ ID NO: 7442643 - DNA, 22 bp, Homo sapiens
gacaggcttcctaagtgccaga

SEQ ID NO: 7442644 - DNA, 22 bp, Homo sapiens
gacaggcttcctaagtgccaga

SEQ ID NO: 7442645 - DNA, 22 bp, Homo sapiens
gacaggcttccactatgttgcc

SEQ ID NO: 7442646 - DNA, 22 bp, Homo sapiens
gacaggcttccactatgttgcc

SEQ ID NO: 7442647 - DNA, 22 bp, Homo sapiens
gacaggcttccactatgttgcc

SEQ ID NO: 7442648 - DNA, 22 bp, Homo sapiens
gacaggcttcatgatggcagga

SEQ ID NO: 7442649 - DNA, 22 bp, Homo sapiens
gacaggcttcatgatggcagga

SEQ ID NO: 7442650 - DNA, 22 bp, Homo sapiens
gacaggctttgagtcccagaac

SEQ ID NO: 7442651 - DNA, 22 bp, Homo sapiens
gacagggaaacattgaagtgtc

SEQ ID NO: 7442652 - DNA, 22 bp, Homo sapiens
gacagggaaacattgaagtgtc

SEQ ID NO: 7442653 - DNA, 22 bp, Homo sapiens
gacagggaaacattgaagtgtc

SEQ ID NO: 7442654 - DNA, 22 bp, Homo sapiens
gacagggaaacattgaagtgtc

SEQ ID NO: 7442655 - DNA, 22 bp, Homo sapiens
gacagggaacttcattagctgt

SEQ ID NO: 7442656 - DNA, 22 bp, Homo sapiens
gacagggaaacattgaagtgtc

SEQ ID NO: 7442657 - DNA, 22 bp, Homo sapiens
gacagggaaacattgaagtgtc

SEQ ID NO: 7442658 - DNA, 22 bp, Homo sapiens
gacctcagattttcccaggcca

SEQ ID NO: 7442659 - DNA, 22 bp, Homo sapiens
gacctatttaagtgtagttcaa

SEQ ID NO: 7442660 - DNA, 22 bp, Homo sapiens
gacctcagctgtggggatgctg

SEQ ID NO: 7442661 - DNA, 22 bp, Homo sapiens
gacctcagattttcccaggcca

SEQ ID NO: 7442662 - DNA, 22 bp, Homo sapiens
gacctcagattttcccaggcca

SEQ ID NO: 7442663 - DNA, 22 bp, Homo sapiens
gaccctttggaggtagtcacca

SEQ ID NO: 7442664 - DNA, 22 bp, Homo sapiens
gaccggttctgccgtggactgg

SEQ ID NO: 7442665 - DNA, 22 bp, Homo sapiens
gacccttggctgcagcatcaca

SEQ ID NO: 7442666 - DNA, 22 bp, Homo sapiens
gacccttagaatgtgatcttat

SEQ ID NO: 7442667 - DNA, 22 bp, Homo sapiens
gacccttagaatgtgatcttat

SEQ ID NO: 7442668 - DNA, 22 bp, Homo sapiens
gaccctgtttctacaaataatt

SEQ ID NO: 7442669 - DNA, 22 bp, Homo sapiens
gaccctgtttctacaaataatt

SEQ ID NO: 7442670 - DNA, 22 bp, Homo sapiens
gaccctggtgggcactggcacc

SEQ ID NO: 7442671 - DNA, 22 bp, Homo sapiens
gaccctggtgggcactggcacc

SEQ ID NO: 7442672 - DNA, 22 bp, Homo sapiens
gaccctggtgggcactggcacc

SEQ ID NO: 7442673 - DNA, 22 bp, Homo sapiens
gaccctggtgggcactggcacc

SEQ ID NO: 7442674 - DNA, 22 bp, Homo sapiens
gaccctggtgggcactggcacc

SEQ ID NO: 7442675 - DNA, 22 bp, Homo sapiens
gaccctggtgggcactggcacc

SEQ ID NO: 7442676 - DNA, 22 bp, Homo sapiens
gaccctggctggagctggcctg

SEQ ID NO: 7442677 - DNA, 22 bp, Homo sapiens
gaccctggctggagctggcctg

SEQ ID NO: 7442678 - DNA, 22 bp, Homo sapiens
gaccctggctggagctggcctg

SEQ ID NO: 7442679 - DNA, 22 bp, Homo sapiens
gaccctggctggagctggcctg

SEQ ID NO: 7442680 - DNA, 22 bp, Homo sapiens
gaccctgggatgcttgttttac

SEQ ID NO: 7442681 - DNA, 22 bp, Homo sapiens
gaccctggggaccatctagccc

SEQ ID NO: 7442682 - DNA, 22 bp, Homo sapiens
gaccctgtttctacaaataatt

SEQ ID NO: 7442683 - DNA, 22 bp, Homo sapiens
gaccctgtggctctgtggcaga

SEQ ID NO: 7442684 - DNA, 22 bp, Homo sapiens
gaccctgtggctctgtggcaga

SEQ ID NO: 7442685 - DNA, 22 bp, Homo sapiens
gaccctgtttctacaaataatt

SEQ ID NO: 7442686 - DNA, 22 bp, Homo sapiens
gaccctgtttctacaaataatt

SEQ ID NO: 7442687 - DNA, 22 bp, Homo sapiens
gaccctggtgtccaggtcctgc

SEQ ID NO: 7442688 - DNA, 22 bp, Homo sapiens
gaccctggtgtccaggtcctgc

SEQ ID NO: 7442689 - DNA, 22 bp, Homo sapiens
gaccctggtgtccaggtcctgc

SEQ ID NO: 7442690 - DNA, 22 bp, Homo sapiens
gaccctggtgtccaggtcctgc

SEQ ID NO: 7442691 - DNA, 22 bp, Homo sapiens
gaccctggtgtccaggtcctgc

SEQ ID NO: 7442692 - DNA, 22 bp, Homo sapiens
gaccctggtgggcactggcacc

SEQ ID NO: 7442693 - DNA, 22 bp, Homo sapiens
gaccctggctagggcttaacct

SEQ ID NO: 7442694 - DNA, 22 bp, Homo sapiens
gaccctggctagggcttaacct

SEQ ID NO: 7442695 - DNA, 22 bp, Homo sapiens
gaccctggcaggtagcctcaca

SEQ ID NO: 7442696 - DNA, 22 bp, Homo sapiens
gaccctggctgccgcggtctgg

SEQ ID NO: 7442697 - DNA, 22 bp, Homo sapiens
gaccctggctggagctggcctg

SEQ ID NO: 7442698 - DNA, 22 bp, Homo sapiens
gaccctggctgccgcggtctgg

SEQ ID NO: 7442699 - DNA, 22 bp, Homo sapiens
gaccccaaaccctgtattcttc

SEQ ID NO: 7442700 - DNA, 22 bp, Homo sapiens
gaccctggcaggtagcctcaca

SEQ ID NO: 7442701 - DNA, 22 bp, Homo sapiens
gacagtaggacagttctgcctc

SEQ ID NO: 7442702 - DNA, 22 bp, Homo sapiens
gacagtcccccagcagcaaacc

SEQ ID NO: 7442703 - DNA, 22 bp, Homo sapiens
gacagtcacttccaggagagga

SEQ ID NO: 7442704 - DNA, 22 bp, Homo sapiens
gacagtcccccagcagcaaacc

SEQ ID NO: 7442705 - DNA, 22 bp, Homo sapiens
gacccagtgggggcctgatctg

SEQ ID NO: 7442706 - DNA, 22 bp, Homo sapiens
gacccagtgactcgtctctgtg

SEQ ID NO: 7442707 - DNA, 22 bp, Homo sapiens
gacccagtcacacttgtgcttt

SEQ ID NO: 7442708 - DNA, 22 bp, Homo sapiens
gacccagtgactcgtctctgtg

SEQ ID NO: 7442709 - DNA, 22 bp, Homo sapiens
gacagtagtccttgctattcat

SEQ ID NO: 7442710 - DNA, 22 bp, Homo sapiens
gacagtagtaaagctaggacca

SEQ ID NO: 7442711 - DNA, 22 bp, Homo sapiens
gacagtatccaggtggtgaaga

SEQ ID NO: 7442712 - DNA, 22 bp, Homo sapiens
gacagtacaggtagaagtcact

SEQ ID NO: 7442713 - DNA, 22 bp, Homo sapiens
gacagtacaggtagaagtcact

SEQ ID NO: 7442714 - DNA, 22 bp, Homo sapiens
gacagtaagtcagagacttggt

SEQ ID NO: 7442715 - DNA, 22 bp, Homo sapiens
gacagtaagagtgtctgggttc

SEQ ID NO: 7442716 - DNA, 22 bp, Homo sapiens
gacagtaaggtggcttcttctt

SEQ ID NO: 7442717 - DNA, 22 bp, Homo sapiens
gacagtaaggtggcttcttctt

SEQ ID NO: 7442718 - DNA, 22 bp, Homo sapiens
gacagtaagtcagagacttggt

SEQ ID NO: 7442719 - DNA, 22 bp, Homo sapiens
gacagtaagtcagagacttggt

SEQ ID NO: 7442720 - DNA, 22 bp, Homo sapiens
gacagtaagtcagagacttggt

SEQ ID NO: 7442721 - DNA, 22 bp, Homo sapiens
gacagtaagaccttaccagcct

SEQ ID NO: 7442722 - DNA, 22 bp, Homo sapiens
gacagtaagagtgtctgggttc

SEQ ID NO: 7442723 - DNA, 22 bp, Homo sapiens
gacagtaactgagagatgtaat

SEQ ID NO: 7442724 - DNA, 22 bp, Homo sapiens
gacagtaagaccttaccagcct

SEQ ID NO: 7442725 - DNA, 22 bp, Homo sapiens
gacagtaactacagttctgtgg

SEQ ID NO: 7442726 - DNA, 22 bp, Homo sapiens
gacagtaactgagagatgtaat

SEQ ID NO: 7442727 - DNA, 22 bp, Homo sapiens
gacagtaactgagagatgtaat

SEQ ID NO: 7442728 - DNA, 22 bp, Homo sapiens
gacagtaactgagagatgtaat

SEQ ID NO: 7442729 - DNA, 22 bp, Homo sapiens
gacagtaactgagagatgtaat

SEQ ID NO: 7442730 - DNA, 22 bp, Homo sapiens
gacagtaactgagagatgtaat

SEQ ID NO: 7442731 - DNA, 22 bp, Homo sapiens
gacagtaactgagagatgtaat

SEQ ID NO: 7442732 - DNA, 22 bp, Homo sapiens
gacaggttgaagtatcaaaggt

SEQ ID NO: 7442733 - DNA, 22 bp, Homo sapiens
gacaggttgaagtatcaaaggt

SEQ ID NO: 7442734 - DNA, 22 bp, Homo sapiens
gacagtaaatgcagtctagcac

SEQ ID NO: 7442735 - DNA, 22 bp, Homo sapiens
gacagtaaatgcagtctagcac

SEQ ID NO: 7442736 - DNA, 22 bp, Homo sapiens
gacagtaactacagttctgtgg

SEQ ID NO: 7442737 - DNA, 18 bp, Homo sapiens
gacagtaaacttccccat

SEQ ID NO: 7442738 - DNA, 18 bp, Homo sapiens
gacagtaaacttccccat

SEQ ID NO: 7442739 - DNA, 18 bp, Homo sapiens
gacaggtgggtgagacca

SEQ ID NO: 7442740 - DNA, 22 bp, Homo sapiens
gacaggtgggttctcgtatctg

SEQ ID NO: 7442741 - DNA, 22 bp, Homo sapiens
gacaggtggggaaactaaggta

SEQ ID NO: 7442742 - DNA, 22 bp, Homo sapiens
gacaggtgaaacagcaaggtaa

SEQ ID NO: 7442743 - DNA, 20 bp, Homo sapiens
gacaggtgctaaagaggggc

SEQ ID NO: 7442744 - DNA, 20 bp, Homo sapiens
gacaggtgctaaagaggggc

SEQ ID NO: 7442745 - DNA, 22 bp, Homo sapiens
gacaggtgctaagggacctggc

SEQ ID NO: 7442746 - DNA, 22 bp, Homo sapiens
gacaggtgctaagggacctggc

SEQ ID NO: 7442747 - DNA, 22 bp, Homo sapiens
gacaggtgctaagggacctggc

SEQ ID NO: 7442748 - DNA, 22 bp, Homo sapiens
gacaggtgctaagggacctggc

SEQ ID NO: 7442749 - DNA, 22 bp, Homo sapiens
gacaggtggggaaactaaggta

SEQ ID NO: 7442750 - DNA, 22 bp, Homo sapiens
gacagggttgagtaaactggga

SEQ ID NO: 7442751 - DNA, 22 bp, Homo sapiens
gacagggtggctgatagggctc

SEQ ID NO: 7442752 - DNA, 22 bp, Homo sapiens
gacagggtggctgatagggctc

SEQ ID NO: 7442753 - DNA, 22 bp, Homo sapiens
gacagggttgagtaaactggga

SEQ ID NO: 7442754 - DNA, 22 bp, Homo sapiens
gacagggtttgcaaggacttcg

SEQ ID NO: 7442755 - DNA, 22 bp, Homo sapiens
gacagggtttgcaaggacttcg

SEQ ID NO: 7442756 - DNA, 22 bp, Homo sapiens
gacaggtaaagatggtggcagg

SEQ ID NO: 7442757 - DNA, 23 bp, Homo sapiens
gacaggtaagggttgggagaatc

SEQ ID NO: 7442758 - DNA, 22 bp, Homo sapiens
gacaggtaaagatggtggcagg

SEQ ID NO: 7442759 - DNA, 22 bp, Homo sapiens
gacagggtccaaaggcagggga

SEQ ID NO: 7442760 - DNA, 22 bp, Homo sapiens
gacagggtccaaaggcagggga

SEQ ID NO: 7442761 - DNA, 22 bp, Homo sapiens
gacagggtccaaaggcagggga

SEQ ID NO: 7442762 - DNA, 22 bp, Homo sapiens
gacagggtggctgatagggctc

SEQ ID NO: 7442763 - DNA, 22 bp, Homo sapiens
gacagggtccaaaggcagggga

SEQ ID NO: 7442764 - DNA, 22 bp, Homo sapiens
gacagggtccaaaggcagggga

SEQ ID NO: 7442765 - DNA, 22 bp, Homo sapiens
gacagggtacgggctaggcaca

SEQ ID NO: 7442766 - DNA, 22 bp, Homo sapiens
gacagggtacgggctaggcaca

SEQ ID NO: 7442767 - DNA, 22 bp, Homo sapiens
gacagggtacgggctaggcaca

SEQ ID NO: 7442768 - DNA, 22 bp, Homo sapiens
gacagggtacgggctaggcaca

SEQ ID NO: 7442769 - DNA, 22 bp, Homo sapiens
gacaggtgagatgaggaacacc

SEQ ID NO: 7442770 - DNA, 21 bp, Homo sapiens
gacaggtgattcagagcaggg

SEQ ID NO: 7442771 - DNA, 21 bp, Homo sapiens
gacaggtgattcagagcaggg

SEQ ID NO: 7442772 - DNA, 21 bp, Homo sapiens
gacaggtgattcagagcaggg

SEQ ID NO: 7442773 - DNA, 22 bp, Homo sapiens
gacaggtgaaacagcaaggtaa

SEQ ID NO: 7442774 - DNA, 22 bp, Homo sapiens
gacaggtgaaacagcaaggtaa

SEQ ID NO: 7442775 - DNA, 22 bp, Homo sapiens
gacaggtgaaacagcaaggtaa

SEQ ID NO: 7442776 - DNA, 22 bp, Homo sapiens
gacaggtaaagtactgggtttt

SEQ ID NO: 7442777 - DNA, 22 bp, Homo sapiens
gacaggtactatgtgcagacac

SEQ ID NO: 7442778 - DNA, 22 bp, Homo sapiens
gacaggtgaaacagcaaggtaa

SEQ ID NO: 7442779 - DNA, 22 bp, Homo sapiens
gaagagctccaaaaacagtgag

SEQ ID NO: 7442780 - DNA, 22 bp, Homo sapiens
gaagagctccaaaaacagtgag

SEQ ID NO: 7442781 - DNA, 22 bp, Homo sapiens
gaagagctgacagtgtcatcct

SEQ ID NO: 7442782 - DNA, 22 bp, Homo sapiens
gaagagctgacagtgtcatcct

SEQ ID NO: 7442783 - DNA, 22 bp, Homo sapiens
gaagagaaggtgtaggccatcc

SEQ ID NO: 7442784 - DNA, 22 bp, Homo sapiens
gaagagctatgtccagggagca

SEQ ID NO: 7442785 - DNA, 22 bp, Homo sapiens
gaagagctgcagtttcctgggc

SEQ ID NO: 7442786 - DNA, 22 bp, Homo sapiens
gaagagctgctcagaacatgat

SEQ ID NO: 7442787 - DNA, 22 bp, Homo sapiens
gaagagctgctcagaacatgat

SEQ ID NO: 7442788 - DNA, 22 bp, Homo sapiens
gaagagctgcacactggggact

SEQ ID NO: 7442789 - DNA, 22 bp, Homo sapiens
gaagagctgcacactggggact

SEQ ID NO: 7442790 - DNA, 22 bp, Homo sapiens
gaagagaagcatcaataggtaa

SEQ ID NO: 7442791 - DNA, 22 bp, Homo sapiens
gaagagaagcatcaataggtaa

SEQ ID NO: 7442792 - DNA, 22 bp, Homo sapiens
gaagagaagcatcaataggtaa

SEQ ID NO: 7442793 - DNA, 22 bp, Homo sapiens
gaagagaagcatcaataggtaa

SEQ ID NO: 7442794 - DNA, 22 bp, Homo sapiens
gaagagaaggtgtaggccatcc

SEQ ID NO: 7442795 - DNA, 22 bp, Homo sapiens
gaagagaaggtgtaggccatcc

SEQ ID NO: 7442796 - DNA, 22 bp, Homo sapiens
gaagagaagcatcaataggtaa

SEQ ID NO: 7442797 - DNA, 22 bp, Homo sapiens
gaagagaaggtgtaggccatcc

SEQ ID NO: 7442798 - DNA, 22 bp, Homo sapiens
gaagagaaggtgtaggccatcc

SEQ ID NO: 7442799 - DNA, 22 bp, Homo sapiens
gaagagaaggtgtaggccatcc

SEQ ID NO: 7442800 - DNA, 22 bp, Homo sapiens
gaagagaaggtgtaggccatcc

SEQ ID NO: 7442801 - DNA, 22 bp, Homo sapiens
gaagactctaagagaaatatga

SEQ ID NO: 7442802 - DNA, 22 bp, Homo sapiens
gaagactttaagccgagattag

SEQ ID NO: 7442803 - DNA, 22 bp, Homo sapiens
gaagactctaagagaaatatga

SEQ ID NO: 7442804 - DNA, 22 bp, Homo sapiens
gaagagaaaggcaaggagtttt

SEQ ID NO: 7442805 - DNA, 22 bp, Homo sapiens
gaagagaaaggcaaggagtttt

SEQ ID NO: 7442806 - DNA, 22 bp, Homo sapiens
gaagagaaaggcaaggagtttt

SEQ ID NO: 7442807 - DNA, 22 bp, Homo sapiens
gaagagaaaggcaaggagtttt

SEQ ID NO: 7442808 - DNA, 22 bp, Homo sapiens
gaagagaagcatcaataggtaa

SEQ ID NO: 7442809 - DNA, 22 bp, Homo sapiens
gaagagaagcatcaataggtaa

SEQ ID NO: 7442810 - DNA, 22 bp, Homo sapiens
gaagagaaaggcaaggagtttt

SEQ ID NO: 7442811 - DNA, 22 bp, Homo sapiens
gaagagaagcatcaataggtaa

SEQ ID NO: 7442812 - DNA, 22 bp, Homo sapiens
gaagagaaaggcaaggagtttt

SEQ ID NO: 7442813 - DNA, 22 bp, Homo sapiens
gaagagaaaggcaaggagtttt

SEQ ID NO: 7442814 - DNA, 22 bp, Homo sapiens
gaagaggctttcctagggcaag

SEQ ID NO: 7442815 - DNA, 22 bp, Homo sapiens
gaagaggctttcctagggcaag

SEQ ID NO: 7442816 - DNA, 22 bp, Homo sapiens
gaagaggctttcctagggcaag

SEQ ID NO: 7442817 - DNA, 22 bp, Homo sapiens
gaagaggcaattgaataagcta

SEQ ID NO: 7442818 - DNA, 22 bp, Homo sapiens
gaagaggctttcctagggcaag

SEQ ID NO: 7442819 - DNA, 22 bp, Homo sapiens
gaagaggctttcctagggcaag

SEQ ID NO: 7442820 - DNA, 22 bp, Homo sapiens
gaagaggctttcctagggcaag

SEQ ID NO: 7442821 - DNA, 22 bp, Homo sapiens
gaagaggatgacaggagccggt

SEQ ID NO: 7442822 - DNA, 22 bp, Homo sapiens
gaagaggatgacaggagccggt

SEQ ID NO: 7442823 - DNA, 22 bp, Homo sapiens
gaagaggcaattgaataagcta

SEQ ID NO: 7442824 - DNA, 22 bp, Homo sapiens
gaagaggatgacaggagccggt

SEQ ID NO: 7442825 - DNA, 22 bp, Homo sapiens
gaagaggatgacaggagccggt

SEQ ID NO: 7442826 - DNA, 22 bp, Homo sapiens
gaagaggatgacaggagccggt

SEQ ID NO: 7442827 - DNA, 22 bp, Homo sapiens
gaagaggatgacaggagccggt

SEQ ID NO: 7442828 - DNA, 22 bp, Homo sapiens
gaagaggatgacaggagccggt

SEQ ID NO: 7442829 - DNA, 22 bp, Homo sapiens
gaagaggatgacaggagccggt

SEQ ID NO: 7442830 - DNA, 22 bp, Homo sapiens
gaagaggatgacaggagccggt

SEQ ID NO: 7442831 - DNA, 22 bp, Homo sapiens
gaagaggactgtggcatcctag

SEQ ID NO: 7442832 - DNA, 22 bp, Homo sapiens
gaagaggatgacaggagccggt

SEQ ID NO: 7442833 - DNA, 22 bp, Homo sapiens
gaagaggactgtggcatcctag

SEQ ID NO: 7442834 - DNA, 22 bp, Homo sapiens
gaagagctgtgattcaggctta

SEQ ID NO: 7442835 - DNA, 22 bp, Homo sapiens
gaagagctgtgattcaggctta

SEQ ID NO: 7442836 - DNA, 22 bp, Homo sapiens
gaagagctgtcagaaaagctaa

SEQ ID NO: 7442837 - DNA, 22 bp, Homo sapiens
gaagagctggaatccagtctgg

SEQ ID NO: 7442838 - DNA, 22 bp, Homo sapiens
gaagagctggaatccagtctgg

SEQ ID NO: 7442839 - DNA, 22 bp, Homo sapiens
gaagaggactgtggcatcctag

SEQ ID NO: 7442840 - DNA, 22 bp, Homo sapiens
gaagaggactgtggcatcctag

SEQ ID NO: 7442841 - DNA, 22 bp, Homo sapiens
gaagagcttagttgtcctagaa

SEQ ID NO: 7442842 - DNA, 22 bp, Homo sapiens
gaagacactaaggcccagggag

SEQ ID NO: 7442843 - DNA, 22 bp, Homo sapiens
gaagacactaaggcccagggag

SEQ ID NO: 7442844 - DNA, 22 bp, Homo sapiens
gaagacactctgcagagttatc

SEQ ID NO: 7442845 - DNA, 22 bp, Homo sapiens
gaagacactctgcagagttatc

SEQ ID NO: 7442846 - DNA, 22 bp, Homo sapiens
gaagacacctactgtcatttct

SEQ ID NO: 7442847 - DNA, 22 bp, Homo sapiens
gaagacactaaactggggcttc

SEQ ID NO: 7442848 - DNA, 21 bp, Homo sapiens
gaagacacataacctctctcc

SEQ ID NO: 7442849 - DNA, 22 bp, Homo sapiens
gaagacatcgtgtggactaaca

SEQ ID NO: 7442850 - DNA, 22 bp, Homo sapiens
gaagacatcgtgtggactaaca

SEQ ID NO: 7442851 - DNA, 22 bp, Homo sapiens
gaagacatcatggagaggatag

SEQ ID NO: 7442852 - DNA, 22 bp, Homo sapiens
gaagacagaaacctgtttggct

SEQ ID NO: 7442853 - DNA, 22 bp, Homo sapiens
gaagacagaaacctgtttggct

SEQ ID NO: 7442854 - DNA, 22 bp, Homo sapiens
gaagacatcatggagaggatag

SEQ ID NO: 7442855 - DNA, 22 bp, Homo sapiens
gaagacagaaacctgtttggct

SEQ ID NO: 7442856 - DNA, 22 bp, Homo sapiens
gaagacatgtttttaatatgta

SEQ ID NO: 7442857 - DNA, 22 bp, Homo sapiens
gaagacattaagtctatgtcac

SEQ ID NO: 7442858 - DNA, 22 bp, Homo sapiens
gaagacatgtttttaatatgta

SEQ ID NO: 7442859 - DNA, 22 bp, Homo sapiens
gaagacatgtttttaatatgta

SEQ ID NO: 7442860 - DNA, 22 bp, Homo sapiens
gaagacatgtttttaatatgta

SEQ ID NO: 7442861 - DNA, 22 bp, Homo sapiens
gaagacatgtggattctagttt

SEQ ID NO: 7442862 - DNA, 22 bp, Homo sapiens
gaagacatgtggattctagttt

SEQ ID NO: 7442863 - DNA, 22 bp, Homo sapiens
gaagacattttatgcatactct

SEQ ID NO: 7442864 - DNA, 22 bp, Homo sapiens
gaagacatttgtaacacttgca

SEQ ID NO: 7442865 - DNA, 22 bp, Homo sapiens
gaagaccaatttgggccatggc

SEQ ID NO: 7442866 - DNA, 22 bp, Homo sapiens
gaagaccaccccctacagcaca

SEQ ID NO: 7442867 - DNA, 22 bp, Homo sapiens
gaagaccaccccctacagcaca

SEQ ID NO: 7442868 - DNA, 22 bp, Homo sapiens
gaagacgagataaaatggtgtc

SEQ ID NO: 7442869 - DNA, 22 bp, Homo sapiens
gaagacctgtttatgctgcatt

SEQ ID NO: 7442870 - DNA, 22 bp, Homo sapiens
gaagacgagatctgtgcctcca

SEQ ID NO: 7442871 - DNA, 22 bp, Homo sapiens
gaagactactgttgcactcata

SEQ ID NO: 7442872 - DNA, 22 bp, Homo sapiens
gaagaccatattcagcaggcat

SEQ ID NO: 7442873 - DNA, 22 bp, Homo sapiens
gaagaccccagagcgaggtaag

SEQ ID NO: 7442874 - DNA, 22 bp, Homo sapiens
gaagacctcataattcacatgc

SEQ ID NO: 7442875 - DNA, 21 bp, Homo sapiens
gaacccagcagcagtgctctg

SEQ ID NO: 7442876 - DNA, 22 bp, Homo sapiens
gaacccagaggatatgggaaag

SEQ ID NO: 7442877 - DNA, 21 bp, Homo sapiens
gaacccagcagcagtgctctg

SEQ ID NO: 7442878 - DNA, 21 bp, Homo sapiens
gaacccagcagcagtgctctg

SEQ ID NO: 7442879 - DNA, 22 bp, Homo sapiens
gaaccatttctgaatagtttgt

SEQ ID NO: 7442880 - DNA, 22 bp, Homo sapiens
gaacccaaacctggacctccct

SEQ ID NO: 7442881 - DNA, 22 bp, Homo sapiens
gaacccaaacctggacctccct

SEQ ID NO: 7442882 - DNA, 22 bp, Homo sapiens
gaacccaacctcacttggggta

SEQ ID NO: 7442883 - DNA, 22 bp, Homo sapiens
gaaccattgttgaaaagaatag

SEQ ID NO: 7442884 - DNA, 22 bp, Homo sapiens
gaaccatttctgaatagtttgt

SEQ ID NO: 7442885 - DNA, 22 bp, Homo sapiens
gaaccagcagactttgacaggt

SEQ ID NO: 7442886 - DNA, 22 bp, Homo sapiens
gaaccagcagttgcctgaaaaa

SEQ ID NO: 7442887 - DNA, 22 bp, Homo sapiens
gaaccagcagttgcctgaaaaa

SEQ ID NO: 7442888 - DNA, 21 bp, Homo sapiens
gaacccagcagcagtgctctg

SEQ ID NO: 7442889 - DNA, 21 bp, Homo sapiens
gaacccagcagcagtgctctg

SEQ ID NO: 7442890 - DNA, 22 bp, Homo sapiens
gaagacaagctgagtgttgtcc

SEQ ID NO: 7442891 - DNA, 22 bp, Homo sapiens
gaagacaattctgggtggagga

SEQ ID NO: 7442892 - DNA, 22 bp, Homo sapiens
gaagacaattctgggtggagga

SEQ ID NO: 7442893 - DNA, 22 bp, Homo sapiens
gaagacacaattggtgggtcca

SEQ ID NO: 7442894 - DNA, 20 bp, Homo sapiens
gaagacacagagttcatctc

SEQ ID NO: 7442895 - DNA, 20 bp, Homo sapiens
gaacatttggccatactgag

SEQ ID NO: 7442896 - DNA, 20 bp, Homo sapiens
gaacatttggccatactgag

SEQ ID NO: 7442897 - DNA, 22 bp, Homo sapiens
gaacatttggcatgagaatttg

SEQ ID NO: 7442898 - DNA, 21 bp, Homo sapiens
gaacatttgggttgtttctac

SEQ ID NO: 7442899 - DNA, 21 bp, Homo sapiens
gaacatttgggttgtttctac

SEQ ID NO: 7442900 - DNA, 20 bp, Homo sapiens
gaacatttggccatactgag

SEQ ID NO: 7442901 - DNA, 22 bp, Homo sapiens
gaaccacaatgtgaagaaggag

SEQ ID NO: 7442902 - DNA, 22 bp, Homo sapiens
gaaccacaatgtgaagaaggag

SEQ ID NO: 7442903 - DNA, 22 bp, Homo sapiens
gaaccacaagattcaaaggggt

SEQ ID NO: 7442904 - DNA, 22 bp, Homo sapiens
gaaccacaatgtgaagaaggag

SEQ ID NO: 7442905 - DNA, 22 bp, Homo sapiens
gaaccacaagattcaaaggggt

SEQ ID NO: 7442906 - DNA, 21 bp, Homo sapiens
gaacatttgggttgtttctac

SEQ ID NO: 7442907 - DNA, 21 bp, Homo sapiens
gaacatttgggttgtttctac

SEQ ID NO: 7442908 - DNA, 21 bp, Homo sapiens
gaacatttgggttgtttctac

SEQ ID NO: 7442909 - DNA, 22 bp, Homo sapiens
gaagatttataggagcctatta

SEQ ID NO: 7442910 - DNA, 22 bp, Homo sapiens
gaagatttataaggaccttatt

SEQ ID NO: 7442911 - DNA, 22 bp, Homo sapiens
gaagatttataaggaccttatt

SEQ ID NO: 7442912 - DNA, 22 bp, Homo sapiens
gaagatttaagcacaatagtct

SEQ ID NO: 7442913 - DNA, 22 bp, Homo sapiens
gaagatttataaggaccttatt

SEQ ID NO: 7442914 - DNA, 22 bp, Homo sapiens
gaagatttataaggaccttatt

SEQ ID NO: 7442915 - DNA, 22 bp, Homo sapiens
gaagatttaagcacaatagtct

SEQ ID NO: 7442916 - DNA, 22 bp, Homo sapiens
gaagatttaagcacaatagtct

SEQ ID NO: 7442917 - DNA, 22 bp, Homo sapiens
gaagattgaaggctgggaatta

SEQ ID NO: 7442918 - DNA, 22 bp, Homo sapiens
gaagatttcagttaagtatcta

SEQ ID NO: 7442919 - DNA, 22 bp, Homo sapiens
gaagatttataggagcctatta

SEQ ID NO: 7442920 - DNA, 22 bp, Homo sapiens
gaagatttctgatgagttactt

SEQ ID NO: 7442921 - DNA, 22 bp, Homo sapiens
gaagatttctgatgagttactt

SEQ ID NO: 7442922 - DNA, 22 bp, Homo sapiens
gaagatttcagttaagtatcta

SEQ ID NO: 7442923 - DNA, 22 bp, Homo sapiens
gaagatttcagttaagtatcta

SEQ ID NO: 7442924 - DNA, 22 bp, Homo sapiens
gaagatttcagttaagtatcta

SEQ ID NO: 7442925 - DNA, 22 bp, Homo sapiens
gaagatttctttatgaaagatg

SEQ ID NO: 7442926 - DNA, 22 bp, Homo sapiens
gaagatttctttatgaaagatg

SEQ ID NO: 7442927 - DNA, 22 bp, Homo sapiens
gaagatttctttatgaaagatg

SEQ ID NO: 7442928 - DNA, 22 bp, Homo sapiens
gaagatttctttatgaaagatg

SEQ ID NO: 7442929 - DNA, 22 bp, Homo sapiens
gaagatttctttatgaaagatg

SEQ ID NO: 7442930 - DNA, 22 bp, Homo sapiens
gaagattaaacatatttagtgt

SEQ ID NO: 7442931 - DNA, 22 bp, Homo sapiens
gaagatgttatggagagctcag

SEQ ID NO: 7442932 - DNA, 22 bp, Homo sapiens
gaagatgtgggcccactccaga

SEQ ID NO: 7442933 - DNA, 22 bp, Homo sapiens
gaagatgttatggagagctcag

SEQ ID NO: 7442934 - DNA, 22 bp, Homo sapiens
gaagatgtgcaatacaaagaaa

SEQ ID NO: 7442935 - DNA, 22 bp, Homo sapiens
gaagatgtgcaatacaaagaaa

SEQ ID NO: 7442936 - DNA, 22 bp, Homo sapiens
gaagatgtgggaactgctgaaa

SEQ ID NO: 7442937 - DNA, 22 bp, Homo sapiens
gaagatgtgggcccactccaga

SEQ ID NO: 7442938 - DNA, 20 bp, Homo sapiens
gaagatgggtagaggcacag

SEQ ID NO: 7442939 - DNA, 20 bp, Homo sapiens
gaagatgggtagaggcacag

SEQ ID NO: 7442940 - DNA, 20 bp, Homo sapiens
gaagatgggtagaggcacag

SEQ ID NO: 7442941 - DNA, 22 bp, Homo sapiens
gaagattaatgagaaacctgct

SEQ ID NO: 7442942 - DNA, 22 bp, Homo sapiens
gaagattaatgagaaacctgct

SEQ ID NO: 7442943 - DNA, 22 bp, Homo sapiens
gaagattacctgagaccacttg

SEQ ID NO: 7442944 - DNA, 22 bp, Homo sapiens
gaagattacctgagaccacttg

SEQ ID NO: 7442945 - DNA, 22 bp, Homo sapiens
gaagattaaacatatttagtgt

SEQ ID NO: 7442946 - DNA, 22 bp, Homo sapiens
gaagattaaacatatttagtgt

SEQ ID NO: 7442947 - DNA, 22 bp, Homo sapiens
gaagattaaatgaagtgacctg

SEQ ID NO: 7442948 - DNA, 22 bp, Homo sapiens
gaagattaaatggctcccatat

SEQ ID NO: 7442949 - DNA, 22 bp, Homo sapiens
gaagattaaatgaagtgacctg

SEQ ID NO: 7442950 - DNA, 22 bp, Homo sapiens
gaagattagaccatttccagct

SEQ ID NO: 7442951 - DNA, 22 bp, Homo sapiens
gaagattagggttagcataagt

SEQ ID NO: 7442952 - DNA, 22 bp, Homo sapiens
gaagattagggttagcataagt

SEQ ID NO: 7442953 - DNA, 22 bp, Homo sapiens
gaagattgaaggctgggaatta

SEQ ID NO: 7442954 - DNA, 22 bp, Homo sapiens
gaagattgaaggctgggaatta

SEQ ID NO: 7442955 - DNA, 22 bp, Homo sapiens
gaagataattcctacttataac

SEQ ID NO: 7442956 - DNA, 22 bp, Homo sapiens
gaagataattcctacttataac

SEQ ID NO: 7442957 - DNA, 22 bp, Homo sapiens
gaagataattcctacttataac

SEQ ID NO: 7442958 - DNA, 22 bp, Homo sapiens
gaagataattcctacttataac

SEQ ID NO: 7442959 - DNA, 22 bp, Homo sapiens
gaagatattctctaaatacttt

SEQ ID NO: 7442960 - DNA, 22 bp, Homo sapiens
gaagatctgcagcctcaggcga

SEQ ID NO: 7442961 - DNA, 22 bp, Homo sapiens
gaagatattctctaaatacttt

SEQ ID NO: 7442962 - DNA, 22 bp, Homo sapiens
gaagatattctctaaatacttt

SEQ ID NO: 7442963 - DNA, 22 bp, Homo sapiens
gaagatattctctaaatacttt

SEQ ID NO: 7442964 - DNA, 22 bp, Homo sapiens
gaagatgggaatgatgagtggg

SEQ ID NO: 7442965 - DNA, 22 bp, Homo sapiens
gaagatgggaatgatgagtggg

SEQ ID NO: 7442966 - DNA, 22 bp, Homo sapiens
gaagatgggaatgatgagtggg

SEQ ID NO: 7442967 - DNA, 20 bp, Homo sapiens
gaagatgggtagaggcacag

SEQ ID NO: 7442968 - DNA, 20 bp, Homo sapiens
gaagatgggtagaggcacag

SEQ ID NO: 7442969 - DNA, 20 bp, Homo sapiens
gaagatgggtagaggcacag

SEQ ID NO: 7442970 - DNA, 22 bp, Homo sapiens
gaagatgggaatgatgagtggg

SEQ ID NO: 7442971 - DNA, 22 bp, Homo sapiens
gaagatgggaatgatgagtggg

SEQ ID NO: 7442972 - DNA, 22 bp, Homo sapiens
gaagatgggaatgatgagtggg

SEQ ID NO: 7442973 - DNA, 22 bp, Homo sapiens
gaagatgggaatgatgagtggg

SEQ ID NO: 7442974 - DNA, 22 bp, Homo sapiens
gaagatgggaatgatgagtggg

SEQ ID NO: 7442975 - DNA, 22 bp, Homo sapiens
gaagatgggaatgatgagtggg

SEQ ID NO: 7442976 - DNA, 22 bp, Homo sapiens
gaagaggctttcctagggcaag

SEQ ID NO: 7442977 - DNA, 22 bp, Homo sapiens
gaagaggctttcctagggcaag

SEQ ID NO: 7442978 - DNA, 22 bp, Homo sapiens
gaagaggctttcctagggcaag

SEQ ID NO: 7442979 - DNA, 22 bp, Homo sapiens
gaagaggctttcctagggcaag

SEQ ID NO: 7442980 - DNA, 22 bp, Homo sapiens
gaagaggttcaacgtggtcatc

SEQ ID NO: 7442981 - DNA, 22 bp, Homo sapiens
gaagaggttcaacgtggtcatc

SEQ ID NO: 7442982 - DNA, 22 bp, Homo sapiens
gaagaggtagcattggcaggtg

SEQ ID NO: 7442983 - DNA, 22 bp, Homo sapiens
gaagaggtagcattggcaggtg

SEQ ID NO: 7442984 - DNA, 22 bp, Homo sapiens
gaagaggtagcattggcaggtg

SEQ ID NO: 7442985 - DNA, 22 bp, Homo sapiens
gaagaggtagcattggcaggtg

SEQ ID NO: 7442986 - DNA, 22 bp, Homo sapiens
gaagaggctttcctagggcaag

SEQ ID NO: 7442987 - DNA, 22 bp, Homo sapiens
gaagaggctttcctagggcaag

SEQ ID NO: 7442988 - DNA, 22 bp, Homo sapiens
gaagataactttaaaaagtggc

SEQ ID NO: 7442989 - DNA, 22 bp, Homo sapiens
gaagataattcctacttataac

SEQ ID NO: 7442990 - DNA, 22 bp, Homo sapiens
gaagataactttaaaaagtggc

SEQ ID NO: 7442991 - DNA, 22 bp, Homo sapiens
gaagagtatatttagtgaaatc

SEQ ID NO: 7442992 - DNA, 22 bp, Homo sapiens
gaagataactttaaaaagtggc

SEQ ID NO: 7442993 - DNA, 22 bp, Homo sapiens
gaagagtggttatccctgctgt

SEQ ID NO: 7442994 - DNA, 22 bp, Homo sapiens
gaagagtggttatccctgctgt

SEQ ID NO: 7442995 - DNA, 22 bp, Homo sapiens
gaagagtatatttagtgaaatc

SEQ ID NO: 7442996 - DNA, 22 bp, Homo sapiens
gaagaggttcaacgtggtcatc

SEQ ID NO: 7442997 - DNA, 22 bp, Homo sapiens
gaagatttggattccatgtcac

SEQ ID NO: 7442998 - DNA, 22 bp, Homo sapiens
gaagatttgcccatgcactttt

SEQ ID NO: 7442999 - DNA, 22 bp, Homo sapiens
gaagatttggattccatgtcac

SEQ ID NO: 7443000 - DNA, 22 bp, Homo sapiens
gaagatttggattccatgtcac

SEQ ID NO: 7443001 - DNA, 22 bp, Homo sapiens
gaagatttgttgtaatttttag

SEQ ID NO: 7443002 - DNA, 22 bp, Homo sapiens
gaagatttgttgtaatttttag

SEQ ID NO: 7443003 - DNA, 22 bp, Homo sapiens
gaagatttgaaacacatagaca

SEQ ID NO: 7443004 - DNA, 22 bp, Homo sapiens
gaagatttgaaacacatagaca

SEQ ID NO: 7443005 - DNA, 22 bp, Homo sapiens
gaagatttgaaacacatagaca

SEQ ID NO: 7443006 - DNA, 22 bp, Homo sapiens
gaagatttgcccatgcactttt

SEQ ID NO: 7443007 - DNA, 22 bp, Homo sapiens
gaagatttgcccatgcactttt

SEQ ID NO: 7443008 - DNA, 22 bp, Homo sapiens
gaagatttgaaacacatagaca

SEQ ID NO: 7443009 - DNA, 22 bp, Homo sapiens
gaagatttgttgtaatttttag

SEQ ID NO: 7443010 - DNA, 22 bp, Homo sapiens
gaagattttctcctttaaatga

SEQ ID NO: 7443011 - DNA, 22 bp, Homo sapiens
gaagattttctcctttaaatga

SEQ ID NO: 7443012 - DNA, 22 bp, Homo sapiens
gaagattttctcctttaaatga

SEQ ID NO: 7443013 - DNA, 22 bp, Homo sapiens
gaagattttctcctttaaatga

SEQ ID NO: 7443014 - DNA, 22 bp, Homo sapiens
gaagattttctcctttaaatga

SEQ ID NO: 7443015 - DNA, 22 bp, Homo sapiens
gaagattttctcctttaaatga

SEQ ID NO: 7443016 - DNA, 22 bp, Homo sapiens
gaagatttttcttaatgctccg

SEQ ID NO: 7443017 - DNA, 22 bp, Homo sapiens
gaagatttttcttaatgctccg

SEQ ID NO: 7443018 - DNA, 22 bp, Homo sapiens
gaagcaaaatgtctgcacatat

SEQ ID NO: 7443019 - DNA, 22 bp, Homo sapiens
gaagcaaaatgtctgcacatat

SEQ ID NO: 7443020 - DNA, 22 bp, Homo sapiens
gaagcaaaatgtctgcacatat

SEQ ID NO: 7443021 - DNA, 22 bp, Homo sapiens
gaagcaaaatgtctgcacatat

SEQ ID NO: 7443022 - DNA, 22 bp, Homo sapiens
gaagccagatttggggcatatc

SEQ ID NO: 7443023 - DNA, 22 bp, Homo sapiens
gaagccagattatcacaagcca

SEQ ID NO: 7443024 - DNA, 22 bp, Homo sapiens
gaagcaaaatgtctgcacatat

SEQ ID NO: 7443025 - DNA, 22 bp, Homo sapiens
gaagccagattatcacaagcca

SEQ ID NO: 7443026 - DNA, 22 bp, Homo sapiens
gaagccagcagtggagaaagga

SEQ ID NO: 7443027 - DNA, 22 bp, Homo sapiens
gaagccagcagtggagaaagga

SEQ ID NO: 7443028 - DNA, 22 bp, Homo sapiens
gaagccagatttggggcatatc

SEQ ID NO: 7443029 - DNA, 22 bp, Homo sapiens
gaagccagcagtggagaaagga

SEQ ID NO: 7443030 - DNA, 22 bp, Homo sapiens
gaagccagcagtggagaaagga

SEQ ID NO: 7443031 - DNA, 22 bp, Homo sapiens
gaagccagcagtggagaaagga

SEQ ID NO: 7443032 - DNA, 22 bp, Homo sapiens
gaagccagatttggggcatatc

SEQ ID NO: 7443033 - DNA, 22 bp, Homo sapiens
gaagccagccttgtctgcctct

SEQ ID NO: 7443034 - DNA, 22 bp, Homo sapiens
gaagccagcatccctctcccat

SEQ ID NO: 7443035 - DNA, 22 bp, Homo sapiens
gaagccagccttgtctgcctct

SEQ ID NO: 7443036 - DNA, 22 bp, Homo sapiens
gaagccagcatccctctcccat

SEQ ID NO: 7443037 - DNA, 22 bp, Homo sapiens
gaagccagcatccctctcccat

SEQ ID NO: 7443038 - DNA, 22 bp, Homo sapiens
gaagccagcatccctctcccat

SEQ ID NO: 7443039 - DNA, 22 bp, Homo sapiens
gaagccaggggcctgacaggca

SEQ ID NO: 7443040 - DNA, 22 bp, Homo sapiens
gaagccaggggcctgacaggca

SEQ ID NO: 7443041 - DNA, 22 bp, Homo sapiens
gaagccagccttgtctgcctct

SEQ ID NO: 7443042 - DNA, 22 bp, Homo sapiens
gaagccaggggcctgacaggca

SEQ ID NO: 7443043 - DNA, 22 bp, Homo sapiens
gaagccaggggcctgacaggca

SEQ ID NO: 7443044 - DNA, 22 bp, Homo sapiens
gaagccaggggcctgacaggca

SEQ ID NO: 7443045 - DNA, 22 bp, Homo sapiens
gaagccagtgtttgaagaattt

SEQ ID NO: 7443046 - DNA, 22 bp, Homo sapiens
gaagccatctttgttccccacc

SEQ ID NO: 7443047 - DNA, 22 bp, Homo sapiens
gaagcccaagcttcacagctat

SEQ ID NO: 7443048 - DNA, 22 bp, Homo sapiens
gaagcccagcaaactgtgatca

SEQ ID NO: 7443049 - DNA, 22 bp, Homo sapiens
gaagcccagcaaactgtgatca

SEQ ID NO: 7443050 - DNA, 22 bp, Homo sapiens
gaagcccagcaaactgtgatca

SEQ ID NO: 7443051 - DNA, 22 bp, Homo sapiens
gaagcccaggcttccttggctt

SEQ ID NO: 7443052 - DNA, 22 bp, Homo sapiens
gaagcccagcaaactgtgatca

SEQ ID NO: 7443053 - DNA, 22 bp, Homo sapiens
gaagccaggggcctgacaggca

SEQ ID NO: 7443054 - DNA, 22 bp, Homo sapiens
gaagccaggggcctgacaggca

SEQ ID NO: 7443055 - DNA, 22 bp, Homo sapiens
gaagccagtactgtgctctgca

SEQ ID NO: 7443056 - DNA, 22 bp, Homo sapiens
gaagccagtgtttgaagaattt

SEQ ID NO: 7443057 - DNA, 22 bp, Homo sapiens
gaagccagtgtttgaagaattt

SEQ ID NO: 7443058 - DNA, 22 bp, Homo sapiens
gaagccagtactgtgctctgca

SEQ ID NO: 7443059 - DNA, 22 bp, Homo sapiens
gaagcccagggcgtggccgggc

SEQ ID NO: 7443060 - DNA, 22 bp, Homo sapiens
gaagccccaaaccctcgccatc

SEQ ID NO: 7443061 - DNA, 22 bp, Homo sapiens
gaagccctaagagaatagagct

SEQ ID NO: 7443062 - DNA, 22 bp, Homo sapiens
gaagccctaatacacagtacct

SEQ ID NO: 7443063 - DNA, 22 bp, Homo sapiens
gaagccctaatacacagtacct

SEQ ID NO: 7443064 - DNA, 22 bp, Homo sapiens
gaagcctcaacatctctgcgtc

SEQ ID NO: 7443065 - DNA, 22 bp, Homo sapiens
gaagcccttagcagagtctgac

SEQ ID NO: 7443066 - DNA, 22 bp, Homo sapiens
gaagcccttagcagagtctgac

SEQ ID NO: 7443067 - DNA, 19 bp, Homo sapiens
gaagccctgcattctccgc

SEQ ID NO: 7443068 - DNA, 22 bp, Homo sapiens
gaagccctggggtcagtgtcgt

SEQ ID NO: 7443069 - DNA, 22 bp, Homo sapiens
gaagccctgtaggtgcaaaggt

SEQ ID NO: 7443070 - DNA, 22 bp, Homo sapiens
gaagccctgtaggtgcaaaggt

SEQ ID NO: 7443071 - DNA, 22 bp, Homo sapiens
gaagccctcctatagtcatctg

SEQ ID NO: 7443072 - DNA, 22 bp, Homo sapiens
gaagccctcctatagtcatctg

SEQ ID NO: 7443073 - DNA, 22 bp, Homo sapiens
gaagccccatggatatatgtga

SEQ ID NO: 7443074 - DNA, 23 bp, Homo sapiens
gaagccctcattggttctccaga

SEQ ID NO: 7443075 - DNA, 22 bp, Homo sapiens
gaagccctaatacacagtacct

SEQ ID NO: 7443076 - DNA, 22 bp, Homo sapiens
gaagccctatcctctcctggga

SEQ ID NO: 7443077 - DNA, 22 bp, Homo sapiens
gaaatgcatggatcttggcaga

SEQ ID NO: 7443078 - DNA, 22 bp, Homo sapiens
gaaatgcataatcttagtagat

SEQ ID NO: 7443079 - DNA, 22 bp, Homo sapiens
gaaatgcatggatcttggcaga

SEQ ID NO: 7443080 - DNA, 22 bp, Homo sapiens
gaaatgcatggatcttggcaga

SEQ ID NO: 7443081 - DNA, 22 bp, Homo sapiens
gaaatgcataatcttagtagat

SEQ ID NO: 7443082 - DNA, 22 bp, Homo sapiens
gaaatgcataatcttagtagat

SEQ ID NO: 7443083 - DNA, 22 bp, Homo sapiens
gaaatgcataatcttagtagat

SEQ ID NO: 7443084 - DNA, 22 bp, Homo sapiens
gaaatgcataatcttagtagat

SEQ ID NO: 7443085 - DNA, 22 bp, Homo sapiens
gaaatgcataatcttagtagat

SEQ ID NO: 7443086 - DNA, 22 bp, Homo sapiens
gaaatgcaggcttggattcagc

SEQ ID NO: 7443087 - DNA, 22 bp, Homo sapiens
gaaatgcaggcttggattcagc

SEQ ID NO: 7443088 - DNA, 22 bp, Homo sapiens
gaaatgcaggcttggattcagc

SEQ ID NO: 7443089 - DNA, 22 bp, Homo sapiens
gaaatgcaggcttggattcagc

SEQ ID NO: 7443090 - DNA, 22 bp, Homo sapiens
gaaatggtaaacattttaatgg

SEQ ID NO: 7443091 - DNA, 22 bp, Homo sapiens
gaaatgctacacttgttaatga

SEQ ID NO: 7443092 - DNA, 22 bp, Homo sapiens
gaaatgcataatcttagtagat

SEQ ID NO: 7443093 - DNA, 22 bp, Homo sapiens
gaaatgcatggatcttggcaga

SEQ ID NO: 7443094 - DNA, 22 bp, Homo sapiens
gaaatgcatggatcttggcaga

SEQ ID NO: 7443095 - DNA, 22 bp, Homo sapiens
gaaatgctacacttgttaatga

SEQ ID NO: 7443096 - DNA, 22 bp, Homo sapiens
gaaatgctacacttgttaatga

SEQ ID NO: 7443097 - DNA, 22 bp, Homo sapiens
gaaatggtagagtaggaagatt

SEQ ID NO: 7443098 - DNA, 22 bp, Homo sapiens
gaaatggtgtgctgtgcaatga

SEQ ID NO: 7443099 - DNA, 22 bp, Homo sapiens
gaaatgtaattctcttgaagat

SEQ ID NO: 7443100 - DNA, 22 bp, Homo sapiens
gaaatgtaattctcttgaagat

SEQ ID NO: 7443101 - DNA, 22 bp, Homo sapiens
gaaatgtaattctcttgaagat

SEQ ID NO: 7443102 - DNA, 20 bp, Homo sapiens
gaaatgtacacattaccaca

SEQ ID NO: 7443103 - DNA, 20 bp, Homo sapiens
gaaatgtacacattaccaca

SEQ ID NO: 7443104 - DNA, 20 bp, Homo sapiens
gaaatgtacacattaccaca

SEQ ID NO: 7443105 - DNA, 22 bp, Homo sapiens
gaaatgtactttaaagccatcc

SEQ ID NO: 7443106 - DNA, 22 bp, Homo sapiens
gaaatgtactttaaagccatcc

SEQ ID NO: 7443107 - DNA, 22 bp, Homo sapiens
gaaatgtactttaaagccatcc

SEQ ID NO: 7443108 - DNA, 22 bp, Homo sapiens
gaaatgtactttaaagccatcc

SEQ ID NO: 7443109 - DNA, 22 bp, Homo sapiens
gaacagcagctcgttctcgatg

SEQ ID NO: 7443110 - DNA, 17 bp, Homo sapiens
gaacagcagaggggaca

SEQ ID NO: 7443111 - DNA, 22 bp, Homo sapiens
gaaatgtagaattgcttaactg

SEQ ID NO: 7443112 - DNA, 22 bp, Homo sapiens
gaacagcagcttcctgggaatt

SEQ ID NO: 7443113 - DNA, 22 bp, Homo sapiens
gaacagcagctcgttctcgatg

SEQ ID NO: 7443114 - DNA, 22 bp, Homo sapiens
gaacagcagcttcctgggaatt

SEQ ID NO: 7443115 - DNA, 22 bp, Homo sapiens
gaacagcagcttcctgggaatt

SEQ ID NO: 7443116 - DNA, 22 bp, Homo sapiens
gaacagcagtcactcatgttat

SEQ ID NO: 7443117 - DNA, 22 bp, Homo sapiens
gaaatgcagaacctgagaccat

SEQ ID NO: 7443118 - DNA, 22 bp, Homo sapiens
gaaatgcagattctgattctgt

SEQ ID NO: 7443119 - DNA, 22 bp, Homo sapiens
gaaatgcagaacctgagaccat

SEQ ID NO: 7443120 - DNA, 22 bp, Homo sapiens
gaaatgcagattctgattctgt

SEQ ID NO: 7443121 - DNA, 22 bp, Homo sapiens
gaaatgcaaattctctctcgct

SEQ ID NO: 7443122 - DNA, 22 bp, Homo sapiens
gaaatgcagaacctgagaccat

SEQ ID NO: 7443123 - DNA, 22 bp, Homo sapiens
gaaatgcagaacctgagaccat

SEQ ID NO: 7443124 - DNA, 22 bp, Homo sapiens
gaaatgcaggcttggattcagc

SEQ ID NO: 7443125 - DNA, 22 bp, Homo sapiens
gaaatgcaggcttggattcagc

SEQ ID NO: 7443126 - DNA, 22 bp, Homo sapiens
gaaatgcagattctgattctgt

SEQ ID NO: 7443127 - DNA, 22 bp, Homo sapiens
gaaatgcaggcttggattcagc

SEQ ID NO: 7443128 - DNA, 22 bp, Homo sapiens
gaaatgcagattctgattctgt

SEQ ID NO: 7443129 - DNA, 22 bp, Homo sapiens
gaaatgcagattctgattctgt

SEQ ID NO: 7443130 - DNA, 22 bp, Homo sapiens
gaaatgcagattctgattctgt

SEQ ID NO: 7443131 - DNA, 22 bp, Homo sapiens
gaaatccagttccctactctta

SEQ ID NO: 7443132 - DNA, 22 bp, Homo sapiens
gaaatccagttccctactctta

SEQ ID NO: 7443133 - DNA, 22 bp, Homo sapiens
gaaatctacgattagtgaaaat

SEQ ID NO: 7443134 - DNA, 22 bp, Homo sapiens
gaaatctacgattagtgaaaat

SEQ ID NO: 7443135 - DNA, 22 bp, Homo sapiens
gaaatctacgattagtgaaaat

SEQ ID NO: 7443136 - DNA, 22 bp, Homo sapiens
gaaatgcaaattctctctcgct

SEQ ID NO: 7443137 - DNA, 22 bp, Homo sapiens
gaaatgcaaattctctctcgct

SEQ ID NO: 7443138 - DNA, 22 bp, Homo sapiens
gaaatgcaaattctctctcgct

SEQ ID NO: 7443139 - DNA, 22 bp, Homo sapiens
gaaatgcaaattctctctcgct

SEQ ID NO: 7443140 - DNA, 22 bp, Homo sapiens
gaaatcattagcaaagatatgt

SEQ ID NO: 7443141 - DNA, 22 bp, Homo sapiens
gaaatcattagcaaagatatgt

SEQ ID NO: 7443142 - DNA, 22 bp, Homo sapiens
gaaatcattagcaaagatatgt

SEQ ID NO: 7443143 - DNA, 22 bp, Homo sapiens
gaaatcattagcaaagatatgt

SEQ ID NO: 7443144 - DNA, 22 bp, Homo sapiens
gaaatcattagcaaagatatgt

SEQ ID NO: 7443145 - DNA, 22 bp, Homo sapiens
gaaatcattagcaaagatatgt

SEQ ID NO: 7443146 - DNA, 22 bp, Homo sapiens
gaaatcattagcaaagatatgt

SEQ ID NO: 7443147 - DNA, 22 bp, Homo sapiens
gaaatccagttccctactctta

SEQ ID NO: 7443148 - DNA, 22 bp, Homo sapiens
gaaatcatctgagtaataatct

SEQ ID NO: 7443149 - DNA, 22 bp, Homo sapiens
gaaatcatctgagtaataatct

SEQ ID NO: 7443150 - DNA, 22 bp, Homo sapiens
gaaatcatctgagtaataatct

SEQ ID NO: 7443151 - DNA, 22 bp, Homo sapiens
gaaatcatctgagtaataatct

SEQ ID NO: 7443152 - DNA, 22 bp, Homo sapiens
gaaatcatctgagtaataatct

SEQ ID NO: 7443153 - DNA, 22 bp, Homo sapiens
gaaatcatctgagtaataatct

SEQ ID NO: 7443154 - DNA, 22 bp, Homo sapiens
gaaatcagttctgaaatttaca

SEQ ID NO: 7443155 - DNA, 22 bp, Homo sapiens
gaacatttggatttgtaaattt

SEQ ID NO: 7443156 - DNA, 22 bp, Homo sapiens
gaacatttggatttgtaaattt

SEQ ID NO: 7443157 - DNA, 22 bp, Homo sapiens
gaacatttggatttgtaaattt

SEQ ID NO: 7443158 - DNA, 22 bp, Homo sapiens
gaacatttggatttgtaaattt

SEQ ID NO: 7443159 - DNA, 22 bp, Homo sapiens
gaacatttggcatgagaatttg

SEQ ID NO: 7443160 - DNA, 22 bp, Homo sapiens
gaacatttggcatgagaatttg

SEQ ID NO: 7443161 - DNA, 22 bp, Homo sapiens
gaacatttggatttgtaaattt

SEQ ID NO: 7443162 - DNA, 22 bp, Homo sapiens
gaacatttggatttgtaaattt

SEQ ID NO: 7443163 - DNA, 22 bp, Homo sapiens
gaacatttggcatgagaatttg

SEQ ID NO: 7443164 - DNA, 22 bp, Homo sapiens
gaacatttggcatgagaatttg

SEQ ID NO: 7443165 - DNA, 17 bp, Homo sapiens
gaacagtgtaagacact

SEQ ID NO: 7443166 - DNA, 22 bp, Homo sapiens
gaacagtttccctgtagaaaat

SEQ ID NO: 7443167 - DNA, 22 bp, Homo sapiens
gaacatttggatttgtaaattt

SEQ ID NO: 7443168 - DNA, 22 bp, Homo sapiens
gaacatttggatttgtaaattt

SEQ ID NO: 7443169 - DNA, 22 bp, Homo sapiens
gaacatttggatttgtaaattt

SEQ ID NO: 7443170 - DNA, 22 bp, Homo sapiens
gaacatttggatttgtaaattt

SEQ ID NO: 7443171 - DNA, 22 bp, Homo sapiens
gaacagtgaactgatttgtaaa

SEQ ID NO: 7443172 - DNA, 22 bp, Homo sapiens
gaacagtgaactgatttgtaaa

SEQ ID NO: 7443173 - DNA, 22 bp, Homo sapiens
gaacagtgccagcacacaataa

SEQ ID NO: 7443174 - DNA, 22 bp, Homo sapiens
gaacagtatttccaggaatccc

SEQ ID NO: 7443175 - DNA, 22 bp, Homo sapiens
gaacagtatttccaggaatccc

SEQ ID NO: 7443176 - DNA, 22 bp, Homo sapiens
gaacagtatttccaggaatccc

SEQ ID NO: 7443177 - DNA, 22 bp, Homo sapiens
gaacagtatcagtagtgccagt

SEQ ID NO: 7443178 - DNA, 22 bp, Homo sapiens
gaacagtatcagtagtgccagt

SEQ ID NO: 7443179 - DNA, 22 bp, Homo sapiens
gaacagtactaagagctttaca

SEQ ID NO: 7443180 - DNA, 22 bp, Homo sapiens
gaacagtatcagtagtgccagt

SEQ ID NO: 7443181 - DNA, 22 bp, Homo sapiens
gaacagtagatgagatgctaga

SEQ ID NO: 7443182 - DNA, 22 bp, Homo sapiens
gaacagtagatgagatgctaga

SEQ ID NO: 7443183 - DNA, 22 bp, Homo sapiens
gaacagtaaatttatgcagcac

SEQ ID NO: 7443184 - DNA, 22 bp, Homo sapiens
gaacagtaaatttatgcagcac

SEQ ID NO: 7443185 - DNA, 22 bp, Homo sapiens
gaacagtaactgtctgctgtgt

SEQ ID NO: 7443186 - DNA, 22 bp, Homo sapiens
gaacagtaactgtctgctgtgt

SEQ ID NO: 7443187 - DNA, 22 bp, Homo sapiens
gaacagggttgggtgagagagg

SEQ ID NO: 7443188 - DNA, 22 bp, Homo sapiens
gaacagggttgggtgagagagg

SEQ ID NO: 7443189 - DNA, 22 bp, Homo sapiens
gaacagggtttgagaggcttag

SEQ ID NO: 7443190 - DNA, 22 bp, Homo sapiens
gaacaggtaatcagtaaaatgt

SEQ ID NO: 7443191 - DNA, 22 bp, Homo sapiens
gaacaggtaatcagtaaaatgt

SEQ ID NO: 7443192 - DNA, 22 bp, Homo sapiens
gaacagggtttgagaggcttag

SEQ ID NO: 7443193 - DNA, 22 bp, Homo sapiens
gaacagtaaatttatgcagcac

SEQ ID NO: 7443194 - DNA, 22 bp, Homo sapiens
gaacagggagtacggcacattt

SEQ ID NO: 7443195 - DNA, 21 bp, Homo sapiens
gaacaggaaaagctggcttca

SEQ ID NO: 7443196 - DNA, 22 bp, Homo sapiens
gaacagctgctagagatctgtg

SEQ ID NO: 7443197 - DNA, 22 bp, Homo sapiens
gaacagcttcttgggagctggg

SEQ ID NO: 7443198 - DNA, 22 bp, Homo sapiens
gaacagcttcttgggagctggg

SEQ ID NO: 7443199 - DNA, 22 bp, Homo sapiens
gaacagctgctagagatctgtg

SEQ ID NO: 7443200 - DNA, 22 bp, Homo sapiens
gaacagctgctagagatctgtg

SEQ ID NO: 7443201 - DNA, 22 bp, Homo sapiens
gaacagctataatcatctgtcc

SEQ ID NO: 7443202 - DNA, 22 bp, Homo sapiens
gaacagctataatcatctgtcc

SEQ ID NO: 7443203 - DNA, 22 bp, Homo sapiens
gaacagctataatcatctgtcc

SEQ ID NO: 7443204 - DNA, 22 bp, Homo sapiens
gaacagctctgaagcagtaaat

SEQ ID NO: 7443205 - DNA, 22 bp, Homo sapiens
gaacagcatgtaagaagctact

SEQ ID NO: 7443206 - DNA, 22 bp, Homo sapiens
gaacagcatgcatgcaagacta

SEQ ID NO: 7443207 - DNA, 22 bp, Homo sapiens
gaacagcatgtaagaagctact

SEQ ID NO: 7443208 - DNA, 22 bp, Homo sapiens
gaacagcatgcatgcaagacta

SEQ ID NO: 7443209 - DNA, 22 bp, Homo sapiens
gaacagcatgcatgcaagacta

SEQ ID NO: 7443210 - DNA, 22 bp, Homo sapiens
gaacagcagtcactcatgttat

SEQ ID NO: 7443211 - DNA, 22 bp, Homo sapiens
gaacagcatgcatgcaagacta

SEQ ID NO: 7443212 - DNA, 22 bp, Homo sapiens
gaacagcatgtaagaagctact

SEQ ID NO: 7443213 - DNA, 22 bp, Homo sapiens
gaacagccctgttaagtctgtt

SEQ ID NO: 7443214 - DNA, 22 bp, Homo sapiens
gaacagcctcaataacatcctt

SEQ ID NO: 7443215 - DNA, 22 bp, Homo sapiens
gaacagcctcaataacatcctt

SEQ ID NO: 7443216 - DNA, 22 bp, Homo sapiens
gaacagcatgtaagaagctact

SEQ ID NO: 7443217 - DNA, 22 bp, Homo sapiens
gaacagcatgtaagaagctact

SEQ ID NO: 7443218 - DNA, 22 bp, Homo sapiens
gaacagcatgtaagaagctact

SEQ ID NO: 7443219 - DNA, 22 bp, Homo sapiens
ctttccaactctagtgaaattt

SEQ ID NO: 7443220 - DNA, 22 bp, Homo sapiens
ctttccaactctagtgaaattt

SEQ ID NO: 7443221 - DNA, 22 bp, Homo sapiens
ctttccaactctagtgaaattt

SEQ ID NO: 7443222 - DNA, 22 bp, Homo sapiens
ctttccaactctagtgaaattt

SEQ ID NO: 7443223 - DNA, 22 bp, Homo sapiens
ctttcatttgataagaatgcca

SEQ ID NO: 7443224 - DNA, 23 bp, Homo sapiens
ctttcattgtggtttcacagagc

SEQ ID NO: 7443225 - DNA, 22 bp, Homo sapiens
ctttcatttgataagaatgcca

SEQ ID NO: 7443226 - DNA, 22 bp, Homo sapiens
ctttcattcttagatattagtg

SEQ ID NO: 7443227 - DNA, 22 bp, Homo sapiens
ctttcatttgataagaatgcca

SEQ ID NO: 7443228 - DNA, 22 bp, Homo sapiens
ctttcattcttagatattagtg

SEQ ID NO: 7443229 - DNA, 23 bp, Homo sapiens
ctttcattgtggtttcacagagc

SEQ ID NO: 7443230 - DNA, 23 bp, Homo sapiens
ctttcattgtggtttcacagagc

SEQ ID NO: 7443231 - DNA, 22 bp, Homo sapiens
ctttcattcttagatattagtg

SEQ ID NO: 7443232 - DNA, 22 bp, Homo sapiens
ctttcattcttagatattagtg

SEQ ID NO: 7443233 - DNA, 23 bp, Homo sapiens
ctttcattgtggtttcacagagc

SEQ ID NO: 7443234 - DNA, 23 bp, Homo sapiens
ctttcattgtggtttcacagagc

SEQ ID NO: 7443235 - DNA, 22 bp, Homo sapiens
ctttcatgcacttctttagatc

SEQ ID NO: 7443236 - DNA, 22 bp, Homo sapiens
ctttcatgcacttctttagatc

SEQ ID NO: 7443237 - DNA, 22 bp, Homo sapiens
ctttcatgcagttgacaaggtg

SEQ ID NO: 7443238 - DNA, 19 bp, Homo sapiens
ctttcatgtggttcttctt

SEQ ID NO: 7443239 - DNA, 19 bp, Homo sapiens
ctttcatgtggttcttctt

SEQ ID NO: 7443240 - DNA, 22 bp, Homo sapiens
ctttcattcttagatattagtg

SEQ ID NO: 7443241 - DNA, 22 bp, Homo sapiens
ctttcattcttagatattagtg

SEQ ID NO: 7443242 - DNA, 22 bp, Homo sapiens
ctttcatagttaaaatagtttg

SEQ ID NO: 7443243 - DNA, 22 bp, Homo sapiens
ctttcatagttaaaatagtttg

SEQ ID NO: 7443244 - DNA, 22 bp, Homo sapiens
ctttcatagttaaaatagtttg

SEQ ID NO: 7443245 - DNA, 22 bp, Homo sapiens
ctttcatagttaaaatagtttg

SEQ ID NO: 7443246 - DNA, 22 bp, Homo sapiens
ctttcatccgcagatgagcctc

SEQ ID NO: 7443247 - DNA, 22 bp, Homo sapiens
ctttcatgaacagacaaggaac

SEQ ID NO: 7443248 - DNA, 22 bp, Homo sapiens
ctttcatgaacagacaaggaac

SEQ ID NO: 7443249 - DNA, 22 bp, Homo sapiens
ctttcatccgcagatgagcctc

SEQ ID NO: 7443250 - DNA, 22 bp, Homo sapiens
gaaatcaaggctacattcaggt

SEQ ID NO: 7443251 - DNA, 22 bp, Homo sapiens
gaaatcaaggctacattcaggt

SEQ ID NO: 7443252 - DNA, 22 bp, Homo sapiens
gaaatcaaggctacattcaggt

SEQ ID NO: 7443253 - DNA, 22 bp, Homo sapiens
gaaatcaaggctacattcaggt

SEQ ID NO: 7443254 - DNA, 22 bp, Homo sapiens
gaaatcaaggctacattcaggt

SEQ ID NO: 7443255 - DNA, 22 bp, Homo sapiens
gaaatcaatttcttggttgata

SEQ ID NO: 7443256 - DNA, 22 bp, Homo sapiens
gaaatcaatttcttggttgata

SEQ ID NO: 7443257 - DNA, 22 bp, Homo sapiens
gaaatcaatttcttggttgata

SEQ ID NO: 7443258 - DNA, 22 bp, Homo sapiens
gaaatcaggatgatgttccaga

SEQ ID NO: 7443259 - DNA, 22 bp, Homo sapiens
gaaatcaggatgatgttccaga

SEQ ID NO: 7443260 - DNA, 22 bp, Homo sapiens
gaaatcagttctgaaatttaca

SEQ ID NO: 7443261 - DNA, 22 bp, Homo sapiens
gaaatcagttctgaaatttaca

SEQ ID NO: 7443262 - DNA, 22 bp, Homo sapiens
gaaatcagttctgaaatttaca

SEQ ID NO: 7443263 - DNA, 22 bp, Homo sapiens
gaaatcaaacccttttctgata

SEQ ID NO: 7443264 - DNA, 22 bp, Homo sapiens
gaaatcaaacccttttctgata

SEQ ID NO: 7443265 - DNA, 22 bp, Homo sapiens
gaaatcaaacccttttctgata

SEQ ID NO: 7443266 - DNA, 22 bp, Homo sapiens
gaaatatttctcttgagcccct

SEQ ID NO: 7443267 - DNA, 22 bp, Homo sapiens
gaaatatttctcttgagcccct

SEQ ID NO: 7443268 - DNA, 22 bp, Homo sapiens
gaaatatttctcttgagcccct

SEQ ID NO: 7443269 - DNA, 22 bp, Homo sapiens
gaaatatttctcttgagcccct

SEQ ID NO: 7443270 - DNA, 22 bp, Homo sapiens
ctttccaactgggtgggcagct

SEQ ID NO: 7443271 - DNA, 22 bp, Homo sapiens
ctttccaactgggtgggcagct

SEQ ID NO: 7443272 - DNA, 22 bp, Homo sapiens
gaaatatttctcttgagcccct

SEQ ID NO: 7443273 - DNA, 22 bp, Homo sapiens
gaaatatttctcttgagcccct

SEQ ID NO: 7443274 - DNA, 22 bp, Homo sapiens
gaaatatttctcttgagcccct

SEQ ID NO: 7443275 - DNA, 22 bp, Homo sapiens
gaaatatttctcttgagcccct

SEQ ID NO: 7443276 - DNA, 22 bp, Homo sapiens
ctttcagttagtacctagtggc

SEQ ID NO: 7443277 - DNA, 22 bp, Homo sapiens
ctttcataaggggttttataat

SEQ ID NO: 7443278 - DNA, 22 bp, Homo sapiens
ctttcataaaggaaatgatgag

SEQ ID NO: 7443279 - DNA, 22 bp, Homo sapiens
ctttcataaaggaaatgatgag

SEQ ID NO: 7443280 - DNA, 22 bp, Homo sapiens
ctttcataaaggaaatgatgag

SEQ ID NO: 7443281 - DNA, 22 bp, Homo sapiens
ctttcagttacagttacacaca

SEQ ID NO: 7443282 - DNA, 22 bp, Homo sapiens
ctttcagtctttacaaggttgc

SEQ ID NO: 7443283 - DNA, 22 bp, Homo sapiens
ctttcagtcagttaactcagaa

SEQ ID NO: 7443284 - DNA, 18 bp, Homo sapiens
ctttcagtaatttcagcc

SEQ ID NO: 7443285 - DNA, 22 bp, Homo sapiens
ctttcagtcagttaactcagaa

SEQ ID NO: 7443286 - DNA, 18 bp, Homo sapiens
ctttcagtaatttcagcc

SEQ ID NO: 7443287 - DNA, 22 bp, Homo sapiens
ctttcagggcaacacttctttt

SEQ ID NO: 7443288 - DNA, 22 bp, Homo sapiens
ctttcaggttctataggaagcc

SEQ ID NO: 7443289 - DNA, 22 bp, Homo sapiens
ctttcagaggggcgtacacagc

SEQ ID NO: 7443290 - DNA, 22 bp, Homo sapiens
ctttcagaagtatattctggaa

SEQ ID NO: 7443291 - DNA, 22 bp, Homo sapiens
ctttcagaagccggaagggcag

SEQ ID NO: 7443292 - DNA, 22 bp, Homo sapiens
ctttcagaagccggaagggcag

SEQ ID NO: 7443293 - DNA, 22 bp, Homo sapiens
ctttcagatagtctgagatata

SEQ ID NO: 7443294 - DNA, 22 bp, Homo sapiens
ctttcagaggttactcaggaaa

SEQ ID NO: 7443295 - DNA, 22 bp, Homo sapiens
ctttcagatagtctgagatata

SEQ ID NO: 7443296 - DNA, 22 bp, Homo sapiens
ctttcacacacatacatttgga

SEQ ID NO: 7443297 - DNA, 22 bp, Homo sapiens
ctttcacagctgtgcttatgat

SEQ ID NO: 7443298 - DNA, 22 bp, Homo sapiens
ctttcacagctgtgcttatgat

SEQ ID NO: 7443299 - DNA, 22 bp, Homo sapiens
ctttcacagtcatatgatgaat

SEQ ID NO: 7443300 - DNA, 22 bp, Homo sapiens
ctttcacagcttgaaaagtatt

SEQ ID NO: 7443301 - DNA, 22 bp, Homo sapiens
ctttcacagtcatatgatgaat

SEQ ID NO: 7443302 - DNA, 22 bp, Homo sapiens
ctttcacagtcatatgatgaat

SEQ ID NO: 7443303 - DNA, 22 bp, Homo sapiens
ctttcactcgagctcctgcagc

SEQ ID NO: 7443304 - DNA, 22 bp, Homo sapiens
ctttcactttaatctgacacct

SEQ ID NO: 7443305 - DNA, 22 bp, Homo sapiens
ctttcagaagaggacctttcca

SEQ ID NO: 7443306 - DNA, 18 bp, Homo sapiens
ctttatgtgcagagcttt

SEQ ID NO: 7443307 - DNA, 18 bp, Homo sapiens
ctttatgtgcagagcttt

SEQ ID NO: 7443308 - DNA, 18 bp, Homo sapiens
ctttatgtgcagagcttt

SEQ ID NO: 7443309 - DNA, 18 bp, Homo sapiens
ctttatgtgcagagcttt

SEQ ID NO: 7443310 - DNA, 22 bp, Homo sapiens
ctttatgtccttgaagagttgt

SEQ ID NO: 7443311 - DNA, 22 bp, Homo sapiens
ctttatgtccttgaagagttgt

SEQ ID NO: 7443312 - DNA, 22 bp, Homo sapiens
ctttcaagtgatggggcatata

SEQ ID NO: 7443313 - DNA, 22 bp, Homo sapiens
ctttcaagtgatggggcatata

SEQ ID NO: 7443314 - DNA, 22 bp, Homo sapiens
ctttatgtgctgggcattaagg

SEQ ID NO: 7443315 - DNA, 22 bp, Homo sapiens
ctttatgtgctgggcattaagg

SEQ ID NO: 7443316 - DNA, 22 bp, Homo sapiens
ctttcaatcaaagtttctagtg

SEQ ID NO: 7443317 - DNA, 22 bp, Homo sapiens
ctttcaatcaaagtttctagtg

SEQ ID NO: 7443318 - DNA, 22 bp, Homo sapiens
ctttcaatcaaagtttctagtg

SEQ ID NO: 7443319 - DNA, 22 bp, Homo sapiens
ctttcacacacatacatttgga

SEQ ID NO: 7443320 - DNA, 22 bp, Homo sapiens
ctttcacaagatttgagatgct

SEQ ID NO: 7443321 - DNA, 22 bp, Homo sapiens
ctttcacaagatttgagatgct

SEQ ID NO: 7443322 - DNA, 22 bp, Homo sapiens
ctttcacaagatttgagatgct

SEQ ID NO: 7443323 - DNA, 22 bp, Homo sapiens
ctttcaatcaaagtttctagtg

SEQ ID NO: 7443324 - DNA, 22 bp, Homo sapiens
ctttcaatgtcatctgtgaatg

SEQ ID NO: 7443325 - DNA, 22 bp, Homo sapiens
ctttcaatgtgcctgccttggg

SEQ ID NO: 7443326 - DNA, 22 bp, Homo sapiens
ctttcaatgtgcctgccttggg

SEQ ID NO: 7443327 - DNA, 22 bp, Homo sapiens
ctttcaatgtgcctgccttggg

SEQ ID NO: 7443328 - DNA, 22 bp, Homo sapiens
ctttcacaagatttgagatgct

SEQ ID NO: 7443329 - DNA, 22 bp, Homo sapiens
gagatgcagaaccctcaggagc

SEQ ID NO: 7443330 - DNA, 22 bp, Homo sapiens
gagatgcagaaccctcaggagc

SEQ ID NO: 7443331 - DNA, 22 bp, Homo sapiens
gagatgatctttcctgtagtcc

SEQ ID NO: 7443332 - DNA, 22 bp, Homo sapiens
gagatgatctctttcagctctg

SEQ ID NO: 7443333 - DNA, 22 bp, Homo sapiens
gagatgcaagcaagtctatttt

SEQ ID NO: 7443334 - DNA, 22 bp, Homo sapiens
gagatgctatggctattcccct

SEQ ID NO: 7443335 - DNA, 22 bp, Homo sapiens
gagatgctgtcaggctatctgt

SEQ ID NO: 7443336 - DNA, 22 bp, Homo sapiens
gagatcggtaaagagcatgcac

SEQ ID NO: 7443337 - DNA, 22 bp, Homo sapiens
gagagggatactgagttttggt

SEQ ID NO: 7443338 - DNA, 18 bp, Homo sapiens
gagagggatccctcagga

SEQ ID NO: 7443339 - DNA, 22 bp, Homo sapiens
gagatcggtaaagagcatgcac

SEQ ID NO: 7443340 - DNA, 22 bp, Homo sapiens
gagatcggtaaagagcatgcac

SEQ ID NO: 7443341 - DNA, 22 bp, Homo sapiens
gagatgaatcattccatggtca

SEQ ID NO: 7443342 - DNA, 22 bp, Homo sapiens
gagatgaatcattccatggtca

SEQ ID NO: 7443343 - DNA, 22 bp, Homo sapiens
gagatgaagaggcccttggagt

SEQ ID NO: 7443344 - DNA, 22 bp, Homo sapiens
gagatctctagcacttcctgta

SEQ ID NO: 7443345 - DNA, 22 bp, Homo sapiens
gagatgaatgtaaacaaaggca

SEQ ID NO: 7443346 - DNA, 22 bp, Homo sapiens
gagatgagtgggggatctctca

SEQ ID NO: 7443347 - DNA, 22 bp, Homo sapiens
gagatgagtgggggatctctca

SEQ ID NO: 7443348 - DNA, 22 bp, Homo sapiens
gagatgaatgtaaacaaaggca

SEQ ID NO: 7443349 - DNA, 22 bp, Homo sapiens
gagatgaatgtaaacaaaggca

SEQ ID NO: 7443350 - DNA, 22 bp, Homo sapiens
gagatgaatgtaaacaaaggca

SEQ ID NO: 7443351 - DNA, 22 bp, Homo sapiens
gagatgaatgtaaacaaaggca

SEQ ID NO: 7443352 - DNA, 22 bp, Homo sapiens
gagatgaatgtaaacaaaggca

SEQ ID NO: 7443353 - DNA, 22 bp, Homo sapiens
gagaggcttaagggctgtgaag

SEQ ID NO: 7443354 - DNA, 22 bp, Homo sapiens
gagaggcttgtgtgaagaacaa

SEQ ID NO: 7443355 - DNA, 22 bp, Homo sapiens
gagaggcttaagggctgtgaag

SEQ ID NO: 7443356 - DNA, 22 bp, Homo sapiens
gagaggcttgtgtgaagaacaa

SEQ ID NO: 7443357 - DNA, 22 bp, Homo sapiens
gagagggagccagccaggaacc

SEQ ID NO: 7443358 - DNA, 22 bp, Homo sapiens
gagagggagccagccaggaacc

SEQ ID NO: 7443359 - DNA, 22 bp, Homo sapiens
gagagggagccagccaggaacc

SEQ ID NO: 7443360 - DNA, 22 bp, Homo sapiens
gagagggagccagccaggaacc

SEQ ID NO: 7443361 - DNA, 22 bp, Homo sapiens
gagaggcttgtgtgaagaacaa

SEQ ID NO: 7443362 - DNA, 22 bp, Homo sapiens
gagaggcttgtgtgaagaacaa

SEQ ID NO: 7443363 - DNA, 22 bp, Homo sapiens
gagaggcttgtgtgaagaacaa

SEQ ID NO: 7443364 - DNA, 22 bp, Homo sapiens
gagagggatactgagttttggt

SEQ ID NO: 7443365 - DNA, 22 bp, Homo sapiens
gagagggagccagccaggaacc

SEQ ID NO: 7443366 - DNA, 22 bp, Homo sapiens
gagagggatactgagttttggt

SEQ ID NO: 7443367 - DNA, 22 bp, Homo sapiens
gagagggagccagccaggaacc

SEQ ID NO: 7443368 - DNA, 22 bp, Homo sapiens
gagagggagccagccaggaacc

SEQ ID NO: 7443369 - DNA, 22 bp, Homo sapiens
gagagggagccagccaggaacc

SEQ ID NO: 7443370 - DNA, 22 bp, Homo sapiens
gagagggagccagccaggaacc

SEQ ID NO: 7443371 - DNA, 22 bp, Homo sapiens
gagagggagccagccaggaacc

SEQ ID NO: 7443372 - DNA, 22 bp, Homo sapiens
gagaggctgggttggagatcga

SEQ ID NO: 7443373 - DNA, 22 bp, Homo sapiens
gagaggctgggttggagatcga

SEQ ID NO: 7443374 - DNA, 22 bp, Homo sapiens
gagaggctgggttggagatcga

SEQ ID NO: 7443375 - DNA, 22 bp, Homo sapiens
gagaggctccatgaccccggca

SEQ ID NO: 7443376 - DNA, 22 bp, Homo sapiens
gagaggctgggttggagatcga

SEQ ID NO: 7443377 - DNA, 22 bp, Homo sapiens
gagaggctgggttggagatcga

SEQ ID NO: 7443378 - DNA, 22 bp, Homo sapiens
gagaggctgggttggagatcga

SEQ ID NO: 7443379 - DNA, 22 bp, Homo sapiens
gagaggctgggttggagatcga

SEQ ID NO: 7443380 - DNA, 22 bp, Homo sapiens
gagaggctgggttggagatcga

SEQ ID NO: 7443381 - DNA, 22 bp, Homo sapiens
gagaggctggtaaagtctgaac

SEQ ID NO: 7443382 - DNA, 22 bp, Homo sapiens
gagaggctggtaaagtctgaac

SEQ ID NO: 7443383 - DNA, 22 bp, Homo sapiens
gagaggctggtaaagtctgaac

SEQ ID NO: 7443384 - DNA, 22 bp, Homo sapiens
gagaggctgtgtgccattgttg

SEQ ID NO: 7443385 - DNA, 22 bp, Homo sapiens
gagaggctggtaaagtctgaac

SEQ ID NO: 7443386 - DNA, 22 bp, Homo sapiens
gagaggctgtgtgccattgttg

SEQ ID NO: 7443387 - DNA, 22 bp, Homo sapiens
gagaggcttaagggctgtgaag

SEQ ID NO: 7443388 - DNA, 22 bp, Homo sapiens
gagaggcttaagggctgtgaag

SEQ ID NO: 7443389 - DNA, 22 bp, Homo sapiens
gagaggctgtgtgccattgttg

SEQ ID NO: 7443390 - DNA, 22 bp, Homo sapiens
gagaggcatggaacagattctt

SEQ ID NO: 7443391 - DNA, 22 bp, Homo sapiens
gagaggcatggaacagattctt

SEQ ID NO: 7443392 - DNA, 22 bp, Homo sapiens
gagaggcatggaacagattctt

SEQ ID NO: 7443393 - DNA, 22 bp, Homo sapiens
gagaggcatggaacagattctt

SEQ ID NO: 7443394 - DNA, 22 bp, Homo sapiens
gagacacaaacatttattccac

SEQ ID NO: 7443395 - DNA, 22 bp, Homo sapiens
gagaggcaggcgctgcaatggt

SEQ ID NO: 7443396 - DNA, 22 bp, Homo sapiens
gagaggcatggaacagattctt

SEQ ID NO: 7443397 - DNA, 22 bp, Homo sapiens
gagaggcatggaacagattctt

SEQ ID NO: 7443398 - DNA, 22 bp, Homo sapiens
gagaggcatggaacagattctt

SEQ ID NO: 7443399 - DNA, 22 bp, Homo sapiens
gagaggcatggaacagattctt

SEQ ID NO: 7443400 - DNA, 22 bp, Homo sapiens
gagacaaagcttcctgtgggta

SEQ ID NO: 7443401 - DNA, 22 bp, Homo sapiens
gagacaaaagttggagtgcaag

SEQ ID NO: 7443402 - DNA, 22 bp, Homo sapiens
gagacaaaagttggagtgcaag

SEQ ID NO: 7443403 - DNA, 22 bp, Homo sapiens
gagacaatttctaagatgcttc

SEQ ID NO: 7443404 - DNA, 22 bp, Homo sapiens
gagacaatttctaagatgcttc

SEQ ID NO: 7443405 - DNA, 22 bp, Homo sapiens
gagacacaaacacatttagagg

SEQ ID NO: 7443406 - DNA, 22 bp, Homo sapiens
gagacaatttctaagatgcttc

SEQ ID NO: 7443407 - DNA, 22 bp, Homo sapiens
gagacacaaacacatttagagg

SEQ ID NO: 7443408 - DNA, 22 bp, Homo sapiens
gagaggccatggctgtgcagtg

SEQ ID NO: 7443409 - DNA, 22 bp, Homo sapiens
gagaggccatggctgtgcagtg

SEQ ID NO: 7443410 - DNA, 22 bp, Homo sapiens
gagaggccatggctgtgcagtg

SEQ ID NO: 7443411 - DNA, 22 bp, Homo sapiens
gagaggccatggctgtgcagtg

SEQ ID NO: 7443412 - DNA, 22 bp, Homo sapiens
gagaggccatggctgtgcagtg

SEQ ID NO: 7443413 - DNA, 22 bp, Homo sapiens
gagaggccatggctgtgcagtg

SEQ ID NO: 7443414 - DNA, 22 bp, Homo sapiens
gagaggccatggggtgggatgc

SEQ ID NO: 7443415 - DNA, 22 bp, Homo sapiens
gagaggccatggggtgggatgc

SEQ ID NO: 7443416 - DNA, 22 bp, Homo sapiens
gagaggccatggggtgggatgc

SEQ ID NO: 7443417 - DNA, 22 bp, Homo sapiens
gagaggccatggctgtgcagtg

SEQ ID NO: 7443418 - DNA, 22 bp, Homo sapiens
gagaggccatggggtgggatgc

SEQ ID NO: 7443419 - DNA, 22 bp, Homo sapiens
gagaggccatggctgtgcagtg

SEQ ID NO: 7443420 - DNA, 22 bp, Homo sapiens
gagaggccacctgacgagcagt

SEQ ID NO: 7443421 - DNA, 22 bp, Homo sapiens
gagaggccatggctgtgcagtg

SEQ ID NO: 7443422 - DNA, 22 bp, Homo sapiens
gagaggccacctgacgagcagt

SEQ ID NO: 7443423 - DNA, 22 bp, Homo sapiens
gagaggccacctgacgagcagt

SEQ ID NO: 7443424 - DNA, 22 bp, Homo sapiens
gagaggccaagggatccgtgag

SEQ ID NO: 7443425 - DNA, 22 bp, Homo sapiens
gagaggccaaaatccctgcccc

SEQ ID NO: 7443426 - DNA, 22 bp, Homo sapiens
gagaggccaaaatccctgcccc

SEQ ID NO: 7443427 - DNA, 22 bp, Homo sapiens
gagaggccaaaatccctgcccc

SEQ ID NO: 7443428 - DNA, 22 bp, Homo sapiens
gagaggccaaaatccctgcccc

SEQ ID NO: 7443429 - DNA, 22 bp, Homo sapiens
gagaggcctgggcccgtgagct

SEQ ID NO: 7443430 - DNA, 22 bp, Homo sapiens
gagaggcctgggcccgtgagct

SEQ ID NO: 7443431 - DNA, 22 bp, Homo sapiens
gagaggcctgggcccgtgagct

SEQ ID NO: 7443432 - DNA, 21 bp, Homo sapiens
gagaggcctgggcccgtgagc

SEQ ID NO: 7443433 - DNA, 22 bp, Homo sapiens
gagaggcctgagaggctgcgga

SEQ ID NO: 7443434 - DNA, 22 bp, Homo sapiens
gagaggcctgagaggctgcgga

SEQ ID NO: 7443435 - DNA, 22 bp, Homo sapiens
gagaggcctgagaggctgcgga

SEQ ID NO: 7443436 - DNA, 22 bp, Homo sapiens
gagaggctcagggacttgctga

SEQ ID NO: 7443437 - DNA, 22 bp, Homo sapiens
gagaggctatgaggttctgtgt

SEQ ID NO: 7443438 - DNA, 22 bp, Homo sapiens
gagaggctatgaggttctgtgt

SEQ ID NO: 7443439 - DNA, 22 bp, Homo sapiens
gagaggctcagggacttgctga

SEQ ID NO: 7443440 - DNA, 22 bp, Homo sapiens
gagaggctatgaggttctgtgt

SEQ ID NO: 7443441 - DNA, 22 bp, Homo sapiens
gagaggctatgaggttctgtgt

SEQ ID NO: 7443442 - DNA, 19 bp, Homo sapiens
gagaggcctgtgcttgaag

SEQ ID NO: 7443443 - DNA, 19 bp, Homo sapiens
gagaggcctgtgcttgaag

SEQ ID NO: 7443444 - DNA, 18 bp, Homo sapiens
gagaggcccggctgtgcc

SEQ ID NO: 7443445 - DNA, 22 bp, Homo sapiens
gagaggccctgaagcccacaga

SEQ ID NO: 7443446 - DNA, 22 bp, Homo sapiens
gagaggccctgaagcccacaga

SEQ ID NO: 7443447 - DNA, 22 bp, Homo sapiens
gagaggccctgaagcccacaga

SEQ ID NO: 7443448 - DNA, 22 bp, Homo sapiens
gagaggccctgaagcccacaga

SEQ ID NO: 7443449 - DNA, 22 bp, Homo sapiens
gagaggccatggggtgggatgc

SEQ ID NO: 7443450 - DNA, 22 bp, Homo sapiens
gagaggccatggggtgggatgc

SEQ ID NO: 7443451 - DNA, 18 bp, Homo sapiens
gagaggcccggctgtgcc

SEQ ID NO: 7443452 - DNA, 18 bp, Homo sapiens
gagaggcccggctgtgcc

SEQ ID NO: 7443453 - DNA, 18 bp, Homo sapiens
gagaggcccggctgtgcc

SEQ ID NO: 7443454 - DNA, 18 bp, Homo sapiens
gagaggcccggctgtgcc

SEQ ID NO: 7443455 - DNA, 22 bp, Homo sapiens
gagaggcctgagaggctgcgga

SEQ ID NO: 7443456 - DNA, 22 bp, Homo sapiens
gagaggcctgagaggctgcgga

SEQ ID NO: 7443457 - DNA, 22 bp, Homo sapiens
gagaggcctgagaggctgcgga

SEQ ID NO: 7443458 - DNA, 22 bp, Homo sapiens
gagaggccggcgtcgctgcggc

SEQ ID NO: 7443459 - DNA, 22 bp, Homo sapiens
gagaggccctgtggtcccagct

SEQ ID NO: 7443460 - DNA, 22 bp, Homo sapiens
gagaggccctgtggtcccagct

SEQ ID NO: 7443461 - DNA, 22 bp, Homo sapiens
gagaggccctgtggtcccagct

SEQ ID NO: 7443462 - DNA, 22 bp, Homo sapiens
gagaagggatatggcttcttga

SEQ ID NO: 7443463 - DNA, 22 bp, Homo sapiens
gagaagggatatggcttcttga

SEQ ID NO: 7443464 - DNA, 22 bp, Homo sapiens
gagaagggatatgccactctcg

SEQ ID NO: 7443465 - DNA, 22 bp, Homo sapiens
gagaagggcttgggagtcaaca

SEQ ID NO: 7443466 - DNA, 22 bp, Homo sapiens
gagaagggatatggcttcttga

SEQ ID NO: 7443467 - DNA, 22 bp, Homo sapiens
gagaagggatatgccactctcg

SEQ ID NO: 7443468 - DNA, 22 bp, Homo sapiens
gagaagggatatgccactctcg

SEQ ID NO: 7443469 - DNA, 22 bp, Homo sapiens
gagaagggatatgccactctcg

SEQ ID NO: 7443470 - DNA, 22 bp, Homo sapiens
gagaagggatatgccactctcg

SEQ ID NO: 7443471 - DNA, 22 bp, Homo sapiens
gagaagggcttgggagtcaaca

SEQ ID NO: 7443472 - DNA, 22 bp, Homo sapiens
gagaagggcttgggagtcaaca

SEQ ID NO: 7443473 - DNA, 22 bp, Homo sapiens
gagaagggcttgggagtcaaca

SEQ ID NO: 7443474 - DNA, 22 bp, Homo sapiens
gagaagggggctcgagtgtcct

SEQ ID NO: 7443475 - DNA, 22 bp, Homo sapiens
gagaagggggctcgagtgtcct

SEQ ID NO: 7443476 - DNA, 22 bp, Homo sapiens
gagaagggcttgggagtcaaca

SEQ ID NO: 7443477 - DNA, 22 bp, Homo sapiens
gagaagggggctcgagtgtcct

SEQ ID NO: 7443478 - DNA, 22 bp, Homo sapiens
gagaagggggctcgagtgtcct

SEQ ID NO: 7443479 - DNA, 22 bp, Homo sapiens
gagaagggatatgccactctcg

SEQ ID NO: 7443480 - DNA, 22 bp, Homo sapiens
gagaaggcttcttttcctctga

SEQ ID NO: 7443481 - DNA, 22 bp, Homo sapiens
gagaaggcttcttttcctctga

SEQ ID NO: 7443482 - DNA, 22 bp, Homo sapiens
gagaaggcttcttttcctctga

SEQ ID NO: 7443483 - DNA, 22 bp, Homo sapiens
gagaaggctgatccttggagtt

SEQ ID NO: 7443484 - DNA, 22 bp, Homo sapiens
gagaaggctggtcttaagtcga

SEQ ID NO: 7443485 - DNA, 22 bp, Homo sapiens
gagaaggctggtcttaagtcga

SEQ ID NO: 7443486 - DNA, 22 bp, Homo sapiens
gagaaggctgatccttggagtt

SEQ ID NO: 7443487 - DNA, 22 bp, Homo sapiens
gagaaggctgatccttggagtt

SEQ ID NO: 7443488 - DNA, 22 bp, Homo sapiens
gagaaggctgatccttggagtt

SEQ ID NO: 7443489 - DNA, 22 bp, Homo sapiens
gagaaggccaggaacccagtgt

SEQ ID NO: 7443490 - DNA, 22 bp, Homo sapiens
gagaaggccaggaacccagtgt

SEQ ID NO: 7443491 - DNA, 22 bp, Homo sapiens
gagaaggatgtggctcatagct

SEQ ID NO: 7443492 - DNA, 22 bp, Homo sapiens
gagaaggatgtggctcatagct

SEQ ID NO: 7443493 - DNA, 22 bp, Homo sapiens
gagaaggatgtggctcatagct

SEQ ID NO: 7443494 - DNA, 22 bp, Homo sapiens
gagaagggggctcgagtgtcct

SEQ ID NO: 7443495 - DNA, 22 bp, Homo sapiens
gagaagggggctcgagtgtcct

SEQ ID NO: 7443496 - DNA, 22 bp, Homo sapiens
gagaagggggctcgagtgtcct

SEQ ID NO: 7443497 - DNA, 22 bp, Homo sapiens
gagaagggggctcgagtgtcct

SEQ ID NO: 7443498 - DNA, 22 bp, Homo sapiens
gagaaggggtgatgtgggtaat

SEQ ID NO: 7443499 - DNA, 22 bp, Homo sapiens
gagaatctctttgacaagcaga

SEQ ID NO: 7443500 - DNA, 19 bp, Homo sapiens
gagaatctctttgatgttt

SEQ ID NO: 7443501 - DNA, 22 bp, Homo sapiens
gagaatctgggttttggctatc

SEQ ID NO: 7443502 - DNA, 22 bp, Homo sapiens
gagaatgggaatgaaagtagca

SEQ ID NO: 7443503 - DNA, 22 bp, Homo sapiens
gagaatgtggagcctgtggttg

SEQ ID NO: 7443504 - DNA, 22 bp, Homo sapiens
gagaatgtggagcctgtggttg

SEQ ID NO: 7443505 - DNA, 22 bp, Homo sapiens
gagaatgttaatgttgaagtat

SEQ ID NO: 7443506 - DNA, 22 bp, Homo sapiens
gagaatgttaatgttgaagtat

SEQ ID NO: 7443507 - DNA, 22 bp, Homo sapiens
gagaatgctggagatttatttt

SEQ ID NO: 7443508 - DNA, 22 bp, Homo sapiens
gagaatgccttggaagaagtcc

SEQ ID NO: 7443509 - DNA, 22 bp, Homo sapiens
gagaatctttccccacagaagg

SEQ ID NO: 7443510 - DNA, 22 bp, Homo sapiens
gagaattagggcgtaattcaga

SEQ ID NO: 7443511 - DNA, 22 bp, Homo sapiens
gagaattagggcgtaattcaga

SEQ ID NO: 7443512 - DNA, 22 bp, Homo sapiens
gagaattactgtttttataaca

SEQ ID NO: 7443513 - DNA, 22 bp, Homo sapiens
gagaattactgtttttataaca

SEQ ID NO: 7443514 - DNA, 22 bp, Homo sapiens
gagaatgttaatgttgaagtat

SEQ ID NO: 7443515 - DNA, 22 bp, Homo sapiens
gagaattagggcgtaattcaga

SEQ ID NO: 7443516 - DNA, 22 bp, Homo sapiens
gagaattcttcaacaaagtatt

SEQ ID NO: 7443517 - DNA, 22 bp, Homo sapiens
gagaattcttcaacaaagtatt

SEQ ID NO: 7443518 - DNA, 22 bp, Homo sapiens
gagaattagggcgtaattcaga

SEQ ID NO: 7443519 - DNA, 22 bp, Homo sapiens
gagaatttcccagtctgtgctg

SEQ ID NO: 7443520 - DNA, 22 bp, Homo sapiens
gagaatttcccagtctgtgctg

SEQ ID NO: 7443521 - DNA, 22 bp, Homo sapiens
gagacaaaagttggagtgcaag

SEQ ID NO: 7443522 - DNA, 22 bp, Homo sapiens
gagaatttgtcttgaattttaa

SEQ ID NO: 7443523 - DNA, 22 bp, Homo sapiens
gagaattttctagtagtttcat

SEQ ID NO: 7443524 - DNA, 22 bp, Homo sapiens
gagacaaaagttggagtgcaag

SEQ ID NO: 7443525 - DNA, 22 bp, Homo sapiens
gagacaaaagttggagtgcaag

SEQ ID NO: 7443526 - DNA, 22 bp, Homo sapiens
gagaatttgctggcttcattgt

SEQ ID NO: 7443527 - DNA, 22 bp, Homo sapiens
gagaattttctagtagtttcat

SEQ ID NO: 7443528 - DNA, 22 bp, Homo sapiens
gagaatttgtcttgaattttaa

SEQ ID NO: 7443529 - DNA, 22 bp, Homo sapiens
gagaatttgtcttgaattttaa

SEQ ID NO: 7443530 - DNA, 22 bp, Homo sapiens
gagaatttgtcttgaattttaa

SEQ ID NO: 7443531 - DNA, 22 bp, Homo sapiens
gacctccgtgtacacctcccag

SEQ ID NO: 7443532 - DNA, 22 bp, Homo sapiens
gacctccattctgtcatgactg

SEQ ID NO: 7443533 - DNA, 22 bp, Homo sapiens
gacctccattctgtcatgactg

SEQ ID NO: 7443534 - DNA, 22 bp, Homo sapiens
gacctccagcggccctgcagag

SEQ ID NO: 7443535 - DNA, 22 bp, Homo sapiens
gacctccgtgtacacctcccag

SEQ ID NO: 7443536 - DNA, 22 bp, Homo sapiens
gacctcgtgatccgccctcctt

SEQ ID NO: 7443537 - DNA, 22 bp, Homo sapiens
gacctcgtgatccgccctcctt

SEQ ID NO: 7443538 - DNA, 22 bp, Homo sapiens
gacctctcaggaatctcacatg

SEQ ID NO: 7443539 - DNA, 22 bp, Homo sapiens
gacctcatgatccacctgcctt

SEQ ID NO: 7443540 - DNA, 22 bp, Homo sapiens
gacctccagcggccctgcagag

SEQ ID NO: 7443541 - DNA, 22 bp, Homo sapiens
gacctccagcggccctgcagag

SEQ ID NO: 7443542 - DNA, 22 bp, Homo sapiens
gacctccagcggccctgcagag

SEQ ID NO: 7443543 - DNA, 22 bp, Homo sapiens
gacctccagcggccctgcagag

SEQ ID NO: 7443544 - DNA, 22 bp, Homo sapiens
gacctccagcggccctgcagag

SEQ ID NO: 7443545 - DNA, 22 bp, Homo sapiens
gacctccagcggccctgcagag

SEQ ID NO: 7443546 - DNA, 22 bp, Homo sapiens
gacctccattctgtcatgactg

SEQ ID NO: 7443547 - DNA, 22 bp, Homo sapiens
gacctcatgatccacctgcctt

SEQ ID NO: 7443548 - DNA, 22 bp, Homo sapiens
gacctcatgatccacctgcctt

SEQ ID NO: 7443549 - DNA, 22 bp, Homo sapiens
gacctcatgatccacctgcctt

SEQ ID NO: 7443550 - DNA, 22 bp, Homo sapiens
gacctcatgatccacctgcctt

SEQ ID NO: 7443551 - DNA, 22 bp, Homo sapiens
gacctcagtgaatggtcatgta

SEQ ID NO: 7443552 - DNA, 22 bp, Homo sapiens
gacctcatgatccacctgcctt

SEQ ID NO: 7443553 - DNA, 22 bp, Homo sapiens
gacctcagtgaatggtcatgta

SEQ ID NO: 7443554 - DNA, 22 bp, Homo sapiens
gacctcagtgaatggtcatgta

SEQ ID NO: 7443555 - DNA, 22 bp, Homo sapiens
gacctcagtgaatggtcatgta

SEQ ID NO: 7443556 - DNA, 16 bp, Homo sapiens
gacctcagtgctggct

SEQ ID NO: 7443557 - DNA, 22 bp, Homo sapiens
gacctcagctgtggggatgctg

SEQ ID NO: 7443558 - DNA, 22 bp, Homo sapiens
gacctcagattttcccaggcca

SEQ ID NO: 7443559 - DNA, 22 bp, Homo sapiens
gacctcaggcttctgtaattaa

SEQ ID NO: 7443560 - DNA, 22 bp, Homo sapiens
gacctcaggcttctgtaattaa

SEQ ID NO: 7443561 - DNA, 22 bp, Homo sapiens
gacctcaggcttctgtaattaa

SEQ ID NO: 7443562 - DNA, 17 bp, Homo sapiens
gacctcaggtgatctgc

SEQ ID NO: 7443563 - DNA, 22 bp, Homo sapiens
gacctcaggtttgtaatggaca

SEQ ID NO: 7443564 - DNA, 17 bp, Homo sapiens
gacctcaggtgatctgc

SEQ ID NO: 7443565 - DNA, 22 bp, Homo sapiens
gacctcaggtttgtaatggaca

SEQ ID NO: 7443566 - DNA, 17 bp, Homo sapiens
gacctcaggtgatctgc

SEQ ID NO: 7443567 - DNA, 22 bp, Homo sapiens
gacctcagtattgttcaggatg

SEQ ID NO: 7443568 - DNA, 22 bp, Homo sapiens
gacctcagtattgttcaggatg

SEQ ID NO: 7443569 - DNA, 22 bp, Homo sapiens
gacctctgggtgatgcccaggc

SEQ ID NO: 7443570 - DNA, 22 bp, Homo sapiens
gacctctgggtgatgcccaggc

SEQ ID NO: 7443571 - DNA, 22 bp, Homo sapiens
gacctctcaggaatctcacatg

SEQ ID NO: 7443572 - DNA, 22 bp, Homo sapiens
gacctctgttggacccctgggg

SEQ ID NO: 7443573 - DNA, 22 bp, Homo sapiens
gacctctgttggacccctgggg

SEQ ID NO: 7443574 - DNA, 22 bp, Homo sapiens
gacctcttgcaccctggctctt

SEQ ID NO: 7443575 - DNA, 22 bp, Homo sapiens
gacctgaaagagattaaatgac

SEQ ID NO: 7443576 - DNA, 22 bp, Homo sapiens
gacctctcaggaatctcacatg

SEQ ID NO: 7443577 - DNA, 22 bp, Homo sapiens
gacctgaaatgggggcctgtcc

SEQ ID NO: 7443578 - DNA, 22 bp, Homo sapiens
gagaaggactacggaaaacaga

SEQ ID NO: 7443579 - DNA, 22 bp, Homo sapiens
gagaaggactacggaaaacaga

SEQ ID NO: 7443580 - DNA, 22 bp, Homo sapiens
gagaaggactacggaaaacaga

SEQ ID NO: 7443581 - DNA, 22 bp, Homo sapiens
gagaaggactacggaaaacaga

SEQ ID NO: 7443582 - DNA, 22 bp, Homo sapiens
gagaaggactacggaaaacaga

SEQ ID NO: 7443583 - DNA, 22 bp, Homo sapiens
gagaaggactacacatctggcc

SEQ ID NO: 7443584 - DNA, 22 bp, Homo sapiens
gagaaggactacacatctggcc

SEQ ID NO: 7443585 - DNA, 22 bp, Homo sapiens
gacctgaaatttgtggtagaac

SEQ ID NO: 7443586 - DNA, 22 bp, Homo sapiens
gagaaggagtagctgacctggg

SEQ ID NO: 7443587 - DNA, 22 bp, Homo sapiens
gagaaggagtagctgacctggg

SEQ ID NO: 7443588 - DNA, 22 bp, Homo sapiens
gagaaggagtagctgacctggg

SEQ ID NO: 7443589 - DNA, 22 bp, Homo sapiens
gagaaggagtagctgacctggg

SEQ ID NO: 7443590 - DNA, 22 bp, Homo sapiens
gagaaggatgaggaaatggtat

SEQ ID NO: 7443591 - DNA, 22 bp, Homo sapiens
gagaaggatgaggaaatggtat

SEQ ID NO: 7443592 - DNA, 22 bp, Homo sapiens
gagaaggatgaggaaatggtat

SEQ ID NO: 7443593 - DNA, 22 bp, Homo sapiens
gagaaggatgtggctcatagct

SEQ ID NO: 7443594 - DNA, 22 bp, Homo sapiens
gagaaggatgtggctcatagct

SEQ ID NO: 7443595 - DNA, 22 bp, Homo sapiens
gagaaggatgtggctcatagct

SEQ ID NO: 7443596 - DNA, 22 bp, Homo sapiens
gagaaggatgtggctcatagct

SEQ ID NO: 7443597 - DNA, 22 bp, Homo sapiens
gagaaggagctcaaatatggct

SEQ ID NO: 7443598 - DNA, 22 bp, Homo sapiens
gagaaggagctcaaatatggct

SEQ ID NO: 7443599 - DNA, 22 bp, Homo sapiens
gagaaggagctcaaatatggct

SEQ ID NO: 7443600 - DNA, 22 bp, Homo sapiens
gagaaggagctccttggggtct

SEQ ID NO: 7443601 - DNA, 22 bp, Homo sapiens
gagaaggagctcaaatatggct

SEQ ID NO: 7443602 - DNA, 22 bp, Homo sapiens
gagaaggagctccttggggtct

SEQ ID NO: 7443603 - DNA, 22 bp, Homo sapiens
gagaaggaggcgaagcgtgtgc

SEQ ID NO: 7443604 - DNA, 22 bp, Homo sapiens
gagaaggaggcgaagcgtgtgc

SEQ ID NO: 7443605 - DNA, 22 bp, Homo sapiens
gagaaggaggcgaagcgtgtgc

SEQ ID NO: 7443606 - DNA, 22 bp, Homo sapiens
gagaaggaggcgaagcgtgtgc

SEQ ID NO: 7443607 - DNA, 22 bp, Homo sapiens
gagattataagatagagtcatt

SEQ ID NO: 7443608 - DNA, 22 bp, Homo sapiens
gagattataagatagagtcatt

SEQ ID NO: 7443609 - DNA, 22 bp, Homo sapiens
gagattctaagtcgttggttag

SEQ ID NO: 7443610 - DNA, 22 bp, Homo sapiens
gagattcagtaaccaatatggt

SEQ ID NO: 7443611 - DNA, 22 bp, Homo sapiens
gagattctaagtcgttggttag

SEQ ID NO: 7443612 - DNA, 22 bp, Homo sapiens
gagattctatgttgttgattat

SEQ ID NO: 7443613 - DNA, 22 bp, Homo sapiens
gagattctaatataaggatggg

SEQ ID NO: 7443614 - DNA, 22 bp, Homo sapiens
gagattctaatataaggatggg

SEQ ID NO: 7443615 - DNA, 22 bp, Homo sapiens
gagattctaatataaggatggg

SEQ ID NO: 7443616 - DNA, 20 bp, Homo sapiens
gagattaactgagaatctag

SEQ ID NO: 7443617 - DNA, 22 bp, Homo sapiens
gagatgtttagatgtttgtcca

SEQ ID NO: 7443618 - DNA, 22 bp, Homo sapiens
gagatgtttagggtggggagag

SEQ ID NO: 7443619 - DNA, 23 bp, Homo sapiens
gagatgtgggtttgttcagtgtc

SEQ ID NO: 7443620 - DNA, 22 bp, Homo sapiens
gagatgttgtgggtagttttgg

SEQ ID NO: 7443621 - DNA, 22 bp, Homo sapiens
gagatgttgttcaaagatttta

SEQ ID NO: 7443622 - DNA, 22 bp, Homo sapiens
gagatgttattcttcagtgtgt

SEQ ID NO: 7443623 - DNA, 22 bp, Homo sapiens
gagatgttctgattaggtttcc

SEQ ID NO: 7443624 - DNA, 22 bp, Homo sapiens
gagatgtgatcctttgctgtgt

SEQ ID NO: 7443625 - DNA, 22 bp, Homo sapiens
gagatgttaactacatagctac

SEQ ID NO: 7443626 - DNA, 22 bp, Homo sapiens
gagatgttaactacatagctac

SEQ ID NO: 7443627 - DNA, 21 bp, Homo sapiens
gagatgtgagctctgatagtc

SEQ ID NO: 7443628 - DNA, 22 bp, Homo sapiens
gagatgtacaatgtgtattaat

SEQ ID NO: 7443629 - DNA, 22 bp, Homo sapiens
gagattggcctggcttgccaac

SEQ ID NO: 7443630 - DNA, 22 bp, Homo sapiens
gagatttaattggattaactta

SEQ ID NO: 7443631 - DNA, 21 bp, Homo sapiens
gagatttagaaggatcaattt

SEQ ID NO: 7443632 - DNA, 22 bp, Homo sapiens
gagatttaattggattaactta

SEQ ID NO: 7443633 - DNA, 22 bp, Homo sapiens
gagattgtttagctaccatggc

SEQ ID NO: 7443634 - DNA, 22 bp, Homo sapiens
gagattctcagaagtactagga

SEQ ID NO: 7443635 - DNA, 22 bp, Homo sapiens
gagattctcagaagtactagga

SEQ ID NO: 7443636 - DNA, 22 bp, Homo sapiens
gagattctcagaagtactagga

SEQ ID NO: 7443637 - DNA, 23 bp, Homo sapiens
gagattctcctgttgtcaagtct

SEQ ID NO: 7443638 - DNA, 22 bp, Homo sapiens
gagattctcgagggcttccagc

SEQ ID NO: 7443639 - DNA, 23 bp, Homo sapiens
gagattctcctgttgtcaagtct

SEQ ID NO: 7443640 - DNA, 23 bp, Homo sapiens
gagattctcctgttgtcaagtct

SEQ ID NO: 7443641 - DNA, 22 bp, Homo sapiens
gagattctgagaagttaagtcc

SEQ ID NO: 7443642 - DNA, 22 bp, Homo sapiens
gagattctatgttgttgattat

SEQ ID NO: 7443643 - DNA, 22 bp, Homo sapiens
gagattctggttaggtgtattt

SEQ ID NO: 7443644 - DNA, 22 bp, Homo sapiens
gagattctcgagggcttccagc

SEQ ID NO: 7443645 - DNA, 22 bp, Homo sapiens
gagattctgagaagttaagtcc

SEQ ID NO: 7443646 - DNA, 22 bp, Homo sapiens
gagattctgagaagttaagtcc

SEQ ID NO: 7443647 - DNA, 22 bp, Homo sapiens
gagattctggttaggtgtattt

SEQ ID NO: 7443648 - DNA, 22 bp, Homo sapiens
gagattctgtagtcaggcatct

SEQ ID NO: 7443649 - DNA, 22 bp, Homo sapiens
gagattctttccagaactttga

SEQ ID NO: 7443650 - DNA, 22 bp, Homo sapiens
gagattctgtgaaacggacatt

SEQ ID NO: 7443651 - DNA, 22 bp, Homo sapiens
gagattctttccagaactttga

SEQ ID NO: 7443652 - DNA, 22 bp, Homo sapiens
gagattctgtagtcaggcatct

SEQ ID NO: 7443653 - DNA, 22 bp, Homo sapiens
gagatggagaaggaagctgttt

SEQ ID NO: 7443654 - DNA, 22 bp, Homo sapiens
gagatggagtctttttctgtca

SEQ ID NO: 7443655 - DNA, 22 bp, Homo sapiens
gagatggagtctttttctgtca

SEQ ID NO: 7443656 - DNA, 22 bp, Homo sapiens
gagatggagtctcactctgtca

SEQ ID NO: 7443657 - DNA, 22 bp, Homo sapiens
gagatggagtctttttctgtca

SEQ ID NO: 7443658 - DNA, 22 bp, Homo sapiens
gagatggagtctttttctgtca

SEQ ID NO: 7443659 - DNA, 22 bp, Homo sapiens
gagatggagtctttttctgtca

SEQ ID NO: 7443660 - DNA, 22 bp, Homo sapiens
gagatggagtctttttctgtca

SEQ ID NO: 7443661 - DNA, 22 bp, Homo sapiens
gagatggagtctttttctgtca

SEQ ID NO: 7443662 - DNA, 22 bp, Homo sapiens
gagatggagtctttttctgtca

SEQ ID NO: 7443663 - DNA, 22 bp, Homo sapiens
gagatggttgggttaacaacta

SEQ ID NO: 7443664 - DNA, 22 bp, Homo sapiens
gagatgtacaatgtgtattaat

SEQ ID NO: 7443665 - DNA, 22 bp, Homo sapiens
gagatggtgttccactgccagt

SEQ ID NO: 7443666 - DNA, 22 bp, Homo sapiens
gagatggagtctttttctgtca

SEQ ID NO: 7443667 - DNA, 22 bp, Homo sapiens
gagatgcttttggtccaagagt

SEQ ID NO: 7443668 - DNA, 22 bp, Homo sapiens
gagatgctttgtgtatagacaa

SEQ ID NO: 7443669 - DNA, 22 bp, Homo sapiens
gagatggaatctgtgtggaggg

SEQ ID NO: 7443670 - DNA, 22 bp, Homo sapiens
gagatggaatctgtgtggaggg

SEQ ID NO: 7443671 - DNA, 20 bp, Homo sapiens
gagatggacagatgaagggg

SEQ ID NO: 7443672 - DNA, 20 bp, Homo sapiens
gagatggacagatgaagggg

SEQ ID NO: 7443673 - DNA, 20 bp, Homo sapiens
gagatggacagatgaagggg

SEQ ID NO: 7443674 - DNA, 20 bp, Homo sapiens
gagatggacagatgaagggg

SEQ ID NO: 7443675 - DNA, 20 bp, Homo sapiens
gagatggacagatgaagggg

SEQ ID NO: 7443676 - DNA, 22 bp, Homo sapiens
gagatggaatctgtgtggaggg

SEQ ID NO: 7443677 - DNA, 22 bp, Homo sapiens
gagcagcagttgttacaatgat

SEQ ID NO: 7443678 - DNA, 22 bp, Homo sapiens
gagcagcagttgttacaatgat

SEQ ID NO: 7443679 - DNA, 22 bp, Homo sapiens
gagcagcatctccggcttaaag

SEQ ID NO: 7443680 - DNA, 22 bp, Homo sapiens
gagcagcatctccggcttaaag

SEQ ID NO: 7443681 - DNA, 22 bp, Homo sapiens
gagcagcatctccggcttaaag

SEQ ID NO: 7443682 - DNA, 22 bp, Homo sapiens
gagcagcagttgttacaatgat

SEQ ID NO: 7443683 - DNA, 22 bp, Homo sapiens
gagcagcaggtggggctggctt

SEQ ID NO: 7443684 - DNA, 22 bp, Homo sapiens
gagcagcaggtggggctggctt

SEQ ID NO: 7443685 - DNA, 22 bp, Homo sapiens
gagcagcaggtggggctggctt

SEQ ID NO: 7443686 - DNA, 22 bp, Homo sapiens
gagcagcaggtggggctggctt

SEQ ID NO: 7443687 - DNA, 22 bp, Homo sapiens
gagcagcaggtggggctggctt

SEQ ID NO: 7443688 - DNA, 22 bp, Homo sapiens
gagcagcaggtggggctggctt

SEQ ID NO: 7443689 - DNA, 22 bp, Homo sapiens
gagcagcaggtggggctggctt

SEQ ID NO: 7443690 - DNA, 22 bp, Homo sapiens
gagcagcaggtggggctggctt

SEQ ID NO: 7443691 - DNA, 22 bp, Homo sapiens
gagcagcaggtggggctggctt

SEQ ID NO: 7443692 - DNA, 22 bp, Homo sapiens
gagcagcaggtggggctggctt

SEQ ID NO: 7443693 - DNA, 22 bp, Homo sapiens
gagcagcaggtggctgtgatgg

SEQ ID NO: 7443694 - DNA, 22 bp, Homo sapiens
gagcagcaggtggctgtgatgg

SEQ ID NO: 7443695 - DNA, 22 bp, Homo sapiens
gagcagcaggtggctgtgatgg

SEQ ID NO: 7443696 - DNA, 22 bp, Homo sapiens
gagcagcaggtggctgtgatgg

SEQ ID NO: 7443697 - DNA, 22 bp, Homo sapiens
gagcagcaggtggggctggctt

SEQ ID NO: 7443698 - DNA, 22 bp, Homo sapiens
gagcagcaggtggctgtgatgg

SEQ ID NO: 7443699 - DNA, 22 bp, Homo sapiens
gagcagcaggtggggctggctt

SEQ ID NO: 7443700 - DNA, 22 bp, Homo sapiens
gagcagcagctgggccaggttc

SEQ ID NO: 7443701 - DNA, 22 bp, Homo sapiens
gagcagcagctgggccaggttc

SEQ ID NO: 7443702 - DNA, 22 bp, Homo sapiens
gagcagcagctgggccaggttc

SEQ ID NO: 7443703 - DNA, 22 bp, Homo sapiens
gagcagcagctgggccaggttc

SEQ ID NO: 7443704 - DNA, 22 bp, Homo sapiens
gagcagcagctgggccaggttc

SEQ ID NO: 7443705 - DNA, 22 bp, Homo sapiens
gagcagcagctgggccaggttc

SEQ ID NO: 7443706 - DNA, 22 bp, Homo sapiens
gagcagcagctgggccaggttc

SEQ ID NO: 7443707 - DNA, 22 bp, Homo sapiens
gagcagcagctgggccaggttc

SEQ ID NO: 7443708 - DNA, 22 bp, Homo sapiens
gagcagcagctgggccaggttc

SEQ ID NO: 7443709 - DNA, 18 bp, Homo sapiens
gagcagcaggatcaagaa

SEQ ID NO: 7443710 - DNA, 18 bp, Homo sapiens
gagcagcaggatcaagaa

SEQ ID NO: 7443711 - DNA, 18 bp, Homo sapiens
gagcagcaggatcaagaa

SEQ ID NO: 7443712 - DNA, 22 bp, Homo sapiens
gagcagcaggccaggttgcagg

SEQ ID NO: 7443713 - DNA, 22 bp, Homo sapiens
gagcagcaggccaggttgcagg

SEQ ID NO: 7443714 - DNA, 22 bp, Homo sapiens
gagcagcaggccaggttgcagg

SEQ ID NO: 7443715 - DNA, 18 bp, Homo sapiens
gagcagcaggatcaagaa

SEQ ID NO: 7443716 - DNA, 18 bp, Homo sapiens
gagcagcaggatcaagaa

SEQ ID NO: 7443717 - DNA, 22 bp, Homo sapiens
gagcagcaggtggctgtgatgg

SEQ ID NO: 7443718 - DNA, 22 bp, Homo sapiens
gagcagcaggtggctgtgatgg

SEQ ID NO: 7443719 - DNA, 22 bp, Homo sapiens
gagcagcaggccaggttgcagg

SEQ ID NO: 7443720 - DNA, 22 bp, Homo sapiens
gagcagcaggccaggttgcagg

SEQ ID NO: 7443721 - DNA, 22 bp, Homo sapiens
gagcagcaggccaggttgcagg

SEQ ID NO: 7443722 - DNA, 22 bp, Homo sapiens
gagcagcaggccaggttgcagg

SEQ ID NO: 7443723 - DNA, 22 bp, Homo sapiens
gagcagcaggccaggttgcagg

SEQ ID NO: 7443724 - DNA, 22 bp, Homo sapiens
gagcagcaggccaggttgcagg

SEQ ID NO: 7443725 - DNA, 22 bp, Homo sapiens
gagcagatctcaggccttctgt

SEQ ID NO: 7443726 - DNA, 22 bp, Homo sapiens
gagcagatctcaggccttctgt

SEQ ID NO: 7443727 - DNA, 22 bp, Homo sapiens
gagcagcaaagggagggtaaat

SEQ ID NO: 7443728 - DNA, 22 bp, Homo sapiens
gagcagcaaagggagggtaaat

SEQ ID NO: 7443729 - DNA, 22 bp, Homo sapiens
gagcagatctcaggccttctgt

SEQ ID NO: 7443730 - DNA, 22 bp, Homo sapiens
gagcagatgtgtgccaggatgc

SEQ ID NO: 7443731 - DNA, 22 bp, Homo sapiens
gagcagagtctatttccacact

SEQ ID NO: 7443732 - DNA, 22 bp, Homo sapiens
gagcagagtctatttccacact

SEQ ID NO: 7443733 - DNA, 22 bp, Homo sapiens
gagcagagtctatttccacact

SEQ ID NO: 7443734 - DNA, 22 bp, Homo sapiens
gagcagagtctatttccacact

SEQ ID NO: 7443735 - DNA, 22 bp, Homo sapiens
gagcagagtctatttccacact

SEQ ID NO: 7443736 - DNA, 22 bp, Homo sapiens
gagatttagctgcttaactcct

SEQ ID NO: 7443737 - DNA, 18 bp, Homo sapiens
gagcagaggctcaactgg

SEQ ID NO: 7443738 - DNA, 22 bp, Homo sapiens
gagcagagtctatttccacact

SEQ ID NO: 7443739 - DNA, 22 bp, Homo sapiens
gagcagagtctatttccacact

SEQ ID NO: 7443740 - DNA, 22 bp, Homo sapiens
gagcagagtctatttccacact

SEQ ID NO: 7443741 - DNA, 18 bp, Homo sapiens
gagcagaggctcaactgg

SEQ ID NO: 7443742 - DNA, 21 bp, Homo sapiens
gagatttagaaggatcaattt

SEQ ID NO: 7443743 - DNA, 23 bp, Homo sapiens
gagatttagcagacaaagctctt

SEQ ID NO: 7443744 - DNA, 22 bp, Homo sapiens
gagcagcacttgaggcatgtca

SEQ ID NO: 7443745 - DNA, 22 bp, Homo sapiens
gagcagcagattgtctccatgg

SEQ ID NO: 7443746 - DNA, 22 bp, Homo sapiens
gagcagcacttgaggcatgtca

SEQ ID NO: 7443747 - DNA, 22 bp, Homo sapiens
gagcagcacttgaggcatgtca

SEQ ID NO: 7443748 - DNA, 22 bp, Homo sapiens
gagcagcacttgaggcatgtca

SEQ ID NO: 7443749 - DNA, 22 bp, Homo sapiens
gagcagcacttgaggcatgtca

SEQ ID NO: 7443750 - DNA, 22 bp, Homo sapiens
gagcagcacttgaggcatgtca

SEQ ID NO: 7443751 - DNA, 22 bp, Homo sapiens
gagcagcagattgtctccatgg

SEQ ID NO: 7443752 - DNA, 22 bp, Homo sapiens
gagcagcagattgtctccatgg

SEQ ID NO: 7443753 - DNA, 22 bp, Homo sapiens
gagcagcagctgggccaggttc

SEQ ID NO: 7443754 - DNA, 22 bp, Homo sapiens
gagcagcagctgggccaggttc

SEQ ID NO: 7443755 - DNA, 22 bp, Homo sapiens
gagcagcaagcactcaaaggct

SEQ ID NO: 7443756 - DNA, 22 bp, Homo sapiens
gagcagcactgagttagcagct

SEQ ID NO: 7443757 - DNA, 22 bp, Homo sapiens
gagcagcactgagttagcagct

SEQ ID NO: 7443758 - DNA, 22 bp, Homo sapiens
gagcagcactgagttagcagct

SEQ ID NO: 7443759 - DNA, 22 bp, Homo sapiens
gagcagcactgagttagcagct

SEQ ID NO: 7443760 - DNA, 22 bp, Homo sapiens
gagcagcactgagttagcagct

SEQ ID NO: 7443761 - DNA, 22 bp, Homo sapiens
gagcagcaaagggagggtaaat

SEQ ID NO: 7443762 - DNA, 22 bp, Homo sapiens
gagcagcaaagggagggtaaat

SEQ ID NO: 7443763 - DNA, 22 bp, Homo sapiens
gagcagcaagcactcaaaggct

SEQ ID NO: 7443764 - DNA, 22 bp, Homo sapiens
gagcagcaagcactcaaaggct

SEQ ID NO: 7443765 - DNA, 22 bp, Homo sapiens
gagcagctgttctgacttgtct

SEQ ID NO: 7443766 - DNA, 22 bp, Homo sapiens
gagcagctgttctgacttgtct

SEQ ID NO: 7443767 - DNA, 22 bp, Homo sapiens
gagcagctgttctgacttgtct

SEQ ID NO: 7443768 - DNA, 20 bp, Homo sapiens
gagcagctgtttgcattgca

SEQ ID NO: 7443769 - DNA, 20 bp, Homo sapiens
gagcagctgtttgcattgca

SEQ ID NO: 7443770 - DNA, 22 bp, Homo sapiens
gagcagctgttctgacttgtct

SEQ ID NO: 7443771 - DNA, 22 bp, Homo sapiens
gagcagctgttctgacttgtct

SEQ ID NO: 7443772 - DNA, 22 bp, Homo sapiens
gagcagctgtggggttgaccat

SEQ ID NO: 7443773 - DNA, 22 bp, Homo sapiens
gagcagctgtggggttgaccat

SEQ ID NO: 7443774 - DNA, 22 bp, Homo sapiens
gagcagctgtggggttgaccat

SEQ ID NO: 7443775 - DNA, 22 bp, Homo sapiens
gagcagctgtccccaaagcttc

SEQ ID NO: 7443776 - DNA, 22 bp, Homo sapiens
gagcagctggtaggtgaaccca

SEQ ID NO: 7443777 - DNA, 22 bp, Homo sapiens
gagcagctggtaggtgaaccca

SEQ ID NO: 7443778 - DNA, 22 bp, Homo sapiens
gagcagctggtaggtgaaccca

SEQ ID NO: 7443779 - DNA, 22 bp, Homo sapiens
gagcagctggctgtattggttt

SEQ ID NO: 7443780 - DNA, 22 bp, Homo sapiens
gagcagctggctgtattggttt

SEQ ID NO: 7443781 - DNA, 22 bp, Homo sapiens
gagcagctggtaggtgaaccca

SEQ ID NO: 7443782 - DNA, 22 bp, Homo sapiens
gagcagctggtaggtgaaccca

SEQ ID NO: 7443783 - DNA, 22 bp, Homo sapiens
gagcagctgtccccaaagcttc

SEQ ID NO: 7443784 - DNA, 22 bp, Homo sapiens
gagcagctgtccccaaagcttc

SEQ ID NO: 7443785 - DNA, 22 bp, Homo sapiens
gagcagctgtggggttgaccat

SEQ ID NO: 7443786 - DNA, 22 bp, Homo sapiens
gagcagctgtccccaaagcttc

SEQ ID NO: 7443787 - DNA, 22 bp, Homo sapiens
gagcagctgtccccaaagcttc

SEQ ID NO: 7443788 - DNA, 22 bp, Homo sapiens
gagcagctggaggccttgttgg

SEQ ID NO: 7443789 - DNA, 22 bp, Homo sapiens
gagcagctggaggccttgttgg

SEQ ID NO: 7443790 - DNA, 22 bp, Homo sapiens
gagcagctggaggccttgttgg

SEQ ID NO: 7443791 - DNA, 22 bp, Homo sapiens
gagcagctggctgtattggttt

SEQ ID NO: 7443792 - DNA, 22 bp, Homo sapiens
gagcagctggaggccttgttgg

SEQ ID NO: 7443793 - DNA, 22 bp, Homo sapiens
gagcagctggctgtattggttt

SEQ ID NO: 7443794 - DNA, 22 bp, Homo sapiens
gagcagctggacaggcctccct

SEQ ID NO: 7443795 - DNA, 22 bp, Homo sapiens
gagcagctggacaggcctccct

SEQ ID NO: 7443796 - DNA, 22 bp, Homo sapiens
gagcagctggacaggcctccct

SEQ ID NO: 7443797 - DNA, 22 bp, Homo sapiens
gagcagctggacaggcctccct

SEQ ID NO: 7443798 - DNA, 22 bp, Homo sapiens
gagcagctggacaggcctccct

SEQ ID NO: 7443799 - DNA, 22 bp, Homo sapiens
gagcagctggacaggcctccct

SEQ ID NO: 7443800 - DNA, 22 bp, Homo sapiens
gagcagctggacaggcctccct

SEQ ID NO: 7443801 - DNA, 22 bp, Homo sapiens
gagcagcctgaggagcgtgggc

SEQ ID NO: 7443802 - DNA, 22 bp, Homo sapiens
gagcagctgcagtgcagaccct

SEQ ID NO: 7443803 - DNA, 16 bp, Homo sapiens
gagcagcctgggcctt

SEQ ID NO: 7443804 - DNA, 22 bp, Homo sapiens
gagcagcctgaggagcgtgggc

SEQ ID NO: 7443805 - DNA, 22 bp, Homo sapiens
gagcagctgcagtgcagaccct

SEQ ID NO: 7443806 - DNA, 22 bp, Homo sapiens
gagcagctgcagtgcagaccct

SEQ ID NO: 7443807 - DNA, 22 bp, Homo sapiens
gagcagccctagggcataagca

SEQ ID NO: 7443808 - DNA, 22 bp, Homo sapiens
gagcagctgcagtgcagaccct

SEQ ID NO: 7443809 - DNA, 22 bp, Homo sapiens
gagcagctgcagtgcagaccct

SEQ ID NO: 7443810 - DNA, 22 bp, Homo sapiens
gagccacagtggattgattcca

SEQ ID NO: 7443811 - DNA, 22 bp, Homo sapiens
gagccacagtggattgattcca

SEQ ID NO: 7443812 - DNA, 22 bp, Homo sapiens
gagccacagtggattgattcca

SEQ ID NO: 7443813 - DNA, 22 bp, Homo sapiens
gagccacagtggattgattcca

SEQ ID NO: 7443814 - DNA, 22 bp, Homo sapiens
gagccacagtggtggcccacgt

SEQ ID NO: 7443815 - DNA, 22 bp, Homo sapiens
gagccacagtggtggcccacgt

SEQ ID NO: 7443816 - DNA, 22 bp, Homo sapiens
gagccaccttcaactcaggaat

SEQ ID NO: 7443817 - DNA, 22 bp, Homo sapiens
gagccacagactgtatttggga

SEQ ID NO: 7443818 - DNA, 22 bp, Homo sapiens
gagccacagactgtatttggga

SEQ ID NO: 7443819 - DNA, 22 bp, Homo sapiens
gagccacagcaacctcaaagga

SEQ ID NO: 7443820 - DNA, 22 bp, Homo sapiens
gagccacagcaacctcaaagga

SEQ ID NO: 7443821 - DNA, 22 bp, Homo sapiens
gagccacagaaggaaattgggg

SEQ ID NO: 7443822 - DNA, 22 bp, Homo sapiens
gagccaagggttgccatggaga

SEQ ID NO: 7443823 - DNA, 22 bp, Homo sapiens
gagccaagggttgccatggaga

SEQ ID NO: 7443824 - DNA, 22 bp, Homo sapiens
gagccaagattgtgtccctgca

SEQ ID NO: 7443825 - DNA, 22 bp, Homo sapiens
gagccaagcaatatacccaacc

SEQ ID NO: 7443826 - DNA, 22 bp, Homo sapiens
gagccaagcaccacattaagtt

SEQ ID NO: 7443827 - DNA, 22 bp, Homo sapiens
gagccaagggcgtgctggagag

SEQ ID NO: 7443828 - DNA, 22 bp, Homo sapiens
gagccaagctcttctccatgag

SEQ ID NO: 7443829 - DNA, 22 bp, Homo sapiens
gagcagcttatgtcaagccaga

SEQ ID NO: 7443830 - DNA, 22 bp, Homo sapiens
gagccaagatcgcaccactgca

SEQ ID NO: 7443831 - DNA, 22 bp, Homo sapiens
gagccaaatgtgcagacattgt

SEQ ID NO: 7443832 - DNA, 22 bp, Homo sapiens
gagcagcttatgtcaagccaga

SEQ ID NO: 7443833 - DNA, 20 bp, Homo sapiens
gagcagctgtttgcattgca

SEQ ID NO: 7443834 - DNA, 22 bp, Homo sapiens
gagcagcttatgtcaagccaga

SEQ ID NO: 7443835 - DNA, 22 bp, Homo sapiens
gagcagcttatgtcaagccaga

SEQ ID NO: 7443836 - DNA, 22 bp, Homo sapiens
gagcagcttatgtcaagccaga

SEQ ID NO: 7443837 - DNA, 22 bp, Homo sapiens
gagccaggggtcagctccgagg

SEQ ID NO: 7443838 - DNA, 22 bp, Homo sapiens
gagccaggggtcagctccgagg

SEQ ID NO: 7443839 - DNA, 22 bp, Homo sapiens
gagccagggctgtgagctgagc

SEQ ID NO: 7443840 - DNA, 22 bp, Homo sapiens
gagccagggctgtgagctgagc

SEQ ID NO: 7443841 - DNA, 22 bp, Homo sapiens
gagccaggggtcagctccgagg

SEQ ID NO: 7443842 - DNA, 22 bp, Homo sapiens
gagccagggctgtgagctgagc

SEQ ID NO: 7443843 - DNA, 22 bp, Homo sapiens
gagccaggggtcagctccgagg

SEQ ID NO: 7443844 - DNA, 22 bp, Homo sapiens
gagccaggggtcagctccgagg

SEQ ID NO: 7443845 - DNA, 22 bp, Homo sapiens
gagccaggggtcagctccgagg

SEQ ID NO: 7443846 - DNA, 22 bp, Homo sapiens
gagccaggggtcagctccgagg

SEQ ID NO: 7443847 - DNA, 22 bp, Homo sapiens
gagccagggtttgaaactagac

SEQ ID NO: 7443848 - DNA, 22 bp, Homo sapiens
gagccaggggtcagctccgagg

SEQ ID NO: 7443849 - DNA, 22 bp, Homo sapiens
gagccagggtttgaaactagac

SEQ ID NO: 7443850 - DNA, 16 bp, Homo sapiens
gagccaggtgccttga

SEQ ID NO: 7443851 - DNA, 22 bp, Homo sapiens
gagccaggtcgggccgcggcga

SEQ ID NO: 7443852 - DNA, 16 bp, Homo sapiens
gagccaggtgccttga

SEQ ID NO: 7443853 - DNA, 22 bp, Homo sapiens
gagccaggtcgggccgcggcga

SEQ ID NO: 7443854 - DNA, 22 bp, Homo sapiens
gagccaggtcgggccgcggcga

SEQ ID NO: 7443855 - DNA, 22 bp, Homo sapiens
gagccaggtcgggccgcggcga

SEQ ID NO: 7443856 - DNA, 22 bp, Homo sapiens
gagccaggttggaggctgcagt

SEQ ID NO: 7443857 - DNA, 22 bp, Homo sapiens
gagccaggttggaggctgcagt

SEQ ID NO: 7443858 - DNA, 22 bp, Homo sapiens
gagccaggttggaggctgcagt

SEQ ID NO: 7443859 - DNA, 22 bp, Homo sapiens
gagccaggttggaggctgcagt

SEQ ID NO: 7443860 - DNA, 22 bp, Homo sapiens
gagccaggttggaggctgcagt

SEQ ID NO: 7443861 - DNA, 22 bp, Homo sapiens
gagccaggttggaggctgcagt

SEQ ID NO: 7443862 - DNA, 22 bp, Homo sapiens
gagccaggttggaggctgcagt

SEQ ID NO: 7443863 - DNA, 22 bp, Homo sapiens
gagccaggttggaggctgcagt

SEQ ID NO: 7443864 - DNA, 22 bp, Homo sapiens
gagccaggttggaggctgcagt

SEQ ID NO: 7443865 - DNA, 22 bp, Homo sapiens
gagccagaaaagctgcctgact

SEQ ID NO: 7443866 - DNA, 22 bp, Homo sapiens
gagccagaaaagctgcctgact

SEQ ID NO: 7443867 - DNA, 22 bp, Homo sapiens
gagccagaaaagctgcctgact

SEQ ID NO: 7443868 - DNA, 22 bp, Homo sapiens
gagccaccttcaactcaggaat

SEQ ID NO: 7443869 - DNA, 22 bp, Homo sapiens
gagccactgttgggcactttcc

SEQ ID NO: 7443870 - DNA, 22 bp, Homo sapiens
gagccactgttgggcactttcc

SEQ ID NO: 7443871 - DNA, 22 bp, Homo sapiens
gagccagaaaagctgcctgact

SEQ ID NO: 7443872 - DNA, 22 bp, Homo sapiens
gagccaccttcaactcaggaat

SEQ ID NO: 7443873 - DNA, 22 bp, Homo sapiens
gagccagactgcctgaagctca

SEQ ID NO: 7443874 - DNA, 22 bp, Homo sapiens
gagccagactgcctgaagctca

SEQ ID NO: 7443875 - DNA, 22 bp, Homo sapiens
gagccagagatccaggatggct

SEQ ID NO: 7443876 - DNA, 22 bp, Homo sapiens
gagccagagatccaggatggct

SEQ ID NO: 7443877 - DNA, 22 bp, Homo sapiens
gagccagagatccaggatggct

SEQ ID NO: 7443878 - DNA, 22 bp, Homo sapiens
gagccagaaaagctgcctgact

SEQ ID NO: 7443879 - DNA, 22 bp, Homo sapiens
gagccagacaggctagagcggg

SEQ ID NO: 7443880 - DNA, 22 bp, Homo sapiens
gagccagactgcctgaagctca

SEQ ID NO: 7443881 - DNA, 22 bp, Homo sapiens
gagccagactgcctgaagctca

SEQ ID NO: 7443882 - DNA, 22 bp, Homo sapiens
gagccagccgcaagagctgtga

SEQ ID NO: 7443883 - DNA, 22 bp, Homo sapiens
gagccagccgcaagagctgtga

SEQ ID NO: 7443884 - DNA, 22 bp, Homo sapiens
gagccagccgcaagagctgtga

SEQ ID NO: 7443885 - DNA, 22 bp, Homo sapiens
gagccagcaggacttaagccag

SEQ ID NO: 7443886 - DNA, 22 bp, Homo sapiens
gagccagcaggacttaagccag

SEQ ID NO: 7443887 - DNA, 22 bp, Homo sapiens
gagccagcctccgcctctctcc

SEQ ID NO: 7443888 - DNA, 22 bp, Homo sapiens
gagccagggctgtgagctgagc

SEQ ID NO: 7443889 - DNA, 22 bp, Homo sapiens
gagccagggctgtgagctgagc

SEQ ID NO: 7443890 - DNA, 22 bp, Homo sapiens
gagccagggctgtgagctgagc

SEQ ID NO: 7443891 - DNA, 22 bp, Homo sapiens
gagccagccgcaagagctgtga

SEQ ID NO: 7443892 - DNA, 22 bp, Homo sapiens
gagccagccgcaagagctgtga

SEQ ID NO: 7443893 - DNA, 22 bp, Homo sapiens
gagccagcagccggcaccacca

SEQ ID NO: 7443894 - DNA, 22 bp, Homo sapiens
gagccagcagccggcaccacca

SEQ ID NO: 7443895 - DNA, 22 bp, Homo sapiens
gagccagcagccggcaccacca

SEQ ID NO: 7443896 - DNA, 22 bp, Homo sapiens
gagccagcagccggcaccacca

SEQ ID NO: 7443897 - DNA, 22 bp, Homo sapiens
gagccagcagccggcaccacca

SEQ ID NO: 7443898 - DNA, 22 bp, Homo sapiens
gagccagattttatgcaagaca

SEQ ID NO: 7443899 - DNA, 22 bp, Homo sapiens
gagccagattttatgcaagaca

SEQ ID NO: 7443900 - DNA, 22 bp, Homo sapiens
gagccagagctacaagtgtctg

SEQ ID NO: 7443901 - DNA, 22 bp, Homo sapiens
gagccagagctacaagtgtctg

SEQ ID NO: 7443902 - DNA, 22 bp, Homo sapiens
gagccagagctacaagtgtctg

SEQ ID NO: 7443903 - DNA, 22 bp, Homo sapiens
gaggcagagaccttcaggacct

SEQ ID NO: 7443904 - DNA, 22 bp, Homo sapiens
gaggcagagaccttcaggacct

SEQ ID NO: 7443905 - DNA, 22 bp, Homo sapiens
gaggcagagactccaccttcag

SEQ ID NO: 7443906 - DNA, 22 bp, Homo sapiens
gaggcagagaccttcaggacct

SEQ ID NO: 7443907 - DNA, 22 bp, Homo sapiens
gaggcagagactccaccttcag

SEQ ID NO: 7443908 - DNA, 22 bp, Homo sapiens
gaggcagagactccaccttcag

SEQ ID NO: 7443909 - DNA, 22 bp, Homo sapiens
gaggcagagactccaccttcag

SEQ ID NO: 7443910 - DNA, 22 bp, Homo sapiens
gaggcagagaccttcaggacct

SEQ ID NO: 7443911 - DNA, 22 bp, Homo sapiens
gaggcagagactccaccttcag

SEQ ID NO: 7443912 - DNA, 22 bp, Homo sapiens
gaggcagaggaaggtggtctct

SEQ ID NO: 7443913 - DNA, 22 bp, Homo sapiens
gaggcagagaccttcaggacct

SEQ ID NO: 7443914 - DNA, 22 bp, Homo sapiens
gaggcagagaccttcaggacct

SEQ ID NO: 7443915 - DNA, 22 bp, Homo sapiens
gaggcagagaccttcaggacct

SEQ ID NO: 7443916 - DNA, 22 bp, Homo sapiens
gaggcagagaccttcaggacct

SEQ ID NO: 7443917 - DNA, 22 bp, Homo sapiens
gaggcagagaccttcaggacct

SEQ ID NO: 7443918 - DNA, 22 bp, Homo sapiens
gaggcagagaccttcaggacct

SEQ ID NO: 7443919 - DNA, 22 bp, Homo sapiens
gaggcagaagttgcagtgagca

SEQ ID NO: 7443920 - DNA, 22 bp, Homo sapiens
gaggcagagaccttcaggacct

SEQ ID NO: 7443921 - DNA, 22 bp, Homo sapiens
gaggcagaagttgcagtgagca

SEQ ID NO: 7443922 - DNA, 22 bp, Homo sapiens
gaggcagaagttgcagtgagca

SEQ ID NO: 7443923 - DNA, 22 bp, Homo sapiens
gaggcagaagttgcagtgagca

SEQ ID NO: 7443924 - DNA, 22 bp, Homo sapiens
gaggcagaagttgcagtgagca

SEQ ID NO: 7443925 - DNA, 22 bp, Homo sapiens
gaggcagaagttgcagtgagca

SEQ ID NO: 7443926 - DNA, 22 bp, Homo sapiens
gaggcagaagttgcagtgagca

SEQ ID NO: 7443927 - DNA, 22 bp, Homo sapiens
gaggcagaagttgcagtgagca

SEQ ID NO: 7443928 - DNA, 22 bp, Homo sapiens
gaggcagaagttgcagtgagca

SEQ ID NO: 7443929 - DNA, 22 bp, Homo sapiens
gaggcagaagttgcagtgagca

SEQ ID NO: 7443930 - DNA, 22 bp, Homo sapiens
gaggcagaagttgcagtgagca

SEQ ID NO: 7443931 - DNA, 22 bp, Homo sapiens
gaggcagaagttgcagtgagca

SEQ ID NO: 7443932 - DNA, 22 bp, Homo sapiens
gaggcagaagttgcagtgagca

SEQ ID NO: 7443933 - DNA, 22 bp, Homo sapiens
gaggcagaagttgcagtgagca

SEQ ID NO: 7443934 - DNA, 22 bp, Homo sapiens
gaggcagaagttgcagtgagca

SEQ ID NO: 7443935 - DNA, 22 bp, Homo sapiens
gaggcagaagttgcagtgagca

SEQ ID NO: 7443936 - DNA, 22 bp, Homo sapiens
gaggcagaagttgcagtgagca

SEQ ID NO: 7443937 - DNA, 22 bp, Homo sapiens
gaggcactggaggaaaggagaa

SEQ ID NO: 7443938 - DNA, 22 bp, Homo sapiens
gaggcactgctgggcccctgta

SEQ ID NO: 7443939 - DNA, 22 bp, Homo sapiens
gaggcactgctgggcccctgta

SEQ ID NO: 7443940 - DNA, 22 bp, Homo sapiens
gaggcactgaatacttgagggt

SEQ ID NO: 7443941 - DNA, 22 bp, Homo sapiens
gaggcactgaatacttgagggt

SEQ ID NO: 7443942 - DNA, 22 bp, Homo sapiens
gaggcactgaatacttgagggt

SEQ ID NO: 7443943 - DNA, 22 bp, Homo sapiens
gaggcactgaatacttgagggt

SEQ ID NO: 7443944 - DNA, 22 bp, Homo sapiens
gaggcactgaccattttcatat

SEQ ID NO: 7443945 - DNA, 22 bp, Homo sapiens
gaggcactgaatacttgagggt

SEQ ID NO: 7443946 - DNA, 22 bp, Homo sapiens
gaggcactgagagtgggggatg

SEQ ID NO: 7443947 - DNA, 22 bp, Homo sapiens
gaggcactgagagtgggggatg

SEQ ID NO: 7443948 - DNA, 22 bp, Homo sapiens
gaggcactgagagtgggggatg

SEQ ID NO: 7443949 - DNA, 22 bp, Homo sapiens
gaggcactgcagtacagtgact

SEQ ID NO: 7443950 - DNA, 22 bp, Homo sapiens
gaggcactgcagtacagtgact

SEQ ID NO: 7443951 - DNA, 22 bp, Homo sapiens
gaggcactgcagtacagtgact

SEQ ID NO: 7443952 - DNA, 22 bp, Homo sapiens
gaggcacctcgcgggaggaggc

SEQ ID NO: 7443953 - DNA, 22 bp, Homo sapiens
gaggcacctcgcgggaggaggc

SEQ ID NO: 7443954 - DNA, 22 bp, Homo sapiens
gaggcacctcgcgggaggaggc

SEQ ID NO: 7443955 - DNA, 22 bp, Homo sapiens
gaggcacctcgcgggaggaggc

SEQ ID NO: 7443956 - DNA, 23 bp, Homo sapiens
gaggcactcaggaaatgtgagtg

SEQ ID NO: 7443957 - DNA, 22 bp, Homo sapiens
gaggcactctcgacaagggtgg

SEQ ID NO: 7443958 - DNA, 23 bp, Homo sapiens
gaggcactcaggaaatgtgagtg

SEQ ID NO: 7443959 - DNA, 22 bp, Homo sapiens
gaggcactgaatacttgagggt

SEQ ID NO: 7443960 - DNA, 22 bp, Homo sapiens
gaggcaccagacatggcctcat

SEQ ID NO: 7443961 - DNA, 22 bp, Homo sapiens
gaggcacatcacttggtgcatt

SEQ ID NO: 7443962 - DNA, 22 bp, Homo sapiens
gaggcacatcacttggtgcatt

SEQ ID NO: 7443963 - DNA, 22 bp, Homo sapiens
gaggcaccagacatggcctcat

SEQ ID NO: 7443964 - DNA, 22 bp, Homo sapiens
gaggcaccagacatggcctcat

SEQ ID NO: 7443965 - DNA, 22 bp, Homo sapiens
gaggcaccagccccgctagcct

SEQ ID NO: 7443966 - DNA, 22 bp, Homo sapiens
gaggcaatgggctatagcattg

SEQ ID NO: 7443967 - DNA, 22 bp, Homo sapiens
gaggcaatgggctatagcattg

SEQ ID NO: 7443968 - DNA, 22 bp, Homo sapiens
gaggcacaatacatgtctcaag

SEQ ID NO: 7443969 - DNA, 22 bp, Homo sapiens
gaggcacaatacatgtctcaag

SEQ ID NO: 7443970 - DNA, 22 bp, Homo sapiens
gaggcacatcacttggtgcatt

SEQ ID NO: 7443971 - DNA, 22 bp, Homo sapiens
gaggcaagcccagtgggtctaa

SEQ ID NO: 7443972 - DNA, 22 bp, Homo sapiens
gaggcacatcacttggtgcatt

SEQ ID NO: 7443973 - DNA, 22 bp, Homo sapiens
gaggcacatcacttggtgcatt

SEQ ID NO: 7443974 - DNA, 22 bp, Homo sapiens
gaggccagcgcgcagcactttt

SEQ ID NO: 7443975 - DNA, 22 bp, Homo sapiens
gaggccagcccctcttgaaggc

SEQ ID NO: 7443976 - DNA, 22 bp, Homo sapiens
gaggccagcgcgcagcactttt

SEQ ID NO: 7443977 - DNA, 22 bp, Homo sapiens
gaggccagcgcgcagcactttt

SEQ ID NO: 7443978 - DNA, 22 bp, Homo sapiens
gaggccagcgcgcagcactttt

SEQ ID NO: 7443979 - DNA, 22 bp, Homo sapiens
gaggccagcgcgcagcactttt

SEQ ID NO: 7443980 - DNA, 22 bp, Homo sapiens
gaggccagcgcgcagcactttt

SEQ ID NO: 7443981 - DNA, 22 bp, Homo sapiens
gaggccagcccctcttgaaggc

SEQ ID NO: 7443982 - DNA, 22 bp, Homo sapiens
gaggccagatgtcatgtcttat

SEQ ID NO: 7443983 - DNA, 22 bp, Homo sapiens
gaggccagatgtcatgtcttat

SEQ ID NO: 7443984 - DNA, 22 bp, Homo sapiens
gaggccagatgtcatgtcttat

SEQ ID NO: 7443985 - DNA, 22 bp, Homo sapiens
gaggccagatgtcatgtcttat

SEQ ID NO: 7443986 - DNA, 22 bp, Homo sapiens
gaggccagatgtcatgtcttat

SEQ ID NO: 7443987 - DNA, 22 bp, Homo sapiens
gaggccagcccctcttgaaggc

SEQ ID NO: 7443988 - DNA, 22 bp, Homo sapiens
gaggccagcccctcttgaaggc

SEQ ID NO: 7443989 - DNA, 22 bp, Homo sapiens
gaggccagcccctcttgaaggc

SEQ ID NO: 7443990 - DNA, 22 bp, Homo sapiens
gaggccagcccctcttgaaggc

SEQ ID NO: 7443991 - DNA, 22 bp, Homo sapiens
gaggccagcccctcttgaaggc

SEQ ID NO: 7443992 - DNA, 22 bp, Homo sapiens
gaggccagcccctcttgaaggc

SEQ ID NO: 7443993 - DNA, 22 bp, Homo sapiens
gaggcagagactccaccttcag

SEQ ID NO: 7443994 - DNA, 22 bp, Homo sapiens
gaggcagaggaaggtggtctct

SEQ ID NO: 7443995 - DNA, 22 bp, Homo sapiens
gaggcagaggaaggtggtctct

SEQ ID NO: 7443996 - DNA, 22 bp, Homo sapiens
gaggcagaggaaggtggtctct

SEQ ID NO: 7443997 - DNA, 22 bp, Homo sapiens
gaggcagaggaaggtggtctct

SEQ ID NO: 7443998 - DNA, 22 bp, Homo sapiens
gaggcagaggaaggtggtctct

SEQ ID NO: 7443999 - DNA, 22 bp, Homo sapiens
gaggcagaggaaggtggtctct

SEQ ID NO: 7444000 - DNA, 22 bp, Homo sapiens
gaggcagaggaaggtggtctct

SEQ ID NO: 7444001 - DNA, 22 bp, Homo sapiens
gaggcagaggttgcagtgagct

SEQ ID NO: 7444002 - DNA, 22 bp, Homo sapiens
gaggcagaggttgcagtgagct

SEQ ID NO: 7444003 - DNA, 22 bp, Homo sapiens
gaggccagatactctcttctgc

SEQ ID NO: 7444004 - DNA, 22 bp, Homo sapiens
gaggcagaggttgcagtgagct

SEQ ID NO: 7444005 - DNA, 22 bp, Homo sapiens
gaggcagaggaaggtggtctct

SEQ ID NO: 7444006 - DNA, 22 bp, Homo sapiens
gaggccagatgtcatgtcttat

SEQ ID NO: 7444007 - DNA, 22 bp, Homo sapiens
gaggccagatgtcatgtcttat

SEQ ID NO: 7444008 - DNA, 22 bp, Homo sapiens
gaggccagatgtcatgtcttat

SEQ ID NO: 7444009 - DNA, 22 bp, Homo sapiens
gaggcagaggttgcagtgagct

SEQ ID NO: 7444010 - DNA, 22 bp, Homo sapiens
gaggcagaggttgcagtgagct

SEQ ID NO: 7444011 - DNA, 22 bp, Homo sapiens
gaggccagatgtcatgtcttat

SEQ ID NO: 7444012 - DNA, 22 bp, Homo sapiens
gaggccaggacatgaaagctga

SEQ ID NO: 7444013 - DNA, 22 bp, Homo sapiens
gaggccaggaagcccaagatca

SEQ ID NO: 7444014 - DNA, 22 bp, Homo sapiens
gaggccaggaagcccaagatca

SEQ ID NO: 7444015 - DNA, 22 bp, Homo sapiens
gaggccaggaagcccaagatca

SEQ ID NO: 7444016 - DNA, 22 bp, Homo sapiens
gaggccaggaagcccaagatca

SEQ ID NO: 7444017 - DNA, 22 bp, Homo sapiens
gaggccaggaagcccaagatca

SEQ ID NO: 7444018 - DNA, 22 bp, Homo sapiens
gaggccaggaagcccaagatca

SEQ ID NO: 7444019 - DNA, 22 bp, Homo sapiens
gaggccaggacatgaaagctga

SEQ ID NO: 7444020 - DNA, 22 bp, Homo sapiens
gaggccaggacatgaaagctga

SEQ ID NO: 7444021 - DNA, 22 bp, Homo sapiens
gaggccaggacatgaaagctga

SEQ ID NO: 7444022 - DNA, 22 bp, Homo sapiens
gaggccaggacatgaaagctga

SEQ ID NO: 7444023 - DNA, 22 bp, Homo sapiens
gaggccaggacatgaaagctga

SEQ ID NO: 7444024 - DNA, 22 bp, Homo sapiens
gaggccaggacatgaaagctga

SEQ ID NO: 7444025 - DNA, 22 bp, Homo sapiens
gaggccaggaggatctctctaa

SEQ ID NO: 7444026 - DNA, 22 bp, Homo sapiens
gaggccaggacatgaaagctga

SEQ ID NO: 7444027 - DNA, 22 bp, Homo sapiens
gaggccaggacatgaaagctga

SEQ ID NO: 7444028 - DNA, 22 bp, Homo sapiens
gaggccagctagtccaggaagt

SEQ ID NO: 7444029 - DNA, 22 bp, Homo sapiens
gaggccagctagtccaggaagt

SEQ ID NO: 7444030 - DNA, 22 bp, Homo sapiens
gaggccagctagtccaggaagt

SEQ ID NO: 7444031 - DNA, 22 bp, Homo sapiens
gaggccagctagtccaggaagt

SEQ ID NO: 7444032 - DNA, 22 bp, Homo sapiens
gaggccagctagtccaggaagt

SEQ ID NO: 7444033 - DNA, 22 bp, Homo sapiens
gaggccagctagtccaggaagt

SEQ ID NO: 7444034 - DNA, 22 bp, Homo sapiens
gaggccagcgcgcagcactttt

SEQ ID NO: 7444035 - DNA, 22 bp, Homo sapiens
gaggccagctacccaagggtca

SEQ ID NO: 7444036 - DNA, 22 bp, Homo sapiens
gaggccagcgcgcagcactttt

SEQ ID NO: 7444037 - DNA, 22 bp, Homo sapiens
gaggccagctacccaagggtca

SEQ ID NO: 7444038 - DNA, 22 bp, Homo sapiens
gaggccagctacccaagggtca

SEQ ID NO: 7444039 - DNA, 22 bp, Homo sapiens
gaggccagctacccaagggtca

SEQ ID NO: 7444040 - DNA, 22 bp, Homo sapiens
gaggccagctacccaagggtca

SEQ ID NO: 7444041 - DNA, 22 bp, Homo sapiens
gaggccagctacccaagggtca

SEQ ID NO: 7444042 - DNA, 22 bp, Homo sapiens
gaggaggctatcagcaatcagg

SEQ ID NO: 7444043 - DNA, 22 bp, Homo sapiens
gaggaggctatcagcaatcagg

SEQ ID NO: 7444044 - DNA, 22 bp, Homo sapiens
gaggaggctatcagcaatcagg

SEQ ID NO: 7444045 - DNA, 22 bp, Homo sapiens
gaggaggctaagtgggctctgg

SEQ ID NO: 7444046 - DNA, 22 bp, Homo sapiens
gaggaggctaagtgggctctgg

SEQ ID NO: 7444047 - DNA, 22 bp, Homo sapiens
gaggcaagcccagtgggtctaa

SEQ ID NO: 7444048 - DNA, 22 bp, Homo sapiens
gaggcaagagaagccagctttc

SEQ ID NO: 7444049 - DNA, 22 bp, Homo sapiens
gaggcaagagaagccagctttc

SEQ ID NO: 7444050 - DNA, 19 bp, Homo sapiens
gaggcaaggagtttaagcc

SEQ ID NO: 7444051 - DNA, 19 bp, Homo sapiens
gaggcaaggagtttaagcc

SEQ ID NO: 7444052 - DNA, 22 bp, Homo sapiens
gaggcaaggccgcacgtctcag

SEQ ID NO: 7444053 - DNA, 22 bp, Homo sapiens
gaggcaaggccgcacgtctcag

SEQ ID NO: 7444054 - DNA, 22 bp, Homo sapiens
gaggaggctaagtgggctctgg

SEQ ID NO: 7444055 - DNA, 22 bp, Homo sapiens
gaggaggctaagtgggctctgg

SEQ ID NO: 7444056 - DNA, 22 bp, Homo sapiens
gaggaggctaagtgggctctgg

SEQ ID NO: 7444057 - DNA, 22 bp, Homo sapiens
gaggaggctaagtgggctctgg

SEQ ID NO: 7444058 - DNA, 22 bp, Homo sapiens
gaggaggctaagtgggctctgg

SEQ ID NO: 7444059 - DNA, 22 bp, Homo sapiens
gaggaggctaagtgggctctgg

SEQ ID NO: 7444060 - DNA, 22 bp, Homo sapiens
gaggaggctaagtgggctctgg

SEQ ID NO: 7444061 - DNA, 22 bp, Homo sapiens
gaggaggccagtggaaggaagc

SEQ ID NO: 7444062 - DNA, 22 bp, Homo sapiens
gaggaggccagtggaaggaagc

SEQ ID NO: 7444063 - DNA, 22 bp, Homo sapiens
gaggaggcagcctatcccttag

SEQ ID NO: 7444064 - DNA, 22 bp, Homo sapiens
gaggaggccagtggaaggaagc

SEQ ID NO: 7444065 - DNA, 22 bp, Homo sapiens
gaggaggccagtggaaggaagc

SEQ ID NO: 7444066 - DNA, 22 bp, Homo sapiens
gaggaggccagtggaaggaagc

SEQ ID NO: 7444067 - DNA, 22 bp, Homo sapiens
gaggaggccagtggaaggaagc

SEQ ID NO: 7444068 - DNA, 22 bp, Homo sapiens
gaggaggcagcctatcccttag

SEQ ID NO: 7444069 - DNA, 22 bp, Homo sapiens
gaggaggcacttgagcagatgt

SEQ ID NO: 7444070 - DNA, 22 bp, Homo sapiens
gaggaggcacttgagcagatgt

SEQ ID NO: 7444071 - DNA, 22 bp, Homo sapiens
gaggaggcacttgagcagatgt

SEQ ID NO: 7444072 - DNA, 22 bp, Homo sapiens
gaggaggcacttgagcagatgt

SEQ ID NO: 7444073 - DNA, 22 bp, Homo sapiens
gaggaggcacttgagcagatgt

SEQ ID NO: 7444074 - DNA, 22 bp, Homo sapiens
gaggaggcacttgagcagatgt

SEQ ID NO: 7444075 - DNA, 22 bp, Homo sapiens
gaggaggcacttgagcagatgt

SEQ ID NO: 7444076 - DNA, 22 bp, Homo sapiens
gaggaggcactagttagtgaca

SEQ ID NO: 7444077 - DNA, 22 bp, Homo sapiens
gaggaggcactagttagtgaca

SEQ ID NO: 7444078 - DNA, 22 bp, Homo sapiens
gaggaggagtatatattagaat

SEQ ID NO: 7444079 - DNA, 22 bp, Homo sapiens
gaggaggaggaagtggaaccca

SEQ ID NO: 7444080 - DNA, 22 bp, Homo sapiens
gaggaggagtatatattagaat

SEQ ID NO: 7444081 - DNA, 22 bp, Homo sapiens
gaggaggaggaagtggaaccca

SEQ ID NO: 7444082 - DNA, 22 bp, Homo sapiens
gaggaggaagttctctgtaggc

SEQ ID NO: 7444083 - DNA, 22 bp, Homo sapiens
gaggaggaagttctctgtaggc

SEQ ID NO: 7444084 - DNA, 22 bp, Homo sapiens
gaggaggaagttctctgtaggc

SEQ ID NO: 7444085 - DNA, 22 bp, Homo sapiens
gaggaggaggaagtggaaccca

SEQ ID NO: 7444086 - DNA, 22 bp, Homo sapiens
gaggaggaggaagtggaaccca

SEQ ID NO: 7444087 - DNA, 22 bp, Homo sapiens
gaggaggaggaagtggaaccca

SEQ ID NO: 7444088 - DNA, 22 bp, Homo sapiens
gaggaggaggaagtggaaccca

SEQ ID NO: 7444089 - DNA, 22 bp, Homo sapiens
gaggaggaggaagtggaaccca

SEQ ID NO: 7444090 - DNA, 19 bp, Homo sapiens
gaggaggaaaactagtgta

SEQ ID NO: 7444091 - DNA, 19 bp, Homo sapiens
gaggaggaaaactagtgta

SEQ ID NO: 7444092 - DNA, 19 bp, Homo sapiens
gaggaggaaaactagtgta

SEQ ID NO: 7444093 - DNA, 22 bp, Homo sapiens
gaggaggaaaccctgttcctct

SEQ ID NO: 7444094 - DNA, 22 bp, Homo sapiens
gaggaggaaaccctgttcctct

SEQ ID NO: 7444095 - DNA, 22 bp, Homo sapiens
gaggaggaaaccctgttcctct

SEQ ID NO: 7444096 - DNA, 19 bp, Homo sapiens
gaggaggaaaactagtgta

SEQ ID NO: 7444097 - DNA, 19 bp, Homo sapiens
gaggaggaaaactagtgta

SEQ ID NO: 7444098 - DNA, 19 bp, Homo sapiens
gaggaggaaaactagtgta

SEQ ID NO: 7444099 - DNA, 19 bp, Homo sapiens
gaggaggaaaactagtgta

SEQ ID NO: 7444100 - DNA, 19 bp, Homo sapiens
gaggaggaaaactagtgta

SEQ ID NO: 7444101 - DNA, 19 bp, Homo sapiens
gaggaggaaaactagtgta

SEQ ID NO: 7444102 - DNA, 22 bp, Homo sapiens
gaggaggaagttctctgtaggc

SEQ ID NO: 7444103 - DNA, 22 bp, Homo sapiens
gaggaggaaaggagttgaaatg

SEQ ID NO: 7444104 - DNA, 22 bp, Homo sapiens
gaggaggaagttctctgtaggc

SEQ ID NO: 7444105 - DNA, 22 bp, Homo sapiens
gaggaggaagttctctgtaggc

SEQ ID NO: 7444106 - DNA, 22 bp, Homo sapiens
gaggaggaagttctctgtaggc

SEQ ID NO: 7444107 - DNA, 22 bp, Homo sapiens
gaggaggaagttctctgtaggc

SEQ ID NO: 7444108 - DNA, 22 bp, Homo sapiens
gaggaggaagttctctgtaggc

SEQ ID NO: 7444109 - DNA, 22 bp, Homo sapiens
gaggaggaaaggagttgaaatg

SEQ ID NO: 7444110 - DNA, 22 bp, Homo sapiens
gaggaggaaaggagttgaaatg

SEQ ID NO: 7444111 - DNA, 22 bp, Homo sapiens
gaggaggaaaggagttgaaatg

SEQ ID NO: 7444112 - DNA, 22 bp, Homo sapiens
gaggaggaaaggagttgaaatg

SEQ ID NO: 7444113 - DNA, 22 bp, Homo sapiens
gaggaaaataacaactaagggc

SEQ ID NO: 7444114 - DNA, 22 bp, Homo sapiens
gaggaaaatattcagggaggtt

SEQ ID NO: 7444115 - DNA, 22 bp, Homo sapiens
gaggaaaatattcagggaggtt

SEQ ID NO: 7444116 - DNA, 22 bp, Homo sapiens
gaggaaaatattcagggaggtt

SEQ ID NO: 7444117 - DNA, 22 bp, Homo sapiens
gaggaaaatattcagggaggtt

SEQ ID NO: 7444118 - DNA, 22 bp, Homo sapiens
gaggaaaatattcagggaggtt

SEQ ID NO: 7444119 - DNA, 22 bp, Homo sapiens
gaggagccctgttccccaggcc

SEQ ID NO: 7444120 - DNA, 22 bp, Homo sapiens
gaggagccctgttccccaggcc

SEQ ID NO: 7444121 - DNA, 22 bp, Homo sapiens
gaggaaaatgcaacaggaatgc

SEQ ID NO: 7444122 - DNA, 22 bp, Homo sapiens
gaggaaaatgcaacaggaatgc

SEQ ID NO: 7444123 - DNA, 22 bp, Homo sapiens
gaggaaaatattcagggaggtt

SEQ ID NO: 7444124 - DNA, 22 bp, Homo sapiens
gaggaaaatattcagggaggtt

SEQ ID NO: 7444125 - DNA, 22 bp, Homo sapiens
gaggaaaatattcagggaggtt

SEQ ID NO: 7444126 - DNA, 22 bp, Homo sapiens
gaggaaaatgcaacaggaatgc

SEQ ID NO: 7444127 - DNA, 22 bp, Homo sapiens
gaggaaaatattcagggaggtt

SEQ ID NO: 7444128 - DNA, 20 bp, Homo sapiens
gaggaaaagctgccaggcct

SEQ ID NO: 7444129 - DNA, 22 bp, Homo sapiens
gaggaaaataacaactaagggc

SEQ ID NO: 7444130 - DNA, 22 bp, Homo sapiens
gaggaaaataacaactaagggc

SEQ ID NO: 7444131 - DNA, 22 bp, Homo sapiens
gaggaaaataacaactaagggc

SEQ ID NO: 7444132 - DNA, 22 bp, Homo sapiens
gaggaaaataacaactaagggc

SEQ ID NO: 7444133 - DNA, 22 bp, Homo sapiens
gaggaaaataacaactaagggc

SEQ ID NO: 7444134 - DNA, 22 bp, Homo sapiens
gaggaaaataacaactaagggc

SEQ ID NO: 7444135 - DNA, 22 bp, Homo sapiens
gaggaaaataacaactaagggc

SEQ ID NO: 7444136 - DNA, 22 bp, Homo sapiens
gaggaaaataacaactaagggc

SEQ ID NO: 7444137 - DNA, 22 bp, Homo sapiens
gaggaaaagagacaggttattg

SEQ ID NO: 7444138 - DNA, 22 bp, Homo sapiens
gaggaaaagagacaggttattg

SEQ ID NO: 7444139 - DNA, 22 bp, Homo sapiens
gaggaaaagagacaggttattg

SEQ ID NO: 7444140 - DNA, 20 bp, Homo sapiens
gaggaaaagctgccaggcct

SEQ ID NO: 7444141 - DNA, 20 bp, Homo sapiens
gaggaaaagctgccaggcct

SEQ ID NO: 7444142 - DNA, 20 bp, Homo sapiens
gaggaaaagctgccaggcct

SEQ ID NO: 7444143 - DNA, 20 bp, Homo sapiens
gaggaaaagctgccaggcct

SEQ ID NO: 7444144 - DNA, 22 bp, Homo sapiens
gaggagctgtctttgtgatctt

SEQ ID NO: 7444145 - DNA, 22 bp, Homo sapiens
gaggagctgtctttgtgatctt

SEQ ID NO: 7444146 - DNA, 22 bp, Homo sapiens
gaggagctgttccctcacctct

SEQ ID NO: 7444147 - DNA, 22 bp, Homo sapiens
gaggagctgttccctcacctct

SEQ ID NO: 7444148 - DNA, 22 bp, Homo sapiens
gaggagctgtctttgtgatctt

SEQ ID NO: 7444149 - DNA, 22 bp, Homo sapiens
gaggagctgttccctcacctct

SEQ ID NO: 7444150 - DNA, 22 bp, Homo sapiens
gaggagctgttccctcacctct

SEQ ID NO: 7444151 - DNA, 22 bp, Homo sapiens
gaggagctgtctttgtgatctt

SEQ ID NO: 7444152 - DNA, 19 bp, Homo sapiens
gaggagctatcggagacag

SEQ ID NO: 7444153 - DNA, 19 bp, Homo sapiens
gaggagctatcggagacag

SEQ ID NO: 7444154 - DNA, 19 bp, Homo sapiens
gaggagctatcggagacag

SEQ ID NO: 7444155 - DNA, 19 bp, Homo sapiens
gaggagctatcggagacag

SEQ ID NO: 7444156 - DNA, 22 bp, Homo sapiens
gaggagcctggccccacatcca

SEQ ID NO: 7444157 - DNA, 22 bp, Homo sapiens
gaggagcctggccccacatcca

SEQ ID NO: 7444158 - DNA, 22 bp, Homo sapiens
gaggagccctgttccccaggcc

SEQ ID NO: 7444159 - DNA, 18 bp, Homo sapiens
gaggagccgtccctacta

SEQ ID NO: 7444160 - DNA, 22 bp, Homo sapiens
gaggagcttgcatttaagtgcc

SEQ ID NO: 7444161 - DNA, 22 bp, Homo sapiens
gaggagcttgaggctaggagcc

SEQ ID NO: 7444162 - DNA, 22 bp, Homo sapiens
gaggagcttgaggctaggagcc

SEQ ID NO: 7444163 - DNA, 22 bp, Homo sapiens
gaggagcttgcatttaagtgcc

SEQ ID NO: 7444164 - DNA, 22 bp, Homo sapiens
gaggagcttgtgagaagatgtc

SEQ ID NO: 7444165 - DNA, 22 bp, Homo sapiens
gaggagcttgtgagaagatgtc

SEQ ID NO: 7444166 - DNA, 22 bp, Homo sapiens
gaggagcttgtgagaagatgtc

SEQ ID NO: 7444167 - DNA, 22 bp, Homo sapiens
gaggagcttgtgagaagatgtc

SEQ ID NO: 7444168 - DNA, 22 bp, Homo sapiens
gaggagcttgtgagaagatgtc

SEQ ID NO: 7444169 - DNA, 22 bp, Homo sapiens
gaggagcttgaggctaggagcc

SEQ ID NO: 7444170 - DNA, 22 bp, Homo sapiens
gaggagcttcagaggaatctta

SEQ ID NO: 7444171 - DNA, 22 bp, Homo sapiens
gaggagcttgaggctaggagcc

SEQ ID NO: 7444172 - DNA, 22 bp, Homo sapiens
gaggagcttgaggctaggagcc

SEQ ID NO: 7444173 - DNA, 22 bp, Homo sapiens
gaggagcttgaggctaggagcc

SEQ ID NO: 7444174 - DNA, 22 bp, Homo sapiens
gaggagcttcagaggaatctta

SEQ ID NO: 7444175 - DNA, 22 bp, Homo sapiens
gaggagcttcagaggaatctta

SEQ ID NO: 7444176 - DNA, 22 bp, Homo sapiens
gaggagcttgaggctaggagcc

SEQ ID NO: 7444177 - DNA, 22 bp, Homo sapiens
gaggagcttgaggctaggagcc

SEQ ID NO: 7444178 - DNA, 22 bp, Homo sapiens
gagctcttatagttctagcagt

SEQ ID NO: 7444179 - DNA, 22 bp, Homo sapiens
gagctcttatagttctagcagt

SEQ ID NO: 7444180 - DNA, 22 bp, Homo sapiens
gagctcttatagttctagcagt

SEQ ID NO: 7444181 - DNA, 22 bp, Homo sapiens
gagctcttagatagggcaggaa

SEQ ID NO: 7444182 - DNA, 22 bp, Homo sapiens
gagctcttagatagggcaggaa

SEQ ID NO: 7444183 - DNA, 22 bp, Homo sapiens
gagctctgttctcgtcctgctg

SEQ ID NO: 7444184 - DNA, 22 bp, Homo sapiens
gagctctgttctcgtcctgctg

SEQ ID NO: 7444185 - DNA, 22 bp, Homo sapiens
gagctctgttctcgtcctgctg

SEQ ID NO: 7444186 - DNA, 22 bp, Homo sapiens
gagctctgttctcgtcctgctg

SEQ ID NO: 7444187 - DNA, 22 bp, Homo sapiens
gagctctgttctcgtcctgctg

SEQ ID NO: 7444188 - DNA, 22 bp, Homo sapiens
gagctctgttctcgtcctgctg

SEQ ID NO: 7444189 - DNA, 22 bp, Homo sapiens
gagctctgtgtggcttgggtgg

SEQ ID NO: 7444190 - DNA, 22 bp, Homo sapiens
gagctctgtgtggcttgggtgg

SEQ ID NO: 7444191 - DNA, 22 bp, Homo sapiens
gagctctgtgtagcctgagggt

SEQ ID NO: 7444192 - DNA, 22 bp, Homo sapiens
gagctctgtgtggcttgggtgg

SEQ ID NO: 7444193 - DNA, 22 bp, Homo sapiens
gagctctgtgtggcttgggtgg

SEQ ID NO: 7444194 - DNA, 22 bp, Homo sapiens
gagctctgtgtagcctgagggt

SEQ ID NO: 7444195 - DNA, 22 bp, Homo sapiens
gagctctgtgtagcctgagggt

SEQ ID NO: 7444196 - DNA, 22 bp, Homo sapiens
gagctctgtgtagcctgagggt

SEQ ID NO: 7444197 - DNA, 22 bp, Homo sapiens
gagctctgtgtagcctgagggt

SEQ ID NO: 7444198 - DNA, 22 bp, Homo sapiens
gagctctgatgtttagtggaga

SEQ ID NO: 7444199 - DNA, 22 bp, Homo sapiens
gagctctgactgctgggtgaca

SEQ ID NO: 7444200 - DNA, 22 bp, Homo sapiens
gagctctgactgctgggtgaca

SEQ ID NO: 7444201 - DNA, 22 bp, Homo sapiens
gagctctgatgtttagtggaga

SEQ ID NO: 7444202 - DNA, 22 bp, Homo sapiens
gagctctgatgtttagtggaga

SEQ ID NO: 7444203 - DNA, 22 bp, Homo sapiens
gagctctgatgtttagtggaga

SEQ ID NO: 7444204 - DNA, 22 bp, Homo sapiens
gagctctgaaaaagcttgcctt

SEQ ID NO: 7444205 - DNA, 22 bp, Homo sapiens
gagctctgaaaaagcttgcctt

SEQ ID NO: 7444206 - DNA, 22 bp, Homo sapiens
gagctctctggggagatgggat

SEQ ID NO: 7444207 - DNA, 22 bp, Homo sapiens
gagctctgaaaaagcttgcctt

SEQ ID NO: 7444208 - DNA, 22 bp, Homo sapiens
gagctctgaaaaagcttgcctt

SEQ ID NO: 7444209 - DNA, 22 bp, Homo sapiens
gagctctgaaaaagcttgcctt

SEQ ID NO: 7444210 - DNA, 22 bp, Homo sapiens
gagctctgaaaaagcttgcctt

SEQ ID NO: 7444211 - DNA, 22 bp, Homo sapiens
gagctctatgtggctggcatgt

SEQ ID NO: 7444212 - DNA, 22 bp, Homo sapiens
gagctagtagaacaagtgagga

SEQ ID NO: 7444213 - DNA, 22 bp, Homo sapiens
gagctatagatgtttacatact

SEQ ID NO: 7444214 - DNA, 22 bp, Homo sapiens
gagctagacagcaagggcctgc

SEQ ID NO: 7444215 - DNA, 22 bp, Homo sapiens
gagctagaattaggccaatttc

SEQ ID NO: 7444216 - DNA, 22 bp, Homo sapiens
gagctactgaaatattgatttt

SEQ ID NO: 7444217 - DNA, 22 bp, Homo sapiens
gagctactgaaatattgatttt

SEQ ID NO: 7444218 - DNA, 22 bp, Homo sapiens
gagctagactgggctctgatgt

SEQ ID NO: 7444219 - DNA, 22 bp, Homo sapiens
gagctagagggagaagggcact

SEQ ID NO: 7444220 - DNA, 22 bp, Homo sapiens
gagctagagggagaagggcact

SEQ ID NO: 7444221 - DNA, 22 bp, Homo sapiens
gagctagagtttgtagggtaga

SEQ ID NO: 7444222 - DNA, 22 bp, Homo sapiens
gagctagagggagaagggcact

SEQ ID NO: 7444223 - DNA, 22 bp, Homo sapiens
gagctaggatatcatgagggta

SEQ ID NO: 7444224 - DNA, 22 bp, Homo sapiens
gagctaggatatcatgagggta

SEQ ID NO: 7444225 - DNA, 22 bp, Homo sapiens
gagctagggaggaggcttgctc

SEQ ID NO: 7444226 - DNA, 22 bp, Homo sapiens
gagctaggggtagtcaggagac

SEQ ID NO: 7444227 - DNA, 22 bp, Homo sapiens
gagctagtagaacaagtgagga

SEQ ID NO: 7444228 - DNA, 20 bp, Homo sapiens
gagctacacaaatgctgctt

SEQ ID NO: 7444229 - DNA, 20 bp, Homo sapiens
gagctacacaaatgctgctt

SEQ ID NO: 7444230 - DNA, 22 bp, Homo sapiens
gagctacaagggagactttttt

SEQ ID NO: 7444231 - DNA, 22 bp, Homo sapiens
gagctacaagggagactttttt

SEQ ID NO: 7444232 - DNA, 22 bp, Homo sapiens
gagctaagtttctggaggcaga

SEQ ID NO: 7444233 - DNA, 22 bp, Homo sapiens
gagctaaggtcacaagaagcag

SEQ ID NO: 7444234 - DNA, 22 bp, Homo sapiens
gagctaaggcacaggcaggctt

SEQ ID NO: 7444235 - DNA, 22 bp, Homo sapiens
gagctacagagtttggtgttca

SEQ ID NO: 7444236 - DNA, 22 bp, Homo sapiens
gagctacagagtttggtgttca

SEQ ID NO: 7444237 - DNA, 22 bp, Homo sapiens
gagctacactgattcatttgtt

SEQ ID NO: 7444238 - DNA, 22 bp, Homo sapiens
gagctacactgattcatttgtt

SEQ ID NO: 7444239 - DNA, 22 bp, Homo sapiens
gagctacaggcagctgagccct

SEQ ID NO: 7444240 - DNA, 22 bp, Homo sapiens
gagctacaggcagctgagccct

SEQ ID NO: 7444241 - DNA, 22 bp, Homo sapiens
gagctactgaaatattgatttt

SEQ ID NO: 7444242 - DNA, 22 bp, Homo sapiens
gagctactgaaatattgatttt

SEQ ID NO: 7444243 - DNA, 22 bp, Homo sapiens
gagctaagaactgtgccaggtg

SEQ ID NO: 7444244 - DNA, 22 bp, Homo sapiens
gagctaaatgaatcataaatca

SEQ ID NO: 7444245 - DNA, 22 bp, Homo sapiens
gagctaaaatgtgtttttctca

SEQ ID NO: 7444246 - DNA, 22 bp, Homo sapiens
gagcgggaggaacggctcgggc

SEQ ID NO: 7444247 - DNA, 22 bp, Homo sapiens
gagcgggaggaacggctcgggc

SEQ ID NO: 7444248 - DNA, 22 bp, Homo sapiens
gagctaagctatgttatgcagc

SEQ ID NO: 7444249 - DNA, 22 bp, Homo sapiens
gagctaagccctggagaggtcg

SEQ ID NO: 7444250 - DNA, 22 bp, Homo sapiens
gagctaagccctggagaggtcg

SEQ ID NO: 7444251 - DNA, 22 bp, Homo sapiens
gagctaagagtctagaaaggct

SEQ ID NO: 7444252 - DNA, 22 bp, Homo sapiens
gagctaagacctgagggcaagt

SEQ ID NO: 7444253 - DNA, 22 bp, Homo sapiens
gagctaagaagcaaataaatca

SEQ ID NO: 7444254 - DNA, 22 bp, Homo sapiens
gagcctggattgaagtgggtgg

SEQ ID NO: 7444255 - DNA, 22 bp, Homo sapiens
gagcctggatagccttgttcca

SEQ ID NO: 7444256 - DNA, 22 bp, Homo sapiens
gagcctggattgaagtgggtgg

SEQ ID NO: 7444257 - DNA, 22 bp, Homo sapiens
gagcctggagctggaacgaagc

SEQ ID NO: 7444258 - DNA, 22 bp, Homo sapiens
gagcctggagctggaacgaagc

SEQ ID NO: 7444259 - DNA, 22 bp, Homo sapiens
gagcctggatagccttgttcca

SEQ ID NO: 7444260 - DNA, 22 bp, Homo sapiens
gagcggaggcttggaggccagc

SEQ ID NO: 7444261 - DNA, 22 bp, Homo sapiens
gagcctggattgtcaccgactt

SEQ ID NO: 7444262 - DNA, 22 bp, Homo sapiens
gagcctggattgtcaccgactt

SEQ ID NO: 7444263 - DNA, 22 bp, Homo sapiens
gagcctggattgaagtgggtgg

SEQ ID NO: 7444264 - DNA, 22 bp, Homo sapiens
gagcctggattgaagtgggtgg

SEQ ID NO: 7444265 - DNA, 22 bp, Homo sapiens
gagcctggattgaagtgggtgg

SEQ ID NO: 7444266 - DNA, 22 bp, Homo sapiens
gagcctggattgaagtgggtgg

SEQ ID NO: 7444267 - DNA, 22 bp, Homo sapiens
gagcctggagctggaacgaagc

SEQ ID NO: 7444268 - DNA, 22 bp, Homo sapiens
gagcctggagctggaacgaagc

SEQ ID NO: 7444269 - DNA, 22 bp, Homo sapiens
gagcctggacatctcaggccca

SEQ ID NO: 7444270 - DNA, 22 bp, Homo sapiens
gagcctggacatctcaggccca

SEQ ID NO: 7444271 - DNA, 22 bp, Homo sapiens
gagcctggacatctcaggccca

SEQ ID NO: 7444272 - DNA, 22 bp, Homo sapiens
gagcctggacatctcaggccca

SEQ ID NO: 7444273 - DNA, 22 bp, Homo sapiens
gagcctggacatctcaggccca

SEQ ID NO: 7444274 - DNA, 22 bp, Homo sapiens
gagcctggacatctcaggccca

SEQ ID NO: 7444275 - DNA, 22 bp, Homo sapiens
gagcctgcgagggagtaaggca

SEQ ID NO: 7444276 - DNA, 22 bp, Homo sapiens
gagcctgcccctccaccaggat

SEQ ID NO: 7444277 - DNA, 22 bp, Homo sapiens
gagcctgcccctccaccaggat

SEQ ID NO: 7444278 - DNA, 22 bp, Homo sapiens
gagcctgcccctccaccaggat

SEQ ID NO: 7444279 - DNA, 22 bp, Homo sapiens
gagccaggtttgaatctcagtc

SEQ ID NO: 7444280 - DNA, 22 bp, Homo sapiens
gagccaggtttgaatctcagtc

SEQ ID NO: 7444281 - DNA, 22 bp, Homo sapiens
gagccaggttggaggctgcagt

SEQ ID NO: 7444282 - DNA, 22 bp, Homo sapiens
gagccaggtttgaatctcagtc

SEQ ID NO: 7444283 - DNA, 22 bp, Homo sapiens
gagccaggtttgaatctcagtc

SEQ ID NO: 7444284 - DNA, 22 bp, Homo sapiens
gagccaggtttgaatctcagtc

SEQ ID NO: 7444285 - DNA, 22 bp, Homo sapiens
gagccaggtttgaatctcagtc

SEQ ID NO: 7444286 - DNA, 22 bp, Homo sapiens
gagccaggtttgaatctcagtc

SEQ ID NO: 7444287 - DNA, 22 bp, Homo sapiens
gagccctgttcaggcctcctca

SEQ ID NO: 7444288 - DNA, 22 bp, Homo sapiens
gagccctgttcaggcctcctca

SEQ ID NO: 7444289 - DNA, 22 bp, Homo sapiens
gagccctgttcaggcctcctca

SEQ ID NO: 7444290 - DNA, 22 bp, Homo sapiens
gagccaggtttgaatctcagtc

SEQ ID NO: 7444291 - DNA, 22 bp, Homo sapiens
gagccctgttcaggcctcctca

SEQ ID NO: 7444292 - DNA, 22 bp, Homo sapiens
gagccgaggcgcacagctcggg

SEQ ID NO: 7444293 - DNA, 22 bp, Homo sapiens
gagccctttccactgccctctg

SEQ ID NO: 7444294 - DNA, 22 bp, Homo sapiens
gagcctcatggtcatcttgagt

SEQ ID NO: 7444295 - DNA, 22 bp, Homo sapiens
gagcctcagggttttgttgaca

SEQ ID NO: 7444296 - DNA, 22 bp, Homo sapiens
gagccgtgccagccctgtctcg

SEQ ID NO: 7444297 - DNA, 22 bp, Homo sapiens
gagcctcctcctggtgtgccga

SEQ ID NO: 7444298 - DNA, 22 bp, Homo sapiens
gagcctcgtggcggccactgcg

SEQ ID NO: 7444299 - DNA, 22 bp, Homo sapiens
gagcctcgtggcggccactgcg

SEQ ID NO: 7444300 - DNA, 22 bp, Homo sapiens
gagcctcctcctggtgtgccga

SEQ ID NO: 7444301 - DNA, 22 bp, Homo sapiens
gagcctcgtggcggccactgcg

SEQ ID NO: 7444302 - DNA, 22 bp, Homo sapiens
gagcctgaatttgacctgctta

SEQ ID NO: 7444303 - DNA, 22 bp, Homo sapiens
gagcctgaaatacaggtcactg

SEQ ID NO: 7444304 - DNA, 22 bp, Homo sapiens
gagcctcgtggcggccactgcg

SEQ ID NO: 7444305 - DNA, 22 bp, Homo sapiens
gagcctgagtgctgcctcccct

SEQ ID NO: 7444306 - DNA, 22 bp, Homo sapiens
gagcctgcagctttcacagcat

SEQ ID NO: 7444307 - DNA, 22 bp, Homo sapiens
gagcctgcagctttcacagcat

SEQ ID NO: 7444308 - DNA, 22 bp, Homo sapiens
gagcctgcaggcctcggcctca

SEQ ID NO: 7444309 - DNA, 22 bp, Homo sapiens
gagcctgcaggcctcggcctca

SEQ ID NO: 7444310 - DNA, 22 bp, Homo sapiens
gagcctgcccagccctgtccac

SEQ ID NO: 7444311 - DNA, 22 bp, Homo sapiens
gagcctgcccagccctgtccac

SEQ ID NO: 7444312 - DNA, 22 bp, Homo sapiens
gagctctttaccaggtcaggac

SEQ ID NO: 7444313 - DNA, 22 bp, Homo sapiens
gagctctttaccaggtcaggac

SEQ ID NO: 7444314 - DNA, 22 bp, Homo sapiens
gagctcttgtagtatgcggtaa

SEQ ID NO: 7444315 - DNA, 22 bp, Homo sapiens
gagctcttgcttctagtccagg

SEQ ID NO: 7444316 - DNA, 22 bp, Homo sapiens
gagctcttctggttagatgttg

SEQ ID NO: 7444317 - DNA, 22 bp, Homo sapiens
gagctcttgcttctagtccagg

SEQ ID NO: 7444318 - DNA, 22 bp, Homo sapiens
gagctcttctaaagatggcaat

SEQ ID NO: 7444319 - DNA, 22 bp, Homo sapiens
gagctcttctggggtaagggac

SEQ ID NO: 7444320 - DNA, 22 bp, Homo sapiens
gagctcttctggttagatgttg

SEQ ID NO: 7444321 - DNA, 22 bp, Homo sapiens
gagctcttgcttctagtccagg

SEQ ID NO: 7444322 - DNA, 22 bp, Homo sapiens
gagctcttcctttcaggaggcc

SEQ ID NO: 7444323 - DNA, 18 bp, Homo sapiens
gagctcttcccttttctc

SEQ ID NO: 7444324 - DNA, 22 bp, Homo sapiens
gagctcttcgcctgtcgctgag

SEQ ID NO: 7444325 - DNA, 22 bp, Homo sapiens
gagctcttcctttcaggaggcc

SEQ ID NO: 7444326 - DNA, 22 bp, Homo sapiens
gagctcttccccatcttacatc

SEQ ID NO: 7444327 - DNA, 22 bp, Homo sapiens
gagctcttccccatcttacatc

SEQ ID NO: 7444328 - DNA, 22 bp, Homo sapiens
gagctcttatagttctagcagt

SEQ ID NO: 7444329 - DNA, 22 bp, Homo sapiens
gagctcttatagttctagcagt

SEQ ID NO: 7444330 - DNA, 22 bp, Homo sapiens
gagctcttccccatcttacatc

SEQ ID NO: 7444331 - DNA, 22 bp, Homo sapiens
gagctgaaatatgaagccaatt

SEQ ID NO: 7444332 - DNA, 22 bp, Homo sapiens
gagctgaaatatgaagccaatt

SEQ ID NO: 7444333 - DNA, 22 bp, Homo sapiens
gagctgaacatcatggaaaggc

SEQ ID NO: 7444334 - DNA, 22 bp, Homo sapiens
gagctgaacaaattgcgagtgg

SEQ ID NO: 7444335 - DNA, 22 bp, Homo sapiens
gagctgaacaaattgcgagtgg

SEQ ID NO: 7444336 - DNA, 22 bp, Homo sapiens
gagctgaacatcatggaaaggc

SEQ ID NO: 7444337 - DNA, 22 bp, Homo sapiens
gagctgaagcgctacagcatcc

SEQ ID NO: 7444338 - DNA, 22 bp, Homo sapiens
gagctgaagcgctacagcatcc

SEQ ID NO: 7444339 - DNA, 22 bp, Homo sapiens
gagctctttcatggttctgtga

SEQ ID NO: 7444340 - DNA, 22 bp, Homo sapiens
gagctctttcagttgactccta

SEQ ID NO: 7444341 - DNA, 22 bp, Homo sapiens
gagctctttcctgcccatactg

SEQ ID NO: 7444342 - DNA, 22 bp, Homo sapiens
gagctctttgaacctgggcagt

SEQ ID NO: 7444343 - DNA, 22 bp, Homo sapiens
gagctctttcggttgttttcga

SEQ ID NO: 7444344 - DNA, 22 bp, Homo sapiens
gagctcttttgatgaaggtagt

SEQ ID NO: 7444345 - DNA, 22 bp, Homo sapiens
gagctcttttgccagtcactgc

SEQ ID NO: 7444346 - DNA, 19 bp, Homo sapiens
gagctgagagtagcactgg

SEQ ID NO: 7444347 - DNA, 22 bp, Homo sapiens
gagctgagatcatgtacactag

SEQ ID NO: 7444348 - DNA, 19 bp, Homo sapiens
gagctgagagtagcactgg

SEQ ID NO: 7444349 - DNA, 19 bp, Homo sapiens
gagctgagagtagcactgg

SEQ ID NO: 7444350 - DNA, 19 bp, Homo sapiens
gagctgagagtagcactgg

SEQ ID NO: 7444351 - DNA, 22 bp, Homo sapiens
gagctgtgttcatgaggagaaa

SEQ ID NO: 7444352 - DNA, 22 bp, Homo sapiens
gagctgtgttcatgaggagaaa

SEQ ID NO: 7444353 - DNA, 22 bp, Homo sapiens
gagctgagaagcagcgcttgat

SEQ ID NO: 7444354 - DNA, 22 bp, Homo sapiens
gagctgagaagcagcgcttgat

SEQ ID NO: 7444355 - DNA, 22 bp, Homo sapiens
gagctgagaagcagcgcttgat

SEQ ID NO: 7444356 - DNA, 22 bp, Homo sapiens
gagctgagacacactttggcaa

SEQ ID NO: 7444357 - DNA, 22 bp, Homo sapiens
gagctgagacacactttggcaa

SEQ ID NO: 7444358 - DNA, 19 bp, Homo sapiens
gagctgagagtagcactgg

SEQ ID NO: 7444359 - DNA, 22 bp, Homo sapiens
gagctgagacacactttggcaa

SEQ ID NO: 7444360 - DNA, 22 bp, Homo sapiens
gagctgacatccagcagtgacc

SEQ ID NO: 7444361 - DNA, 22 bp, Homo sapiens
gagctgacatccagcagtgacc

SEQ ID NO: 7444362 - DNA, 18 bp, Homo sapiens
gagctgagaagaggatgc

SEQ ID NO: 7444363 - DNA, 18 bp, Homo sapiens
gagctgagaagaggatgc

SEQ ID NO: 7444364 - DNA, 18 bp, Homo sapiens
gagctgagaagaggatgc

SEQ ID NO: 7444365 - DNA, 18 bp, Homo sapiens
gagctgagaagaggatgc

SEQ ID NO: 7444366 - DNA, 18 bp, Homo sapiens
gagctgagaagaggatgc

SEQ ID NO: 7444367 - DNA, 18 bp, Homo sapiens
gagctgagaagaggatgc

SEQ ID NO: 7444368 - DNA, 21 bp, Homo sapiens
gagctgaatatgttctagggg

SEQ ID NO: 7444369 - DNA, 22 bp, Homo sapiens
gagctgaatcagagatattatt

SEQ ID NO: 7444370 - DNA, 22 bp, Homo sapiens
gagctgaaggagaaagcagggg

SEQ ID NO: 7444371 - DNA, 22 bp, Homo sapiens
gagctgaagtttccatttgtac

SEQ ID NO: 7444372 - DNA, 22 bp, Homo sapiens
gagctgaagtttccatttgtac

SEQ ID NO: 7444373 - DNA, 22 bp, Homo sapiens
gagctgaattacggtgagtcat

SEQ ID NO: 7444374 - DNA, 22 bp, Homo sapiens
gagctgaatcagagatattatt

SEQ ID NO: 7444375 - DNA, 22 bp, Homo sapiens
gagctgaattacggtgagtcat

SEQ ID NO: 7444376 - DNA, 22 bp, Homo sapiens
gagcttaaatggctaaatataa

SEQ ID NO: 7444377 - DNA, 22 bp, Homo sapiens
gagcttaatagtcatgctttct

SEQ ID NO: 7444378 - DNA, 22 bp, Homo sapiens
gagcttaaatggctaaatataa

SEQ ID NO: 7444379 - DNA, 22 bp, Homo sapiens
gagcttaaatggctaaatataa

SEQ ID NO: 7444380 - DNA, 22 bp, Homo sapiens
gagctgtgttgtctagtaccga

SEQ ID NO: 7444381 - DNA, 22 bp, Homo sapiens
gagctgttaagagggagtgaca

SEQ ID NO: 7444382 - DNA, 21 bp, Homo sapiens
gagctgttactctctctggag

SEQ ID NO: 7444383 - DNA, 23 bp, Homo sapiens
gagctgtttgtgcagagagccct

SEQ ID NO: 7444384 - DNA, 22 bp, Homo sapiens
gagctgtttttccaaactattg

SEQ ID NO: 7444385 - DNA, 20 bp, Homo sapiens
gagcttcaactcagcaaaca

SEQ ID NO: 7444386 - DNA, 22 bp, Homo sapiens
gagcttcagaatttaacagact

SEQ ID NO: 7444387 - DNA, 22 bp, Homo sapiens
gagcttcaaatggacgaccttt

SEQ ID NO: 7444388 - DNA, 22 bp, Homo sapiens
gagcttaggccagggacaggga

SEQ ID NO: 7444389 - DNA, 23 bp, Homo sapiens
gagcttagtctactcagacatcc

SEQ ID NO: 7444390 - DNA, 22 bp, Homo sapiens
gagcttcagctgccatgactgt

SEQ ID NO: 7444391 - DNA, 22 bp, Homo sapiens
gagcttcatatgttgcagagaa

SEQ ID NO: 7444392 - DNA, 22 bp, Homo sapiens
gagcttcatatgttgcagagaa

SEQ ID NO: 7444393 - DNA, 22 bp, Homo sapiens
gagcttccagagacatcagagt

SEQ ID NO: 7444394 - DNA, 22 bp, Homo sapiens
gagcttccagagacatcagagt

SEQ ID NO: 7444395 - DNA, 22 bp, Homo sapiens
gagcttccactctagaaggagt

SEQ ID NO: 7444396 - DNA, 22 bp, Homo sapiens
gagcttccatccttactgtgtg

SEQ ID NO: 7444397 - DNA, 22 bp, Homo sapiens
gagcttccatccttactgtgtg

SEQ ID NO: 7444398 - DNA, 22 bp, Homo sapiens
gagcttccatccttactgtgtg

SEQ ID NO: 7444399 - DNA, 22 bp, Homo sapiens
gagcttcatgattgctttgctt

SEQ ID NO: 7444400 - DNA, 22 bp, Homo sapiens
gagcttccatggacgccatctg

SEQ ID NO: 7444401 - DNA, 22 bp, Homo sapiens
gagcttccctctgcagtccctg

SEQ ID NO: 7444402 - DNA, 22 bp, Homo sapiens
gagcttttcttccagttaatga

SEQ ID NO: 7444403 - DNA, 23 bp, Homo sapiens
gagcttttgtagtagtcactgtg

SEQ ID NO: 7444404 - DNA, 22 bp, Homo sapiens
gaggaaaagagacaggttattg

SEQ ID NO: 7444405 - DNA, 22 bp, Homo sapiens
gagcttttgtgggggccaaggt

SEQ ID NO: 7444406 - DNA, 22 bp, Homo sapiens
gagcttttgtgggggccaaggt

SEQ ID NO: 7444407 - DNA, 22 bp, Homo sapiens
gagcttggctggacctcacgga

SEQ ID NO: 7444408 - DNA, 22 bp, Homo sapiens
gagcttggctggacctcacgga

SEQ ID NO: 7444409 - DNA, 22 bp, Homo sapiens
gagcttttcccgtctttctcgt

SEQ ID NO: 7444410 - DNA, 22 bp, Homo sapiens
gagcttggcctcttgaacgtgg

SEQ ID NO: 7444411 - DNA, 22 bp, Homo sapiens
gagcttggcctcttgaacgtgg

SEQ ID NO: 7444412 - DNA, 22 bp, Homo sapiens
gagcttggcagtgtcactaggg

SEQ ID NO: 7444413 - DNA, 22 bp, Homo sapiens
gagcttggacaagctctgaagg

SEQ ID NO: 7444414 - DNA, 22 bp, Homo sapiens
gagcttggacaagctctgaagg

SEQ ID NO: 7444415 - DNA, 22 bp, Homo sapiens
gagcttggacaagctctgaagg

SEQ ID NO: 7444416 - DNA, 22 bp, Homo sapiens
gagcttggacaagctctgaagg

SEQ ID NO: 7444417 - DNA, 22 bp, Homo sapiens
gagcttggacaccttggcaggt

SEQ ID NO: 7444418 - DNA, 22 bp, Homo sapiens
gagcttggacaccttggcaggt

SEQ ID NO: 7444419 - DNA, 22 bp, Homo sapiens
gagcttggatgtcttttgttca

SEQ ID NO: 7444420 - DNA, 22 bp, Homo sapiens
gagcttggcagtgtcactaggg

SEQ ID NO: 7444421 - DNA, 22 bp, Homo sapiens
gagcttggatgtcttttgttca

SEQ ID NO: 7444422 - DNA, 22 bp, Homo sapiens
gagcttcttgtttcttcatctg

SEQ ID NO: 7444423 - DNA, 22 bp, Homo sapiens
gagcttggaagcagatcctcac

SEQ ID NO: 7444424 - DNA, 22 bp, Homo sapiens
gagcttcctttttctgcatgac

SEQ ID NO: 7444425 - DNA, 22 bp, Homo sapiens
gagcttctcaacagttatctct

SEQ ID NO: 7444426 - DNA, 22 bp, Homo sapiens
gagcttcctcagcctttctcac

SEQ ID NO: 7444427 - DNA, 22 bp, Homo sapiens
gagcttcctgcaggtcactgtg

SEQ ID NO: 7444428 - DNA, 22 bp, Homo sapiens
ctggggttggccagggccctag

SEQ ID NO: 7444429 - DNA, 22 bp, Homo sapiens
ctgggtctctttagggtgccgt

SEQ ID NO: 7444430 - DNA, 22 bp, Homo sapiens
ctgggtctcttaccatgtgact

SEQ ID NO: 7444431 - DNA, 22 bp, Homo sapiens
ctgggtctcttaccatgtgact

SEQ ID NO: 7444432 - DNA, 22 bp, Homo sapiens
ctgggtctggaggccaagggtg

SEQ ID NO: 7444433 - DNA, 22 bp, Homo sapiens
ctgggtctggccacaggaagta

SEQ ID NO: 7444434 - DNA, 22 bp, Homo sapiens
ctgggtctggaggccaagggtg

SEQ ID NO: 7444435 - DNA, 22 bp, Homo sapiens
ctgggtctggaggccaagggtg

SEQ ID NO: 7444436 - DNA, 22 bp, Homo sapiens
ctgggtctggctactgcttcct

SEQ ID NO: 7444437 - DNA, 22 bp, Homo sapiens
ctgggtctggccacaggaagta

SEQ ID NO: 7444438 - DNA, 22 bp, Homo sapiens
ctgggtctggccacaggaagta

SEQ ID NO: 7444439 - DNA, 22 bp, Homo sapiens
ctgggtctggctactgcttcct

SEQ ID NO: 7444440 - DNA, 22 bp, Homo sapiens
ctgggtctggctactgcttcct

SEQ ID NO: 7444441 - DNA, 22 bp, Homo sapiens
ctgggtctggccacaggaagta

SEQ ID NO: 7444442 - DNA, 22 bp, Homo sapiens
ctgggtctggccacaggaagta

SEQ ID NO: 7444443 - DNA, 22 bp, Homo sapiens
ctgggtctggccacaggaagta

SEQ ID NO: 7444444 - DNA, 22 bp, Homo sapiens
ctgggtctggccacaggaagta

SEQ ID NO: 7444445 - DNA, 22 bp, Homo sapiens
ctgggtctggccacaggaagta

SEQ ID NO: 7444446 - DNA, 22 bp, Homo sapiens
ctgggtctgggcctcctggagt

SEQ ID NO: 7444447 - DNA, 22 bp, Homo sapiens
ctgggtctggtgtcaggcgacg

SEQ ID NO: 7444448 - DNA, 22 bp, Homo sapiens
ctgggtctggtgtcaggcgacg

SEQ ID NO: 7444449 - DNA, 22 bp, Homo sapiens
ctgggtctggtgtcaggcgacg

SEQ ID NO: 7444450 - DNA, 22 bp, Homo sapiens
ctgggtctggtgtcaggcgacg

SEQ ID NO: 7444451 - DNA, 22 bp, Homo sapiens
ctgggtctgtcactagataaat

SEQ ID NO: 7444452 - DNA, 22 bp, Homo sapiens
ctgggtctggtgtcaggcgacg

SEQ ID NO: 7444453 - DNA, 22 bp, Homo sapiens
ctgggtctgggcctcctggagt

SEQ ID NO: 7444454 - DNA, 22 bp, Homo sapiens
ctgggtctgggcctcctggagt

SEQ ID NO: 7444455 - DNA, 22 bp, Homo sapiens
ctggggctgcagcgatcttcat

SEQ ID NO: 7444456 - DNA, 22 bp, Homo sapiens
ctggggctgcagcgatcttcat

SEQ ID NO: 7444457 - DNA, 22 bp, Homo sapiens
ctggggctgcggtggaggagcc

SEQ ID NO: 7444458 - DNA, 22 bp, Homo sapiens
ctggggctgcggtggaggagcc

SEQ ID NO: 7444459 - DNA, 22 bp, Homo sapiens
ctggggctgcggtggaggagcc

SEQ ID NO: 7444460 - DNA, 22 bp, Homo sapiens
ctggggctgcggacgggagccc

SEQ ID NO: 7444461 - DNA, 22 bp, Homo sapiens
ctggggctgcggacgggagccc

SEQ ID NO: 7444462 - DNA, 22 bp, Homo sapiens
ctggggctgcggacgggagccc

SEQ ID NO: 7444463 - DNA, 22 bp, Homo sapiens
ctggggctgcggacgggagccc

SEQ ID NO: 7444464 - DNA, 22 bp, Homo sapiens
ctggggtgtgctcagagcaggg

SEQ ID NO: 7444465 - DNA, 22 bp, Homo sapiens
ctggggtgtgctcagagcaggg

SEQ ID NO: 7444466 - DNA, 22 bp, Homo sapiens
ctggggtgtgctcagagcaggg

SEQ ID NO: 7444467 - DNA, 22 bp, Homo sapiens
ctggggtgtgctcagagcaggg

SEQ ID NO: 7444468 - DNA, 22 bp, Homo sapiens
ctggggtgtgctcagagcaggg

SEQ ID NO: 7444469 - DNA, 22 bp, Homo sapiens
ctggggtgtgctcagagcaggg

SEQ ID NO: 7444470 - DNA, 22 bp, Homo sapiens
ctggggtgtgctcagagcaggg

SEQ ID NO: 7444471 - DNA, 22 bp, Homo sapiens
ctggggtgtgctcagagcaggg

SEQ ID NO: 7444472 - DNA, 22 bp, Homo sapiens
ctggggctgcggtggaggagcc

SEQ ID NO: 7444473 - DNA, 22 bp, Homo sapiens
ctggggctgcggtggaggagcc

SEQ ID NO: 7444474 - DNA, 22 bp, Homo sapiens
ctggggctggtgaggcaggctc

SEQ ID NO: 7444475 - DNA, 22 bp, Homo sapiens
ctggggctgcggtggaggagcc

SEQ ID NO: 7444476 - DNA, 22 bp, Homo sapiens
ctggggctgcggtggaggagcc

SEQ ID NO: 7444477 - DNA, 22 bp, Homo sapiens
ctggggctgcggtggaggagcc

SEQ ID NO: 7444478 - DNA, 22 bp, Homo sapiens
ctggggctgcggtggaggagcc

SEQ ID NO: 7444479 - DNA, 22 bp, Homo sapiens
ctggggctctctggaatgcttg

SEQ ID NO: 7444480 - DNA, 23 bp, Homo sapiens
ctggggctcattgcagtagccat

SEQ ID NO: 7444481 - DNA, 22 bp, Homo sapiens
ctggggctctctggaatgcttg

SEQ ID NO: 7444482 - DNA, 22 bp, Homo sapiens
ctggggctctctggaatgcttg

SEQ ID NO: 7444483 - DNA, 22 bp, Homo sapiens
ctggggctgcagcgatcttcat

SEQ ID NO: 7444484 - DNA, 22 bp, Homo sapiens
ctggggctctctggaatgcttg

SEQ ID NO: 7444485 - DNA, 22 bp, Homo sapiens
ctggggctgcagcgatcttcat

SEQ ID NO: 7444486 - DNA, 22 bp, Homo sapiens
ctggggctcactttggtcaggc

SEQ ID NO: 7444487 - DNA, 22 bp, Homo sapiens
ctggggctcactttggtcaggc

SEQ ID NO: 7444488 - DNA, 23 bp, Homo sapiens
ctggggctcattgcagtagccat

SEQ ID NO: 7444489 - DNA, 23 bp, Homo sapiens
ctggggctcattgcagtagccat

SEQ ID NO: 7444490 - DNA, 22 bp, Homo sapiens
ctggggctcactttggtcaggc

SEQ ID NO: 7444491 - DNA, 22 bp, Homo sapiens
ctggggcccgagccttgggcca

SEQ ID NO: 7444492 - DNA, 22 bp, Homo sapiens
ctggggcccgagccttgggcca

SEQ ID NO: 7444493 - DNA, 22 bp, Homo sapiens
ctggggcccgagccttgggcca

SEQ ID NO: 7444494 - DNA, 22 bp, Homo sapiens
ctggggcccgagccttgggcca

SEQ ID NO: 7444495 - DNA, 22 bp, Homo sapiens
ctggggctcactccagccctgg

SEQ ID NO: 7444496 - DNA, 22 bp, Homo sapiens
ctggggccctgggtctgccctc

SEQ ID NO: 7444497 - DNA, 22 bp, Homo sapiens
ctggggctcactttggtcaggc

SEQ ID NO: 7444498 - DNA, 22 bp, Homo sapiens
ctggggctcactttggtcaggc

SEQ ID NO: 7444499 - DNA, 22 bp, Homo sapiens
ctggggctcactttggtcaggc

SEQ ID NO: 7444500 - DNA, 22 bp, Homo sapiens
ctggggctcactttggtcaggc

SEQ ID NO: 7444501 - DNA, 22 bp, Homo sapiens
ctggggctcactccagccctgg

SEQ ID NO: 7444502 - DNA, 22 bp, Homo sapiens
ctggggctcactccagccctgg

SEQ ID NO: 7444503 - DNA, 22 bp, Homo sapiens
ctggggctcactccagccctgg

SEQ ID NO: 7444504 - DNA, 22 bp, Homo sapiens
ctggggctcactccagccctgg

SEQ ID NO: 7444505 - DNA, 22 bp, Homo sapiens
ctggggccacaacggcgcacgc

SEQ ID NO: 7444506 - DNA, 22 bp, Homo sapiens
ctggggcattgggagaggcctg

SEQ ID NO: 7444507 - DNA, 22 bp, Homo sapiens
ctggggccacaacggcgcacgc

SEQ ID NO: 7444508 - DNA, 22 bp, Homo sapiens
ctggggccacaacggcgcacgc

SEQ ID NO: 7444509 - DNA, 22 bp, Homo sapiens
ctggggccacaacggcgcacgc

SEQ ID NO: 7444510 - DNA, 22 bp, Homo sapiens
ctggggccacaacggcgcacgc

SEQ ID NO: 7444511 - DNA, 22 bp, Homo sapiens
ctggggccagtgaggaggcttt

SEQ ID NO: 7444512 - DNA, 22 bp, Homo sapiens
ctggggccagtgaggaggcttt

SEQ ID NO: 7444513 - DNA, 22 bp, Homo sapiens
ctggggccagtgaggaggcttt

SEQ ID NO: 7444514 - DNA, 22 bp, Homo sapiens
ctggggccagtgaggaggcttt

SEQ ID NO: 7444515 - DNA, 22 bp, Homo sapiens
ctggggcattgggagaggcctg

SEQ ID NO: 7444516 - DNA, 22 bp, Homo sapiens
ctggggcattgggagaggcctg

SEQ ID NO: 7444517 - DNA, 22 bp, Homo sapiens
ctggggcattgggagaggcctg

SEQ ID NO: 7444518 - DNA, 22 bp, Homo sapiens
ctggggcattgggagaggcctg

SEQ ID NO: 7444519 - DNA, 20 bp, Homo sapiens
ctggggaggaggatgtgttc

SEQ ID NO: 7444520 - DNA, 20 bp, Homo sapiens
ctggggaggaggatgtgttc

SEQ ID NO: 7444521 - DNA, 22 bp, Homo sapiens
ctggggcattgggagaggcctg

SEQ ID NO: 7444522 - DNA, 22 bp, Homo sapiens
ctggggcattgggagaggcctg

SEQ ID NO: 7444523 - DNA, 22 bp, Homo sapiens
ctggggcattgggagaggcctg

SEQ ID NO: 7444524 - DNA, 22 bp, Homo sapiens
ctggggcattgggagaggcctg

SEQ ID NO: 7444525 - DNA, 22 bp, Homo sapiens
ctggggcccatcgagggctgag

SEQ ID NO: 7444526 - DNA, 22 bp, Homo sapiens
ctggggcccatcgagggctgag

SEQ ID NO: 7444527 - DNA, 22 bp, Homo sapiens
ctggggcccatcgagggctgag

SEQ ID NO: 7444528 - DNA, 22 bp, Homo sapiens
ctggggccagtgaggaggcttt

SEQ ID NO: 7444529 - DNA, 22 bp, Homo sapiens
ctggggccagtgaggaggcttt

SEQ ID NO: 7444530 - DNA, 22 bp, Homo sapiens
ctggggccagtgaggaggcttt

SEQ ID NO: 7444531 - DNA, 22 bp, Homo sapiens
ctggggccagtgaggaggcttt

SEQ ID NO: 7444532 - DNA, 22 bp, Homo sapiens
ctggggcccatcgagggctgag

SEQ ID NO: 7444533 - DNA, 22 bp, Homo sapiens
ctggggcccatcgagggctgag

SEQ ID NO: 7444534 - DNA, 22 bp, Homo sapiens
ctggggcccatcgagggctgag

SEQ ID NO: 7444535 - DNA, 22 bp, Homo sapiens
ctggggcccatcgagggctgag

SEQ ID NO: 7444536 - DNA, 22 bp, Homo sapiens
ctggggcccatcgagggctgag

SEQ ID NO: 7444537 - DNA, 22 bp, Homo sapiens
ctggggcccatcgagggctgag

SEQ ID NO: 7444538 - DNA, 22 bp, Homo sapiens
ctgggctgccaggtaggcacac

SEQ ID NO: 7444539 - DNA, 22 bp, Homo sapiens
ctgggctgccaggtaggcacac

SEQ ID NO: 7444540 - DNA, 22 bp, Homo sapiens
ctgggctgccaggtaggcacac

SEQ ID NO: 7444541 - DNA, 22 bp, Homo sapiens
ctgggctgccaggtaggcacac

SEQ ID NO: 7444542 - DNA, 22 bp, Homo sapiens
ctgggctgccaggtaggcacac

SEQ ID NO: 7444543 - DNA, 22 bp, Homo sapiens
ctgggctgccaggtaggcacac

SEQ ID NO: 7444544 - DNA, 22 bp, Homo sapiens
ctgggctgccaggtaggcacac

SEQ ID NO: 7444545 - DNA, 22 bp, Homo sapiens
ctgggctgccaggtaggcacac

SEQ ID NO: 7444546 - DNA, 22 bp, Homo sapiens
ctgggctgccaggtaggcacac

SEQ ID NO: 7444547 - DNA, 20 bp, Homo sapiens
ctgggctgcccagctatggg

SEQ ID NO: 7444548 - DNA, 20 bp, Homo sapiens
ctgggctgcccagctatggg

SEQ ID NO: 7444549 - DNA, 20 bp, Homo sapiens
ctgggctgcccagctatggg

SEQ ID NO: 7444550 - DNA, 20 bp, Homo sapiens
ctgggctgcccagctatggg

SEQ ID NO: 7444551 - DNA, 20 bp, Homo sapiens
ctgggctgcccagctatggg

SEQ ID NO: 7444552 - DNA, 20 bp, Homo sapiens
ctgggctgcccagctatggg

SEQ ID NO: 7444553 - DNA, 20 bp, Homo sapiens
ctgggctgcccagctatggg

SEQ ID NO: 7444554 - DNA, 20 bp, Homo sapiens
ctgggctgcccagctatggg

SEQ ID NO: 7444555 - DNA, 20 bp, Homo sapiens
ctgggctgcccagctatggg

SEQ ID NO: 7444556 - DNA, 20 bp, Homo sapiens
ctgggctgcccagctatggg

SEQ ID NO: 7444557 - DNA, 20 bp, Homo sapiens
ctgggctgcccagctatggg

SEQ ID NO: 7444558 - DNA, 20 bp, Homo sapiens
ctgggctgcccagctatggg

SEQ ID NO: 7444559 - DNA, 22 bp, Homo sapiens
ctgggctgcgggcgcccctcca

SEQ ID NO: 7444560 - DNA, 22 bp, Homo sapiens
ctgggctgcgggcgcccctcca

SEQ ID NO: 7444561 - DNA, 22 bp, Homo sapiens
ctgggctgcgggcgcccctcca

SEQ ID NO: 7444562 - DNA, 22 bp, Homo sapiens
ctgggctgcgggcgcccctcca

SEQ ID NO: 7444563 - DNA, 22 bp, Homo sapiens
ctgggctgcgggcgcccctcca

SEQ ID NO: 7444564 - DNA, 22 bp, Homo sapiens
ctgggctgcgggcgcccctcca

SEQ ID NO: 7444565 - DNA, 22 bp, Homo sapiens
ctgggctgcgggcgcccctcca

SEQ ID NO: 7444566 - DNA, 22 bp, Homo sapiens
ctgggctgcgggcgcccctcca

SEQ ID NO: 7444567 - DNA, 22 bp, Homo sapiens
ctgggctgcggtggtaggttgt

SEQ ID NO: 7444568 - DNA, 22 bp, Homo sapiens
ctgggctgcggtggtaggttgt

SEQ ID NO: 7444569 - DNA, 22 bp, Homo sapiens
ctgggctgcggtggtaggttgt

SEQ ID NO: 7444570 - DNA, 22 bp, Homo sapiens
ctgggctgcggttctctgaagc

SEQ ID NO: 7444571 - DNA, 22 bp, Homo sapiens
ctgggctgcggttctctgaagc

SEQ ID NO: 7444572 - DNA, 22 bp, Homo sapiens
ctgggctgcggttctctgaagc

SEQ ID NO: 7444573 - DNA, 22 bp, Homo sapiens
ctgggctgcggttctctgaagc

SEQ ID NO: 7444574 - DNA, 22 bp, Homo sapiens
ctgggctgcggtggtaggttgt

SEQ ID NO: 7444575 - DNA, 22 bp, Homo sapiens
ctgggctgctcagccccctcgc

SEQ ID NO: 7444576 - DNA, 22 bp, Homo sapiens
ctgggctgctcagccccctcgc

SEQ ID NO: 7444577 - DNA, 22 bp, Homo sapiens
ctgggctgcggttctctgaagc

SEQ ID NO: 7444578 - DNA, 22 bp, Homo sapiens
ctgggctgctcagccccctcgc

SEQ ID NO: 7444579 - DNA, 22 bp, Homo sapiens
ctgggctgctcagccccctcgc

SEQ ID NO: 7444580 - DNA, 22 bp, Homo sapiens
ctgggctgctgtccactagggt

SEQ ID NO: 7444581 - DNA, 22 bp, Homo sapiens
ctgggctgctcagccccctcgc

SEQ ID NO: 7444582 - DNA, 20 bp, Homo sapiens
ctggggaggaggatgtgttc

SEQ ID NO: 7444583 - DNA, 20 bp, Homo sapiens
ctggggagctgctcccacga

SEQ ID NO: 7444584 - DNA, 20 bp, Homo sapiens
ctggggaggaggatgtgttc

SEQ ID NO: 7444585 - DNA, 20 bp, Homo sapiens
ctggggaggaggatgtgttc

SEQ ID NO: 7444586 - DNA, 20 bp, Homo sapiens
ctggggaggaggatgtgttc

SEQ ID NO: 7444587 - DNA, 20 bp, Homo sapiens
ctggggaggaggatgtgttc

SEQ ID NO: 7444588 - DNA, 20 bp, Homo sapiens
ctggggaggaggatgtgttc

SEQ ID NO: 7444589 - DNA, 20 bp, Homo sapiens
ctggggaggaggatgtgttc

SEQ ID NO: 7444590 - DNA, 22 bp, Homo sapiens
ctgggctggacacacttaacct

SEQ ID NO: 7444591 - DNA, 22 bp, Homo sapiens
ctgggctggacacacttaacct

SEQ ID NO: 7444592 - DNA, 22 bp, Homo sapiens
ctgggctgcttgctgaaggggt

SEQ ID NO: 7444593 - DNA, 22 bp, Homo sapiens
ctgggctgcttgctgaaggggt

SEQ ID NO: 7444594 - DNA, 22 bp, Homo sapiens
ctgggctgcttgctgaaggggt

SEQ ID NO: 7444595 - DNA, 22 bp, Homo sapiens
ctgggctgcttgctgaaggggt

SEQ ID NO: 7444596 - DNA, 22 bp, Homo sapiens
ctgggctgctgtccactagggt

SEQ ID NO: 7444597 - DNA, 22 bp, Homo sapiens
ctgggctgctgtccactagggt

SEQ ID NO: 7444598 - DNA, 22 bp, Homo sapiens
ctgggctgctgtccactagggt

SEQ ID NO: 7444599 - DNA, 22 bp, Homo sapiens
ctgggctgctgtccactagggt

SEQ ID NO: 7444600 - DNA, 22 bp, Homo sapiens
ctgggctgctgtccactagggt

SEQ ID NO: 7444601 - DNA, 22 bp, Homo sapiens
ctgggctgctgtccactagggt

SEQ ID NO: 7444602 - DNA, 22 bp, Homo sapiens
ctgggctgctgtccactagggt

SEQ ID NO: 7444603 - DNA, 23 bp, Homo sapiens
ctgggctgcttgagtccctggct

SEQ ID NO: 7444604 - DNA, 23 bp, Homo sapiens
ctgggctgcttgagtccctggct

SEQ ID NO: 7444605 - DNA, 23 bp, Homo sapiens
ctgggctgcttgagtccctggct

SEQ ID NO: 7444606 - DNA, 23 bp, Homo sapiens
ctgggctgcttgagtccctggct

SEQ ID NO: 7444607 - DNA, 23 bp, Homo sapiens
ctgggctgcttgagtccctggct

SEQ ID NO: 7444608 - DNA, 22 bp, Homo sapiens
ctgggctgctgtccactagggt

SEQ ID NO: 7444609 - DNA, 22 bp, Homo sapiens
ctgggctgctgtccactagggt

SEQ ID NO: 7444610 - DNA, 23 bp, Homo sapiens
ctgggctgcttgagtccctggct

SEQ ID NO: 7444611 - DNA, 23 bp, Homo sapiens
ctgggctgcttgagtccctggct

SEQ ID NO: 7444612 - DNA, 22 bp, Homo sapiens
ctgggctgcttgctgaaggggt

SEQ ID NO: 7444613 - DNA, 22 bp, Homo sapiens
ctgggctgcttgctgaaggggt

SEQ ID NO: 7444614 - DNA, 22 bp, Homo sapiens
ctgggctgcttgctgaaggggt

SEQ ID NO: 7444615 - DNA, 22 bp, Homo sapiens
ctgggctgcttgctgaaggggt

SEQ ID NO: 7444616 - DNA, 22 bp, Homo sapiens
ctgggctgcttgctgaaggggt

SEQ ID NO: 7444617 - DNA, 22 bp, Homo sapiens
ctgggctgcttgctgaaggggt

SEQ ID NO: 7444618 - DNA, 22 bp, Homo sapiens
ctgggctgcagttcctggtcct

SEQ ID NO: 7444619 - DNA, 22 bp, Homo sapiens
ctgggctgcaggcactaattgg

SEQ ID NO: 7444620 - DNA, 22 bp, Homo sapiens
ctgggctgcaggcactaattgg

SEQ ID NO: 7444621 - DNA, 22 bp, Homo sapiens
ctgggctgcaggagtggggcaa

SEQ ID NO: 7444622 - DNA, 22 bp, Homo sapiens
ctgggctgcaggagtggggcaa

SEQ ID NO: 7444623 - DNA, 22 bp, Homo sapiens
ctgggctgcagttcctggtcct

SEQ ID NO: 7444624 - DNA, 22 bp, Homo sapiens
ctgggctgcagttcctggtcct

SEQ ID NO: 7444625 - DNA, 22 bp, Homo sapiens
ctgggctgcagttcctggtcct

SEQ ID NO: 7444626 - DNA, 22 bp, Homo sapiens
ctgggctgcagttcctggtcct

SEQ ID NO: 7444627 - DNA, 22 bp, Homo sapiens
ctgggctgcagttcctggtcct

SEQ ID NO: 7444628 - DNA, 22 bp, Homo sapiens
ctgggctgcagttcctggtcct

SEQ ID NO: 7444629 - DNA, 22 bp, Homo sapiens
ctgggctgcatcaaagaggcat

SEQ ID NO: 7444630 - DNA, 22 bp, Homo sapiens
ctgggctgcatcaaagaggcat

SEQ ID NO: 7444631 - DNA, 22 bp, Homo sapiens
ctgggctgcatcaaagaggcat

SEQ ID NO: 7444632 - DNA, 22 bp, Homo sapiens
ctgggctgcagttcctggtcct

SEQ ID NO: 7444633 - DNA, 22 bp, Homo sapiens
ctgggctgcagttcctggtcct

SEQ ID NO: 7444634 - DNA, 22 bp, Homo sapiens
ctgggctgcatcaaagaggcat

SEQ ID NO: 7444635 - DNA, 22 bp, Homo sapiens
ctgggctgcatcaaagaggcat

SEQ ID NO: 7444636 - DNA, 22 bp, Homo sapiens
ctgggctgcaggagtggggcaa

SEQ ID NO: 7444637 - DNA, 22 bp, Homo sapiens
ctgggctgcaggagtggggcaa

SEQ ID NO: 7444638 - DNA, 22 bp, Homo sapiens
ctgggctgcaggagtggggcaa

SEQ ID NO: 7444639 - DNA, 22 bp, Homo sapiens
ctgggctgcaggagtggggcaa

SEQ ID NO: 7444640 - DNA, 22 bp, Homo sapiens
ctgggctgcaggagtggggcaa

SEQ ID NO: 7444641 - DNA, 22 bp, Homo sapiens
ctgggctgcaggagtggggcaa

SEQ ID NO: 7444642 - DNA, 22 bp, Homo sapiens
ctgggctgcaggagtggggcaa

SEQ ID NO: 7444643 - DNA, 22 bp, Homo sapiens
ctgggctgcaggagtggggcaa

SEQ ID NO: 7444644 - DNA, 22 bp, Homo sapiens
ctgggctgcaggagtggggcaa

SEQ ID NO: 7444645 - DNA, 22 bp, Homo sapiens
ctgggctgcaggagtggggcaa

SEQ ID NO: 7444646 - DNA, 22 bp, Homo sapiens
ctgggctgcagcgggagcgacg

SEQ ID NO: 7444647 - DNA, 22 bp, Homo sapiens
ctgggctgcagcgggagcgacg

SEQ ID NO: 7444648 - DNA, 22 bp, Homo sapiens
ctgggctgcagcgggagcgacg

SEQ ID NO: 7444649 - DNA, 22 bp, Homo sapiens
ctgggccagatccagcctcaca

SEQ ID NO: 7444650 - DNA, 22 bp, Homo sapiens
ctgggccagatccagcctcaca

SEQ ID NO: 7444651 - DNA, 22 bp, Homo sapiens
ctgggccagatccagcctcaca

SEQ ID NO: 7444652 - DNA, 22 bp, Homo sapiens
ctgggccagatccagcctcaca

SEQ ID NO: 7444653 - DNA, 22 bp, Homo sapiens
ctgggccagatccagcctcaca

SEQ ID NO: 7444654 - DNA, 18 bp, Homo sapiens
ctgggccagagtttctgc

SEQ ID NO: 7444655 - DNA, 18 bp, Homo sapiens
ctgggccagagtttctgc

SEQ ID NO: 7444656 - DNA, 22 bp, Homo sapiens
ctgggccagatccagcctcaca

SEQ ID NO: 7444657 - DNA, 22 bp, Homo sapiens
ctgggccagatccagcctcaca

SEQ ID NO: 7444658 - DNA, 22 bp, Homo sapiens
ctgggccagatccagcctcaca

SEQ ID NO: 7444659 - DNA, 22 bp, Homo sapiens
ctgggctctgcagttgatgttt

SEQ ID NO: 7444660 - DNA, 22 bp, Homo sapiens
ctgggctctgcagttgatgttt

SEQ ID NO: 7444661 - DNA, 22 bp, Homo sapiens
ctgggctctgcggtgtcgctct

SEQ ID NO: 7444662 - DNA, 22 bp, Homo sapiens
ctgggctctgcagttgatgttt

SEQ ID NO: 7444663 - DNA, 22 bp, Homo sapiens
ctgggctctaggaaccattcct

SEQ ID NO: 7444664 - DNA, 22 bp, Homo sapiens
ctgggctctaggaaccattcct

SEQ ID NO: 7444665 - DNA, 22 bp, Homo sapiens
ctgggctctaggaaccattcct

SEQ ID NO: 7444666 - DNA, 19 bp, Homo sapiens
ctgggccagagctgtcctc

SEQ ID NO: 7444667 - DNA, 19 bp, Homo sapiens
ctgggccagagctgtcctc

SEQ ID NO: 7444668 - DNA, 19 bp, Homo sapiens
ctgggccagagctgtcctc

SEQ ID NO: 7444669 - DNA, 19 bp, Homo sapiens
ctgggccagagctgtcctc

SEQ ID NO: 7444670 - DNA, 19 bp, Homo sapiens
ctgggccagagctgtcctc

SEQ ID NO: 7444671 - DNA, 22 bp, Homo sapiens
ctgggccagaccttgtggtctt

SEQ ID NO: 7444672 - DNA, 22 bp, Homo sapiens
ctgggccagaccttgtggtctt

SEQ ID NO: 7444673 - DNA, 22 bp, Homo sapiens
ctgggccagaccttgtggtctt

SEQ ID NO: 7444674 - DNA, 22 bp, Homo sapiens
ctgggccagaccttgtggtctt

SEQ ID NO: 7444675 - DNA, 19 bp, Homo sapiens
ctgggccagagctgtcctc

SEQ ID NO: 7444676 - DNA, 19 bp, Homo sapiens
ctgggccagagctgtcctc

SEQ ID NO: 7444677 - DNA, 19 bp, Homo sapiens
ctgggccagagctgtcctc

SEQ ID NO: 7444678 - DNA, 19 bp, Homo sapiens
ctgggccagagctgtcctc

SEQ ID NO: 7444679 - DNA, 19 bp, Homo sapiens
ctgggccagagctgtcctc

SEQ ID NO: 7444680 - DNA, 18 bp, Homo sapiens
ctgggccagagtttctgc

SEQ ID NO: 7444681 - DNA, 22 bp, Homo sapiens
ctggctttggtcatgtgatcat

SEQ ID NO: 7444682 - DNA, 22 bp, Homo sapiens
ctggctttggaaacaatttatc

SEQ ID NO: 7444683 - DNA, 22 bp, Homo sapiens
ctggctttggaacaaatcatag

SEQ ID NO: 7444684 - DNA, 22 bp, Homo sapiens
ctggctttggaacaaatcatag

SEQ ID NO: 7444685 - DNA, 22 bp, Homo sapiens
ctggctttggtcccctgtgcct

SEQ ID NO: 7444686 - DNA, 22 bp, Homo sapiens
ctggctttggtcccctgtgcct

SEQ ID NO: 7444687 - DNA, 22 bp, Homo sapiens
ctggctttggtcatgtgatcat

SEQ ID NO: 7444688 - DNA, 22 bp, Homo sapiens
ctggctttgtatagttccctga

SEQ ID NO: 7444689 - DNA, 22 bp, Homo sapiens
ctggctttgtatagttccctga

SEQ ID NO: 7444690 - DNA, 22 bp, Homo sapiens
ctggctttgtatagttccctga

SEQ ID NO: 7444691 - DNA, 22 bp, Homo sapiens
ctggctttgttctgattgcttc

SEQ ID NO: 7444692 - DNA, 22 bp, Homo sapiens
ctggctttgttctgattgcttc

SEQ ID NO: 7444693 - DNA, 22 bp, Homo sapiens
ctggcttttcctaaactgggaa

SEQ ID NO: 7444694 - DNA, 22 bp, Homo sapiens
ctggcttttgcaggtgttgcta

SEQ ID NO: 7444695 - DNA, 22 bp, Homo sapiens
ctggcttttcctaaactgggaa

SEQ ID NO: 7444696 - DNA, 22 bp, Homo sapiens
ctggcttttcctaaactgggaa

SEQ ID NO: 7444697 - DNA, 22 bp, Homo sapiens
ctggcttttcaaactgttcagt

SEQ ID NO: 7444698 - DNA, 22 bp, Homo sapiens
ctggcttttcaaactgttcagt

SEQ ID NO: 7444699 - DNA, 22 bp, Homo sapiens
ctggcttttcaaactgttcagt

SEQ ID NO: 7444700 - DNA, 22 bp, Homo sapiens
ctggcttttcaaactgttcagt

SEQ ID NO: 7444701 - DNA, 22 bp, Homo sapiens
ctggcttttagtgtgaagactt

SEQ ID NO: 7444702 - DNA, 22 bp, Homo sapiens
ctggcttttagtgtgaagactt

SEQ ID NO: 7444703 - DNA, 22 bp, Homo sapiens
ctggcttttagtgtgaagactt

SEQ ID NO: 7444704 - DNA, 22 bp, Homo sapiens
ctggcttttagtgtgaagactt

SEQ ID NO: 7444705 - DNA, 22 bp, Homo sapiens
ctggcttttggaggagggtcag

SEQ ID NO: 7444706 - DNA, 22 bp, Homo sapiens
ctggcttttttcccattatgca

SEQ ID NO: 7444707 - DNA, 22 bp, Homo sapiens
ctggcttttggaggagggtcag

SEQ ID NO: 7444708 - DNA, 22 bp, Homo sapiens
ctggcttttggaaacaggctca

SEQ ID NO: 7444709 - DNA, 22 bp, Homo sapiens
ctggcttttggaaacaggctca

SEQ ID NO: 7444710 - DNA, 22 bp, Homo sapiens
ctggcttttggaaacaggctca

SEQ ID NO: 7444711 - DNA, 22 bp, Homo sapiens
ctggcttttgcctgtaattcta

SEQ ID NO: 7444712 - DNA, 22 bp, Homo sapiens
ctgggaacatctgaatgctgag

SEQ ID NO: 7444713 - DNA, 22 bp, Homo sapiens
ctgggaaattgacactgataaa

SEQ ID NO: 7444714 - DNA, 22 bp, Homo sapiens
ctgggaaattgacactgataaa

SEQ ID NO: 7444715 - DNA, 22 bp, Homo sapiens
ctgggaaatataataaagtggt

SEQ ID NO: 7444716 - DNA, 22 bp, Homo sapiens
ctgggaaattgacactgataaa

SEQ ID NO: 7444717 - DNA, 22 bp, Homo sapiens
ctgggagctcagccctggggtg

SEQ ID NO: 7444718 - DNA, 22 bp, Homo sapiens
ctgggagctagctctgagctga

SEQ ID NO: 7444719 - DNA, 22 bp, Homo sapiens
ctgggagctcagccctggggtg

SEQ ID NO: 7444720 - DNA, 22 bp, Homo sapiens
ctgggagctcagccctggggtg

SEQ ID NO: 7444721 - DNA, 22 bp, Homo sapiens
ctgggagctagctctgagctga

SEQ ID NO: 7444722 - DNA, 22 bp, Homo sapiens
ctgggagctgaggctgacgctg

SEQ ID NO: 7444723 - DNA, 22 bp, Homo sapiens
ctgggagctgaggctgacgctg

SEQ ID NO: 7444724 - DNA, 22 bp, Homo sapiens
ctgggagctgaggctgacgctg

SEQ ID NO: 7444725 - DNA, 22 bp, Homo sapiens
ctgggagctcagccctggggtg

SEQ ID NO: 7444726 - DNA, 22 bp, Homo sapiens
ctgggagctcagccctggggtg

SEQ ID NO: 7444727 - DNA, 22 bp, Homo sapiens
ctgggagctcagccctggggtg

SEQ ID NO: 7444728 - DNA, 22 bp, Homo sapiens
ctgggagctagctctgagctga

SEQ ID NO: 7444729 - DNA, 22 bp, Homo sapiens
ctgggagctagctctgagctga

SEQ ID NO: 7444730 - DNA, 22 bp, Homo sapiens
ctgggagctagctctgagctga

SEQ ID NO: 7444731 - DNA, 22 bp, Homo sapiens
ctgggaagaaattgtgggaggc

SEQ ID NO: 7444732 - DNA, 22 bp, Homo sapiens
ctgggaagaaattgtgggaggc

SEQ ID NO: 7444733 - DNA, 22 bp, Homo sapiens
ctgggaagaaattgtgggaggc

SEQ ID NO: 7444734 - DNA, 22 bp, Homo sapiens
ctgggaagaaattgtgggaggc

SEQ ID NO: 7444735 - DNA, 22 bp, Homo sapiens
ctgggagctgaggctgacgctg

SEQ ID NO: 7444736 - DNA, 22 bp, Homo sapiens
ctgggagctgaggctgacgctg

SEQ ID NO: 7444737 - DNA, 22 bp, Homo sapiens
ctgggagctgaggctgacgctg

SEQ ID NO: 7444738 - DNA, 22 bp, Homo sapiens
ctgggagctgaggctgacgctg

SEQ ID NO: 7444739 - DNA, 22 bp, Homo sapiens
ctgggaggattcattgaggtga

SEQ ID NO: 7444740 - DNA, 22 bp, Homo sapiens
ctgggaggattcattgaggtga

SEQ ID NO: 7444741 - DNA, 22 bp, Homo sapiens
ctgggaggattcattgaggtga

SEQ ID NO: 7444742 - DNA, 22 bp, Homo sapiens
ctgggaggattcattgaggtga

SEQ ID NO: 7444743 - DNA, 22 bp, Homo sapiens
ctgggaggcaccgcgtcgtgct

SEQ ID NO: 7444744 - DNA, 22 bp, Homo sapiens
ctgggaggcaccgcgtcgtgct

SEQ ID NO: 7444745 - DNA, 22 bp, Homo sapiens
ctgggaggcaccgcgtcgtgct

SEQ ID NO: 7444746 - DNA, 22 bp, Homo sapiens
ctgggaggcaccgcgtcgtgct

SEQ ID NO: 7444747 - DNA, 22 bp, Homo sapiens
ctggctttgctggactgggagt

SEQ ID NO: 7444748 - DNA, 22 bp, Homo sapiens
ctggctttggaaacaatttatc

SEQ ID NO: 7444749 - DNA, 22 bp, Homo sapiens
ctggctttggaaacaatttatc

SEQ ID NO: 7444750 - DNA, 22 bp, Homo sapiens
ctggctttgctggactgggagt

SEQ ID NO: 7444751 - DNA, 22 bp, Homo sapiens
ctggctttgctggactgggagt

SEQ ID NO: 7444752 - DNA, 22 bp, Homo sapiens
ctggctttgatcagagtgacct

SEQ ID NO: 7444753 - DNA, 22 bp, Homo sapiens
ctggctttgatcagagtgacct

SEQ ID NO: 7444754 - DNA, 22 bp, Homo sapiens
ctggctttgatcagagtgacct

SEQ ID NO: 7444755 - DNA, 22 bp, Homo sapiens
ctggctttgcgtctttgccaca

SEQ ID NO: 7444756 - DNA, 22 bp, Homo sapiens
ctggctttgcgtctttgccaca

SEQ ID NO: 7444757 - DNA, 22 bp, Homo sapiens
ctggctttgcgtctttgccaca

SEQ ID NO: 7444758 - DNA, 22 bp, Homo sapiens
ctggctttgaaatgcatttcag

SEQ ID NO: 7444759 - DNA, 22 bp, Homo sapiens
ctggctttgaaatgcatttcag

SEQ ID NO: 7444760 - DNA, 22 bp, Homo sapiens
ctggctttgaaatgcatttcag

SEQ ID NO: 7444761 - DNA, 22 bp, Homo sapiens
ctggctttgaaatgcatttcag

SEQ ID NO: 7444762 - DNA, 18 bp, Homo sapiens
ctggctttcttatccatc

SEQ ID NO: 7444763 - DNA, 18 bp, Homo sapiens
ctggctttcttatccatc

SEQ ID NO: 7444764 - DNA, 18 bp, Homo sapiens
ctggctttcttatccatc

SEQ ID NO: 7444765 - DNA, 22 bp, Homo sapiens
ctggctttgaaggtctttccta

SEQ ID NO: 7444766 - DNA, 22 bp, Homo sapiens
ctggctttgaaggtctttccta

SEQ ID NO: 7444767 - DNA, 22 bp, Homo sapiens
ctggctttgaaggtctttccta

SEQ ID NO: 7444768 - DNA, 22 bp, Homo sapiens
ctggctttgaaggtctttccta

SEQ ID NO: 7444769 - DNA, 22 bp, Homo sapiens
ctggctttgaggatcccctctt

SEQ ID NO: 7444770 - DNA, 22 bp, Homo sapiens
ctggctttgaggatcccctctt

SEQ ID NO: 7444771 - DNA, 22 bp, Homo sapiens
ctggctttctgcacagaattgg

SEQ ID NO: 7444772 - DNA, 22 bp, Homo sapiens
ctggctttctgcacagaattgg

SEQ ID NO: 7444773 - DNA, 22 bp, Homo sapiens
ctggctttctgcacagaattgg

SEQ ID NO: 7444774 - DNA, 22 bp, Homo sapiens
ctggctttctgttataaagaca

SEQ ID NO: 7444775 - DNA, 22 bp, Homo sapiens
ctggctttctgttataaagaca

SEQ ID NO: 7444776 - DNA, 22 bp, Homo sapiens
ctggctttctgttataaagaca

SEQ ID NO: 7444777 - DNA, 22 bp, Homo sapiens
ctggctttctgacatgttactg

SEQ ID NO: 7444778 - DNA, 22 bp, Homo sapiens
ctggctttctgacatgttactg

SEQ ID NO: 7444779 - DNA, 22 bp, Homo sapiens
ctggctttctgcaaatctccat

SEQ ID NO: 7444780 - DNA, 22 bp, Homo sapiens
ctggctttctgcaaatctccat

SEQ ID NO: 7444781 - DNA, 22 bp, Homo sapiens
ctggctttctgcaaatctccat

SEQ ID NO: 7444782 - DNA, 22 bp, Homo sapiens
ctggctttctatttggtgctat

SEQ ID NO: 7444783 - DNA, 22 bp, Homo sapiens
ctggctttctatttggtgctat

SEQ ID NO: 7444784 - DNA, 22 bp, Homo sapiens
ctggctttctccagaaattttt

SEQ ID NO: 7444785 - DNA, 22 bp, Homo sapiens
ctggctttctccagaaattttt

SEQ ID NO: 7444786 - DNA, 22 bp, Homo sapiens
ctggctttctccagaaattttt

SEQ ID NO: 7444787 - DNA, 22 bp, Homo sapiens
ctggctttctctgtggtgttca

SEQ ID NO: 7444788 - DNA, 22 bp, Homo sapiens
ctggctttctctgtggtgttca

SEQ ID NO: 7444789 - DNA, 22 bp, Homo sapiens
ctggctttctctgtggtgttca

SEQ ID NO: 7444790 - DNA, 22 bp, Homo sapiens
ctggctttctgaacatcagtga

SEQ ID NO: 7444791 - DNA, 22 bp, Homo sapiens
ctggctttctgaacatcagtga

SEQ ID NO: 7444792 - DNA, 22 bp, Homo sapiens
ctggctttaggttggagagctg

SEQ ID NO: 7444793 - DNA, 22 bp, Homo sapiens
ctggctttaggttggagagctg

SEQ ID NO: 7444794 - DNA, 22 bp, Homo sapiens
ctggctttcatggcgcagttga

SEQ ID NO: 7444795 - DNA, 22 bp, Homo sapiens
ctggctttcatggcgcagttga

SEQ ID NO: 7444796 - DNA, 22 bp, Homo sapiens
ctggctttcattcattcaggcc

SEQ ID NO: 7444797 - DNA, 22 bp, Homo sapiens
ctggctttcattcattcaggcc

SEQ ID NO: 7444798 - DNA, 22 bp, Homo sapiens
ctggctttacctcactggggct

SEQ ID NO: 7444799 - DNA, 22 bp, Homo sapiens
ctggctttaggttggagagctg

SEQ ID NO: 7444800 - DNA, 22 bp, Homo sapiens
ctggctttacctcactggggct

SEQ ID NO: 7444801 - DNA, 22 bp, Homo sapiens
ctggctttaggttggagagctg

SEQ ID NO: 7444802 - DNA, 22 bp, Homo sapiens
ctggctttaggttggagagctg

SEQ ID NO: 7444803 - DNA, 22 bp, Homo sapiens
ctggctttaggttggagagctg

SEQ ID NO: 7444804 - DNA, 22 bp, Homo sapiens
ctggctttaggttggagagctg

SEQ ID NO: 7444805 - DNA, 22 bp, Homo sapiens
ctggctttccttgtctgcatcc

SEQ ID NO: 7444806 - DNA, 22 bp, Homo sapiens
ctggctttccttgtctgcatcc

SEQ ID NO: 7444807 - DNA, 22 bp, Homo sapiens
ctggctttccctggacaacagc

SEQ ID NO: 7444808 - DNA, 22 bp, Homo sapiens
ctggctttccctggacaacagc

SEQ ID NO: 7444809 - DNA, 22 bp, Homo sapiens
ctggctttcattcattcaggcc

SEQ ID NO: 7444810 - DNA, 22 bp, Homo sapiens
ctggctttcatttcaagcacgt

SEQ ID NO: 7444811 - DNA, 22 bp, Homo sapiens
ctggctttcatttcaagcacgt

SEQ ID NO: 7444812 - DNA, 22 bp, Homo sapiens
ctggctttaaaatgctcctgga

SEQ ID NO: 7444813 - DNA, 22 bp, Homo sapiens
ctggctttaaccctacaaacct

SEQ ID NO: 7444814 - DNA, 22 bp, Homo sapiens
ctggctttaaccctacaaacct

SEQ ID NO: 7444815 - DNA, 22 bp, Homo sapiens
ctggctttaaaatgctcctgga

SEQ ID NO: 7444816 - DNA, 22 bp, Homo sapiens
ctggctttaaaatgctcctgga

SEQ ID NO: 7444817 - DNA, 22 bp, Homo sapiens
ctggcttgttttaagaatacaa

SEQ ID NO: 7444818 - DNA, 22 bp, Homo sapiens
ctggctgtggattatcacaggc

SEQ ID NO: 7444819 - DNA, 22 bp, Homo sapiens
ctggcttgttttaagaatacaa

SEQ ID NO: 7444820 - DNA, 22 bp, Homo sapiens
ctggctttaatgtcatctttct

SEQ ID NO: 7444821 - DNA, 22 bp, Homo sapiens
ctggctttaatgtcatctttct

SEQ ID NO: 7444822 - DNA, 22 bp, Homo sapiens
ctggctttaatgtcatctttct

SEQ ID NO: 7444823 - DNA, 22 bp, Homo sapiens
ctggctttaatgtcatctttct

SEQ ID NO: 7444824 - DNA, 22 bp, Homo sapiens
ctggctttaaccctacaaacct

SEQ ID NO: 7444825 - DNA, 22 bp, Homo sapiens
ctggctttacctcactggggct

SEQ ID NO: 7444826 - DNA, 22 bp, Homo sapiens
ctggcttggcttattcatggaa

SEQ ID NO: 7444827 - DNA, 22 bp, Homo sapiens
ctggcttggcttattcatggaa

SEQ ID NO: 7444828 - DNA, 22 bp, Homo sapiens
ctggcttgggtctacctgcctt

SEQ ID NO: 7444829 - DNA, 22 bp, Homo sapiens
ctggcttgggtctacctgcctt

SEQ ID NO: 7444830 - DNA, 22 bp, Homo sapiens
ctggctgtgctgactgagaggg

SEQ ID NO: 7444831 - DNA, 22 bp, Homo sapiens
ctggctgtgctgactgagaggg

SEQ ID NO: 7444832 - DNA, 22 bp, Homo sapiens
ctgggaggcccacgttgggaag

SEQ ID NO: 7444833 - DNA, 22 bp, Homo sapiens
ctgggaggcccacgttgggaag

SEQ ID NO: 7444834 - DNA, 22 bp, Homo sapiens
ctgggaggcccacgttgggaag

SEQ ID NO: 7444835 - DNA, 22 bp, Homo sapiens
ctgggaggcccacgttgggaag

SEQ ID NO: 7444836 - DNA, 22 bp, Homo sapiens
ctgggaggcccacgttgggaag

SEQ ID NO: 7444837 - DNA, 22 bp, Homo sapiens
ctgggaggcccacgttgggaag

SEQ ID NO: 7444838 - DNA, 22 bp, Homo sapiens
ctgggaggcagtctctctagaa

SEQ ID NO: 7444839 - DNA, 22 bp, Homo sapiens
ctgggaggcagtctctctagaa

SEQ ID NO: 7444840 - DNA, 22 bp, Homo sapiens
ctgggaggcagtctctctagaa

SEQ ID NO: 7444841 - DNA, 22 bp, Homo sapiens
ctgggaggcagtctctctagaa

SEQ ID NO: 7444842 - DNA, 22 bp, Homo sapiens
ctgggaggcagtctctctagaa

SEQ ID NO: 7444843 - DNA, 22 bp, Homo sapiens
ctgggaggcagtctctctagaa

SEQ ID NO: 7444844 - DNA, 22 bp, Homo sapiens
ctgggaggcagtctctctagaa

SEQ ID NO: 7444845 - DNA, 22 bp, Homo sapiens
ctgggaggcccacgttgggaag

SEQ ID NO: 7444846 - DNA, 22 bp, Homo sapiens
ctgggcaggagaggtggttgga

SEQ ID NO: 7444847 - DNA, 22 bp, Homo sapiens
ctgggcaggagaggtggttgga

SEQ ID NO: 7444848 - DNA, 22 bp, Homo sapiens
ctgggcaggagaggtggttgga

SEQ ID NO: 7444849 - DNA, 22 bp, Homo sapiens
ctgggcaggagaggtggttgga

SEQ ID NO: 7444850 - DNA, 22 bp, Homo sapiens
ctgggcaggagaggtggttgga

SEQ ID NO: 7444851 - DNA, 22 bp, Homo sapiens
ctgggaggcggagcttgcagtg

SEQ ID NO: 7444852 - DNA, 22 bp, Homo sapiens
ctgggaggcggagcttgcagtg

SEQ ID NO: 7444853 - DNA, 22 bp, Homo sapiens
ctgggaggcggagcttgcagtg

SEQ ID NO: 7444854 - DNA, 22 bp, Homo sapiens
ctgggaggcggagcttgcagtg

SEQ ID NO: 7444855 - DNA, 22 bp, Homo sapiens
ctgggaggcggagcttgcagtg

SEQ ID NO: 7444856 - DNA, 22 bp, Homo sapiens
ctgggaggcggagcttgcagtg

SEQ ID NO: 7444857 - DNA, 22 bp, Homo sapiens
ctgggaggcagaggttgtagtg

SEQ ID NO: 7444858 - DNA, 22 bp, Homo sapiens
ctgggaggcagaggttgtagtg

SEQ ID NO: 7444859 - DNA, 22 bp, Homo sapiens
ctgggaggcagtctctctagaa

SEQ ID NO: 7444860 - DNA, 22 bp, Homo sapiens
ctgggaggcagaggttgtagtg

SEQ ID NO: 7444861 - DNA, 22 bp, Homo sapiens
ctgggaggcagaggttgtagtg

SEQ ID NO: 7444862 - DNA, 22 bp, Homo sapiens
ctgggaggcagaggttgtagtg

SEQ ID NO: 7444863 - DNA, 22 bp, Homo sapiens
ctgggaggcagaggttgtagtg

SEQ ID NO: 7444864 - DNA, 22 bp, Homo sapiens
ctgggaggcagaggttgcagtg

SEQ ID NO: 7444865 - DNA, 22 bp, Homo sapiens
ctgggaggcagaggttgtagtg

SEQ ID NO: 7444866 - DNA, 22 bp, Homo sapiens
ctgggaggcagaggttgcagtg

SEQ ID NO: 7444867 - DNA, 22 bp, Homo sapiens
ctgggaggcagaggttgcagtg

SEQ ID NO: 7444868 - DNA, 22 bp, Homo sapiens
ctgggaggcagaggttgcagtg

SEQ ID NO: 7444869 - DNA, 22 bp, Homo sapiens
ctgggaggcagaggttgcagtg

SEQ ID NO: 7444870 - DNA, 22 bp, Homo sapiens
ctgggaggcagaggttgcagtg

SEQ ID NO: 7444871 - DNA, 22 bp, Homo sapiens
ctgggaggcactattcaggagg

SEQ ID NO: 7444872 - DNA, 22 bp, Homo sapiens
ctgggaggcactattcaggagg

SEQ ID NO: 7444873 - DNA, 22 bp, Homo sapiens
ctgggaggcagaggttgcagtg

SEQ ID NO: 7444874 - DNA, 22 bp, Homo sapiens
ctgggaggcagaggttgcagtg

SEQ ID NO: 7444875 - DNA, 22 bp, Homo sapiens
ctgggaggcagaggttgcagtg

SEQ ID NO: 7444876 - DNA, 22 bp, Homo sapiens
ctgggaggcagaggttgcagtg

SEQ ID NO: 7444877 - DNA, 22 bp, Homo sapiens
ctgggaggcactattcaggagg

SEQ ID NO: 7444878 - DNA, 22 bp, Homo sapiens
ctgggaggcactattcaggagg

SEQ ID NO: 7444879 - DNA, 22 bp, Homo sapiens
ctgggaggcactattcaggagg

SEQ ID NO: 7444880 - DNA, 22 bp, Homo sapiens
ctgggaggcactattcaggagg

SEQ ID NO: 7444881 - DNA, 22 bp, Homo sapiens
ctgggaggcactattcaggagg

SEQ ID NO: 7444882 - DNA, 22 bp, Homo sapiens
ctgggaggcactattcaggagg

SEQ ID NO: 7444883 - DNA, 22 bp, Homo sapiens
ctgggaggcactattcaggagg

SEQ ID NO: 7444884 - DNA, 22 bp, Homo sapiens
ctgggaggcactattcaggagg

SEQ ID NO: 7444885 - DNA, 22 bp, Homo sapiens
ctgggcaggagggctctatgga

SEQ ID NO: 7444886 - DNA, 22 bp, Homo sapiens
ctgggcaggagaggtggttgga

SEQ ID NO: 7444887 - DNA, 22 bp, Homo sapiens
ctgggcaggagggctctatgga

SEQ ID NO: 7444888 - DNA, 22 bp, Homo sapiens
ctgggcaggagggctctatgga

SEQ ID NO: 7444889 - DNA, 22 bp, Homo sapiens
ctgggcagtttattcagttctg

SEQ ID NO: 7444890 - DNA, 22 bp, Homo sapiens
ctgggcaggagggctctatgga

SEQ ID NO: 7444891 - DNA, 22 bp, Homo sapiens
ctgggcagtttattcagttctg

SEQ ID NO: 7444892 - DNA, 22 bp, Homo sapiens
ctgggcagtttattcagttctg

SEQ ID NO: 7444893 - DNA, 22 bp, Homo sapiens
ctgggcagtttattcagttctg

SEQ ID NO: 7444894 - DNA, 22 bp, Homo sapiens
ctgggcagtttattcagttctg

SEQ ID NO: 7444895 - DNA, 22 bp, Homo sapiens
ctgggcagtttattcagttctg

SEQ ID NO: 7444896 - DNA, 22 bp, Homo sapiens
ctgggcagtttattcagttctg

SEQ ID NO: 7444897 - DNA, 22 bp, Homo sapiens
ctgggcagttttacatcattgc

SEQ ID NO: 7444898 - DNA, 22 bp, Homo sapiens
ctgggcagttttacatcattgc

SEQ ID NO: 7444899 - DNA, 22 bp, Homo sapiens
ctgggcatggacagctgcacag

SEQ ID NO: 7444900 - DNA, 22 bp, Homo sapiens
ctgggcatgaaaaggatgccag

SEQ ID NO: 7444901 - DNA, 22 bp, Homo sapiens
ctgggcatgaaaaggatgccag

SEQ ID NO: 7444902 - DNA, 22 bp, Homo sapiens
ctgggcatgaaaaggatgccag

SEQ ID NO: 7444903 - DNA, 22 bp, Homo sapiens
ctgggcatatacgtgcaagtca

SEQ ID NO: 7444904 - DNA, 23 bp, Homo sapiens
ctgggcatggagcttcagaggct

SEQ ID NO: 7444905 - DNA, 22 bp, Homo sapiens
ctgggcatggacagctgcacag

SEQ ID NO: 7444906 - DNA, 22 bp, Homo sapiens
ctgggccaagaagttgtgtatg

SEQ ID NO: 7444907 - DNA, 22 bp, Homo sapiens
ctgggccaaaagaagtgttctt

SEQ ID NO: 7444908 - DNA, 22 bp, Homo sapiens
ctgggccaaaagaagtgttctt

SEQ ID NO: 7444909 - DNA, 22 bp, Homo sapiens
ctgggccaaaagaagtgttctt

SEQ ID NO: 7444910 - DNA, 22 bp, Homo sapiens
ctgggccaagaagttgtgtatg

SEQ ID NO: 7444911 - DNA, 22 bp, Homo sapiens
ctgggccacaaaaaactcctgt

SEQ ID NO: 7444912 - DNA, 22 bp, Homo sapiens
ctgggccacaaaaaactcctgt

SEQ ID NO: 7444913 - DNA, 22 bp, Homo sapiens
ctgggccacaaaaaactcctgt

SEQ ID NO: 7444914 - DNA, 22 bp, Homo sapiens
ctgggccacaaaaaactcctgt

SEQ ID NO: 7444915 - DNA, 22 bp, Homo sapiens
ctgggccacaaaaaactcctgt

SEQ ID NO: 7444916 - DNA, 22 bp, Homo sapiens
ctgggccacttcctcaggggaa

SEQ ID NO: 7444917 - DNA, 22 bp, Homo sapiens
ctgggccagaagacatttagga

SEQ ID NO: 7444918 - DNA, 22 bp, Homo sapiens
ctgggccacttcctcaggggaa

SEQ ID NO: 7444919 - DNA, 22 bp, Homo sapiens
ctgggccacttcctcaggggaa

SEQ ID NO: 7444920 - DNA, 22 bp, Homo sapiens
ctgggccacttcctcaggggaa

SEQ ID NO: 7444921 - DNA, 22 bp, Homo sapiens
ctgggccagaagacatttagga

SEQ ID NO: 7444922 - DNA, 22 bp, Homo sapiens
ctgggccagaagacatttagga

SEQ ID NO: 7444923 - DNA, 22 bp, Homo sapiens
ctgggccagaagacatttagga

SEQ ID NO: 7444924 - DNA, 19 bp, Homo sapiens
ctgggccagaatcagctca

SEQ ID NO: 7444925 - DNA, 19 bp, Homo sapiens
ctgggccagaatcagctca

SEQ ID NO: 7444926 - DNA, 19 bp, Homo sapiens
ctgggccagaatcagctca

SEQ ID NO: 7444927 - DNA, 22 bp, Homo sapiens
ctgggccactccagatgcccac

SEQ ID NO: 7444928 - DNA, 22 bp, Homo sapiens
ctgggccacttcctcaggggaa

SEQ ID NO: 7444929 - DNA, 22 bp, Homo sapiens
ctgggccactccagatgcccac

SEQ ID NO: 7444930 - DNA, 22 bp, Homo sapiens
ctgggccactccagatgcccac

SEQ ID NO: 7444931 - DNA, 22 bp, Homo sapiens
ctgggccactccagatgcccac

SEQ ID NO: 7444932 - DNA, 22 bp, Homo sapiens
ctgggccactccagatgcccac

SEQ ID NO: 7444933 - DNA, 22 bp, Homo sapiens
ctgggccactccagatgcccac

SEQ ID NO: 7444934 - DNA, 22 bp, Homo sapiens
ctgggccactccagatgcccac

SEQ ID NO: 7444935 - DNA, 22 bp, Homo sapiens
ctgggccactccagatgcccac

SEQ ID NO: 7444936 - DNA, 22 bp, Homo sapiens
ctgggccacatcagatgaagac

SEQ ID NO: 7444937 - DNA, 22 bp, Homo sapiens
ctgggccacatcagatgaagac

SEQ ID NO: 7444938 - DNA, 22 bp, Homo sapiens
ctgggccacatcagatgaagac

SEQ ID NO: 7444939 - DNA, 22 bp, Homo sapiens
ctgggccacatcagatgaagac

SEQ ID NO: 7444940 - DNA, 22 bp, Homo sapiens
ctgggccacatcagatgaagac

SEQ ID NO: 7444941 - DNA, 22 bp, Homo sapiens
ctgggccacatcagatgaagac

SEQ ID NO: 7444942 - DNA, 22 bp, Homo sapiens
ctgggccacatcagatgaagac

SEQ ID NO: 7444943 - DNA, 22 bp, Homo sapiens
ctgggccacagactcaaggcag

SEQ ID NO: 7444944 - DNA, 22 bp, Homo sapiens
ctgggccacagactcaaggcag

SEQ ID NO: 7444945 - DNA, 22 bp, Homo sapiens
ctgggccacagactcaaggcag

SEQ ID NO: 7444946 - DNA, 22 bp, Homo sapiens
ctgggccacagactcaaggcag

SEQ ID NO: 7444947 - DNA, 22 bp, Homo sapiens
ctgggccacagactcaaggcag

SEQ ID NO: 7444948 - DNA, 22 bp, Homo sapiens
ctgggccacaagcctgtgtgat

SEQ ID NO: 7444949 - DNA, 22 bp, Homo sapiens
ctgggccacaagcctgtgtgat

SEQ ID NO: 7444950 - DNA, 22 bp, Homo sapiens
ctgggccacaagcctgtgtgat

SEQ ID NO: 7444951 - DNA, 22 bp, Homo sapiens
ctgggccacaagcctgtgtgat

SEQ ID NO: 7444952 - DNA, 22 bp, Homo sapiens
ctgggccacaagcctgtgtgat

SEQ ID NO: 7444953 - DNA, 22 bp, Homo sapiens
ctgggccacaagcctgtgtgat

SEQ ID NO: 7444954 - DNA, 22 bp, Homo sapiens
ctgggccacaaaaaactcctgt

SEQ ID NO: 7444955 - DNA, 22 bp, Homo sapiens
ctgggccacaagcctgtgtgat

SEQ ID NO: 7444956 - DNA, 22 bp, Homo sapiens
ctgccagaaggttcctgctgca

SEQ ID NO: 7444957 - DNA, 22 bp, Homo sapiens
ctgccagacacgttatgctcat

SEQ ID NO: 7444958 - DNA, 22 bp, Homo sapiens
ctgccagagatctgggcagagt

SEQ ID NO: 7444959 - DNA, 22 bp, Homo sapiens
ctgccagagatctgggcagagt

SEQ ID NO: 7444960 - DNA, 22 bp, Homo sapiens
ctgccagagaaaagtggatctt

SEQ ID NO: 7444961 - DNA, 22 bp, Homo sapiens
ctgccagagatctgggcagagt

SEQ ID NO: 7444962 - DNA, 22 bp, Homo sapiens
ctgccagcaagctaccctggca

SEQ ID NO: 7444963 - DNA, 22 bp, Homo sapiens
ctgccagatcattggattcaca

SEQ ID NO: 7444964 - DNA, 22 bp, Homo sapiens
ctgccagatcattggattcaca

SEQ ID NO: 7444965 - DNA, 22 bp, Homo sapiens
ctgccagagatttggtgaacaa

SEQ ID NO: 7444966 - DNA, 22 bp, Homo sapiens
ctgccagagtacttgtaagaat

SEQ ID NO: 7444967 - DNA, 22 bp, Homo sapiens
ctgccagagtcacttgccacct

SEQ ID NO: 7444968 - DNA, 22 bp, Homo sapiens
ctgccagaaggttcctgctgca

SEQ ID NO: 7444969 - DNA, 22 bp, Homo sapiens
ctgccagaaggttcctgctgca

SEQ ID NO: 7444970 - DNA, 22 bp, Homo sapiens
ctgccagaaggttcctgctgca

SEQ ID NO: 7444971 - DNA, 22 bp, Homo sapiens
ctgccagaaggttcctgctgca

SEQ ID NO: 7444972 - DNA, 22 bp, Homo sapiens
ctgccagaagagaacaccagtt

SEQ ID NO: 7444973 - DNA, 22 bp, Homo sapiens
ctgccagaagagaacaccagtt

SEQ ID NO: 7444974 - DNA, 22 bp, Homo sapiens
ctgccagaagagaacaccagtt

SEQ ID NO: 7444975 - DNA, 22 bp, Homo sapiens
ctgccagaagagaacaccagtt

SEQ ID NO: 7444976 - DNA, 22 bp, Homo sapiens
ctgccagaagagaacaccagtt

SEQ ID NO: 7444977 - DNA, 22 bp, Homo sapiens
ctgccactttggagtgctcaga

SEQ ID NO: 7444978 - DNA, 22 bp, Homo sapiens
ctgccactttggagtgctcaga

SEQ ID NO: 7444979 - DNA, 22 bp, Homo sapiens
ctgccactttggagtgctcaga

SEQ ID NO: 7444980 - DNA, 22 bp, Homo sapiens
ctgccactttggagtgctcaga

SEQ ID NO: 7444981 - DNA, 21 bp, Homo sapiens
ctgccacctgctccatcagca

SEQ ID NO: 7444982 - DNA, 22 bp, Homo sapiens
ctgccactagctttcacatctt

SEQ ID NO: 7444983 - DNA, 21 bp, Homo sapiens
ctgccacctgctccatcagca

SEQ ID NO: 7444984 - DNA, 21 bp, Homo sapiens
ctgccacctgctccatcagca

SEQ ID NO: 7444985 - DNA, 21 bp, Homo sapiens
ctgccacctgctccatcagca

SEQ ID NO: 7444986 - DNA, 22 bp, Homo sapiens
ctgccactagctttcacatctt

SEQ ID NO: 7444987 - DNA, 22 bp, Homo sapiens
ctgccactagctttcacatctt

SEQ ID NO: 7444988 - DNA, 22 bp, Homo sapiens
ctgccactctgggtgggcctgg

SEQ ID NO: 7444989 - DNA, 22 bp, Homo sapiens
ctgccactctgggtgggcctgg

SEQ ID NO: 7444990 - DNA, 22 bp, Homo sapiens
ctgccactttcacccagtgctc

SEQ ID NO: 7444991 - DNA, 22 bp, Homo sapiens
ctgccacttactaggcatggtg

SEQ ID NO: 7444992 - DNA, 18 bp, Homo sapiens
ctgccacttaatgtggtg

SEQ ID NO: 7444993 - DNA, 22 bp, Homo sapiens
ctgccactttcacccagtgctc

SEQ ID NO: 7444994 - DNA, 22 bp, Homo sapiens
ctgccactttggagtgctcaga

SEQ ID NO: 7444995 - DNA, 22 bp, Homo sapiens
ctgccactttcacccagtgctc

SEQ ID NO: 7444996 - DNA, 22 bp, Homo sapiens
ctgcatccatgttgctgcaaag

SEQ ID NO: 7444997 - DNA, 22 bp, Homo sapiens
ctgcatccatgttgctgcaaag

SEQ ID NO: 7444998 - DNA, 22 bp, Homo sapiens
ctgcatccatgttgctgcaaag

SEQ ID NO: 7444999 - DNA, 22 bp, Homo sapiens
ctgccaagtaatgcctgggctc

SEQ ID NO: 7445000 - DNA, 22 bp, Homo sapiens
ctgcatcattttcagacaatgg

SEQ ID NO: 7445001 - DNA, 22 bp, Homo sapiens
ctgcatcattttcagacaatgg

SEQ ID NO: 7445002 - DNA, 22 bp, Homo sapiens
ctgcatcattttcagacaatgg

SEQ ID NO: 7445003 - DNA, 22 bp, Homo sapiens
ctgcatcattggtgattcagga

SEQ ID NO: 7445004 - DNA, 20 bp, Homo sapiens
ctgcatcatggttaagaaca

SEQ ID NO: 7445005 - DNA, 22 bp, Homo sapiens
ctgccacaggggagcaggcaga

SEQ ID NO: 7445006 - DNA, 22 bp, Homo sapiens
ctgccacaggggagcaggcaga

SEQ ID NO: 7445007 - DNA, 22 bp, Homo sapiens
ctgccacaggggagcaggcaga

SEQ ID NO: 7445008 - DNA, 22 bp, Homo sapiens
ctgccacaggggagcaggcaga

SEQ ID NO: 7445009 - DNA, 22 bp, Homo sapiens
ctgccaccaaatagctgcatga

SEQ ID NO: 7445010 - DNA, 22 bp, Homo sapiens
ctgccaccaaatagctgcatga

SEQ ID NO: 7445011 - DNA, 22 bp, Homo sapiens
ctgccacaggggagcaggcaga

SEQ ID NO: 7445012 - DNA, 22 bp, Homo sapiens
ctgccacaggggagcaggcaga

SEQ ID NO: 7445013 - DNA, 22 bp, Homo sapiens
ctgccacaggggagcaggcaga

SEQ ID NO: 7445014 - DNA, 22 bp, Homo sapiens
ctgccacaggggagcaggcaga

SEQ ID NO: 7445015 - DNA, 22 bp, Homo sapiens
ctgccacaagctggccctgtgt

SEQ ID NO: 7445016 - DNA, 22 bp, Homo sapiens
ctgccacaagctggccctgtgt

SEQ ID NO: 7445017 - DNA, 22 bp, Homo sapiens
ctgccaccatgccccagcagag

SEQ ID NO: 7445018 - DNA, 21 bp, Homo sapiens
ctgccacctgctccatcagca

SEQ ID NO: 7445019 - DNA, 21 bp, Homo sapiens
ctgccacctgctccatcagca

SEQ ID NO: 7445020 - DNA, 21 bp, Homo sapiens
ctgccacctgctccatcagca

SEQ ID NO: 7445021 - DNA, 22 bp, Homo sapiens
ctgccaccatgccccagcagag

SEQ ID NO: 7445022 - DNA, 22 bp, Homo sapiens
ctgccaccatgccccagcagag

SEQ ID NO: 7445023 - DNA, 22 bp, Homo sapiens
ctgccaccatgccccagcagag

SEQ ID NO: 7445024 - DNA, 22 bp, Homo sapiens
ctgccaccaaatagctgcatga

SEQ ID NO: 7445025 - DNA, 22 bp, Homo sapiens
ctgccaccaaatagctgcatga

SEQ ID NO: 7445026 - DNA, 22 bp, Homo sapiens
ctgccaccaaatagctgcatga

SEQ ID NO: 7445027 - DNA, 22 bp, Homo sapiens
ctgccaccatgccccagcagag

SEQ ID NO: 7445028 - DNA, 22 bp, Homo sapiens
ctgccaccatgccccagcagag

SEQ ID NO: 7445029 - DNA, 22 bp, Homo sapiens
ctgccaccatgccccagcagag

SEQ ID NO: 7445030 - DNA, 22 bp, Homo sapiens
ctgccaccatgccccagcagag

SEQ ID NO: 7445031 - DNA, 22 bp, Homo sapiens
ctggcagcatttttttcagaag

SEQ ID NO: 7445032 - DNA, 22 bp, Homo sapiens
ctggcagccaagtgggatactc

SEQ ID NO: 7445033 - DNA, 22 bp, Homo sapiens
ctgccagctcaccggctcagac

SEQ ID NO: 7445034 - DNA, 22 bp, Homo sapiens
ctgccagctcgccacaatgaca

SEQ ID NO: 7445035 - DNA, 22 bp, Homo sapiens
ctggcagcccaacctagagtct

SEQ ID NO: 7445036 - DNA, 22 bp, Homo sapiens
ctggcagcccaacctagagtct

SEQ ID NO: 7445037 - DNA, 22 bp, Homo sapiens
ctggcagcccaacctagagtct

SEQ ID NO: 7445038 - DNA, 22 bp, Homo sapiens
ctggcagccaagtgggatactc

SEQ ID NO: 7445039 - DNA, 22 bp, Homo sapiens
ctgccagctcaccggctcagac

SEQ ID NO: 7445040 - DNA, 22 bp, Homo sapiens
ctgccagctcaccggctcagac

SEQ ID NO: 7445041 - DNA, 22 bp, Homo sapiens
ctgccagctcaaagcgcagcta

SEQ ID NO: 7445042 - DNA, 22 bp, Homo sapiens
ctgccagctcaaagcgcagcta

SEQ ID NO: 7445043 - DNA, 22 bp, Homo sapiens
ctgccagctagctcctagttga

SEQ ID NO: 7445044 - DNA, 22 bp, Homo sapiens
ctgccagcactgcctcctgagg

SEQ ID NO: 7445045 - DNA, 22 bp, Homo sapiens
ctgccagcactgcctcctgagg

SEQ ID NO: 7445046 - DNA, 22 bp, Homo sapiens
ctgccagcagaggccagcgctg

SEQ ID NO: 7445047 - DNA, 22 bp, Homo sapiens
ctgccagcaagctaccctggca

SEQ ID NO: 7445048 - DNA, 22 bp, Homo sapiens
ctgccagcaatgtgaccatgct

SEQ ID NO: 7445049 - DNA, 22 bp, Homo sapiens
ctgccagcactgcctcctgagg

SEQ ID NO: 7445050 - DNA, 22 bp, Homo sapiens
ctgccagccaggccaggtaggc

SEQ ID NO: 7445051 - DNA, 22 bp, Homo sapiens
ctgccagcagaggccagcgctg

SEQ ID NO: 7445052 - DNA, 22 bp, Homo sapiens
ctgccagcagaggccagcgctg

SEQ ID NO: 7445053 - DNA, 22 bp, Homo sapiens
ctgccagcagaggccagcgctg

SEQ ID NO: 7445054 - DNA, 22 bp, Homo sapiens
ctgccagccaggccaggtaggc

SEQ ID NO: 7445055 - DNA, 22 bp, Homo sapiens
ctgccagctagctcctagttga

SEQ ID NO: 7445056 - DNA, 19 bp, Homo sapiens
ctggcagcctgtctgtgtc

SEQ ID NO: 7445057 - DNA, 19 bp, Homo sapiens
ctggcagcctgtctgtgtc

SEQ ID NO: 7445058 - DNA, 19 bp, Homo sapiens
ctggcagcctgtctgtgtc

SEQ ID NO: 7445059 - DNA, 19 bp, Homo sapiens
ctggcagcctgtctgtgtc

SEQ ID NO: 7445060 - DNA, 22 bp, Homo sapiens
ctggcagcccaacctagagtct

SEQ ID NO: 7445061 - DNA, 22 bp, Homo sapiens
ctggcagcccaacctagagtct

SEQ ID NO: 7445062 - DNA, 22 bp, Homo sapiens
ctggcagcccaacctagagtct

SEQ ID NO: 7445063 - DNA, 22 bp, Homo sapiens
ctggcaggaagaggaaaggtca

SEQ ID NO: 7445064 - DNA, 22 bp, Homo sapiens
ctggcaggaagaggaaaggtca

SEQ ID NO: 7445065 - DNA, 22 bp, Homo sapiens
ctggcagcttcctttgcatctg

SEQ ID NO: 7445066 - DNA, 22 bp, Homo sapiens
ctggcagcttcctttgcatctg

SEQ ID NO: 7445067 - DNA, 22 bp, Homo sapiens
ctggcagcttcctttgcatctg

SEQ ID NO: 7445068 - DNA, 22 bp, Homo sapiens
ctggcagcttcctttgcatctg

SEQ ID NO: 7445069 - DNA, 22 bp, Homo sapiens
ctggcagcttcaggacactcgg

SEQ ID NO: 7445070 - DNA, 22 bp, Homo sapiens
ctggcagcttcaggacactcgg

SEQ ID NO: 7445071 - DNA, 22 bp, Homo sapiens
ctggcagcttcaggacactcgg

SEQ ID NO: 7445072 - DNA, 22 bp, Homo sapiens
ctggcaggaagaggaaaggtca

SEQ ID NO: 7445073 - DNA, 22 bp, Homo sapiens
ctggcaggaagttagatggtaa

SEQ ID NO: 7445074 - DNA, 22 bp, Homo sapiens
ctggcaggaagttagatggtaa

SEQ ID NO: 7445075 - DNA, 22 bp, Homo sapiens
ctggcaggaagttagatggtaa

SEQ ID NO: 7445076 - DNA, 22 bp, Homo sapiens
ctggcaggaagaggaaaggtca

SEQ ID NO: 7445077 - DNA, 22 bp, Homo sapiens
ctggcaggaagaggaaaggtca

SEQ ID NO: 7445078 - DNA, 22 bp, Homo sapiens
ctggcaggaagaggaaaggtca

SEQ ID NO: 7445079 - DNA, 22 bp, Homo sapiens
ctggcaggagcattcacagagg

SEQ ID NO: 7445080 - DNA, 22 bp, Homo sapiens
ctggcaggagcattcacagagg

SEQ ID NO: 7445081 - DNA, 22 bp, Homo sapiens
ctggcaggagcattcacagagg

SEQ ID NO: 7445082 - DNA, 22 bp, Homo sapiens
ctggcaggaagttagatggtaa

SEQ ID NO: 7445083 - DNA, 22 bp, Homo sapiens
ctggcaggagcattcacagagg

SEQ ID NO: 7445084 - DNA, 22 bp, Homo sapiens
ctggcaggagcattcacagagg

SEQ ID NO: 7445085 - DNA, 22 bp, Homo sapiens
ctggcaggaagttagatggtaa

SEQ ID NO: 7445086 - DNA, 22 bp, Homo sapiens
ctggcaggaagttagatggtaa

SEQ ID NO: 7445087 - DNA, 22 bp, Homo sapiens
ctggcaggaagttagatggtaa

SEQ ID NO: 7445088 - DNA, 22 bp, Homo sapiens
ctggcaggaagttagatggtaa

SEQ ID NO: 7445089 - DNA, 22 bp, Homo sapiens
ctggccactgcacctcttcctt

SEQ ID NO: 7445090 - DNA, 22 bp, Homo sapiens
ctggccactgcacctcttcctt

SEQ ID NO: 7445091 - DNA, 22 bp, Homo sapiens
ctggccactgcacctcttcctt

SEQ ID NO: 7445092 - DNA, 22 bp, Homo sapiens
ctggccactgcacctcttcctt

SEQ ID NO: 7445093 - DNA, 22 bp, Homo sapiens
ctggccactgcgggcctctgcc

SEQ ID NO: 7445094 - DNA, 22 bp, Homo sapiens
ctggccactgcacctcttcctt

SEQ ID NO: 7445095 - DNA, 22 bp, Homo sapiens
ctggccagaggttcctctgccc

SEQ ID NO: 7445096 - DNA, 21 bp, Homo sapiens
ctggccactgcacctcttcct

SEQ ID NO: 7445097 - DNA, 22 bp, Homo sapiens
ctggccactgattcctcccctg

SEQ ID NO: 7445098 - DNA, 21 bp, Homo sapiens
ctggccactgcacctcttcct

SEQ ID NO: 7445099 - DNA, 21 bp, Homo sapiens
ctggccactgcacctcttcct

SEQ ID NO: 7445100 - DNA, 21 bp, Homo sapiens
ctggccactgcacctcttcct

SEQ ID NO: 7445101 - DNA, 21 bp, Homo sapiens
ctggccactgcacctcttcct

SEQ ID NO: 7445102 - DNA, 22 bp, Homo sapiens
ctggccagagttggagggtgtg

SEQ ID NO: 7445103 - DNA, 22 bp, Homo sapiens
ctggccagagttggagggtgtg

SEQ ID NO: 7445104 - DNA, 22 bp, Homo sapiens
ctggccagagttggagggtgtg

SEQ ID NO: 7445105 - DNA, 22 bp, Homo sapiens
ctggccagagttggagggtgtg

SEQ ID NO: 7445106 - DNA, 22 bp, Homo sapiens
ctggccagagttggagggtgtg

SEQ ID NO: 7445107 - DNA, 22 bp, Homo sapiens
ctggccagagttggagggtgtg

SEQ ID NO: 7445108 - DNA, 22 bp, Homo sapiens
ctggccagagttggagggtgtg

SEQ ID NO: 7445109 - DNA, 22 bp, Homo sapiens
ctggccagcatggctgaagtac

SEQ ID NO: 7445110 - DNA, 22 bp, Homo sapiens
ctggccagcatggctgaagtac

SEQ ID NO: 7445111 - DNA, 22 bp, Homo sapiens
ctggccagcatttttgctttag

SEQ ID NO: 7445112 - DNA, 22 bp, Homo sapiens
ctggccagcctcccaggtaccc

SEQ ID NO: 7445113 - DNA, 22 bp, Homo sapiens
ctggccagcctcccaggtaccc

SEQ ID NO: 7445114 - DNA, 22 bp, Homo sapiens
ctggccagcctcccaggtaccc

SEQ ID NO: 7445115 - DNA, 22 bp, Homo sapiens
ctggccagcatggctgaagtac

SEQ ID NO: 7445116 - DNA, 22 bp, Homo sapiens
ctggccagcatggctgaagtac

SEQ ID NO: 7445117 - DNA, 22 bp, Homo sapiens
ctggccagcatggctgaagtac

SEQ ID NO: 7445118 - DNA, 22 bp, Homo sapiens
ctggccagcatggctgaagtac

SEQ ID NO: 7445119 - DNA, 22 bp, Homo sapiens
ctggccagcatggctgaagtac

SEQ ID NO: 7445120 - DNA, 22 bp, Homo sapiens
ctggccagcatggctgaagtac

SEQ ID NO: 7445121 - DNA, 22 bp, Homo sapiens
ctggccagatgttacgtccaat

SEQ ID NO: 7445122 - DNA, 22 bp, Homo sapiens
ctggccagatgttacgtccaat

SEQ ID NO: 7445123 - DNA, 22 bp, Homo sapiens
ctggccagatgttacgtccaat

SEQ ID NO: 7445124 - DNA, 22 bp, Homo sapiens
ctggccagatgttacgtccaat

SEQ ID NO: 7445125 - DNA, 22 bp, Homo sapiens
ctggccagatgttacgtccaat

SEQ ID NO: 7445126 - DNA, 22 bp, Homo sapiens
ctggccagatgttacgtccaat

SEQ ID NO: 7445127 - DNA, 22 bp, Homo sapiens
ctggccaggaggtaaccagatg

SEQ ID NO: 7445128 - DNA, 22 bp, Homo sapiens
ctggccaggaggtaaccagatg

SEQ ID NO: 7445129 - DNA, 22 bp, Homo sapiens
ctggccaggaggtaaccagatg

SEQ ID NO: 7445130 - DNA, 22 bp, Homo sapiens
ctggccaggcatcccctgatcc

SEQ ID NO: 7445131 - DNA, 22 bp, Homo sapiens
ctggccaggcatcccctgatcc

SEQ ID NO: 7445132 - DNA, 22 bp, Homo sapiens
ctggccaggcatcccctgatcc

SEQ ID NO: 7445133 - DNA, 22 bp, Homo sapiens
ctggccaggcatcccctgatcc

SEQ ID NO: 7445134 - DNA, 22 bp, Homo sapiens
ctggccaggaggtaaccagatg

SEQ ID NO: 7445135 - DNA, 22 bp, Homo sapiens
ctggccagctgacagcagggct

SEQ ID NO: 7445136 - DNA, 22 bp, Homo sapiens
ctggccagctgacagcagggct

SEQ ID NO: 7445137 - DNA, 22 bp, Homo sapiens
ctggccagctgacagcagggct

SEQ ID NO: 7445138 - DNA, 22 bp, Homo sapiens
ctggccagctgacagcagggct

SEQ ID NO: 7445139 - DNA, 22 bp, Homo sapiens
ctggccagctgacagcagggct

SEQ ID NO: 7445140 - DNA, 22 bp, Homo sapiens
ctggccagctgacagcagggct

SEQ ID NO: 7445141 - DNA, 22 bp, Homo sapiens
ctggccagctgacagcagggct

SEQ ID NO: 7445142 - DNA, 22 bp, Homo sapiens
ctggccagctgacagcagggct

SEQ ID NO: 7445143 - DNA, 22 bp, Homo sapiens
ctggccagctgacagcagggct

SEQ ID NO: 7445144 - DNA, 22 bp, Homo sapiens
ctggccagcctgtcgatgccct

SEQ ID NO: 7445145 - DNA, 22 bp, Homo sapiens
ctggccagcctgtcgatgccct

SEQ ID NO: 7445146 - DNA, 22 bp, Homo sapiens
ctggccagcctgtcgatgccct

SEQ ID NO: 7445147 - DNA, 22 bp, Homo sapiens
ctggccagcctgtcgatgccct

SEQ ID NO: 7445148 - DNA, 22 bp, Homo sapiens
ctggccagcctgtcgatgccct

SEQ ID NO: 7445149 - DNA, 22 bp, Homo sapiens
ctggccagcctcccaggtaccc

SEQ ID NO: 7445150 - DNA, 22 bp, Homo sapiens
ctggccagcctcccaggtaccc

SEQ ID NO: 7445151 - DNA, 22 bp, Homo sapiens
ctggccagcctcccaggtaccc

SEQ ID NO: 7445152 - DNA, 22 bp, Homo sapiens
ctggccagcctcccaggtaccc

SEQ ID NO: 7445153 - DNA, 22 bp, Homo sapiens
ctggccagcctcccaggtaccc

SEQ ID NO: 7445154 - DNA, 22 bp, Homo sapiens
ctggccagcctcccaggtaccc

SEQ ID NO: 7445155 - DNA, 22 bp, Homo sapiens
ctggccagcctgtcgatgccct

SEQ ID NO: 7445156 - DNA, 22 bp, Homo sapiens
ctggccagcctgtcgatgccct

SEQ ID NO: 7445157 - DNA, 22 bp, Homo sapiens
ctggccagctgacagcagggct

SEQ ID NO: 7445158 - DNA, 22 bp, Homo sapiens
ctggccagcctgtcgatgccct

SEQ ID NO: 7445159 - DNA, 22 bp, Homo sapiens
ctggccagcctgtcgatgccct

SEQ ID NO: 7445160 - DNA, 22 bp, Homo sapiens
ctggccagcctgtcgatgccct

SEQ ID NO: 7445161 - DNA, 22 bp, Homo sapiens
ctggcaggcggcagagcccagg

SEQ ID NO: 7445162 - DNA, 22 bp, Homo sapiens
ctggcaggcggcagagcccagg

SEQ ID NO: 7445163 - DNA, 22 bp, Homo sapiens
ctggcaggcggcagagcccagg

SEQ ID NO: 7445164 - DNA, 22 bp, Homo sapiens
ctggcaggcggcagagcccagg

SEQ ID NO: 7445165 - DNA, 22 bp, Homo sapiens
ctggcaggcggcagagcccagg

SEQ ID NO: 7445166 - DNA, 22 bp, Homo sapiens
ctggcaggcggcagagcccagg

SEQ ID NO: 7445167 - DNA, 22 bp, Homo sapiens
ctggcaggcggaggttgcagtg

SEQ ID NO: 7445168 - DNA, 22 bp, Homo sapiens
ctggcaggcggaggttgcagtg

SEQ ID NO: 7445169 - DNA, 22 bp, Homo sapiens
ctggcaggcggaggttgcagtg

SEQ ID NO: 7445170 - DNA, 22 bp, Homo sapiens
ctggcaggcggaggttgcagtg

SEQ ID NO: 7445171 - DNA, 22 bp, Homo sapiens
ctggcaggcggaggttgcagtg

SEQ ID NO: 7445172 - DNA, 22 bp, Homo sapiens
ctggcaggcggaggttgcagtg

SEQ ID NO: 7445173 - DNA, 22 bp, Homo sapiens
ctggcaggcggaggttgcagtg

SEQ ID NO: 7445174 - DNA, 22 bp, Homo sapiens
ctggcaggcggaggttgcagtg

SEQ ID NO: 7445175 - DNA, 22 bp, Homo sapiens
ctggcaggcggaggttgcagtg

SEQ ID NO: 7445176 - DNA, 22 bp, Homo sapiens
ctggcaggcggaggttgcagtg

SEQ ID NO: 7445177 - DNA, 22 bp, Homo sapiens
ctggcaggcggaggttgcagtg

SEQ ID NO: 7445178 - DNA, 22 bp, Homo sapiens
ctggcaggcggaggttgcagtg

SEQ ID NO: 7445179 - DNA, 22 bp, Homo sapiens
ctggcaggcagacttctgcaag

SEQ ID NO: 7445180 - DNA, 22 bp, Homo sapiens
ctggcaggctctctggtcggtt

SEQ ID NO: 7445181 - DNA, 22 bp, Homo sapiens
ctggcaggctctctggtcggtt

SEQ ID NO: 7445182 - DNA, 22 bp, Homo sapiens
ctggcaggctctctggtcggtt

SEQ ID NO: 7445183 - DNA, 22 bp, Homo sapiens
ctggcaggctctctggtcggtt

SEQ ID NO: 7445184 - DNA, 22 bp, Homo sapiens
ctggcaggctctctggtcggtt

SEQ ID NO: 7445185 - DNA, 22 bp, Homo sapiens
ctggcaggctctctggtcggtt

SEQ ID NO: 7445186 - DNA, 22 bp, Homo sapiens
ctggcaggctctctggtcggtt

SEQ ID NO: 7445187 - DNA, 22 bp, Homo sapiens
ctggcaggcggcagagcccagg

SEQ ID NO: 7445188 - DNA, 22 bp, Homo sapiens
ctggcaggctctctggtcggtt

SEQ ID NO: 7445189 - DNA, 22 bp, Homo sapiens
ctggccactgattcctcccctg

SEQ ID NO: 7445190 - DNA, 22 bp, Homo sapiens
ctggccacccatgcctccctga

SEQ ID NO: 7445191 - DNA, 22 bp, Homo sapiens
ctggccactgattcctcccctg

SEQ ID NO: 7445192 - DNA, 22 bp, Homo sapiens
ctggccacccatgcctccctga

SEQ ID NO: 7445193 - DNA, 22 bp, Homo sapiens
ctggccactgattcctcccctg

SEQ ID NO: 7445194 - DNA, 22 bp, Homo sapiens
ctggccactgattcctcccctg

SEQ ID NO: 7445195 - DNA, 22 bp, Homo sapiens
ctggcagggcaggggtttgtgc

SEQ ID NO: 7445196 - DNA, 22 bp, Homo sapiens
ctggcagggcaggggtttgtgc

SEQ ID NO: 7445197 - DNA, 22 bp, Homo sapiens
ctggcagggctctttgggtgct

SEQ ID NO: 7445198 - DNA, 22 bp, Homo sapiens
ctggccacccatgcctccctga

SEQ ID NO: 7445199 - DNA, 22 bp, Homo sapiens
ctggcaggagctgtggccgtag

SEQ ID NO: 7445200 - DNA, 22 bp, Homo sapiens
ctggcaggagctgtggccgtag

SEQ ID NO: 7445201 - DNA, 22 bp, Homo sapiens
ctggcaggagctgtggccgtag

SEQ ID NO: 7445202 - DNA, 22 bp, Homo sapiens
ctggcaggagctgtggccgtag

SEQ ID NO: 7445203 - DNA, 22 bp, Homo sapiens
ctggcaggagctgtggccgtag

SEQ ID NO: 7445204 - DNA, 22 bp, Homo sapiens
ctggcaggatctaaccagggaa

SEQ ID NO: 7445205 - DNA, 22 bp, Homo sapiens
ctggcaggatctaaccagggaa

SEQ ID NO: 7445206 - DNA, 22 bp, Homo sapiens
ctggcaggagttgggattttga

SEQ ID NO: 7445207 - DNA, 22 bp, Homo sapiens
ctggcaggatctaaccagggaa

SEQ ID NO: 7445208 - DNA, 20 bp, Homo sapiens
ctggcaggagcgagtctacc

SEQ ID NO: 7445209 - DNA, 20 bp, Homo sapiens
ctggcaggagcgagtctacc

SEQ ID NO: 7445210 - DNA, 20 bp, Homo sapiens
ctggcaggagcgagtctacc

SEQ ID NO: 7445211 - DNA, 20 bp, Homo sapiens
ctggcaggagcgagtctacc

SEQ ID NO: 7445212 - DNA, 20 bp, Homo sapiens
ctggcaggagcgagtctacc

SEQ ID NO: 7445213 - DNA, 22 bp, Homo sapiens
ctggcaggagcattcacagagg

SEQ ID NO: 7445214 - DNA, 22 bp, Homo sapiens
ctggcaggagcattcacagagg

SEQ ID NO: 7445215 - DNA, 22 bp, Homo sapiens
ctggcaggcaaattggtgggag

SEQ ID NO: 7445216 - DNA, 22 bp, Homo sapiens
ctggcaggcaaattggtgggag

SEQ ID NO: 7445217 - DNA, 22 bp, Homo sapiens
ctggcaggcaaattggtgggag

SEQ ID NO: 7445218 - DNA, 22 bp, Homo sapiens
ctggcaggcaaattggtgggag

SEQ ID NO: 7445219 - DNA, 22 bp, Homo sapiens
ctggcaggcaaattggtgggag

SEQ ID NO: 7445220 - DNA, 22 bp, Homo sapiens
ctggcaggcaaattggtgggag

SEQ ID NO: 7445221 - DNA, 22 bp, Homo sapiens
ctggcaggatctaaccagggaa

SEQ ID NO: 7445222 - DNA, 22 bp, Homo sapiens
ctggcaggatctaaccagggaa

SEQ ID NO: 7445223 - DNA, 22 bp, Homo sapiens
ctggcaggatctaaccagggaa

SEQ ID NO: 7445224 - DNA, 22 bp, Homo sapiens
ctggcaggcagacttctgcaag

SEQ ID NO: 7445225 - DNA, 22 bp, Homo sapiens
ctggcaggcagacttctgcaag

SEQ ID NO: 7445226 - DNA, 22 bp, Homo sapiens
ctggcaggcactcatgaaataa

SEQ ID NO: 7445227 - DNA, 22 bp, Homo sapiens
ctggcaggcactcatgaaataa

SEQ ID NO: 7445228 - DNA, 22 bp, Homo sapiens
ctggcaggcaaattggtgggag

SEQ ID NO: 7445229 - DNA, 22 bp, Homo sapiens
ctggcaggcaaattggtgggag

SEQ ID NO: 7445230 - DNA, 22 bp, Homo sapiens
ctggcaggcaaattggtgggag

SEQ ID NO: 7445231 - DNA, 22 bp, Homo sapiens
ctggcaggcaaattggtgggag

SEQ ID NO: 7445232 - DNA, 22 bp, Homo sapiens
ctggccctgcctaatgtacttg

SEQ ID NO: 7445233 - DNA, 22 bp, Homo sapiens
ctggccctgcctaatgtacttg

SEQ ID NO: 7445234 - DNA, 22 bp, Homo sapiens
ctggccctgcctaatgtacttg

SEQ ID NO: 7445235 - DNA, 22 bp, Homo sapiens
ctggccctgctccgcgccgcgg

SEQ ID NO: 7445236 - DNA, 22 bp, Homo sapiens
ctggccctgctccgcgccgcgg

SEQ ID NO: 7445237 - DNA, 22 bp, Homo sapiens
ctggccctgctccgcgccgcgg

SEQ ID NO: 7445238 - DNA, 22 bp, Homo sapiens
ctggccctgccagagatcaaca

SEQ ID NO: 7445239 - DNA, 22 bp, Homo sapiens
ctggccctcgtcagtttcactg

SEQ ID NO: 7445240 - DNA, 22 bp, Homo sapiens
ctggccctcgtcagtttcactg

SEQ ID NO: 7445241 - DNA, 22 bp, Homo sapiens
ctggccctgccagagatcaaca

SEQ ID NO: 7445242 - DNA, 22 bp, Homo sapiens
ctggccctgcctaatgtacttg

SEQ ID NO: 7445243 - DNA, 22 bp, Homo sapiens
ctggccctgcctaatgtacttg

SEQ ID NO: 7445244 - DNA, 22 bp, Homo sapiens
ctggccctggagggctgtgcga

SEQ ID NO: 7445245 - DNA, 22 bp, Homo sapiens
ctggccctggagggctgtgcga

SEQ ID NO: 7445246 - DNA, 22 bp, Homo sapiens
ctggccctggagggctgtgcga

SEQ ID NO: 7445247 - DNA, 22 bp, Homo sapiens
ctggccctggagggctgtgcga

SEQ ID NO: 7445248 - DNA, 22 bp, Homo sapiens
ctggccctggagggctgtgcga

SEQ ID NO: 7445249 - DNA, 16 bp, Homo sapiens
ctggccctggctctgg

SEQ ID NO: 7445250 - DNA, 22 bp, Homo sapiens
ctggccctggagggctgtgcga

SEQ ID NO: 7445251 - DNA, 22 bp, Homo sapiens
ctggccctggagggctgtgcga

SEQ ID NO: 7445252 - DNA, 22 bp, Homo sapiens
ctggccctggagggctgtgcga

SEQ ID NO: 7445253 - DNA, 22 bp, Homo sapiens
ctggccctcgtcagtttcactg

SEQ ID NO: 7445254 - DNA, 22 bp, Homo sapiens
ctggccctcggagtccagctgc

SEQ ID NO: 7445255 - DNA, 22 bp, Homo sapiens
ctggccctcggagtccagctgc

SEQ ID NO: 7445256 - DNA, 22 bp, Homo sapiens
ctggccctcggagtccagctgc

SEQ ID NO: 7445257 - DNA, 22 bp, Homo sapiens
ctggccctcgtcagtttcactg

SEQ ID NO: 7445258 - DNA, 22 bp, Homo sapiens
ctggccctcgtcagtttcactg

SEQ ID NO: 7445259 - DNA, 22 bp, Homo sapiens
ctggccctcggagtccagctgc

SEQ ID NO: 7445260 - DNA, 22 bp, Homo sapiens
ctggccctcggagtccagctgc

SEQ ID NO: 7445261 - DNA, 22 bp, Homo sapiens
ctggccctcggagtccagctgc

SEQ ID NO: 7445262 - DNA, 22 bp, Homo sapiens
ctggccctcggagtccagctgc

SEQ ID NO: 7445263 - DNA, 22 bp, Homo sapiens
ctggccctcggagtccagctgc

SEQ ID NO: 7445264 - DNA, 22 bp, Homo sapiens
ctggccctcggagtccagctgc

SEQ ID NO: 7445265 - DNA, 22 bp, Homo sapiens
ctggccctcggagtccagctgc

SEQ ID NO: 7445266 - DNA, 22 bp, Homo sapiens
ctggccctcggagtccagctgc

SEQ ID NO: 7445267 - DNA, 22 bp, Homo sapiens
ctggccctcagactcatgggca

SEQ ID NO: 7445268 - DNA, 22 bp, Homo sapiens
ctggccctattccaggccttcc

SEQ ID NO: 7445269 - DNA, 22 bp, Homo sapiens
ctggccctcagactcatgggca

SEQ ID NO: 7445270 - DNA, 22 bp, Homo sapiens
ctggcccagtctcagagtgtca

SEQ ID NO: 7445271 - DNA, 22 bp, Homo sapiens
ctggcccagtctcagagtgtca

SEQ ID NO: 7445272 - DNA, 22 bp, Homo sapiens
ctggcccagtctcagagtgtca

SEQ ID NO: 7445273 - DNA, 22 bp, Homo sapiens
ctggcccagtctcagagtgtca

SEQ ID NO: 7445274 - DNA, 22 bp, Homo sapiens
ctggccaggccccttgcagggc

SEQ ID NO: 7445275 - DNA, 22 bp, Homo sapiens
ctggcccaggtggtcgttgagg

SEQ ID NO: 7445276 - DNA, 22 bp, Homo sapiens
ctggccaggccccttgcagggc

SEQ ID NO: 7445277 - DNA, 22 bp, Homo sapiens
ctggccaggccccttgcagggc

SEQ ID NO: 7445278 - DNA, 22 bp, Homo sapiens
ctggccctatgagcctcctgat

SEQ ID NO: 7445279 - DNA, 22 bp, Homo sapiens
ctggccctatgagcctcctgat

SEQ ID NO: 7445280 - DNA, 22 bp, Homo sapiens
ctggcccagtctcagagtgtca

SEQ ID NO: 7445281 - DNA, 22 bp, Homo sapiens
ctggccctattccaggccttcc

SEQ ID NO: 7445282 - DNA, 22 bp, Homo sapiens
ctggccctattccaggccttcc

SEQ ID NO: 7445283 - DNA, 22 bp, Homo sapiens
ctggccctattccaggccttcc

SEQ ID NO: 7445284 - DNA, 22 bp, Homo sapiens
ctggccctattccaggccttcc

SEQ ID NO: 7445285 - DNA, 22 bp, Homo sapiens
ctggccctattccaggccttcc

SEQ ID NO: 7445286 - DNA, 19 bp, Homo sapiens
ctggccaggccaggggccc

SEQ ID NO: 7445287 - DNA, 22 bp, Homo sapiens
ctggccaggccccttgcagggc

SEQ ID NO: 7445288 - DNA, 22 bp, Homo sapiens
ctggccaggccccttgcagggc

SEQ ID NO: 7445289 - DNA, 22 bp, Homo sapiens
ctggccaggccccttgcagggc

SEQ ID NO: 7445290 - DNA, 22 bp, Homo sapiens
ctggccaggccccttgcagggc

SEQ ID NO: 7445291 - DNA, 22 bp, Homo sapiens
ctggccaggccccttgcagggc

SEQ ID NO: 7445292 - DNA, 19 bp, Homo sapiens
ctggccaggccaggggccc

SEQ ID NO: 7445293 - DNA, 19 bp, Homo sapiens
ctggccaggccaggggccc

SEQ ID NO: 7445294 - DNA, 19 bp, Homo sapiens
ctggccaggccaggggccc

SEQ ID NO: 7445295 - DNA, 19 bp, Homo sapiens
ctggccaggccaggggccc

SEQ ID NO: 7445296 - DNA, 19 bp, Homo sapiens
ctggccaggccaggggccc

SEQ ID NO: 7445297 - DNA, 19 bp, Homo sapiens
ctggccaggccaggggccc

SEQ ID NO: 7445298 - DNA, 19 bp, Homo sapiens
ctggccaggccaggggccc

SEQ ID NO: 7445299 - DNA, 19 bp, Homo sapiens
ctggccaggccaggggccc

SEQ ID NO: 7445300 - DNA, 19 bp, Homo sapiens
ctggccaggccaggggccc

SEQ ID NO: 7445301 - DNA, 22 bp, Homo sapiens
ctggccaggcatcccctgatcc

SEQ ID NO: 7445302 - DNA, 22 bp, Homo sapiens
ctggccaggcatcccctgatcc

SEQ ID NO: 7445303 - DNA, 22 bp, Homo sapiens
ctggccaggcatcccctgatcc

SEQ ID NO: 7445304 - DNA, 22 bp, Homo sapiens
ctggccaggcatcccctgatcc

SEQ ID NO: 7445305 - DNA, 23 bp, Homo sapiens
ctggccctggctctgtgatcatg

SEQ ID NO: 7445306 - DNA, 23 bp, Homo sapiens
ctggccctggctctgtgatcatg

SEQ ID NO: 7445307 - DNA, 23 bp, Homo sapiens
ctggccctggctctgtgatcatg

SEQ ID NO: 7445308 - DNA, 23 bp, Homo sapiens
ctggccctggctctgtgatcatg

SEQ ID NO: 7445309 - DNA, 22 bp, Homo sapiens
ctggccctggctggagcccagg

SEQ ID NO: 7445310 - DNA, 22 bp, Homo sapiens
ctggccctggctggagcccagg

SEQ ID NO: 7445311 - DNA, 23 bp, Homo sapiens
ctggccctggctctgtgatcatg

SEQ ID NO: 7445312 - DNA, 16 bp, Homo sapiens
ctggccctggctctgg

SEQ ID NO: 7445313 - DNA, 16 bp, Homo sapiens
ctggccctggctctgg

SEQ ID NO: 7445314 - DNA, 23 bp, Homo sapiens
ctggccctggctctgtgatcatg

SEQ ID NO: 7445315 - DNA, 22 bp, Homo sapiens
ctggccctggctggagcccagg

SEQ ID NO: 7445316 - DNA, 22 bp, Homo sapiens
ctggccctggctggagcccagg

SEQ ID NO: 7445317 - DNA, 22 bp, Homo sapiens
ctggccctggctggagcccagg

SEQ ID NO: 7445318 - DNA, 22 bp, Homo sapiens
ctggccctggctggagcccagg

SEQ ID NO: 7445319 - DNA, 22 bp, Homo sapiens
ctggccctggtaaggacaccca

SEQ ID NO: 7445320 - DNA, 22 bp, Homo sapiens
ctggccctggtaaggacaccca

SEQ ID NO: 7445321 - DNA, 22 bp, Homo sapiens
ctggccctggtaaggacaccca

SEQ ID NO: 7445322 - DNA, 22 bp, Homo sapiens
ctggccctggtaaggacaccca

SEQ ID NO: 7445323 - DNA, 22 bp, Homo sapiens
ctggccctgtggaggcaggaac

SEQ ID NO: 7445324 - DNA, 22 bp, Homo sapiens
ctggccctgtggaggcaggaac

SEQ ID NO: 7445325 - DNA, 22 bp, Homo sapiens
ctggccctgtggaggcaggaac

SEQ ID NO: 7445326 - DNA, 22 bp, Homo sapiens
ctggccctgtcagcacagaatc

SEQ ID NO: 7445327 - DNA, 22 bp, Homo sapiens
ctggccctgtcagcacagaatc

SEQ ID NO: 7445328 - DNA, 22 bp, Homo sapiens
ctggccctgtcagcacagaatc

SEQ ID NO: 7445329 - DNA, 22 bp, Homo sapiens
ctggccctgtaggatgtgagtt

SEQ ID NO: 7445330 - DNA, 22 bp, Homo sapiens
ctggccctgtaggatgtgagtt

SEQ ID NO: 7445331 - DNA, 22 bp, Homo sapiens
ctggccctgtaggatgtgagtt

SEQ ID NO: 7445332 - DNA, 22 bp, Homo sapiens
ctggcctgtcctgacccagcct

SEQ ID NO: 7445333 - DNA, 22 bp, Homo sapiens
ctggcctggtctggcctctcca

SEQ ID NO: 7445334 - DNA, 22 bp, Homo sapiens
ctggccctgtaggatgtgagtt

SEQ ID NO: 7445335 - DNA, 22 bp, Homo sapiens
ctggccctgtggaggcaggaac

SEQ ID NO: 7445336 - DNA, 22 bp, Homo sapiens
ctggccctgtggaggcaggaac

SEQ ID NO: 7445337 - DNA, 22 bp, Homo sapiens
ctggcctggtctggcctctcca

SEQ ID NO: 7445338 - DNA, 22 bp, Homo sapiens
ctggcctggtctggcctctcca

SEQ ID NO: 7445339 - DNA, 22 bp, Homo sapiens
ctggctcagacagctgtgcagt

SEQ ID NO: 7445340 - DNA, 22 bp, Homo sapiens
ctggctcagacagctgtgcagt

SEQ ID NO: 7445341 - DNA, 22 bp, Homo sapiens
ctggctcagacagctgtgcagt

SEQ ID NO: 7445342 - DNA, 22 bp, Homo sapiens
ctggctcagacagctgtgcagt

SEQ ID NO: 7445343 - DNA, 22 bp, Homo sapiens
ctggctcagacagctgtgcagt

SEQ ID NO: 7445344 - DNA, 22 bp, Homo sapiens
ctggctcagacagctgtgcagt

SEQ ID NO: 7445345 - DNA, 22 bp, Homo sapiens
ctggctcactagccctgccctg

SEQ ID NO: 7445346 - DNA, 22 bp, Homo sapiens
ctggctcactagccctgccctg

SEQ ID NO: 7445347 - DNA, 22 bp, Homo sapiens
ctggctcactagccctgccctg

SEQ ID NO: 7445348 - DNA, 22 bp, Homo sapiens
ctggctcactagccctgccctg

SEQ ID NO: 7445349 - DNA, 22 bp, Homo sapiens
ctggctcactagccctgccctg

SEQ ID NO: 7445350 - DNA, 22 bp, Homo sapiens
ctggctcaggaaagttgctgct

SEQ ID NO: 7445351 - DNA, 22 bp, Homo sapiens
ctggctcaggaaagttgctgct

SEQ ID NO: 7445352 - DNA, 22 bp, Homo sapiens
ctggctcaggaaagttgctgct

SEQ ID NO: 7445353 - DNA, 22 bp, Homo sapiens
ctggctcagacagctgtgcagt

SEQ ID NO: 7445354 - DNA, 22 bp, Homo sapiens
ctggctcagggtggtctgggtc

SEQ ID NO: 7445355 - DNA, 22 bp, Homo sapiens
ctggctcagggtggtctgggtc

SEQ ID NO: 7445356 - DNA, 22 bp, Homo sapiens
ctggctcagggtggtctgggtc

SEQ ID NO: 7445357 - DNA, 22 bp, Homo sapiens
ctggctcaggaaagttgctgct

SEQ ID NO: 7445358 - DNA, 22 bp, Homo sapiens
ctggctcaggaaagttgctgct

SEQ ID NO: 7445359 - DNA, 22 bp, Homo sapiens
ctggctcacctccgctccagca

SEQ ID NO: 7445360 - DNA, 22 bp, Homo sapiens
ctggctcacctccgctccagca

SEQ ID NO: 7445361 - DNA, 22 bp, Homo sapiens
ctggctcacctccgctccagca

SEQ ID NO: 7445362 - DNA, 22 bp, Homo sapiens
ctggctcacctccgctccagca

SEQ ID NO: 7445363 - DNA, 22 bp, Homo sapiens
ctggctcactagccctgccctg

SEQ ID NO: 7445364 - DNA, 22 bp, Homo sapiens
ctggctcactagccctgccctg

SEQ ID NO: 7445365 - DNA, 22 bp, Homo sapiens
ctggctcactagccctgccctg

SEQ ID NO: 7445366 - DNA, 22 bp, Homo sapiens
ctggcctgtgggctgtctccgg

SEQ ID NO: 7445367 - DNA, 22 bp, Homo sapiens
ctggcctgtgggctgtctccgg

SEQ ID NO: 7445368 - DNA, 22 bp, Homo sapiens
ctggcctgtgggctgtctccgg

SEQ ID NO: 7445369 - DNA, 22 bp, Homo sapiens
ctggcctgtgggctgtctccgg

SEQ ID NO: 7445370 - DNA, 22 bp, Homo sapiens
ctggcctgtgggctgtctccgg

SEQ ID NO: 7445371 - DNA, 22 bp, Homo sapiens
ctggcctgtgggctgtctccgg

SEQ ID NO: 7445372 - DNA, 22 bp, Homo sapiens
ctggcctgtcctgacccagcct

SEQ ID NO: 7445373 - DNA, 22 bp, Homo sapiens
ctggcctgtcctgacccagcct

SEQ ID NO: 7445374 - DNA, 22 bp, Homo sapiens
ctggcctgtcctgacccagcct

SEQ ID NO: 7445375 - DNA, 22 bp, Homo sapiens
ctggcctgtcctgacccagcct

SEQ ID NO: 7445376 - DNA, 22 bp, Homo sapiens
ctggcctgtcctgacccagcct

SEQ ID NO: 7445377 - DNA, 22 bp, Homo sapiens
ctggcctgtgggctgtctccgg

SEQ ID NO: 7445378 - DNA, 22 bp, Homo sapiens
ctggcctgtcctgacccagcct

SEQ ID NO: 7445379 - DNA, 22 bp, Homo sapiens
ctggcctgtcctgacccagcct

SEQ ID NO: 7445380 - DNA, 22 bp, Homo sapiens
ctggctcatgtgatgagggcaa

SEQ ID NO: 7445381 - DNA, 22 bp, Homo sapiens
ctggctcatgtgatgagggcaa

SEQ ID NO: 7445382 - DNA, 22 bp, Homo sapiens
ctggctcatgtgatgagggcaa

SEQ ID NO: 7445383 - DNA, 22 bp, Homo sapiens
ctggctcattttagcatcaggt

SEQ ID NO: 7445384 - DNA, 22 bp, Homo sapiens
ctggctcatgtgatgagggcaa

SEQ ID NO: 7445385 - DNA, 22 bp, Homo sapiens
ctggctcatgtgatgagggcaa

SEQ ID NO: 7445386 - DNA, 22 bp, Homo sapiens
ctggctcattttagcatcaggt

SEQ ID NO: 7445387 - DNA, 22 bp, Homo sapiens
ctggctcattttagcatcaggt

SEQ ID NO: 7445388 - DNA, 22 bp, Homo sapiens
ctggctcattttagcatcaggt

SEQ ID NO: 7445389 - DNA, 22 bp, Homo sapiens
ctggctcatgtgatgagggcaa

SEQ ID NO: 7445390 - DNA, 23 bp, Homo sapiens
ctggctcatcctggttgcagtgg

SEQ ID NO: 7445391 - DNA, 23 bp, Homo sapiens
ctggctcatcctggttgcagtgg

SEQ ID NO: 7445392 - DNA, 23 bp, Homo sapiens
ctggctcatcctggttgcagtgg

SEQ ID NO: 7445393 - DNA, 22 bp, Homo sapiens
ctggctcatccaggtgttgctc

SEQ ID NO: 7445394 - DNA, 22 bp, Homo sapiens
ctggctcatccaggtgttgctc

SEQ ID NO: 7445395 - DNA, 22 bp, Homo sapiens
ctggctcatccaggtgttgctc

SEQ ID NO: 7445396 - DNA, 23 bp, Homo sapiens
ctggctcatcctggttgcagtgg

SEQ ID NO: 7445397 - DNA, 22 bp, Homo sapiens
ctggctcatgtgatgagggcaa

SEQ ID NO: 7445398 - DNA, 23 bp, Homo sapiens
ctggctcatcctggttgcagtgg

SEQ ID NO: 7445399 - DNA, 22 bp, Homo sapiens
ctggctcatagagcagctccaa

SEQ ID NO: 7445400 - DNA, 22 bp, Homo sapiens
ctggctcatagagcagctccaa

SEQ ID NO: 7445401 - DNA, 22 bp, Homo sapiens
ctggctcatagagcagctccaa

SEQ ID NO: 7445402 - DNA, 22 bp, Homo sapiens
ctggctcatagagcagctccaa

SEQ ID NO: 7445403 - DNA, 22 bp, Homo sapiens
ctggctcatccaggtgttgctc

SEQ ID NO: 7445404 - DNA, 22 bp, Homo sapiens
ctggctcatccaggtgttgctc

SEQ ID NO: 7445405 - DNA, 22 bp, Homo sapiens
ctggctcatagagcagctccaa

SEQ ID NO: 7445406 - DNA, 22 bp, Homo sapiens
ctggctcagtgccttcagaagt

SEQ ID NO: 7445407 - DNA, 22 bp, Homo sapiens
ctggctcagggtggtctgggtc

SEQ ID NO: 7445408 - DNA, 22 bp, Homo sapiens
ctggctcagttcttggttttca

SEQ ID NO: 7445409 - DNA, 22 bp, Homo sapiens
ctggctcagtgccttcagaagt

SEQ ID NO: 7445410 - DNA, 22 bp, Homo sapiens
ctggctcagttcttggttttca

SEQ ID NO: 7445411 - DNA, 22 bp, Homo sapiens
ctggctcagttcttggttttca

SEQ ID NO: 7445412 - DNA, 22 bp, Homo sapiens
ctggctcatagagcagctccaa

SEQ ID NO: 7445413 - DNA, 22 bp, Homo sapiens
ctggctcatagagcagctccaa

SEQ ID NO: 7445414 - DNA, 22 bp, Homo sapiens
ctggctccaaggaagaggtttt

SEQ ID NO: 7445415 - DNA, 22 bp, Homo sapiens
ctggctccaaggaagaggtttt

SEQ ID NO: 7445416 - DNA, 22 bp, Homo sapiens
ctggctccaaggaagaggtttt

SEQ ID NO: 7445417 - DNA, 22 bp, Homo sapiens
ctggctccaaggaagaggtttt

SEQ ID NO: 7445418 - DNA, 22 bp, Homo sapiens
ctggctccaaggaagaggtttt

SEQ ID NO: 7445419 - DNA, 22 bp, Homo sapiens
ctggctccaaggaagaggtttt

SEQ ID NO: 7445420 - DNA, 22 bp, Homo sapiens
ctggctccaccccaggaggatg

SEQ ID NO: 7445421 - DNA, 22 bp, Homo sapiens
ctggctccaccccaggaggatg

SEQ ID NO: 7445422 - DNA, 22 bp, Homo sapiens
ctggctccaaattctgatgttc

SEQ ID NO: 7445423 - DNA, 22 bp, Homo sapiens
ctggctccaaattctgatgttc

SEQ ID NO: 7445424 - DNA, 22 bp, Homo sapiens
ctggctcattttagcatcaggt

SEQ ID NO: 7445425 - DNA, 22 bp, Homo sapiens
ctggctcattttagcatcaggt

SEQ ID NO: 7445426 - DNA, 22 bp, Homo sapiens
ctggctcttcagtgcttggttc

SEQ ID NO: 7445427 - DNA, 22 bp, Homo sapiens
ctggctcttcagtgcttggttc

SEQ ID NO: 7445428 - DNA, 21 bp, Homo sapiens
ctggctctgttgtcacccggc

SEQ ID NO: 7445429 - DNA, 21 bp, Homo sapiens
ctggctctgttgtcacccggc

SEQ ID NO: 7445430 - DNA, 22 bp, Homo sapiens
ctggctcttgcgactcagcttg

SEQ ID NO: 7445431 - DNA, 22 bp, Homo sapiens
ctggctcttgcgactcagcttg

SEQ ID NO: 7445432 - DNA, 22 bp, Homo sapiens
ctggctcttgcgactcagcttg

SEQ ID NO: 7445433 - DNA, 22 bp, Homo sapiens
ctggctcttgcgactcagcttg

SEQ ID NO: 7445434 - DNA, 22 bp, Homo sapiens
ctggctcttgcgactcagcttg

SEQ ID NO: 7445435 - DNA, 22 bp, Homo sapiens
ctggctcttgcgactcagcttg

SEQ ID NO: 7445436 - DNA, 22 bp, Homo sapiens
ctggctcttctgggttctgtgt

SEQ ID NO: 7445437 - DNA, 22 bp, Homo sapiens
ctggctcttctgggttctgtgt

SEQ ID NO: 7445438 - DNA, 22 bp, Homo sapiens
ctggctgcagtagcaagagact

SEQ ID NO: 7445439 - DNA, 22 bp, Homo sapiens
ctggctgcagtagcaagagact

SEQ ID NO: 7445440 - DNA, 22 bp, Homo sapiens
ctggctgcaggatgaggctgcc

SEQ ID NO: 7445441 - DNA, 22 bp, Homo sapiens
ctggctgcaggatgaggctgcc

SEQ ID NO: 7445442 - DNA, 22 bp, Homo sapiens
ctggctgcaggatgaggctgcc

SEQ ID NO: 7445443 - DNA, 22 bp, Homo sapiens
ctggctgcaggatgaggctgcc

SEQ ID NO: 7445444 - DNA, 22 bp, Homo sapiens
ctggctgcaggatgaggctgcc

SEQ ID NO: 7445445 - DNA, 22 bp, Homo sapiens
ctggctgcaggatgaggctgcc

SEQ ID NO: 7445446 - DNA, 22 bp, Homo sapiens
ctggctgcaggatgaggctgcc

SEQ ID NO: 7445447 - DNA, 22 bp, Homo sapiens
ctggctgcaggatgaggctgcc

SEQ ID NO: 7445448 - DNA, 22 bp, Homo sapiens
ctggctgcaggatgaggctgcc

SEQ ID NO: 7445449 - DNA, 22 bp, Homo sapiens
ctggctgcaggatgaggctgcc

SEQ ID NO: 7445450 - DNA, 22 bp, Homo sapiens
ctggctgcaggatgaggctgcc

SEQ ID NO: 7445451 - DNA, 22 bp, Homo sapiens
ctggctgcaggaaggagtgggc

SEQ ID NO: 7445452 - DNA, 22 bp, Homo sapiens
ctggctgcaggaaggagtgggc

SEQ ID NO: 7445453 - DNA, 22 bp, Homo sapiens
ctggctgcaggaaggagtgggc

SEQ ID NO: 7445454 - DNA, 22 bp, Homo sapiens
ctggctgcaggaaggagtgggc

SEQ ID NO: 7445455 - DNA, 22 bp, Homo sapiens
ctggctgcaggaaggagtgggc

SEQ ID NO: 7445456 - DNA, 22 bp, Homo sapiens
ctggctgcaggaaggagtgggc

SEQ ID NO: 7445457 - DNA, 22 bp, Homo sapiens
ctggctcttgcgactcagcttg

SEQ ID NO: 7445458 - DNA, 22 bp, Homo sapiens
ctggctcttgcgactcagcttg

SEQ ID NO: 7445459 - DNA, 22 bp, Homo sapiens
ctggctcttgcgactcagcttg

SEQ ID NO: 7445460 - DNA, 22 bp, Homo sapiens
ctggctgcgtctgctctgacag

SEQ ID NO: 7445461 - DNA, 22 bp, Homo sapiens
ctggctgcgtctgctctgacag

SEQ ID NO: 7445462 - DNA, 22 bp, Homo sapiens
ctggctgcgtctgctctgacag

SEQ ID NO: 7445463 - DNA, 22 bp, Homo sapiens
ctggctgcgtctgctctgacag

SEQ ID NO: 7445464 - DNA, 22 bp, Homo sapiens
ctggctgctggcctgaggatgc

SEQ ID NO: 7445465 - DNA, 22 bp, Homo sapiens
ctggctgcgtctgctctgacag

SEQ ID NO: 7445466 - DNA, 22 bp, Homo sapiens
ctggctgctggcctgaggatgc

SEQ ID NO: 7445467 - DNA, 22 bp, Homo sapiens
ctggctgcgtctgctctgacag

SEQ ID NO: 7445468 - DNA, 22 bp, Homo sapiens
ctggctgcgtctgctctgacag

SEQ ID NO: 7445469 - DNA, 22 bp, Homo sapiens
ctggctgcttgggacagccatg

SEQ ID NO: 7445470 - DNA, 22 bp, Homo sapiens
ctggctgcttgggacagccatg

SEQ ID NO: 7445471 - DNA, 22 bp, Homo sapiens
ctggctgcttgggacagccatg

SEQ ID NO: 7445472 - DNA, 22 bp, Homo sapiens
ctggctgcttgggacagccatg

SEQ ID NO: 7445473 - DNA, 22 bp, Homo sapiens
ctggctgcttgggacagccatg

SEQ ID NO: 7445474 - DNA, 22 bp, Homo sapiens
ctggctgctggcctgaggatgc

SEQ ID NO: 7445475 - DNA, 22 bp, Homo sapiens
ctggctgctggcctgaggatgc

SEQ ID NO: 7445476 - DNA, 22 bp, Homo sapiens
ctggctgctggcctgaggatgc

SEQ ID NO: 7445477 - DNA, 22 bp, Homo sapiens
ctggctgcttgtagactcgact

SEQ ID NO: 7445478 - DNA, 22 bp, Homo sapiens
ctggctgcttgggacagccatg

SEQ ID NO: 7445479 - DNA, 22 bp, Homo sapiens
ctggctgcttgtagactcgact

SEQ ID NO: 7445480 - DNA, 22 bp, Homo sapiens
ctggctgcttgtagactcgact

SEQ ID NO: 7445481 - DNA, 22 bp, Homo sapiens
ctggctgcattggcaagtcaat

SEQ ID NO: 7445482 - DNA, 22 bp, Homo sapiens
ctggctgccacttcagggtctt

SEQ ID NO: 7445483 - DNA, 22 bp, Homo sapiens
ctggctgcattggcaagtcaat

SEQ ID NO: 7445484 - DNA, 22 bp, Homo sapiens
ctggctgcattggcaagtcaat

SEQ ID NO: 7445485 - DNA, 22 bp, Homo sapiens
ctggctgcattggcaagtcaat

SEQ ID NO: 7445486 - DNA, 22 bp, Homo sapiens
ctggctgccagcatttggggga

SEQ ID NO: 7445487 - DNA, 22 bp, Homo sapiens
ctggctgccacttcagggtctt

SEQ ID NO: 7445488 - DNA, 22 bp, Homo sapiens
ctggctgccacttcagggtctt

SEQ ID NO: 7445489 - DNA, 22 bp, Homo sapiens
ctggctgccacttcagggtctt

SEQ ID NO: 7445490 - DNA, 22 bp, Homo sapiens
ctggctgccacttcagggtctt

SEQ ID NO: 7445491 - DNA, 22 bp, Homo sapiens
ctggctgccacttcagggtctt

SEQ ID NO: 7445492 - DNA, 22 bp, Homo sapiens
ctggctgcctggagtgagggag

SEQ ID NO: 7445493 - DNA, 22 bp, Homo sapiens
ctggctgcctatagtctccctt

SEQ ID NO: 7445494 - DNA, 22 bp, Homo sapiens
ctggctgcctatagtctccctt

SEQ ID NO: 7445495 - DNA, 22 bp, Homo sapiens
ctggctgcctggagtgagggag

SEQ ID NO: 7445496 - DNA, 22 bp, Homo sapiens
ctggctgcctggagtgagggag

SEQ ID NO: 7445497 - DNA, 22 bp, Homo sapiens
ctggctgcctggagtgagggag

SEQ ID NO: 7445498 - DNA, 22 bp, Homo sapiens
ctggctgcctggagtgagggag

SEQ ID NO: 7445499 - DNA, 22 bp, Homo sapiens
ctggctgcctggagtgagggag

SEQ ID NO: 7445500 - DNA, 22 bp, Homo sapiens
ctggctgcctatagtctccctt

SEQ ID NO: 7445501 - DNA, 22 bp, Homo sapiens
ctggctgccagcatttggggga

SEQ ID NO: 7445502 - DNA, 22 bp, Homo sapiens
ctggctgccagcatttggggga

SEQ ID NO: 7445503 - DNA, 22 bp, Homo sapiens
ctggctgcctatagtctccctt

SEQ ID NO: 7445504 - DNA, 22 bp, Homo sapiens
ctggctgtgcagtcttccagaa

SEQ ID NO: 7445505 - DNA, 22 bp, Homo sapiens
ctggctgtgcagtcttccagaa

SEQ ID NO: 7445506 - DNA, 22 bp, Homo sapiens
ctggctggagctgttgtaggct

SEQ ID NO: 7445507 - DNA, 22 bp, Homo sapiens
ctggctggagcaggcatcttgt

SEQ ID NO: 7445508 - DNA, 22 bp, Homo sapiens
ctggctggacttgtgcatgtca

SEQ ID NO: 7445509 - DNA, 22 bp, Homo sapiens
ctggctggacttgtgcatgtca

SEQ ID NO: 7445510 - DNA, 22 bp, Homo sapiens
ctggctggaagttagagaactt

SEQ ID NO: 7445511 - DNA, 22 bp, Homo sapiens
ctggctggacttgtgcatgtca

SEQ ID NO: 7445512 - DNA, 22 bp, Homo sapiens
ctggctggacttgtgcatgtca

SEQ ID NO: 7445513 - DNA, 22 bp, Homo sapiens
ctggctggacttgtgcatgtca

SEQ ID NO: 7445514 - DNA, 22 bp, Homo sapiens
ctggctggacttgtgcatgtca

SEQ ID NO: 7445515 - DNA, 22 bp, Homo sapiens
ctggctggagaaatgaaattct

SEQ ID NO: 7445516 - DNA, 22 bp, Homo sapiens
ctggctggagcaggcatcttgt

SEQ ID NO: 7445517 - DNA, 22 bp, Homo sapiens
ctggctggagcaggcatcttgt

SEQ ID NO: 7445518 - DNA, 22 bp, Homo sapiens
ctggctggagcaggcatcttgt

SEQ ID NO: 7445519 - DNA, 22 bp, Homo sapiens
ctggctggagcaggcatcttgt

SEQ ID NO: 7445520 - DNA, 20 bp, Homo sapiens
ctggctggaaacttagcctt

SEQ ID NO: 7445521 - DNA, 20 bp, Homo sapiens
ctggctggaaacttagcctt

SEQ ID NO: 7445522 - DNA, 20 bp, Homo sapiens
ctggctggaaacttagcctt

SEQ ID NO: 7445523 - DNA, 20 bp, Homo sapiens
ctggctggaaacttagcctt

SEQ ID NO: 7445524 - DNA, 22 bp, Homo sapiens
ctggctggaacgccgaggcggc

SEQ ID NO: 7445525 - DNA, 20 bp, Homo sapiens
ctggctggaaacttagcctt

SEQ ID NO: 7445526 - DNA, 20 bp, Homo sapiens
ctggctggaaacttagcctt

SEQ ID NO: 7445527 - DNA, 22 bp, Homo sapiens
ctggctgcttgttttgatgggt

SEQ ID NO: 7445528 - DNA, 22 bp, Homo sapiens
ctggctgcttgttttgatgggt

SEQ ID NO: 7445529 - DNA, 22 bp, Homo sapiens
ctggctgcttgtagactcgact

SEQ ID NO: 7445530 - DNA, 22 bp, Homo sapiens
ctggctgcttgttttgatgggt

SEQ ID NO: 7445531 - DNA, 22 bp, Homo sapiens
ctggctgcttgttttgatgggt

SEQ ID NO: 7445532 - DNA, 22 bp, Homo sapiens
ctggctggaagttagagaactt

SEQ ID NO: 7445533 - DNA, 16 bp, Homo sapiens
ctggctggaagcctgg

SEQ ID NO: 7445534 - DNA, 22 bp, Homo sapiens
ctggctggaagttagagaactt

SEQ ID NO: 7445535 - DNA, 22 bp, Homo sapiens
ctggctggaagttagagaactt

SEQ ID NO: 7445536 - DNA, 20 bp, Homo sapiens
ctggctggaaacttagcctt

SEQ ID NO: 7445537 - DNA, 22 bp, Homo sapiens
ctggctggaacgccgaggcggc

SEQ ID NO: 7445538 - DNA, 22 bp, Homo sapiens
ctggctggaacgccgaggcggc

SEQ ID NO: 7445539 - DNA, 22 bp, Homo sapiens
ctggctggaacgccgaggcggc

SEQ ID NO: 7445540 - DNA, 22 bp, Homo sapiens
cttcagctgcagttatgtttag

SEQ ID NO: 7445541 - DNA, 22 bp, Homo sapiens
cttcagctgcagttatgtttag

SEQ ID NO: 7445542 - DNA, 22 bp, Homo sapiens
cttcagctgtggtctccaaggc

SEQ ID NO: 7445543 - DNA, 22 bp, Homo sapiens
cttcagctgtggtctccaaggc

SEQ ID NO: 7445544 - DNA, 22 bp, Homo sapiens
cttcagctgtggtctccaaggc

SEQ ID NO: 7445545 - DNA, 22 bp, Homo sapiens
cttcaggaaaatctctaaggat

SEQ ID NO: 7445546 - DNA, 22 bp, Homo sapiens
cttcagctgacgtcaaaacacc

SEQ ID NO: 7445547 - DNA, 22 bp, Homo sapiens
cttcagctttcagcttccctga

SEQ ID NO: 7445548 - DNA, 22 bp, Homo sapiens
cttcagctttcagcttccctga

SEQ ID NO: 7445549 - DNA, 22 bp, Homo sapiens
cttcaggagtagttacctagca

SEQ ID NO: 7445550 - DNA, 22 bp, Homo sapiens
cttcaggattaatttggggcct

SEQ ID NO: 7445551 - DNA, 22 bp, Homo sapiens
cttcaggatttaggaagatgaa

SEQ ID NO: 7445552 - DNA, 22 bp, Homo sapiens
cttcaggattaatttggggcct

SEQ ID NO: 7445553 - DNA, 20 bp, Homo sapiens
cttcaggacccatcctcccc

SEQ ID NO: 7445554 - DNA, 20 bp, Homo sapiens
cttcaggacccatcctcccc

SEQ ID NO: 7445555 - DNA, 22 bp, Homo sapiens
cttcaggagtagttacctagca

SEQ ID NO: 7445556 - DNA, 22 bp, Homo sapiens
cttcagctgcagttatgtttag

SEQ ID NO: 7445557 - DNA, 22 bp, Homo sapiens
cttcagctgcagttatgtttag

SEQ ID NO: 7445558 - DNA, 22 bp, Homo sapiens
cttcagctcttggtaaatgttt

SEQ ID NO: 7445559 - DNA, 22 bp, Homo sapiens
cttcagctgcagttatgtttag

SEQ ID NO: 7445560 - DNA, 22 bp, Homo sapiens
cttcagctgcagttatgtttag

SEQ ID NO: 7445561 - DNA, 22 bp, Homo sapiens
cttcagctacctctgatgcaag

SEQ ID NO: 7445562 - DNA, 22 bp, Homo sapiens
cttcagctaggatccctgcagc

SEQ ID NO: 7445563 - DNA, 22 bp, Homo sapiens
cttcagctaggatccctgcagc

SEQ ID NO: 7445564 - DNA, 22 bp, Homo sapiens
cttcagcctcatctcagcccgt

SEQ ID NO: 7445565 - DNA, 22 bp, Homo sapiens
cttcagctaggatccctgcagc

SEQ ID NO: 7445566 - DNA, 22 bp, Homo sapiens
cttcagctaggatccctgcagc

SEQ ID NO: 7445567 - DNA, 22 bp, Homo sapiens
cttcagcctcgttactcctgcg

SEQ ID NO: 7445568 - DNA, 22 bp, Homo sapiens
cttcagcctcgttactcctgcg

SEQ ID NO: 7445569 - DNA, 22 bp, Homo sapiens
cttcagcctcatctcagcccgt

SEQ ID NO: 7445570 - DNA, 22 bp, Homo sapiens
cttcagccctgagtgccagcag

SEQ ID NO: 7445571 - DNA, 22 bp, Homo sapiens
cttcagccctgagtgccagcag

SEQ ID NO: 7445572 - DNA, 22 bp, Homo sapiens
cttcagccctgagtgccagcag

SEQ ID NO: 7445573 - DNA, 22 bp, Homo sapiens
cttcagtgaatgttgagtaagg

SEQ ID NO: 7445574 - DNA, 22 bp, Homo sapiens
cttcagtgaatgttgagtaagg

SEQ ID NO: 7445575 - DNA, 22 bp, Homo sapiens
cttcagtgacagccacccaggc

SEQ ID NO: 7445576 - DNA, 18 bp, Homo sapiens
cttcagtgacagtctggc

SEQ ID NO: 7445577 - DNA, 18 bp, Homo sapiens
cttcagtgacagtctggc

SEQ ID NO: 7445578 - DNA, 22 bp, Homo sapiens
cttcagtgacattccttccctc

SEQ ID NO: 7445579 - DNA, 22 bp, Homo sapiens
cttcagtgcatgtttataatca

SEQ ID NO: 7445580 - DNA, 22 bp, Homo sapiens
cttcagtgcatgtttataatca

SEQ ID NO: 7445581 - DNA, 22 bp, Homo sapiens
cttcagtgattgcagaaagcct

SEQ ID NO: 7445582 - DNA, 22 bp, Homo sapiens
cttcagtgattgcagaaagcct

SEQ ID NO: 7445583 - DNA, 22 bp, Homo sapiens
cttcagtgattgcagaaagcct

SEQ ID NO: 7445584 - DNA, 22 bp, Homo sapiens
cttcagtgatataggcttctcc

SEQ ID NO: 7445585 - DNA, 22 bp, Homo sapiens
cttcagtgatataggcttctcc

SEQ ID NO: 7445586 - DNA, 22 bp, Homo sapiens
cttcagtgattgcagaaagcct

SEQ ID NO: 7445587 - DNA, 22 bp, Homo sapiens
cttcagtgatataggcttctcc

SEQ ID NO: 7445588 - DNA, 22 bp, Homo sapiens
cttcagtgatataggcttctcc

SEQ ID NO: 7445589 - DNA, 22 bp, Homo sapiens
cttcagggaggagcatgggttc

SEQ ID NO: 7445590 - DNA, 19 bp, Homo sapiens
cttcagggaggggccaggc

SEQ ID NO: 7445591 - DNA, 19 bp, Homo sapiens
cttcagggaggggccaggc

SEQ ID NO: 7445592 - DNA, 22 bp, Homo sapiens
cttcagggaggagcatgggttc

SEQ ID NO: 7445593 - DNA, 22 bp, Homo sapiens
cttcagggtgacgcaggctgca

SEQ ID NO: 7445594 - DNA, 22 bp, Homo sapiens
cttcagggcatattattggctc

SEQ ID NO: 7445595 - DNA, 22 bp, Homo sapiens
cttcagtcgccttggcaggggc

SEQ ID NO: 7445596 - DNA, 18 bp, Homo sapiens
cttcagtcttcccacctc

SEQ ID NO: 7445597 - DNA, 18 bp, Homo sapiens
cttcagtcttcccacctc

SEQ ID NO: 7445598 - DNA, 22 bp, Homo sapiens
cttcagtgaatgttgagtaagg

SEQ ID NO: 7445599 - DNA, 22 bp, Homo sapiens
cttcagtccttaagccaagcaa

SEQ ID NO: 7445600 - DNA, 22 bp, Homo sapiens
cttcagtatcctccacatgtta

SEQ ID NO: 7445601 - DNA, 22 bp, Homo sapiens
cttcagtatcctccacatgtta

SEQ ID NO: 7445602 - DNA, 22 bp, Homo sapiens
cttcagtatcctccacatgtta

SEQ ID NO: 7445603 - DNA, 22 bp, Homo sapiens
cttcagtatcctccacatgtta

SEQ ID NO: 7445604 - DNA, 18 bp, Homo sapiens
cttcctcttctggagaaa

SEQ ID NO: 7445605 - DNA, 18 bp, Homo sapiens
cttcctcttctggagaaa

SEQ ID NO: 7445606 - DNA, 22 bp, Homo sapiens
cttcctctgtgtcctgggcttg

SEQ ID NO: 7445607 - DNA, 16 bp, Homo sapiens
cttcctcttcactggc

SEQ ID NO: 7445608 - DNA, 22 bp, Homo sapiens
cttcctctgtgtcctgggcttg

SEQ ID NO: 7445609 - DNA, 22 bp, Homo sapiens
cttcctctgtgtcctgggcttg

SEQ ID NO: 7445610 - DNA, 22 bp, Homo sapiens
cttcctctgtgtcctgggcttg

SEQ ID NO: 7445611 - DNA, 22 bp, Homo sapiens
cttcctctgtgtcctgggcttg

SEQ ID NO: 7445612 - DNA, 22 bp, Homo sapiens
cttcctctgtgtcctgggcttg

SEQ ID NO: 7445613 - DNA, 22 bp, Homo sapiens
cttcctctgtgtcctgggcttg

SEQ ID NO: 7445614 - DNA, 22 bp, Homo sapiens
cttcctctgtggccagagtgta

SEQ ID NO: 7445615 - DNA, 22 bp, Homo sapiens
cttcctctgtggccagagtgta

SEQ ID NO: 7445616 - DNA, 22 bp, Homo sapiens
cttcctctgtggccagagtgta

SEQ ID NO: 7445617 - DNA, 22 bp, Homo sapiens
cttcctctgtggccagagtgta

SEQ ID NO: 7445618 - DNA, 22 bp, Homo sapiens
cttcctctgtgtcctgggcttc

SEQ ID NO: 7445619 - DNA, 22 bp, Homo sapiens
cttcctctgtgtcctgggcttc

SEQ ID NO: 7445620 - DNA, 22 bp, Homo sapiens
cttcctctgtgtcctgggcttc

SEQ ID NO: 7445621 - DNA, 22 bp, Homo sapiens
cttcctctgtgtcctgggcttc

SEQ ID NO: 7445622 - DNA, 22 bp, Homo sapiens
cttcctctgtgtcctgggcttc

SEQ ID NO: 7445623 - DNA, 22 bp, Homo sapiens
cttcctctgtgtcctgggcttc

SEQ ID NO: 7445624 - DNA, 22 bp, Homo sapiens
cttcctctgtgtcctgggcttc

SEQ ID NO: 7445625 - DNA, 22 bp, Homo sapiens
cttcctgaatcttccatgtata

SEQ ID NO: 7445626 - DNA, 18 bp, Homo sapiens
cttcctgactagctctgg

SEQ ID NO: 7445627 - DNA, 22 bp, Homo sapiens
cttcctgaaggatggcagcctc

SEQ ID NO: 7445628 - DNA, 22 bp, Homo sapiens
cttcctgaagaggttggtcagg

SEQ ID NO: 7445629 - DNA, 22 bp, Homo sapiens
cttcctgaaggatggcagcctc

SEQ ID NO: 7445630 - DNA, 22 bp, Homo sapiens
cttcctgaaggatggcagcctc

SEQ ID NO: 7445631 - DNA, 22 bp, Homo sapiens
cttcctgaaggatggcagcctc

SEQ ID NO: 7445632 - DNA, 22 bp, Homo sapiens
cttcctgaggtgctgagcacag

SEQ ID NO: 7445633 - DNA, 22 bp, Homo sapiens
cttcctgagcaaggaactatag

SEQ ID NO: 7445634 - DNA, 22 bp, Homo sapiens
cttcctgagcaaggaactatag

SEQ ID NO: 7445635 - DNA, 18 bp, Homo sapiens
cttcctgactagctctgg

SEQ ID NO: 7445636 - DNA, 22 bp, Homo sapiens
cttcctgagcaaggaactatag

SEQ ID NO: 7445637 - DNA, 22 bp, Homo sapiens
cttcctgaacaatgccatcaat

SEQ ID NO: 7445638 - DNA, 22 bp, Homo sapiens
cttcctgaacaatgccatcaat

SEQ ID NO: 7445639 - DNA, 22 bp, Homo sapiens
cttcctgaagaggttggtcagg

SEQ ID NO: 7445640 - DNA, 22 bp, Homo sapiens
cttcctgaaggatggcagcctc

SEQ ID NO: 7445641 - DNA, 22 bp, Homo sapiens
cttcctgaagaggttggtcagg

SEQ ID NO: 7445642 - DNA, 22 bp, Homo sapiens
cttcctgaaatgtctcaccagt

SEQ ID NO: 7445643 - DNA, 22 bp, Homo sapiens
cttcctgaaagtagtaggttga

SEQ ID NO: 7445644 - DNA, 22 bp, Homo sapiens
cttcctgaaagtagtaggttga

SEQ ID NO: 7445645 - DNA, 22 bp, Homo sapiens
cttcctgaaatgtctcaccagt

SEQ ID NO: 7445646 - DNA, 18 bp, Homo sapiens
cttcctcttctggagaaa

SEQ ID NO: 7445647 - DNA, 22 bp, Homo sapiens
cttccctttttatgtcttcagc

SEQ ID NO: 7445648 - DNA, 22 bp, Homo sapiens
cttcagtgttgccagggcctag

SEQ ID NO: 7445649 - DNA, 22 bp, Homo sapiens
cttcagtgttgccagggcctag

SEQ ID NO: 7445650 - DNA, 22 bp, Homo sapiens
cttcagtgttcccatctgtaaa

SEQ ID NO: 7445651 - DNA, 22 bp, Homo sapiens
cttcagtgttcccatctgtaaa

SEQ ID NO: 7445652 - DNA, 19 bp, Homo sapiens
cttcagtgttcacctggcc

SEQ ID NO: 7445653 - DNA, 19 bp, Homo sapiens
cttcagtgttcacctggcc

SEQ ID NO: 7445654 - DNA, 19 bp, Homo sapiens
cttcagtgttcacctggcc

SEQ ID NO: 7445655 - DNA, 22 bp, Homo sapiens
cttcagtgtcctctctagtaga

SEQ ID NO: 7445656 - DNA, 22 bp, Homo sapiens
cttcagtgtcctctctagtaga

SEQ ID NO: 7445657 - DNA, 23 bp, Homo sapiens
cttcagtgtgggactgcagcgtg

SEQ ID NO: 7445658 - DNA, 23 bp, Homo sapiens
cttcagtgtgggactgcagcgtg

SEQ ID NO: 7445659 - DNA, 23 bp, Homo sapiens
cttcagtgtgggactgcagcgtg

SEQ ID NO: 7445660 - DNA, 23 bp, Homo sapiens
cttcagtgtgggactgcagcgtg

SEQ ID NO: 7445661 - DNA, 18 bp, Homo sapiens
cttcagtggctgctctgc

SEQ ID NO: 7445662 - DNA, 18 bp, Homo sapiens
cttcagtggctgctctgc

SEQ ID NO: 7445663 - DNA, 18 bp, Homo sapiens
cttcagtggctgctctgc

SEQ ID NO: 7445664 - DNA, 22 bp, Homo sapiens
cttcagtggtcatttgtgataa

SEQ ID NO: 7445665 - DNA, 22 bp, Homo sapiens
cttcagtgtcctctctagtaga

SEQ ID NO: 7445666 - DNA, 22 bp, Homo sapiens
cttccgtgtcagttccaggtgg

SEQ ID NO: 7445667 - DNA, 22 bp, Homo sapiens
cttcctaaaagcttcaagagaa

SEQ ID NO: 7445668 - DNA, 22 bp, Homo sapiens
cttcctaaaagcttcaagagaa

SEQ ID NO: 7445669 - DNA, 22 bp, Homo sapiens
cttccgtgtcagttccaggtgg

SEQ ID NO: 7445670 - DNA, 22 bp, Homo sapiens
cttccctttttatgtcttcagc

SEQ ID NO: 7445671 - DNA, 22 bp, Homo sapiens
cttccctttttatgtcttcagc

SEQ ID NO: 7445672 - DNA, 22 bp, Homo sapiens
cttccctttttatgtcttcagc

SEQ ID NO: 7445673 - DNA, 22 bp, Homo sapiens
cttcctctgaggcttctgagtc

SEQ ID NO: 7445674 - DNA, 22 bp, Homo sapiens
cttcctctgcctcccgtgctca

SEQ ID NO: 7445675 - DNA, 22 bp, Homo sapiens
cttcctctgcctcccgtgctca

SEQ ID NO: 7445676 - DNA, 22 bp, Homo sapiens
cttcctctgcggcgccgggcgc

SEQ ID NO: 7445677 - DNA, 22 bp, Homo sapiens
cttcctctgcctcccgtgctca

SEQ ID NO: 7445678 - DNA, 22 bp, Homo sapiens
cttcaaaagccagaagcctgcg

SEQ ID NO: 7445679 - DNA, 22 bp, Homo sapiens
cttcaaaagccagaagcctgcg

SEQ ID NO: 7445680 - DNA, 22 bp, Homo sapiens
cttcaaaagccagaagcctgcg

SEQ ID NO: 7445681 - DNA, 22 bp, Homo sapiens
cttattttgctgatgacccagg

SEQ ID NO: 7445682 - DNA, 22 bp, Homo sapiens
cttattttgctgatgacccagg

SEQ ID NO: 7445683 - DNA, 22 bp, Homo sapiens
cttattttgctgatgacccagg

SEQ ID NO: 7445684 - DNA, 22 bp, Homo sapiens
cttattttgctgatgacccagg

SEQ ID NO: 7445685 - DNA, 22 bp, Homo sapiens
cttcaaaagccagaagcctgcg

SEQ ID NO: 7445686 - DNA, 22 bp, Homo sapiens
cttcaaaagccagaagcctgcg

SEQ ID NO: 7445687 - DNA, 22 bp, Homo sapiens
cttcaaaccacatgctgaaaat

SEQ ID NO: 7445688 - DNA, 22 bp, Homo sapiens
cttcaaacccagattaaatgca

SEQ ID NO: 7445689 - DNA, 22 bp, Homo sapiens
cttcaaacactagaaacacagg

SEQ ID NO: 7445690 - DNA, 22 bp, Homo sapiens
cttcagaagcctgcagcctttg

SEQ ID NO: 7445691 - DNA, 22 bp, Homo sapiens
cttcagaagcctgcagcctttg

SEQ ID NO: 7445692 - DNA, 22 bp, Homo sapiens
cttcagaagagttaagtgtgag

SEQ ID NO: 7445693 - DNA, 22 bp, Homo sapiens
cttcagaagagttaagtgtgag

SEQ ID NO: 7445694 - DNA, 22 bp, Homo sapiens
cttcagaagagttaagtgtgag

SEQ ID NO: 7445695 - DNA, 22 bp, Homo sapiens
cttcagccagctggggatgcgg

SEQ ID NO: 7445696 - DNA, 22 bp, Homo sapiens
cttcagccctgagtgccagcag

SEQ ID NO: 7445697 - DNA, 22 bp, Homo sapiens
cttcagcccagcctccgcctcc

SEQ ID NO: 7445698 - DNA, 22 bp, Homo sapiens
cttcagaagaaaagcagtgtgt

SEQ ID NO: 7445699 - DNA, 22 bp, Homo sapiens
cttcagaactataaaaagtact

SEQ ID NO: 7445700 - DNA, 22 bp, Homo sapiens
cttcagaactataaaaagtact

SEQ ID NO: 7445701 - DNA, 22 bp, Homo sapiens
cttcagaagaaaagcagtgtgt

SEQ ID NO: 7445702 - DNA, 22 bp, Homo sapiens
cttcagaaccagccagaagagg

SEQ ID NO: 7445703 - DNA, 22 bp, Homo sapiens
cttcagaactataaaaagtact

SEQ ID NO: 7445704 - DNA, 22 bp, Homo sapiens
cttcagaaccagccagaagagg

SEQ ID NO: 7445705 - DNA, 22 bp, Homo sapiens
cttcagaactataaaaagtact

SEQ ID NO: 7445706 - DNA, 22 bp, Homo sapiens
cttatttgtactaataaatctg

SEQ ID NO: 7445707 - DNA, 22 bp, Homo sapiens
cttattttaagtcagtttgggt

SEQ ID NO: 7445708 - DNA, 22 bp, Homo sapiens
cttattttaagtcagtttgggt

SEQ ID NO: 7445709 - DNA, 22 bp, Homo sapiens
cttattttaagtcagtttgggt

SEQ ID NO: 7445710 - DNA, 22 bp, Homo sapiens
cttattttaagtcagtttgggt

SEQ ID NO: 7445711 - DNA, 22 bp, Homo sapiens
cttattttaagtcagtttgggt

SEQ ID NO: 7445712 - DNA, 22 bp, Homo sapiens
cttattttaagtcagtttgggt

SEQ ID NO: 7445713 - DNA, 22 bp, Homo sapiens
cttatttgcccatgtttcttta

SEQ ID NO: 7445714 - DNA, 22 bp, Homo sapiens
cttatttgcccatgtttcttta

SEQ ID NO: 7445715 - DNA, 22 bp, Homo sapiens
cttatttgcccatgtttcttta

SEQ ID NO: 7445716 - DNA, 22 bp, Homo sapiens
cttatttgcccatgtttcttta

SEQ ID NO: 7445717 - DNA, 22 bp, Homo sapiens
cttattttaagtcagtttgggt

SEQ ID NO: 7445718 - DNA, 22 bp, Homo sapiens
cttattttaagtcagtttgggt

SEQ ID NO: 7445719 - DNA, 22 bp, Homo sapiens
cttattttgctgatgacccagg

SEQ ID NO: 7445720 - DNA, 22 bp, Homo sapiens
cttattttgctgatgacccagg

SEQ ID NO: 7445721 - DNA, 22 bp, Homo sapiens
cttattttgctgatgacccagg

SEQ ID NO: 7445722 - DNA, 22 bp, Homo sapiens
cttattttgctgatgacccagg

SEQ ID NO: 7445723 - DNA, 22 bp, Homo sapiens
cttattttgctgatgacccagg

SEQ ID NO: 7445724 - DNA, 22 bp, Homo sapiens
cttattttgctgatgacccagg

SEQ ID NO: 7445725 - DNA, 19 bp, Homo sapiens
cttatttctggttttgggt

SEQ ID NO: 7445726 - DNA, 22 bp, Homo sapiens
cttatttgagagaaaagaaact

SEQ ID NO: 7445727 - DNA, 22 bp, Homo sapiens
cttatttgagagaaaagaaact

SEQ ID NO: 7445728 - DNA, 22 bp, Homo sapiens
cttatttgaatgtatgagtttt

SEQ ID NO: 7445729 - DNA, 22 bp, Homo sapiens
cttatttctccatccagagtca

SEQ ID NO: 7445730 - DNA, 22 bp, Homo sapiens
cttatttctccatccagagtca

SEQ ID NO: 7445731 - DNA, 22 bp, Homo sapiens
cttatttcctgacatggaaaga

SEQ ID NO: 7445732 - DNA, 22 bp, Homo sapiens
cttatttactgatccacagatg

SEQ ID NO: 7445733 - DNA, 22 bp, Homo sapiens
cttatttactgatccacagatg

SEQ ID NO: 7445734 - DNA, 22 bp, Homo sapiens
cttatttactgatccacagatg

SEQ ID NO: 7445735 - DNA, 22 bp, Homo sapiens
cttatttactgatccacagatg

SEQ ID NO: 7445736 - DNA, 22 bp, Homo sapiens
cttatttatgtctgtctctaat

SEQ ID NO: 7445737 - DNA, 22 bp, Homo sapiens
cttatttatgtctgtctctaat

SEQ ID NO: 7445738 - DNA, 22 bp, Homo sapiens
cttatttcagccctgggcaccc

SEQ ID NO: 7445739 - DNA, 22 bp, Homo sapiens
cttatttcctgacatggaaaga

SEQ ID NO: 7445740 - DNA, 22 bp, Homo sapiens
cttatttcagccctgggcaccc

SEQ ID NO: 7445741 - DNA, 22 bp, Homo sapiens
cttatttatgtctgtctctaat

SEQ ID NO: 7445742 - DNA, 22 bp, Homo sapiens
cttattgggatgagaggatgca

SEQ ID NO: 7445743 - DNA, 22 bp, Homo sapiens
cttattgggatgagaggatgca

SEQ ID NO: 7445744 - DNA, 22 bp, Homo sapiens
cttattggtcccaggaggagaa

SEQ ID NO: 7445745 - DNA, 22 bp, Homo sapiens
cttattggtcccaggaggagaa

SEQ ID NO: 7445746 - DNA, 22 bp, Homo sapiens
cttattggtggagtcaggccct

SEQ ID NO: 7445747 - DNA, 22 bp, Homo sapiens
cttattggtggagtcaggccct

SEQ ID NO: 7445748 - DNA, 22 bp, Homo sapiens
cttattggtgctttttctcata

SEQ ID NO: 7445749 - DNA, 22 bp, Homo sapiens
cttattggtgctttttctcata

SEQ ID NO: 7445750 - DNA, 22 bp, Homo sapiens
cttattggtgctttttctcata

SEQ ID NO: 7445751 - DNA, 22 bp, Homo sapiens
cttattggtgctttttctcata

SEQ ID NO: 7445752 - DNA, 22 bp, Homo sapiens
cttattggtgctttttctcata

SEQ ID NO: 7445753 - DNA, 22 bp, Homo sapiens
cttattggagagttgggccctt

SEQ ID NO: 7445754 - DNA, 22 bp, Homo sapiens
cttattggagagttgggccctt

SEQ ID NO: 7445755 - DNA, 22 bp, Homo sapiens
cttattgaaagcccctgtgcct

SEQ ID NO: 7445756 - DNA, 22 bp, Homo sapiens
cttattgcaggactaagaacac

SEQ ID NO: 7445757 - DNA, 22 bp, Homo sapiens
cttattgcaggactaagaacac

SEQ ID NO: 7445758 - DNA, 21 bp, Homo sapiens
cttattgctgcacaatgattt

SEQ ID NO: 7445759 - DNA, 21 bp, Homo sapiens
cttattgctgcacaatgattt

SEQ ID NO: 7445760 - DNA, 22 bp, Homo sapiens
cttattctactccacaagctct

SEQ ID NO: 7445761 - DNA, 22 bp, Homo sapiens
cttattctactccacaagctct

SEQ ID NO: 7445762 - DNA, 22 bp, Homo sapiens
cttattctactccacaagctct

SEQ ID NO: 7445763 - DNA, 22 bp, Homo sapiens
cttattgtcttacagtaataga

SEQ ID NO: 7445764 - DNA, 22 bp, Homo sapiens
cttattgtcctgactcatggcc

SEQ ID NO: 7445765 - DNA, 22 bp, Homo sapiens
cttattgtcttacagtaataga

SEQ ID NO: 7445766 - DNA, 22 bp, Homo sapiens
cttattgtcttacagtaataga

SEQ ID NO: 7445767 - DNA, 22 bp, Homo sapiens
cttattgtgaggtattgagatt

SEQ ID NO: 7445768 - DNA, 22 bp, Homo sapiens
cttattgtgaggtattgagatt

SEQ ID NO: 7445769 - DNA, 22 bp, Homo sapiens
cttattgtgagatgcgataatt

SEQ ID NO: 7445770 - DNA, 22 bp, Homo sapiens
cttattgtgagatgcgataatt

SEQ ID NO: 7445771 - DNA, 22 bp, Homo sapiens
cttattgtgattcctgcctctt

SEQ ID NO: 7445772 - DNA, 22 bp, Homo sapiens
cttattgtgataccatgcagta

SEQ ID NO: 7445773 - DNA, 22 bp, Homo sapiens
cttattgtgtgtattttctagt

SEQ ID NO: 7445774 - DNA, 22 bp, Homo sapiens
cttattgtgtgtattttctagt

SEQ ID NO: 7445775 - DNA, 22 bp, Homo sapiens
cttattgtgtctttgaataagt

SEQ ID NO: 7445776 - DNA, 22 bp, Homo sapiens
cttattgtgtctttgaataagt

SEQ ID NO: 7445777 - DNA, 22 bp, Homo sapiens
cttatttaatgagggttagaat

SEQ ID NO: 7445778 - DNA, 22 bp, Homo sapiens
cttatttaatgagggttagaat

SEQ ID NO: 7445779 - DNA, 22 bp, Homo sapiens
cttatttaatgagggttagaat

SEQ ID NO: 7445780 - DNA, 22 bp, Homo sapiens
cttatttaatgagggttagaat

SEQ ID NO: 7445781 - DNA, 22 bp, Homo sapiens
cttatttactgatccacagatg

SEQ ID NO: 7445782 - DNA, 22 bp, Homo sapiens
cttatttactgatccacagatg

SEQ ID NO: 7445783 - DNA, 22 bp, Homo sapiens
cttatttactgatccacagatg

SEQ ID NO: 7445784 - DNA, 18 bp, Homo sapiens
cttattgtttaaatggcc

SEQ ID NO: 7445785 - DNA, 22 bp, Homo sapiens
cttattgttcctggaccctgag

SEQ ID NO: 7445786 - DNA, 18 bp, Homo sapiens
cttattgtttaaatggcc

SEQ ID NO: 7445787 - DNA, 22 bp, Homo sapiens
cttattgttcagatagagatga

SEQ ID NO: 7445788 - DNA, 22 bp, Homo sapiens
cttattgttcagatagagatga

SEQ ID NO: 7445789 - DNA, 22 bp, Homo sapiens
cttattgttcagatagagatga

SEQ ID NO: 7445790 - DNA, 22 bp, Homo sapiens
cttattgttcagatagagatga

SEQ ID NO: 7445791 - DNA, 22 bp, Homo sapiens
cttatattttaggaacagacaa

SEQ ID NO: 7445792 - DNA, 22 bp, Homo sapiens
cttatattttaggaacagacaa

SEQ ID NO: 7445793 - DNA, 22 bp, Homo sapiens
cttatattttaggaacagacaa

SEQ ID NO: 7445794 - DNA, 22 bp, Homo sapiens
cttatattttaggaacagacaa

SEQ ID NO: 7445795 - DNA, 22 bp, Homo sapiens
cttatatttgtcaactttacaa

SEQ ID NO: 7445796 - DNA, 22 bp, Homo sapiens
cttatattttaggaacagacaa

SEQ ID NO: 7445797 - DNA, 22 bp, Homo sapiens
ctgtttaaccagatctcatatc

SEQ ID NO: 7445798 - DNA, 22 bp, Homo sapiens
ctgtttaaccagatctcatatc

SEQ ID NO: 7445799 - DNA, 22 bp, Homo sapiens
ctgttgttccgggagctgcagc

SEQ ID NO: 7445800 - DNA, 23 bp, Homo sapiens
cttattcattcatgtagcccatt

SEQ ID NO: 7445801 - DNA, 22 bp, Homo sapiens
cttatattttaggaacagacaa

SEQ ID NO: 7445802 - DNA, 22 bp, Homo sapiens
cttatcagattatctgggctgt

SEQ ID NO: 7445803 - DNA, 22 bp, Homo sapiens
cttatcagattatctgggctgt

SEQ ID NO: 7445804 - DNA, 22 bp, Homo sapiens
cttatcagattatctgggctgt

SEQ ID NO: 7445805 - DNA, 22 bp, Homo sapiens
cttatcagattatctgggctgt

SEQ ID NO: 7445806 - DNA, 22 bp, Homo sapiens
cttatattttaggaacagacaa

SEQ ID NO: 7445807 - DNA, 22 bp, Homo sapiens
cttatattttaggaacagacaa

SEQ ID NO: 7445808 - DNA, 22 bp, Homo sapiens
cttatattttaggaacagacaa

SEQ ID NO: 7445809 - DNA, 22 bp, Homo sapiens
cttatattttaggaacagacaa

SEQ ID NO: 7445810 - DNA, 22 bp, Homo sapiens
cttatcaaactggagcaggctt

SEQ ID NO: 7445811 - DNA, 22 bp, Homo sapiens
cttatcagattatctgggctgt

SEQ ID NO: 7445812 - DNA, 22 bp, Homo sapiens
ctgttgtattattcaatattat

SEQ ID NO: 7445813 - DNA, 22 bp, Homo sapiens
ctgttgtatttccaactatgta

SEQ ID NO: 7445814 - DNA, 22 bp, Homo sapiens
ctgttgttcatcatctgtcatt

SEQ ID NO: 7445815 - DNA, 22 bp, Homo sapiens
ctgttgttcatcatctgtcatt

SEQ ID NO: 7445816 - DNA, 22 bp, Homo sapiens
ctgttgtctatataagtttttc

SEQ ID NO: 7445817 - DNA, 17 bp, Homo sapiens
ctgttggttggaaaatt

SEQ ID NO: 7445818 - DNA, 22 bp, Homo sapiens
ctgttgtaaagctattcatttg

SEQ ID NO: 7445819 - DNA, 22 bp, Homo sapiens
ctgttgtaaagctattcatttg

SEQ ID NO: 7445820 - DNA, 23 bp, Homo sapiens
ctgttggctgtcagggctggact

SEQ ID NO: 7445821 - DNA, 22 bp, Homo sapiens
ctgttggcttcagtgcagagaa

SEQ ID NO: 7445822 - DNA, 22 bp, Homo sapiens
ctgttggtgttgattaaatagt

SEQ ID NO: 7445823 - DNA, 23 bp, Homo sapiens
ctgttggctgtcagggctggact

SEQ ID NO: 7445824 - DNA, 22 bp, Homo sapiens
ctgttggcattaagatagtcat

SEQ ID NO: 7445825 - DNA, 22 bp, Homo sapiens
ctgttggcctggtgatgaagct

SEQ ID NO: 7445826 - DNA, 22 bp, Homo sapiens
ctgttgcttcaggaaacagtaa

SEQ ID NO: 7445827 - DNA, 22 bp, Homo sapiens
cttcctggatgagcaggctgat

SEQ ID NO: 7445828 - DNA, 22 bp, Homo sapiens
cttcctggcaaagcaatcagag

SEQ ID NO: 7445829 - DNA, 22 bp, Homo sapiens
cttcctggcaaagcaatcagag

SEQ ID NO: 7445830 - DNA, 22 bp, Homo sapiens
cttcctggcaaagcaatcagag

SEQ ID NO: 7445831 - DNA, 22 bp, Homo sapiens
cttcctggcaaagcaatcagag

SEQ ID NO: 7445832 - DNA, 22 bp, Homo sapiens
cttcctggatgaagcccagcat

SEQ ID NO: 7445833 - DNA, 22 bp, Homo sapiens
cttcctggatgaagcccagcat

SEQ ID NO: 7445834 - DNA, 22 bp, Homo sapiens
cttcctggatgaagcccagcat

SEQ ID NO: 7445835 - DNA, 22 bp, Homo sapiens
cttcctggatgagcaggctgat

SEQ ID NO: 7445836 - DNA, 22 bp, Homo sapiens
cttcctgctcccctgccaattc

SEQ ID NO: 7445837 - DNA, 22 bp, Homo sapiens
cttcctgctcccctgccaattc

SEQ ID NO: 7445838 - DNA, 19 bp, Homo sapiens
cttcctggaggagagcctc

SEQ ID NO: 7445839 - DNA, 19 bp, Homo sapiens
cttcctggaggagagcctc

SEQ ID NO: 7445840 - DNA, 19 bp, Homo sapiens
cttcctggaggagagcctc

SEQ ID NO: 7445841 - DNA, 22 bp, Homo sapiens
cttcctggatgaacagtagaaa

SEQ ID NO: 7445842 - DNA, 19 bp, Homo sapiens
cttcctggaggagagcctc

SEQ ID NO: 7445843 - DNA, 22 bp, Homo sapiens
cttcctggatgaacagtagaaa

SEQ ID NO: 7445844 - DNA, 22 bp, Homo sapiens
cttcctgcccacttcctgctgg

SEQ ID NO: 7445845 - DNA, 22 bp, Homo sapiens
cttcctgcattgtgccagagtt

SEQ ID NO: 7445846 - DNA, 22 bp, Homo sapiens
cttcctgcccacttcctgctgg

SEQ ID NO: 7445847 - DNA, 22 bp, Homo sapiens
cttcctgcccacttcctgctgg

SEQ ID NO: 7445848 - DNA, 22 bp, Homo sapiens
cttcctgcccacttcctgctgg

SEQ ID NO: 7445849 - DNA, 22 bp, Homo sapiens
cttcctgcccacttcctgctgg

SEQ ID NO: 7445850 - DNA, 22 bp, Homo sapiens
cttcctgcccacttcctgctgg

SEQ ID NO: 7445851 - DNA, 22 bp, Homo sapiens
cttcctgcaggacagccatctg

SEQ ID NO: 7445852 - DNA, 22 bp, Homo sapiens
cttcctgcaggacagccatctg

SEQ ID NO: 7445853 - DNA, 22 bp, Homo sapiens
cttcctgaggtgctgagcacag

SEQ ID NO: 7445854 - DNA, 22 bp, Homo sapiens
cttcctgcaacacctgtgttgc

SEQ ID NO: 7445855 - DNA, 22 bp, Homo sapiens
cttcctgcaacacctgtgttgc

SEQ ID NO: 7445856 - DNA, 22 bp, Homo sapiens
cttcctgggcaatgttctgctt

SEQ ID NO: 7445857 - DNA, 22 bp, Homo sapiens
cttcctgggcaatgttctgctt

SEQ ID NO: 7445858 - DNA, 22 bp, Homo sapiens
cttcctgggccctgcttaagca

SEQ ID NO: 7445859 - DNA, 22 bp, Homo sapiens
cttcctgggccctgcttaagca

SEQ ID NO: 7445860 - DNA, 22 bp, Homo sapiens
cttcctgggccctgcttaagca

SEQ ID NO: 7445861 - DNA, 22 bp, Homo sapiens
cttcctgggacacctaactcta

SEQ ID NO: 7445862 - DNA, 22 bp, Homo sapiens
cttcctggctcggtgcctcacc

SEQ ID NO: 7445863 - DNA, 22 bp, Homo sapiens
cttcctgggacacctaactcta

SEQ ID NO: 7445864 - DNA, 22 bp, Homo sapiens
cttcctggctcggtgcctcacc

SEQ ID NO: 7445865 - DNA, 22 bp, Homo sapiens
cttcctggccattgccatggca

SEQ ID NO: 7445866 - DNA, 22 bp, Homo sapiens
cttcctggcatgggtctcatga

SEQ ID NO: 7445867 - DNA, 22 bp, Homo sapiens
cttcctggcatgggtctcatga

SEQ ID NO: 7445868 - DNA, 22 bp, Homo sapiens
cttcctggcatgggtctcatga

SEQ ID NO: 7445869 - DNA, 22 bp, Homo sapiens
cttcctggcatgggtctcatga

SEQ ID NO: 7445870 - DNA, 22 bp, Homo sapiens
cttcctgggtcagcctggaggt

SEQ ID NO: 7445871 - DNA, 22 bp, Homo sapiens
cttcctgggtctggagactgga

SEQ ID NO: 7445872 - DNA, 22 bp, Homo sapiens
cttcctgggtctggagactgga

SEQ ID NO: 7445873 - DNA, 22 bp, Homo sapiens
cttgacaagttttggacagcca

SEQ ID NO: 7445874 - DNA, 22 bp, Homo sapiens
cttgacactgtcactcaggcca

SEQ ID NO: 7445875 - DNA, 22 bp, Homo sapiens
cttgacactgtcactcaggcca

SEQ ID NO: 7445876 - DNA, 22 bp, Homo sapiens
cttgacactgtcactcaggcca

SEQ ID NO: 7445877 - DNA, 22 bp, Homo sapiens
cttgacactgtcactcaggcca

SEQ ID NO: 7445878 - DNA, 22 bp, Homo sapiens
cttgactctgtgatgaccttga

SEQ ID NO: 7445879 - DNA, 21 bp, Homo sapiens
cttgacatagcctgtcagctt

SEQ ID NO: 7445880 - DNA, 22 bp, Homo sapiens
cttgacagtcccaggaaaatag

SEQ ID NO: 7445881 - DNA, 22 bp, Homo sapiens
cttgacactgtcactcaggcca

SEQ ID NO: 7445882 - DNA, 22 bp, Homo sapiens
cttgacactgtcactcaggcca

SEQ ID NO: 7445883 - DNA, 22 bp, Homo sapiens
cttgacactgtcactcaggcca

SEQ ID NO: 7445884 - DNA, 22 bp, Homo sapiens
cttgcaagggcagggaggtggc

SEQ ID NO: 7445885 - DNA, 22 bp, Homo sapiens
cttgcacacatgtacatgtgta

SEQ ID NO: 7445886 - DNA, 22 bp, Homo sapiens
cttgatttattacccactatat

SEQ ID NO: 7445887 - DNA, 22 bp, Homo sapiens
cttgatggtggcagaagagtga

SEQ ID NO: 7445888 - DNA, 22 bp, Homo sapiens
cttgatgtataagttgatatgt

SEQ ID NO: 7445889 - DNA, 22 bp, Homo sapiens
cttgatttcagccttgtgatat

SEQ ID NO: 7445890 - DNA, 22 bp, Homo sapiens
cttgatttattacccactatat

SEQ ID NO: 7445891 - DNA, 22 bp, Homo sapiens
cttgatttcagccttgtgatat

SEQ ID NO: 7445892 - DNA, 22 bp, Homo sapiens
cttgatttcagccttgtgatat

SEQ ID NO: 7445893 - DNA, 22 bp, Homo sapiens
cttgatctacatagtgaaaccc

SEQ ID NO: 7445894 - DNA, 19 bp, Homo sapiens
cttgatcttggacttccag

SEQ ID NO: 7445895 - DNA, 22 bp, Homo sapiens
cttgatgaaatttttcaattgt

SEQ ID NO: 7445896 - DNA, 22 bp, Homo sapiens
cttgatgaatgacctgggtggt

SEQ ID NO: 7445897 - DNA, 22 bp, Homo sapiens
cttgatgactcaggaggaggag

SEQ ID NO: 7445898 - DNA, 19 bp, Homo sapiens
cttgatcttggacttccag

SEQ ID NO: 7445899 - DNA, 22 bp, Homo sapiens
cttgatctacatagtgaaaccc

SEQ ID NO: 7445900 - DNA, 22 bp, Homo sapiens
cttgagaaaggaacaggaagct

SEQ ID NO: 7445901 - DNA, 22 bp, Homo sapiens
cttgacttcttctagaaataag

SEQ ID NO: 7445902 - DNA, 22 bp, Homo sapiens
cttgacttcttctagaaataag

SEQ ID NO: 7445903 - DNA, 22 bp, Homo sapiens
cttgatggaggggccaggcttt

SEQ ID NO: 7445904 - DNA, 22 bp, Homo sapiens
cttgatggggtgatccagcacc

SEQ ID NO: 7445905 - DNA, 22 bp, Homo sapiens
cttgatgatagcaggcagggaa

SEQ ID NO: 7445906 - DNA, 22 bp, Homo sapiens
cttgatgatgacgtcggtgatg

SEQ ID NO: 7445907 - DNA, 22 bp, Homo sapiens
cttgatgatttgcagagggagt

SEQ ID NO: 7445908 - DNA, 22 bp, Homo sapiens
cttgatgagtcagaactgaagg

SEQ ID NO: 7445909 - DNA, 22 bp, Homo sapiens
cttgatgatagaatgtgaggag

SEQ ID NO: 7445910 - DNA, 22 bp, Homo sapiens
cttgatgaggtatgaacctctc

SEQ ID NO: 7445911 - DNA, 22 bp, Homo sapiens
cttgatgagcctagtgcttaga

SEQ ID NO: 7445912 - DNA, 20 bp, Homo sapiens
cttgatgagataaacagcag

SEQ ID NO: 7445913 - DNA, 20 bp, Homo sapiens
cttgatgagataaacagcag

SEQ ID NO: 7445914 - DNA, 22 bp, Homo sapiens
cttgcacatttcacacaatagg

SEQ ID NO: 7445915 - DNA, 22 bp, Homo sapiens
cttgcacatttcacacaatagg

SEQ ID NO: 7445916 - DNA, 22 bp, Homo sapiens
cttgcacagtgactaacacgta

SEQ ID NO: 7445917 - DNA, 22 bp, Homo sapiens
cttgcagatgtgactaaattaa

SEQ ID NO: 7445918 - DNA, 22 bp, Homo sapiens
cttgcacgcacatatttgtgca

SEQ ID NO: 7445919 - DNA, 22 bp, Homo sapiens
cttgcacgtcagatcttcctca

SEQ ID NO: 7445920 - DNA, 22 bp, Homo sapiens
cttgcacgtcagatcttcctca

SEQ ID NO: 7445921 - DNA, 22 bp, Homo sapiens
cttgcagaggctgttccagatg

SEQ ID NO: 7445922 - DNA, 23 bp, Homo sapiens
cttgcaggaagcagatggcacac

SEQ ID NO: 7445923 - DNA, 23 bp, Homo sapiens
cttgcaggaagcagatggcacac

SEQ ID NO: 7445924 - DNA, 23 bp, Homo sapiens
cttgcaggaagcagatggcacac

SEQ ID NO: 7445925 - DNA, 23 bp, Homo sapiens
cttgcaggaagcagatggcacac

SEQ ID NO: 7445926 - DNA, 22 bp, Homo sapiens
cttgcagccttaccaaggcatt

SEQ ID NO: 7445927 - DNA, 20 bp, Homo sapiens
cttgcaggagtgggtagagt

SEQ ID NO: 7445928 - DNA, 20 bp, Homo sapiens
cttgcaggagtgggtagagt

SEQ ID NO: 7445929 - DNA, 22 bp, Homo sapiens
cttgcaggattttgctgctgta

SEQ ID NO: 7445930 - DNA, 22 bp, Homo sapiens
cttgcaggattttgctgctgta

SEQ ID NO: 7445931 - DNA, 22 bp, Homo sapiens
cttgcagggctgatgggaagtg

SEQ ID NO: 7445932 - DNA, 22 bp, Homo sapiens
cttgcagtgtggccttgaagag

SEQ ID NO: 7445933 - DNA, 23 bp, Homo sapiens
cttgcagggctggaggcttagaa

SEQ ID NO: 7445934 - DNA, 23 bp, Homo sapiens
cttgcagggctggaggcttagaa

SEQ ID NO: 7445935 - DNA, 23 bp, Homo sapiens
cttgcagggctggaggcttagaa

SEQ ID NO: 7445936 - DNA, 22 bp, Homo sapiens
cttgcaggcctttctagctcta

SEQ ID NO: 7445937 - DNA, 22 bp, Homo sapiens
cttgcaggcctttctagctcta

SEQ ID NO: 7445938 - DNA, 22 bp, Homo sapiens
cttgcaggcctttctagctcta

SEQ ID NO: 7445939 - DNA, 22 bp, Homo sapiens
cttgcagggctgatgggaagtg

SEQ ID NO: 7445940 - DNA, 22 bp, Homo sapiens
cttgcagggctgatgggaagtg

SEQ ID NO: 7445941 - DNA, 22 bp, Homo sapiens
cttgcaggctacatggaacctg

SEQ ID NO: 7445942 - DNA, 22 bp, Homo sapiens
cttgcaggcccagccttacaag

SEQ ID NO: 7445943 - DNA, 22 bp, Homo sapiens
cttgcaggcccagccttacaag

SEQ ID NO: 7445944 - DNA, 22 bp, Homo sapiens
cttgcaggcccagccttacaag

SEQ ID NO: 7445945 - DNA, 22 bp, Homo sapiens
cttgcaggcagggcctcctgga

SEQ ID NO: 7445946 - DNA, 22 bp, Homo sapiens
cttgcaggcagggcctcctgga

SEQ ID NO: 7445947 - DNA, 22 bp, Homo sapiens
cttgcaggcagggcctcctgga

SEQ ID NO: 7445948 - DNA, 22 bp, Homo sapiens
cttgcaggcagggcctcctgga

SEQ ID NO: 7445949 - DNA, 22 bp, Homo sapiens
cttgcaggcagggacactgtct

SEQ ID NO: 7445950 - DNA, 22 bp, Homo sapiens
cttgcaggcagggacactgtct

SEQ ID NO: 7445951 - DNA, 22 bp, Homo sapiens
cttgcaggattttgctgctgta

SEQ ID NO: 7445952 - DNA, 22 bp, Homo sapiens
cttgcctacttgtcaaccagca

SEQ ID NO: 7445953 - DNA, 22 bp, Homo sapiens
cttgggtataaaacttggctat

SEQ ID NO: 7445954 - DNA, 22 bp, Homo sapiens
cttgggtcacaactctgaggtg

SEQ ID NO: 7445955 - DNA, 22 bp, Homo sapiens
cttgggtctgtcctgctgtgca

SEQ ID NO: 7445956 - DNA, 22 bp, Homo sapiens
cttgggtgctcagggaaagctt

SEQ ID NO: 7445957 - DNA, 22 bp, Homo sapiens
cttgggtgctggaggctgccgc

SEQ ID NO: 7445958 - DNA, 22 bp, Homo sapiens
cttgggtgctcagggaaagctt

SEQ ID NO: 7445959 - DNA, 22 bp, Homo sapiens
cttgggtgctcagggaaagctt

SEQ ID NO: 7445960 - DNA, 22 bp, Homo sapiens
cttgggtgctcagggaaagctt

SEQ ID NO: 7445961 - DNA, 20 bp, Homo sapiens
cttgcccagggtctcctgcc

SEQ ID NO: 7445962 - DNA, 20 bp, Homo sapiens
cttgcccagggtctcctgcc

SEQ ID NO: 7445963 - DNA, 20 bp, Homo sapiens
cttgcccagggtctcctgcc

SEQ ID NO: 7445964 - DNA, 20 bp, Homo sapiens
cttgcccagggtctcctgcc

SEQ ID NO: 7445965 - DNA, 22 bp, Homo sapiens
cttgcccaccagtcagtggctt

SEQ ID NO: 7445966 - DNA, 20 bp, Homo sapiens
cttgcccagggtctcctgcc

SEQ ID NO: 7445967 - DNA, 22 bp, Homo sapiens
cttgcccaccagtcagtggctt

SEQ ID NO: 7445968 - DNA, 22 bp, Homo sapiens
cttgcccaccagtcagtggctt

SEQ ID NO: 7445969 - DNA, 22 bp, Homo sapiens
cttgcccaccagtcagtggctt

SEQ ID NO: 7445970 - DNA, 20 bp, Homo sapiens
cttgccagttccctggcaga

SEQ ID NO: 7445971 - DNA, 22 bp, Homo sapiens
cttgccagtgttgcagaagctc

SEQ ID NO: 7445972 - DNA, 20 bp, Homo sapiens
cttgccagttccctggcaga

SEQ ID NO: 7445973 - DNA, 22 bp, Homo sapiens
cttgccatctaaccagactgcc

SEQ ID NO: 7445974 - DNA, 22 bp, Homo sapiens
cttgcattggctttcttggcag

SEQ ID NO: 7445975 - DNA, 20 bp, Homo sapiens
cttgcagtttcaccttcact

SEQ ID NO: 7445976 - DNA, 22 bp, Homo sapiens
cttgcatgcatttgaagatcat

SEQ ID NO: 7445977 - DNA, 22 bp, Homo sapiens
cttgcagtttaggtcctctgtg

SEQ ID NO: 7445978 - DNA, 22 bp, Homo sapiens
cttgcagtgtggccttgaagag

SEQ ID NO: 7445979 - DNA, 22 bp, Homo sapiens
cttgccagcacttggccagctg

SEQ ID NO: 7445980 - DNA, 22 bp, Homo sapiens
cttgccagcacttggccagctg

SEQ ID NO: 7445981 - DNA, 22 bp, Homo sapiens
cttgccaatggtacaaacgatt

SEQ ID NO: 7445982 - DNA, 22 bp, Homo sapiens
cttgccaaattaacatacagaa

SEQ ID NO: 7445983 - DNA, 22 bp, Homo sapiens
cttgccagtgttgcagaagctc

SEQ ID NO: 7445984 - DNA, 22 bp, Homo sapiens
cttgccagtgttgcagaagctc

SEQ ID NO: 7445985 - DNA, 22 bp, Homo sapiens
cttgccagtgttgcagaagctc

SEQ ID NO: 7445986 - DNA, 22 bp, Homo sapiens
cttgccagggactcagtcaggg

SEQ ID NO: 7445987 - DNA, 22 bp, Homo sapiens
cttgccagggactcagtcaggg

SEQ ID NO: 7445988 - DNA, 22 bp, Homo sapiens
cttgccagggactcagtcaggg

SEQ ID NO: 7445989 - DNA, 18 bp, Homo sapiens
cttgcagtgtgtggagaa

SEQ ID NO: 7445990 - DNA, 22 bp, Homo sapiens
cttgccagcacttggccagctg

SEQ ID NO: 7445991 - DNA, 22 bp, Homo sapiens
cttgccagcaggcgctgtgtac

SEQ ID NO: 7445992 - DNA, 22 bp, Homo sapiens
cttgccagcaggcgctgtgtac

SEQ ID NO: 7445993 - DNA, 22 bp, Homo sapiens
cttgccagcaggcgctgtgtac

SEQ ID NO: 7445994 - DNA, 22 bp, Homo sapiens
cttgccagcatttatagggatt

SEQ ID NO: 7445995 - DNA, 22 bp, Homo sapiens
cttgccaggatcagagtcacag

SEQ ID NO: 7445996 - DNA, 22 bp, Homo sapiens
cttgccaggatcagagtcacag

SEQ ID NO: 7445997 - DNA, 22 bp, Homo sapiens
cttgccaggatcagagtcacag

SEQ ID NO: 7445998 - DNA, 21 bp, Homo sapiens
cttgccaggccaggtgtcctc

SEQ ID NO: 7445999 - DNA, 22 bp, Homo sapiens
cttgtagaattgaaatggtctc

SEQ ID NO: 7446000 - DNA, 22 bp, Homo sapiens
cttgtagaattgaaatggtctc

SEQ ID NO: 7446001 - DNA, 22 bp, Homo sapiens
cttgtagaattgaaatggtctc

SEQ ID NO: 7446002 - DNA, 22 bp, Homo sapiens
cttgtagaattgaaatggtctc

SEQ ID NO: 7446003 - DNA, 22 bp, Homo sapiens
cttgtacattgatttctgcatt

SEQ ID NO: 7446004 - DNA, 22 bp, Homo sapiens
cttgtacattgatttctgcatt

SEQ ID NO: 7446005 - DNA, 22 bp, Homo sapiens
cttgtacattgatttctgcatt

SEQ ID NO: 7446006 - DNA, 22 bp, Homo sapiens
cttgtacattgatttctgcatt

SEQ ID NO: 7446007 - DNA, 22 bp, Homo sapiens
cttgtacatgataatctcactc

SEQ ID NO: 7446008 - DNA, 22 bp, Homo sapiens
cttgtacatgataatctcactc

SEQ ID NO: 7446009 - DNA, 22 bp, Homo sapiens
cttgtacatgataatctcactc

SEQ ID NO: 7446010 - DNA, 22 bp, Homo sapiens
cttgtacatgataatctcactc

SEQ ID NO: 7446011 - DNA, 22 bp, Homo sapiens
cttgtagacccctggactcacg

SEQ ID NO: 7446012 - DNA, 22 bp, Homo sapiens
cttgtagacccctggactcacg

SEQ ID NO: 7446013 - DNA, 22 bp, Homo sapiens
cttgtagacccctggactcacg

SEQ ID NO: 7446014 - DNA, 22 bp, Homo sapiens
cttgtagacccctggactcacg

SEQ ID NO: 7446015 - DNA, 22 bp, Homo sapiens
cttgtagacccctggactcacg

SEQ ID NO: 7446016 - DNA, 22 bp, Homo sapiens
cttgtagaattgaaatggtctc

SEQ ID NO: 7446017 - DNA, 22 bp, Homo sapiens
cttgtagaattgaaatggtctc

SEQ ID NO: 7446018 - DNA, 22 bp, Homo sapiens
cttgtagaattgaaatggtctc

SEQ ID NO: 7446019 - DNA, 22 bp, Homo sapiens
cttgtatacagagaaggctcat

SEQ ID NO: 7446020 - DNA, 22 bp, Homo sapiens
cttgtagctgcttcttctgaag

SEQ ID NO: 7446021 - DNA, 22 bp, Homo sapiens
cttgtagacccctggactcacg

SEQ ID NO: 7446022 - DNA, 22 bp, Homo sapiens
cttgggtgctggaggctgccgc

SEQ ID NO: 7446023 - DNA, 22 bp, Homo sapiens
cttgtacactcagtacttctag

SEQ ID NO: 7446024 - DNA, 22 bp, Homo sapiens
cttgggtgtgaccttggcattg

SEQ ID NO: 7446025 - DNA, 22 bp, Homo sapiens
cttgggtgctggaggctgccgc

SEQ ID NO: 7446026 - DNA, 22 bp, Homo sapiens
cttgggtgctggaggctgccgc

SEQ ID NO: 7446027 - DNA, 22 bp, Homo sapiens
cttgtacagatcttgcaaggac

SEQ ID NO: 7446028 - DNA, 22 bp, Homo sapiens
cttgtacagatcttgcaaggac

SEQ ID NO: 7446029 - DNA, 22 bp, Homo sapiens
cttgtacagatcttgcaaggac

SEQ ID NO: 7446030 - DNA, 22 bp, Homo sapiens
cttgtacaggaatccatggtat

SEQ ID NO: 7446031 - DNA, 22 bp, Homo sapiens
cttgtacaggaatccatggtat

SEQ ID NO: 7446032 - DNA, 22 bp, Homo sapiens
cttgtacaggaatccatggtat

SEQ ID NO: 7446033 - DNA, 22 bp, Homo sapiens
cttgtacaggaatccatggtat

SEQ ID NO: 7446034 - DNA, 22 bp, Homo sapiens
cttgtacaggatattataggct

SEQ ID NO: 7446035 - DNA, 22 bp, Homo sapiens
cttgtacaggatattataggct

SEQ ID NO: 7446036 - DNA, 22 bp, Homo sapiens
cttgtacaggatattataggct

SEQ ID NO: 7446037 - DNA, 22 bp, Homo sapiens
cttgtacaggatattataggct

SEQ ID NO: 7446038 - DNA, 20 bp, Homo sapiens
cttgtacatgataaagattt

SEQ ID NO: 7446039 - DNA, 20 bp, Homo sapiens
cttgtacatgataaagattt

SEQ ID NO: 7446040 - DNA, 20 bp, Homo sapiens
cttgtacatgataaagattt

SEQ ID NO: 7446041 - DNA, 20 bp, Homo sapiens
cttgtacatgataaagattt

SEQ ID NO: 7446042 - DNA, 20 bp, Homo sapiens
cttgtacatgataaagattt

SEQ ID NO: 7446043 - DNA, 20 bp, Homo sapiens
cttgtacatgataaagattt

SEQ ID NO: 7446044 - DNA, 20 bp, Homo sapiens
cttgtacatgataaagattt

SEQ ID NO: 7446045 - DNA, 22 bp, Homo sapiens
cttgtacatcactggcagatgg

SEQ ID NO: 7446046 - DNA, 22 bp, Homo sapiens
cttgtacatcactggcagatgg

SEQ ID NO: 7446047 - DNA, 22 bp, Homo sapiens
cttgtacatcactggcagatgg

SEQ ID NO: 7446048 - DNA, 22 bp, Homo sapiens
cttgtacatcactggcagatgg

SEQ ID NO: 7446049 - DNA, 22 bp, Homo sapiens
cttgtacagggaggcctgtggt

SEQ ID NO: 7446050 - DNA, 22 bp, Homo sapiens
cttgtacagggaggcctgtggt

SEQ ID NO: 7446051 - DNA, 22 bp, Homo sapiens
cttgtacaggatattataggct

SEQ ID NO: 7446052 - DNA, 22 bp, Homo sapiens
cttgtacaggtctgttgtgggc

SEQ ID NO: 7446053 - DNA, 22 bp, Homo sapiens
cttgtacaggtctgttgtgggc

SEQ ID NO: 7446054 - DNA, 22 bp, Homo sapiens
cttgtacagggaggcctgtggt

SEQ ID NO: 7446055 - DNA, 22 bp, Homo sapiens
cttgtacaggtctgttgtgggc

SEQ ID NO: 7446056 - DNA, 22 bp, Homo sapiens
cttgtacatagagaagaagcct

SEQ ID NO: 7446057 - DNA, 22 bp, Homo sapiens
cttgtacatagagaagaagcct

SEQ ID NO: 7446058 - DNA, 22 bp, Homo sapiens
cttgtacatagagaagaagcct

SEQ ID NO: 7446059 - DNA, 22 bp, Homo sapiens
cttgtacatagagaagaagcct

SEQ ID NO: 7446060 - DNA, 22 bp, Homo sapiens
cttgtacatagagaagaagcct

SEQ ID NO: 7446061 - DNA, 22 bp, Homo sapiens
cttgtcactctggctccagagc

SEQ ID NO: 7446062 - DNA, 22 bp, Homo sapiens
cttgtcaagtcactttaacctc

SEQ ID NO: 7446063 - DNA, 22 bp, Homo sapiens
cttgtattgctgttttgcatct

SEQ ID NO: 7446064 - DNA, 22 bp, Homo sapiens
cttgtcactctggctccagagc

SEQ ID NO: 7446065 - DNA, 22 bp, Homo sapiens
cttgtcacagcacctcagtctc

SEQ ID NO: 7446066 - DNA, 22 bp, Homo sapiens
cttgtcactctggctccagagc

SEQ ID NO: 7446067 - DNA, 22 bp, Homo sapiens
cttgtcagccaattgtggattt

SEQ ID NO: 7446068 - DNA, 22 bp, Homo sapiens
cttgtcagccaattgtggattt

SEQ ID NO: 7446069 - DNA, 22 bp, Homo sapiens
cttgtcagccaattgtggattt

SEQ ID NO: 7446070 - DNA, 22 bp, Homo sapiens
cttgtcagccaattgtggattt

SEQ ID NO: 7446071 - DNA, 22 bp, Homo sapiens
cttgtcagccaattgtggattt

SEQ ID NO: 7446072 - DNA, 22 bp, Homo sapiens
cttgtcagccaattgtggattt

SEQ ID NO: 7446073 - DNA, 22 bp, Homo sapiens
cttgtcagccaattgtggattt

SEQ ID NO: 7446074 - DNA, 22 bp, Homo sapiens
cttgtattgctgttttgcatct

SEQ ID NO: 7446075 - DNA, 22 bp, Homo sapiens
cttgtattctgcctaaccttca

SEQ ID NO: 7446076 - DNA, 22 bp, Homo sapiens
cttgtattctgcctaaccttca

SEQ ID NO: 7446077 - DNA, 22 bp, Homo sapiens
cttgtattcttgtacctttcaa

SEQ ID NO: 7446078 - DNA, 22 bp, Homo sapiens
cttgtattcttccacttaagat

SEQ ID NO: 7446079 - DNA, 22 bp, Homo sapiens
cttgtatagggaaagataaatc

SEQ ID NO: 7446080 - DNA, 22 bp, Homo sapiens
cttgtatacagtgtacacattg

SEQ ID NO: 7446081 - DNA, 22 bp, Homo sapiens
cttgtattaagcttagagaggc

SEQ ID NO: 7446082 - DNA, 22 bp, Homo sapiens
cttgtatatagcatgagtttga

SEQ ID NO: 7446083 - DNA, 22 bp, Homo sapiens
cttgtattaggaagaatgcttt

SEQ ID NO: 7446084 - DNA, 22 bp, Homo sapiens
cttgtattaggaagaatgcttt

SEQ ID NO: 7446085 - DNA, 22 bp, Homo sapiens
cttgtattaggaagaatgcttt

SEQ ID NO: 7446086 - DNA, 22 bp, Homo sapiens
cttgtattaagcttagagaggc

SEQ ID NO: 7446087 - DNA, 22 bp, Homo sapiens
cttgtattatggttcgcttagt

SEQ ID NO: 7446088 - DNA, 22 bp, Homo sapiens
cttgtattaggaagaatgcttt

SEQ ID NO: 7446089 - DNA, 22 bp, Homo sapiens
cttgtattaggaagaatgcttt

SEQ ID NO: 7446090 - DNA, 22 bp, Homo sapiens
cttgtattcccctatctctaaa

SEQ ID NO: 7446091 - DNA, 22 bp, Homo sapiens
cttgtattcagcatcttaacta

SEQ ID NO: 7446092 - DNA, 22 bp, Homo sapiens
cttgtattcccctatctctaaa

SEQ ID NO: 7446093 - DNA, 22 bp, Homo sapiens
cttgtattcccctatctctaaa

SEQ ID NO: 7446094 - DNA, 22 bp, Homo sapiens
cttgtattcagcatcttaacta

SEQ ID NO: 7446095 - DNA, 22 bp, Homo sapiens
cttgtattcagagtggacatga

SEQ ID NO: 7446096 - DNA, 22 bp, Homo sapiens
cttgtattcagagtggacatga

SEQ ID NO: 7446097 - DNA, 22 bp, Homo sapiens
cttgtattcagagtggacatga

SEQ ID NO: 7446098 - DNA, 22 bp, Homo sapiens
cttgtattcagagtggacatga

SEQ ID NO: 7446099 - DNA, 23 bp, Homo sapiens
cttgtattcactcatttgggaac

SEQ ID NO: 7446100 - DNA, 22 bp, Homo sapiens
cttgtcctttacttgagactca

SEQ ID NO: 7446101 - DNA, 22 bp, Homo sapiens
cttgtcaggtaggtgtcatttc

SEQ ID NO: 7446102 - DNA, 22 bp, Homo sapiens
cttgtcagtgtactttcttttg

SEQ ID NO: 7446103 - DNA, 22 bp, Homo sapiens
cttgtcaggtaggtgtcatttc

SEQ ID NO: 7446104 - DNA, 22 bp, Homo sapiens
cttgtcagtcaaggtgtgcagg

SEQ ID NO: 7446105 - DNA, 22 bp, Homo sapiens
cttgtcagccaattgtggattt

SEQ ID NO: 7446106 - DNA, 22 bp, Homo sapiens
cttgtcagccaattgtggattt

SEQ ID NO: 7446107 - DNA, 22 bp, Homo sapiens
cttgtcagccaattgtggattt

SEQ ID NO: 7446108 - DNA, 22 bp, Homo sapiens
cttgtctagttcctggtgatgt

SEQ ID NO: 7446109 - DNA, 21 bp, Homo sapiens
cttgtctgcagtgtttatagc

SEQ ID NO: 7446110 - DNA, 22 bp, Homo sapiens
cttgtctgataatggggccaac

SEQ ID NO: 7446111 - DNA, 22 bp, Homo sapiens
cttgtctgctataaaaatccag

SEQ ID NO: 7446112 - DNA, 22 bp, Homo sapiens
cttgtctgggcagcttgggagt

SEQ ID NO: 7446113 - DNA, 22 bp, Homo sapiens
cttgtctgggcagcttgggagt

SEQ ID NO: 7446114 - DNA, 22 bp, Homo sapiens
cttgtctgataatggggccaac

SEQ ID NO: 7446115 - DNA, 22 bp, Homo sapiens
cttgtctgataatggggccaac

SEQ ID NO: 7446116 - DNA, 23 bp, Homo sapiens
cttgtctaattcatggtgaaggc

SEQ ID NO: 7446117 - DNA, 22 bp, Homo sapiens
cttgtcctttacttgagactca

SEQ ID NO: 7446118 - DNA, 22 bp, Homo sapiens
cttgtcctttacttgagactca

SEQ ID NO: 7446119 - DNA, 22 bp, Homo sapiens
cttgtccgaggagacgcggaag

SEQ ID NO: 7446120 - DNA, 22 bp, Homo sapiens
cttgtcagtgtactttcttttg

SEQ ID NO: 7446121 - DNA, 22 bp, Homo sapiens
cttgtcttgcacacggttgcca

SEQ ID NO: 7446122 - DNA, 21 bp, Homo sapiens
cttgtcttgcttagaatagac

SEQ ID NO: 7446123 - DNA, 22 bp, Homo sapiens
cttgtctttatttcatattcca

SEQ ID NO: 7446124 - DNA, 21 bp, Homo sapiens
cttgtcttgcttagaatagac

SEQ ID NO: 7446125 - DNA, 22 bp, Homo sapiens
cttgtctttatttcatattcca

SEQ ID NO: 7446126 - DNA, 22 bp, Homo sapiens
cttgtcttgcacacggttgcca

SEQ ID NO: 7446127 - DNA, 22 bp, Homo sapiens
cttgtcttgcacacggttgcca

SEQ ID NO: 7446128 - DNA, 22 bp, Homo sapiens
cttgtcttgcacacggttgcca

SEQ ID NO: 7446129 - DNA, 22 bp, Homo sapiens
cttgtcttgcacacggttgcca

SEQ ID NO: 7446130 - DNA, 22 bp, Homo sapiens
cttgtctgtgtcggataaaact

SEQ ID NO: 7446131 - DNA, 22 bp, Homo sapiens
cttgtctgtgtcggataaaact

SEQ ID NO: 7446132 - DNA, 16 bp, Homo sapiens
cttgtctgttgctcat

SEQ ID NO: 7446133 - DNA, 22 bp, Homo sapiens
ctttatgtccaccagactgcaa

SEQ ID NO: 7446134 - DNA, 22 bp, Homo sapiens
ctttatgtccaccagactgcaa

SEQ ID NO: 7446135 - DNA, 22 bp, Homo sapiens
ctttatgtccttgaagagttgt

SEQ ID NO: 7446136 - DNA, 22 bp, Homo sapiens
ctttatgtccttgaagagttgt

SEQ ID NO: 7446137 - DNA, 22 bp, Homo sapiens
ctttatgtccaccagactgcaa

SEQ ID NO: 7446138 - DNA, 22 bp, Homo sapiens
ctttatggtaagtatagatgac

SEQ ID NO: 7446139 - DNA, 22 bp, Homo sapiens
ctttatgtactgtgtatttgaa

SEQ ID NO: 7446140 - DNA, 22 bp, Homo sapiens
cttgtctttatttcatattcca

SEQ ID NO: 7446141 - DNA, 22 bp, Homo sapiens
cttgtctttatttcatattcca

SEQ ID NO: 7446142 - DNA, 22 bp, Homo sapiens
ctttatggaatcaaagactgga

SEQ ID NO: 7446143 - DNA, 22 bp, Homo sapiens
ctgttctggagacactgatgaa

SEQ ID NO: 7446144 - DNA, 22 bp, Homo sapiens
ctgttctgtaagctgctgttgt

SEQ ID NO: 7446145 - DNA, 22 bp, Homo sapiens
ctgttctgtctcatgttgcaca

SEQ ID NO: 7446146 - DNA, 22 bp, Homo sapiens
ctgttctgtctcatgttgcaca

SEQ ID NO: 7446147 - DNA, 22 bp, Homo sapiens
ctgttctgtctcatgttgcaca

SEQ ID NO: 7446148 - DNA, 22 bp, Homo sapiens
ctgttctgaccagtgcagggat

SEQ ID NO: 7446149 - DNA, 22 bp, Homo sapiens
ctgttctgctgcataaaaactt

SEQ ID NO: 7446150 - DNA, 22 bp, Homo sapiens
ctgttctgctgcataaaaactt

SEQ ID NO: 7446151 - DNA, 22 bp, Homo sapiens
ctgttctggagacactgatgaa

SEQ ID NO: 7446152 - DNA, 18 bp, Homo sapiens
ctgttgagatgtggctga

SEQ ID NO: 7446153 - DNA, 22 bp, Homo sapiens
ctgttctttagttccactgcaa

SEQ ID NO: 7446154 - DNA, 22 bp, Homo sapiens
ctgttcttctgggaatggccct

SEQ ID NO: 7446155 - DNA, 22 bp, Homo sapiens
ctgttcttctagtccactgaca

SEQ ID NO: 7446156 - DNA, 22 bp, Homo sapiens
ctgttcttctgggaatggccct

SEQ ID NO: 7446157 - DNA, 22 bp, Homo sapiens
ctgttcttctagtccactgaca

SEQ ID NO: 7446158 - DNA, 22 bp, Homo sapiens
ctgttcttctagtccactgaca

SEQ ID NO: 7446159 - DNA, 22 bp, Homo sapiens
ctgttcttatcgtcttaatatc

SEQ ID NO: 7446160 - DNA, 22 bp, Homo sapiens
ctgttcttatcgtcttaatatc

SEQ ID NO: 7446161 - DNA, 22 bp, Homo sapiens
ctgttgctctgaacaggtcttg

SEQ ID NO: 7446162 - DNA, 22 bp, Homo sapiens
ctgttgctctgaacaggtcttg

SEQ ID NO: 7446163 - DNA, 22 bp, Homo sapiens
ctgttgctccagggaacacaga

SEQ ID NO: 7446164 - DNA, 22 bp, Homo sapiens
ctgttgctcccagggagagggt

SEQ ID NO: 7446165 - DNA, 22 bp, Homo sapiens
ctgttgctctgaacaggtcttg

SEQ ID NO: 7446166 - DNA, 22 bp, Homo sapiens
ctgttgctctgaacaggtcttg

SEQ ID NO: 7446167 - DNA, 22 bp, Homo sapiens
ctgttgctgaggttcaagggtc

SEQ ID NO: 7446168 - DNA, 22 bp, Homo sapiens
ctgttgcttcaggaaacagtaa

SEQ ID NO: 7446169 - DNA, 22 bp, Homo sapiens
ctgttgctgggaacgcatgtca

SEQ ID NO: 7446170 - DNA, 19 bp, Homo sapiens
ctgttgctggggctctctt

SEQ ID NO: 7446171 - DNA, 19 bp, Homo sapiens
ctgttgctggggctctctt

SEQ ID NO: 7446172 - DNA, 22 bp, Homo sapiens
ctgttgatctcagttagctaga

SEQ ID NO: 7446173 - DNA, 18 bp, Homo sapiens
ctgttgagatgtggctga

SEQ ID NO: 7446174 - DNA, 22 bp, Homo sapiens
ctgttgcatcatggctcttaat

SEQ ID NO: 7446175 - DNA, 22 bp, Homo sapiens
ctgttgattagaatttcacatc

SEQ ID NO: 7446176 - DNA, 22 bp, Homo sapiens
ctgttgcatgactgtgcatgct

SEQ ID NO: 7446177 - DNA, 22 bp, Homo sapiens
ctgttgctaagtagtgcaggta

SEQ ID NO: 7446178 - DNA, 22 bp, Homo sapiens
ctgttgctaagtagtgcaggta

SEQ ID NO: 7446179 - DNA, 22 bp, Homo sapiens
ctgttctgaactgcctgcatgc

SEQ ID NO: 7446180 - DNA, 22 bp, Homo sapiens
ctgttctgaactgcctgcatgc

SEQ ID NO: 7446181 - DNA, 22 bp, Homo sapiens
ctgttctctggcggtggctgtt

SEQ ID NO: 7446182 - DNA, 22 bp, Homo sapiens
ctgttctctggcggtggctgtt

SEQ ID NO: 7446183 - DNA, 22 bp, Homo sapiens
ctgttctgaactgcctgcatgc

SEQ ID NO: 7446184 - DNA, 22 bp, Homo sapiens
ctgttctgaccagtgcagggat

SEQ ID NO: 7446185 - DNA, 22 bp, Homo sapiens
ctgttctgaccagtgcagggat

SEQ ID NO: 7446186 - DNA, 22 bp, Homo sapiens
ctgttctgaccagtgcagggat

SEQ ID NO: 7446187 - DNA, 22 bp, Homo sapiens
ctgttctgaccagtgcagggat

SEQ ID NO: 7446188 - DNA, 22 bp, Homo sapiens
ctgttctgaccagtgcagggat

SEQ ID NO: 7446189 - DNA, 20 bp, Homo sapiens
ctgttcctgtcccatgaagc

SEQ ID NO: 7446190 - DNA, 22 bp, Homo sapiens
ctgttcctgtagagtccaagtc

SEQ ID NO: 7446191 - DNA, 22 bp, Homo sapiens
ctgttcctgtagagtccaagtc

SEQ ID NO: 7446192 - DNA, 20 bp, Homo sapiens
ctgttcctgtcccatgaagc

SEQ ID NO: 7446193 - DNA, 17 bp, Homo sapiens
ctgttccccactactca

SEQ ID NO: 7446194 - DNA, 22 bp, Homo sapiens
ctgttctccggccagtccagag

SEQ ID NO: 7446195 - DNA, 22 bp, Homo sapiens
ctgttctatcattaaaagctat

SEQ ID NO: 7446196 - DNA, 22 bp, Homo sapiens
ctgttcacagaatcctcccctg

SEQ ID NO: 7446197 - DNA, 22 bp, Homo sapiens
ctgttcacagaatcctcccctg

SEQ ID NO: 7446198 - DNA, 22 bp, Homo sapiens
ctgttcaatttgtttcagttat

SEQ ID NO: 7446199 - DNA, 22 bp, Homo sapiens
ctgttactaatcttttctgcta

SEQ ID NO: 7446200 - DNA, 22 bp, Homo sapiens
ctgttattttcctctgaactct

SEQ ID NO: 7446201 - DNA, 21 bp, Homo sapiens
ctgttcactgtgctgtgcaaa

SEQ ID NO: 7446202 - DNA, 22 bp, Homo sapiens
ctgttcagaaaaaatcttcatg

SEQ ID NO: 7446203 - DNA, 21 bp, Homo sapiens
ctgttcactgtgctgtgcaaa

SEQ ID NO: 7446204 - DNA, 22 bp, Homo sapiens
ctgttcagaaaaaatcttcatg

SEQ ID NO: 7446205 - DNA, 22 bp, Homo sapiens
ctgttcagaaaaaatcttcatg

SEQ ID NO: 7446206 - DNA, 22 bp, Homo sapiens
ctgttcagatggcacattcagt

SEQ ID NO: 7446207 - DNA, 22 bp, Homo sapiens
ctgttcagatggcacattcagt

SEQ ID NO: 7446208 - DNA, 22 bp, Homo sapiens
ctgttcatggaaaaatagttgg

SEQ ID NO: 7446209 - DNA, 22 bp, Homo sapiens
ctgttcatggaaaaatagttgg

SEQ ID NO: 7446210 - DNA, 22 bp, Homo sapiens
ctgttcagtaacctataaaaca

SEQ ID NO: 7446211 - DNA, 22 bp, Homo sapiens
ctgttcatgctgattctgtatg

SEQ ID NO: 7446212 - DNA, 22 bp, Homo sapiens
ctgttccagatcaggacaccgt

SEQ ID NO: 7446213 - DNA, 18 bp, Homo sapiens
ctgttcagctgaactaca

SEQ ID NO: 7446214 - DNA, 18 bp, Homo sapiens
ctgttcagctgaactaca

SEQ ID NO: 7446215 - DNA, 18 bp, Homo sapiens
ctgttcagctgaactaca

SEQ ID NO: 7446216 - DNA, 18 bp, Homo sapiens
ctgttcagctgaactaca

SEQ ID NO: 7446217 - DNA, 22 bp, Homo sapiens
ctgttcagtaacctataaaaca

SEQ ID NO: 7446218 - DNA, 22 bp, Homo sapiens
ctgttcagtaacctataaaaca

SEQ ID NO: 7446219 - DNA, 22 bp, Homo sapiens
ctgtgtcttcaatgtactggga

SEQ ID NO: 7446220 - DNA, 22 bp, Homo sapiens
ctgtgtcttcaatgtactggga

SEQ ID NO: 7446221 - DNA, 22 bp, Homo sapiens
ctgtgtcttcaatgtactggga

SEQ ID NO: 7446222 - DNA, 22 bp, Homo sapiens
ctgtgtcttcaatgtactggga

SEQ ID NO: 7446223 - DNA, 22 bp, Homo sapiens
ctgtgtcttcaatgtactggga

SEQ ID NO: 7446224 - DNA, 22 bp, Homo sapiens
ctgtgtctgtggaatagcgaat

SEQ ID NO: 7446225 - DNA, 22 bp, Homo sapiens
ctgtgtctgtggaatagcgaat

SEQ ID NO: 7446226 - DNA, 22 bp, Homo sapiens
ctgtgtctgtggaatagcgaat

SEQ ID NO: 7446227 - DNA, 22 bp, Homo sapiens
ctgtgtcttcctctgcccaggc

SEQ ID NO: 7446228 - DNA, 22 bp, Homo sapiens
ctgtgtcttctgcttacagtct

SEQ ID NO: 7446229 - DNA, 22 bp, Homo sapiens
ctgtgtcttcacatttgtgtgc

SEQ ID NO: 7446230 - DNA, 22 bp, Homo sapiens
ctgtgtcttcctctgcccaggc

SEQ ID NO: 7446231 - DNA, 22 bp, Homo sapiens
ctgtgtcttcacatttgtgtgc

SEQ ID NO: 7446232 - DNA, 22 bp, Homo sapiens
ctgtgtcttcacatttgtgtgc

SEQ ID NO: 7446233 - DNA, 22 bp, Homo sapiens
ctgtgtcttcacatttgtgtgc

SEQ ID NO: 7446234 - DNA, 23 bp, Homo sapiens
ctgttaaattccttaagagcagg

SEQ ID NO: 7446235 - DNA, 22 bp, Homo sapiens
ctgttaagcaacatgagtaagt

SEQ ID NO: 7446236 - DNA, 22 bp, Homo sapiens
ctgttaagcaacatgagtaagt

SEQ ID NO: 7446237 - DNA, 22 bp, Homo sapiens
ctgtgtcttcctctgcccaggc

SEQ ID NO: 7446238 - DNA, 22 bp, Homo sapiens
ctgtgtcttctgcttacagtct

SEQ ID NO: 7446239 - DNA, 22 bp, Homo sapiens
ctgtgtcttctgcttacagtct

SEQ ID NO: 7446240 - DNA, 22 bp, Homo sapiens
ctgttaatggaggactacagga

SEQ ID NO: 7446241 - DNA, 22 bp, Homo sapiens
ctgtgtcttctgcttacagtct

SEQ ID NO: 7446242 - DNA, 23 bp, Homo sapiens
ctgttaaattccttaagagcagg

SEQ ID NO: 7446243 - DNA, 22 bp, Homo sapiens
ctgttaagtgtagataatgtgg

SEQ ID NO: 7446244 - DNA, 22 bp, Homo sapiens
ctgttaagtgtagataatgtgg

SEQ ID NO: 7446245 - DNA, 22 bp, Homo sapiens
ctgttacatagcttttcttaac

SEQ ID NO: 7446246 - DNA, 22 bp, Homo sapiens
ctgttacaagagagagacatga

SEQ ID NO: 7446247 - DNA, 22 bp, Homo sapiens
ctgttacaagagagagacatga

SEQ ID NO: 7446248 - DNA, 22 bp, Homo sapiens
ctgttacacggaccttcaaatc

SEQ ID NO: 7446249 - DNA, 17 bp, Homo sapiens
ctgttaattcatttccc

SEQ ID NO: 7446250 - DNA, 17 bp, Homo sapiens
ctgttaattcatttccc

SEQ ID NO: 7446251 - DNA, 17 bp, Homo sapiens
ctgttaattcatttccc

SEQ ID NO: 7446252 - DNA, 22 bp, Homo sapiens
ctgtgtctcatccgcctctggc

SEQ ID NO: 7446253 - DNA, 23 bp, Homo sapiens
ctgtgtctatgcagccatatcca

SEQ ID NO: 7446254 - DNA, 22 bp, Homo sapiens
ctgtgtctcatccgcctctggc

SEQ ID NO: 7446255 - DNA, 22 bp, Homo sapiens
ctgtgtctcatccgcctctggc

SEQ ID NO: 7446256 - DNA, 22 bp, Homo sapiens
ctgtgtctcatccgcctctggc

SEQ ID NO: 7446257 - DNA, 22 bp, Homo sapiens
ctgtgtctcccaaggagggtca

SEQ ID NO: 7446258 - DNA, 22 bp, Homo sapiens
ctgtgtctcatccgcctctggc

SEQ ID NO: 7446259 - DNA, 22 bp, Homo sapiens
ctgtgtctccttggtgggatat

SEQ ID NO: 7446260 - DNA, 22 bp, Homo sapiens
ctgtgtctccttggtgggatat

SEQ ID NO: 7446261 - DNA, 22 bp, Homo sapiens
ctgtgtctccttggtgggatat

SEQ ID NO: 7446262 - DNA, 22 bp, Homo sapiens
ctgtgtctcccaaggagggtca

SEQ ID NO: 7446263 - DNA, 22 bp, Homo sapiens
ctgtgtctcccaaggagggtca

SEQ ID NO: 7446264 - DNA, 22 bp, Homo sapiens
ctgtgtctcgttaaagcattgg

SEQ ID NO: 7446265 - DNA, 22 bp, Homo sapiens
ctgtgtctcgttaaagcattgg

SEQ ID NO: 7446266 - DNA, 22 bp, Homo sapiens
ctgtgtctcgttaaagcattgg

SEQ ID NO: 7446267 - DNA, 22 bp, Homo sapiens
ctgtgtctctacctccccatcc

SEQ ID NO: 7446268 - DNA, 22 bp, Homo sapiens
ctgtgtctctacctccccatcc

SEQ ID NO: 7446269 - DNA, 22 bp, Homo sapiens
ctgtgtctctacctccccatcc

SEQ ID NO: 7446270 - DNA, 22 bp, Homo sapiens
ctgtgtctctccttacaagact

SEQ ID NO: 7446271 - DNA, 22 bp, Homo sapiens
ctgtgtctctccttacaagact

SEQ ID NO: 7446272 - DNA, 22 bp, Homo sapiens
ctgtgtctctccttacaagact

SEQ ID NO: 7446273 - DNA, 22 bp, Homo sapiens
ctgtgtctctccttacaagact

SEQ ID NO: 7446274 - DNA, 22 bp, Homo sapiens
ctgtgtctgaataactctgtgt

SEQ ID NO: 7446275 - DNA, 22 bp, Homo sapiens
ctgtgtctgcctgggatccatt

SEQ ID NO: 7446276 - DNA, 22 bp, Homo sapiens
ctgtgtctgcctgggatccatt

SEQ ID NO: 7446277 - DNA, 22 bp, Homo sapiens
ctgtgtctgcctgggatccatt

SEQ ID NO: 7446278 - DNA, 22 bp, Homo sapiens
ctgtgtctgcctgggatccatt

SEQ ID NO: 7446279 - DNA, 22 bp, Homo sapiens
ctgtgtctgaataactctgtgt

SEQ ID NO: 7446280 - DNA, 22 bp, Homo sapiens
ctgtgtctctccttacaagact

SEQ ID NO: 7446281 - DNA, 22 bp, Homo sapiens
ctgtgtctgaataactctgtgt

SEQ ID NO: 7446282 - DNA, 22 bp, Homo sapiens
ctgtgtctgaataactctgtgt

SEQ ID NO: 7446283 - DNA, 22 bp, Homo sapiens
ctgtgtagcctcatgtgggctt

SEQ ID NO: 7446284 - DNA, 22 bp, Homo sapiens
ctgtgtagagcggctgcgagcg

SEQ ID NO: 7446285 - DNA, 22 bp, Homo sapiens
ctgtgtagagcggctgcgagcg

SEQ ID NO: 7446286 - DNA, 22 bp, Homo sapiens
ctgtggttggagtgcagtgaga

SEQ ID NO: 7446287 - DNA, 22 bp, Homo sapiens
ctgtggttggagtgcagtgaga

SEQ ID NO: 7446288 - DNA, 22 bp, Homo sapiens
ctgtggtggcctccctgccatg

SEQ ID NO: 7446289 - DNA, 22 bp, Homo sapiens
ctgtggtggcctccctgccatg

SEQ ID NO: 7446290 - DNA, 22 bp, Homo sapiens
ctgtggtggcctccctgccatg

SEQ ID NO: 7446291 - DNA, 22 bp, Homo sapiens
ctgtggtgggccctgggcttca

SEQ ID NO: 7446292 - DNA, 22 bp, Homo sapiens
ctgtggctgtatttggccagag

SEQ ID NO: 7446293 - DNA, 22 bp, Homo sapiens
ctgtggctgtatttggccagag

SEQ ID NO: 7446294 - DNA, 22 bp, Homo sapiens
ctgtggcttcagcattcagagc

SEQ ID NO: 7446295 - DNA, 22 bp, Homo sapiens
ctgtggctgtgaaacttctcag

SEQ ID NO: 7446296 - DNA, 22 bp, Homo sapiens
ctgtggctgcgtaggtctggca

SEQ ID NO: 7446297 - DNA, 22 bp, Homo sapiens
ctgtggctgcgtaggtctggca

SEQ ID NO: 7446298 - DNA, 22 bp, Homo sapiens
ctgtggctggaataataaatgt

SEQ ID NO: 7446299 - DNA, 22 bp, Homo sapiens
ctgtggctgcgtaggtctggca

SEQ ID NO: 7446300 - DNA, 22 bp, Homo sapiens
ctgtggctggcctgtctgacat

SEQ ID NO: 7446301 - DNA, 22 bp, Homo sapiens
ctgtggctggcctgtctgacat

SEQ ID NO: 7446302 - DNA, 22 bp, Homo sapiens
ctgtggctggctcatcataggt

SEQ ID NO: 7446303 - DNA, 22 bp, Homo sapiens
ctgtggctgtatttggccagag

SEQ ID NO: 7446304 - DNA, 22 bp, Homo sapiens
ctgtggctgtatttggccagag

SEQ ID NO: 7446305 - DNA, 22 bp, Homo sapiens
ctgtggctgtatttggccagag

SEQ ID NO: 7446306 - DNA, 22 bp, Homo sapiens
ctgtggctgtatttggccagag

SEQ ID NO: 7446307 - DNA, 22 bp, Homo sapiens
ctgtgtatctctgtgggacaga

SEQ ID NO: 7446308 - DNA, 22 bp, Homo sapiens
ctgtgtagtcaggtggtcccac

SEQ ID NO: 7446309 - DNA, 22 bp, Homo sapiens
ctgtgtcctccccatcacttct

SEQ ID NO: 7446310 - DNA, 22 bp, Homo sapiens
ctgtgtcctcccgctgcaccca

SEQ ID NO: 7446311 - DNA, 22 bp, Homo sapiens
ctgtgtcctcccgctgcaccca

SEQ ID NO: 7446312 - DNA, 22 bp, Homo sapiens
ctgtgtcctgcgtcaagccaat

SEQ ID NO: 7446313 - DNA, 22 bp, Homo sapiens
ctgtgtcctcccgctgcaccca

SEQ ID NO: 7446314 - DNA, 22 bp, Homo sapiens
ctgtgtcctgtctcctaaggtg

SEQ ID NO: 7446315 - DNA, 22 bp, Homo sapiens
ctgtgtcctgtctcctaaggtg

SEQ ID NO: 7446316 - DNA, 22 bp, Homo sapiens
ctgtgtcctgtctcctaaggtg

SEQ ID NO: 7446317 - DNA, 22 bp, Homo sapiens
ctgtgtctaatcaggtcagtca

SEQ ID NO: 7446318 - DNA, 22 bp, Homo sapiens
ctgtgtctaatcttatacatca

SEQ ID NO: 7446319 - DNA, 22 bp, Homo sapiens
ctgtgtctaatcaggtcagtca

SEQ ID NO: 7446320 - DNA, 22 bp, Homo sapiens
ctgtgtccttttagttgctgtg

SEQ ID NO: 7446321 - DNA, 22 bp, Homo sapiens
ctgtgtctaatcaggtcagtca

SEQ ID NO: 7446322 - DNA, 22 bp, Homo sapiens
ctgtgtcctttaaaaaagacac

SEQ ID NO: 7446323 - DNA, 22 bp, Homo sapiens
ctgtgtccttttagttgctgtg

SEQ ID NO: 7446324 - DNA, 22 bp, Homo sapiens
ctgtgtccttttagttgctgtg

SEQ ID NO: 7446325 - DNA, 22 bp, Homo sapiens
ctgtgtctaatcttatacatca

SEQ ID NO: 7446326 - DNA, 23 bp, Homo sapiens
ctgtgtctatgcagccatatcca

SEQ ID NO: 7446327 - DNA, 22 bp, Homo sapiens
ctgtgtctcatccgcctctggc

SEQ ID NO: 7446328 - DNA, 23 bp, Homo sapiens
ctgtgtctatgcagccatatcca

SEQ ID NO: 7446329 - DNA, 22 bp, Homo sapiens
ctgtgtctaatcttatacatca

SEQ ID NO: 7446330 - DNA, 23 bp, Homo sapiens
ctgtgtctatgcagccatatcca

SEQ ID NO: 7446331 - DNA, 22 bp, Homo sapiens
ctgtggctgcctcacctacagg

SEQ ID NO: 7446332 - DNA, 22 bp, Homo sapiens
ctgtggctgcctcacctacagg

SEQ ID NO: 7446333 - DNA, 22 bp, Homo sapiens
ctgtggctgcagccttggtcct

SEQ ID NO: 7446334 - DNA, 22 bp, Homo sapiens
ctgtggctgcagccttggtcct

SEQ ID NO: 7446335 - DNA, 22 bp, Homo sapiens
ctgtggctgcagccttggtcct

SEQ ID NO: 7446336 - DNA, 22 bp, Homo sapiens
ctgtggctgcgccatcgaaaac

SEQ ID NO: 7446337 - DNA, 22 bp, Homo sapiens
ctgtggctgcgccatcgaaaac

SEQ ID NO: 7446338 - DNA, 22 bp, Homo sapiens
ctgtggctgcgccatcgaaaac

SEQ ID NO: 7446339 - DNA, 22 bp, Homo sapiens
ctgtggctgcgtaggtctggca

SEQ ID NO: 7446340 - DNA, 22 bp, Homo sapiens
ctgtggctgcgtaggtctggca

SEQ ID NO: 7446341 - DNA, 22 bp, Homo sapiens
ctgtggctgcgccctgggggag

SEQ ID NO: 7446342 - DNA, 22 bp, Homo sapiens
ctgtggctgcgccctgggggag

SEQ ID NO: 7446343 - DNA, 22 bp, Homo sapiens
ctgtggctgcgccctgggggag

SEQ ID NO: 7446344 - DNA, 19 bp, Homo sapiens
ctgtggctgacctctggcc

SEQ ID NO: 7446345 - DNA, 19 bp, Homo sapiens
ctgtggctgacctctggcc

SEQ ID NO: 7446346 - DNA, 19 bp, Homo sapiens
ctgtggctgacctctggcc

SEQ ID NO: 7446347 - DNA, 19 bp, Homo sapiens
ctgtggctgacctctggcc

SEQ ID NO: 7446348 - DNA, 23 bp, Homo sapiens
ctgtggctgagtcctgttggagt

SEQ ID NO: 7446349 - DNA, 22 bp, Homo sapiens
ctgtggctgagttccttatgtt

SEQ ID NO: 7446350 - DNA, 22 bp, Homo sapiens
ctgtggctgagttccttatgtt

SEQ ID NO: 7446351 - DNA, 23 bp, Homo sapiens
ctgtggctgagtcctgttggagt

SEQ ID NO: 7446352 - DNA, 22 bp, Homo sapiens
ctgtggctctgcagtcccaaca

SEQ ID NO: 7446353 - DNA, 22 bp, Homo sapiens
ctgtggctctttagttgagcac

SEQ ID NO: 7446354 - DNA, 22 bp, Homo sapiens
ctgtggctctttagttgagcac

SEQ ID NO: 7446355 - DNA, 22 bp, Homo sapiens
ctgtggctctttagttgagcac

SEQ ID NO: 7446356 - DNA, 22 bp, Homo sapiens
ctgtggctgaactctgaagagg

SEQ ID NO: 7446357 - DNA, 22 bp, Homo sapiens
ctgtggctgaactctgaagagg

SEQ ID NO: 7446358 - DNA, 22 bp, Homo sapiens
ctgtggctctcagaggctgctg

SEQ ID NO: 7446359 - DNA, 22 bp, Homo sapiens
ctgtggctctcagaggctgctg

SEQ ID NO: 7446360 - DNA, 22 bp, Homo sapiens
ctgtggctctcagaggctgctg

SEQ ID NO: 7446361 - DNA, 22 bp, Homo sapiens
ctgtggctctcagaggctgctg

SEQ ID NO: 7446362 - DNA, 22 bp, Homo sapiens
ctgtggctctcagaggctgctg

SEQ ID NO: 7446363 - DNA, 22 bp, Homo sapiens
ctgtggctctcagaggctgctg

SEQ ID NO: 7446364 - DNA, 22 bp, Homo sapiens
ctgtggctctctgcagggtccc

SEQ ID NO: 7446365 - DNA, 22 bp, Homo sapiens
ctgtggctctctgcagggtccc

SEQ ID NO: 7446366 - DNA, 22 bp, Homo sapiens
ctgtggctctctgcagggtccc

SEQ ID NO: 7446367 - DNA, 22 bp, Homo sapiens
ctgtggctctccaatggaggga

SEQ ID NO: 7446368 - DNA, 22 bp, Homo sapiens
ctgtggctctccaatggaggga

SEQ ID NO: 7446369 - DNA, 22 bp, Homo sapiens
ctgtggctctccaatggaggga

SEQ ID NO: 7446370 - DNA, 22 bp, Homo sapiens
ctgtggctctccaatggaggga

SEQ ID NO: 7446371 - DNA, 22 bp, Homo sapiens
ctgtggctccatagaagttgca

SEQ ID NO: 7446372 - DNA, 22 bp, Homo sapiens
ctgtggctccatagaagttgca

SEQ ID NO: 7446373 - DNA, 22 bp, Homo sapiens
ctgtggctccagtgaaccaatg

SEQ ID NO: 7446374 - DNA, 22 bp, Homo sapiens
ctgtggctccagtgaaccaatg

SEQ ID NO: 7446375 - DNA, 22 bp, Homo sapiens
ctgtggctcattcttggtggca

SEQ ID NO: 7446376 - DNA, 22 bp, Homo sapiens
ctgtggctcattcttggtggca

SEQ ID NO: 7446377 - DNA, 20 bp, Homo sapiens
ctgtggctcatgcatctgcc

SEQ ID NO: 7446378 - DNA, 20 bp, Homo sapiens
ctgtggctcatgcatctgcc

SEQ ID NO: 7446379 - DNA, 20 bp, Homo sapiens
ctgtggctcatgcatctgcc

SEQ ID NO: 7446380 - DNA, 20 bp, Homo sapiens
ctgtggctcatgcatctgcc

SEQ ID NO: 7446381 - DNA, 20 bp, Homo sapiens
ctgtggctcatgcatctgcc

SEQ ID NO: 7446382 - DNA, 20 bp, Homo sapiens
ctgtggctcatgcatctgcc

SEQ ID NO: 7446383 - DNA, 20 bp, Homo sapiens
ctgtggctcatgcatctgcc

SEQ ID NO: 7446384 - DNA, 20 bp, Homo sapiens
ctgtggctcatgcatctgcc

SEQ ID NO: 7446385 - DNA, 17 bp, Homo sapiens
ctgtggccacctggatg

SEQ ID NO: 7446386 - DNA, 17 bp, Homo sapiens
ctgtggccacctggatg

SEQ ID NO: 7446387 - DNA, 22 bp, Homo sapiens
ctgtggccagatggtgccagtt

SEQ ID NO: 7446388 - DNA, 22 bp, Homo sapiens
ctgtggccagtcccacacctcc

SEQ ID NO: 7446389 - DNA, 22 bp, Homo sapiens
ctgtggccagatggtgccagtt

SEQ ID NO: 7446390 - DNA, 22 bp, Homo sapiens
ctgtggccagagcgccgttgac

SEQ ID NO: 7446391 - DNA, 22 bp, Homo sapiens
ctgtggccagatggtgccagtt

SEQ ID NO: 7446392 - DNA, 22 bp, Homo sapiens
ctgtggccagatggtgccagtt

SEQ ID NO: 7446393 - DNA, 22 bp, Homo sapiens
ctgtggccagatggtgccagtt

SEQ ID NO: 7446394 - DNA, 22 bp, Homo sapiens
ctgtggccagatggtgccagtt

SEQ ID NO: 7446395 - DNA, 22 bp, Homo sapiens
ctgtggccagtcccacacctcc

SEQ ID NO: 7446396 - DNA, 22 bp, Homo sapiens
ctgtggccccaccctcttggcc

SEQ ID NO: 7446397 - DNA, 22 bp, Homo sapiens
ctgtggccccaccctcttggcc

SEQ ID NO: 7446398 - DNA, 22 bp, Homo sapiens
ctgtggctcatatctgtaatct

SEQ ID NO: 7446399 - DNA, 22 bp, Homo sapiens
ctgtggctcatatctgtaatct

SEQ ID NO: 7446400 - DNA, 22 bp, Homo sapiens
ctgtgcccggcccagggccctg

SEQ ID NO: 7446401 - DNA, 22 bp, Homo sapiens
ctgtgcccggcccagggccctg

SEQ ID NO: 7446402 - DNA, 22 bp, Homo sapiens
ctgtgccccacagagctccaca

SEQ ID NO: 7446403 - DNA, 22 bp, Homo sapiens
ctgtgcccggcccagggccctg

SEQ ID NO: 7446404 - DNA, 22 bp, Homo sapiens
ctgtgcccggcccagggccctg

SEQ ID NO: 7446405 - DNA, 22 bp, Homo sapiens
ctgtgcccggcccagggccctg

SEQ ID NO: 7446406 - DNA, 22 bp, Homo sapiens
ctgtgccccacagagctccaca

SEQ ID NO: 7446407 - DNA, 22 bp, Homo sapiens
ctgtgccccacagagctccaca

SEQ ID NO: 7446408 - DNA, 22 bp, Homo sapiens
ctgtgcccaggctggagtgcag

SEQ ID NO: 7446409 - DNA, 22 bp, Homo sapiens
ctgtgcccataatctggtattt

SEQ ID NO: 7446410 - DNA, 22 bp, Homo sapiens
ctgtgccctctttgctggcctt

SEQ ID NO: 7446411 - DNA, 19 bp, Homo sapiens
ctgtgccctatgacttgta

SEQ ID NO: 7446412 - DNA, 22 bp, Homo sapiens
ctgtgccctctttgctggcctt

SEQ ID NO: 7446413 - DNA, 22 bp, Homo sapiens
ctgtgccctctttgctggcctt

SEQ ID NO: 7446414 - DNA, 19 bp, Homo sapiens
ctgtgccctatgacttgta

SEQ ID NO: 7446415 - DNA, 23 bp, Homo sapiens
ctgtgcccggggctccacctgat

SEQ ID NO: 7446416 - DNA, 23 bp, Homo sapiens
ctgtgcccggggctccacctgat

SEQ ID NO: 7446417 - DNA, 23 bp, Homo sapiens
ctgtgcccggggctccacctgat

SEQ ID NO: 7446418 - DNA, 23 bp, Homo sapiens
ctgtgcccggggctccacctgat

SEQ ID NO: 7446419 - DNA, 22 bp, Homo sapiens
ctgtgccaggcccagctgactt

SEQ ID NO: 7446420 - DNA, 22 bp, Homo sapiens
ctgtgccaggcccagctgactt

SEQ ID NO: 7446421 - DNA, 22 bp, Homo sapiens
ctgtgccaggcccagctgactt

SEQ ID NO: 7446422 - DNA, 22 bp, Homo sapiens
ctgtgccaggcccagctgactt

SEQ ID NO: 7446423 - DNA, 22 bp, Homo sapiens
ctgtgccaggcccgggtgggtg

SEQ ID NO: 7446424 - DNA, 22 bp, Homo sapiens
ctgtgccagggtctattccaga

SEQ ID NO: 7446425 - DNA, 22 bp, Homo sapiens
ctgtgccagggtctattccaga

SEQ ID NO: 7446426 - DNA, 22 bp, Homo sapiens
ctgtgccatcctagggctgctg

SEQ ID NO: 7446427 - DNA, 22 bp, Homo sapiens
ctgtgccatcctagggctgctg

SEQ ID NO: 7446428 - DNA, 22 bp, Homo sapiens
ctgtgccattctttgtagcatg

SEQ ID NO: 7446429 - DNA, 22 bp, Homo sapiens
ctgtgccattctttgtagcatg

SEQ ID NO: 7446430 - DNA, 22 bp, Homo sapiens
ctgtgccatctttttgctacct

SEQ ID NO: 7446431 - DNA, 22 bp, Homo sapiens
ctgtgcccacctggctctgagg

SEQ ID NO: 7446432 - DNA, 22 bp, Homo sapiens
ctgtgcccacctggctctgagg

SEQ ID NO: 7446433 - DNA, 22 bp, Homo sapiens
ctgtgcccacctggctctgagg

SEQ ID NO: 7446434 - DNA, 22 bp, Homo sapiens
ctgtgcccaggctggagtgcag

SEQ ID NO: 7446435 - DNA, 22 bp, Homo sapiens
ctgtgcccaggcccctggggat

SEQ ID NO: 7446436 - DNA, 22 bp, Homo sapiens
ctgtgcccaggcccctggggat

SEQ ID NO: 7446437 - DNA, 22 bp, Homo sapiens
ctgtgcccaggctggagtgcag

SEQ ID NO: 7446438 - DNA, 22 bp, Homo sapiens
ctgtgcccaggctggagtgcag

SEQ ID NO: 7446439 - DNA, 22 bp, Homo sapiens
ctgtgcccacctggctctgagg

SEQ ID NO: 7446440 - DNA, 22 bp, Homo sapiens
ctgtgcccagctccctgactgc

SEQ ID NO: 7446441 - DNA, 22 bp, Homo sapiens
ctgtgcccagctccctgactgc

SEQ ID NO: 7446442 - DNA, 22 bp, Homo sapiens
ctgtgcccaggcccctggggat

SEQ ID NO: 7446443 - DNA, 22 bp, Homo sapiens
ctgtgcccagctccctgactgc

SEQ ID NO: 7446444 - DNA, 22 bp, Homo sapiens
ctgtgccactgccccaggcctc

SEQ ID NO: 7446445 - DNA, 22 bp, Homo sapiens
ctgtgccactgccccaggcctc

SEQ ID NO: 7446446 - DNA, 22 bp, Homo sapiens
ctgtgccactgccctgccacgc

SEQ ID NO: 7446447 - DNA, 22 bp, Homo sapiens
ctgtgccacctgagggactcta

SEQ ID NO: 7446448 - DNA, 22 bp, Homo sapiens
ctgtgccactgccccaggcctc

SEQ ID NO: 7446449 - DNA, 22 bp, Homo sapiens
ctgtgccactgccccaggcctc

SEQ ID NO: 7446450 - DNA, 22 bp, Homo sapiens
ctgtgccactgccccaggcctc

SEQ ID NO: 7446451 - DNA, 22 bp, Homo sapiens
ctgtgccaggcccagctgactt

SEQ ID NO: 7446452 - DNA, 22 bp, Homo sapiens
ctgtgccagagggtgaccaagg

SEQ ID NO: 7446453 - DNA, 22 bp, Homo sapiens
ctgtgccagcctgtcccaggag

SEQ ID NO: 7446454 - DNA, 22 bp, Homo sapiens
ctgtgccagcctgtcccaggag

SEQ ID NO: 7446455 - DNA, 22 bp, Homo sapiens
ctgtgccagagggtgaccaagg

SEQ ID NO: 7446456 - DNA, 22 bp, Homo sapiens
ctgtgcattgtcttgtctgtag

SEQ ID NO: 7446457 - DNA, 22 bp, Homo sapiens
ctgtgccacctgagggactcta

SEQ ID NO: 7446458 - DNA, 22 bp, Homo sapiens
ctgtgccacctgagggactcta

SEQ ID NO: 7446459 - DNA, 22 bp, Homo sapiens
ctgtgcattgtcttgtctgtag

SEQ ID NO: 7446460 - DNA, 22 bp, Homo sapiens
ctgtgcatgtgttctctggtaa

SEQ ID NO: 7446461 - DNA, 22 bp, Homo sapiens
ctgtgcattgttgagtgtttag

SEQ ID NO: 7446462 - DNA, 22 bp, Homo sapiens
ctgtgcattgttgagtgtttag

SEQ ID NO: 7446463 - DNA, 22 bp, Homo sapiens
ctgtgcattgtcttgtctgtag

SEQ ID NO: 7446464 - DNA, 22 bp, Homo sapiens
ctgtgcatggcagatgctgtta

SEQ ID NO: 7446465 - DNA, 22 bp, Homo sapiens
ctgtgcatggcagatgctgtta

SEQ ID NO: 7446466 - DNA, 22 bp, Homo sapiens
ctgtgcatcttcttcctggagg

SEQ ID NO: 7446467 - DNA, 22 bp, Homo sapiens
ctgtgcataaatggacatggat

SEQ ID NO: 7446468 - DNA, 22 bp, Homo sapiens
ctgtgcagtgtggggtaggcct

SEQ ID NO: 7446469 - DNA, 22 bp, Homo sapiens
ctgtgcagtgtggggtaggcct

SEQ ID NO: 7446470 - DNA, 22 bp, Homo sapiens
ctgtgcagtgtggggtaggcct

SEQ ID NO: 7446471 - DNA, 22 bp, Homo sapiens
ctgtgcagtggggctctgggtt

SEQ ID NO: 7446472 - DNA, 22 bp, Homo sapiens
ctgtcctgtgcattgtcagatg

SEQ ID NO: 7446473 - DNA, 22 bp, Homo sapiens
ctgtcctgtgcattgtcagatg

SEQ ID NO: 7446474 - DNA, 22 bp, Homo sapiens
ctgtcctgtctgcttttaattt

SEQ ID NO: 7446475 - DNA, 22 bp, Homo sapiens
ctgtcctgtctgcttttaattt

SEQ ID NO: 7446476 - DNA, 22 bp, Homo sapiens
ctgtcctgtctgcttttaattt

SEQ ID NO: 7446477 - DNA, 23 bp, Homo sapiens
ctgtcctgtagttcacgttggcc

SEQ ID NO: 7446478 - DNA, 23 bp, Homo sapiens
ctgtcctgtagttcacgttggcc

SEQ ID NO: 7446479 - DNA, 23 bp, Homo sapiens
ctgtcctgtagttcacgttggcc

SEQ ID NO: 7446480 - DNA, 22 bp, Homo sapiens
ctgtcctgtagctccatcagtc

SEQ ID NO: 7446481 - DNA, 22 bp, Homo sapiens
ctgtcctgtagctccatcagtc

SEQ ID NO: 7446482 - DNA, 22 bp, Homo sapiens
ctgtcctgtggacctgaggacg

SEQ ID NO: 7446483 - DNA, 22 bp, Homo sapiens
ctgtcctgtggacctgaggacg

SEQ ID NO: 7446484 - DNA, 22 bp, Homo sapiens
ctgtcctgtgcattgtcagatg

SEQ ID NO: 7446485 - DNA, 22 bp, Homo sapiens
ctgtcctgtgctttttactgtc

SEQ ID NO: 7446486 - DNA, 22 bp, Homo sapiens
ctgtcctgtgctttttactgtc

SEQ ID NO: 7446487 - DNA, 22 bp, Homo sapiens
ctgtgagggtcacagccatgcc

SEQ ID NO: 7446488 - DNA, 22 bp, Homo sapiens
ctgtgagggccagagtcagggc

SEQ ID NO: 7446489 - DNA, 22 bp, Homo sapiens
ctgtgagggccagagtcagggc

SEQ ID NO: 7446490 - DNA, 22 bp, Homo sapiens
ctgtcctgtggacctgaggacg

SEQ ID NO: 7446491 - DNA, 22 bp, Homo sapiens
ctgtgagggccagagtcagggc

SEQ ID NO: 7446492 - DNA, 22 bp, Homo sapiens
ctgtgagtccctggggaggtta

SEQ ID NO: 7446493 - DNA, 22 bp, Homo sapiens
ctgtgagggtcacagccatgcc

SEQ ID NO: 7446494 - DNA, 19 bp, Homo sapiens
ctgtgagtcttgtggcctc

SEQ ID NO: 7446495 - DNA, 22 bp, Homo sapiens
ctgtgagtgaccctggtcagca

SEQ ID NO: 7446496 - DNA, 19 bp, Homo sapiens
ctgtgagtcttgtggcctc

SEQ ID NO: 7446497 - DNA, 22 bp, Homo sapiens
ctgtgcagtggcagcgtgtggg

SEQ ID NO: 7446498 - DNA, 22 bp, Homo sapiens
ctgtgcagtccagccctggaca

SEQ ID NO: 7446499 - DNA, 22 bp, Homo sapiens
ctgtgcagtccagccctggaca

SEQ ID NO: 7446500 - DNA, 22 bp, Homo sapiens
ctgtgcagtggcagcgtgtggg

SEQ ID NO: 7446501 - DNA, 22 bp, Homo sapiens
ctgtgcagtggcagcgtgtggg

SEQ ID NO: 7446502 - DNA, 22 bp, Homo sapiens
ctgtgcagtggcagcgtgtggg

SEQ ID NO: 7446503 - DNA, 22 bp, Homo sapiens
ctgtcctggagggcataggacg

SEQ ID NO: 7446504 - DNA, 22 bp, Homo sapiens
ctgtcctggagggcataggacg

SEQ ID NO: 7446505 - DNA, 22 bp, Homo sapiens
ctgtcctggccgcccttgtgag

SEQ ID NO: 7446506 - DNA, 22 bp, Homo sapiens
ctgtcctggagggcataggacg

SEQ ID NO: 7446507 - DNA, 22 bp, Homo sapiens
ctgtcctggagggcataggacg

SEQ ID NO: 7446508 - DNA, 22 bp, Homo sapiens
ctgtcctggagggcataggacg

SEQ ID NO: 7446509 - DNA, 22 bp, Homo sapiens
ctgtcctggagggcataggacg

SEQ ID NO: 7446510 - DNA, 22 bp, Homo sapiens
ctgtcctggagggcataggacg

SEQ ID NO: 7446511 - DNA, 22 bp, Homo sapiens
ctgtcctgcccaccctgcaggg

SEQ ID NO: 7446512 - DNA, 22 bp, Homo sapiens
ctgtcctgcccaccctgcaggg

SEQ ID NO: 7446513 - DNA, 22 bp, Homo sapiens
ctgtcctgcccaccctgcaggg

SEQ ID NO: 7446514 - DNA, 22 bp, Homo sapiens
ctgtcctggggaaagccagccc

SEQ ID NO: 7446515 - DNA, 22 bp, Homo sapiens
ctgtcctgggggtggtccttgc

SEQ ID NO: 7446516 - DNA, 22 bp, Homo sapiens
ctgtcctgggggtggtccttgc

SEQ ID NO: 7446517 - DNA, 22 bp, Homo sapiens
ctgtcctgggggtggtccttgc

SEQ ID NO: 7446518 - DNA, 22 bp, Homo sapiens
ctgtcctggtactttgaggttc

SEQ ID NO: 7446519 - DNA, 22 bp, Homo sapiens
ctgtcctggtactttgaggttc

SEQ ID NO: 7446520 - DNA, 22 bp, Homo sapiens
ctgtcctggtactttgaggttc

SEQ ID NO: 7446521 - DNA, 22 bp, Homo sapiens
ctgtcctggccgcccttgtgag

SEQ ID NO: 7446522 - DNA, 22 bp, Homo sapiens
ctgtcctggccgcccttgtgag

SEQ ID NO: 7446523 - DNA, 22 bp, Homo sapiens
ctgtcctggccgcccttgtgag

SEQ ID NO: 7446524 - DNA, 22 bp, Homo sapiens
ctgtcctggggaaagccagccc

SEQ ID NO: 7446525 - DNA, 22 bp, Homo sapiens
ctgtcctggggaaagccagccc

SEQ ID NO: 7446526 - DNA, 21 bp, Homo sapiens
ctgtcctggtctagaggcaca

SEQ ID NO: 7446527 - DNA, 21 bp, Homo sapiens
ctgtcctggtctagaggcaca

SEQ ID NO: 7446528 - DNA, 21 bp, Homo sapiens
ctgtcctggtctagaggcaca

SEQ ID NO: 7446529 - DNA, 21 bp, Homo sapiens
ctgtcctggtctagaggcaca

SEQ ID NO: 7446530 - DNA, 22 bp, Homo sapiens
ctgtcctggtgctggggatccc

SEQ ID NO: 7446531 - DNA, 21 bp, Homo sapiens
ctgtcctggtctagaggcaca

SEQ ID NO: 7446532 - DNA, 22 bp, Homo sapiens
ctgtcctggtgctggggatccc

SEQ ID NO: 7446533 - DNA, 22 bp, Homo sapiens
ctgtcctggtgctggggatccc

SEQ ID NO: 7446534 - DNA, 19 bp, Homo sapiens
ctgtcctggtttggtccct

SEQ ID NO: 7446535 - DNA, 19 bp, Homo sapiens
ctgtcctggtttggtccct

SEQ ID NO: 7446536 - DNA, 22 bp, Homo sapiens
ctgtcctgtagctccatcagtc

SEQ ID NO: 7446537 - DNA, 22 bp, Homo sapiens
ctgtcctgtagctccatcagtc

SEQ ID NO: 7446538 - DNA, 22 bp, Homo sapiens
ctgtcctgtagctccatcagtc

SEQ ID NO: 7446539 - DNA, 22 bp, Homo sapiens
ctgtcctgtactttgaggccct

SEQ ID NO: 7446540 - DNA, 22 bp, Homo sapiens
ctgtcctgtactttgaggccct

SEQ ID NO: 7446541 - DNA, 22 bp, Homo sapiens
ctgtcctgtactttgaggccct

SEQ ID NO: 7446542 - DNA, 22 bp, Homo sapiens
ctgtcctgtagctccatcagtc

SEQ ID NO: 7446543 - DNA, 22 bp, Homo sapiens
ctgtcctgtagctccatcagtc

SEQ ID NO: 7446544 - DNA, 22 bp, Homo sapiens
ctgtcctgtagctccatcagtc

SEQ ID NO: 7446545 - DNA, 22 bp, Homo sapiens
ctgtcctgtactttgaggccct

SEQ ID NO: 7446546 - DNA, 22 bp, Homo sapiens
ctgtcctgagataaagatgagg

SEQ ID NO: 7446547 - DNA, 22 bp, Homo sapiens
ctgtcctgagataaagatgagg

SEQ ID NO: 7446548 - DNA, 22 bp, Homo sapiens
ctgtcctgagataaagatgagg

SEQ ID NO: 7446549 - DNA, 22 bp, Homo sapiens
ctgtcctgagataaagatgagg

SEQ ID NO: 7446550 - DNA, 22 bp, Homo sapiens
ctgtcctgaggcaggtggcctg

SEQ ID NO: 7446551 - DNA, 22 bp, Homo sapiens
ctgtcctgaggcaggtggcctg

SEQ ID NO: 7446552 - DNA, 22 bp, Homo sapiens
ctgtcctgaggcaggtggcctg

SEQ ID NO: 7446553 - DNA, 22 bp, Homo sapiens
ctgtcctgagttcttggaggtc

SEQ ID NO: 7446554 - DNA, 22 bp, Homo sapiens
ctgtcctgagttcttggaggtc

SEQ ID NO: 7446555 - DNA, 22 bp, Homo sapiens
ctgtcctgagttcttggaggtc

SEQ ID NO: 7446556 - DNA, 20 bp, Homo sapiens
ctgtcctgatcttttcagaa

SEQ ID NO: 7446557 - DNA, 20 bp, Homo sapiens
ctgtcctgatcttttcagaa

SEQ ID NO: 7446558 - DNA, 20 bp, Homo sapiens
ctgtcctgatcttttcagaa

SEQ ID NO: 7446559 - DNA, 22 bp, Homo sapiens
ctgtcctgatggtgccactggt

SEQ ID NO: 7446560 - DNA, 22 bp, Homo sapiens
ctgtcctgatggtgccactggt

SEQ ID NO: 7446561 - DNA, 22 bp, Homo sapiens
ctgtcctgatggtgccactggt

SEQ ID NO: 7446562 - DNA, 22 bp, Homo sapiens
ctgtcctgatggtgccactggt

SEQ ID NO: 7446563 - DNA, 22 bp, Homo sapiens
ctgtcctgatggtgccactggt

SEQ ID NO: 7446564 - DNA, 22 bp, Homo sapiens
ctgtcctgatggtgccactggt

SEQ ID NO: 7446565 - DNA, 22 bp, Homo sapiens
ctgtcctgatggtgccactggt

SEQ ID NO: 7446566 - DNA, 22 bp, Homo sapiens
ctgtcctgcccaccctgcaggg

SEQ ID NO: 7446567 - DNA, 22 bp, Homo sapiens
ctgtcctgcccaccctgcaggg

SEQ ID NO: 7446568 - DNA, 22 bp, Homo sapiens
ctgtcctgcccaccctgcaggg

SEQ ID NO: 7446569 - DNA, 22 bp, Homo sapiens
ctgtcctgcccaccctgcaggg

SEQ ID NO: 7446570 - DNA, 22 bp, Homo sapiens
ctgtcctgcccaccctgcaggg

SEQ ID NO: 7446571 - DNA, 22 bp, Homo sapiens
ctgtcctgcccaccctgcaggg

SEQ ID NO: 7446572 - DNA, 22 bp, Homo sapiens
ctgtcctgcccaccctgcaggg

SEQ ID NO: 7446573 - DNA, 22 bp, Homo sapiens
ctgtcctgccagtcctggactc

SEQ ID NO: 7446574 - DNA, 22 bp, Homo sapiens
ctgtcctgccagtcctggactc

SEQ ID NO: 7446575 - DNA, 22 bp, Homo sapiens
ctgtcctgccagtcctggactc

SEQ ID NO: 7446576 - DNA, 22 bp, Homo sapiens
ctgtcctgccagtcctggactc

SEQ ID NO: 7446577 - DNA, 23 bp, Homo sapiens
ctgtcctgccatccacagcggcc

SEQ ID NO: 7446578 - DNA, 23 bp, Homo sapiens
ctgtcctgccatccacagcggcc

SEQ ID NO: 7446579 - DNA, 22 bp, Homo sapiens
ctgtcctgcagttgggggcagg

SEQ ID NO: 7446580 - DNA, 22 bp, Homo sapiens
ctgtcctgcagttgggggcagg

SEQ ID NO: 7446581 - DNA, 22 bp, Homo sapiens
ctgtcctgcagttgggggcagg

SEQ ID NO: 7446582 - DNA, 22 bp, Homo sapiens
ctgtcctgccagtcctggactc

SEQ ID NO: 7446583 - DNA, 22 bp, Homo sapiens
ctgtcctgaaagggagattggg

SEQ ID NO: 7446584 - DNA, 22 bp, Homo sapiens
ctgtcctgaaagggagattggg

SEQ ID NO: 7446585 - DNA, 22 bp, Homo sapiens
ctgtcctgaaagggagattggg

SEQ ID NO: 7446586 - DNA, 22 bp, Homo sapiens
ctgtcctgaaagggagattggg

SEQ ID NO: 7446587 - DNA, 22 bp, Homo sapiens
ctgtcctctgtcctcagcagga

SEQ ID NO: 7446588 - DNA, 22 bp, Homo sapiens
ctgtcctgaagttttcatgaga

SEQ ID NO: 7446589 - DNA, 22 bp, Homo sapiens
ctgtcctgaagttttcatgaga

SEQ ID NO: 7446590 - DNA, 22 bp, Homo sapiens
ctgtcctgaagttttcatgaga

SEQ ID NO: 7446591 - DNA, 22 bp, Homo sapiens
ctgtcctctgtcctcagcagga

SEQ ID NO: 7446592 - DNA, 22 bp, Homo sapiens
ctgtcctctgtcctcagcagga

SEQ ID NO: 7446593 - DNA, 22 bp, Homo sapiens
ctgtcctctgtcctcagcagga

SEQ ID NO: 7446594 - DNA, 22 bp, Homo sapiens
ctgtcctctgtcctcagcagga

SEQ ID NO: 7446595 - DNA, 22 bp, Homo sapiens
ctgtcctctgtcctcagcagga

SEQ ID NO: 7446596 - DNA, 22 bp, Homo sapiens
ctgtcccttcattattcactac

SEQ ID NO: 7446597 - DNA, 22 bp, Homo sapiens
ctgtcccttcattattcactac

SEQ ID NO: 7446598 - DNA, 22 bp, Homo sapiens
ctgtcccttcattattcactac

SEQ ID NO: 7446599 - DNA, 22 bp, Homo sapiens
ctgtccctgagcaactcctgtt

SEQ ID NO: 7446600 - DNA, 22 bp, Homo sapiens
ctgtccctgagcaactcctgtt

SEQ ID NO: 7446601 - DNA, 22 bp, Homo sapiens
ctgggtgccacgggcaccctgg

SEQ ID NO: 7446602 - DNA, 22 bp, Homo sapiens
ctgggtgattcctgtccaggca

SEQ ID NO: 7446603 - DNA, 22 bp, Homo sapiens
ctgggtgccacgggcaccctgg

SEQ ID NO: 7446604 - DNA, 22 bp, Homo sapiens
ctgggtgccacgggcaccctgg

SEQ ID NO: 7446605 - DNA, 22 bp, Homo sapiens
ctgggtgccagcatggctgagt

SEQ ID NO: 7446606 - DNA, 22 bp, Homo sapiens
ctgggtgccagcatggctgagt

SEQ ID NO: 7446607 - DNA, 22 bp, Homo sapiens
ctgggtgccagcatggctgagt

SEQ ID NO: 7446608 - DNA, 22 bp, Homo sapiens
ctgggtgcgtgagcgcatgcgt

SEQ ID NO: 7446609 - DNA, 22 bp, Homo sapiens
ctgggtgcgtgagcgcatgcgt

SEQ ID NO: 7446610 - DNA, 22 bp, Homo sapiens
ctgggtgctgtgggctcagagg

SEQ ID NO: 7446611 - DNA, 22 bp, Homo sapiens
ctgggtgctgtgggctcagagg

SEQ ID NO: 7446612 - DNA, 22 bp, Homo sapiens
ctgggtgcgtgagcgcatgcgt

SEQ ID NO: 7446613 - DNA, 22 bp, Homo sapiens
ctgggtgccagcatggctgagt

SEQ ID NO: 7446614 - DNA, 22 bp, Homo sapiens
ctgtccctgagcaactcctgtt

SEQ ID NO: 7446615 - DNA, 22 bp, Homo sapiens
ctgtccctgagcaactcctgtt

SEQ ID NO: 7446616 - DNA, 22 bp, Homo sapiens
ctgggtgctgtgggctcagagg

SEQ ID NO: 7446617 - DNA, 22 bp, Homo sapiens
ctgggtgctgtgggctcagagg

SEQ ID NO: 7446618 - DNA, 22 bp, Homo sapiens
ctgtccctgagcaactcctgtt

SEQ ID NO: 7446619 - DNA, 22 bp, Homo sapiens
ctgggtgcttactttgtgctag

SEQ ID NO: 7446620 - DNA, 22 bp, Homo sapiens
ctgtccctgagcaactcctgtt

SEQ ID NO: 7446621 - DNA, 22 bp, Homo sapiens
ctgtccctgagcaactcctgtt

SEQ ID NO: 7446622 - DNA, 22 bp, Homo sapiens
ctgggtgccaattcatgtttat

SEQ ID NO: 7446623 - DNA, 22 bp, Homo sapiens
ctgggtgattcctgtccaggca

SEQ ID NO: 7446624 - DNA, 22 bp, Homo sapiens
ctgggtgattcctgtccaggca

SEQ ID NO: 7446625 - DNA, 22 bp, Homo sapiens
ctgggtgattcctgtccaggca

SEQ ID NO: 7446626 - DNA, 22 bp, Homo sapiens
ctgggtgagttgatgaaggaga

SEQ ID NO: 7446627 - DNA, 22 bp, Homo sapiens
ctgggtgagttgatgaaggaga

SEQ ID NO: 7446628 - DNA, 22 bp, Homo sapiens
ctgggtgacagagtgagatggt

SEQ ID NO: 7446629 - DNA, 22 bp, Homo sapiens
ctgggtgagctggccagagggt

SEQ ID NO: 7446630 - DNA, 22 bp, Homo sapiens
ctgggtgagctggccagagggt

SEQ ID NO: 7446631 - DNA, 22 bp, Homo sapiens
ctgggtgacagagtgagatggt

SEQ ID NO: 7446632 - DNA, 22 bp, Homo sapiens
ctgggtgagttgatgaaggaga

SEQ ID NO: 7446633 - DNA, 22 bp, Homo sapiens
ctgggtgagtataggaaaggga

SEQ ID NO: 7446634 - DNA, 22 bp, Homo sapiens
ctgggtcttcagcagcaggcgg

SEQ ID NO: 7446635 - DNA, 22 bp, Homo sapiens
ctgggtcttcagcagcaggcgg

SEQ ID NO: 7446636 - DNA, 22 bp, Homo sapiens
ctgggtcttcagcagcaggcgg

SEQ ID NO: 7446637 - DNA, 22 bp, Homo sapiens
ctgggtctgtgcccagggacct

SEQ ID NO: 7446638 - DNA, 22 bp, Homo sapiens
ctgggtctgtgcccagggacct

SEQ ID NO: 7446639 - DNA, 22 bp, Homo sapiens
ctgggtgaatttgaaggaaagg

SEQ ID NO: 7446640 - DNA, 22 bp, Homo sapiens
ctgggtgacagagtgagatggt

SEQ ID NO: 7446641 - DNA, 22 bp, Homo sapiens
ctgggtcttcagcagcaggcgg

SEQ ID NO: 7446642 - DNA, 22 bp, Homo sapiens
ctattaggtatgcagcctattt

SEQ ID NO: 7446643 - DNA, 22 bp, Homo sapiens
ctattattaatgtggggctttg

SEQ ID NO: 7446644 - DNA, 22 bp, Homo sapiens
ctattattagataatctacttg

SEQ ID NO: 7446645 - DNA, 22 bp, Homo sapiens
ctattattaatgtggggctttg

SEQ ID NO: 7446646 - DNA, 22 bp, Homo sapiens
ctattattagataatctacttg

SEQ ID NO: 7446647 - DNA, 22 bp, Homo sapiens
ctattattagcaaaaggtggat

SEQ ID NO: 7446648 - DNA, 22 bp, Homo sapiens
ctattattagataatctacttg

SEQ ID NO: 7446649 - DNA, 22 bp, Homo sapiens
ctattactgacttctgtattta

SEQ ID NO: 7446650 - DNA, 22 bp, Homo sapiens
ctattacatttctggacattca

SEQ ID NO: 7446651 - DNA, 22 bp, Homo sapiens
ctattagaaagcatcttctata

SEQ ID NO: 7446652 - DNA, 22 bp, Homo sapiens
ctattagaaagcatcttctata

SEQ ID NO: 7446653 - DNA, 22 bp, Homo sapiens
ctattagctgaataatgcattg

SEQ ID NO: 7446654 - DNA, 22 bp, Homo sapiens
ctattagacacaattagtgatt

SEQ ID NO: 7446655 - DNA, 22 bp, Homo sapiens
ctattagacacaattagtgatt

SEQ ID NO: 7446656 - DNA, 22 bp, Homo sapiens
ctcaaaatccataaaatcaggt

SEQ ID NO: 7446657 - DNA, 22 bp, Homo sapiens
ctcaaaatccataaaatcaggt

SEQ ID NO: 7446658 - DNA, 22 bp, Homo sapiens
ctcaaaatccataaaatcaggt

SEQ ID NO: 7446659 - DNA, 22 bp, Homo sapiens
ctatttttctgtaccctaattt

SEQ ID NO: 7446660 - DNA, 22 bp, Homo sapiens
ctcaaaagacttaaacataaga

SEQ ID NO: 7446661 - DNA, 22 bp, Homo sapiens
ctcaaaagacttaaacataaga

SEQ ID NO: 7446662 - DNA, 22 bp, Homo sapiens
ctattatttcctcatctataaa

SEQ ID NO: 7446663 - DNA, 22 bp, Homo sapiens
ctattatttcctcatctataaa

SEQ ID NO: 7446664 - DNA, 22 bp, Homo sapiens
ctattattatcctaatttctgt

SEQ ID NO: 7446665 - DNA, 22 bp, Homo sapiens
ctattattatgttaactggact

SEQ ID NO: 7446666 - DNA, 22 bp, Homo sapiens
ctattattatcctaatttctgt

SEQ ID NO: 7446667 - DNA, 22 bp, Homo sapiens
ctattattatgttaactggact

SEQ ID NO: 7446668 - DNA, 22 bp, Homo sapiens
ctattatttcctcatctataaa

SEQ ID NO: 7446669 - DNA, 22 bp, Homo sapiens
ctattattatgttaactggact

SEQ ID NO: 7446670 - DNA, 22 bp, Homo sapiens
ctattattatgttaactggact

SEQ ID NO: 7446671 - DNA, 22 bp, Homo sapiens
ctcaagatgtcagggcacctgc

SEQ ID NO: 7446672 - DNA, 22 bp, Homo sapiens
ctcaaggaaagtctggagaaga

SEQ ID NO: 7446673 - DNA, 22 bp, Homo sapiens
ctcaagatattccagctctcaa

SEQ ID NO: 7446674 - DNA, 22 bp, Homo sapiens
ctcaagatcatcaatataccaa

SEQ ID NO: 7446675 - DNA, 22 bp, Homo sapiens
ctcaagatgtcagggcacctgc

SEQ ID NO: 7446676 - DNA, 22 bp, Homo sapiens
ctcaagcctgctgagttttgga

SEQ ID NO: 7446677 - DNA, 22 bp, Homo sapiens
ctcaaaatggttaattttaata

SEQ ID NO: 7446678 - DNA, 22 bp, Homo sapiens
ctcaaaatggttaattttaata

SEQ ID NO: 7446679 - DNA, 22 bp, Homo sapiens
ctcaaaatccataaaatcaggt

SEQ ID NO: 7446680 - DNA, 22 bp, Homo sapiens
ctcaaaatggttaattttaata

SEQ ID NO: 7446681 - DNA, 22 bp, Homo sapiens
ctcaaaatggttaattttaata

SEQ ID NO: 7446682 - DNA, 22 bp, Homo sapiens
ctcaagaggatatgtccagaaa

SEQ ID NO: 7446683 - DNA, 22 bp, Homo sapiens
ctcaagtttcatatttgtctag

SEQ ID NO: 7446684 - DNA, 22 bp, Homo sapiens
ctcaatatgccagaggggaaag

SEQ ID NO: 7446685 - DNA, 22 bp, Homo sapiens
ctcaatatgccagaggggaaag

SEQ ID NO: 7446686 - DNA, 22 bp, Homo sapiens
ctcaagtttcatatttgtctag

SEQ ID NO: 7446687 - DNA, 22 bp, Homo sapiens
ctcaagttggcatgaacaaatt

SEQ ID NO: 7446688 - DNA, 22 bp, Homo sapiens
ctcaagttggcatgaacaaatt

SEQ ID NO: 7446689 - DNA, 22 bp, Homo sapiens
ctcaagtctgatgggttaggtt

SEQ ID NO: 7446690 - DNA, 22 bp, Homo sapiens
ctcaagtctgagtactggctct

SEQ ID NO: 7446691 - DNA, 22 bp, Homo sapiens
ctcaagtctattgataagtgca

SEQ ID NO: 7446692 - DNA, 22 bp, Homo sapiens
ctcaagtcccgcagtgttcctc

SEQ ID NO: 7446693 - DNA, 22 bp, Homo sapiens
ctcaagtcccgcagtgttcctc

SEQ ID NO: 7446694 - DNA, 22 bp, Homo sapiens
ctcaagtccatagaatcaggaa

SEQ ID NO: 7446695 - DNA, 22 bp, Homo sapiens
ctcaagtcagaaataaaagcat

SEQ ID NO: 7446696 - DNA, 22 bp, Homo sapiens
ctcaagtccatagaatcaggaa

SEQ ID NO: 7446697 - DNA, 22 bp, Homo sapiens
ctcaagtaattagcaacaaata

SEQ ID NO: 7446698 - DNA, 22 bp, Homo sapiens
ctcaagtaattagcaacaaata

SEQ ID NO: 7446699 - DNA, 22 bp, Homo sapiens
ctcaagtaattagcaacaaata

SEQ ID NO: 7446700 - DNA, 22 bp, Homo sapiens
ctcaagtaagaaacagaattgg

SEQ ID NO: 7446701 - DNA, 20 bp, Homo sapiens
ctcaagtaaggttataaggt

SEQ ID NO: 7446702 - DNA, 22 bp, Homo sapiens
ctcaagtaagaaacagaattgg

SEQ ID NO: 7446703 - DNA, 22 bp, Homo sapiens
ctcaaggccagttcttctgact

SEQ ID NO: 7446704 - DNA, 22 bp, Homo sapiens
ctcaagtaaacattctagagat

SEQ ID NO: 7446705 - DNA, 22 bp, Homo sapiens
ctcacaggtaccagcaccctcc

SEQ ID NO: 7446706 - DNA, 22 bp, Homo sapiens
ctcacaggtaccagcaccctcc

SEQ ID NO: 7446707 - DNA, 22 bp, Homo sapiens
ctcacagggttctatcgaagag

SEQ ID NO: 7446708 - DNA, 22 bp, Homo sapiens
ctcacaggtaccagcaccctcc

SEQ ID NO: 7446709 - DNA, 22 bp, Homo sapiens
ctcacaggtcatgtggtggctt

SEQ ID NO: 7446710 - DNA, 22 bp, Homo sapiens
ctcacaggttagttgtgtggat

SEQ ID NO: 7446711 - DNA, 22 bp, Homo sapiens
ctcacaggttagttgtgtggat

SEQ ID NO: 7446712 - DNA, 22 bp, Homo sapiens
ctcacaggtcatgtggtggctt

SEQ ID NO: 7446713 - DNA, 22 bp, Homo sapiens
ctcacaggcatctcatcaggct

SEQ ID NO: 7446714 - DNA, 22 bp, Homo sapiens
ctcacaggcatctcatcaggct

SEQ ID NO: 7446715 - DNA, 21 bp, Homo sapiens
ctcacaggatgcagtgttact

SEQ ID NO: 7446716 - DNA, 22 bp, Homo sapiens
ctcacaggcatctcatcaggct

SEQ ID NO: 7446717 - DNA, 22 bp, Homo sapiens
ctcacaggcggtaattcaggga

SEQ ID NO: 7446718 - DNA, 22 bp, Homo sapiens
ctcacagggttctatcgaagag

SEQ ID NO: 7446719 - DNA, 22 bp, Homo sapiens
ctcacagggttctatcgaagag

SEQ ID NO: 7446720 - DNA, 22 bp, Homo sapiens
ctcacagctgcttcaggatcca

SEQ ID NO: 7446721 - DNA, 22 bp, Homo sapiens
ctcacaggagaaagtcatggtc

SEQ ID NO: 7446722 - DNA, 22 bp, Homo sapiens
ctcacagctgcttcaggatcca

SEQ ID NO: 7446723 - DNA, 22 bp, Homo sapiens
ctcacagcatggaattttctgg

SEQ ID NO: 7446724 - DNA, 22 bp, Homo sapiens
ctcacagcatggaattttctgg

SEQ ID NO: 7446725 - DNA, 22 bp, Homo sapiens
ctcacagcatggaattttctgg

SEQ ID NO: 7446726 - DNA, 22 bp, Homo sapiens
ctcacaggagaaagtcatggtc

SEQ ID NO: 7446727 - DNA, 22 bp, Homo sapiens
ctcacagctgcttcaggatcca

SEQ ID NO: 7446728 - DNA, 22 bp, Homo sapiens
ctcacaggagaaagtcatggtc

SEQ ID NO: 7446729 - DNA, 22 bp, Homo sapiens
ctcacaggagaaagtcatggtc

SEQ ID NO: 7446730 - DNA, 22 bp, Homo sapiens
ctcacagcacttgtgtcattgg

SEQ ID NO: 7446731 - DNA, 22 bp, Homo sapiens
ctcacagcacttgtgtcattgg

SEQ ID NO: 7446732 - DNA, 22 bp, Homo sapiens
ctcacagcacttgtgtcattgg

SEQ ID NO: 7446733 - DNA, 22 bp, Homo sapiens
ctcacagcaaggaggtaaggta

SEQ ID NO: 7446734 - DNA, 22 bp, Homo sapiens
ctcacagcagccagtctgcctt

SEQ ID NO: 7446735 - DNA, 22 bp, Homo sapiens
ctcacagcagccagtctgcctt

SEQ ID NO: 7446736 - DNA, 22 bp, Homo sapiens
ctcacagcacttgtgtcattgg

SEQ ID NO: 7446737 - DNA, 22 bp, Homo sapiens
ctcacagcacttgtgtcattgg

SEQ ID NO: 7446738 - DNA, 22 bp, Homo sapiens
ctcacagcagccagtctgcctt

SEQ ID NO: 7446739 - DNA, 22 bp, Homo sapiens
ctcacagcagctctgcgagata

SEQ ID NO: 7446740 - DNA, 22 bp, Homo sapiens
ctcacagcagctctgcgagata

SEQ ID NO: 7446741 - DNA, 22 bp, Homo sapiens
ctcacagcagctctgcgagata

SEQ ID NO: 7446742 - DNA, 22 bp, Homo sapiens
ctcacagcagccagtctgcctt

SEQ ID NO: 7446743 - DNA, 22 bp, Homo sapiens
ctcacagcagctctgcgagata

SEQ ID NO: 7446744 - DNA, 22 bp, Homo sapiens
ctcacagcagctctgcgagata

SEQ ID NO: 7446745 - DNA, 22 bp, Homo sapiens
ctcacagcagctctgcgagata

SEQ ID NO: 7446746 - DNA, 22 bp, Homo sapiens
ctcacagcatggaattttctgg

SEQ ID NO: 7446747 - DNA, 22 bp, Homo sapiens
ctcacactgacttccaggaaca

SEQ ID NO: 7446748 - DNA, 20 bp, Homo sapiens
ctcacactggaaaagtctga

SEQ ID NO: 7446749 - DNA, 20 bp, Homo sapiens
ctcacactggaaaagtctga

SEQ ID NO: 7446750 - DNA, 20 bp, Homo sapiens
ctcacactggaaaagtctga

SEQ ID NO: 7446751 - DNA, 22 bp, Homo sapiens
ctcacacacgaagcccttggcc

SEQ ID NO: 7446752 - DNA, 22 bp, Homo sapiens
ctcacacacgaagcccttggcc

SEQ ID NO: 7446753 - DNA, 22 bp, Homo sapiens
ctcacaccagcttacaagactt

SEQ ID NO: 7446754 - DNA, 22 bp, Homo sapiens
ctcacaccagcttacaagactt

SEQ ID NO: 7446755 - DNA, 22 bp, Homo sapiens
ctcacacacgaagcccttggcc

SEQ ID NO: 7446756 - DNA, 22 bp, Homo sapiens
ctcaatgagaggctttggaaag

SEQ ID NO: 7446757 - DNA, 22 bp, Homo sapiens
ctcaatgagggaaggacagagg

SEQ ID NO: 7446758 - DNA, 22 bp, Homo sapiens
ctcacacttcccaccctcctgg

SEQ ID NO: 7446759 - DNA, 22 bp, Homo sapiens
ctcacacttcccaccctcctgg

SEQ ID NO: 7446760 - DNA, 22 bp, Homo sapiens
ctcacagagcctctgtgtcttc

SEQ ID NO: 7446761 - DNA, 22 bp, Homo sapiens
ctcacagagctcatactgggag

SEQ ID NO: 7446762 - DNA, 22 bp, Homo sapiens
ctcacagatacggctattcctg

SEQ ID NO: 7446763 - DNA, 22 bp, Homo sapiens
ctcacagagcctctgtgtcttc

SEQ ID NO: 7446764 - DNA, 22 bp, Homo sapiens
ctcacagagctcatactgggag

SEQ ID NO: 7446765 - DNA, 22 bp, Homo sapiens
ctcacagatgatgtctatgtgg

SEQ ID NO: 7446766 - DNA, 22 bp, Homo sapiens
ctcacagatgatgtctatgtgg

SEQ ID NO: 7446767 - DNA, 22 bp, Homo sapiens
ctcacagatctgtgcctgaacc

SEQ ID NO: 7446768 - DNA, 22 bp, Homo sapiens
ctcacagatatttgcttcaggt

SEQ ID NO: 7446769 - DNA, 22 bp, Homo sapiens
ctcacagatatttgcttcaggt

SEQ ID NO: 7446770 - DNA, 22 bp, Homo sapiens
ctcacagatacggctattcctg

SEQ ID NO: 7446771 - DNA, 22 bp, Homo sapiens
ctcacagcaaggaggtaaggta

SEQ ID NO: 7446772 - DNA, 22 bp, Homo sapiens
ctcacagatgttctcctttagg

SEQ ID NO: 7446773 - DNA, 22 bp, Homo sapiens
ctcacagatgctgtgggtcagg

SEQ ID NO: 7446774 - DNA, 22 bp, Homo sapiens
ctcacagatgctgtgggtcagg

SEQ ID NO: 7446775 - DNA, 22 bp, Homo sapiens
ctattaaatactcttcaaattg

SEQ ID NO: 7446776 - DNA, 22 bp, Homo sapiens
ctattaaacactactgtgcact

SEQ ID NO: 7446777 - DNA, 22 bp, Homo sapiens
ctattaaacactactgtgcact

SEQ ID NO: 7446778 - DNA, 22 bp, Homo sapiens
ctattaaacactactgtgcact

SEQ ID NO: 7446779 - DNA, 22 bp, Homo sapiens
ctattaaatactcttcaaattg

SEQ ID NO: 7446780 - DNA, 22 bp, Homo sapiens
ctattaaacactactgtgcact

SEQ ID NO: 7446781 - DNA, 22 bp, Homo sapiens
ctattaaatactcttcaaattg

SEQ ID NO: 7446782 - DNA, 22 bp, Homo sapiens
ctattaaatactcttcaaattg

SEQ ID NO: 7446783 - DNA, 22 bp, Homo sapiens
ctattaaatactcttcaaattg

SEQ ID NO: 7446784 - DNA, 22 bp, Homo sapiens
ctattaaatactcttcaaattg

SEQ ID NO: 7446785 - DNA, 22 bp, Homo sapiens
ctattaaatactcttcaaattg

SEQ ID NO: 7446786 - DNA, 22 bp, Homo sapiens
ctattaaatactcttcaaattg

SEQ ID NO: 7446787 - DNA, 22 bp, Homo sapiens
ctattaaatactcttcaaattg

SEQ ID NO: 7446788 - DNA, 22 bp, Homo sapiens
ctattaaacactactgtgcact

SEQ ID NO: 7446789 - DNA, 22 bp, Homo sapiens
ctattaaacactactgtgcact

SEQ ID NO: 7446790 - DNA, 22 bp, Homo sapiens
ctatgtttatctgtatttctgt

SEQ ID NO: 7446791 - DNA, 22 bp, Homo sapiens
ctatgtttatctgtatttctgt

SEQ ID NO: 7446792 - DNA, 22 bp, Homo sapiens
ctatgtttatctgtatttctgt

SEQ ID NO: 7446793 - DNA, 19 bp, Homo sapiens
ctatgtttatatatccagt

SEQ ID NO: 7446794 - DNA, 22 bp, Homo sapiens
ctatgtgcagtagtttctttat

SEQ ID NO: 7446795 - DNA, 22 bp, Homo sapiens
ctatgtgtcttgaaacaagact

SEQ ID NO: 7446796 - DNA, 22 bp, Homo sapiens
ctatgttacaaagcagttagtt

SEQ ID NO: 7446797 - DNA, 22 bp, Homo sapiens
ctatgttctcggcactatggat

SEQ ID NO: 7446798 - DNA, 22 bp, Homo sapiens
ctattaaatactcttcaaattg

SEQ ID NO: 7446799 - DNA, 22 bp, Homo sapiens
ctattacaatctgctactatga

SEQ ID NO: 7446800 - DNA, 22 bp, Homo sapiens
ctattacaatctgctactatga

SEQ ID NO: 7446801 - DNA, 22 bp, Homo sapiens
ctattaaatactcttcaaattg

SEQ ID NO: 7446802 - DNA, 22 bp, Homo sapiens
ctattaaatactcttcaaattg

SEQ ID NO: 7446803 - DNA, 22 bp, Homo sapiens
ctattaaatactcttcaaattg

SEQ ID NO: 7446804 - DNA, 22 bp, Homo sapiens
ctattaaatactcttcaaattg

SEQ ID NO: 7446805 - DNA, 22 bp, Homo sapiens
ctattacatttctggacattca

SEQ ID NO: 7446806 - DNA, 22 bp, Homo sapiens
ctattacatttctggacattca

SEQ ID NO: 7446807 - DNA, 22 bp, Homo sapiens
ctattacaatctgctactatga

SEQ ID NO: 7446808 - DNA, 22 bp, Homo sapiens
ctattacaatctgctactatga

SEQ ID NO: 7446809 - DNA, 18 bp, Homo sapiens
ctattacaatgcagtggt

SEQ ID NO: 7446810 - DNA, 18 bp, Homo sapiens
ctattacaatgcagtggt

SEQ ID NO: 7446811 - DNA, 22 bp, Homo sapiens
ctattacaattctgcaaggagt

SEQ ID NO: 7446812 - DNA, 22 bp, Homo sapiens
ctatgcttcagagttccaggtg

SEQ ID NO: 7446813 - DNA, 22 bp, Homo sapiens
ctatgagaagaaaacaagatta

SEQ ID NO: 7446814 - DNA, 22 bp, Homo sapiens
ctatgcaggccaggtccgcccg

SEQ ID NO: 7446815 - DNA, 18 bp, Homo sapiens
ctatgcatgcattgtatc

SEQ ID NO: 7446816 - DNA, 22 bp, Homo sapiens
ctatatatatcatcttccagtt

SEQ ID NO: 7446817 - DNA, 22 bp, Homo sapiens
ctatatatatcatcttccagtt

SEQ ID NO: 7446818 - DNA, 22 bp, Homo sapiens
ctatgcagaatttagtgactta

SEQ ID NO: 7446819 - DNA, 16 bp, Homo sapiens
ctatggctagaaacat

SEQ ID NO: 7446820 - DNA, 22 bp, Homo sapiens
ctatggctagatgtatcaggtg

SEQ ID NO: 7446821 - DNA, 22 bp, Homo sapiens
ctatggcatttattttgtcaat

SEQ ID NO: 7446822 - DNA, 22 bp, Homo sapiens
ctatggcatgtcacctgctgag

SEQ ID NO: 7446823 - DNA, 23 bp, Homo sapiens
ctatggaataccaatgattctca

SEQ ID NO: 7446824 - DNA, 23 bp, Homo sapiens
ctatggaataccaatgattctca

SEQ ID NO: 7446825 - DNA, 22 bp, Homo sapiens
ctatggaagggatgcaaagaaa

SEQ ID NO: 7446826 - DNA, 22 bp, Homo sapiens
ctatggaaactcaacatttgtt

SEQ ID NO: 7446827 - DNA, 22 bp, Homo sapiens
ctatggaaacctaatcaggaga

SEQ ID NO: 7446828 - DNA, 22 bp, Homo sapiens
ctatggaaactcaacatttgtt

SEQ ID NO: 7446829 - DNA, 22 bp, Homo sapiens
ctatggaaacctaatcaggaga

SEQ ID NO: 7446830 - DNA, 22 bp, Homo sapiens
ctatgtatgcgattagaatttt

SEQ ID NO: 7446831 - DNA, 22 bp, Homo sapiens
ctatgtctcactccctagtcag

SEQ ID NO: 7446832 - DNA, 22 bp, Homo sapiens
ctatgtaccatgcctgatgtta

SEQ ID NO: 7446833 - DNA, 22 bp, Homo sapiens
ctatgtactggattagctccca

SEQ ID NO: 7446834 - DNA, 22 bp, Homo sapiens
ctatggctgcacttatctgagg

SEQ ID NO: 7446835 - DNA, 22 bp, Homo sapiens
ctatggtgatagaaatcagaat

SEQ ID NO: 7446836 - DNA, 22 bp, Homo sapiens
ctatggtgatagaaatcagaat

SEQ ID NO: 7446837 - DNA, 22 bp, Homo sapiens
ctatggtctggaccgaggtcct

SEQ ID NO: 7446838 - DNA, 22 bp, Homo sapiens
ctatggcttgcaatattcttgg

SEQ ID NO: 7446839 - DNA, 22 bp, Homo sapiens
ctatggtctggaccgaggtcct

SEQ ID NO: 7446840 - DNA, 22 bp, Homo sapiens
ctatggcttaagattgacatga

SEQ ID NO: 7446841 - DNA, 22 bp, Homo sapiens
ctatggctgtgttcatgctaca

SEQ ID NO: 7446842 - DNA, 22 bp, Homo sapiens
ctatggctgatttcatttgttt

SEQ ID NO: 7446843 - DNA, 22 bp, Homo sapiens
ctatggctgccactcaagccaa

SEQ ID NO: 7446844 - DNA, 22 bp, Homo sapiens
ctatggctcaattctagtggtt

SEQ ID NO: 7446845 - DNA, 22 bp, Homo sapiens
ctatggctctgtcttttaagtt

SEQ ID NO: 7446846 - DNA, 22 bp, Homo sapiens
ctatggctccttctctactggg

SEQ ID NO: 7446847 - DNA, 22 bp, Homo sapiens
ctatggctctggttatggctgt

SEQ ID NO: 7446848 - DNA, 22 bp, Homo sapiens
ctatggctcaattctagtggtt

SEQ ID NO: 7446849 - DNA, 22 bp, Homo sapiens
ttctctggatgtttctcagtca

SEQ ID NO: 7446850 - DNA, 22 bp, Homo sapiens
ttctctggccatagctggctag

SEQ ID NO: 7446851 - DNA, 22 bp, Homo sapiens
ttctctggccatagctggctag

SEQ ID NO: 7446852 - DNA, 22 bp, Homo sapiens
ttctctggcctgaggcgaggcc

SEQ ID NO: 7446853 - DNA, 22 bp, Homo sapiens
ttctctggcgcgctgtgctatg

SEQ ID NO: 7446854 - DNA, 22 bp, Homo sapiens
ttctctggcgcgctgtgctatg

SEQ ID NO: 7446855 - DNA, 22 bp, Homo sapiens
ttctctggcgcgctgtgctatg

SEQ ID NO: 7446856 - DNA, 22 bp, Homo sapiens
ttctctggcctgaggcgaggcc

SEQ ID NO: 7446857 - DNA, 22 bp, Homo sapiens
ttctctggcctgaggcgaggcc

SEQ ID NO: 7446858 - DNA, 22 bp, Homo sapiens
ttctctggcctgaggcgaggcc

SEQ ID NO: 7446859 - DNA, 22 bp, Homo sapiens
ttctctggcctgaggcgaggcc

SEQ ID NO: 7446860 - DNA, 22 bp, Homo sapiens
ttctctggcctgaggcgaggcc

SEQ ID NO: 7446861 - DNA, 22 bp, Homo sapiens
ttctctggcgcgctgtgctatg

SEQ ID NO: 7446862 - DNA, 22 bp, Homo sapiens
ctagatttctagttcattatcc

SEQ ID NO: 7446863 - DNA, 22 bp, Homo sapiens
ctagatttctagttcattatcc

SEQ ID NO: 7446864 - DNA, 22 bp, Homo sapiens
ctagatttgcatgcctacacca

SEQ ID NO: 7446865 - DNA, 22 bp, Homo sapiens
ctagatttgcatgcctacacca

SEQ ID NO: 7446866 - DNA, 22 bp, Homo sapiens
ctagcaccagcctgagagtttt

SEQ ID NO: 7446867 - DNA, 22 bp, Homo sapiens
ctagcactgagaatagtgcata

SEQ ID NO: 7446868 - DNA, 22 bp, Homo sapiens
ctagcacagtatggtatcagat

SEQ ID NO: 7446869 - DNA, 19 bp, Homo sapiens
ctagattatggaatgctgc

SEQ ID NO: 7446870 - DNA, 19 bp, Homo sapiens
ctagattatggaatgctgc

SEQ ID NO: 7446871 - DNA, 21 bp, Homo sapiens
ttctctggcttctgtagctgg

SEQ ID NO: 7446872 - DNA, 21 bp, Homo sapiens
ttctctggcttctgtagctgg

SEQ ID NO: 7446873 - DNA, 21 bp, Homo sapiens
ttctctggcttctgtagctgg

SEQ ID NO: 7446874 - DNA, 21 bp, Homo sapiens
ttctctggcttctgtagctgg

SEQ ID NO: 7446875 - DNA, 22 bp, Homo sapiens
ttctctggcggtgtgttttcct

SEQ ID NO: 7446876 - DNA, 22 bp, Homo sapiens
ctagcaggtcaaaccagctgat

SEQ ID NO: 7446877 - DNA, 22 bp, Homo sapiens
ctagcatcagatgagaagctgt

SEQ ID NO: 7446878 - DNA, 22 bp, Homo sapiens
ctagcatctcactgatttactg

SEQ ID NO: 7446879 - DNA, 22 bp, Homo sapiens
ctagccagactcaagggccacc

SEQ ID NO: 7446880 - DNA, 22 bp, Homo sapiens
ctagccagactcaagggccacc

SEQ ID NO: 7446881 - DNA, 22 bp, Homo sapiens
ctagccagatgattcccaaata

SEQ ID NO: 7446882 - DNA, 22 bp, Homo sapiens
ctagccagatgattcccaaata

SEQ ID NO: 7446883 - DNA, 22 bp, Homo sapiens
ctagcatctcactgatttactg

SEQ ID NO: 7446884 - DNA, 22 bp, Homo sapiens
ctagccagactcaagggccacc

SEQ ID NO: 7446885 - DNA, 22 bp, Homo sapiens
ctatatatatcatcttccagtt

SEQ ID NO: 7446886 - DNA, 22 bp, Homo sapiens
ctatatatatcatcttccagtt

SEQ ID NO: 7446887 - DNA, 22 bp, Homo sapiens
ctatatacttttcacagatgtt

SEQ ID NO: 7446888 - DNA, 22 bp, Homo sapiens
ctatatacttttcacagatgtt

SEQ ID NO: 7446889 - DNA, 22 bp, Homo sapiens
ctatatacttttcacagatgtt

SEQ ID NO: 7446890 - DNA, 22 bp, Homo sapiens
ctatatacttttcacagatgtt

SEQ ID NO: 7446891 - DNA, 22 bp, Homo sapiens
ctatatacttttcacagatgtt

SEQ ID NO: 7446892 - DNA, 22 bp, Homo sapiens
ctagccagatttaaagagagac

SEQ ID NO: 7446893 - DNA, 22 bp, Homo sapiens
ctagccagatttaaagagagac

SEQ ID NO: 7446894 - DNA, 22 bp, Homo sapiens
ctagccagatttaaagagagac

SEQ ID NO: 7446895 - DNA, 22 bp, Homo sapiens
ctagcaggtcaaaccagctgat

SEQ ID NO: 7446896 - DNA, 22 bp, Homo sapiens
ctagcagggattgggcactggg

SEQ ID NO: 7446897 - DNA, 22 bp, Homo sapiens
ctagcagggtcgacgtctggcg

SEQ ID NO: 7446898 - DNA, 22 bp, Homo sapiens
ctagcagggtcgacgtctggcg

SEQ ID NO: 7446899 - DNA, 22 bp, Homo sapiens
ctagcaggtcaaaccagctgat

SEQ ID NO: 7446900 - DNA, 22 bp, Homo sapiens
ctagcaggtcaaaccagctgat

SEQ ID NO: 7446901 - DNA, 22 bp, Homo sapiens
ctagcaggctaatgtaagcttg

SEQ ID NO: 7446902 - DNA, 22 bp, Homo sapiens
ctagcaggctaatgtaagcttg

SEQ ID NO: 7446903 - DNA, 22 bp, Homo sapiens
ctagcagctctgatatttacaa

SEQ ID NO: 7446904 - DNA, 22 bp, Homo sapiens
ctagcagggattgggcactggg

SEQ ID NO: 7446905 - DNA, 22 bp, Homo sapiens
ctagcagggattgggcactggg

SEQ ID NO: 7446906 - DNA, 22 bp, Homo sapiens
ctagcagggattgggcactggg

SEQ ID NO: 7446907 - DNA, 22 bp, Homo sapiens
ctagcagcattcttctagttag

SEQ ID NO: 7446908 - DNA, 22 bp, Homo sapiens
ctagcagcattcttctagttag

SEQ ID NO: 7446909 - DNA, 22 bp, Homo sapiens
ctagcagcattcttctagttag

SEQ ID NO: 7446910 - DNA, 22 bp, Homo sapiens
ctagcagctctgatatttacaa

SEQ ID NO: 7446911 - DNA, 22 bp, Homo sapiens
ctagcagaagctccttgagggt

SEQ ID NO: 7446912 - DNA, 22 bp, Homo sapiens
ctagcagcatcacaggaagact

SEQ ID NO: 7446913 - DNA, 22 bp, Homo sapiens
ctagcagcatcacaggaagact

SEQ ID NO: 7446914 - DNA, 22 bp, Homo sapiens
ctagcagcatcacaggaagact

SEQ ID NO: 7446915 - DNA, 22 bp, Homo sapiens
ctagcagcatcacaggaagact

SEQ ID NO: 7446916 - DNA, 22 bp, Homo sapiens
ctagcagcatcacaggaagact

SEQ ID NO: 7446917 - DNA, 22 bp, Homo sapiens
ctacaacattatgctttctgtc

SEQ ID NO: 7446918 - DNA, 22 bp, Homo sapiens
ctacagagaactcagctgccct

SEQ ID NO: 7446919 - DNA, 22 bp, Homo sapiens
ttccaggatgggctgtcctact

SEQ ID NO: 7446920 - DNA, 22 bp, Homo sapiens
ctacaacatagtcttctacaga

SEQ ID NO: 7446921 - DNA, 22 bp, Homo sapiens
ttccaggatgggctgtcctact

SEQ ID NO: 7446922 - DNA, 22 bp, Homo sapiens
ttccaggatgggctgtcctact

SEQ ID NO: 7446923 - DNA, 22 bp, Homo sapiens
ttccaggatggcaataatgaat

SEQ ID NO: 7446924 - DNA, 22 bp, Homo sapiens
ttccaggatggcaataatgaat

SEQ ID NO: 7446925 - DNA, 22 bp, Homo sapiens
ctacaacatagtcttctacaga

SEQ ID NO: 7446926 - DNA, 22 bp, Homo sapiens
ctacaacaccaggcacggagtg

SEQ ID NO: 7446927 - DNA, 22 bp, Homo sapiens
ctacagaggacacaaagatctt

SEQ ID NO: 7446928 - DNA, 22 bp, Homo sapiens
ctacagagaattgtgtgatttt

SEQ ID NO: 7446929 - DNA, 22 bp, Homo sapiens
ctacagagaactcagctgccct

SEQ ID NO: 7446930 - DNA, 22 bp, Homo sapiens
ctacagagaactcagctgccct

SEQ ID NO: 7446931 - DNA, 22 bp, Homo sapiens
ctacagagaattgtgtgatttt

SEQ ID NO: 7446932 - DNA, 22 bp, Homo sapiens
ctacagagaactcagctgccct

SEQ ID NO: 7446933 - DNA, 22 bp, Homo sapiens
ctacagagaactcagctgccct

SEQ ID NO: 7446934 - DNA, 21 bp, Homo sapiens
ctacagaggagagggaaaggc

SEQ ID NO: 7446935 - DNA, 21 bp, Homo sapiens
ctacagaggagagggaaaggc

SEQ ID NO: 7446936 - DNA, 22 bp, Homo sapiens
ctacagagtatctaaagaggta

SEQ ID NO: 7446937 - DNA, 22 bp, Homo sapiens
ttccaggatggagacactagta

SEQ ID NO: 7446938 - DNA, 22 bp, Homo sapiens
ttccaggatggagacactagta

SEQ ID NO: 7446939 - DNA, 22 bp, Homo sapiens
ttccaggatggcaataatgaat

SEQ ID NO: 7446940 - DNA, 22 bp, Homo sapiens
ttccaggatgctgctgcttttt

SEQ ID NO: 7446941 - DNA, 22 bp, Homo sapiens
ttccaggatgctgctgcttttt

SEQ ID NO: 7446942 - DNA, 22 bp, Homo sapiens
ttccaggaggtcaaaggcctgt

SEQ ID NO: 7446943 - DNA, 22 bp, Homo sapiens
ttccaggaggcttggcgggagg

SEQ ID NO: 7446944 - DNA, 22 bp, Homo sapiens
ttccaggaggtcaaaggcctgt

SEQ ID NO: 7446945 - DNA, 22 bp, Homo sapiens
ttccaggatagctttcaggaat

SEQ ID NO: 7446946 - DNA, 22 bp, Homo sapiens
ttccaggatagctttcaggaat

SEQ ID NO: 7446947 - DNA, 22 bp, Homo sapiens
ttccaggatagctttcaggaat

SEQ ID NO: 7446948 - DNA, 22 bp, Homo sapiens
ttccaggatgctgctgcttttt

SEQ ID NO: 7446949 - DNA, 22 bp, Homo sapiens
ttccaggatgctgctgcttttt

SEQ ID NO: 7446950 - DNA, 22 bp, Homo sapiens
ttccaggaggcttggcgggagg

SEQ ID NO: 7446951 - DNA, 22 bp, Homo sapiens
ttccaggaggcttggcgggagg

SEQ ID NO: 7446952 - DNA, 22 bp, Homo sapiens
ttccaggaggcattcttagttt

SEQ ID NO: 7446953 - DNA, 22 bp, Homo sapiens
ttccaggaggcattcttagttt

SEQ ID NO: 7446954 - DNA, 22 bp, Homo sapiens
ttccaggaggcactgacagagg

SEQ ID NO: 7446955 - DNA, 22 bp, Homo sapiens
ttccaggaggcattcttagttt

SEQ ID NO: 7446956 - DNA, 22 bp, Homo sapiens
ttccaggaggcactgacagagg

SEQ ID NO: 7446957 - DNA, 22 bp, Homo sapiens
ttccaggaggaggtactagagg

SEQ ID NO: 7446958 - DNA, 22 bp, Homo sapiens
ttccaggaggcactgacagagg

SEQ ID NO: 7446959 - DNA, 22 bp, Homo sapiens
ttccaggaggaggtactagagg

SEQ ID NO: 7446960 - DNA, 22 bp, Homo sapiens
ttccaggaggaggtactagagg

SEQ ID NO: 7446961 - DNA, 22 bp, Homo sapiens
ttccaggagacttccagaaata

SEQ ID NO: 7446962 - DNA, 22 bp, Homo sapiens
ttccaggagaggaaacctgatt

SEQ ID NO: 7446963 - DNA, 22 bp, Homo sapiens
ttccaggacttcatggctctga

SEQ ID NO: 7446964 - DNA, 22 bp, Homo sapiens
ttccaggacttcatggctctga

SEQ ID NO: 7446965 - DNA, 22 bp, Homo sapiens
ttccaggagacttccagaaata

SEQ ID NO: 7446966 - DNA, 22 bp, Homo sapiens
ttccaggagacttccagaaata

SEQ ID NO: 7446967 - DNA, 22 bp, Homo sapiens
ttccaggagccacacaggggcg

SEQ ID NO: 7446968 - DNA, 22 bp, Homo sapiens
ttccaggagccacacaggggcg

SEQ ID NO: 7446969 - DNA, 22 bp, Homo sapiens
ttccaggagccacacaggggcg

SEQ ID NO: 7446970 - DNA, 22 bp, Homo sapiens
ttccaggaggaaagtttgggtg

SEQ ID NO: 7446971 - DNA, 22 bp, Homo sapiens
ttccaggaggaaagtttgggtg

SEQ ID NO: 7446972 - DNA, 22 bp, Homo sapiens
ttccaggactcgttctggctca

SEQ ID NO: 7446973 - DNA, 22 bp, Homo sapiens
ttccaggactcgttctggctca

SEQ ID NO: 7446974 - DNA, 22 bp, Homo sapiens
ttccaggacttcatggctctga

SEQ ID NO: 7446975 - DNA, 22 bp, Homo sapiens
ttccaggactgggtgtttgaag

SEQ ID NO: 7446976 - DNA, 22 bp, Homo sapiens
ttccaggactgggtgtttgaag

SEQ ID NO: 7446977 - DNA, 22 bp, Homo sapiens
ttccaggacttcatggctctga

SEQ ID NO: 7446978 - DNA, 22 bp, Homo sapiens
ttccaggactcgttctggctca

SEQ ID NO: 7446979 - DNA, 22 bp, Homo sapiens
ttccaggactgggtgtttgaag

SEQ ID NO: 7446980 - DNA, 22 bp, Homo sapiens
ttccaggaccaggaagagggga

SEQ ID NO: 7446981 - DNA, 22 bp, Homo sapiens
ttccaggaccaggaagagggga

SEQ ID NO: 7446982 - DNA, 22 bp, Homo sapiens
ttccaggaccaggaagagggga

SEQ ID NO: 7446983 - DNA, 22 bp, Homo sapiens
ttccaggactcgttctggctca

SEQ ID NO: 7446984 - DNA, 22 bp, Homo sapiens
ttccaggacaagatgtttcagg

SEQ ID NO: 7446985 - DNA, 22 bp, Homo sapiens
ttccaggaccaggaagagggga

SEQ ID NO: 7446986 - DNA, 22 bp, Homo sapiens
ttccaggacaagatgtttcagg

SEQ ID NO: 7446987 - DNA, 22 bp, Homo sapiens
ttccaggacaagatgtttcagg

SEQ ID NO: 7446988 - DNA, 22 bp, Homo sapiens
ctaaatgatattttggtttcct

SEQ ID NO: 7446989 - DNA, 22 bp, Homo sapiens
ctaaatgatattttggtttcct

SEQ ID NO: 7446990 - DNA, 22 bp, Homo sapiens
ctaaatgatattttggtttcct

SEQ ID NO: 7446991 - DNA, 22 bp, Homo sapiens
ttccaggaattcagctctcagt

SEQ ID NO: 7446992 - DNA, 22 bp, Homo sapiens
ttccaggaattcagctctcagt

SEQ ID NO: 7446993 - DNA, 22 bp, Homo sapiens
ttccaggaattcagctctcagt

SEQ ID NO: 7446994 - DNA, 22 bp, Homo sapiens
ctaaatcatcatttatgtttgt

SEQ ID NO: 7446995 - DNA, 22 bp, Homo sapiens
ctaaatcaggccttacagcttc

SEQ ID NO: 7446996 - DNA, 22 bp, Homo sapiens
ctaaatcaggccttacagcttc

SEQ ID NO: 7446997 - DNA, 22 bp, Homo sapiens
ctaaatcatcatttatgtttgt

SEQ ID NO: 7446998 - DNA, 22 bp, Homo sapiens
ctaaatcatcatttatgtttgt

SEQ ID NO: 7446999 - DNA, 22 bp, Homo sapiens
ctaaatctagtctttactgatt

SEQ ID NO: 7447000 - DNA, 22 bp, Homo sapiens
ctaaatctagtctttactgatt

SEQ ID NO: 7447001 - DNA, 22 bp, Homo sapiens
ctaaatgacaggtaccatagtg

SEQ ID NO: 7447002 - DNA, 22 bp, Homo sapiens
ctaaatgacaggtaccatagtg

SEQ ID NO: 7447003 - DNA, 22 bp, Homo sapiens
ctaaatgacttccagtggttat

SEQ ID NO: 7447004 - DNA, 22 bp, Homo sapiens
ctacagcagagctacactaact

SEQ ID NO: 7447005 - DNA, 22 bp, Homo sapiens
ctacagcagagctacactaact

SEQ ID NO: 7447006 - DNA, 22 bp, Homo sapiens
ctacagctggccttggaaaact

SEQ ID NO: 7447007 - DNA, 22 bp, Homo sapiens
ctacagcagagctacactaact

SEQ ID NO: 7447008 - DNA, 22 bp, Homo sapiens
ctacagcagagctacactaact

SEQ ID NO: 7447009 - DNA, 22 bp, Homo sapiens
ctacagcagagaccagccacat

SEQ ID NO: 7447010 - DNA, 22 bp, Homo sapiens
ctacagctgtaaaaggaatgtc

SEQ ID NO: 7447011 - DNA, 22 bp, Homo sapiens
ctacagctggccttggaaaact

SEQ ID NO: 7447012 - DNA, 22 bp, Homo sapiens
ctacagctgtaaaaggaatgtc

SEQ ID NO: 7447013 - DNA, 22 bp, Homo sapiens
ctacagctgtgtgtttatgtgc

SEQ ID NO: 7447014 - DNA, 22 bp, Homo sapiens
ctacaggaaggatcttgctcaa

SEQ ID NO: 7447015 - DNA, 22 bp, Homo sapiens
ctacagctgtaaaaggaatgtc

SEQ ID NO: 7447016 - DNA, 22 bp, Homo sapiens
ctacagctgtgtgtttatgtgc

SEQ ID NO: 7447017 - DNA, 22 bp, Homo sapiens
ctacagcagagaccagccacat

SEQ ID NO: 7447018 - DNA, 22 bp, Homo sapiens
ctacagagttcacaggatttta

SEQ ID NO: 7447019 - DNA, 22 bp, Homo sapiens
ctacagagttcacaggatttta

SEQ ID NO: 7447020 - DNA, 22 bp, Homo sapiens
ctacagagtgaatgcagaaaat

SEQ ID NO: 7447021 - DNA, 22 bp, Homo sapiens
ctacagagtatctaaagaggta

SEQ ID NO: 7447022 - DNA, 22 bp, Homo sapiens
ctacaggctcagggagccctct

SEQ ID NO: 7447023 - DNA, 22 bp, Homo sapiens
ctacaggctcagggagccctct

SEQ ID NO: 7447024 - DNA, 22 bp, Homo sapiens
ctacaggagtaaaataatttca

SEQ ID NO: 7447025 - DNA, 22 bp, Homo sapiens
ctacaggtatgtgcatgacatc

SEQ ID NO: 7447026 - DNA, 22 bp, Homo sapiens
ctacaggtatgtgcatgacatc

SEQ ID NO: 7447027 - DNA, 22 bp, Homo sapiens
ctacaggctcagggagccctct

SEQ ID NO: 7447028 - DNA, 22 bp, Homo sapiens
ctacaggctcagggagccctct

SEQ ID NO: 7447029 - DNA, 22 bp, Homo sapiens
ctacaggctcagggagccctct

SEQ ID NO: 7447030 - DNA, 22 bp, Homo sapiens
ctacaggagtaaaataatttca

SEQ ID NO: 7447031 - DNA, 22 bp, Homo sapiens
ctacagctgtgtgtttatgtgc

SEQ ID NO: 7447032 - DNA, 22 bp, Homo sapiens
ctacaggaaggatcttgctcaa

SEQ ID NO: 7447033 - DNA, 22 bp, Homo sapiens
ctacagtagaggttgtcaggga

SEQ ID NO: 7447034 - DNA, 22 bp, Homo sapiens
ctacagtagagtaggcctctga

SEQ ID NO: 7447035 - DNA, 22 bp, Homo sapiens
ctacagtatgaaacctttactc

SEQ ID NO: 7447036 - DNA, 22 bp, Homo sapiens
ctacagtatgaaacctttactc

SEQ ID NO: 7447037 - DNA, 22 bp, Homo sapiens
ctacagtagagaggatgtagaa

SEQ ID NO: 7447038 - DNA, 22 bp, Homo sapiens
ctacagtactggatgctcagcc

SEQ ID NO: 7447039 - DNA, 22 bp, Homo sapiens
ctacagtagagaggatgtagaa

SEQ ID NO: 7447040 - DNA, 23 bp, Homo sapiens
ctacaggttaattttcagtggaa

SEQ ID NO: 7447041 - DNA, 22 bp, Homo sapiens
ctacaggtcagtaagacctaga

SEQ ID NO: 7447042 - DNA, 22 bp, Homo sapiens
ctacaggtatgtgcatgacatc

SEQ ID NO: 7447043 - DNA, 22 bp, Homo sapiens
ttcctgggattattgtcaagca

SEQ ID NO: 7447044 - DNA, 22 bp, Homo sapiens
ttcctgggattattgtcaagca

SEQ ID NO: 7447045 - DNA, 22 bp, Homo sapiens
ttcctgggattattgtcaagca

SEQ ID NO: 7447046 - DNA, 22 bp, Homo sapiens
ttcctgggaggctgtgtacttg

SEQ ID NO: 7447047 - DNA, 22 bp, Homo sapiens
ttcctgggaggctgtgtacttg

SEQ ID NO: 7447048 - DNA, 22 bp, Homo sapiens
ttcctgggaggctgtgtacttg

SEQ ID NO: 7447049 - DNA, 22 bp, Homo sapiens
ttcctgggctgcagagagcacc

SEQ ID NO: 7447050 - DNA, 22 bp, Homo sapiens
ttcctgggctgcagagagcacc

SEQ ID NO: 7447051 - DNA, 22 bp, Homo sapiens
ttcctgggctctggctggccta

SEQ ID NO: 7447052 - DNA, 22 bp, Homo sapiens
ttcctgggctctggctggccta

SEQ ID NO: 7447053 - DNA, 22 bp, Homo sapiens
ttcctgggcaggacgagagtct

SEQ ID NO: 7447054 - DNA, 22 bp, Homo sapiens
ttcctgggcaggacgagagtct

SEQ ID NO: 7447055 - DNA, 22 bp, Homo sapiens
ttcctgggcaggacgagagtct

SEQ ID NO: 7447056 - DNA, 22 bp, Homo sapiens
ttcctgggccttaaatcttttg

SEQ ID NO: 7447057 - DNA, 22 bp, Homo sapiens
ttcctgggccttaaatcttttg

SEQ ID NO: 7447058 - DNA, 22 bp, Homo sapiens
ttcctggctgtcatgccctagt

SEQ ID NO: 7447059 - DNA, 22 bp, Homo sapiens
ttcctgggactggagcagccca

SEQ ID NO: 7447060 - DNA, 22 bp, Homo sapiens
ttcctggcttttgggctaattc

SEQ ID NO: 7447061 - DNA, 22 bp, Homo sapiens
ttcctggcttttgggctaattc

SEQ ID NO: 7447062 - DNA, 22 bp, Homo sapiens
ttcctgggagctagccacatct

SEQ ID NO: 7447063 - DNA, 22 bp, Homo sapiens
ttcctgggagctagccacatct

SEQ ID NO: 7447064 - DNA, 22 bp, Homo sapiens
ttcctgggactggagcagccca

SEQ ID NO: 7447065 - DNA, 22 bp, Homo sapiens
ttcctgggactggagcagccca

SEQ ID NO: 7447066 - DNA, 22 bp, Homo sapiens
ctacagtctggcaggaatgtta

SEQ ID NO: 7447067 - DNA, 22 bp, Homo sapiens
ttcctggctcacagcagtgggg

SEQ ID NO: 7447068 - DNA, 20 bp, Homo sapiens
ttcctggctctaggaccttg

SEQ ID NO: 7447069 - DNA, 22 bp, Homo sapiens
ttcctggctctctgttgcacag

SEQ ID NO: 7447070 - DNA, 20 bp, Homo sapiens
ttcctggctctaggaccttg

SEQ ID NO: 7447071 - DNA, 19 bp, Homo sapiens
ttcctggctcttctgtttt

SEQ ID NO: 7447072 - DNA, 22 bp, Homo sapiens
ttcctggctgaactgaactcct

SEQ ID NO: 7447073 - DNA, 21 bp, Homo sapiens
ttcctggggaaggagctgcct

SEQ ID NO: 7447074 - DNA, 22 bp, Homo sapiens
ctacatttcatccagggagagc

SEQ ID NO: 7447075 - DNA, 22 bp, Homo sapiens
ctacatttcatccagggagagc

SEQ ID NO: 7447076 - DNA, 22 bp, Homo sapiens
ctacatttcatccagggagagc

SEQ ID NO: 7447077 - DNA, 22 bp, Homo sapiens
ctacatttcccagctgccttcc

SEQ ID NO: 7447078 - DNA, 22 bp, Homo sapiens
ctacatttcccagctgccttcc

SEQ ID NO: 7447079 - DNA, 22 bp, Homo sapiens
ttcctgggctttcccctctggt

SEQ ID NO: 7447080 - DNA, 22 bp, Homo sapiens
ttcctgggctgcagagagcacc

SEQ ID NO: 7447081 - DNA, 21 bp, Homo sapiens
ttcctggggaaggagctgcct

SEQ ID NO: 7447082 - DNA, 22 bp, Homo sapiens
ttcctgggctgcagagagcacc

SEQ ID NO: 7447083 - DNA, 22 bp, Homo sapiens
ttcctgggctgcagagagcacc

SEQ ID NO: 7447084 - DNA, 22 bp, Homo sapiens
ctacccttaagtttctgtgggg

SEQ ID NO: 7447085 - DNA, 22 bp, Homo sapiens
ctacccttaagtttctgtgggg

SEQ ID NO: 7447086 - DNA, 22 bp, Homo sapiens
ctaccctgtatttagagatgca

SEQ ID NO: 7447087 - DNA, 22 bp, Homo sapiens
ctaccctgtatttagagatgca

SEQ ID NO: 7447088 - DNA, 22 bp, Homo sapiens
ctacccttaagtttctgtgggg

SEQ ID NO: 7447089 - DNA, 22 bp, Homo sapiens
ctacctgaaaaggttgtggtga

SEQ ID NO: 7447090 - DNA, 22 bp, Homo sapiens
ctaccgggttctcagccaggca

SEQ ID NO: 7447091 - DNA, 22 bp, Homo sapiens
ctacctatgtgccctctggcca

SEQ ID NO: 7447092 - DNA, 22 bp, Homo sapiens
ctaccttcaagttcctccctct

SEQ ID NO: 7447093 - DNA, 22 bp, Homo sapiens
ctacctgaaaaggttgtggtga

SEQ ID NO: 7447094 - DNA, 22 bp, Homo sapiens
ctacctgaaaaggttgtggtga

SEQ ID NO: 7447095 - DNA, 22 bp, Homo sapiens
ctacccaggcttagagggctgg

SEQ ID NO: 7447096 - DNA, 22 bp, Homo sapiens
ctacccaggcttagagggctgg

SEQ ID NO: 7447097 - DNA, 22 bp, Homo sapiens
ctacccaggctggagtgcagta

SEQ ID NO: 7447098 - DNA, 22 bp, Homo sapiens
ctacccaggctggagtgcagta

SEQ ID NO: 7447099 - DNA, 22 bp, Homo sapiens
ctacatttcccagctgccttcc

SEQ ID NO: 7447100 - DNA, 21 bp, Homo sapiens
ctaccctcactcccattcctc

SEQ ID NO: 7447101 - DNA, 21 bp, Homo sapiens
ctaccctctcctgctcatatc

SEQ ID NO: 7447102 - DNA, 21 bp, Homo sapiens
ctaccctcactcccattcctc

SEQ ID NO: 7447103 - DNA, 22 bp, Homo sapiens
ctacccaggcttagagggctgg

SEQ ID NO: 7447104 - DNA, 22 bp, Homo sapiens
ctacctttctgactcttgggat

SEQ ID NO: 7447105 - DNA, 22 bp, Homo sapiens
ctactagatcagtatgcctcaa

SEQ ID NO: 7447106 - DNA, 22 bp, Homo sapiens
ctaccttcaagttcctccctct

SEQ ID NO: 7447107 - DNA, 22 bp, Homo sapiens
ctaccttcaagttcctccctct

SEQ ID NO: 7447108 - DNA, 22 bp, Homo sapiens
ctactagctactcattcaaatt

SEQ ID NO: 7447109 - DNA, 22 bp, Homo sapiens
ctactagtggtctctttctgtg

SEQ ID NO: 7447110 - DNA, 22 bp, Homo sapiens
ctactgaattagactgcatttt

SEQ ID NO: 7447111 - DNA, 22 bp, Homo sapiens
ctactgagtccttcagctgcca

SEQ ID NO: 7447112 - DNA, 22 bp, Homo sapiens
ctactgatgatgttggttgtgg

SEQ ID NO: 7447113 - DNA, 22 bp, Homo sapiens
ctactgatgatgttggttgtgg

SEQ ID NO: 7447114 - DNA, 22 bp, Homo sapiens
ctactgatgctatacttctcag

SEQ ID NO: 7447115 - DNA, 22 bp, Homo sapiens
ctactgaaactcagaaattcaa

SEQ ID NO: 7447116 - DNA, 22 bp, Homo sapiens
ctactcttttgagtcttcagat

SEQ ID NO: 7447117 - DNA, 22 bp, Homo sapiens
ctactgaagataactggctctt

SEQ ID NO: 7447118 - DNA, 22 bp, Homo sapiens
ctactgaaactcagaaattcaa

SEQ ID NO: 7447119 - DNA, 22 bp, Homo sapiens
ctactggccatctgatctacaa

SEQ ID NO: 7447120 - DNA, 22 bp, Homo sapiens
ctactgccattgtctctgccat

SEQ ID NO: 7447121 - DNA, 22 bp, Homo sapiens
ctactgtaatagatgaatttga

SEQ ID NO: 7447122 - DNA, 22 bp, Homo sapiens
ctactgccattgtctctgccat

SEQ ID NO: 7447123 - DNA, 22 bp, Homo sapiens
ctactgccattgtctctgccat

SEQ ID NO: 7447124 - DNA, 22 bp, Homo sapiens
ctactgatgctatacttctcag

SEQ ID NO: 7447125 - DNA, 22 bp, Homo sapiens
ctactgatgctatacttctcag

SEQ ID NO: 7447126 - DNA, 22 bp, Homo sapiens
ctactgtctcatcagtgttatt

SEQ ID NO: 7447127 - DNA, 22 bp, Homo sapiens
ctactgttattattaatagtaa

SEQ ID NO: 7447128 - DNA, 22 bp, Homo sapiens
ctactgttgggagccctggaag

SEQ ID NO: 7447129 - DNA, 22 bp, Homo sapiens
ctactgttgtgttttaaaggta

SEQ ID NO: 7447130 - DNA, 22 bp, Homo sapiens
ctactgccattgtctctgccat

SEQ ID NO: 7447131 - DNA, 22 bp, Homo sapiens
ctactgtagtggcctatttacc

SEQ ID NO: 7447132 - DNA, 22 bp, Homo sapiens
ctactgtagtggcctatttacc

SEQ ID NO: 7447133 - DNA, 22 bp, Homo sapiens
ctagaaaaatactttattgtga

SEQ ID NO: 7447134 - DNA, 22 bp, Homo sapiens
ctagaaaaatactttattgtga

SEQ ID NO: 7447135 - DNA, 22 bp, Homo sapiens
ctagaaaaatactttattgtga

SEQ ID NO: 7447136 - DNA, 22 bp, Homo sapiens
ctagaaaaatactttattgtga

SEQ ID NO: 7447137 - DNA, 22 bp, Homo sapiens
ctagaaaaatactttattgtga

SEQ ID NO: 7447138 - DNA, 22 bp, Homo sapiens
ctagaaaaatactttattgtga

SEQ ID NO: 7447139 - DNA, 19 bp, Homo sapiens
ctactttataatatgcctc

SEQ ID NO: 7447140 - DNA, 22 bp, Homo sapiens
ctactttacctccatcagactg

SEQ ID NO: 7447141 - DNA, 22 bp, Homo sapiens
ctactttgctgcccagcagtgc

SEQ ID NO: 7447142 - DNA, 19 bp, Homo sapiens
ctactttataatatgcctc

SEQ ID NO: 7447143 - DNA, 20 bp, Homo sapiens
ctactttaggcactgagaat

SEQ ID NO: 7447144 - DNA, 20 bp, Homo sapiens
ctactttaggcactgagaat

SEQ ID NO: 7447145 - DNA, 20 bp, Homo sapiens
ctactttaggcactgagaat

SEQ ID NO: 7447146 - DNA, 22 bp, Homo sapiens
ctactttacctccatcagactg

SEQ ID NO: 7447147 - DNA, 22 bp, Homo sapiens
ctactttaattttctgcagaga

SEQ ID NO: 7447148 - DNA, 22 bp, Homo sapiens
ctacttgttcactgtaggtcgc

SEQ ID NO: 7447149 - DNA, 22 bp, Homo sapiens
ctactttaacatggaggcactt

SEQ ID NO: 7447150 - DNA, 22 bp, Homo sapiens
ctactttaacatggaggcactt

SEQ ID NO: 7447151 - DNA, 22 bp, Homo sapiens
ctacttctgtgatgaaactaca

SEQ ID NO: 7447152 - DNA, 22 bp, Homo sapiens
ctacttctgtgatgaaactaca

SEQ ID NO: 7447153 - DNA, 22 bp, Homo sapiens
ctacttggtacctgaagatcgg

SEQ ID NO: 7447154 - DNA, 22 bp, Homo sapiens
ctacttgttcactgtaggtcgc

SEQ ID NO: 7447155 - DNA, 22 bp, Homo sapiens
ctacttcttgatctgtcgacct

SEQ ID NO: 7447156 - DNA, 17 bp, Homo sapiens
ctacttcttctattctt

SEQ ID NO: 7447157 - DNA, 22 bp, Homo sapiens
ctacttccaggggtggggctca

SEQ ID NO: 7447158 - DNA, 22 bp, Homo sapiens
ctacttctaagtacatggtgat

SEQ ID NO: 7447159 - DNA, 22 bp, Homo sapiens
ctacttctgtgatgaaactaca

SEQ ID NO: 7447160 - DNA, 21 bp, Homo sapiens
ctacttaagtaggggattagg

SEQ ID NO: 7447161 - DNA, 21 bp, Homo sapiens
ctacttaagtaggggattagg

SEQ ID NO: 7447162 - DNA, 21 bp, Homo sapiens
ctacttaagtaggggattagg

SEQ ID NO: 7447163 - DNA, 22 bp, Homo sapiens
ctacttagagacatgctaacat

SEQ ID NO: 7447164 - DNA, 22 bp, Homo sapiens
ctacttatgggtggtaccagca

SEQ ID NO: 7447165 - DNA, 21 bp, Homo sapiens
ctacttaagtaggggattagg

SEQ ID NO: 7447166 - DNA, 22 bp, Homo sapiens
ttctctggagggctgcccggcc

SEQ ID NO: 7447167 - DNA, 22 bp, Homo sapiens
ttctctaagagatgcagaagtt

SEQ ID NO: 7447168 - DNA, 22 bp, Homo sapiens
ttctctggactatttgcactcc

SEQ ID NO: 7447169 - DNA, 22 bp, Homo sapiens
ttctctggagagtatcttctta

SEQ ID NO: 7447170 - DNA, 22 bp, Homo sapiens
ttctctggagagtatcttctta

SEQ ID NO: 7447171 - DNA, 20 bp, Homo sapiens
ttctctggatagccagatgt

SEQ ID NO: 7447172 - DNA, 22 bp, Homo sapiens
ttctctggagggctgcccggcc

SEQ ID NO: 7447173 - DNA, 20 bp, Homo sapiens
ttctctggatagccagatgt

SEQ ID NO: 7447174 - DNA, 21 bp, Homo sapiens
ttctctggataggccagtcct

SEQ ID NO: 7447175 - DNA, 21 bp, Homo sapiens
ttctctggataggccagtcct

SEQ ID NO: 7447176 - DNA, 22 bp, Homo sapiens
ttctctggatgtttctcagtca

SEQ ID NO: 7447177 - DNA, 22 bp, Homo sapiens
ttctctggatgtttctcagtca

SEQ ID NO: 7447178 - DNA, 22 bp, Homo sapiens
ttctctaaagagttaggccaag

SEQ ID NO: 7447179 - DNA, 22 bp, Homo sapiens
ttctctaaaattaagtgaggta

SEQ ID NO: 7447180 - DNA, 22 bp, Homo sapiens
ctagaaacattacatgtgttaa

SEQ ID NO: 7447181 - DNA, 22 bp, Homo sapiens
ctagaaacgcctttagcacaac

SEQ ID NO: 7447182 - DNA, 22 bp, Homo sapiens
ctagaaacgcctttagcacaac

SEQ ID NO: 7447183 - DNA, 22 bp, Homo sapiens
ttctcctttgtaattctcatcc

SEQ ID NO: 7447184 - DNA, 21 bp, Homo sapiens
ctagaaagaatgttgtcgtct

SEQ ID NO: 7447185 - DNA, 22 bp, Homo sapiens
ttctccttttccagttcccagt

SEQ ID NO: 7447186 - DNA, 22 bp, Homo sapiens
ctaaagctcaacaggcactatt

SEQ ID NO: 7447187 - DNA, 22 bp, Homo sapiens
ctaaaggatattagaggagaaa

SEQ ID NO: 7447188 - DNA, 22 bp, Homo sapiens
ctaaagcaactgagacacatag

SEQ ID NO: 7447189 - DNA, 22 bp, Homo sapiens
ctaaagcaactgagacacatag

SEQ ID NO: 7447190 - DNA, 22 bp, Homo sapiens
ctaaagatgtacatttttctcc

SEQ ID NO: 7447191 - DNA, 22 bp, Homo sapiens
ctaaagatgtacatttttctcc

SEQ ID NO: 7447192 - DNA, 22 bp, Homo sapiens
ctaaaggctcagcattcttttc

SEQ ID NO: 7447193 - DNA, 22 bp, Homo sapiens
ctaaaggattcttagttcctgg

SEQ ID NO: 7447194 - DNA, 22 bp, Homo sapiens
ctaaaggattcttagttcctgg

SEQ ID NO: 7447195 - DNA, 22 bp, Homo sapiens
ctaaagtccttatcaagtgtaa

SEQ ID NO: 7447196 - DNA, 22 bp, Homo sapiens
ctaaagaattttgcttgaccag

SEQ ID NO: 7447197 - DNA, 22 bp, Homo sapiens
ctaaagaagctagcaatctata

SEQ ID NO: 7447198 - DNA, 22 bp, Homo sapiens
ctaaagaagctagcaatctata

SEQ ID NO: 7447199 - DNA, 22 bp, Homo sapiens
ctaaagaattttgcttgaccag

SEQ ID NO: 7447200 - DNA, 22 bp, Homo sapiens
ctaaagacacaataagtagctt

SEQ ID NO: 7447201 - DNA, 22 bp, Homo sapiens
ctaaagacacaataagtagctt

SEQ ID NO: 7447202 - DNA, 22 bp, Homo sapiens
ctaaagataaggaaagtatcct

SEQ ID NO: 7447203 - DNA, 22 bp, Homo sapiens
ctaaagataaggaaagtatcct

SEQ ID NO: 7447204 - DNA, 22 bp, Homo sapiens
ctaaagatctacagaggctttt

SEQ ID NO: 7447205 - DNA, 22 bp, Homo sapiens
ctaaataatccctctggtctta

SEQ ID NO: 7447206 - DNA, 22 bp, Homo sapiens
ctaaataatccctctggtctta

SEQ ID NO: 7447207 - DNA, 22 bp, Homo sapiens
ctaaataatccctctggtctta

SEQ ID NO: 7447208 - DNA, 22 bp, Homo sapiens
ctaaataatccctctggtctta

SEQ ID NO: 7447209 - DNA, 22 bp, Homo sapiens
ctaaagtgccaggaatacaggt

SEQ ID NO: 7447210 - DNA, 22 bp, Homo sapiens
ctaaagtgccaggaatacaggt

SEQ ID NO: 7447211 - DNA, 22 bp, Homo sapiens
ctaaataatccctctggtctta

SEQ ID NO: 7447212 - DNA, 22 bp, Homo sapiens
ctaaataatccctctggtctta

SEQ ID NO: 7447213 - DNA, 22 bp, Homo sapiens
ctaaataatccctctggtctta

SEQ ID NO: 7447214 - DNA, 22 bp, Homo sapiens
ctaaatactagccttcagattt

SEQ ID NO: 7447215 - DNA, 22 bp, Homo sapiens
ctaaataatccctctggtctta

SEQ ID NO: 7447216 - DNA, 22 bp, Homo sapiens
ctaaatcaggccttacagcttc

SEQ ID NO: 7447217 - DNA, 22 bp, Homo sapiens
ctaaatactagccttcagattt

SEQ ID NO: 7447218 - DNA, 17 bp, Homo sapiens
ctaaatacttgcgtttc

SEQ ID NO: 7447219 - DNA, 17 bp, Homo sapiens
ctaaatacttgcgtttc

SEQ ID NO: 7447220 - DNA, 17 bp, Homo sapiens
ctaaatacttgcgtttc

SEQ ID NO: 7447221 - DNA, 22 bp, Homo sapiens
ttcatgaagggtgaatatagtc

SEQ ID NO: 7447222 - DNA, 22 bp, Homo sapiens
ttcatgaagggtgaatatagtc

SEQ ID NO: 7447223 - DNA, 22 bp, Homo sapiens
ttcatgaacgaacatatgtata

SEQ ID NO: 7447224 - DNA, 22 bp, Homo sapiens
ttcatgaacgaacatatgtata

SEQ ID NO: 7447225 - DNA, 22 bp, Homo sapiens
ttcatgaacgaacatatgtata

SEQ ID NO: 7447226 - DNA, 22 bp, Homo sapiens
ttcatgaacgaacatatgtata

SEQ ID NO: 7447227 - DNA, 22 bp, Homo sapiens
ttcatgaacgaacatatgtata

SEQ ID NO: 7447228 - DNA, 22 bp, Homo sapiens
ttcatgaagggtgaatatagtc

SEQ ID NO: 7447229 - DNA, 22 bp, Homo sapiens
ttcatgaatggaatcaatgctc

SEQ ID NO: 7447230 - DNA, 22 bp, Homo sapiens
ttcatgaatatattgaattagc

SEQ ID NO: 7447231 - DNA, 22 bp, Homo sapiens
ttcatgaatatattgaattagc

SEQ ID NO: 7447232 - DNA, 22 bp, Homo sapiens
ttcatgaatatattgaattagc

SEQ ID NO: 7447233 - DNA, 22 bp, Homo sapiens
ttcatgaatatattgaattagc

SEQ ID NO: 7447234 - DNA, 22 bp, Homo sapiens
ttcatgaatatattgaattagc

SEQ ID NO: 7447235 - DNA, 22 bp, Homo sapiens
ctaaaattacctaccagtttag

SEQ ID NO: 7447236 - DNA, 22 bp, Homo sapiens
ctaaaattacctaccagtttag

SEQ ID NO: 7447237 - DNA, 22 bp, Homo sapiens
ctaaaatgtttggggcagaacc

SEQ ID NO: 7447238 - DNA, 22 bp, Homo sapiens
ctaaaattacctaccagtttag

SEQ ID NO: 7447239 - DNA, 22 bp, Homo sapiens
ctaaaattacctaccagtttag

SEQ ID NO: 7447240 - DNA, 22 bp, Homo sapiens
ctaaaattatcaagataattcc

SEQ ID NO: 7447241 - DNA, 22 bp, Homo sapiens
ctaaaattatcaagataattcc

SEQ ID NO: 7447242 - DNA, 22 bp, Homo sapiens
ctaaacttttataacattgaga

SEQ ID NO: 7447243 - DNA, 22 bp, Homo sapiens
ctaaagaagctagcaatctata

SEQ ID NO: 7447244 - DNA, 22 bp, Homo sapiens
ctaaagaagctagcaatctata

SEQ ID NO: 7447245 - DNA, 22 bp, Homo sapiens
ctaaagaagctagcaatctata

SEQ ID NO: 7447246 - DNA, 22 bp, Homo sapiens
ctaaaaatccacactaggtgaa

SEQ ID NO: 7447247 - DNA, 22 bp, Homo sapiens
ctaaaaatccacactaggtgaa

SEQ ID NO: 7447248 - DNA, 22 bp, Homo sapiens
ttcatgaatgttccatgtgagt

SEQ ID NO: 7447249 - DNA, 22 bp, Homo sapiens
ttcatgaatgttccatgtgagt

SEQ ID NO: 7447250 - DNA, 22 bp, Homo sapiens
ttcatgaatgttccatgtgagt

SEQ ID NO: 7447251 - DNA, 22 bp, Homo sapiens
ttcatgaaagacagcaactgtg

SEQ ID NO: 7447252 - DNA, 22 bp, Homo sapiens
ttcatgaaagacagcaactgtg

SEQ ID NO: 7447253 - DNA, 22 bp, Homo sapiens
ttcatgaaagacagcaactgtg

SEQ ID NO: 7447254 - DNA, 22 bp, Homo sapiens
ttcatgaaaaggtctatttctt

SEQ ID NO: 7447255 - DNA, 22 bp, Homo sapiens
ttcatgaaacttaactgttggg

SEQ ID NO: 7447256 - DNA, 22 bp, Homo sapiens
ttcatgaaacttaactgttggg

SEQ ID NO: 7447257 - DNA, 22 bp, Homo sapiens
ttcatctgtagtttttccaagg

SEQ ID NO: 7447258 - DNA, 22 bp, Homo sapiens
ttcatctgtagtttttccaagg

SEQ ID NO: 7447259 - DNA, 22 bp, Homo sapiens
ttcatctgtagtttttccaagg

SEQ ID NO: 7447260 - DNA, 22 bp, Homo sapiens
ttcatgaaacttaactgttggg

SEQ ID NO: 7447261 - DNA, 22 bp, Homo sapiens
ttcatctgcttcttgattttgc

SEQ ID NO: 7447262 - DNA, 22 bp, Homo sapiens
ttcatctggaagttcccaaggc

SEQ ID NO: 7447263 - DNA, 21 bp, Homo sapiens
ttcatctggccgtattccagg

SEQ ID NO: 7447264 - DNA, 22 bp, Homo sapiens
ttcatctggaatttatgttata

SEQ ID NO: 7447265 - DNA, 21 bp, Homo sapiens
ttcatctggccgtattccagg

SEQ ID NO: 7447266 - DNA, 22 bp, Homo sapiens
ttcatctgtagcatcttccaat

SEQ ID NO: 7447267 - DNA, 22 bp, Homo sapiens
ttcatctgtagcatcttccaat

SEQ ID NO: 7447268 - DNA, 22 bp, Homo sapiens
ttcatctgtagtttttccaagg

SEQ ID NO: 7447269 - DNA, 22 bp, Homo sapiens
cgtatacatgaagacattgctg

SEQ ID NO: 7447270 - DNA, 22 bp, Homo sapiens
cgtattcactcaggacacatag

SEQ ID NO: 7447271 - DNA, 22 bp, Homo sapiens
cgtatttagaaggctgctgaaa

SEQ ID NO: 7447272 - DNA, 22 bp, Homo sapiens
cgtcactggcgtgaagtgagga

SEQ ID NO: 7447273 - DNA, 22 bp, Homo sapiens
cgtcacttcttagtctattttc

SEQ ID NO: 7447274 - DNA, 22 bp, Homo sapiens
cgtcacttcttagtctattttc

SEQ ID NO: 7447275 - DNA, 22 bp, Homo sapiens
ttcatctgcttcttcctattcc

SEQ ID NO: 7447276 - DNA, 22 bp, Homo sapiens
ttcatccatgtggttgtgtata

SEQ ID NO: 7447277 - DNA, 22 bp, Homo sapiens
ttcatccatatgcagagagctt

SEQ ID NO: 7447278 - DNA, 22 bp, Homo sapiens
ttcatccatatgcagagagctt

SEQ ID NO: 7447279 - DNA, 22 bp, Homo sapiens
cgtcagtgtaaaagacagcacc

SEQ ID NO: 7447280 - DNA, 22 bp, Homo sapiens
ttcatccatatgcagagagctt

SEQ ID NO: 7447281 - DNA, 22 bp, Homo sapiens
cgtcacttcttagtctattttc

SEQ ID NO: 7447282 - DNA, 22 bp, Homo sapiens
cgtcacttcttagtctattttc

SEQ ID NO: 7447283 - DNA, 22 bp, Homo sapiens
cgtcacttcttagtctattttc

SEQ ID NO: 7447284 - DNA, 22 bp, Homo sapiens
cgtcagggttgagcaggtagat

SEQ ID NO: 7447285 - DNA, 22 bp, Homo sapiens
cggtggctcaggcccccagcag

SEQ ID NO: 7447286 - DNA, 22 bp, Homo sapiens
cggtggctcaggcccccagcag

SEQ ID NO: 7447287 - DNA, 21 bp, Homo sapiens
cggtggctcccgggatggctc

SEQ ID NO: 7447288 - DNA, 19 bp, Homo sapiens
cggtggcttgcagggaggt

SEQ ID NO: 7447289 - DNA, 19 bp, Homo sapiens
cggtggcttgcagggaggt

SEQ ID NO: 7447290 - DNA, 19 bp, Homo sapiens
cggtggcttgcagggaggt

SEQ ID NO: 7447291 - DNA, 22 bp, Homo sapiens
cgtaagaaatagcttgtcaaag

SEQ ID NO: 7447292 - DNA, 22 bp, Homo sapiens
cggttctcgcctctgctgctcc

SEQ ID NO: 7447293 - DNA, 22 bp, Homo sapiens
cgtaggtggctcagcacctggg

SEQ ID NO: 7447294 - DNA, 22 bp, Homo sapiens
cgtagctgggaacttcactctc

SEQ ID NO: 7447295 - DNA, 22 bp, Homo sapiens
cgtaggtggctcagcacctggg

SEQ ID NO: 7447296 - DNA, 22 bp, Homo sapiens
cgtaggtggctcagcacctggg

SEQ ID NO: 7447297 - DNA, 22 bp, Homo sapiens
cgtaggtggctcagcacctggg

SEQ ID NO: 7447298 - DNA, 22 bp, Homo sapiens
cgtaggtggctcagcacctggg

SEQ ID NO: 7447299 - DNA, 22 bp, Homo sapiens
cgtaatggtttatgttgcagga

SEQ ID NO: 7447300 - DNA, 22 bp, Homo sapiens
cgtaattctctctagtacccct

SEQ ID NO: 7447301 - DNA, 19 bp, Homo sapiens
cgtacctgacacagaacag

SEQ ID NO: 7447302 - DNA, 22 bp, Homo sapiens
cgtagctgggaacttcactctc

SEQ ID NO: 7447303 - DNA, 22 bp, Homo sapiens
cggtgcccggtgccaggcgcgg

SEQ ID NO: 7447304 - DNA, 22 bp, Homo sapiens
cggtgcggtgattgggtaggtc

SEQ ID NO: 7447305 - DNA, 22 bp, Homo sapiens
cggtggccaacaagaggccggg

SEQ ID NO: 7447306 - DNA, 22 bp, Homo sapiens
cggtggagtgctcagctgaacc

SEQ ID NO: 7447307 - DNA, 22 bp, Homo sapiens
cggtctcccgtgtgtgtgcgct

SEQ ID NO: 7447308 - DNA, 22 bp, Homo sapiens
cggtctcccgtgtgtgtgcgct

SEQ ID NO: 7447309 - DNA, 22 bp, Homo sapiens
cggtctcccgtgtgtgtgcgct

SEQ ID NO: 7447310 - DNA, 22 bp, Homo sapiens
cggtctcccgtgtgtgtgcgct

SEQ ID NO: 7447311 - DNA, 22 bp, Homo sapiens
cggtctcccgtgtgtgtgcgct

SEQ ID NO: 7447312 - DNA, 22 bp, Homo sapiens
cggtcaggtgcagcgttggcac

SEQ ID NO: 7447313 - DNA, 22 bp, Homo sapiens
cggtcagttgccaggccctgcc

SEQ ID NO: 7447314 - DNA, 22 bp, Homo sapiens
cggtccaggatggctggcaagc

SEQ ID NO: 7447315 - DNA, 22 bp, Homo sapiens
cggtccagggaacgcccccgcc

SEQ ID NO: 7447316 - DNA, 22 bp, Homo sapiens
cggtcctggcacttgcggctcc

SEQ ID NO: 7447317 - DNA, 22 bp, Homo sapiens
cggtcctgtacttgatgagata

SEQ ID NO: 7447318 - DNA, 22 bp, Homo sapiens
ttcacactgtttttcatagtgg

SEQ ID NO: 7447319 - DNA, 22 bp, Homo sapiens
ttcacactataaagggcgtgaa

SEQ ID NO: 7447320 - DNA, 22 bp, Homo sapiens
ttcacactgtcccgggtggaaa

SEQ ID NO: 7447321 - DNA, 22 bp, Homo sapiens
ttcacactgtcccgggtggaaa

SEQ ID NO: 7447322 - DNA, 22 bp, Homo sapiens
ttcacaccaagcttcccaaaga

SEQ ID NO: 7447323 - DNA, 22 bp, Homo sapiens
ttcacaccaggtatttatattt

SEQ ID NO: 7447324 - DNA, 22 bp, Homo sapiens
ttcacacctcctagagttcaca

SEQ ID NO: 7447325 - DNA, 22 bp, Homo sapiens
ttcacacctgctcaattatgag

SEQ ID NO: 7447326 - DNA, 22 bp, Homo sapiens
ttcacacagcaactgtatgaat

SEQ ID NO: 7447327 - DNA, 22 bp, Homo sapiens
ttcacaccaaagacaaacaggg

SEQ ID NO: 7447328 - DNA, 22 bp, Homo sapiens
ttcacaccaaagacaaacaggg

SEQ ID NO: 7447329 - DNA, 22 bp, Homo sapiens
ttcacaccaagcttcccaaaga

SEQ ID NO: 7447330 - DNA, 22 bp, Homo sapiens
ttcacacttgttaggatggctt

SEQ ID NO: 7447331 - DNA, 22 bp, Homo sapiens
ttcacactttggaattccacct

SEQ ID NO: 7447332 - DNA, 22 bp, Homo sapiens
ttcacagaagaggtcacatttc

SEQ ID NO: 7447333 - DNA, 22 bp, Homo sapiens
ttcacagaagaggtcacatttc

SEQ ID NO: 7447334 - DNA, 22 bp, Homo sapiens
ttcacactttggaattccacct

SEQ ID NO: 7447335 - DNA, 22 bp, Homo sapiens
ttcacagaagaggtcacatttc

SEQ ID NO: 7447336 - DNA, 22 bp, Homo sapiens
ttcacagaagaggtcacatttc

SEQ ID NO: 7447337 - DNA, 22 bp, Homo sapiens
ttcacagaagaggtcacatttc

SEQ ID NO: 7447338 - DNA, 22 bp, Homo sapiens
ttcacagaatggcaagttatgg

SEQ ID NO: 7447339 - DNA, 22 bp, Homo sapiens
ttcacagaatggcaagttatgg

SEQ ID NO: 7447340 - DNA, 22 bp, Homo sapiens
ttcacagaagaggtcacatttc

SEQ ID NO: 7447341 - DNA, 22 bp, Homo sapiens
ttcacagaatggcaagttatgg

SEQ ID NO: 7447342 - DNA, 22 bp, Homo sapiens
ttcagaaataaaatatcccaac

SEQ ID NO: 7447343 - DNA, 22 bp, Homo sapiens
ttcagaaataaaatatcccaac

SEQ ID NO: 7447344 - DNA, 22 bp, Homo sapiens
ttcagaaagtgaatcttgttat

SEQ ID NO: 7447345 - DNA, 22 bp, Homo sapiens
ttcagaaagtgaatcttgttat

SEQ ID NO: 7447346 - DNA, 22 bp, Homo sapiens
ttcagagggcttgctatgtaca

SEQ ID NO: 7447347 - DNA, 22 bp, Homo sapiens
ttcagagggacattcaagggaa

SEQ ID NO: 7447348 - DNA, 22 bp, Homo sapiens
ttcagaggctctgccaatgtgt

SEQ ID NO: 7447349 - DNA, 21 bp, Homo sapiens
ttcagaggatgccaaggtcca

SEQ ID NO: 7447350 - DNA, 21 bp, Homo sapiens
ttcagaggatgccaaggtcca

SEQ ID NO: 7447351 - DNA, 22 bp, Homo sapiens
ttcacagaattgtcttgactgg

SEQ ID NO: 7447352 - DNA, 22 bp, Homo sapiens
ttcacagaattgtcttgactgg

SEQ ID NO: 7447353 - DNA, 22 bp, Homo sapiens
ttcacagacattgcagactgaa

SEQ ID NO: 7447354 - DNA, 22 bp, Homo sapiens
ttcagaaagtgaatcttgttat

SEQ ID NO: 7447355 - DNA, 22 bp, Homo sapiens
ttcagaaagtgaatcttgttat

SEQ ID NO: 7447356 - DNA, 22 bp, Homo sapiens
ttcagaaagtgaatcttgttat

SEQ ID NO: 7447357 - DNA, 22 bp, Homo sapiens
ttcagaaagtgaatcttgttat

SEQ ID NO: 7447358 - DNA, 22 bp, Homo sapiens
ttcagaaagtgaatcttgttat

SEQ ID NO: 7447359 - DNA, 22 bp, Homo sapiens
ttcagataaattgttttgtgat

SEQ ID NO: 7447360 - DNA, 22 bp, Homo sapiens
ttcagataagtcaagttagtat

SEQ ID NO: 7447361 - DNA, 22 bp, Homo sapiens
ttcagataaactacaaataatt

SEQ ID NO: 7447362 - DNA, 22 bp, Homo sapiens
ttcagataatgacaggtcagga

SEQ ID NO: 7447363 - DNA, 22 bp, Homo sapiens
ttcagagttagacgaaaagcaa

SEQ ID NO: 7447364 - DNA, 22 bp, Homo sapiens
ttcagataaactacaaataatt

SEQ ID NO: 7447365 - DNA, 22 bp, Homo sapiens
ttcagataaactacaaataatt

SEQ ID NO: 7447366 - DNA, 22 bp, Homo sapiens
ttcagagttagacgaaaagcaa

SEQ ID NO: 7447367 - DNA, 22 bp, Homo sapiens
ttcagagtggtatgaagtgatg

SEQ ID NO: 7447368 - DNA, 22 bp, Homo sapiens
ttcagagttagacgaaaagcaa

SEQ ID NO: 7447369 - DNA, 22 bp, Homo sapiens
ttcagagtaggatactagctta

SEQ ID NO: 7447370 - DNA, 20 bp, Homo sapiens
ttcagagtcagcaaatgcag

SEQ ID NO: 7447371 - DNA, 22 bp, Homo sapiens
ttcagagtcagggatctcagag

SEQ ID NO: 7447372 - DNA, 22 bp, Homo sapiens
ttcagagtcagggatctcagag

SEQ ID NO: 7447373 - DNA, 18 bp, Homo sapiens
ttcagagtctggtgagga

SEQ ID NO: 7447374 - DNA, 22 bp, Homo sapiens
ttcagagtcagggatctcagag

SEQ ID NO: 7447375 - DNA, 18 bp, Homo sapiens
ttcagagtctggtgagga

SEQ ID NO: 7447376 - DNA, 22 bp, Homo sapiens
ttcagagtggtatgaagtgatg

SEQ ID NO: 7447377 - DNA, 22 bp, Homo sapiens
ttcagagtggtatgaagtgatg

SEQ ID NO: 7447378 - DNA, 22 bp, Homo sapiens
ttcagagtacacagagatcttc

SEQ ID NO: 7447379 - DNA, 22 bp, Homo sapiens
ttcagagtacacagagatcttc

SEQ ID NO: 7447380 - DNA, 22 bp, Homo sapiens
ttcagagtacacagagatcttc

SEQ ID NO: 7447381 - DNA, 22 bp, Homo sapiens
ttcagaggtgggctgagaggat

SEQ ID NO: 7447382 - DNA, 22 bp, Homo sapiens
ttcagaggttagagcagtggga

SEQ ID NO: 7447383 - DNA, 22 bp, Homo sapiens
ttcagaggttagagcagtggga

SEQ ID NO: 7447384 - DNA, 22 bp, Homo sapiens
ttcagaggtagagaggatcttg

SEQ ID NO: 7447385 - DNA, 22 bp, Homo sapiens
ttcagaggtaagggtctcagaa

SEQ ID NO: 7447386 - DNA, 20 bp, Homo sapiens
ttcagaggtgaagttgtggt

SEQ ID NO: 7447387 - DNA, 20 bp, Homo sapiens
ttcagaggtgaagttgtggt

SEQ ID NO: 7447388 - DNA, 22 bp, Homo sapiens
ttcagagggttttagggtcaga

SEQ ID NO: 7447389 - DNA, 22 bp, Homo sapiens
ttcagagggttttagggtcaga

SEQ ID NO: 7447390 - DNA, 22 bp, Homo sapiens
ttcagaggggctaagtacttgc

SEQ ID NO: 7447391 - DNA, 22 bp, Homo sapiens
ttcagagggttcagagggttcg

SEQ ID NO: 7447392 - DNA, 22 bp, Homo sapiens
ttcaggcccaacgcacagcttc

SEQ ID NO: 7447393 - DNA, 22 bp, Homo sapiens
ttcaggcccaacgcacagcttc

SEQ ID NO: 7447394 - DNA, 22 bp, Homo sapiens
ttcaggcccagcacagcgcgtg

SEQ ID NO: 7447395 - DNA, 22 bp, Homo sapiens
ttcaggcccaacgcacagcttc

SEQ ID NO: 7447396 - DNA, 22 bp, Homo sapiens
ttcaggcctaatttctagcccc

SEQ ID NO: 7447397 - DNA, 22 bp, Homo sapiens
ttcaggcctaatttctagcccc

SEQ ID NO: 7447398 - DNA, 22 bp, Homo sapiens
ttcaggcctaatttctagcccc

SEQ ID NO: 7447399 - DNA, 22 bp, Homo sapiens
ttcaggcctctaaagggaaagc

SEQ ID NO: 7447400 - DNA, 22 bp, Homo sapiens
ttcagggacttagtgtcagttt

SEQ ID NO: 7447401 - DNA, 22 bp, Homo sapiens
ttcagggacttagtgtcagttt

SEQ ID NO: 7447402 - DNA, 22 bp, Homo sapiens
ttcagggacttagtgtcagttt

SEQ ID NO: 7447403 - DNA, 22 bp, Homo sapiens
ttcagggactttgatgtatcag

SEQ ID NO: 7447404 - DNA, 22 bp, Homo sapiens
ttcagggagagcgggacgggtg

SEQ ID NO: 7447405 - DNA, 22 bp, Homo sapiens
ttcagggagagcgggacgggtg

SEQ ID NO: 7447406 - DNA, 22 bp, Homo sapiens
ttcagggactttgatgtatcag

SEQ ID NO: 7447407 - DNA, 22 bp, Homo sapiens
ttcagggagagcgggacgggtg

SEQ ID NO: 7447408 - DNA, 22 bp, Homo sapiens
cggggctgtagcacagctgagc

SEQ ID NO: 7447409 - DNA, 22 bp, Homo sapiens
cggggctgtagcacagctgagc

SEQ ID NO: 7447410 - DNA, 22 bp, Homo sapiens
cggggctgtagcacagctgagc

SEQ ID NO: 7447411 - DNA, 22 bp, Homo sapiens
cggggctgtagcacagctgagc

SEQ ID NO: 7447412 - DNA, 22 bp, Homo sapiens
cggtcaggtgcagcgttggcac

SEQ ID NO: 7447413 - DNA, 22 bp, Homo sapiens
cggtcaggtgcagcgttggcac

SEQ ID NO: 7447414 - DNA, 22 bp, Homo sapiens
cgggggagttgaggcacatggg

SEQ ID NO: 7447415 - DNA, 22 bp, Homo sapiens
cgggggagttgaggcacatggg

SEQ ID NO: 7447416 - DNA, 22 bp, Homo sapiens
cgggggagttgaggcacatggg

SEQ ID NO: 7447417 - DNA, 22 bp, Homo sapiens
cgggggagttgaggcacatggg

SEQ ID NO: 7447418 - DNA, 22 bp, Homo sapiens
cgggggagttgaggcacatggg

SEQ ID NO: 7447419 - DNA, 22 bp, Homo sapiens
cggggctgtagcacagctgagc

SEQ ID NO: 7447420 - DNA, 22 bp, Homo sapiens
cggggctgtagcacagctgagc

SEQ ID NO: 7447421 - DNA, 22 bp, Homo sapiens
ttcagggcagctagaaccagga

SEQ ID NO: 7447422 - DNA, 22 bp, Homo sapiens
ttcagggcatgagggacacatc

SEQ ID NO: 7447423 - DNA, 22 bp, Homo sapiens
ttcagggcatgagggacacatc

SEQ ID NO: 7447424 - DNA, 22 bp, Homo sapiens
ttcagggcagacagaagagatg

SEQ ID NO: 7447425 - DNA, 22 bp, Homo sapiens
ttcagggcagagagttcaggga

SEQ ID NO: 7447426 - DNA, 22 bp, Homo sapiens
ttcagggcagagagttcaggga

SEQ ID NO: 7447427 - DNA, 22 bp, Homo sapiens
ttcaggcccaacgcacagcttc

SEQ ID NO: 7447428 - DNA, 22 bp, Homo sapiens
ttcaggcatggaaactggatta

SEQ ID NO: 7447429 - DNA, 22 bp, Homo sapiens
ttcaggcatggaaactggatta

SEQ ID NO: 7447430 - DNA, 22 bp, Homo sapiens
ttcaggcatggaaactggatta

SEQ ID NO: 7447431 - DNA, 22 bp, Homo sapiens
ttcaggcagctgaggagaaagt

SEQ ID NO: 7447432 - DNA, 22 bp, Homo sapiens
ttcaggcagctgaggagaaagt

SEQ ID NO: 7447433 - DNA, 22 bp, Homo sapiens
ttcaggcatccctacagttagg

SEQ ID NO: 7447434 - DNA, 22 bp, Homo sapiens
ttcaggcatccctacagttagg

SEQ ID NO: 7447435 - DNA, 22 bp, Homo sapiens
ttcaggattctgtgtctgacaa

SEQ ID NO: 7447436 - DNA, 22 bp, Homo sapiens
ttcaggcaagatattaacttct

SEQ ID NO: 7447437 - DNA, 22 bp, Homo sapiens
ttcagcaaacacgatgcttgtt

SEQ ID NO: 7447438 - DNA, 22 bp, Homo sapiens
ttcagcaaacacgatgcttgtt

SEQ ID NO: 7447439 - DNA, 22 bp, Homo sapiens
ttcagcaaacacgatgcttgtt

SEQ ID NO: 7447440 - DNA, 22 bp, Homo sapiens
ttcagcaaacacgatgcttgtt

SEQ ID NO: 7447441 - DNA, 22 bp, Homo sapiens
ttcagcaaatggactgttcagg

SEQ ID NO: 7447442 - DNA, 22 bp, Homo sapiens
ttcaggagtgtcaggagtgcct

SEQ ID NO: 7447443 - DNA, 22 bp, Homo sapiens
ttcagcaaacacgatgcttgtt

SEQ ID NO: 7447444 - DNA, 22 bp, Homo sapiens
ttcagcaaatggactgttcagg

SEQ ID NO: 7447445 - DNA, 22 bp, Homo sapiens
ttcagattttttaataggtaat

SEQ ID NO: 7447446 - DNA, 22 bp, Homo sapiens
ttcagcaaaatatctcagatag

SEQ ID NO: 7447447 - DNA, 22 bp, Homo sapiens
ttcagattttttaataggtaat

SEQ ID NO: 7447448 - DNA, 22 bp, Homo sapiens
ttcagattttttaataggtaat

SEQ ID NO: 7447449 - DNA, 22 bp, Homo sapiens
ttcagatgattagaatagtatt

SEQ ID NO: 7447450 - DNA, 22 bp, Homo sapiens
ttcagatatcattaatttagta

SEQ ID NO: 7447451 - DNA, 22 bp, Homo sapiens
ttcagatatcattaatttagta

SEQ ID NO: 7447452 - DNA, 22 bp, Homo sapiens
ttcagatatcattaatttagta

SEQ ID NO: 7447453 - DNA, 22 bp, Homo sapiens
ttcagataatgacaggtcagga

SEQ ID NO: 7447454 - DNA, 22 bp, Homo sapiens
ttcagatatcattaatttagta

SEQ ID NO: 7447455 - DNA, 22 bp, Homo sapiens
ttcagatatcattaatttagta

SEQ ID NO: 7447456 - DNA, 22 bp, Homo sapiens
cgccccagtctgtaggtgcccc

SEQ ID NO: 7447457 - DNA, 22 bp, Homo sapiens
cgcccccagggcctcgagcatg

SEQ ID NO: 7447458 - DNA, 22 bp, Homo sapiens
cgccccagtctgtaggtgcccc

SEQ ID NO: 7447459 - DNA, 22 bp, Homo sapiens
cgccccggacgtctgaccaaac

SEQ ID NO: 7447460 - DNA, 22 bp, Homo sapiens
cgccccctcggccacctgcggg

SEQ ID NO: 7447461 - DNA, 22 bp, Homo sapiens
cgcccctcagcgacccaccagc

SEQ ID NO: 7447462 - DNA, 22 bp, Homo sapiens
cgcccctcagcgacccaccagc

SEQ ID NO: 7447463 - DNA, 22 bp, Homo sapiens
cgccctccacacagcccctggc

SEQ ID NO: 7447464 - DNA, 22 bp, Homo sapiens
cgccgcctgctgcagcagctgt

SEQ ID NO: 7447465 - DNA, 22 bp, Homo sapiens
cgcccctcagcgacccaccagc

SEQ ID NO: 7447466 - DNA, 22 bp, Homo sapiens
cgccctccacacagcccctggc

SEQ ID NO: 7447467 - DNA, 22 bp, Homo sapiens
cgccctccacacagcccctggc

SEQ ID NO: 7447468 - DNA, 22 bp, Homo sapiens
cgccctccacacagcccctggc

SEQ ID NO: 7447469 - DNA, 22 bp, Homo sapiens
cgccctccacacagcccctggc

SEQ ID NO: 7447470 - DNA, 22 bp, Homo sapiens
ttcaagttaactctccttgtac

SEQ ID NO: 7447471 - DNA, 22 bp, Homo sapiens
ttcaagttaactctccttgtac

SEQ ID NO: 7447472 - DNA, 22 bp, Homo sapiens
ttcaagtcttccatggtattct

SEQ ID NO: 7447473 - DNA, 22 bp, Homo sapiens
ttcaagtcttccatggtattct

SEQ ID NO: 7447474 - DNA, 22 bp, Homo sapiens
ttcaagtgaggctgtctttaga

SEQ ID NO: 7447475 - DNA, 22 bp, Homo sapiens
ttcaagtctggagatctggaac

SEQ ID NO: 7447476 - DNA, 22 bp, Homo sapiens
ttcaagtctggagatctggaac

SEQ ID NO: 7447477 - DNA, 22 bp, Homo sapiens
ttcaagtctgtttcattgcatg

SEQ ID NO: 7447478 - DNA, 22 bp, Homo sapiens
ttcaagtctgtttcattgcatg

SEQ ID NO: 7447479 - DNA, 22 bp, Homo sapiens
ttcaagtctgcccagagtcagc

SEQ ID NO: 7447480 - DNA, 22 bp, Homo sapiens
ttcaagtctgtttcattgcatg

SEQ ID NO: 7447481 - DNA, 22 bp, Homo sapiens
ttcaagtctggagatctggaac

SEQ ID NO: 7447482 - DNA, 22 bp, Homo sapiens
cgccggcttgaggcaggcggca

SEQ ID NO: 7447483 - DNA, 22 bp, Homo sapiens
cgccggcttgaggcaggcggca

SEQ ID NO: 7447484 - DNA, 22 bp, Homo sapiens
cgccggcttgaggcaggcggca

SEQ ID NO: 7447485 - DNA, 22 bp, Homo sapiens
cgccggcttgaggcaggcggca

SEQ ID NO: 7447486 - DNA, 22 bp, Homo sapiens
cgccggcttgaggcaggcggca

SEQ ID NO: 7447487 - DNA, 22 bp, Homo sapiens
ttcaacaaaatatatttttcca

SEQ ID NO: 7447488 - DNA, 22 bp, Homo sapiens
ttcaagtctgaagaggactaat

SEQ ID NO: 7447489 - DNA, 22 bp, Homo sapiens
ttcaaatttggtatgcaagcca

SEQ ID NO: 7447490 - DNA, 22 bp, Homo sapiens
cgcccaggctggagagcagtgg

SEQ ID NO: 7447491 - DNA, 22 bp, Homo sapiens
cgcccaggctggagagcagtgg

SEQ ID NO: 7447492 - DNA, 20 bp, Homo sapiens
cgcccaggagggcccatgtg

SEQ ID NO: 7447493 - DNA, 20 bp, Homo sapiens
cgcccaggagggcccatgtg

SEQ ID NO: 7447494 - DNA, 20 bp, Homo sapiens
cgcccaggagggcccatgtg

SEQ ID NO: 7447495 - DNA, 22 bp, Homo sapiens
cgcccagctgaaatctccaggc

SEQ ID NO: 7447496 - DNA, 22 bp, Homo sapiens
cgcccagctgaaatctccaggc

SEQ ID NO: 7447497 - DNA, 22 bp, Homo sapiens
cgcccagctgaaatctccaggc

SEQ ID NO: 7447498 - DNA, 20 bp, Homo sapiens
cgcccaggagggcccatgtg

SEQ ID NO: 7447499 - DNA, 20 bp, Homo sapiens
cgcccaggagggcccatgtg

SEQ ID NO: 7447500 - DNA, 22 bp, Homo sapiens
cgcccaggctggagtgcagtga

SEQ ID NO: 7447501 - DNA, 22 bp, Homo sapiens
cgcccaggctggagtgcagtga

SEQ ID NO: 7447502 - DNA, 22 bp, Homo sapiens
cgcccaggctggagtgcagtga

SEQ ID NO: 7447503 - DNA, 22 bp, Homo sapiens
cgcccaggctggagtgcagtga

SEQ ID NO: 7447504 - DNA, 22 bp, Homo sapiens
cgcccaggctggagagcagtgg

SEQ ID NO: 7447505 - DNA, 22 bp, Homo sapiens
cgcccagctgaaatctccaggc

SEQ ID NO: 7447506 - DNA, 22 bp, Homo sapiens
cgcccaggctggagagcagtgg

SEQ ID NO: 7447507 - DNA, 20 bp, Homo sapiens
cgcccaggagggcccatgtg

SEQ ID NO: 7447508 - DNA, 22 bp, Homo sapiens
cgcccaggctggagagcagtgg

SEQ ID NO: 7447509 - DNA, 22 bp, Homo sapiens
cgcccaggctggagtgcagtgg

SEQ ID NO: 7447510 - DNA, 22 bp, Homo sapiens
cgcccaggctggagtgcagtgg

SEQ ID NO: 7447511 - DNA, 22 bp, Homo sapiens
cgcccaggctggagtgcagtgg

SEQ ID NO: 7447512 - DNA, 22 bp, Homo sapiens
cgcccaggctggagtgcagtgg

SEQ ID NO: 7447513 - DNA, 22 bp, Homo sapiens
cgcccagggcaggaggccgctc

SEQ ID NO: 7447514 - DNA, 22 bp, Homo sapiens
cgcccagggcaggaggccgctc

SEQ ID NO: 7447515 - DNA, 22 bp, Homo sapiens
cgcccagggcaggaggccgctc

SEQ ID NO: 7447516 - DNA, 22 bp, Homo sapiens
cgcccagggcaggaggccgctc

SEQ ID NO: 7447517 - DNA, 22 bp, Homo sapiens
cgcccagggcaggaggccgctc

SEQ ID NO: 7447518 - DNA, 22 bp, Homo sapiens
cgccccagtctgtaggtgcccc

SEQ ID NO: 7447519 - DNA, 22 bp, Homo sapiens
cgccccagtctgtaggtgcccc

SEQ ID NO: 7447520 - DNA, 22 bp, Homo sapiens
cgccccagtctgtaggtgcccc

SEQ ID NO: 7447521 - DNA, 22 bp, Homo sapiens
cgccccagtctgtaggtgcccc

SEQ ID NO: 7447522 - DNA, 22 bp, Homo sapiens
cgccccagccagttgagcggcg

SEQ ID NO: 7447523 - DNA, 22 bp, Homo sapiens
cgccccagccagttgagcggcg

SEQ ID NO: 7447524 - DNA, 22 bp, Homo sapiens
cgccccagatgcaagacaaaga

SEQ ID NO: 7447525 - DNA, 22 bp, Homo sapiens
cgcccagggcaggaggccgctc

SEQ ID NO: 7447526 - DNA, 20 bp, Homo sapiens
cgcccagtgcggttctgacc

SEQ ID NO: 7447527 - DNA, 20 bp, Homo sapiens
cgcccagtgcggttctgacc

SEQ ID NO: 7447528 - DNA, 22 bp, Homo sapiens
cgccccagatgcaagacaaaga

SEQ ID NO: 7447529 - DNA, 22 bp, Homo sapiens
cgccccagatgcaagacaaaga

SEQ ID NO: 7447530 - DNA, 20 bp, Homo sapiens
cgcccagtgcggttctgacc

SEQ ID NO: 7447531 - DNA, 20 bp, Homo sapiens
cgcccagtgcggttctgacc

SEQ ID NO: 7447532 - DNA, 22 bp, Homo sapiens
ttcacacacagcttcctattgt

SEQ ID NO: 7447533 - DNA, 19 bp, Homo sapiens
ttcacaattatgaaattag

SEQ ID NO: 7447534 - DNA, 22 bp, Homo sapiens
ttcacaatttcccttcatcagg

SEQ ID NO: 7447535 - DNA, 22 bp, Homo sapiens
ttcacaatttcccttcatcagg

SEQ ID NO: 7447536 - DNA, 22 bp, Homo sapiens
ttcacaatttcccttcatcagg

SEQ ID NO: 7447537 - DNA, 22 bp, Homo sapiens
ttcacaatttcccttcatcagg

SEQ ID NO: 7447538 - DNA, 22 bp, Homo sapiens
ttcacacagcaactgtatgaat

SEQ ID NO: 7447539 - DNA, 22 bp, Homo sapiens
ttcacacagcaactgtatgaat

SEQ ID NO: 7447540 - DNA, 22 bp, Homo sapiens
ttcacacagcaactgtatgaat

SEQ ID NO: 7447541 - DNA, 22 bp, Homo sapiens
ttcacacagaatctgaggagct

SEQ ID NO: 7447542 - DNA, 22 bp, Homo sapiens
ttcacacagaatctgaggagct

SEQ ID NO: 7447543 - DNA, 22 bp, Homo sapiens
ttcacacagaatctgaggagct

SEQ ID NO: 7447544 - DNA, 22 bp, Homo sapiens
ttcacacagaatctgaggagct

SEQ ID NO: 7447545 - DNA, 22 bp, Homo sapiens
ttcacacagaatctgaggagct

SEQ ID NO: 7447546 - DNA, 22 bp, Homo sapiens
ttcacacagaatctgaggagct

SEQ ID NO: 7447547 - DNA, 22 bp, Homo sapiens
ttcacacagaatctgaggagct

SEQ ID NO: 7447548 - DNA, 22 bp, Homo sapiens
ttcaatagcatacttttgctct

SEQ ID NO: 7447549 - DNA, 22 bp, Homo sapiens
ttcaataggatgcatgatataa

SEQ ID NO: 7447550 - DNA, 22 bp, Homo sapiens
ttcaagtttttaaaggcagtta

SEQ ID NO: 7447551 - DNA, 22 bp, Homo sapiens
ttcaatacaaagaaaggaattt

SEQ ID NO: 7447552 - DNA, 20 bp, Homo sapiens
ttcaatacattactttgatt

SEQ ID NO: 7447553 - DNA, 21 bp, Homo sapiens
ttcaatactatttcaatagtc

SEQ ID NO: 7447554 - DNA, 22 bp, Homo sapiens
ttcaatacaccataggaatagt

SEQ ID NO: 7447555 - DNA, 19 bp, Homo sapiens
ttcacaattatgaaattag

SEQ ID NO: 7447556 - DNA, 22 bp, Homo sapiens
ttcacaatttcccttcatcagg

SEQ ID NO: 7447557 - DNA, 19 bp, Homo sapiens
ttcacaattatgaaattag

SEQ ID NO: 7447558 - DNA, 19 bp, Homo sapiens
ttcacaattatgaaattag

SEQ ID NO: 7447559 - DNA, 22 bp, Homo sapiens
ttcacaattaactttatactta

SEQ ID NO: 7447560 - DNA, 19 bp, Homo sapiens
ttcacaattatgaaattag

SEQ ID NO: 7447561 - DNA, 19 bp, Homo sapiens
ttcacaattatgaaattag

SEQ ID NO: 7447562 - DNA, 19 bp, Homo sapiens
ttcacaattatgaaattag

SEQ ID NO: 7447563 - DNA, 22 bp, Homo sapiens
ttcaatatcattgtttagtctc

SEQ ID NO: 7447564 - DNA, 22 bp, Homo sapiens
ttcaatatcattgtttagtctc

SEQ ID NO: 7447565 - DNA, 22 bp, Homo sapiens
ttcaagttagagatatatttag

SEQ ID NO: 7447566 - DNA, 22 bp, Homo sapiens
ttcaagttagagatatatttag

SEQ ID NO: 7447567 - DNA, 22 bp, Homo sapiens
ttcaagttcatgtgtagtcagt

SEQ ID NO: 7447568 - DNA, 22 bp, Homo sapiens
ttcaagttctagtgttcacttc

SEQ ID NO: 7447569 - DNA, 22 bp, Homo sapiens
ttcaagttctagtgttcacttc

SEQ ID NO: 7447570 - DNA, 22 bp, Homo sapiens
ttcaagttcatgtgtagtcagt

SEQ ID NO: 7447571 - DNA, 22 bp, Homo sapiens
ttcaagttaatgattctggttt

SEQ ID NO: 7447572 - DNA, 22 bp, Homo sapiens
ttcaagttaactctccttgtac

SEQ ID NO: 7447573 - DNA, 22 bp, Homo sapiens
ttcaagttaatgattctggttt

SEQ ID NO: 7447574 - DNA, 22 bp, Homo sapiens
ttcaagttacctttaaacagct

SEQ ID NO: 7447575 - DNA, 22 bp, Homo sapiens
ttcaagttaatgattctggttt

SEQ ID NO: 7447576 - DNA, 22 bp, Homo sapiens
ttcaagttacctttaaacagct

SEQ ID NO: 7447577 - DNA, 22 bp, Homo sapiens
ttcaagttacctttaaacagct

SEQ ID NO: 7447578 - DNA, 22 bp, Homo sapiens
ttcaagttctagtgttcacttc

SEQ ID NO: 7447579 - DNA, 22 bp, Homo sapiens
ttcaagttctagtgttcacttc

SEQ ID NO: 7447580 - DNA, 20 bp, Homo sapiens
ttcaagttgggtctctggct

SEQ ID NO: 7447581 - DNA, 22 bp, Homo sapiens
ttcaagttctagtgttcacttc

SEQ ID NO: 7447582 - DNA, 20 bp, Homo sapiens
ttcaagttgggtctctggct

SEQ ID NO: 7447583 - DNA, 20 bp, Homo sapiens
ttcaagttgggtctctggct

SEQ ID NO: 7447584 - DNA, 22 bp, Homo sapiens
ttcaagttttgcctccccatcc

SEQ ID NO: 7447585 - DNA, 22 bp, Homo sapiens
ttcaagttttgacttagtcctt

SEQ ID NO: 7447586 - DNA, 22 bp, Homo sapiens
ttcaagttttcagaatagccac

SEQ ID NO: 7447587 - DNA, 22 bp, Homo sapiens
ttcaagttttcagaatagccac

SEQ ID NO: 7447588 - DNA, 22 bp, Homo sapiens
ttcaagttttcagaatagccac

SEQ ID NO: 7447589 - DNA, 22 bp, Homo sapiens
ttcaagttttcagaatagccac

SEQ ID NO: 7447590 - DNA, 22 bp, Homo sapiens
ttcaagttttcagaatagccac

SEQ ID NO: 7447591 - DNA, 22 bp, Homo sapiens
ttcaagttttatattgaagcaa

SEQ ID NO: 7447592 - DNA, 22 bp, Homo sapiens
ttcaagttttatattgaagcaa

SEQ ID NO: 7447593 - DNA, 22 bp, Homo sapiens
ttcaagttttatatccatggct

SEQ ID NO: 7447594 - DNA, 22 bp, Homo sapiens
ttcaagttttatatccatggct

SEQ ID NO: 7447595 - DNA, 22 bp, Homo sapiens
ttcaagtttcgcaaggacatat

SEQ ID NO: 7447596 - DNA, 22 bp, Homo sapiens
ttcaagtttactttgaagttta

SEQ ID NO: 7447597 - DNA, 22 bp, Homo sapiens
ttcaagttgtgttttccgggct

SEQ ID NO: 7447598 - DNA, 22 bp, Homo sapiens
ttcaagtttactttgaagttta

SEQ ID NO: 7447599 - DNA, 22 bp, Homo sapiens
ttcaagttttatatccatggct

SEQ ID NO: 7447600 - DNA, 22 bp, Homo sapiens
ttcaagttttatatccatggct

SEQ ID NO: 7447601 - DNA, 22 bp, Homo sapiens
ttcaagtttgtatttctgtatt

SEQ ID NO: 7447602 - DNA, 22 bp, Homo sapiens
ttcaagtttgtatttctgtatt

SEQ ID NO: 7447603 - DNA, 22 bp, Homo sapiens
ttcaagtttgtatttctgtatt

SEQ ID NO: 7447604 - DNA, 22 bp, Homo sapiens
ttcaagtttgtatttctgtatt

SEQ ID NO: 7447605 - DNA, 22 bp, Homo sapiens
cgcagctgctgctctgaaacag

SEQ ID NO: 7447606 - DNA, 22 bp, Homo sapiens
cgcagctgctgctctgaaacag

SEQ ID NO: 7447607 - DNA, 22 bp, Homo sapiens
cgcagctgctgctctgaaacag

SEQ ID NO: 7447608 - DNA, 22 bp, Homo sapiens
cgcagctgccttgtcagccgtt

SEQ ID NO: 7447609 - DNA, 22 bp, Homo sapiens
cgcagctgccttgtcagccgtt

SEQ ID NO: 7447610 - DNA, 22 bp, Homo sapiens
ttaggcttttttaaagcacaga

SEQ ID NO: 7447611 - DNA, 22 bp, Homo sapiens
ttaggcttcatgtgcagaggat

SEQ ID NO: 7447612 - DNA, 22 bp, Homo sapiens
ttaggcttccggcaggcggcgc

SEQ ID NO: 7447613 - DNA, 22 bp, Homo sapiens
ttaggctgttcttgtgttgtta

SEQ ID NO: 7447614 - DNA, 22 bp, Homo sapiens
ttaggctgttcttgtgttgtta

SEQ ID NO: 7447615 - DNA, 22 bp, Homo sapiens
ttaggctgttcttgtgttgtta

SEQ ID NO: 7447616 - DNA, 22 bp, Homo sapiens
ttaggctgttcttgtgttgtta

SEQ ID NO: 7447617 - DNA, 22 bp, Homo sapiens
ttaggctgttcttgtgttgtta

SEQ ID NO: 7447618 - DNA, 22 bp, Homo sapiens
ttaggcctttgattggggtgct

SEQ ID NO: 7447619 - DNA, 22 bp, Homo sapiens
ttaggcctttgattggggtgct

SEQ ID NO: 7447620 - DNA, 22 bp, Homo sapiens
ttaggcctttgattggggtgct

SEQ ID NO: 7447621 - DNA, 22 bp, Homo sapiens
ttaggctagggtgcaatggtgc

SEQ ID NO: 7447622 - DNA, 22 bp, Homo sapiens
ttaggctgggctacaacaactg

SEQ ID NO: 7447623 - DNA, 22 bp, Homo sapiens
ttaggctctctgcaactaagta

SEQ ID NO: 7447624 - DNA, 22 bp, Homo sapiens
ttaggcattagagaaatgcaat

SEQ ID NO: 7447625 - DNA, 22 bp, Homo sapiens
ttaggaggtctatggacatcct

SEQ ID NO: 7447626 - DNA, 22 bp, Homo sapiens
ttaggagatggtcctctaggga

SEQ ID NO: 7447627 - DNA, 22 bp, Homo sapiens
ttaggattaaaagttaatgcaa

SEQ ID NO: 7447628 - DNA, 22 bp, Homo sapiens
ttaggattaaaagttaatgcaa

SEQ ID NO: 7447629 - DNA, 22 bp, Homo sapiens
ttaggcaaagatattacgtagt

SEQ ID NO: 7447630 - DNA, 22 bp, Homo sapiens
ttaggcaaagatattacgtagt

SEQ ID NO: 7447631 - DNA, 22 bp, Homo sapiens
ttaggcaaagctggaatccagg

SEQ ID NO: 7447632 - DNA, 22 bp, Homo sapiens
ttaggatttgaaaaggggcaga

SEQ ID NO: 7447633 - DNA, 22 bp, Homo sapiens
ttaggatttgaaaaggggcaga

SEQ ID NO: 7447634 - DNA, 22 bp, Homo sapiens
ttaggatttgaaaaggggcaga

SEQ ID NO: 7447635 - DNA, 22 bp, Homo sapiens
ttaggcatagttttgataaata

SEQ ID NO: 7447636 - DNA, 22 bp, Homo sapiens
ttaggcaattttgtcattgtgt

SEQ ID NO: 7447637 - DNA, 22 bp, Homo sapiens
ttaggcacttgctttgtgttca

SEQ ID NO: 7447638 - DNA, 22 bp, Homo sapiens
ttaggcaatgaattattccaag

SEQ ID NO: 7447639 - DNA, 22 bp, Homo sapiens
ttaggcaatgaattattccaag

SEQ ID NO: 7447640 - DNA, 22 bp, Homo sapiens
ttaggcaaataaaatgtttcca

SEQ ID NO: 7447641 - DNA, 22 bp, Homo sapiens
ttaggcaaataaaatgtttcca

SEQ ID NO: 7447642 - DNA, 22 bp, Homo sapiens
ttaggcaatgaattattccaag

SEQ ID NO: 7447643 - DNA, 22 bp, Homo sapiens
ttaggcaatgctctcaaatttg

SEQ ID NO: 7447644 - DNA, 22 bp, Homo sapiens
ttaggcaatgctctcaaatttg

SEQ ID NO: 7447645 - DNA, 22 bp, Homo sapiens
ttaggcaatatcattggagttg

SEQ ID NO: 7447646 - DNA, 22 bp, Homo sapiens
ttaggcaatttgatttttcaag

SEQ ID NO: 7447647 - DNA, 22 bp, Homo sapiens
ttaggcaatttgatttttcaag

SEQ ID NO: 7447648 - DNA, 22 bp, Homo sapiens
ttaggcaattttgtcattgtgt

SEQ ID NO: 7447649 - DNA, 22 bp, Homo sapiens
cgcagctggatatcatgtgcct

SEQ ID NO: 7447650 - DNA, 22 bp, Homo sapiens
cgcagctggatatcatgtgcct

SEQ ID NO: 7447651 - DNA, 22 bp, Homo sapiens
cgcagctggatatcatgtgcct

SEQ ID NO: 7447652 - DNA, 22 bp, Homo sapiens
cgcagctgctgctctgaaacag

SEQ ID NO: 7447653 - DNA, 22 bp, Homo sapiens
cgcagctggatatcatgtgcct

SEQ ID NO: 7447654 - DNA, 22 bp, Homo sapiens
cgcagctgtccatgtgtggggg

SEQ ID NO: 7447655 - DNA, 22 bp, Homo sapiens
cgcagctgtccatgtgtggggg

SEQ ID NO: 7447656 - DNA, 22 bp, Homo sapiens
cgcagctgtccatgtgtggggg

SEQ ID NO: 7447657 - DNA, 19 bp, Homo sapiens
cgcaggtggaaggagccgc

SEQ ID NO: 7447658 - DNA, 22 bp, Homo sapiens
cgcaggtgggcccttcattgat

SEQ ID NO: 7447659 - DNA, 22 bp, Homo sapiens
cgcagtgagtctgtaaaaggct

SEQ ID NO: 7447660 - DNA, 22 bp, Homo sapiens
cgcagtgagtctgtaaaaggct

SEQ ID NO: 7447661 - DNA, 22 bp, Homo sapiens
cgcatacatagaaacacacaga

SEQ ID NO: 7447662 - DNA, 22 bp, Homo sapiens
cgcatacatagaaacacacaga

SEQ ID NO: 7447663 - DNA, 22 bp, Homo sapiens
cgcaggtgtgttttcaggacta

SEQ ID NO: 7447664 - DNA, 22 bp, Homo sapiens
cgcatgcagtggggctgcagtt

SEQ ID NO: 7447665 - DNA, 22 bp, Homo sapiens
cgcatgcagtggggctgcagtt

SEQ ID NO: 7447666 - DNA, 22 bp, Homo sapiens
cgcatgtgcgttgattgcagtg

SEQ ID NO: 7447667 - DNA, 22 bp, Homo sapiens
cgccaggcttggtagctcatgc

SEQ ID NO: 7447668 - DNA, 22 bp, Homo sapiens
cgccaggcttggtagctcatgc

SEQ ID NO: 7447669 - DNA, 22 bp, Homo sapiens
cgcatgagacctgccggccatc

SEQ ID NO: 7447670 - DNA, 22 bp, Homo sapiens
cgcatccagggcgcaggatctg

SEQ ID NO: 7447671 - DNA, 22 bp, Homo sapiens
cgcatcgggtagaggagctgga

SEQ ID NO: 7447672 - DNA, 22 bp, Homo sapiens
cgcatccagggcgcaggatctg

SEQ ID NO: 7447673 - DNA, 23 bp, Homo sapiens
cgcccagcctcagtgacctgggc

SEQ ID NO: 7447674 - DNA, 23 bp, Homo sapiens
cgcccagcctcagtgacctgggc

SEQ ID NO: 7447675 - DNA, 22 bp, Homo sapiens
cgccagtggcagctggaacagg

SEQ ID NO: 7447676 - DNA, 22 bp, Homo sapiens
cgccaggcttggtagctcatgc

SEQ ID NO: 7447677 - DNA, 22 bp, Homo sapiens
cgccaggcttggtagctcatgc

SEQ ID NO: 7447678 - DNA, 22 bp, Homo sapiens
cctttctctggcagcaggacag

SEQ ID NO: 7447679 - DNA, 22 bp, Homo sapiens
cctttctctggcagcaggacag

SEQ ID NO: 7447680 - DNA, 22 bp, Homo sapiens
cctttctctatcgacccatcgc

SEQ ID NO: 7447681 - DNA, 17 bp, Homo sapiens
cctttctctttcatctc

SEQ ID NO: 7447682 - DNA, 22 bp, Homo sapiens
cctttctctttgctgatcatgt

SEQ ID NO: 7447683 - DNA, 22 bp, Homo sapiens
cctttctgacagtgatgggggg

SEQ ID NO: 7447684 - DNA, 22 bp, Homo sapiens
cctttctgacagtgatgggggg

SEQ ID NO: 7447685 - DNA, 22 bp, Homo sapiens
cctttctctttgctgatcatgt

SEQ ID NO: 7447686 - DNA, 22 bp, Homo sapiens
ttaggaatttatcacagactgg

SEQ ID NO: 7447687 - DNA, 22 bp, Homo sapiens
ttaggaatttattccattgttg

SEQ ID NO: 7447688 - DNA, 22 bp, Homo sapiens
ttaggacatggacagctttggt

SEQ ID NO: 7447689 - DNA, 22 bp, Homo sapiens
ttaggacaagataaaacacaag

SEQ ID NO: 7447690 - DNA, 22 bp, Homo sapiens
ttaggaatttatcacagactgg

SEQ ID NO: 7447691 - DNA, 22 bp, Homo sapiens
ttaggaatgagatttctagtga

SEQ ID NO: 7447692 - DNA, 22 bp, Homo sapiens
ttaggaatgagatttctagtga

SEQ ID NO: 7447693 - DNA, 22 bp, Homo sapiens
ttaggaagttatagtggaaatg

SEQ ID NO: 7447694 - DNA, 22 bp, Homo sapiens
ttaggaagtttcagaaaatgca

SEQ ID NO: 7447695 - DNA, 22 bp, Homo sapiens
ttaggaatatgtattttaaagt

SEQ ID NO: 7447696 - DNA, 22 bp, Homo sapiens
ttaggaatatgtattttaaagt

SEQ ID NO: 7447697 - DNA, 22 bp, Homo sapiens
ttaggaatattttctgagtagt

SEQ ID NO: 7447698 - DNA, 22 bp, Homo sapiens
cctttccccgcgggaggtgcca

SEQ ID NO: 7447699 - DNA, 22 bp, Homo sapiens
cctttccccgcgggaggtgcca

SEQ ID NO: 7447700 - DNA, 22 bp, Homo sapiens
cctttccccgcgggaggtgcca

SEQ ID NO: 7447701 - DNA, 22 bp, Homo sapiens
cctttcccgctttgagggcaag

SEQ ID NO: 7447702 - DNA, 22 bp, Homo sapiens
cctttcccgctttgagggcaag

SEQ ID NO: 7447703 - DNA, 22 bp, Homo sapiens
cctttcccgctttgagggcaag

SEQ ID NO: 7447704 - DNA, 18 bp, Homo sapiens
cctttcctcccctcagct

SEQ ID NO: 7447705 - DNA, 18 bp, Homo sapiens
cctttcctcccctcagct

SEQ ID NO: 7447706 - DNA, 18 bp, Homo sapiens
cctttcctcccctcagct

SEQ ID NO: 7447707 - DNA, 22 bp, Homo sapiens
cctttcctgcctcaggaagtag

SEQ ID NO: 7447708 - DNA, 22 bp, Homo sapiens
cctttcctgcctcaggaagtag

SEQ ID NO: 7447709 - DNA, 22 bp, Homo sapiens
cctttcctgcctcaggaagtag

SEQ ID NO: 7447710 - DNA, 22 bp, Homo sapiens
cctttcctgcctcaggaagtag

SEQ ID NO: 7447711 - DNA, 22 bp, Homo sapiens
cctttcaaaacagaacactagc

SEQ ID NO: 7447712 - DNA, 22 bp, Homo sapiens
cctttcaaaacagaacactagc

SEQ ID NO: 7447713 - DNA, 22 bp, Homo sapiens
cctttcaaagttttgccatgct

SEQ ID NO: 7447714 - DNA, 22 bp, Homo sapiens
cctttcaaaacagaacactagc

SEQ ID NO: 7447715 - DNA, 19 bp, Homo sapiens
cctttcagaacagaagcca

SEQ ID NO: 7447716 - DNA, 22 bp, Homo sapiens
cctttcaacaagatttctggcc

SEQ ID NO: 7447717 - DNA, 19 bp, Homo sapiens
cctttcagaacagaagcca

SEQ ID NO: 7447718 - DNA, 16 bp, Homo sapiens
cctttctctgccttcc

SEQ ID NO: 7447719 - DNA, 22 bp, Homo sapiens
cctttctctatcgacccatcgc

SEQ ID NO: 7447720 - DNA, 22 bp, Homo sapiens
cctttctctatcgacccatcgc

SEQ ID NO: 7447721 - DNA, 22 bp, Homo sapiens
cctttctctatcgacccatcgc

SEQ ID NO: 7447722 - DNA, 22 bp, Homo sapiens
cctttctctatcgacccatcgc

SEQ ID NO: 7447723 - DNA, 22 bp, Homo sapiens
cctttctcattttaagcattag

SEQ ID NO: 7447724 - DNA, 22 bp, Homo sapiens
cctttctaagatactgcaactt

SEQ ID NO: 7447725 - DNA, 22 bp, Homo sapiens
cctttcctttttagtgtgggag

SEQ ID NO: 7447726 - DNA, 22 bp, Homo sapiens
cctttctaagatactgcaactt

SEQ ID NO: 7447727 - DNA, 22 bp, Homo sapiens
cctttcctgtgtccttttaagg

SEQ ID NO: 7447728 - DNA, 22 bp, Homo sapiens
cctttcctgcctcaggaagtag

SEQ ID NO: 7447729 - DNA, 22 bp, Homo sapiens
cctttcctgtgtccttttaagg

SEQ ID NO: 7447730 - DNA, 22 bp, Homo sapiens
tggggctgtggattctcacgaa

SEQ ID NO: 7447731 - DNA, 19 bp, Homo sapiens
tggggctgtgttttgaccc

SEQ ID NO: 7447732 - DNA, 19 bp, Homo sapiens
tggggctgtgttttgaccc

SEQ ID NO: 7447733 - DNA, 19 bp, Homo sapiens
tggggctgtgttttgaccc

SEQ ID NO: 7447734 - DNA, 19 bp, Homo sapiens
tggggctgtgttttgaccc

SEQ ID NO: 7447735 - DNA, 19 bp, Homo sapiens
tggggctgtgttttgaccc

SEQ ID NO: 7447736 - DNA, 22 bp, Homo sapiens
tggggctgtggattctcacgaa

SEQ ID NO: 7447737 - DNA, 22 bp, Homo sapiens
tggggctgtggattctcacgaa

SEQ ID NO: 7447738 - DNA, 22 bp, Homo sapiens
tggggctgtggattctcacgaa

SEQ ID NO: 7447739 - DNA, 22 bp, Homo sapiens
tggggctgtggattctcacgaa

SEQ ID NO: 7447740 - DNA, 22 bp, Homo sapiens
tggggctgtgagactacaggat

SEQ ID NO: 7447741 - DNA, 22 bp, Homo sapiens
tggggctgtgagactacaggat

SEQ ID NO: 7447742 - DNA, 22 bp, Homo sapiens
tggggctgtgagactacaggat

SEQ ID NO: 7447743 - DNA, 22 bp, Homo sapiens
tggggctgtggattctcacgaa

SEQ ID NO: 7447744 - DNA, 22 bp, Homo sapiens
tggggctgtggattctcacgaa

SEQ ID NO: 7447745 - DNA, 22 bp, Homo sapiens
tggggctgtgagactacaggat

SEQ ID NO: 7447746 - DNA, 22 bp, Homo sapiens
tggggctgtgagactacaggat

SEQ ID NO: 7447747 - DNA, 22 bp, Homo sapiens
tggggctgtgagactacaggat

SEQ ID NO: 7447748 - DNA, 23 bp, Homo sapiens
tggggccaagtgaggaagggtct

SEQ ID NO: 7447749 - DNA, 23 bp, Homo sapiens
tggggccaagtgaggaagggtct

SEQ ID NO: 7447750 - DNA, 23 bp, Homo sapiens
tggggccaagtgaggaagggtct

SEQ ID NO: 7447751 - DNA, 22 bp, Homo sapiens
tggggcagttaataaacattct

SEQ ID NO: 7447752 - DNA, 22 bp, Homo sapiens
tggggcatgtgaacctggatgt

SEQ ID NO: 7447753 - DNA, 22 bp, Homo sapiens
tggggcatggatgataagctgg

SEQ ID NO: 7447754 - DNA, 22 bp, Homo sapiens
tggggccaagaaggtctcatgt

SEQ ID NO: 7447755 - DNA, 23 bp, Homo sapiens
tggggccaagtgaggaagggtct

SEQ ID NO: 7447756 - DNA, 22 bp, Homo sapiens
tggggccacactgatctcccag

SEQ ID NO: 7447757 - DNA, 22 bp, Homo sapiens
tggggccacactgatctcccag

SEQ ID NO: 7447758 - DNA, 22 bp, Homo sapiens
tggggccacacatctctttcta

SEQ ID NO: 7447759 - DNA, 22 bp, Homo sapiens
tggggctgtccttagtctgaga

SEQ ID NO: 7447760 - DNA, 22 bp, Homo sapiens
tggggctgtgagactacaggat

SEQ ID NO: 7447761 - DNA, 22 bp, Homo sapiens
tggggctgtgagactacaggat

SEQ ID NO: 7447762 - DNA, 22 bp, Homo sapiens
tggggcagtggcttttcaccct

SEQ ID NO: 7447763 - DNA, 22 bp, Homo sapiens
tggggcagttaataaacattct

SEQ ID NO: 7447764 - DNA, 22 bp, Homo sapiens
tggggcagttaataaacattct

SEQ ID NO: 7447765 - DNA, 22 bp, Homo sapiens
tggggcagttaataaacattct

SEQ ID NO: 7447766 - DNA, 22 bp, Homo sapiens
tggggcagtggcttttcaccct

SEQ ID NO: 7447767 - DNA, 22 bp, Homo sapiens
tggggcagtggcttttcaccct

SEQ ID NO: 7447768 - DNA, 22 bp, Homo sapiens
tggggcagggatgggaaactat

SEQ ID NO: 7447769 - DNA, 22 bp, Homo sapiens
tggggcagtggcttttcaccct

SEQ ID NO: 7447770 - DNA, 22 bp, Homo sapiens
tggggcagtggcttttcaccct

SEQ ID NO: 7447771 - DNA, 22 bp, Homo sapiens
tggggcagtggcttttcaccct

SEQ ID NO: 7447772 - DNA, 22 bp, Homo sapiens
tggggcagggatgggaaactat

SEQ ID NO: 7447773 - DNA, 22 bp, Homo sapiens
tggggcagggatgggaaactat

SEQ ID NO: 7447774 - DNA, 22 bp, Homo sapiens
tggggcagggatgggaaactat

SEQ ID NO: 7447775 - DNA, 22 bp, Homo sapiens
tggggcagggatgggaaactat

SEQ ID NO: 7447776 - DNA, 22 bp, Homo sapiens
tggggcagggatgggaaactat

SEQ ID NO: 7447777 - DNA, 22 bp, Homo sapiens
tggggcagggatgggaaactat

SEQ ID NO: 7447778 - DNA, 22 bp, Homo sapiens
tggggcagggatgggaaactat

SEQ ID NO: 7447779 - DNA, 22 bp, Homo sapiens
tggggcagggatgggaaactat

SEQ ID NO: 7447780 - DNA, 22 bp, Homo sapiens
tggggcagctccatctattcca

SEQ ID NO: 7447781 - DNA, 22 bp, Homo sapiens
tggggcagctccatctattcca

SEQ ID NO: 7447782 - DNA, 22 bp, Homo sapiens
tggggcagctccatctattcca

SEQ ID NO: 7447783 - DNA, 22 bp, Homo sapiens
tggggcagctccatctattcca

SEQ ID NO: 7447784 - DNA, 22 bp, Homo sapiens
tggggcagccacatagacaaca

SEQ ID NO: 7447785 - DNA, 22 bp, Homo sapiens
tggggcagctccatctattcca

SEQ ID NO: 7447786 - DNA, 22 bp, Homo sapiens
tggggcagccacatagacaaca

SEQ ID NO: 7447787 - DNA, 22 bp, Homo sapiens
tggggcagccacatagacaaca

SEQ ID NO: 7447788 - DNA, 22 bp, Homo sapiens
tggggcagccacatagacaaca

SEQ ID NO: 7447789 - DNA, 22 bp, Homo sapiens
tggggcagccacatagacaaca

SEQ ID NO: 7447790 - DNA, 22 bp, Homo sapiens
tggggaggaagtcagatttcag

SEQ ID NO: 7447791 - DNA, 22 bp, Homo sapiens
tggggcagccacatagacaaca

SEQ ID NO: 7447792 - DNA, 22 bp, Homo sapiens
tggggcagccacatagacaaca

SEQ ID NO: 7447793 - DNA, 22 bp, Homo sapiens
tggggcagccacatagacaaca

SEQ ID NO: 7447794 - DNA, 22 bp, Homo sapiens
tggggcagccacatagacaaca

SEQ ID NO: 7447795 - DNA, 22 bp, Homo sapiens
tgggggactgcactggcgtcag

SEQ ID NO: 7447796 - DNA, 22 bp, Homo sapiens
tgggggactgcactggcgtcag

SEQ ID NO: 7447797 - DNA, 22 bp, Homo sapiens
tgggggactgcactggcgtcag

SEQ ID NO: 7447798 - DNA, 22 bp, Homo sapiens
tgggggactgcactggcgtcag

SEQ ID NO: 7447799 - DNA, 21 bp, Homo sapiens
tgggggagaattggttgcttt

SEQ ID NO: 7447800 - DNA, 21 bp, Homo sapiens
tgggggagaattggttgcttt

SEQ ID NO: 7447801 - DNA, 21 bp, Homo sapiens
tgggggagaattggttgcttt

SEQ ID NO: 7447802 - DNA, 21 bp, Homo sapiens
tgggggagaattggttgcttt

SEQ ID NO: 7447803 - DNA, 21 bp, Homo sapiens
tgggggagaattggttgcttt

SEQ ID NO: 7447804 - DNA, 21 bp, Homo sapiens
tgggggagaattggttgcttt

SEQ ID NO: 7447805 - DNA, 21 bp, Homo sapiens
tgggggagaattggttgcttt

SEQ ID NO: 7447806 - DNA, 22 bp, Homo sapiens
tgggggaactgttgcgcgcggg

SEQ ID NO: 7447807 - DNA, 22 bp, Homo sapiens
tgggggaaattcagccagatat

SEQ ID NO: 7447808 - DNA, 22 bp, Homo sapiens
tgggggaaattcagccagatat

SEQ ID NO: 7447809 - DNA, 22 bp, Homo sapiens
tgggggaaattcagccagatat

SEQ ID NO: 7447810 - DNA, 22 bp, Homo sapiens
tgggggaagagcttgttaaagt

SEQ ID NO: 7447811 - DNA, 22 bp, Homo sapiens
tgggggaagagcttgttaaagt

SEQ ID NO: 7447812 - DNA, 22 bp, Homo sapiens
tgggggacaccagtctctctct

SEQ ID NO: 7447813 - DNA, 22 bp, Homo sapiens
tgggggacaccagtctctctct

SEQ ID NO: 7447814 - DNA, 19 bp, Homo sapiens
cctgggagtcagctgaagg

SEQ ID NO: 7447815 - DNA, 19 bp, Homo sapiens
cctgggagtcagctgaagg

SEQ ID NO: 7447816 - DNA, 19 bp, Homo sapiens
cctgggagtcagctgaagg

SEQ ID NO: 7447817 - DNA, 19 bp, Homo sapiens
cctgggagtcagctgaagg

SEQ ID NO: 7447818 - DNA, 19 bp, Homo sapiens
cctgggagtcagctgaagg

SEQ ID NO: 7447819 - DNA, 22 bp, Homo sapiens
cctgggaggtggatgttgcggt

SEQ ID NO: 7447820 - DNA, 22 bp, Homo sapiens
cctgggaggctgaggctgcagt

SEQ ID NO: 7447821 - DNA, 22 bp, Homo sapiens
cctgggaggtggatgttgcggt

SEQ ID NO: 7447822 - DNA, 22 bp, Homo sapiens
cctgggaggtggatgttgcggt

SEQ ID NO: 7447823 - DNA, 22 bp, Homo sapiens
cctgggaggctgaggctgcagt

SEQ ID NO: 7447824 - DNA, 22 bp, Homo sapiens
cctgggaggctgaggctgcagt

SEQ ID NO: 7447825 - DNA, 21 bp, Homo sapiens
tgggggagaattggttgcttt

SEQ ID NO: 7447826 - DNA, 22 bp, Homo sapiens
cctgggaggctgaggctgcagt

SEQ ID NO: 7447827 - DNA, 22 bp, Homo sapiens
cctgggaggctgaggctgcagt

SEQ ID NO: 7447828 - DNA, 22 bp, Homo sapiens
cctgggaggctgaggctgcagt

SEQ ID NO: 7447829 - DNA, 22 bp, Homo sapiens
cctgggaggctgaggctgcagt

SEQ ID NO: 7447830 - DNA, 21 bp, Homo sapiens
tgggggagaattggttgcttt

SEQ ID NO: 7447831 - DNA, 22 bp, Homo sapiens
cctgggagtgtcagacttgctt

SEQ ID NO: 7447832 - DNA, 22 bp, Homo sapiens
cctgggagtgtcagacttgctt

SEQ ID NO: 7447833 - DNA, 22 bp, Homo sapiens
cctgggagtgtcagacttgctt

SEQ ID NO: 7447834 - DNA, 22 bp, Homo sapiens
cctgggagtgtgccatctctgt

SEQ ID NO: 7447835 - DNA, 22 bp, Homo sapiens
cctgggagtgtcagacttgctt

SEQ ID NO: 7447836 - DNA, 22 bp, Homo sapiens
cctgggagtgtgccatctctgt

SEQ ID NO: 7447837 - DNA, 22 bp, Homo sapiens
cctgggagtgtgccatctctgt

SEQ ID NO: 7447838 - DNA, 22 bp, Homo sapiens
cctgggagtgtgccatctctgt

SEQ ID NO: 7447839 - DNA, 22 bp, Homo sapiens
cctgggagtgtgccatctctgt

SEQ ID NO: 7447840 - DNA, 22 bp, Homo sapiens
cctgggagtgtgccatctctgt

SEQ ID NO: 7447841 - DNA, 22 bp, Homo sapiens
cctgggagtgtgccatctctgt

SEQ ID NO: 7447842 - DNA, 22 bp, Homo sapiens
cctgggatgaaagcagcccact

SEQ ID NO: 7447843 - DNA, 22 bp, Homo sapiens
cctgggatgaaagcagcccact

SEQ ID NO: 7447844 - DNA, 22 bp, Homo sapiens
cctgggagtgtgccatctctgt

SEQ ID NO: 7447845 - DNA, 22 bp, Homo sapiens
cctgggatgctgtcctcatcta

SEQ ID NO: 7447846 - DNA, 22 bp, Homo sapiens
cctgggatgctgtcctcatcta

SEQ ID NO: 7447847 - DNA, 22 bp, Homo sapiens
cctgggatttcctgagcactct

SEQ ID NO: 7447848 - DNA, 22 bp, Homo sapiens
cctgggatttcctgagcactct

SEQ ID NO: 7447849 - DNA, 22 bp, Homo sapiens
cctgggatttcctgagcactct

SEQ ID NO: 7447850 - DNA, 19 bp, Homo sapiens
cctgggagtcagctgaagg

SEQ ID NO: 7447851 - DNA, 22 bp, Homo sapiens
cctgggagtggcactcacagca

SEQ ID NO: 7447852 - DNA, 19 bp, Homo sapiens
cctgggagtcagctgaagg

SEQ ID NO: 7447853 - DNA, 22 bp, Homo sapiens
cctgggagtgcacaggtttcgt

SEQ ID NO: 7447854 - DNA, 22 bp, Homo sapiens
cctgggagtgcacaggtttcgt

SEQ ID NO: 7447855 - DNA, 22 bp, Homo sapiens
cctgggagtgcacaggtttcgt

SEQ ID NO: 7447856 - DNA, 22 bp, Homo sapiens
cctgggagtggcactcacagca

SEQ ID NO: 7447857 - DNA, 22 bp, Homo sapiens
cctgggagtggcactcacagca

SEQ ID NO: 7447858 - DNA, 22 bp, Homo sapiens
cctgggagtggcactcacagca

SEQ ID NO: 7447859 - DNA, 22 bp, Homo sapiens
cctgggagtggcactcacagca

SEQ ID NO: 7447860 - DNA, 22 bp, Homo sapiens
cctgggagtggcactcacagca

SEQ ID NO: 7447861 - DNA, 22 bp, Homo sapiens
cctgggagtggcactcacagca

SEQ ID NO: 7447862 - DNA, 22 bp, Homo sapiens
tgtgtatatgtaaatatagttg

SEQ ID NO: 7447863 - DNA, 22 bp, Homo sapiens
tgtgtatattaggacacattct

SEQ ID NO: 7447864 - DNA, 22 bp, Homo sapiens
tgtgtatatatgtttaagtcat

SEQ ID NO: 7447865 - DNA, 22 bp, Homo sapiens
tgtgtatatgtaaatatagttg

SEQ ID NO: 7447866 - DNA, 22 bp, Homo sapiens
tgtgtatgcatacacacataga

SEQ ID NO: 7447867 - DNA, 22 bp, Homo sapiens
tgtgtatgcatacacacataga

SEQ ID NO: 7447868 - DNA, 22 bp, Homo sapiens
tgtgtatgcatacacacataga

SEQ ID NO: 7447869 - DNA, 22 bp, Homo sapiens
tgtgtatgcatacacacataga

SEQ ID NO: 7447870 - DNA, 22 bp, Homo sapiens
tgtgtatctgtatacaagtttg

SEQ ID NO: 7447871 - DNA, 22 bp, Homo sapiens
tgtgtatattaggacacattct

SEQ ID NO: 7447872 - DNA, 21 bp, Homo sapiens
tgtgtatgtccaatgccctac

SEQ ID NO: 7447873 - DNA, 18 bp, Homo sapiens
tgtgtatgtctcagggaa

SEQ ID NO: 7447874 - DNA, 23 bp, Homo sapiens
tgtgtatgtatctatgcataggt

SEQ ID NO: 7447875 - DNA, 23 bp, Homo sapiens
tgtgtatgtatctatgcataggt

SEQ ID NO: 7447876 - DNA, 23 bp, Homo sapiens
tgtgtatgtatctatgcataggt

SEQ ID NO: 7447877 - DNA, 22 bp, Homo sapiens
tgtgtatgtaagcatgtgcata

SEQ ID NO: 7447878 - DNA, 22 bp, Homo sapiens
tgtgtatgtaagcatgtgcata

SEQ ID NO: 7447879 - DNA, 22 bp, Homo sapiens
tgtgtatgtaagcatgtgcata

SEQ ID NO: 7447880 - DNA, 22 bp, Homo sapiens
tgtgtatgtaagcatgtgcata

SEQ ID NO: 7447881 - DNA, 23 bp, Homo sapiens
tgtgtatgtatctatgcataggt

SEQ ID NO: 7447882 - DNA, 22 bp, Homo sapiens
tgtgtatgtaagcatgtgcata

SEQ ID NO: 7447883 - DNA, 22 bp, Homo sapiens
tgtgtattaccattttacagct

SEQ ID NO: 7447884 - DNA, 22 bp, Homo sapiens
tgtgtctcaagtcagagcatca

SEQ ID NO: 7447885 - DNA, 22 bp, Homo sapiens
tgtgtattaatgtttgtatatg

SEQ ID NO: 7447886 - DNA, 22 bp, Homo sapiens
tgtgtattaatgtttgtatatg

SEQ ID NO: 7447887 - DNA, 22 bp, Homo sapiens
tgtgtattaatgtttgtatatg

SEQ ID NO: 7447888 - DNA, 22 bp, Homo sapiens
tgtgtatgtctgtatgcacaca

SEQ ID NO: 7447889 - DNA, 20 bp, Homo sapiens
tgtgtatgtgcacatgcgaa

SEQ ID NO: 7447890 - DNA, 22 bp, Homo sapiens
tgtgtatgtctgtatgcacaca

SEQ ID NO: 7447891 - DNA, 20 bp, Homo sapiens
tgtgtatgtgcacatgcgaa

SEQ ID NO: 7447892 - DNA, 22 bp, Homo sapiens
tgtgtatgttttgaggttgcta

SEQ ID NO: 7447893 - DNA, 22 bp, Homo sapiens
tgtgtatgtgtatacactatat

SEQ ID NO: 7447894 - DNA, 22 bp, Homo sapiens
tgtgtatgtgtatacactatat

SEQ ID NO: 7447895 - DNA, 20 bp, Homo sapiens
tgtgtatgtgcacatgcgaa

SEQ ID NO: 7447896 - DNA, 22 bp, Homo sapiens
tgtgtatgtctgtatgcacaca

SEQ ID NO: 7447897 - DNA, 22 bp, Homo sapiens
tgtgtatgtgtatacactatat

SEQ ID NO: 7447898 - DNA, 22 bp, Homo sapiens
tgtgtatgtgtatacactatat

SEQ ID NO: 7447899 - DNA, 22 bp, Homo sapiens
tgtgtctgcactgagtcctcac

SEQ ID NO: 7447900 - DNA, 23 bp, Homo sapiens
tgtgtctgaggatatatgtgcat

SEQ ID NO: 7447901 - DNA, 22 bp, Homo sapiens
tgtgtctgcactgagtcctcac

SEQ ID NO: 7447902 - DNA, 22 bp, Homo sapiens
tgtgtctgcactgagtcctcac

SEQ ID NO: 7447903 - DNA, 22 bp, Homo sapiens
tgtgtctgcactgagtcctcac

SEQ ID NO: 7447904 - DNA, 23 bp, Homo sapiens
tgtgtctgaggatatatgtgcat

SEQ ID NO: 7447905 - DNA, 22 bp, Homo sapiens
tgtgtctgcccttagtacatct

SEQ ID NO: 7447906 - DNA, 22 bp, Homo sapiens
tgtgtctgcactgagtcctcac

SEQ ID NO: 7447907 - DNA, 22 bp, Homo sapiens
tgtgtctgcactgagtcctcac

SEQ ID NO: 7447908 - DNA, 22 bp, Homo sapiens
tgtgtctgcactgagtcctcac

SEQ ID NO: 7447909 - DNA, 23 bp, Homo sapiens
tgtgtctgaggatatatgtgcat

SEQ ID NO: 7447910 - DNA, 23 bp, Homo sapiens
tgtgtctgaggatatatgtgcat

SEQ ID NO: 7447911 - DNA, 23 bp, Homo sapiens
tgtgtctgaggatatatgtgcat

SEQ ID NO: 7447912 - DNA, 23 bp, Homo sapiens
tgtgtctgaggatatatgtgcat

SEQ ID NO: 7447913 - DNA, 23 bp, Homo sapiens
tgtgtctgaggatatatgtgcat

SEQ ID NO: 7447914 - DNA, 22 bp, Homo sapiens
tgtgtctgaacatgctttgtaa

SEQ ID NO: 7447915 - DNA, 22 bp, Homo sapiens
tgtgtctgaactagttgctctc

SEQ ID NO: 7447916 - DNA, 22 bp, Homo sapiens
tgtgtctgaactagttgctctc

SEQ ID NO: 7447917 - DNA, 22 bp, Homo sapiens
tgtgtctgaactagttgctctc

SEQ ID NO: 7447918 - DNA, 22 bp, Homo sapiens
tgtgtctgaacatgctttgtaa

SEQ ID NO: 7447919 - DNA, 22 bp, Homo sapiens
tgtgtctgaacatgctttgtaa

SEQ ID NO: 7447920 - DNA, 22 bp, Homo sapiens
tgtgtctgaacatgctttgtaa

SEQ ID NO: 7447921 - DNA, 22 bp, Homo sapiens
tgtgtctgaactagttgctctc

SEQ ID NO: 7447922 - DNA, 22 bp, Homo sapiens
tgtgtctgaacatgctttgtaa

SEQ ID NO: 7447923 - DNA, 22 bp, Homo sapiens
tgtgtctctttgtcctagagct

SEQ ID NO: 7447924 - DNA, 22 bp, Homo sapiens
tgtgtctctttgtcctagagct

SEQ ID NO: 7447925 - DNA, 22 bp, Homo sapiens
tgtgtctgaacatgctttgtaa

SEQ ID NO: 7447926 - DNA, 22 bp, Homo sapiens
tgtgtctcttggggtttaaagc

SEQ ID NO: 7447927 - DNA, 22 bp, Homo sapiens
tgtgtctctttgtcctagagct

SEQ ID NO: 7447928 - DNA, 22 bp, Homo sapiens
tgtgtctctcctggaagcacgt

SEQ ID NO: 7447929 - DNA, 22 bp, Homo sapiens
tgtgtctctcctggaagcacgt

SEQ ID NO: 7447930 - DNA, 22 bp, Homo sapiens
tgtgtctcctttccctgtctaa

SEQ ID NO: 7447931 - DNA, 19 bp, Homo sapiens
tgtgtctctgtgtagcctg

SEQ ID NO: 7447932 - DNA, 19 bp, Homo sapiens
tgtgtctctgtgtagcctg

SEQ ID NO: 7447933 - DNA, 19 bp, Homo sapiens
tgtgtctctgtgtagcctg

SEQ ID NO: 7447934 - DNA, 22 bp, Homo sapiens
tgtgtatgttttgaggttgcta

SEQ ID NO: 7447935 - DNA, 22 bp, Homo sapiens
tgtgtctccatagccagctagc

SEQ ID NO: 7447936 - DNA, 22 bp, Homo sapiens
tgtgtctcatttcctcctgctg

SEQ ID NO: 7447937 - DNA, 22 bp, Homo sapiens
tgtgtctccatagccagctagc

SEQ ID NO: 7447938 - DNA, 22 bp, Homo sapiens
tgtgtctccatagccagctagc

SEQ ID NO: 7447939 - DNA, 22 bp, Homo sapiens
tgtgtctcctttccctgtctaa

SEQ ID NO: 7447940 - DNA, 22 bp, Homo sapiens
tgtgtctcctttccctgtctaa

SEQ ID NO: 7447941 - DNA, 22 bp, Homo sapiens
cctgggcaacatagtgagacct

SEQ ID NO: 7447942 - DNA, 22 bp, Homo sapiens
cctgggcaacatagtgagacct

SEQ ID NO: 7447943 - DNA, 22 bp, Homo sapiens
cctgggcaacatagtgagacct

SEQ ID NO: 7447944 - DNA, 22 bp, Homo sapiens
cctgggcaacatagtgagacct

SEQ ID NO: 7447945 - DNA, 22 bp, Homo sapiens
cctgggcaacatagtgagacct

SEQ ID NO: 7447946 - DNA, 22 bp, Homo sapiens
cctgggcaacatagtgagacct

SEQ ID NO: 7447947 - DNA, 22 bp, Homo sapiens
cctgggcaacatagtgagaccc

SEQ ID NO: 7447948 - DNA, 22 bp, Homo sapiens
cctgggcaacatagtgagaccc

SEQ ID NO: 7447949 - DNA, 22 bp, Homo sapiens
cctgggcaacatagtgagaccc

SEQ ID NO: 7447950 - DNA, 22 bp, Homo sapiens
cctgggcaacatagtgagaccc

SEQ ID NO: 7447951 - DNA, 22 bp, Homo sapiens
cctgggcaacatagtgagaccc

SEQ ID NO: 7447952 - DNA, 22 bp, Homo sapiens
cctgggcaacatagtgagaccc

SEQ ID NO: 7447953 - DNA, 22 bp, Homo sapiens
cctgggcaacatagggagaccc

SEQ ID NO: 7447954 - DNA, 22 bp, Homo sapiens
cctgggcaacatagggagaccc

SEQ ID NO: 7447955 - DNA, 22 bp, Homo sapiens
cctgggcaacatagggagaccc

SEQ ID NO: 7447956 - DNA, 22 bp, Homo sapiens
cctgggcaacatagggagaccc

SEQ ID NO: 7447957 - DNA, 22 bp, Homo sapiens
cctgggcaacatagggagaccc

SEQ ID NO: 7447958 - DNA, 22 bp, Homo sapiens
cctgggcaacatagggagaccc

SEQ ID NO: 7447959 - DNA, 22 bp, Homo sapiens
cctgggcaacatagggagaccc

SEQ ID NO: 7447960 - DNA, 22 bp, Homo sapiens
cctgggcaaattatgttactca

SEQ ID NO: 7447961 - DNA, 22 bp, Homo sapiens
cctgggatttcctgagcactct

SEQ ID NO: 7447962 - DNA, 22 bp, Homo sapiens
cctgggatttgcgccagacctt

SEQ ID NO: 7447963 - DNA, 22 bp, Homo sapiens
cctgggcaaatgccagagacaa

SEQ ID NO: 7447964 - DNA, 22 bp, Homo sapiens
cctgggcaaatgccagagacaa

SEQ ID NO: 7447965 - DNA, 22 bp, Homo sapiens
cctgggcaaatgccagagacaa

SEQ ID NO: 7447966 - DNA, 22 bp, Homo sapiens
cctgggcaaatgccagagacaa

SEQ ID NO: 7447967 - DNA, 22 bp, Homo sapiens
cctgggcaatatagtgaggccc

SEQ ID NO: 7447968 - DNA, 22 bp, Homo sapiens
cctgggcaatatagtgaggccc

SEQ ID NO: 7447969 - DNA, 22 bp, Homo sapiens
cctgggcaatatagtgaggccc

SEQ ID NO: 7447970 - DNA, 22 bp, Homo sapiens
cctgggcaatatagtgaggccc

SEQ ID NO: 7447971 - DNA, 22 bp, Homo sapiens
tgtgggtgatgaatttgttctt

SEQ ID NO: 7447972 - DNA, 22 bp, Homo sapiens
cctgggcaatatagtgaggccc

SEQ ID NO: 7447973 - DNA, 22 bp, Homo sapiens
tgtgggtcctcctgtgtgcccg

SEQ ID NO: 7447974 - DNA, 22 bp, Homo sapiens
tgtgggtcctcctgtgtgcccg

SEQ ID NO: 7447975 - DNA, 22 bp, Homo sapiens
tgtgtataaaagcagtgcagga

SEQ ID NO: 7447976 - DNA, 22 bp, Homo sapiens
tgtgtataaaagcagtgcagga

SEQ ID NO: 7447977 - DNA, 22 bp, Homo sapiens
tgtgggtgatgaatttgttctt

SEQ ID NO: 7447978 - DNA, 22 bp, Homo sapiens
tgtgggtgctcagagtaccccc

SEQ ID NO: 7447979 - DNA, 22 bp, Homo sapiens
tgtgggtgatgaatttgttctt

SEQ ID NO: 7447980 - DNA, 22 bp, Homo sapiens
tgtgggtcctcctgtgtgcccg

SEQ ID NO: 7447981 - DNA, 20 bp, Homo sapiens
tgtgtataaatatatgtttc

SEQ ID NO: 7447982 - DNA, 22 bp, Homo sapiens
tgtgtataactcttaattcatt

SEQ ID NO: 7447983 - DNA, 22 bp, Homo sapiens
tgtgtataaacaagagtctgtg

SEQ ID NO: 7447984 - DNA, 22 bp, Homo sapiens
tgtgtatacatacatacacacg

SEQ ID NO: 7447985 - DNA, 22 bp, Homo sapiens
tgtgtatacgagtatgaatatg

SEQ ID NO: 7447986 - DNA, 22 bp, Homo sapiens
tgtgtatacatacatacacacg

SEQ ID NO: 7447987 - DNA, 22 bp, Homo sapiens
tgtgtatacaacttataggagc

SEQ ID NO: 7447988 - DNA, 22 bp, Homo sapiens
tgtgtataagtgagaatgctgt

SEQ ID NO: 7447989 - DNA, 22 bp, Homo sapiens
tgtgtataattagaccatttac

SEQ ID NO: 7447990 - DNA, 22 bp, Homo sapiens
tgtgtataattagaccatttac

SEQ ID NO: 7447991 - DNA, 22 bp, Homo sapiens
tgtgtatatatgtgcacatgta

SEQ ID NO: 7447992 - DNA, 22 bp, Homo sapiens
tgtgtatagcagtttccagtct

SEQ ID NO: 7447993 - DNA, 22 bp, Homo sapiens
tgtgtataggttgtgctaatag

SEQ ID NO: 7447994 - DNA, 22 bp, Homo sapiens
tgtgtatagaaagtaggaaagg

SEQ ID NO: 7447995 - DNA, 22 bp, Homo sapiens
tgtgtatagatgcatgcatata

SEQ ID NO: 7447996 - DNA, 22 bp, Homo sapiens
tgtgtatagatgcatgcatata

SEQ ID NO: 7447997 - DNA, 22 bp, Homo sapiens
tgtgtatagatgcatgcatata

SEQ ID NO: 7447998 - DNA, 22 bp, Homo sapiens
cctggtggcttctgggtggacg

SEQ ID NO: 7447999 - DNA, 22 bp, Homo sapiens
cctggtggcgaatggtggtagg

SEQ ID NO: 7448000 - DNA, 22 bp, Homo sapiens
cctggtggcgaatggtggtagg

SEQ ID NO: 7448001 - DNA, 22 bp, Homo sapiens
cctggtggcgaatggtggtagg

SEQ ID NO: 7448002 - DNA, 22 bp, Homo sapiens
cctggtggcgaatggtggtagg

SEQ ID NO: 7448003 - DNA, 22 bp, Homo sapiens
cctggtggagaggggcggagcg

SEQ ID NO: 7448004 - DNA, 22 bp, Homo sapiens
cctggtggagaggggcggagcg

SEQ ID NO: 7448005 - DNA, 22 bp, Homo sapiens
cctggtggagaggggcggagcg

SEQ ID NO: 7448006 - DNA, 22 bp, Homo sapiens
cctggtggccttcagcccacaa

SEQ ID NO: 7448007 - DNA, 22 bp, Homo sapiens
cctggtggccttcagcccacaa

SEQ ID NO: 7448008 - DNA, 22 bp, Homo sapiens
cctggtggccttcagcccacaa

SEQ ID NO: 7448009 - DNA, 22 bp, Homo sapiens
cctggtggccttcagcccacaa

SEQ ID NO: 7448010 - DNA, 22 bp, Homo sapiens
cctggtgggcaggagtgagacc

SEQ ID NO: 7448011 - DNA, 22 bp, Homo sapiens
cctggtgggcaggagtgagacc

SEQ ID NO: 7448012 - DNA, 22 bp, Homo sapiens
cctggtgggcaggagtgagacc

SEQ ID NO: 7448013 - DNA, 22 bp, Homo sapiens
cctggtgggcaggagtgagacc

SEQ ID NO: 7448014 - DNA, 22 bp, Homo sapiens
cctggtgggcaggagtgagacc

SEQ ID NO: 7448015 - DNA, 22 bp, Homo sapiens
cctggtggcttctgggtggacg

SEQ ID NO: 7448016 - DNA, 22 bp, Homo sapiens
cctggtggcttctgggtggacg

SEQ ID NO: 7448017 - DNA, 22 bp, Homo sapiens
cctggtggcttctgggtggacg

SEQ ID NO: 7448018 - DNA, 22 bp, Homo sapiens
cctggtggcttctgggtggacg

SEQ ID NO: 7448019 - DNA, 22 bp, Homo sapiens
cctggtggcttctgggtggacg

SEQ ID NO: 7448020 - DNA, 22 bp, Homo sapiens
cctggtggagaggggcggagcg

SEQ ID NO: 7448021 - DNA, 22 bp, Homo sapiens
cctggtggacagcagccagcag

SEQ ID NO: 7448022 - DNA, 22 bp, Homo sapiens
cctggtggacagcagccagcag

SEQ ID NO: 7448023 - DNA, 22 bp, Homo sapiens
cctggtggacagcagccagcag

SEQ ID NO: 7448024 - DNA, 22 bp, Homo sapiens
cctggtggagaggggcggagcg

SEQ ID NO: 7448025 - DNA, 22 bp, Homo sapiens
cctggtggagaggggcggagcg

SEQ ID NO: 7448026 - DNA, 22 bp, Homo sapiens
cctggtggagaggggcggagcg

SEQ ID NO: 7448027 - DNA, 22 bp, Homo sapiens
cctggtggacagcagccagcag

SEQ ID NO: 7448028 - DNA, 22 bp, Homo sapiens
cctggtggaaggtgagtgaggc

SEQ ID NO: 7448029 - DNA, 22 bp, Homo sapiens
cctggtggaaggtgagtgaggc

SEQ ID NO: 7448030 - DNA, 22 bp, Homo sapiens
cctggtggaaggtgagtgaggc

SEQ ID NO: 7448031 - DNA, 22 bp, Homo sapiens
cctggtggaaggtgagtgaggc

SEQ ID NO: 7448032 - DNA, 22 bp, Homo sapiens
cctggtggaaggtgagtgaggc

SEQ ID NO: 7448033 - DNA, 22 bp, Homo sapiens
cctggtggaaggtgagtgaggc

SEQ ID NO: 7448034 - DNA, 22 bp, Homo sapiens
cctgggtgtcatgggcagctgg

SEQ ID NO: 7448035 - DNA, 22 bp, Homo sapiens
cctgggtgtcatgggcagctgg

SEQ ID NO: 7448036 - DNA, 22 bp, Homo sapiens
cctgggtgtcatgggcagctgg

SEQ ID NO: 7448037 - DNA, 22 bp, Homo sapiens
cctgggtgtcatgggcagctgg

SEQ ID NO: 7448038 - DNA, 22 bp, Homo sapiens
cctgggtgtcatgggcagctgg

SEQ ID NO: 7448039 - DNA, 22 bp, Homo sapiens
cctgggtgtcatgggcagctgg

SEQ ID NO: 7448040 - DNA, 22 bp, Homo sapiens
cctggtgcttaccagagctttt

SEQ ID NO: 7448041 - DNA, 22 bp, Homo sapiens
cctgggtgtcatgggcagctgg

SEQ ID NO: 7448042 - DNA, 22 bp, Homo sapiens
cctggttcagtctttctatgct

SEQ ID NO: 7448043 - DNA, 21 bp, Homo sapiens
cctggttcaagtgatgcccct

SEQ ID NO: 7448044 - DNA, 22 bp, Homo sapiens
cctggtgtctgtttacagcagc

SEQ ID NO: 7448045 - DNA, 22 bp, Homo sapiens
cctggtgtctgtttacagcagc

SEQ ID NO: 7448046 - DNA, 22 bp, Homo sapiens
cctggtgtggccctgtgacatg

SEQ ID NO: 7448047 - DNA, 22 bp, Homo sapiens
cctggtgtggctgtcacagagg

SEQ ID NO: 7448048 - DNA, 22 bp, Homo sapiens
cctggtttatgccagatcctgt

SEQ ID NO: 7448049 - DNA, 22 bp, Homo sapiens
cctggtttaatgctcactgttg

SEQ ID NO: 7448050 - DNA, 22 bp, Homo sapiens
cctggtttaatgctcactgttg

SEQ ID NO: 7448051 - DNA, 22 bp, Homo sapiens
cctggtttatgccagatcctgt

SEQ ID NO: 7448052 - DNA, 22 bp, Homo sapiens
cctggtttcaggaacataatct

SEQ ID NO: 7448053 - DNA, 22 bp, Homo sapiens
cctggttgagggaggtgtggac

SEQ ID NO: 7448054 - DNA, 22 bp, Homo sapiens
cctggttgtgagttgagttgag

SEQ ID NO: 7448055 - DNA, 22 bp, Homo sapiens
tgtttacttaaatgttttcata

SEQ ID NO: 7448056 - DNA, 22 bp, Homo sapiens
tgtttacttaaatgttttcata

SEQ ID NO: 7448057 - DNA, 22 bp, Homo sapiens
tgtttacttaaatgttttcata

SEQ ID NO: 7448058 - DNA, 22 bp, Homo sapiens
tgtttactggctcctgtggttc

SEQ ID NO: 7448059 - DNA, 22 bp, Homo sapiens
tgtttactggctcctgtggttc

SEQ ID NO: 7448060 - DNA, 22 bp, Homo sapiens
cctggtttcaggaacataatct

SEQ ID NO: 7448061 - DNA, 22 bp, Homo sapiens
cctggtttcaggaacataatct

SEQ ID NO: 7448062 - DNA, 22 bp, Homo sapiens
cctggtttctccatgtctcatt

SEQ ID NO: 7448063 - DNA, 22 bp, Homo sapiens
cctggtttgggtgccagtgagt

SEQ ID NO: 7448064 - DNA, 22 bp, Homo sapiens
tgtttacttgaggtggaaacaa

SEQ ID NO: 7448065 - DNA, 22 bp, Homo sapiens
tgtttacttgaggtggaaacaa

SEQ ID NO: 7448066 - DNA, 22 bp, Homo sapiens
tgtttacttgaggtggaaacaa

SEQ ID NO: 7448067 - DNA, 22 bp, Homo sapiens
tgtttacttcatcgagtacttc

SEQ ID NO: 7448068 - DNA, 22 bp, Homo sapiens
tgtttacttctttccatggctt

SEQ ID NO: 7448069 - DNA, 22 bp, Homo sapiens
tgtttacttctttccatggctt

SEQ ID NO: 7448070 - DNA, 22 bp, Homo sapiens
tgtttacttcatcgagtacttc

SEQ ID NO: 7448071 - DNA, 22 bp, Homo sapiens
tgtttacttcatcgagtacttc

SEQ ID NO: 7448072 - DNA, 22 bp, Homo sapiens
tgtttacttcatcgagtacttc

SEQ ID NO: 7448073 - DNA, 22 bp, Homo sapiens
tgtttacttatgtgggtcacat

SEQ ID NO: 7448074 - DNA, 22 bp, Homo sapiens
tgtttacttaaatgttttcata

SEQ ID NO: 7448075 - DNA, 22 bp, Homo sapiens
tgtttacttatgtgggtcacat

SEQ ID NO: 7448076 - DNA, 22 bp, Homo sapiens
tgttccagaggcagagatagga

SEQ ID NO: 7448077 - DNA, 22 bp, Homo sapiens
tgttccagaggcagagatagga

SEQ ID NO: 7448078 - DNA, 20 bp, Homo sapiens
tgttccaaggagttgagggg

SEQ ID NO: 7448079 - DNA, 18 bp, Homo sapiens
tgttccaaggaaggaatc

SEQ ID NO: 7448080 - DNA, 23 bp, Homo sapiens
tgttccagatacgccttttcctc

SEQ ID NO: 7448081 - DNA, 23 bp, Homo sapiens
tgttccagatacgccttttcctc

SEQ ID NO: 7448082 - DNA, 23 bp, Homo sapiens
tgttccagatacgccttttcctc

SEQ ID NO: 7448083 - DNA, 23 bp, Homo sapiens
tgttccagatacgccttttcctc

SEQ ID NO: 7448084 - DNA, 22 bp, Homo sapiens
tgttccagattcggcgtgggac

SEQ ID NO: 7448085 - DNA, 22 bp, Homo sapiens
tgttccagattcggcgtgggac

SEQ ID NO: 7448086 - DNA, 22 bp, Homo sapiens
tgttccagattcggcgtgggac

SEQ ID NO: 7448087 - DNA, 22 bp, Homo sapiens
tgttccagatttagccaaccga

SEQ ID NO: 7448088 - DNA, 23 bp, Homo sapiens
tgttccagatacgccttttcctc

SEQ ID NO: 7448089 - DNA, 22 bp, Homo sapiens
tgttccatcagtttttggttga

SEQ ID NO: 7448090 - DNA, 22 bp, Homo sapiens
tgttccataagtggtgctttgt

SEQ ID NO: 7448091 - DNA, 22 bp, Homo sapiens
tgttccagggcgcgaaggtggt

SEQ ID NO: 7448092 - DNA, 22 bp, Homo sapiens
tgttccagatttagccaaccga

SEQ ID NO: 7448093 - DNA, 20 bp, Homo sapiens
tgttccaggaggccagggct

SEQ ID NO: 7448094 - DNA, 20 bp, Homo sapiens
tgttccaggaggccagggct

SEQ ID NO: 7448095 - DNA, 20 bp, Homo sapiens
tgttccaggaggccagggct

SEQ ID NO: 7448096 - DNA, 22 bp, Homo sapiens
tgttccagggcgcgaaggtggt

SEQ ID NO: 7448097 - DNA, 22 bp, Homo sapiens
tgttcattttgaagtacttcaa

SEQ ID NO: 7448098 - DNA, 22 bp, Homo sapiens
tgttcattttgaagtacttcaa

SEQ ID NO: 7448099 - DNA, 22 bp, Homo sapiens
tgttcattctgtgacctggttc

SEQ ID NO: 7448100 - DNA, 22 bp, Homo sapiens
tgttcattctgtatatgctgta

SEQ ID NO: 7448101 - DNA, 22 bp, Homo sapiens
tgttcatttgcaacaaccaaat

SEQ ID NO: 7448102 - DNA, 22 bp, Homo sapiens
tgttcattcgctattgtctatg

SEQ ID NO: 7448103 - DNA, 22 bp, Homo sapiens
tgttcattcaacatgtcatcta

SEQ ID NO: 7448104 - DNA, 22 bp, Homo sapiens
tgttcattcaacatgtcatcta

SEQ ID NO: 7448105 - DNA, 22 bp, Homo sapiens
tgttcattattcttcatctgcc

SEQ ID NO: 7448106 - DNA, 22 bp, Homo sapiens
tgttcattagtggaagtaagtt

SEQ ID NO: 7448107 - DNA, 22 bp, Homo sapiens
tgttcattattcttcatctgcc

SEQ ID NO: 7448108 - DNA, 22 bp, Homo sapiens
tgttacaatattatcaactgag

SEQ ID NO: 7448109 - DNA, 22 bp, Homo sapiens
tgttacacagcagaatagcaag

SEQ ID NO: 7448110 - DNA, 22 bp, Homo sapiens
tgttacaatattatcaactgag

SEQ ID NO: 7448111 - DNA, 22 bp, Homo sapiens
tgttacagaaatattgcttctt

SEQ ID NO: 7448112 - DNA, 22 bp, Homo sapiens
tgttacagaaagtttatgaatg

SEQ ID NO: 7448113 - DNA, 22 bp, Homo sapiens
tgttacagaaatattgcttctt

SEQ ID NO: 7448114 - DNA, 22 bp, Homo sapiens
tgttacagaatgaatttccgga

SEQ ID NO: 7448115 - DNA, 22 bp, Homo sapiens
tgttacagaatgaatttccgga

SEQ ID NO: 7448116 - DNA, 22 bp, Homo sapiens
tgttacagaaagtttatgaatg

SEQ ID NO: 7448117 - DNA, 22 bp, Homo sapiens
tgttacacagcagaatagcaag

SEQ ID NO: 7448118 - DNA, 22 bp, Homo sapiens
tgttacagcagaattgaaagag

SEQ ID NO: 7448119 - DNA, 22 bp, Homo sapiens
tgttacagcagaattgaaagag

SEQ ID NO: 7448120 - DNA, 22 bp, Homo sapiens
tgttacagggataaatgaggta

SEQ ID NO: 7448121 - DNA, 22 bp, Homo sapiens
tgttacagggataaatgaggta

SEQ ID NO: 7448122 - DNA, 22 bp, Homo sapiens
tgttacaggaaatagaattacc

SEQ ID NO: 7448123 - DNA, 22 bp, Homo sapiens
tgttacagtactacaattctgc

SEQ ID NO: 7448124 - DNA, 22 bp, Homo sapiens
tgttacagtactacaattctgc

SEQ ID NO: 7448125 - DNA, 22 bp, Homo sapiens
tgttacagtactacaattctgc

SEQ ID NO: 7448126 - DNA, 22 bp, Homo sapiens
tgttacagtactacaattctgc

SEQ ID NO: 7448127 - DNA, 22 bp, Homo sapiens
tgttacagtactacaattctgc

SEQ ID NO: 7448128 - DNA, 22 bp, Homo sapiens
tgttacagtcattgttttctga

SEQ ID NO: 7448129 - DNA, 22 bp, Homo sapiens
tgttacagtcattgttttctga

SEQ ID NO: 7448130 - DNA, 21 bp, Homo sapiens
tgttacagtccaaatgtttgt

SEQ ID NO: 7448131 - DNA, 22 bp, Homo sapiens
tgttcattactgctgtttgcca

SEQ ID NO: 7448132 - DNA, 22 bp, Homo sapiens
tgttcatctggcaggcatagcc

SEQ ID NO: 7448133 - DNA, 22 bp, Homo sapiens
tgttcatatcattttgaaagct

SEQ ID NO: 7448134 - DNA, 22 bp, Homo sapiens
tgttcatatcattttgaaagct

SEQ ID NO: 7448135 - DNA, 22 bp, Homo sapiens
tgttcagtttgctatcataatc

SEQ ID NO: 7448136 - DNA, 22 bp, Homo sapiens
tgttcagtttgctatcataatc

SEQ ID NO: 7448137 - DNA, 22 bp, Homo sapiens
tgttcagtttgctatcataatc

SEQ ID NO: 7448138 - DNA, 22 bp, Homo sapiens
tgttcatagctatcattgtgtc

SEQ ID NO: 7448139 - DNA, 22 bp, Homo sapiens
tgttcatagctatcattgtgtc

SEQ ID NO: 7448140 - DNA, 22 bp, Homo sapiens
tgttcagttaacacagacacca

SEQ ID NO: 7448141 - DNA, 19 bp, Homo sapiens
tgttcagatatgtcagctt

SEQ ID NO: 7448142 - DNA, 19 bp, Homo sapiens
tgttcagatatgtcagctt

SEQ ID NO: 7448143 - DNA, 22 bp, Homo sapiens
tgttcagagacagaaattctaa

SEQ ID NO: 7448144 - DNA, 22 bp, Homo sapiens
tgttcagagacagaaattctaa

SEQ ID NO: 7448145 - DNA, 22 bp, Homo sapiens
tgttcagagacagaaattctaa

SEQ ID NO: 7448146 - DNA, 21 bp, Homo sapiens
tgttcagaccaacttggactg

SEQ ID NO: 7448147 - DNA, 21 bp, Homo sapiens
tgttacagtccaaatgtttgt

SEQ ID NO: 7448148 - DNA, 22 bp, Homo sapiens
tgttacagtgactaatgtttta

SEQ ID NO: 7448149 - DNA, 22 bp, Homo sapiens
tgttacagtgactaatgtttta

SEQ ID NO: 7448150 - DNA, 22 bp, Homo sapiens
tgtgtctggataggtaatggat

SEQ ID NO: 7448151 - DNA, 22 bp, Homo sapiens
tgtgtctggataggtaatggat

SEQ ID NO: 7448152 - DNA, 22 bp, Homo sapiens
tgtgtctggaccggggaggagc

SEQ ID NO: 7448153 - DNA, 22 bp, Homo sapiens
tgtgtctggaccggggaggagc

SEQ ID NO: 7448154 - DNA, 22 bp, Homo sapiens
tgtgtctggataggtaatggat

SEQ ID NO: 7448155 - DNA, 22 bp, Homo sapiens
tgtgtctggaccggggaggagc

SEQ ID NO: 7448156 - DNA, 22 bp, Homo sapiens
tgtgtctgcccttagtacatct

SEQ ID NO: 7448157 - DNA, 22 bp, Homo sapiens
tgtgtctgcccttagtacatct

SEQ ID NO: 7448158 - DNA, 22 bp, Homo sapiens
tgtgtctgcccttagtacatct

SEQ ID NO: 7448159 - DNA, 22 bp, Homo sapiens
cctgggctctatcctgacccag

SEQ ID NO: 7448160 - DNA, 22 bp, Homo sapiens
cctgggctctatcctgacccag

SEQ ID NO: 7448161 - DNA, 22 bp, Homo sapiens
cctgggctctatcctgacccag

SEQ ID NO: 7448162 - DNA, 22 bp, Homo sapiens
cctgggctctatcctgacccag

SEQ ID NO: 7448163 - DNA, 22 bp, Homo sapiens
cctgggctctatcctgacccag

SEQ ID NO: 7448164 - DNA, 22 bp, Homo sapiens
cctgggctcaagtgatcctcct

SEQ ID NO: 7448165 - DNA, 22 bp, Homo sapiens
tgtgtctggataggtaatggat

SEQ ID NO: 7448166 - DNA, 22 bp, Homo sapiens
cctgggctcaagtgatcctcct

SEQ ID NO: 7448167 - DNA, 22 bp, Homo sapiens
cctgggctcaagtgatcctcct

SEQ ID NO: 7448168 - DNA, 22 bp, Homo sapiens
cctgggctctatcctgacccag

SEQ ID NO: 7448169 - DNA, 22 bp, Homo sapiens
cctgggctctatcctgacccag

SEQ ID NO: 7448170 - DNA, 22 bp, Homo sapiens
cctgggctctatcctgacccag

SEQ ID NO: 7448171 - DNA, 22 bp, Homo sapiens
cctgggctctgaggagggagtc

SEQ ID NO: 7448172 - DNA, 22 bp, Homo sapiens
cctgggctctgaggagggagtc

SEQ ID NO: 7448173 - DNA, 22 bp, Homo sapiens
cctgggctctgaggagggagtc

SEQ ID NO: 7448174 - DNA, 22 bp, Homo sapiens
cctgggctctgaggagggagtc

SEQ ID NO: 7448175 - DNA, 22 bp, Homo sapiens
cctgggctctgaggagggagtc

SEQ ID NO: 7448176 - DNA, 22 bp, Homo sapiens
cctgggctctgaggagggagtc

SEQ ID NO: 7448177 - DNA, 22 bp, Homo sapiens
cctgggctctgaggagggagtc

SEQ ID NO: 7448178 - DNA, 22 bp, Homo sapiens
cctgggctctgaggagggagtc

SEQ ID NO: 7448179 - DNA, 22 bp, Homo sapiens
cctgggctctgaggagggagtc

SEQ ID NO: 7448180 - DNA, 22 bp, Homo sapiens
cctgggctctgtcagaattggg

SEQ ID NO: 7448181 - DNA, 22 bp, Homo sapiens
cctgggctctgaggagggagtc

SEQ ID NO: 7448182 - DNA, 22 bp, Homo sapiens
cctgggctctgaggagggagtc

SEQ ID NO: 7448183 - DNA, 22 bp, Homo sapiens
cctgggctctgaggagggagtc

SEQ ID NO: 7448184 - DNA, 22 bp, Homo sapiens
cctgggctctgaggagggagtc

SEQ ID NO: 7448185 - DNA, 22 bp, Homo sapiens
cctgggctgcatgatggcattt

SEQ ID NO: 7448186 - DNA, 22 bp, Homo sapiens
cctgggctgcatgatggcattt

SEQ ID NO: 7448187 - DNA, 22 bp, Homo sapiens
cctgggctgcatgatggcattt

SEQ ID NO: 7448188 - DNA, 22 bp, Homo sapiens
cctgggctgcatgatggcattt

SEQ ID NO: 7448189 - DNA, 22 bp, Homo sapiens
cctgggctgaagtcaagtgtgg

SEQ ID NO: 7448190 - DNA, 22 bp, Homo sapiens
cctgggctgcatgatggcattt

SEQ ID NO: 7448191 - DNA, 22 bp, Homo sapiens
cctgggctgcatgatggcattt

SEQ ID NO: 7448192 - DNA, 22 bp, Homo sapiens
cctgggctgcatgatggcattt

SEQ ID NO: 7448193 - DNA, 22 bp, Homo sapiens
cctgggctgaagtcaagtgtgg

SEQ ID NO: 7448194 - DNA, 22 bp, Homo sapiens
cctgggctctgtcagaattggg

SEQ ID NO: 7448195 - DNA, 22 bp, Homo sapiens
cctgggctctgtcagaattggg

SEQ ID NO: 7448196 - DNA, 16 bp, Homo sapiens
cctgggctctgttgga

SEQ ID NO: 7448197 - DNA, 16 bp, Homo sapiens
cctgggctctgttgga

SEQ ID NO: 7448198 - DNA, 22 bp, Homo sapiens
cctgggctgaagtcaagtgtgg

SEQ ID NO: 7448199 - DNA, 22 bp, Homo sapiens
cctgggctgaagtcaagtgtgg

SEQ ID NO: 7448200 - DNA, 22 bp, Homo sapiens
cctgggctgaagtcaagtgtgg

SEQ ID NO: 7448201 - DNA, 22 bp, Homo sapiens
cctgggctgaagtcaagtgtgg

SEQ ID NO: 7448202 - DNA, 16 bp, Homo sapiens
cctgggctctgttgga

SEQ ID NO: 7448203 - DNA, 22 bp, Homo sapiens
cctgggctggagtacagcagtg

SEQ ID NO: 7448204 - DNA, 22 bp, Homo sapiens
cctgggctggagtacagcagtg

SEQ ID NO: 7448205 - DNA, 22 bp, Homo sapiens
cctgggctggagtacagcagtg

SEQ ID NO: 7448206 - DNA, 22 bp, Homo sapiens
cctgggctggagtacagcagtg

SEQ ID NO: 7448207 - DNA, 22 bp, Homo sapiens
cctgggctggagtacagcagtg

SEQ ID NO: 7448208 - DNA, 22 bp, Homo sapiens
cctgggctggagtacagcagtg

SEQ ID NO: 7448209 - DNA, 22 bp, Homo sapiens
cctgggctggagtacagcagtg

SEQ ID NO: 7448210 - DNA, 22 bp, Homo sapiens
cctgggctgctcatggggatga

SEQ ID NO: 7448211 - DNA, 22 bp, Homo sapiens
cctgggctgctcatggggatga

SEQ ID NO: 7448212 - DNA, 22 bp, Homo sapiens
cctgggctgctcatggggatga

SEQ ID NO: 7448213 - DNA, 22 bp, Homo sapiens
cctgggctgctcatggggatga

SEQ ID NO: 7448214 - DNA, 22 bp, Homo sapiens
cctgggctgcatgatggcattt

SEQ ID NO: 7448215 - DNA, 22 bp, Homo sapiens
cctgggctggagtacagcagtg

SEQ ID NO: 7448216 - DNA, 22 bp, Homo sapiens
cctgggctgctcatggggatga

SEQ ID NO: 7448217 - DNA, 22 bp, Homo sapiens
cctgggctgctcatggggatga

SEQ ID NO: 7448218 - DNA, 22 bp, Homo sapiens
cctgggctgctcatggggatga

SEQ ID NO: 7448219 - DNA, 22 bp, Homo sapiens
tgtgttctcctacagataagga

SEQ ID NO: 7448220 - DNA, 22 bp, Homo sapiens
cctgggcttccacgagcagagg

SEQ ID NO: 7448221 - DNA, 22 bp, Homo sapiens
cctgggcttccacgagcagagg

SEQ ID NO: 7448222 - DNA, 22 bp, Homo sapiens
cctgggcttccacgagcagagg

SEQ ID NO: 7448223 - DNA, 22 bp, Homo sapiens
cctgggcttccacgagcagagg

SEQ ID NO: 7448224 - DNA, 22 bp, Homo sapiens
cctgggcttccacgagcagagg

SEQ ID NO: 7448225 - DNA, 22 bp, Homo sapiens
cctgggcttccacgagcagagg

SEQ ID NO: 7448226 - DNA, 22 bp, Homo sapiens
cctgggcttacgacctctgact

SEQ ID NO: 7448227 - DNA, 22 bp, Homo sapiens
cctgggcttccacgagcagagg

SEQ ID NO: 7448228 - DNA, 22 bp, Homo sapiens
cctgggcttacgacctctgact

SEQ ID NO: 7448229 - DNA, 22 bp, Homo sapiens
cctgggcttacgacctctgact

SEQ ID NO: 7448230 - DNA, 22 bp, Homo sapiens
cctgggcttacgacctctgact

SEQ ID NO: 7448231 - DNA, 22 bp, Homo sapiens
cctgggctgttgcatcatcctt

SEQ ID NO: 7448232 - DNA, 22 bp, Homo sapiens
cctgggctgttgcatcatcctt

SEQ ID NO: 7448233 - DNA, 22 bp, Homo sapiens
cctgggctgttgcatcatcctt

SEQ ID NO: 7448234 - DNA, 22 bp, Homo sapiens
cctgggcttacgacctctgact

SEQ ID NO: 7448235 - DNA, 22 bp, Homo sapiens
cctgggctgttgcatcatcctt

SEQ ID NO: 7448236 - DNA, 22 bp, Homo sapiens
cctgggcttacgacctctgact

SEQ ID NO: 7448237 - DNA, 22 bp, Homo sapiens
cctgggcttacgacctctgact

SEQ ID NO: 7448238 - DNA, 22 bp, Homo sapiens
cctgggcttacgacctctgact

SEQ ID NO: 7448239 - DNA, 22 bp, Homo sapiens
cctgggcttacgacctctgact

SEQ ID NO: 7448240 - DNA, 22 bp, Homo sapiens
cctgggctgtacctgtgcgcgg

SEQ ID NO: 7448241 - DNA, 22 bp, Homo sapiens
cctgggctgggcgtctcatggg

SEQ ID NO: 7448242 - DNA, 22 bp, Homo sapiens
cctgggctgggcgtctcatggg

SEQ ID NO: 7448243 - DNA, 22 bp, Homo sapiens
cctgggctgggcgtctcatggg

SEQ ID NO: 7448244 - DNA, 22 bp, Homo sapiens
cctgggctgggcgtctcatggg

SEQ ID NO: 7448245 - DNA, 22 bp, Homo sapiens
cctgggctgggcgtctcatggg

SEQ ID NO: 7448246 - DNA, 22 bp, Homo sapiens
cctgggctgggcgtctcatggg

SEQ ID NO: 7448247 - DNA, 22 bp, Homo sapiens
cctgggctgggcgtctcatggg

SEQ ID NO: 7448248 - DNA, 22 bp, Homo sapiens
cctgggctgggcgtctcatggg

SEQ ID NO: 7448249 - DNA, 22 bp, Homo sapiens
cctgggctgtacctgtgcgcgg

SEQ ID NO: 7448250 - DNA, 22 bp, Homo sapiens
cctgggctgtacctgtgcgcgg

SEQ ID NO: 7448251 - DNA, 22 bp, Homo sapiens
cctgggctgtacctgtgcgcgg

SEQ ID NO: 7448252 - DNA, 22 bp, Homo sapiens
cctgggctgttgcatcatcctt

SEQ ID NO: 7448253 - DNA, 22 bp, Homo sapiens
cctgggctgttgcatcatcctt

SEQ ID NO: 7448254 - DNA, 21 bp, Homo sapiens
cctgggctgtggtttggagac

SEQ ID NO: 7448255 - DNA, 21 bp, Homo sapiens
cctgggctgtggtttggagac

SEQ ID NO: 7448256 - DNA, 21 bp, Homo sapiens
cctgggctgtggtttggagac

SEQ ID NO: 7448257 - DNA, 21 bp, Homo sapiens
cctgggctgtggtttggagac

SEQ ID NO: 7448258 - DNA, 22 bp, Homo sapiens
tgtgttctgaaggagaagagtg

SEQ ID NO: 7448259 - DNA, 22 bp, Homo sapiens
tgtgttctgaaggagaagagtg

SEQ ID NO: 7448260 - DNA, 18 bp, Homo sapiens
tgttaaggatccagtagt

SEQ ID NO: 7448261 - DNA, 22 bp, Homo sapiens
tgtgttctgaaggagaagagtg

SEQ ID NO: 7448262 - DNA, 22 bp, Homo sapiens
tgtgttctcctacagataagga

SEQ ID NO: 7448263 - DNA, 22 bp, Homo sapiens
tgttaagggtaaacagcagtaa

SEQ ID NO: 7448264 - DNA, 22 bp, Homo sapiens
tgttaaggtcctgacttctgca

SEQ ID NO: 7448265 - DNA, 22 bp, Homo sapiens
tgttaaggggatatagcagggc

SEQ ID NO: 7448266 - DNA, 22 bp, Homo sapiens
tgttaagttgccagtgtatgac

SEQ ID NO: 7448267 - DNA, 22 bp, Homo sapiens
tgttaatatactaaaatccact

SEQ ID NO: 7448268 - DNA, 23 bp, Homo sapiens
tgttaatacatctgccactcatt

SEQ ID NO: 7448269 - DNA, 23 bp, Homo sapiens
tgttaatacatctgccactcatt

SEQ ID NO: 7448270 - DNA, 23 bp, Homo sapiens
tgttaatacatctgccactcatt

SEQ ID NO: 7448271 - DNA, 22 bp, Homo sapiens
tgttaatatactaaaatccact

SEQ ID NO: 7448272 - DNA, 22 bp, Homo sapiens
tgttaatatactaaaatccact

SEQ ID NO: 7448273 - DNA, 22 bp, Homo sapiens
tgttaatatactaaaatccact

SEQ ID NO: 7448274 - DNA, 22 bp, Homo sapiens
tgttaatcaatcaacagtatta

SEQ ID NO: 7448275 - DNA, 22 bp, Homo sapiens
tgttaatatactaaaatccact

SEQ ID NO: 7448276 - DNA, 22 bp, Homo sapiens
tgttaatatactaaaatccact

SEQ ID NO: 7448277 - DNA, 22 bp, Homo sapiens
tgttacaaactgttgtttctat

SEQ ID NO: 7448278 - DNA, 22 bp, Homo sapiens
tgttacaaactgttgtttctat

SEQ ID NO: 7448279 - DNA, 22 bp, Homo sapiens
tgttacaaactgttgtttctat

SEQ ID NO: 7448280 - DNA, 22 bp, Homo sapiens
tgttaatttctttagaagtgga

SEQ ID NO: 7448281 - DNA, 17 bp, Homo sapiens
tgttaattccaatgata

SEQ ID NO: 7448282 - DNA, 17 bp, Homo sapiens
tgttaattccaatgata

SEQ ID NO: 7448283 - DNA, 22 bp, Homo sapiens
tgttaatgtgctttgaaagact

SEQ ID NO: 7448284 - DNA, 22 bp, Homo sapiens
tgttaatggctgaagacatcct

SEQ ID NO: 7448285 - DNA, 22 bp, Homo sapiens
tgttaatggctgaagacatcct

SEQ ID NO: 7448286 - DNA, 22 bp, Homo sapiens
tgttaatggctgaagacatcct

SEQ ID NO: 7448287 - DNA, 22 bp, Homo sapiens
tgttaatcaatcaacagtatta

SEQ ID NO: 7448288 - DNA, 22 bp, Homo sapiens
tgttaatgctgtgctcctgtga

SEQ ID NO: 7448289 - DNA, 22 bp, Homo sapiens
tgttacaagtcttgaggtactt

SEQ ID NO: 7448290 - DNA, 22 bp, Homo sapiens
tgttacaagtcttgaggtactt

SEQ ID NO: 7448291 - DNA, 22 bp, Homo sapiens
tgttacaaggaagaatgtaggt

SEQ ID NO: 7448292 - DNA, 22 bp, Homo sapiens
tgttacaacagtaccgtgctgt

SEQ ID NO: 7448293 - DNA, 22 bp, Homo sapiens
tgttacaactatagatcccaag

SEQ ID NO: 7448294 - DNA, 22 bp, Homo sapiens
tgttacaactatagatcccaag

SEQ ID NO: 7448295 - DNA, 22 bp, Homo sapiens
tgttacaactatagatcccaag

SEQ ID NO: 7448296 - DNA, 22 bp, Homo sapiens
cctgtgtcttccccactggtgt

SEQ ID NO: 7448297 - DNA, 22 bp, Homo sapiens
cctgtgtcttccccactggtgt

SEQ ID NO: 7448298 - DNA, 22 bp, Homo sapiens
cctgtgtcttccccactggtgt

SEQ ID NO: 7448299 - DNA, 22 bp, Homo sapiens
cctgtgtctgaccatgcacatg

SEQ ID NO: 7448300 - DNA, 23 bp, Homo sapiens
cctgtgtctgttgctgaataatg

SEQ ID NO: 7448301 - DNA, 22 bp, Homo sapiens
cctgtgtcttccccactggtgt

SEQ ID NO: 7448302 - DNA, 22 bp, Homo sapiens
cctgtgtcttccccactggtgt

SEQ ID NO: 7448303 - DNA, 22 bp, Homo sapiens
cctgtgtccttggcagatatcc

SEQ ID NO: 7448304 - DNA, 22 bp, Homo sapiens
cctgtgtccttggcagatatcc

SEQ ID NO: 7448305 - DNA, 22 bp, Homo sapiens
cctgtgtccttggcagatatcc

SEQ ID NO: 7448306 - DNA, 22 bp, Homo sapiens
cctgtgtccttggcagatatcc

SEQ ID NO: 7448307 - DNA, 22 bp, Homo sapiens
cctgtgtctgaccatgcacatg

SEQ ID NO: 7448308 - DNA, 22 bp, Homo sapiens
cctgtgtctgaccatgcacatg

SEQ ID NO: 7448309 - DNA, 22 bp, Homo sapiens
cctgtgtcctaatccatcaggc

SEQ ID NO: 7448310 - DNA, 22 bp, Homo sapiens
cctgtgtcctcccactcagtcc

SEQ ID NO: 7448311 - DNA, 22 bp, Homo sapiens
cctgtgtccttggcagatatcc

SEQ ID NO: 7448312 - DNA, 22 bp, Homo sapiens
cctgtgtcctcccactcagtcc

SEQ ID NO: 7448313 - DNA, 22 bp, Homo sapiens
cctgtgtgattggaagctgaga

SEQ ID NO: 7448314 - DNA, 22 bp, Homo sapiens
cctgtgtgaaggttaggcaggt

SEQ ID NO: 7448315 - DNA, 22 bp, Homo sapiens
cctgtgtgcacacgaggccatg

SEQ ID NO: 7448316 - DNA, 22 bp, Homo sapiens
cctgtgtgcacacgaggccatg

SEQ ID NO: 7448317 - DNA, 22 bp, Homo sapiens
cctgtgtgcacacgaggccatg

SEQ ID NO: 7448318 - DNA, 22 bp, Homo sapiens
cctgtgtgcacacgaggccatg

SEQ ID NO: 7448319 - DNA, 22 bp, Homo sapiens
cctgtgtgctgatgacgacaga

SEQ ID NO: 7448320 - DNA, 22 bp, Homo sapiens
cctgtgtgctgatgacgacaga

SEQ ID NO: 7448321 - DNA, 22 bp, Homo sapiens
cctgtgtggaaaccgcatgacg

SEQ ID NO: 7448322 - DNA, 22 bp, Homo sapiens
cctgtgtgcctggccgcgggag

SEQ ID NO: 7448323 - DNA, 22 bp, Homo sapiens
cctgtgtgctgatgacgacaga

SEQ ID NO: 7448324 - DNA, 22 bp, Homo sapiens
cctgtgtgtctgtcactgcaca

SEQ ID NO: 7448325 - DNA, 22 bp, Homo sapiens
ccttcaggtcatatatgtcaga

SEQ ID NO: 7448326 - DNA, 22 bp, Homo sapiens
cctgtgtgtaggccaggggagt

SEQ ID NO: 7448327 - DNA, 21 bp, Homo sapiens
cctgtgtgtctgactgggcta

SEQ ID NO: 7448328 - DNA, 22 bp, Homo sapiens
cctgtgtgtaggccaggggagt

SEQ ID NO: 7448329 - DNA, 22 bp, Homo sapiens
cctgtgtgtaggccaggggagt

SEQ ID NO: 7448330 - DNA, 22 bp, Homo sapiens
cctgtgtgtaggccaggggagt

SEQ ID NO: 7448331 - DNA, 22 bp, Homo sapiens
cctgtgtggtagccagcggtgc

SEQ ID NO: 7448332 - DNA, 19 bp, Homo sapiens
cctgtgtggggtagagatc

SEQ ID NO: 7448333 - DNA, 22 bp, Homo sapiens
cctgtgtggtagccagcggtgc

SEQ ID NO: 7448334 - DNA, 20 bp, Homo sapiens
cctgtgtggtttgcactaca

SEQ ID NO: 7448335 - DNA, 20 bp, Homo sapiens
cctgtgtggtttgcactaca

SEQ ID NO: 7448336 - DNA, 20 bp, Homo sapiens
cctgtgtggtttgcactaca

SEQ ID NO: 7448337 - DNA, 22 bp, Homo sapiens
cctgtgtgtaggccaggggagt

SEQ ID NO: 7448338 - DNA, 22 bp, Homo sapiens
cctgtgtgtaggccaggggagt

SEQ ID NO: 7448339 - DNA, 22 bp, Homo sapiens
cctgtgtggccaggctggagtc

SEQ ID NO: 7448340 - DNA, 22 bp, Homo sapiens
cctgtgtggccaggctggagtc

SEQ ID NO: 7448341 - DNA, 20 bp, Homo sapiens
cctgtgtggccagctgaggc

SEQ ID NO: 7448342 - DNA, 20 bp, Homo sapiens
cctgtgtggccagctgaggc

SEQ ID NO: 7448343 - DNA, 20 bp, Homo sapiens
cctgtgtggccagctgaggc

SEQ ID NO: 7448344 - DNA, 20 bp, Homo sapiens
cctgtgtggccagctgaggc

SEQ ID NO: 7448345 - DNA, 22 bp, Homo sapiens
cctgtgtggaaggcaggaggcc

SEQ ID NO: 7448346 - DNA, 22 bp, Homo sapiens
cctgtgtggaaggcaggaggcc

SEQ ID NO: 7448347 - DNA, 22 bp, Homo sapiens
cctgtgtggaaggcaggaggcc

SEQ ID NO: 7448348 - DNA, 22 bp, Homo sapiens
cctgtgtggaaaccgcatgacg

SEQ ID NO: 7448349 - DNA, 19 bp, Homo sapiens
cctgtgtggggtagagatc

SEQ ID NO: 7448350 - DNA, 19 bp, Homo sapiens
cctgtgtggggtagagatc

SEQ ID NO: 7448351 - DNA, 22 bp, Homo sapiens
cctgtgtggccgcactgctccc

SEQ ID NO: 7448352 - DNA, 22 bp, Homo sapiens
cctgtgtggccaggctggagtc

SEQ ID NO: 7448353 - DNA, 22 bp, Homo sapiens
cctgtgtggccgcactgctccc

SEQ ID NO: 7448354 - DNA, 22 bp, Homo sapiens
cctgtgtggccgcactgctccc

SEQ ID NO: 7448355 - DNA, 22 bp, Homo sapiens
cctgtgtggccaggctggagtc

SEQ ID NO: 7448356 - DNA, 19 bp, Homo sapiens
ccttccccttcagcctctg

SEQ ID NO: 7448357 - DNA, 19 bp, Homo sapiens
ccttccccttcagcctctg

SEQ ID NO: 7448358 - DNA, 22 bp, Homo sapiens
ccttccctaaagcgtcgcttag

SEQ ID NO: 7448359 - DNA, 22 bp, Homo sapiens
ccttccctaaagcgtcgcttag

SEQ ID NO: 7448360 - DNA, 22 bp, Homo sapiens
ccttcctcatccatttctcttg

SEQ ID NO: 7448361 - DNA, 22 bp, Homo sapiens
ccttcctcatccatttctcttg

SEQ ID NO: 7448362 - DNA, 22 bp, Homo sapiens
ccttccctaaagcgtcgcttag

SEQ ID NO: 7448363 - DNA, 22 bp, Homo sapiens
ccttcctaacattgccatgaca

SEQ ID NO: 7448364 - DNA, 19 bp, Homo sapiens
ccttcctccccagggccat

SEQ ID NO: 7448365 - DNA, 17 bp, Homo sapiens
ccttcctcatctccttc

SEQ ID NO: 7448366 - DNA, 17 bp, Homo sapiens
ccttcctcatctccttc

SEQ ID NO: 7448367 - DNA, 17 bp, Homo sapiens
ccttcctcatctccttc

SEQ ID NO: 7448368 - DNA, 17 bp, Homo sapiens
ccttcctcatctccttc

SEQ ID NO: 7448369 - DNA, 17 bp, Homo sapiens
ccttcctcatctccttc

SEQ ID NO: 7448370 - DNA, 22 bp, Homo sapiens
ccttcctggagcccatgcagat

SEQ ID NO: 7448371 - DNA, 22 bp, Homo sapiens
ccttcctggagcccatgcagat

SEQ ID NO: 7448372 - DNA, 19 bp, Homo sapiens
ccttcctccccagggccat

SEQ ID NO: 7448373 - DNA, 22 bp, Homo sapiens
ccttcctggagcccatgcagat

SEQ ID NO: 7448374 - DNA, 22 bp, Homo sapiens
ccttcctggctgtccgcctgat

SEQ ID NO: 7448375 - DNA, 22 bp, Homo sapiens
ccttcctggctgtccgcctgat

SEQ ID NO: 7448376 - DNA, 22 bp, Homo sapiens
ccttcctggctgtccgcctgat

SEQ ID NO: 7448377 - DNA, 22 bp, Homo sapiens
ccttcctggctgtccgcctgat

SEQ ID NO: 7448378 - DNA, 22 bp, Homo sapiens
ccttccttcaagcacacatcta

SEQ ID NO: 7448379 - DNA, 22 bp, Homo sapiens
ccttccttcaagcacacatcta

SEQ ID NO: 7448380 - DNA, 22 bp, Homo sapiens
ccttcctggctgtccgcctgat

SEQ ID NO: 7448381 - DNA, 22 bp, Homo sapiens
ccttcctggctgtccgcctgat

SEQ ID NO: 7448382 - DNA, 22 bp, Homo sapiens
ccttcctggctgtccgcctgat

SEQ ID NO: 7448383 - DNA, 20 bp, Homo sapiens
ccttccccacccgctgaggt

SEQ ID NO: 7448384 - DNA, 20 bp, Homo sapiens
ccttccccacccgctgaggt

SEQ ID NO: 7448385 - DNA, 22 bp, Homo sapiens
ccttcccatgcagcctgtctga

SEQ ID NO: 7448386 - DNA, 20 bp, Homo sapiens
ccttccccacccgctgaggt

SEQ ID NO: 7448387 - DNA, 20 bp, Homo sapiens
ccttccccacccgctgaggt

SEQ ID NO: 7448388 - DNA, 20 bp, Homo sapiens
ccttccccacccgctgaggt

SEQ ID NO: 7448389 - DNA, 22 bp, Homo sapiens
ccttccccaggtgctcactgtc

SEQ ID NO: 7448390 - DNA, 22 bp, Homo sapiens
ccttccccaggtgctcactgtc

SEQ ID NO: 7448391 - DNA, 22 bp, Homo sapiens
ccttccccaggtgctcactgtc

SEQ ID NO: 7448392 - DNA, 22 bp, Homo sapiens
ccttccccaggtgctcactgtc

SEQ ID NO: 7448393 - DNA, 22 bp, Homo sapiens
ccttccccaggtgctcactgtc

SEQ ID NO: 7448394 - DNA, 22 bp, Homo sapiens
ccttccccaggtgctcactgtc

SEQ ID NO: 7448395 - DNA, 22 bp, Homo sapiens
ccttccccaggtgctcactgtc

SEQ ID NO: 7448396 - DNA, 22 bp, Homo sapiens
ccttccccaggtgctcactgtc

SEQ ID NO: 7448397 - DNA, 22 bp, Homo sapiens
ccttccccagtgattctctcag

SEQ ID NO: 7448398 - DNA, 22 bp, Homo sapiens
ccttccccagtgattctctcag

SEQ ID NO: 7448399 - DNA, 22 bp, Homo sapiens
ccttccccagtgattctctcag

SEQ ID NO: 7448400 - DNA, 19 bp, Homo sapiens
ccttccccttcagcctctg

SEQ ID NO: 7448401 - DNA, 19 bp, Homo sapiens
ccttccccttcagcctctg

SEQ ID NO: 7448402 - DNA, 19 bp, Homo sapiens
ccttccccttcagcctctg

SEQ ID NO: 7448403 - DNA, 19 bp, Homo sapiens
ccttccccttcagcctctg

SEQ ID NO: 7448404 - DNA, 19 bp, Homo sapiens
ccttccccttcagcctctg

SEQ ID NO: 7448405 - DNA, 19 bp, Homo sapiens
ccttccccttcagcctctg

SEQ ID NO: 7448406 - DNA, 22 bp, Homo sapiens
ccttcattattcctgaactgtt

SEQ ID NO: 7448407 - DNA, 22 bp, Homo sapiens
ccttcattattcctgaactgtt

SEQ ID NO: 7448408 - DNA, 22 bp, Homo sapiens
ccttcattcagctatagcatcc

SEQ ID NO: 7448409 - DNA, 22 bp, Homo sapiens
ccttcattcagctatagcatcc

SEQ ID NO: 7448410 - DNA, 22 bp, Homo sapiens
ccttccagtgactaaggaggaa

SEQ ID NO: 7448411 - DNA, 22 bp, Homo sapiens
ccttccagtgatatgcgtgaat

SEQ ID NO: 7448412 - DNA, 22 bp, Homo sapiens
ccttccagtgatatgcgtgaat

SEQ ID NO: 7448413 - DNA, 22 bp, Homo sapiens
ccttcattattcctgaactgtt

SEQ ID NO: 7448414 - DNA, 22 bp, Homo sapiens
ccttcatgatggaaagggttca

SEQ ID NO: 7448415 - DNA, 22 bp, Homo sapiens
ccttcagtcccatgtttctctt

SEQ ID NO: 7448416 - DNA, 22 bp, Homo sapiens
ccttcatgtcattggacacctt

SEQ ID NO: 7448417 - DNA, 22 bp, Homo sapiens
ccttcagtcccatgtttctctt

SEQ ID NO: 7448418 - DNA, 22 bp, Homo sapiens
ccttcccacattccttacatgc

SEQ ID NO: 7448419 - DNA, 22 bp, Homo sapiens
ccttccagttcttggttgtaat

SEQ ID NO: 7448420 - DNA, 22 bp, Homo sapiens
ccttcccaggctagaccaacat

SEQ ID NO: 7448421 - DNA, 22 bp, Homo sapiens
ccttccagttcttggttgtaat

SEQ ID NO: 7448422 - DNA, 22 bp, Homo sapiens
ccttcccacattccttacatgc

SEQ ID NO: 7448423 - DNA, 15 bp, Homo sapiens
ccttcccacccaccc

SEQ ID NO: 7448424 - DNA, 22 bp, Homo sapiens
ccttcccaggctagaccaacat

SEQ ID NO: 7448425 - DNA, 22 bp, Homo sapiens
ccttcccatgcagcctgtctga

SEQ ID NO: 7448426 - DNA, 22 bp, Homo sapiens
ccttcccaggctagaccaacat

SEQ ID NO: 7448427 - DNA, 22 bp, Homo sapiens
ccttcccatgcagcctgtctga

SEQ ID NO: 7448428 - DNA, 22 bp, Homo sapiens
ccttcccatgcagcctgtctga

SEQ ID NO: 7448429 - DNA, 22 bp, Homo sapiens
ttagaagtgggcctatagtcct

SEQ ID NO: 7448430 - DNA, 22 bp, Homo sapiens
ttagaagttcaggtctgtaatc

SEQ ID NO: 7448431 - DNA, 22 bp, Homo sapiens
ttagaatctaacattcttatct

SEQ ID NO: 7448432 - DNA, 22 bp, Homo sapiens
ttagaatctttagagtctcact

SEQ ID NO: 7448433 - DNA, 22 bp, Homo sapiens
ttagaatctttagagtctcact

SEQ ID NO: 7448434 - DNA, 22 bp, Homo sapiens
ttagaatcttgtatcagaagtt

SEQ ID NO: 7448435 - DNA, 22 bp, Homo sapiens
ttagaatcttgtatcagaagtt

SEQ ID NO: 7448436 - DNA, 22 bp, Homo sapiens
ttagaatcaggtgttataatca

SEQ ID NO: 7448437 - DNA, 22 bp, Homo sapiens
ttagaatcaggtgttataatca

SEQ ID NO: 7448438 - DNA, 22 bp, Homo sapiens
ttagaatccatggttgcagtgg

SEQ ID NO: 7448439 - DNA, 22 bp, Homo sapiens
ttagaatctaacattcttatct

SEQ ID NO: 7448440 - DNA, 22 bp, Homo sapiens
ttagacaagggctccttaaaag

SEQ ID NO: 7448441 - DNA, 22 bp, Homo sapiens
ttagaatgatagagaatttgtt

SEQ ID NO: 7448442 - DNA, 22 bp, Homo sapiens
ttagaatgatagagaatttgtt

SEQ ID NO: 7448443 - DNA, 22 bp, Homo sapiens
ttagaatctaacattcttatct

SEQ ID NO: 7448444 - DNA, 22 bp, Homo sapiens
ttagaatgatagagaatttgtt

SEQ ID NO: 7448445 - DNA, 22 bp, Homo sapiens
ttagacaatctgttggtaaggt

SEQ ID NO: 7448446 - DNA, 23 bp, Homo sapiens
ttagacaatcctcaaaaggtaat

SEQ ID NO: 7448447 - DNA, 22 bp, Homo sapiens
ttagaagtgaaatgctgcagag

SEQ ID NO: 7448448 - DNA, 22 bp, Homo sapiens
ttagaagtgaaatagctgtaca

SEQ ID NO: 7448449 - DNA, 22 bp, Homo sapiens
ttagaagtcagtatataggtgg

SEQ ID NO: 7448450 - DNA, 22 bp, Homo sapiens
ttagaagtcagtatataggtgg

SEQ ID NO: 7448451 - DNA, 22 bp, Homo sapiens
ttagaagtcatctagtctaaaa

SEQ ID NO: 7448452 - DNA, 22 bp, Homo sapiens
ttagaagtcatctagtctaaaa

SEQ ID NO: 7448453 - DNA, 22 bp, Homo sapiens
ttagaaaatttgcttctttgga

SEQ ID NO: 7448454 - DNA, 22 bp, Homo sapiens
ttagaaaatttgcttctttgga

SEQ ID NO: 7448455 - DNA, 22 bp, Homo sapiens
ttagaaaatttgcttctttgga

SEQ ID NO: 7448456 - DNA, 22 bp, Homo sapiens
ttagaaaacataagtggtaaag

SEQ ID NO: 7448457 - DNA, 22 bp, Homo sapiens
ttagaaaacataagtggtaaag

SEQ ID NO: 7448458 - DNA, 22 bp, Homo sapiens
ttagaaaacataagtggtaaag

SEQ ID NO: 7448459 - DNA, 22 bp, Homo sapiens
ttagaaaatggaggtgggaggg

SEQ ID NO: 7448460 - DNA, 22 bp, Homo sapiens
ttagaaaatggaggtgggaggg

SEQ ID NO: 7448461 - DNA, 22 bp, Homo sapiens
ttagaaaaatgttcagtagttt

SEQ ID NO: 7448462 - DNA, 22 bp, Homo sapiens
ttagaaaaatgttcagtagttt

SEQ ID NO: 7448463 - DNA, 22 bp, Homo sapiens
ttagaaaacataagtggtaaag

SEQ ID NO: 7448464 - DNA, 22 bp, Homo sapiens
ttagaaaacataagtggtaaag

SEQ ID NO: 7448465 - DNA, 22 bp, Homo sapiens
ttagaaaacataagtggtaaag

SEQ ID NO: 7448466 - DNA, 22 bp, Homo sapiens
ttagaaaaaggctgtggtctta

SEQ ID NO: 7448467 - DNA, 22 bp, Homo sapiens
ttagaaaaaggctgtggtctta

SEQ ID NO: 7448468 - DNA, 22 bp, Homo sapiens
ttagaaaaaggctgtggtctta

SEQ ID NO: 7448469 - DNA, 22 bp, Homo sapiens
ttagaaaaatgttcagtagttt

SEQ ID NO: 7448470 - DNA, 22 bp, Homo sapiens
ttagaaaaatgttcagtagttt

SEQ ID NO: 7448471 - DNA, 22 bp, Homo sapiens
ttagaaaaatgttcagtagttt

SEQ ID NO: 7448472 - DNA, 22 bp, Homo sapiens
ttagaaaaatgttcagtagttt

SEQ ID NO: 7448473 - DNA, 22 bp, Homo sapiens
ttagaaaaatgttcagtagttt

SEQ ID NO: 7448474 - DNA, 21 bp, Homo sapiens
ttacttttgcagcaacctaat

SEQ ID NO: 7448475 - DNA, 21 bp, Homo sapiens
ttacttttgcagcaacctaat

SEQ ID NO: 7448476 - DNA, 23 bp, Homo sapiens
ttacttttgcaccaacctaatat

SEQ ID NO: 7448477 - DNA, 23 bp, Homo sapiens
ttacttttgcaccaacctaatat

SEQ ID NO: 7448478 - DNA, 23 bp, Homo sapiens
ttacttttgcaccaacctaatat

SEQ ID NO: 7448479 - DNA, 21 bp, Homo sapiens
ttacttttgcaccaacctaat

SEQ ID NO: 7448480 - DNA, 23 bp, Homo sapiens
ttacttttgcaccaacctaatat

SEQ ID NO: 7448481 - DNA, 22 bp, Homo sapiens
ttagaaaaaggctgtggtctta

SEQ ID NO: 7448482 - DNA, 22 bp, Homo sapiens
ttagaaaaaggctgtggtctta

SEQ ID NO: 7448483 - DNA, 22 bp, Homo sapiens
ttagaaaaaggctgtggtctta

SEQ ID NO: 7448484 - DNA, 22 bp, Homo sapiens
ttagaaaaaggctgtggtctta

SEQ ID NO: 7448485 - DNA, 22 bp, Homo sapiens
ttagaaaaaggctgtggtctta

SEQ ID NO: 7448486 - DNA, 22 bp, Homo sapiens
ttagaaaaaggctgtggtctta

SEQ ID NO: 7448487 - DNA, 22 bp, Homo sapiens
ttagaaaaaacgtcttctagtg

SEQ ID NO: 7448488 - DNA, 21 bp, Homo sapiens
ttacttttgcagcaacctaat

SEQ ID NO: 7448489 - DNA, 22 bp, Homo sapiens
ttagaaaaaacgtcttctagtg

SEQ ID NO: 7448490 - DNA, 22 bp, Homo sapiens
ttagaaaaaacgtcttctagtg

SEQ ID NO: 7448491 - DNA, 22 bp, Homo sapiens
ttagaaaaaacgtcttctagtg

SEQ ID NO: 7448492 - DNA, 22 bp, Homo sapiens
ttagaaaaaacgtcttctagtg

SEQ ID NO: 7448493 - DNA, 22 bp, Homo sapiens
ttacttttgcaccaaactaata

SEQ ID NO: 7448494 - DNA, 22 bp, Homo sapiens
ttacttttgcaccaaactaata

SEQ ID NO: 7448495 - DNA, 22 bp, Homo sapiens
ttacttttgcaccaaactaata

SEQ ID NO: 7448496 - DNA, 22 bp, Homo sapiens
ttacttttgcaccaaactaata

SEQ ID NO: 7448497 - DNA, 22 bp, Homo sapiens
ttacttttgcaccaaactaata

SEQ ID NO: 7448498 - DNA, 22 bp, Homo sapiens
ttacttttgcaccaaactaata

SEQ ID NO: 7448499 - DNA, 21 bp, Homo sapiens
ttacttttgcaccaacctaat

SEQ ID NO: 7448500 - DNA, 21 bp, Homo sapiens
ttacttttgcaccaacctaat

SEQ ID NO: 7448501 - DNA, 22 bp, Homo sapiens
ttactaaggactctaagttcta

SEQ ID NO: 7448502 - DNA, 21 bp, Homo sapiens
ccttctccacagggtctccgg

SEQ ID NO: 7448503 - DNA, 22 bp, Homo sapiens
ttacttttgcaccaaactaata

SEQ ID NO: 7448504 - DNA, 22 bp, Homo sapiens
ttacttttgcaccaaactaata

SEQ ID NO: 7448505 - DNA, 22 bp, Homo sapiens
ttactacaagattctgttttat

SEQ ID NO: 7448506 - DNA, 22 bp, Homo sapiens
ttacttttctattcgatatgtg

SEQ ID NO: 7448507 - DNA, 22 bp, Homo sapiens
ccttccttttactgtctccgga

SEQ ID NO: 7448508 - DNA, 22 bp, Homo sapiens
ccttccttttactgtctccgga

SEQ ID NO: 7448509 - DNA, 22 bp, Homo sapiens
ccttccttttactgtctccgga

SEQ ID NO: 7448510 - DNA, 22 bp, Homo sapiens
ccttccttttactgtctccgga

SEQ ID NO: 7448511 - DNA, 22 bp, Homo sapiens
ccttctagcaaatcaacataaa

SEQ ID NO: 7448512 - DNA, 22 bp, Homo sapiens
ccttcgaaggtgctgggatggt

SEQ ID NO: 7448513 - DNA, 22 bp, Homo sapiens
ccttcgagatttaaacactgat

SEQ ID NO: 7448514 - DNA, 22 bp, Homo sapiens
ccttctagcaaatcaacataaa

SEQ ID NO: 7448515 - DNA, 22 bp, Homo sapiens
ccttctagcaaatcaacataaa

SEQ ID NO: 7448516 - DNA, 19 bp, Homo sapiens
ccttcgcaagttttcttta

SEQ ID NO: 7448517 - DNA, 22 bp, Homo sapiens
ccttctagcaaatcaacataaa

SEQ ID NO: 7448518 - DNA, 21 bp, Homo sapiens
ccttctccacagggtctccgg

SEQ ID NO: 7448519 - DNA, 21 bp, Homo sapiens
ccttctccacagggtctccgg

SEQ ID NO: 7448520 - DNA, 21 bp, Homo sapiens
ccttctccacagggtctccgg

SEQ ID NO: 7448521 - DNA, 21 bp, Homo sapiens
ccttctccacagggtctccgg

SEQ ID NO: 7448522 - DNA, 22 bp, Homo sapiens
ccttccttgtctacaaaagctc

SEQ ID NO: 7448523 - DNA, 22 bp, Homo sapiens
ccttccttgtctacaaaagctc

SEQ ID NO: 7448524 - DNA, 22 bp, Homo sapiens
ccttccttgtctacaaaagctc

SEQ ID NO: 7448525 - DNA, 22 bp, Homo sapiens
ccttccttgagaagcaattcct

SEQ ID NO: 7448526 - DNA, 22 bp, Homo sapiens
ccttccttgtctacaaaagctc

SEQ ID NO: 7448527 - DNA, 22 bp, Homo sapiens
ccttccttgagaagcaattcct

SEQ ID NO: 7448528 - DNA, 22 bp, Homo sapiens
ccttccttgagaagcaattcct

SEQ ID NO: 7448529 - DNA, 22 bp, Homo sapiens
ccttccttgagaagcaattcct

SEQ ID NO: 7448530 - DNA, 22 bp, Homo sapiens
ccttccttcaagcacacatcta

SEQ ID NO: 7448531 - DNA, 22 bp, Homo sapiens
ccttcctttgcatcatttctag

SEQ ID NO: 7448532 - DNA, 22 bp, Homo sapiens
ccttcctttgcatcatttctag

SEQ ID NO: 7448533 - DNA, 22 bp, Homo sapiens
ccttcctttgcaggtcaggtca

SEQ ID NO: 7448534 - DNA, 22 bp, Homo sapiens
ccttcctttcagggctatgcct

SEQ ID NO: 7448535 - DNA, 22 bp, Homo sapiens
ccttcctttgcaggtcaggtca

SEQ ID NO: 7448536 - DNA, 22 bp, Homo sapiens
ccttcctttgcaggtcaggtca

SEQ ID NO: 7448537 - DNA, 22 bp, Homo sapiens
ccttcctttcagggctatgcct

SEQ ID NO: 7448538 - DNA, 22 bp, Homo sapiens
ccttcctttcagggctatgcct

SEQ ID NO: 7448539 - DNA, 22 bp, Homo sapiens
ccttcctttcagggctatgcct

SEQ ID NO: 7448540 - DNA, 22 bp, Homo sapiens
ccttcctttcagggctatgcct

SEQ ID NO: 7448541 - DNA, 22 bp, Homo sapiens
cctgtgccctggaaggagagag

SEQ ID NO: 7448542 - DNA, 22 bp, Homo sapiens
cctgtgccctggaaggagagag

SEQ ID NO: 7448543 - DNA, 22 bp, Homo sapiens
cctgtgccctgccaggctggtg

SEQ ID NO: 7448544 - DNA, 22 bp, Homo sapiens
cctgtgccctgccaggctggtg

SEQ ID NO: 7448545 - DNA, 22 bp, Homo sapiens
cctgtgccctctgcatagcagc

SEQ ID NO: 7448546 - DNA, 22 bp, Homo sapiens
cctgtgccctgccaggctggtg

SEQ ID NO: 7448547 - DNA, 22 bp, Homo sapiens
cctgtgccctgccaggctggtg

SEQ ID NO: 7448548 - DNA, 22 bp, Homo sapiens
cctgtgccttaaccctttaggc

SEQ ID NO: 7448549 - DNA, 22 bp, Homo sapiens
cctgtgccttccttaggcacct

SEQ ID NO: 7448550 - DNA, 22 bp, Homo sapiens
cctgtgcctgcctgtgagttct

SEQ ID NO: 7448551 - DNA, 22 bp, Homo sapiens
cctgtgccttccttaggcacct

SEQ ID NO: 7448552 - DNA, 22 bp, Homo sapiens
cctgtgccatcctgagcatccc

SEQ ID NO: 7448553 - DNA, 22 bp, Homo sapiens
cctgtgccctacacctttccag

SEQ ID NO: 7448554 - DNA, 22 bp, Homo sapiens
cctgtgccctacacctttccag

SEQ ID NO: 7448555 - DNA, 22 bp, Homo sapiens
cctgtgccctacacctttccag

SEQ ID NO: 7448556 - DNA, 22 bp, Homo sapiens
cctgtgccctcagcctggctct

SEQ ID NO: 7448557 - DNA, 22 bp, Homo sapiens
cctgtgccctcagcctggctct

SEQ ID NO: 7448558 - DNA, 22 bp, Homo sapiens
cctgtgccctctgcatagcagc

SEQ ID NO: 7448559 - DNA, 22 bp, Homo sapiens
cctgtgccctcagcctggctct

SEQ ID NO: 7448560 - DNA, 22 bp, Homo sapiens
cctgtgccctcagcctggctct

SEQ ID NO: 7448561 - DNA, 22 bp, Homo sapiens
cctgtgccctacacctttccag

SEQ ID NO: 7448562 - DNA, 22 bp, Homo sapiens
cctgtgccctcagcctggctct

SEQ ID NO: 7448563 - DNA, 21 bp, Homo sapiens
cctgtgctatcagcttgggtt

SEQ ID NO: 7448564 - DNA, 19 bp, Homo sapiens
cctgtgctaggagctgacc

SEQ ID NO: 7448565 - DNA, 21 bp, Homo sapiens
cctgtgctccacacagggtcc

SEQ ID NO: 7448566 - DNA, 21 bp, Homo sapiens
cctgtgctccacacagggtcc

SEQ ID NO: 7448567 - DNA, 21 bp, Homo sapiens
cctgtgctatcagcttgggtt

SEQ ID NO: 7448568 - DNA, 19 bp, Homo sapiens
cctgtgctaggagctgacc

SEQ ID NO: 7448569 - DNA, 22 bp, Homo sapiens
cctgtgccttccttaggcacct

SEQ ID NO: 7448570 - DNA, 22 bp, Homo sapiens
cctgtgccttccttaggcacct

SEQ ID NO: 7448571 - DNA, 19 bp, Homo sapiens
cctgtgctaggagctgacc

SEQ ID NO: 7448572 - DNA, 19 bp, Homo sapiens
cctgtgctaggagctgacc

SEQ ID NO: 7448573 - DNA, 18 bp, Homo sapiens
cctgtgctccagcatctg

SEQ ID NO: 7448574 - DNA, 21 bp, Homo sapiens
cctgtgctccacacagggtcc

SEQ ID NO: 7448575 - DNA, 21 bp, Homo sapiens
cctgtgctccacacagggtcc

SEQ ID NO: 7448576 - DNA, 22 bp, Homo sapiens
cctgtgctcccatagcttctgt

SEQ ID NO: 7448577 - DNA, 22 bp, Homo sapiens
cctgtgctcccatagcttctgt

SEQ ID NO: 7448578 - DNA, 18 bp, Homo sapiens
cctgtgctccagcatctg

SEQ ID NO: 7448579 - DNA, 22 bp, Homo sapiens
cctgtgctccctatgtatctgg

SEQ ID NO: 7448580 - DNA, 22 bp, Homo sapiens
cctgtgctccctatgtatctgg

SEQ ID NO: 7448581 - DNA, 22 bp, Homo sapiens
cctgtgctcccatagcttctgt

SEQ ID NO: 7448582 - DNA, 22 bp, Homo sapiens
cctgtgctcccatagcttctgt

SEQ ID NO: 7448583 - DNA, 22 bp, Homo sapiens
cctgtgcttcagctggaggagg

SEQ ID NO: 7448584 - DNA, 22 bp, Homo sapiens
cctgtgcttcagctggaggagg

SEQ ID NO: 7448585 - DNA, 22 bp, Homo sapiens
ttaaagctgagccctcagaagc

SEQ ID NO: 7448586 - DNA, 21 bp, Homo sapiens
ttaaagctatggtagtgggct

SEQ ID NO: 7448587 - DNA, 22 bp, Homo sapiens
cctgtgcttcagctggaggagg

SEQ ID NO: 7448588 - DNA, 22 bp, Homo sapiens
cctgtgcttcagctggaggagg

SEQ ID NO: 7448589 - DNA, 20 bp, Homo sapiens
cctgtgcttatcacttgctg

SEQ ID NO: 7448590 - DNA, 22 bp, Homo sapiens
cctgtgcttcactcaacaagcc

SEQ ID NO: 7448591 - DNA, 20 bp, Homo sapiens
cctgtgcttatcacttgctg

SEQ ID NO: 7448592 - DNA, 22 bp, Homo sapiens
cctgtgctggacagggctgggc

SEQ ID NO: 7448593 - DNA, 22 bp, Homo sapiens
cctgtgctggacagggctgggc

SEQ ID NO: 7448594 - DNA, 22 bp, Homo sapiens
cctgtgctggacagggctgggc

SEQ ID NO: 7448595 - DNA, 22 bp, Homo sapiens
cctgtgctggacagggctgggc

SEQ ID NO: 7448596 - DNA, 22 bp, Homo sapiens
cctgtgctggacagggctgggc

SEQ ID NO: 7448597 - DNA, 20 bp, Homo sapiens
cctgtgctgccctcggggcc

SEQ ID NO: 7448598 - DNA, 22 bp, Homo sapiens
cctgtgctgggaaaacacggag

SEQ ID NO: 7448599 - DNA, 22 bp, Homo sapiens
cctgtgctggctttattctcag

SEQ ID NO: 7448600 - DNA, 22 bp, Homo sapiens
cctgtgctgggtgtgagggaca

SEQ ID NO: 7448601 - DNA, 22 bp, Homo sapiens
cctgtgctggacagggctgggc

SEQ ID NO: 7448602 - DNA, 22 bp, Homo sapiens
cctgtgctgggaaaacacggag

SEQ ID NO: 7448603 - DNA, 22 bp, Homo sapiens
cctgtgctgggtgtgagggaca

SEQ ID NO: 7448604 - DNA, 22 bp, Homo sapiens
cctgtgctgggtgtgagggaca

SEQ ID NO: 7448605 - DNA, 22 bp, Homo sapiens
ttaaagctgtagagttacttgc

SEQ ID NO: 7448606 - DNA, 22 bp, Homo sapiens
ttaaagctgtagagttacttgc

SEQ ID NO: 7448607 - DNA, 22 bp, Homo sapiens
ttaaagctggcgttacagtttg

SEQ ID NO: 7448608 - DNA, 22 bp, Homo sapiens
ttaaagctggcgttacagtttg

SEQ ID NO: 7448609 - DNA, 22 bp, Homo sapiens
ttaaagctgagccctcagaagc

SEQ ID NO: 7448610 - DNA, 22 bp, Homo sapiens
ttaaagctggcgttacagtttg

SEQ ID NO: 7448611 - DNA, 22 bp, Homo sapiens
ttaaagctgctgaatcctattt

SEQ ID NO: 7448612 - DNA, 22 bp, Homo sapiens
ttaaagctgctgaatcctattt

SEQ ID NO: 7448613 - DNA, 17 bp, Homo sapiens
ttaaaggatgctctctc

SEQ ID NO: 7448614 - DNA, 17 bp, Homo sapiens
ttaaaggatgctctctc

SEQ ID NO: 7448615 - DNA, 22 bp, Homo sapiens
ttaaaggcatggttagacatgg

SEQ ID NO: 7448616 - DNA, 23 bp, Homo sapiens
ttaaaggcagatgttgagtatta

SEQ ID NO: 7448617 - DNA, 22 bp, Homo sapiens
ttaaaggatctttgtcattaat

SEQ ID NO: 7448618 - DNA, 22 bp, Homo sapiens
ttaaaggatctttgtcattaat

SEQ ID NO: 7448619 - DNA, 22 bp, Homo sapiens
ttaaaggaattgagtttcttgt

SEQ ID NO: 7448620 - DNA, 22 bp, Homo sapiens
ttaaaggaattgagtttcttgt

SEQ ID NO: 7448621 - DNA, 22 bp, Homo sapiens
cctgtgggtcacatgggtgact

SEQ ID NO: 7448622 - DNA, 22 bp, Homo sapiens
cctgtgggagcccaggcagata

SEQ ID NO: 7448623 - DNA, 22 bp, Homo sapiens
cctgtgggtcacatgggtgact

SEQ ID NO: 7448624 - DNA, 22 bp, Homo sapiens
cctgtgggaaaggtctgctctc

SEQ ID NO: 7448625 - DNA, 22 bp, Homo sapiens
cctgtgggttttctgtagaaat

SEQ ID NO: 7448626 - DNA, 21 bp, Homo sapiens
cctgtggtctggagggagcac

SEQ ID NO: 7448627 - DNA, 21 bp, Homo sapiens
cctgtggtctggagggagcac

SEQ ID NO: 7448628 - DNA, 21 bp, Homo sapiens
cctgtggtctggagggagcac

SEQ ID NO: 7448629 - DNA, 21 bp, Homo sapiens
cctgtggtctggagggagcac

SEQ ID NO: 7448630 - DNA, 21 bp, Homo sapiens
cctgtggtctggagggagcac

SEQ ID NO: 7448631 - DNA, 21 bp, Homo sapiens
cctgtggtgccagatcgccag

SEQ ID NO: 7448632 - DNA, 22 bp, Homo sapiens
cctgtggttacgcctgtttcca

SEQ ID NO: 7448633 - DNA, 22 bp, Homo sapiens
cctgtggtttacatgacagtta

SEQ ID NO: 7448634 - DNA, 22 bp, Homo sapiens
cctgtggtttacgtacagctcc

SEQ ID NO: 7448635 - DNA, 22 bp, Homo sapiens
cctgtggtttactctgtggcta

SEQ ID NO: 7448636 - DNA, 21 bp, Homo sapiens
cctgtgtatatggcttgcatg

SEQ ID NO: 7448637 - DNA, 22 bp, Homo sapiens
cctgtggtttactctgtggcta

SEQ ID NO: 7448638 - DNA, 22 bp, Homo sapiens
cctgtggtttactctgtggcta

SEQ ID NO: 7448639 - DNA, 22 bp, Homo sapiens
cctgtgtcagcccctgcctcca

SEQ ID NO: 7448640 - DNA, 22 bp, Homo sapiens
cctgtgtcagcccctgcctcca

SEQ ID NO: 7448641 - DNA, 22 bp, Homo sapiens
cctgtgtcaccggaacggagga

SEQ ID NO: 7448642 - DNA, 22 bp, Homo sapiens
cctgtgtcaccggaacggagga

SEQ ID NO: 7448643 - DNA, 22 bp, Homo sapiens
cctgtgtcagcccctgcctcca

SEQ ID NO: 7448644 - DNA, 22 bp, Homo sapiens
cctgtgtcatcagctgtggcta

SEQ ID NO: 7448645 - DNA, 22 bp, Homo sapiens
cctgtgtcatcagctgtggcta

SEQ ID NO: 7448646 - DNA, 22 bp, Homo sapiens
cctgtgtcagcccctgcctcca

SEQ ID NO: 7448647 - DNA, 22 bp, Homo sapiens
cctgtgtcagcccctgcctcca

SEQ ID NO: 7448648 - DNA, 19 bp, Homo sapiens
cctgtgtcccacgtagatg

SEQ ID NO: 7448649 - DNA, 22 bp, Homo sapiens
cctgtgtcctaatccatcaggc

SEQ ID NO: 7448650 - DNA, 22 bp, Homo sapiens
cctgtgtcctaatccatcaggc

SEQ ID NO: 7448651 - DNA, 22 bp, Homo sapiens
cctgtgtcctaatccatcaggc

SEQ ID NO: 7448652 - DNA, 22 bp, Homo sapiens
cctgtgtccagttccaggttgt

SEQ ID NO: 7448653 - DNA, 22 bp, Homo sapiens
cctgtgtccagttccaggttgt

SEQ ID NO: 7448654 - DNA, 22 bp, Homo sapiens
cctgtgtcatcagctgtggcta

SEQ ID NO: 7448655 - DNA, 22 bp, Homo sapiens
cctgtgtcatcagctgtggcta

SEQ ID NO: 7448656 - DNA, 22 bp, Homo sapiens
cctgtgtcatcagctgtggcta

SEQ ID NO: 7448657 - DNA, 22 bp, Homo sapiens
ttaaagtttcagaaacttggtc

SEQ ID NO: 7448658 - DNA, 22 bp, Homo sapiens
ttaaagttcattaaatgagcca

SEQ ID NO: 7448659 - DNA, 22 bp, Homo sapiens
ttaaagtttcagaaacttggtc

SEQ ID NO: 7448660 - DNA, 22 bp, Homo sapiens
ttaaagtttcagaaacttggtc

SEQ ID NO: 7448661 - DNA, 22 bp, Homo sapiens
ttaaagtttgcctatgtgttgt

SEQ ID NO: 7448662 - DNA, 22 bp, Homo sapiens
ttaaagtttgcctatgtgttgt

SEQ ID NO: 7448663 - DNA, 22 bp, Homo sapiens
ttaaagtttgcctatgtgttgt

SEQ ID NO: 7448664 - DNA, 22 bp, Homo sapiens
ttaaagttcattaaatgagcca

SEQ ID NO: 7448665 - DNA, 22 bp, Homo sapiens
ttaaagttcattaaatgagcca

SEQ ID NO: 7448666 - DNA, 22 bp, Homo sapiens
ttaaagttcattaaatgagcca

SEQ ID NO: 7448667 - DNA, 22 bp, Homo sapiens
ttaaagttcattaaatgagcca

SEQ ID NO: 7448668 - DNA, 22 bp, Homo sapiens
ttaaagtgttaactgaagctta

SEQ ID NO: 7448669 - DNA, 22 bp, Homo sapiens
ttaaagtgttaactgaagctta

SEQ ID NO: 7448670 - DNA, 22 bp, Homo sapiens
ttaaagttcattaaatgagcca

SEQ ID NO: 7448671 - DNA, 19 bp, Homo sapiens
ttaaagtgcgagaagtctt

SEQ ID NO: 7448672 - DNA, 22 bp, Homo sapiens
ttaaatagctcttgtagaagaa

SEQ ID NO: 7448673 - DNA, 22 bp, Homo sapiens
ttaaatagctcttgtagaagaa

SEQ ID NO: 7448674 - DNA, 22 bp, Homo sapiens
ttaaatagctcttgtagaagaa

SEQ ID NO: 7448675 - DNA, 22 bp, Homo sapiens
ttaaatagctcttgtagaagaa

SEQ ID NO: 7448676 - DNA, 22 bp, Homo sapiens
cctgtggctggtcaggccagca

SEQ ID NO: 7448677 - DNA, 22 bp, Homo sapiens
ttaaatagctcttgtagaagaa

SEQ ID NO: 7448678 - DNA, 22 bp, Homo sapiens
cctgtgggaaaggtctgctctc

SEQ ID NO: 7448679 - DNA, 22 bp, Homo sapiens
cctgtgggaaaggtctgctctc

SEQ ID NO: 7448680 - DNA, 22 bp, Homo sapiens
cctgtggcttccacgacctaat

SEQ ID NO: 7448681 - DNA, 22 bp, Homo sapiens
cctgtggcttccacgacctaat

SEQ ID NO: 7448682 - DNA, 22 bp, Homo sapiens
cctgtggcttccacgacctaat

SEQ ID NO: 7448683 - DNA, 22 bp, Homo sapiens
cctgtggcttccacgacctaat

SEQ ID NO: 7448684 - DNA, 22 bp, Homo sapiens
ttaaagtatagaggacaaaaac

SEQ ID NO: 7448685 - DNA, 22 bp, Homo sapiens
ttaaagtatagaggacaaaaac

SEQ ID NO: 7448686 - DNA, 22 bp, Homo sapiens
ttaaagtaatctgtgtgaattt

SEQ ID NO: 7448687 - DNA, 22 bp, Homo sapiens
ttaaagtaatctgtgtgaattt

SEQ ID NO: 7448688 - DNA, 22 bp, Homo sapiens
ttaaagtaatctgtgtgaattt

SEQ ID NO: 7448689 - DNA, 22 bp, Homo sapiens
ttaaaggctgatcttaatatta

SEQ ID NO: 7448690 - DNA, 22 bp, Homo sapiens
ttaaaggctatggctgcctggg

SEQ ID NO: 7448691 - DNA, 22 bp, Homo sapiens
ttaaaggctgatcttaatatta

SEQ ID NO: 7448692 - DNA, 22 bp, Homo sapiens
ttaaagtatagaggacaaaaac

SEQ ID NO: 7448693 - DNA, 22 bp, Homo sapiens
ttaaagtatagaggacaaaaac

SEQ ID NO: 7448694 - DNA, 22 bp, Homo sapiens
ttaaagtatggtttaagggctt

SEQ ID NO: 7448695 - DNA, 22 bp, Homo sapiens
ttaaagtctatgtactacactt

SEQ ID NO: 7448696 - DNA, 19 bp, Homo sapiens
ttaaagtgcgagaagtctt

SEQ ID NO: 7448697 - DNA, 22 bp, Homo sapiens
ttaaagtctatgtactacactt

SEQ ID NO: 7448698 - DNA, 23 bp, Homo sapiens
cctgtctgtgctgggtggacaca

SEQ ID NO: 7448699 - DNA, 19 bp, Homo sapiens
cctgtctgtcttcagctag

SEQ ID NO: 7448700 - DNA, 23 bp, Homo sapiens
cctgtctgtgctgggtggacaca

SEQ ID NO: 7448701 - DNA, 23 bp, Homo sapiens
cctgtctgtgctgggtggacaca

SEQ ID NO: 7448702 - DNA, 23 bp, Homo sapiens
cctgtctgtgctgggtggacaca

SEQ ID NO: 7448703 - DNA, 22 bp, Homo sapiens
cctgtctgtcctttgcattctt

SEQ ID NO: 7448704 - DNA, 19 bp, Homo sapiens
cctgtctgtcttcagctag

SEQ ID NO: 7448705 - DNA, 22 bp, Homo sapiens
cctgtctgtttcattccttgtt

SEQ ID NO: 7448706 - DNA, 22 bp, Homo sapiens
cctgtctgtttgcccattcttg

SEQ ID NO: 7448707 - DNA, 22 bp, Homo sapiens
cctgtctgtttgcccattcttg

SEQ ID NO: 7448708 - DNA, 23 bp, Homo sapiens
cctgtctgtgctgggtggacaca

SEQ ID NO: 7448709 - DNA, 22 bp, Homo sapiens
cctgtctgttctgactggtcag

SEQ ID NO: 7448710 - DNA, 22 bp, Homo sapiens
cctgtcttagggaaagactgga

SEQ ID NO: 7448711 - DNA, 21 bp, Homo sapiens
cctgtcttggactgaggcacc

SEQ ID NO: 7448712 - DNA, 22 bp, Homo sapiens
cctgtctgtttgcccattcttg

SEQ ID NO: 7448713 - DNA, 17 bp, Homo sapiens
cctgtcttgtttctgcc

SEQ ID NO: 7448714 - DNA, 17 bp, Homo sapiens
cctgtcttgtttctgcc

SEQ ID NO: 7448715 - DNA, 17 bp, Homo sapiens
cctgtcttgtttctgcc

SEQ ID NO: 7448716 - DNA, 21 bp, Homo sapiens
cctgtcttggactgaggcacc

SEQ ID NO: 7448717 - DNA, 22 bp, Homo sapiens
cctgtgccatcctgagcatccc

SEQ ID NO: 7448718 - DNA, 21 bp, Homo sapiens
cctgtgccagtctatgtgttc

SEQ ID NO: 7448719 - DNA, 22 bp, Homo sapiens
cctgtgccatcctgagcatccc

SEQ ID NO: 7448720 - DNA, 22 bp, Homo sapiens
cctgtgccatcctgagcatccc

SEQ ID NO: 7448721 - DNA, 22 bp, Homo sapiens
cctgtgccatcctgagcatccc

SEQ ID NO: 7448722 - DNA, 22 bp, Homo sapiens
cctgtgaatgcattaatgagtg

SEQ ID NO: 7448723 - DNA, 22 bp, Homo sapiens
cctgtgaacttgcatgagtttt

SEQ ID NO: 7448724 - DNA, 18 bp, Homo sapiens
cctgtgacagaggcatca

SEQ ID NO: 7448725 - DNA, 23 bp, Homo sapiens
cctgtgacactgtttgtggtaag

SEQ ID NO: 7448726 - DNA, 22 bp, Homo sapiens
cctgtctggccaccagggcgat

SEQ ID NO: 7448727 - DNA, 22 bp, Homo sapiens
cctgtctggccttccacggggg

SEQ ID NO: 7448728 - DNA, 22 bp, Homo sapiens
cctgtctggccttccacggggg

SEQ ID NO: 7448729 - DNA, 22 bp, Homo sapiens
cctgtctggggactccctgggt

SEQ ID NO: 7448730 - DNA, 22 bp, Homo sapiens
cctgtctggggactccctgggt

SEQ ID NO: 7448731 - DNA, 22 bp, Homo sapiens
cctgtctgggcttgagtattta

SEQ ID NO: 7448732 - DNA, 22 bp, Homo sapiens
cctgtctgggcttgagtattta

SEQ ID NO: 7448733 - DNA, 22 bp, Homo sapiens
cctgtctggccttccacggggg

SEQ ID NO: 7448734 - DNA, 22 bp, Homo sapiens
cctgtctggccaccagggcgat

SEQ ID NO: 7448735 - DNA, 20 bp, Homo sapiens
cctgtctggagacaaagaga

SEQ ID NO: 7448736 - DNA, 22 bp, Homo sapiens
cctgtctggaacatggcctgtt

SEQ ID NO: 7448737 - DNA, 22 bp, Homo sapiens
cctgtctggaacatggcctgtt

SEQ ID NO: 7448738 - DNA, 22 bp, Homo sapiens
cctgtctggggactccctgggt

SEQ ID NO: 7448739 - DNA, 18 bp, Homo sapiens
cctgtctggggtccccac

SEQ ID NO: 7448740 - DNA, 18 bp, Homo sapiens
cctgtctggggtccccac

SEQ ID NO: 7448741 - DNA, 18 bp, Homo sapiens
cctgtctggggtccccac

SEQ ID NO: 7448742 - DNA, 22 bp, Homo sapiens
cctgtctgtatcggttcagagt

SEQ ID NO: 7448743 - DNA, 22 bp, Homo sapiens
cctgtctgtattattcaccact

SEQ ID NO: 7448744 - DNA, 22 bp, Homo sapiens
cctgtctgtattattcaccact

SEQ ID NO: 7448745 - DNA, 22 bp, Homo sapiens
cctgtctgtattggtttgctat

SEQ ID NO: 7448746 - DNA, 22 bp, Homo sapiens
cctgtctgtcctctcatgagcc

SEQ ID NO: 7448747 - DNA, 22 bp, Homo sapiens
cctgtctgtcctctcatgagcc

SEQ ID NO: 7448748 - DNA, 22 bp, Homo sapiens
cctgtctgtcctctcatgagcc

SEQ ID NO: 7448749 - DNA, 22 bp, Homo sapiens
cctgtctgtcctctcatgagcc

SEQ ID NO: 7448750 - DNA, 22 bp, Homo sapiens
cctgtctgtcctttgcattctt

SEQ ID NO: 7448751 - DNA, 22 bp, Homo sapiens
tgtttataatatgcagtgagca

SEQ ID NO: 7448752 - DNA, 22 bp, Homo sapiens
tgtttataaattttcttgccat

SEQ ID NO: 7448753 - DNA, 22 bp, Homo sapiens
tgtttataaattttcttgccat

SEQ ID NO: 7448754 - DNA, 22 bp, Homo sapiens
tgtttataaattttcttgccat

SEQ ID NO: 7448755 - DNA, 22 bp, Homo sapiens
cctgtcactgttgcagccagct

SEQ ID NO: 7448756 - DNA, 22 bp, Homo sapiens
cctgtcactctgagccgctccg

SEQ ID NO: 7448757 - DNA, 22 bp, Homo sapiens
cctgtcactgttgcagccagct

SEQ ID NO: 7448758 - DNA, 22 bp, Homo sapiens
cctgtcactctgagccgctccg

SEQ ID NO: 7448759 - DNA, 22 bp, Homo sapiens
cctgtcactgttgcagccagct

SEQ ID NO: 7448760 - DNA, 22 bp, Homo sapiens
cctgtctctgcagggccctgcc

SEQ ID NO: 7448761 - DNA, 22 bp, Homo sapiens
cctgtcagctgatggctatgta

SEQ ID NO: 7448762 - DNA, 22 bp, Homo sapiens
cctgtcagccccacttctgcct

SEQ ID NO: 7448763 - DNA, 22 bp, Homo sapiens
cctgtctctgcagggccctgcc

SEQ ID NO: 7448764 - DNA, 22 bp, Homo sapiens
cctgtctctgcagggccctgcc

SEQ ID NO: 7448765 - DNA, 22 bp, Homo sapiens
cctgtctctttcaatctgagag

SEQ ID NO: 7448766 - DNA, 22 bp, Homo sapiens
tgtttagagtctctgtcaacat

SEQ ID NO: 7448767 - DNA, 22 bp, Homo sapiens
tgtttagatgcaaagtctcaca

SEQ ID NO: 7448768 - DNA, 22 bp, Homo sapiens
tgtttagcataaagattttcca

SEQ ID NO: 7448769 - DNA, 22 bp, Homo sapiens
tgtttagatgcaaagtctcaca

SEQ ID NO: 7448770 - DNA, 22 bp, Homo sapiens
tgtttagatgcaaagtctcaca

SEQ ID NO: 7448771 - DNA, 22 bp, Homo sapiens
tgtttagaggaacaacagactt

SEQ ID NO: 7448772 - DNA, 22 bp, Homo sapiens
tgtttagaggaactggaatcag

SEQ ID NO: 7448773 - DNA, 22 bp, Homo sapiens
tgtttagactcaaaattgaaag

SEQ ID NO: 7448774 - DNA, 22 bp, Homo sapiens
tgtttagactcaaaattgaaag

SEQ ID NO: 7448775 - DNA, 22 bp, Homo sapiens
tgtttagacaaggatcaggtta

SEQ ID NO: 7448776 - DNA, 22 bp, Homo sapiens
tgtttagacagaatgagttctt

SEQ ID NO: 7448777 - DNA, 22 bp, Homo sapiens
tgtttagaatcattcaaaagtt

SEQ ID NO: 7448778 - DNA, 22 bp, Homo sapiens
tgtttacttttaattacctgtc

SEQ ID NO: 7448779 - DNA, 22 bp, Homo sapiens
tgtttacttttaattacctgtc

SEQ ID NO: 7448780 - DNA, 22 bp, Homo sapiens
tgtttactttccttctcacagg

SEQ ID NO: 7448781 - DNA, 22 bp, Homo sapiens
tgtttactttccttctcacagg

SEQ ID NO: 7448782 - DNA, 22 bp, Homo sapiens
tgtttactttccttctcacagg

SEQ ID NO: 7448783 - DNA, 22 bp, Homo sapiens
tgtttactttccttctcacagg

SEQ ID NO: 7448784 - DNA, 22 bp, Homo sapiens
cctgtctgaatcatgatttcct

SEQ ID NO: 7448785 - DNA, 22 bp, Homo sapiens
cctgtctctgttaccacatttg

SEQ ID NO: 7448786 - DNA, 22 bp, Homo sapiens
cctgtctctttcaatctgagag

SEQ ID NO: 7448787 - DNA, 22 bp, Homo sapiens
cctgtctgaaggcagggggatg

SEQ ID NO: 7448788 - DNA, 22 bp, Homo sapiens
cctgtctgagccagggtgggca

SEQ ID NO: 7448789 - DNA, 22 bp, Homo sapiens
cctgtctgaatcatgatttcct

SEQ ID NO: 7448790 - DNA, 22 bp, Homo sapiens
cctgtctgaatcatgatttcct

SEQ ID NO: 7448791 - DNA, 22 bp, Homo sapiens
cctgtctgaggaggtgctcttt

SEQ ID NO: 7448792 - DNA, 22 bp, Homo sapiens
cctgtctgaggaggtgctcttt

SEQ ID NO: 7448793 - DNA, 20 bp, Homo sapiens
cctgtctgcaatggaggtca

SEQ ID NO: 7448794 - DNA, 20 bp, Homo sapiens
cctgtctgcaatggaggtca

SEQ ID NO: 7448795 - DNA, 22 bp, Homo sapiens
cctgtctgcagatatctcaggt

SEQ ID NO: 7448796 - DNA, 22 bp, Homo sapiens
cctgtctgcagatatctcaggt

SEQ ID NO: 7448797 - DNA, 22 bp, Homo sapiens
cctgtctgcatgatccctgcca

SEQ ID NO: 7448798 - DNA, 22 bp, Homo sapiens
cctgtctgcatgatccctgcca

SEQ ID NO: 7448799 - DNA, 22 bp, Homo sapiens
cctgtctgcatgatccctgcca

SEQ ID NO: 7448800 - DNA, 22 bp, Homo sapiens
cctgtctgcggaggagtggaag

SEQ ID NO: 7448801 - DNA, 22 bp, Homo sapiens
cctgtctggaacatggcctgtt

SEQ ID NO: 7448802 - DNA, 22 bp, Homo sapiens
cctgtctggaacatggcctgtt

SEQ ID NO: 7448803 - DNA, 22 bp, Homo sapiens
cctgtctggaacatggcctgtt

SEQ ID NO: 7448804 - DNA, 22 bp, Homo sapiens
cctgtctggaacatggcctgtt

SEQ ID NO: 7448805 - DNA, 22 bp, Homo sapiens
cctgtctgcatgatccctgcca

SEQ ID NO: 7448806 - DNA, 22 bp, Homo sapiens
cctgtctgcaggaaattaccag

SEQ ID NO: 7448807 - DNA, 22 bp, Homo sapiens
cctgtctgcatgagtgagcata

SEQ ID NO: 7448808 - DNA, 22 bp, Homo sapiens
cctgtctgcagatatctcaggt

SEQ ID NO: 7448809 - DNA, 22 bp, Homo sapiens
cctgtctgcatgatccctgcca

SEQ ID NO: 7448810 - DNA, 22 bp, Homo sapiens
cctgtctgcatgagtgagcata

SEQ ID NO: 7448811 - DNA, 22 bp, Homo sapiens
cctgtctgcatgagtgagcata

SEQ ID NO: 7448812 - DNA, 22 bp, Homo sapiens
tttcaattccaccaaagcgccc

SEQ ID NO: 7448813 - DNA, 22 bp, Homo sapiens
tttcaattgactttggaagaaa

SEQ ID NO: 7448814 - DNA, 22 bp, Homo sapiens
tttcaattgactttggaagaaa

SEQ ID NO: 7448815 - DNA, 22 bp, Homo sapiens
tttcaattgactttggaagaaa

SEQ ID NO: 7448816 - DNA, 22 bp, Homo sapiens
tttcaattgactttggaagaaa

SEQ ID NO: 7448817 - DNA, 22 bp, Homo sapiens
tttcaattgactttggaagaaa

SEQ ID NO: 7448818 - DNA, 22 bp, Homo sapiens
tttcaatttccaggctagaatt

SEQ ID NO: 7448819 - DNA, 22 bp, Homo sapiens
tttcaatttccaggctagaatt

SEQ ID NO: 7448820 - DNA, 21 bp, Homo sapiens
tttcaatttgccttgagtcat

SEQ ID NO: 7448821 - DNA, 22 bp, Homo sapiens
tttcaatttccaggctagaatt

SEQ ID NO: 7448822 - DNA, 22 bp, Homo sapiens
tttcaatttccaggctagaatt

SEQ ID NO: 7448823 - DNA, 21 bp, Homo sapiens
tttcacaaaagtatgtgacaa

SEQ ID NO: 7448824 - DNA, 21 bp, Homo sapiens
tttcacaaaagtatgtgacaa

SEQ ID NO: 7448825 - DNA, 22 bp, Homo sapiens
tttcaatgtatgtctttctgag

SEQ ID NO: 7448826 - DNA, 22 bp, Homo sapiens
tttcaatgtatgtctttctgag

SEQ ID NO: 7448827 - DNA, 22 bp, Homo sapiens
tttcaatgtatgtctttctgag

SEQ ID NO: 7448828 - DNA, 21 bp, Homo sapiens
tttcaatgtgttctttgtagt

SEQ ID NO: 7448829 - DNA, 21 bp, Homo sapiens
tttcaatgtgttctttgtagt

SEQ ID NO: 7448830 - DNA, 21 bp, Homo sapiens
tttcaatgtgttctttgtagt

SEQ ID NO: 7448831 - DNA, 21 bp, Homo sapiens
tttcaatgtgttctttgtagt

SEQ ID NO: 7448832 - DNA, 22 bp, Homo sapiens
tttcaatgtaacatttccaggc

SEQ ID NO: 7448833 - DNA, 22 bp, Homo sapiens
tttcaatgtaacatttccaggc

SEQ ID NO: 7448834 - DNA, 23 bp, Homo sapiens
tttcaaattactctgcagatgac

SEQ ID NO: 7448835 - DNA, 23 bp, Homo sapiens
tttcaaattactctgcagatgac

SEQ ID NO: 7448836 - DNA, 23 bp, Homo sapiens
tttcaaattactctgcagatgac

SEQ ID NO: 7448837 - DNA, 23 bp, Homo sapiens
tttcaaattactctgcagatgac

SEQ ID NO: 7448838 - DNA, 22 bp, Homo sapiens
tttcaaatggagtcgtgaaatg

SEQ ID NO: 7448839 - DNA, 22 bp, Homo sapiens
tttcaaatggagtcgtgaaatg

SEQ ID NO: 7448840 - DNA, 22 bp, Homo sapiens
tttcaaatggatccctcagcct

SEQ ID NO: 7448841 - DNA, 22 bp, Homo sapiens
tttcaaatggatccctcagcct

SEQ ID NO: 7448842 - DNA, 22 bp, Homo sapiens
ctcctggccctgagctcccagg

SEQ ID NO: 7448843 - DNA, 22 bp, Homo sapiens
ctcctggccctgagctcccagg

SEQ ID NO: 7448844 - DNA, 22 bp, Homo sapiens
ctcctggccctgagctcccagg

SEQ ID NO: 7448845 - DNA, 22 bp, Homo sapiens
tttcacaggtacaaacactcct

SEQ ID NO: 7448846 - DNA, 22 bp, Homo sapiens
tttcacaggtacaaacactcct

SEQ ID NO: 7448847 - DNA, 22 bp, Homo sapiens
tttcacaggtacaaacactcct

SEQ ID NO: 7448848 - DNA, 22 bp, Homo sapiens
tttcacaggtatccacgggtct

SEQ ID NO: 7448849 - DNA, 22 bp, Homo sapiens
tttcacaggtatccacgggtct

SEQ ID NO: 7448850 - DNA, 22 bp, Homo sapiens
tttcacaggtaagcaatacagg

SEQ ID NO: 7448851 - DNA, 22 bp, Homo sapiens
tttcacaggtaagcaatacagg

SEQ ID NO: 7448852 - DNA, 22 bp, Homo sapiens
tttcacaggtaagcaatacagg

SEQ ID NO: 7448853 - DNA, 22 bp, Homo sapiens
tttcacaaatgtctttaacttg

SEQ ID NO: 7448854 - DNA, 22 bp, Homo sapiens
tttcacaaatgtctttaacttg

SEQ ID NO: 7448855 - DNA, 22 bp, Homo sapiens
tttcacaaatgtctttaacttg

SEQ ID NO: 7448856 - DNA, 22 bp, Homo sapiens
tttcacaacacaatctcgttaa

SEQ ID NO: 7448857 - DNA, 22 bp, Homo sapiens
tttcacaaactgaggagacaat

SEQ ID NO: 7448858 - DNA, 22 bp, Homo sapiens
tttcacaaactgaggagacaat

SEQ ID NO: 7448859 - DNA, 22 bp, Homo sapiens
tttcacaaactgaggagacaat

SEQ ID NO: 7448860 - DNA, 21 bp, Homo sapiens
tttcacaaaagtatgtgacaa

SEQ ID NO: 7448861 - DNA, 22 bp, Homo sapiens
tttcacaaactcagggtgtgtg

SEQ ID NO: 7448862 - DNA, 22 bp, Homo sapiens
tttcacaaagcatagcacttta

SEQ ID NO: 7448863 - DNA, 22 bp, Homo sapiens
tttcacaaagcatagcacttta

SEQ ID NO: 7448864 - DNA, 22 bp, Homo sapiens
tttcacaaagcatagcacttta

SEQ ID NO: 7448865 - DNA, 22 bp, Homo sapiens
tttcacaaagcatagcacttta

SEQ ID NO: 7448866 - DNA, 22 bp, Homo sapiens
tttcacaaactgaggagacaat

SEQ ID NO: 7448867 - DNA, 19 bp, Homo sapiens
tttcacaaagagagcgtga

SEQ ID NO: 7448868 - DNA, 19 bp, Homo sapiens
tttcacaaagagagcgtga

SEQ ID NO: 7448869 - DNA, 19 bp, Homo sapiens
tttcacaaagagagcgtga

SEQ ID NO: 7448870 - DNA, 20 bp, Homo sapiens
tttcacagtccctgtttcct

SEQ ID NO: 7448871 - DNA, 20 bp, Homo sapiens
tttcacagtccctgtttcct

SEQ ID NO: 7448872 - DNA, 20 bp, Homo sapiens
tttcacagtccctgtttcct

SEQ ID NO: 7448873 - DNA, 20 bp, Homo sapiens
tttcacagtccctgtttcct

SEQ ID NO: 7448874 - DNA, 22 bp, Homo sapiens
tttcacagtcaatttggagtca

SEQ ID NO: 7448875 - DNA, 22 bp, Homo sapiens
tttcacagtagaaatcattatg

SEQ ID NO: 7448876 - DNA, 22 bp, Homo sapiens
tttcacagtcaatttggagtca

SEQ ID NO: 7448877 - DNA, 22 bp, Homo sapiens
tttcacagtgctctgtaagtat

SEQ ID NO: 7448878 - DNA, 22 bp, Homo sapiens
tttcacagtgctctgtaagtat

SEQ ID NO: 7448879 - DNA, 22 bp, Homo sapiens
tttcacagtgctctgtaagtat

SEQ ID NO: 7448880 - DNA, 22 bp, Homo sapiens
tttcacataaatattatgccta

SEQ ID NO: 7448881 - DNA, 22 bp, Homo sapiens
tttcacagttagcatgaggact

SEQ ID NO: 7448882 - DNA, 22 bp, Homo sapiens
tttcacagttagcatgaggact

SEQ ID NO: 7448883 - DNA, 22 bp, Homo sapiens
tttcacagttagcatgaggact

SEQ ID NO: 7448884 - DNA, 22 bp, Homo sapiens
tttcacagttagcatgaggact

SEQ ID NO: 7448885 - DNA, 22 bp, Homo sapiens
tttcacataaatggagtaaaga

SEQ ID NO: 7448886 - DNA, 22 bp, Homo sapiens
tttcacataaatggagtaaaga

SEQ ID NO: 7448887 - DNA, 22 bp, Homo sapiens
tttcacataaatattatgccta

SEQ ID NO: 7448888 - DNA, 22 bp, Homo sapiens
tttcacataaatggagtaaaga

SEQ ID NO: 7448889 - DNA, 22 bp, Homo sapiens
tttcacataaatattatgccta

SEQ ID NO: 7448890 - DNA, 22 bp, Homo sapiens
tttcacatagaaagtgatttac

SEQ ID NO: 7448891 - DNA, 22 bp, Homo sapiens
tttcacatagaaagtgatttac

SEQ ID NO: 7448892 - DNA, 22 bp, Homo sapiens
tttcacatagaaagtgatttac

SEQ ID NO: 7448893 - DNA, 22 bp, Homo sapiens
tttcacatagaaagtgatttac

SEQ ID NO: 7448894 - DNA, 22 bp, Homo sapiens
tttcacatacagtgtatagtag

SEQ ID NO: 7448895 - DNA, 22 bp, Homo sapiens
tttcacatacagtgtatagtag

SEQ ID NO: 7448896 - DNA, 22 bp, Homo sapiens
tttcacatacagtgtatagtag

SEQ ID NO: 7448897 - DNA, 22 bp, Homo sapiens
tttccagaaataccatttggtg

SEQ ID NO: 7448898 - DNA, 22 bp, Homo sapiens
tttccagaaataccatttggtg

SEQ ID NO: 7448899 - DNA, 22 bp, Homo sapiens
tttccagagcatgtctgctcag

SEQ ID NO: 7448900 - DNA, 22 bp, Homo sapiens
tttccagagcatgtctgctcag

SEQ ID NO: 7448901 - DNA, 22 bp, Homo sapiens
tttcctaacacaatgcatgaga

SEQ ID NO: 7448902 - DNA, 22 bp, Homo sapiens
tttccagagcatgtctgctcag

SEQ ID NO: 7448903 - DNA, 20 bp, Homo sapiens
tttccactgtaatgtatgat

SEQ ID NO: 7448904 - DNA, 22 bp, Homo sapiens
tttccactgtagagatgttgaa

SEQ ID NO: 7448905 - DNA, 20 bp, Homo sapiens
tttccactgtaatgtatgat

SEQ ID NO: 7448906 - DNA, 20 bp, Homo sapiens
tttccactgtaatgtatgat

SEQ ID NO: 7448907 - DNA, 22 bp, Homo sapiens
tttcctaaggctcattttaaaa

SEQ ID NO: 7448908 - DNA, 22 bp, Homo sapiens
tttcctaaggctcattttaaaa

SEQ ID NO: 7448909 - DNA, 22 bp, Homo sapiens
tttcctaactcatcggatgtac

SEQ ID NO: 7448910 - DNA, 22 bp, Homo sapiens
tttcctaaggctcattttaaaa

SEQ ID NO: 7448911 - DNA, 22 bp, Homo sapiens
tttcctaaggctcattttaaaa

SEQ ID NO: 7448912 - DNA, 22 bp, Homo sapiens
tttcctaacacaatgcatgaga

SEQ ID NO: 7448913 - DNA, 22 bp, Homo sapiens
tttcctaactcatcggatgtac

SEQ ID NO: 7448914 - DNA, 22 bp, Homo sapiens
tttcctaagatagatacttcag

SEQ ID NO: 7448915 - DNA, 22 bp, Homo sapiens
tttcctaagatagatacttcag

SEQ ID NO: 7448916 - DNA, 20 bp, Homo sapiens
tttcctaagtggtttgctga

SEQ ID NO: 7448917 - DNA, 20 bp, Homo sapiens
tttcctaagtggtttgctga

SEQ ID NO: 7448918 - DNA, 22 bp, Homo sapiens
tttcctaatcccaatgacattt

SEQ ID NO: 7448919 - DNA, 22 bp, Homo sapiens
tttcctaaggtagtgataattt

SEQ ID NO: 7448920 - DNA, 22 bp, Homo sapiens
tttcctaaggtagtgataattt

SEQ ID NO: 7448921 - DNA, 22 bp, Homo sapiens
tttcctaagggatgcggctcaa

SEQ ID NO: 7448922 - DNA, 22 bp, Homo sapiens
tttcctaaggtagtgataattt

SEQ ID NO: 7448923 - DNA, 22 bp, Homo sapiens
tttcctaggagattgatcacat

SEQ ID NO: 7448924 - DNA, 22 bp, Homo sapiens
tttcctactgccctatacacac

SEQ ID NO: 7448925 - DNA, 22 bp, Homo sapiens
tttcctagagtctctagaagaa

SEQ ID NO: 7448926 - DNA, 22 bp, Homo sapiens
tttcctaatcccaatgacattt

SEQ ID NO: 7448927 - DNA, 22 bp, Homo sapiens
tttcctaatcccaatgacattt

SEQ ID NO: 7448928 - DNA, 22 bp, Homo sapiens
tttcctaatcccaatgacattt

SEQ ID NO: 7448929 - DNA, 22 bp, Homo sapiens
tttcctactgccctatacacac

SEQ ID NO: 7448930 - DNA, 22 bp, Homo sapiens
tttcctacccttccaggcagag

SEQ ID NO: 7448931 - DNA, 22 bp, Homo sapiens
tttcctacccttccaggcagag

SEQ ID NO: 7448932 - DNA, 22 bp, Homo sapiens
tttccttgcctcctgtccttct

SEQ ID NO: 7448933 - DNA, 22 bp, Homo sapiens
ctctctggaagggggagctgat

SEQ ID NO: 7448934 - DNA, 22 bp, Homo sapiens
tttccttgcctcctgtccttct

SEQ ID NO: 7448935 - DNA, 22 bp, Homo sapiens
tttccttgcctcctgtccttct

SEQ ID NO: 7448936 - DNA, 22 bp, Homo sapiens
ctctctggaagggggagctgat

SEQ ID NO: 7448937 - DNA, 22 bp, Homo sapiens
tttccttgcctcctgtccttct

SEQ ID NO: 7448938 - DNA, 22 bp, Homo sapiens
tttccttgcctcctgtccttct

SEQ ID NO: 7448939 - DNA, 22 bp, Homo sapiens
tttccttgcctcctgtccttct

SEQ ID NO: 7448940 - DNA, 18 bp, Homo sapiens
tttccttgtatgaacata

SEQ ID NO: 7448941 - DNA, 18 bp, Homo sapiens
tttccttgtatgaacata

SEQ ID NO: 7448942 - DNA, 18 bp, Homo sapiens
tttccttgtatgaacata

SEQ ID NO: 7448943 - DNA, 22 bp, Homo sapiens
tttccttgggtctcttagtggc

SEQ ID NO: 7448944 - DNA, 22 bp, Homo sapiens
tttccttgggtctcttagtggc

SEQ ID NO: 7448945 - DNA, 22 bp, Homo sapiens
tttccttgggtctcttagtggc

SEQ ID NO: 7448946 - DNA, 22 bp, Homo sapiens
tttccttgggtctcttagtggc

SEQ ID NO: 7448947 - DNA, 22 bp, Homo sapiens
tttccttgcctcctgtccttct

SEQ ID NO: 7448948 - DNA, 22 bp, Homo sapiens
ctctctggaagggggagctgat

SEQ ID NO: 7448949 - DNA, 22 bp, Homo sapiens
ctctctggaagggggagctgat

SEQ ID NO: 7448950 - DNA, 22 bp, Homo sapiens
ctctctggaagggggagctgat

SEQ ID NO: 7448951 - DNA, 22 bp, Homo sapiens
ctctctggaagggggagctgat

SEQ ID NO: 7448952 - DNA, 22 bp, Homo sapiens
ctctctgctgtatccttaggct

SEQ ID NO: 7448953 - DNA, 22 bp, Homo sapiens
ctctctgctgtatccttaggct

SEQ ID NO: 7448954 - DNA, 22 bp, Homo sapiens
ctctctgctgtatccttaggct

SEQ ID NO: 7448955 - DNA, 22 bp, Homo sapiens
ctctctgatgtcaggtcgctga

SEQ ID NO: 7448956 - DNA, 22 bp, Homo sapiens
ctctctgagtggctgtactttc

SEQ ID NO: 7448957 - DNA, 22 bp, Homo sapiens
ctctctgatttgcttggagaca

SEQ ID NO: 7448958 - DNA, 22 bp, Homo sapiens
ctctctgctgtatccttaggct

SEQ ID NO: 7448959 - DNA, 22 bp, Homo sapiens
ctctctgaggcaggcctgtggg

SEQ ID NO: 7448960 - DNA, 22 bp, Homo sapiens
ctctctgagtgagggacaagct

SEQ ID NO: 7448961 - DNA, 22 bp, Homo sapiens
ctctctgaggaaggagcatctg

SEQ ID NO: 7448962 - DNA, 20 bp, Homo sapiens
ctctctctccattcccaggg

SEQ ID NO: 7448963 - DNA, 20 bp, Homo sapiens
ctctctctccattcccaggg

SEQ ID NO: 7448964 - DNA, 20 bp, Homo sapiens
ctctctctccattcccaggg

SEQ ID NO: 7448965 - DNA, 20 bp, Homo sapiens
ctctctctccattcccaggg

SEQ ID NO: 7448966 - DNA, 20 bp, Homo sapiens
ctctctctccattcccaggg

SEQ ID NO: 7448967 - DNA, 20 bp, Homo sapiens
ctctctctccattcccaggg

SEQ ID NO: 7448968 - DNA, 20 bp, Homo sapiens
ctctctctccattcccaggg

SEQ ID NO: 7448969 - DNA, 20 bp, Homo sapiens
ctctctctccattcccaggg

SEQ ID NO: 7448970 - DNA, 20 bp, Homo sapiens
ctctctctccattcccaggg

SEQ ID NO: 7448971 - DNA, 22 bp, Homo sapiens
ctctctctatgcgttgttccta

SEQ ID NO: 7448972 - DNA, 23 bp, Homo sapiens
ctctctctaccatgtgaggacac

SEQ ID NO: 7448973 - DNA, 22 bp, Homo sapiens
ctctctctatgcgttgttccta

SEQ ID NO: 7448974 - DNA, 22 bp, Homo sapiens
ctctctctatgcgttgttccta

SEQ ID NO: 7448975 - DNA, 22 bp, Homo sapiens
ctctctctatgcgttgttccta

SEQ ID NO: 7448976 - DNA, 20 bp, Homo sapiens
ctctctctccattcccaggg

SEQ ID NO: 7448977 - DNA, 22 bp, Homo sapiens
ctctctgaaactggagagtctc

SEQ ID NO: 7448978 - DNA, 22 bp, Homo sapiens
ctctctgaaactggagagtctc

SEQ ID NO: 7448979 - DNA, 22 bp, Homo sapiens
ctctctgaggaaggagcatctg

SEQ ID NO: 7448980 - DNA, 22 bp, Homo sapiens
ctctctgaaactggagagtctc

SEQ ID NO: 7448981 - DNA, 16 bp, Homo sapiens
ctctctgaatgcaatt

SEQ ID NO: 7448982 - DNA, 22 bp, Homo sapiens
ctctctgaggcaggcctgtggg

SEQ ID NO: 7448983 - DNA, 22 bp, Homo sapiens
ctctctgaggaaggagcatctg

SEQ ID NO: 7448984 - DNA, 22 bp, Homo sapiens
ctctctgaaactggagagtctc

SEQ ID NO: 7448985 - DNA, 22 bp, Homo sapiens
ctctctctttagaagcgtctgg

SEQ ID NO: 7448986 - DNA, 22 bp, Homo sapiens
ctctctctttagaagcgtctgg

SEQ ID NO: 7448987 - DNA, 22 bp, Homo sapiens
ctctctcttgtgttgctgcaga

SEQ ID NO: 7448988 - DNA, 22 bp, Homo sapiens
ctctctcttgtgttgctgcaga

SEQ ID NO: 7448989 - DNA, 22 bp, Homo sapiens
ctctctcttgtgttgctgcaga

SEQ ID NO: 7448990 - DNA, 22 bp, Homo sapiens
ctctctctttagaagcgtctgg

SEQ ID NO: 7448991 - DNA, 22 bp, Homo sapiens
ctctctctttagaagcgtctgg

SEQ ID NO: 7448992 - DNA, 22 bp, Homo sapiens
ctctctctttagaagcgtctgg

SEQ ID NO: 7448993 - DNA, 22 bp, Homo sapiens
ctctctcttgtgttgctgcaga

SEQ ID NO: 7448994 - DNA, 22 bp, Homo sapiens
ctctctcttgtgttgctgcaga

SEQ ID NO: 7448995 - DNA, 22 bp, Homo sapiens
ctctctcttgtgttgctgcaga

SEQ ID NO: 7448996 - DNA, 22 bp, Homo sapiens
ctctctcttgtgttgctgcaga

SEQ ID NO: 7448997 - DNA, 22 bp, Homo sapiens
ctctctcttgtgttgctgcaga

SEQ ID NO: 7448998 - DNA, 22 bp, Homo sapiens
ctctccaggggtagatgccttc

SEQ ID NO: 7448999 - DNA, 22 bp, Homo sapiens
ctctccaggggtagatgccttc

SEQ ID NO: 7449000 - DNA, 22 bp, Homo sapiens
ctctccaggggtagatgccttc

SEQ ID NO: 7449001 - DNA, 22 bp, Homo sapiens
ctctccaggggtagatgccttc

SEQ ID NO: 7449002 - DNA, 22 bp, Homo sapiens
ctctccaggggtagatgccttc

SEQ ID NO: 7449003 - DNA, 22 bp, Homo sapiens
ctctccaggggtagatgccttc

SEQ ID NO: 7449004 - DNA, 22 bp, Homo sapiens
ctctccagggcatgagttccac

SEQ ID NO: 7449005 - DNA, 22 bp, Homo sapiens
ctctccagggcatgagttccac

SEQ ID NO: 7449006 - DNA, 22 bp, Homo sapiens
ctctccagggaagcagtgtact

SEQ ID NO: 7449007 - DNA, 22 bp, Homo sapiens
ctctccaggggtagatgccttc

SEQ ID NO: 7449008 - DNA, 22 bp, Homo sapiens
ctctccaggggaacattgttcc

SEQ ID NO: 7449009 - DNA, 22 bp, Homo sapiens
ctctccagggcatgagttccac

SEQ ID NO: 7449010 - DNA, 22 bp, Homo sapiens
ctctcctggtgtggaggacagg

SEQ ID NO: 7449011 - DNA, 21 bp, Homo sapiens
ctctccagtggttcctgattc

SEQ ID NO: 7449012 - DNA, 22 bp, Homo sapiens
ctctccagtcatattctcagtc

SEQ ID NO: 7449013 - DNA, 22 bp, Homo sapiens
ctctccagtcatattctcagtc

SEQ ID NO: 7449014 - DNA, 22 bp, Homo sapiens
ctctccagtcatattctcagtc

SEQ ID NO: 7449015 - DNA, 22 bp, Homo sapiens
ctctccagtcatattctcagtc

SEQ ID NO: 7449016 - DNA, 22 bp, Homo sapiens
ctctccagtcatattctcagtc

SEQ ID NO: 7449017 - DNA, 22 bp, Homo sapiens
ctctccagtcaggaactctgac

SEQ ID NO: 7449018 - DNA, 22 bp, Homo sapiens
ctctccaggttagagcacttat

SEQ ID NO: 7449019 - DNA, 22 bp, Homo sapiens
ctctccaggttagagcacttat

SEQ ID NO: 7449020 - DNA, 22 bp, Homo sapiens
ctctccagtcaggaactctgac

SEQ ID NO: 7449021 - DNA, 22 bp, Homo sapiens
ctctccagtcaggaactctgac

SEQ ID NO: 7449022 - DNA, 22 bp, Homo sapiens
ctctccaggttagagcacttat

SEQ ID NO: 7449023 - DNA, 22 bp, Homo sapiens
tttcctcaactgtcaaatgggg

SEQ ID NO: 7449024 - DNA, 22 bp, Homo sapiens
tttcctatgatattctatgtgt

SEQ ID NO: 7449025 - DNA, 22 bp, Homo sapiens
tttcctcacacagaagatcttg

SEQ ID NO: 7449026 - DNA, 22 bp, Homo sapiens
tttcctcacacagaagatcttg

SEQ ID NO: 7449027 - DNA, 22 bp, Homo sapiens
tttcctcaactgtcaaatgggg

SEQ ID NO: 7449028 - DNA, 22 bp, Homo sapiens
tttcctcacacagaagatcttg

SEQ ID NO: 7449029 - DNA, 22 bp, Homo sapiens
tttcctcacacagaagatcttg

SEQ ID NO: 7449030 - DNA, 22 bp, Homo sapiens
ctctccaggagagcactttgag

SEQ ID NO: 7449031 - DNA, 22 bp, Homo sapiens
ctctccaggagctcagagtcta

SEQ ID NO: 7449032 - DNA, 22 bp, Homo sapiens
ctctccaggagctcagagtcta

SEQ ID NO: 7449033 - DNA, 22 bp, Homo sapiens
ctctccaggagctcagagtcta

SEQ ID NO: 7449034 - DNA, 22 bp, Homo sapiens
tttcctcactcatgtcatcagt

SEQ ID NO: 7449035 - DNA, 22 bp, Homo sapiens
tttcctcactcatgtcatcagt

SEQ ID NO: 7449036 - DNA, 22 bp, Homo sapiens
tttcctcactcatgtcatcagt

SEQ ID NO: 7449037 - DNA, 22 bp, Homo sapiens
tttcctcactcatgtcatcagt

SEQ ID NO: 7449038 - DNA, 22 bp, Homo sapiens
ctctccaggctgggacaggacc

SEQ ID NO: 7449039 - DNA, 22 bp, Homo sapiens
ctctccagggaagcagtgtact

SEQ ID NO: 7449040 - DNA, 22 bp, Homo sapiens
ctctccagggaagcagtgtact

SEQ ID NO: 7449041 - DNA, 22 bp, Homo sapiens
ctctccaggctgggacaggacc

SEQ ID NO: 7449042 - DNA, 22 bp, Homo sapiens
ctctccaggctgggacaggacc

SEQ ID NO: 7449043 - DNA, 22 bp, Homo sapiens
ctctccaggctgggacaggacc

SEQ ID NO: 7449044 - DNA, 22 bp, Homo sapiens
ctctccaggcgaggtcctactg

SEQ ID NO: 7449045 - DNA, 22 bp, Homo sapiens
ctctccaggcgaggtcctactg

SEQ ID NO: 7449046 - DNA, 22 bp, Homo sapiens
ctctccaggcgaggtcctactg

SEQ ID NO: 7449047 - DNA, 22 bp, Homo sapiens
ctctccaggcgaggtcctactg

SEQ ID NO: 7449048 - DNA, 22 bp, Homo sapiens
ctctccaggagctcagagtcta

SEQ ID NO: 7449049 - DNA, 22 bp, Homo sapiens
tttagtagaatagtatatcaaa

SEQ ID NO: 7449050 - DNA, 22 bp, Homo sapiens
tttagtagaatagtatatcaaa

SEQ ID NO: 7449051 - DNA, 22 bp, Homo sapiens
tttagtagaatagtatatcaaa

SEQ ID NO: 7449052 - DNA, 22 bp, Homo sapiens
tttagtactgtttaaaaatgga

SEQ ID NO: 7449053 - DNA, 22 bp, Homo sapiens
tttagtactgtttaaaaatgga

SEQ ID NO: 7449054 - DNA, 22 bp, Homo sapiens
tttagtaagttcactgcaaagc

SEQ ID NO: 7449055 - DNA, 22 bp, Homo sapiens
tttagtaccatcatttgcctct

SEQ ID NO: 7449056 - DNA, 22 bp, Homo sapiens
tttagtaagttcactgcaaagc

SEQ ID NO: 7449057 - DNA, 22 bp, Homo sapiens
tttagtaccatcatttgcctct

SEQ ID NO: 7449058 - DNA, 22 bp, Homo sapiens
tttagtatataaaaagagaagt

SEQ ID NO: 7449059 - DNA, 22 bp, Homo sapiens
tttagtatataaaaagagaagt

SEQ ID NO: 7449060 - DNA, 22 bp, Homo sapiens
tttagtatataaaaagagaagt

SEQ ID NO: 7449061 - DNA, 22 bp, Homo sapiens
tttagtaggaaattgtcttata

SEQ ID NO: 7449062 - DNA, 22 bp, Homo sapiens
tttaggcttggtgatattctta

SEQ ID NO: 7449063 - DNA, 22 bp, Homo sapiens
tttaggctcaaaagagttggtg

SEQ ID NO: 7449064 - DNA, 22 bp, Homo sapiens
tttaggctgcagcagggatgga

SEQ ID NO: 7449065 - DNA, 22 bp, Homo sapiens
tttaggcattgaattagaatag

SEQ ID NO: 7449066 - DNA, 22 bp, Homo sapiens
tttaggcattgaattagaatag

SEQ ID NO: 7449067 - DNA, 22 bp, Homo sapiens
tttaggcatgcagttctattta

SEQ ID NO: 7449068 - DNA, 22 bp, Homo sapiens
tttaggtcttcttaagagtcaa

SEQ ID NO: 7449069 - DNA, 20 bp, Homo sapiens
tttaggtcctgtgcctgggt

SEQ ID NO: 7449070 - DNA, 22 bp, Homo sapiens
tttaggtgtgtttggattgaga

SEQ ID NO: 7449071 - DNA, 22 bp, Homo sapiens
tttaggttaatcaacaaacatt

SEQ ID NO: 7449072 - DNA, 22 bp, Homo sapiens
tttagggtgatgtatgtgcagc

SEQ ID NO: 7449073 - DNA, 22 bp, Homo sapiens
tttaggttttttcacgtggcta

SEQ ID NO: 7449074 - DNA, 22 bp, Homo sapiens
tttaggttcttggaatcagtct

SEQ ID NO: 7449075 - DNA, 22 bp, Homo sapiens
tttaggttaatcaacaaacatt

SEQ ID NO: 7449076 - DNA, 22 bp, Homo sapiens
tttagtgataagaattatgaaa

SEQ ID NO: 7449077 - DNA, 22 bp, Homo sapiens
tttagtgataagaattatgaaa

SEQ ID NO: 7449078 - DNA, 22 bp, Homo sapiens
tttagtgattcatttagaaaaa

SEQ ID NO: 7449079 - DNA, 23 bp, Homo sapiens
tttagtgatctcgtgtttttagc

SEQ ID NO: 7449080 - DNA, 23 bp, Homo sapiens
tttagtgatctcgtgtttttagc

SEQ ID NO: 7449081 - DNA, 22 bp, Homo sapiens
tttagtgattcatttagaaaaa

SEQ ID NO: 7449082 - DNA, 22 bp, Homo sapiens
tttagtgagtgtgaatcaaatg

SEQ ID NO: 7449083 - DNA, 23 bp, Homo sapiens
tttagtcagttgacagccatata

SEQ ID NO: 7449084 - DNA, 23 bp, Homo sapiens
tttagtcagttgacagccatata

SEQ ID NO: 7449085 - DNA, 22 bp, Homo sapiens
tttagtcatagatacccaaggt

SEQ ID NO: 7449086 - DNA, 22 bp, Homo sapiens
tttagtcatttggatttgatct

SEQ ID NO: 7449087 - DNA, 22 bp, Homo sapiens
tttagtcatttggatttgatct

SEQ ID NO: 7449088 - DNA, 22 bp, Homo sapiens
tttagtctaataaaagtggagt

SEQ ID NO: 7449089 - DNA, 22 bp, Homo sapiens
tttagtcaggtaagatgcaggg

SEQ ID NO: 7449090 - DNA, 22 bp, Homo sapiens
tttagtatgtatttaatggact

SEQ ID NO: 7449091 - DNA, 22 bp, Homo sapiens
tttagtattctctatttccatc

SEQ ID NO: 7449092 - DNA, 22 bp, Homo sapiens
tttagtatcctatctcatttaa

SEQ ID NO: 7449093 - DNA, 19 bp, Homo sapiens
tttagtatgagctccaggg

SEQ ID NO: 7449094 - DNA, 22 bp, Homo sapiens
ctcctccacagagtccttgcca

SEQ ID NO: 7449095 - DNA, 22 bp, Homo sapiens
ctcctccacagacctactgaat

SEQ ID NO: 7449096 - DNA, 22 bp, Homo sapiens
ctcctcagttgtcccatggaga

SEQ ID NO: 7449097 - DNA, 22 bp, Homo sapiens
tttagtgcctgggccagttcca

SEQ ID NO: 7449098 - DNA, 18 bp, Homo sapiens
ctcctccacagcccctgc

SEQ ID NO: 7449099 - DNA, 18 bp, Homo sapiens
ctcctccacagcccctgc

SEQ ID NO: 7449100 - DNA, 22 bp, Homo sapiens
ctcctccacagacctactgaat

SEQ ID NO: 7449101 - DNA, 22 bp, Homo sapiens
ctcctccacagagtccttgcca

SEQ ID NO: 7449102 - DNA, 22 bp, Homo sapiens
ctcctccacagagtccttgcca

SEQ ID NO: 7449103 - DNA, 18 bp, Homo sapiens
ctcccctgttttccctgc

SEQ ID NO: 7449104 - DNA, 18 bp, Homo sapiens
ctcccctgttttccctgc

SEQ ID NO: 7449105 - DNA, 18 bp, Homo sapiens
ctcccctgttttccctgc

SEQ ID NO: 7449106 - DNA, 22 bp, Homo sapiens
ctcccctccttaggtcttctag

SEQ ID NO: 7449107 - DNA, 20 bp, Homo sapiens
ctcccctctacagagggctg

SEQ ID NO: 7449108 - DNA, 20 bp, Homo sapiens
ctcccctctacagagggctg

SEQ ID NO: 7449109 - DNA, 20 bp, Homo sapiens
ctcccctctacagagggctg

SEQ ID NO: 7449110 - DNA, 22 bp, Homo sapiens
ctccccttccgccagctcttga

SEQ ID NO: 7449111 - DNA, 22 bp, Homo sapiens
ctccccttcttgccagatcctt

SEQ ID NO: 7449112 - DNA, 22 bp, Homo sapiens
ctcccgaggcggccccggctcg

SEQ ID NO: 7449113 - DNA, 22 bp, Homo sapiens
ctcccgaggcggccccggctcg

SEQ ID NO: 7449114 - DNA, 22 bp, Homo sapiens
ctcccgagttcaagctattttc

SEQ ID NO: 7449115 - DNA, 22 bp, Homo sapiens
ctcccgaggagcctcagcgctc

SEQ ID NO: 7449116 - DNA, 22 bp, Homo sapiens
ctcccggcacttggcatgtcat

SEQ ID NO: 7449117 - DNA, 22 bp, Homo sapiens
ctcccgtgatcctggaggagag

SEQ ID NO: 7449118 - DNA, 22 bp, Homo sapiens
ctcccgtgatcctggaggagag

SEQ ID NO: 7449119 - DNA, 22 bp, Homo sapiens
ctcccgtggatgttcttcagtc

SEQ ID NO: 7449120 - DNA, 22 bp, Homo sapiens
ctccctcacaaagcattctctt

SEQ ID NO: 7449121 - DNA, 22 bp, Homo sapiens
ctccctcacaaagcattctctt

SEQ ID NO: 7449122 - DNA, 22 bp, Homo sapiens
ctccctcacaaagcattctctt

SEQ ID NO: 7449123 - DNA, 22 bp, Homo sapiens
ctccctcacaaagcattctctt

SEQ ID NO: 7449124 - DNA, 22 bp, Homo sapiens
tttagacatggcttgctcactt

SEQ ID NO: 7449125 - DNA, 22 bp, Homo sapiens
tttagacatttgtggtttgcaa

SEQ ID NO: 7449126 - DNA, 19 bp, Homo sapiens
tttagacattgtctggtat

SEQ ID NO: 7449127 - DNA, 22 bp, Homo sapiens
tttagacatttgtggtttgcaa

SEQ ID NO: 7449128 - DNA, 22 bp, Homo sapiens
tttagagaagttaggaaataaa

SEQ ID NO: 7449129 - DNA, 22 bp, Homo sapiens
tttagagaagttaggaaataaa

SEQ ID NO: 7449130 - DNA, 22 bp, Homo sapiens
tttagagaagttaggaaataaa

SEQ ID NO: 7449131 - DNA, 21 bp, Homo sapiens
tttagagaagacaatgggcat

SEQ ID NO: 7449132 - DNA, 21 bp, Homo sapiens
tttagagaatactcactattt

SEQ ID NO: 7449133 - DNA, 22 bp, Homo sapiens
tttaggcagtcattgaacaagt

SEQ ID NO: 7449134 - DNA, 22 bp, Homo sapiens
tttaggcagtcattgaacaagt

SEQ ID NO: 7449135 - DNA, 22 bp, Homo sapiens
tttaggcagtcattgaacaagt

SEQ ID NO: 7449136 - DNA, 22 bp, Homo sapiens
ctcccctccttaggtcttctag

SEQ ID NO: 7449137 - DNA, 22 bp, Homo sapiens
ctcccctccttaggtcttctag

SEQ ID NO: 7449138 - DNA, 22 bp, Homo sapiens
ctcccctagcccgttgggaggt

SEQ ID NO: 7449139 - DNA, 22 bp, Homo sapiens
ctcccctccttaggtcttctag

SEQ ID NO: 7449140 - DNA, 22 bp, Homo sapiens
ctcccctccttaggtcttctag

SEQ ID NO: 7449141 - DNA, 22 bp, Homo sapiens
ctcccccttagctcttgtcttt

SEQ ID NO: 7449142 - DNA, 22 bp, Homo sapiens
ctcccccttagctcttgtcttt

SEQ ID NO: 7449143 - DNA, 22 bp, Homo sapiens
ctcccccttagctcttgtcttt

SEQ ID NO: 7449144 - DNA, 22 bp, Homo sapiens
ctcccccttagctcttgtcttt

SEQ ID NO: 7449145 - DNA, 22 bp, Homo sapiens
ctccccccacagtgttcttgcc

SEQ ID NO: 7449146 - DNA, 17 bp, Homo sapiens
ctcccccccacgtgtcc

SEQ ID NO: 7449147 - DNA, 17 bp, Homo sapiens
ctcccccccacgtgtcc

SEQ ID NO: 7449148 - DNA, 22 bp, Homo sapiens
ctccccattgtgacctcatcca

SEQ ID NO: 7449149 - DNA, 22 bp, Homo sapiens
ctccccattgtgacctcatcca

SEQ ID NO: 7449150 - DNA, 22 bp, Homo sapiens
ctccccattgtgacctcatcca

SEQ ID NO: 7449151 - DNA, 22 bp, Homo sapiens
ctccccattgtgacctcatcca

SEQ ID NO: 7449152 - DNA, 22 bp, Homo sapiens
ctccccatggcaacagttatgg

SEQ ID NO: 7449153 - DNA, 22 bp, Homo sapiens
ctccccatggcaacagttatgg

SEQ ID NO: 7449154 - DNA, 22 bp, Homo sapiens
ctccccattatgcagtcattat

SEQ ID NO: 7449155 - DNA, 22 bp, Homo sapiens
ctccccatccaggcagcaggtg

SEQ ID NO: 7449156 - DNA, 23 bp, Homo sapiens
ctccccagtgtcctcatgcatct

SEQ ID NO: 7449157 - DNA, 23 bp, Homo sapiens
ctccccagtgtcctcatgcatct

SEQ ID NO: 7449158 - DNA, 22 bp, Homo sapiens
tttaatctattccctaaacacc

SEQ ID NO: 7449159 - DNA, 23 bp, Homo sapiens
ctccccagtgtcctcatgcatct

SEQ ID NO: 7449160 - DNA, 23 bp, Homo sapiens
ctccccagtgtcctcatgcatct

SEQ ID NO: 7449161 - DNA, 23 bp, Homo sapiens
ctccccagtgtcctcatgcatct

SEQ ID NO: 7449162 - DNA, 23 bp, Homo sapiens
ctccccagtgtcctcatgcatct

SEQ ID NO: 7449163 - DNA, 22 bp, Homo sapiens
tttaatcaggcaaagcataata

SEQ ID NO: 7449164 - DNA, 22 bp, Homo sapiens
tttaatcaggcaaagcataata

SEQ ID NO: 7449165 - DNA, 22 bp, Homo sapiens
tttaatcaggcaaagcataata

SEQ ID NO: 7449166 - DNA, 22 bp, Homo sapiens
tttaatcaggcaaagcataata

SEQ ID NO: 7449167 - DNA, 22 bp, Homo sapiens
tttaatcaggcaaagcataata

SEQ ID NO: 7449168 - DNA, 22 bp, Homo sapiens
tttaatcataagaaggaaaata

SEQ ID NO: 7449169 - DNA, 22 bp, Homo sapiens
tttaatcataagaaggaaaata

SEQ ID NO: 7449170 - DNA, 22 bp, Homo sapiens
tttaatcataagaaggaaaata

SEQ ID NO: 7449171 - DNA, 22 bp, Homo sapiens
tttaatcataagaaggaaaata

SEQ ID NO: 7449172 - DNA, 22 bp, Homo sapiens
tttaatcataagaaggaaaata

SEQ ID NO: 7449173 - DNA, 22 bp, Homo sapiens
tttaatcataagaaggaaaata

SEQ ID NO: 7449174 - DNA, 17 bp, Homo sapiens
ctcctggcagcctcagg

SEQ ID NO: 7449175 - DNA, 17 bp, Homo sapiens
ctcctggcagcctcagg

SEQ ID NO: 7449176 - DNA, 22 bp, Homo sapiens
ctcctggcaggctgagtgaaat

SEQ ID NO: 7449177 - DNA, 22 bp, Homo sapiens
ctcctggcaggctgagtgaaat

SEQ ID NO: 7449178 - DNA, 17 bp, Homo sapiens
ctcctggcagcctcagg

SEQ ID NO: 7449179 - DNA, 17 bp, Homo sapiens
ctcctggcagcctcagg

SEQ ID NO: 7449180 - DNA, 17 bp, Homo sapiens
ctcctggcagcctcagg

SEQ ID NO: 7449181 - DNA, 17 bp, Homo sapiens
ctcctggcagcctcagg

SEQ ID NO: 7449182 - DNA, 22 bp, Homo sapiens
ctcctggcactgtcttgaccca

SEQ ID NO: 7449183 - DNA, 22 bp, Homo sapiens
ctcctggcactgtcttgaccca

SEQ ID NO: 7449184 - DNA, 22 bp, Homo sapiens
ctcctggcagcaacatttatat

SEQ ID NO: 7449185 - DNA, 17 bp, Homo sapiens
ctcctggccacccctct

SEQ ID NO: 7449186 - DNA, 22 bp, Homo sapiens
ctcctggccacgttcttgctgg

SEQ ID NO: 7449187 - DNA, 17 bp, Homo sapiens
ctcctggccacccctct

SEQ ID NO: 7449188 - DNA, 22 bp, Homo sapiens
ctcctggcagttccccttgtca

SEQ ID NO: 7449189 - DNA, 22 bp, Homo sapiens
ctcctggcagttccccttgtca

SEQ ID NO: 7449190 - DNA, 22 bp, Homo sapiens
ctcctggcagttccccttgtca

SEQ ID NO: 7449191 - DNA, 22 bp, Homo sapiens
ctcctggcagttccccttgtca

SEQ ID NO: 7449192 - DNA, 22 bp, Homo sapiens
ctcctggccctgagctcccagg

SEQ ID NO: 7449193 - DNA, 22 bp, Homo sapiens
ctcctggccctgagctcccagg

SEQ ID NO: 7449194 - DNA, 22 bp, Homo sapiens
ctcctggccccagatcccaatc

SEQ ID NO: 7449195 - DNA, 22 bp, Homo sapiens
ctcctggccccagatcccaatc

SEQ ID NO: 7449196 - DNA, 22 bp, Homo sapiens
ctcctggccacgttcttgctgg

SEQ ID NO: 7449197 - DNA, 22 bp, Homo sapiens
ctcctggccacgttcttgctgg

SEQ ID NO: 7449198 - DNA, 22 bp, Homo sapiens
ctcctggccacgttcttgctgg

SEQ ID NO: 7449199 - DNA, 16 bp, Homo sapiens
tttatttactagtgtt

SEQ ID NO: 7449200 - DNA, 16 bp, Homo sapiens
tttatttactagtgtt

SEQ ID NO: 7449201 - DNA, 16 bp, Homo sapiens
tttatttactagtgtt

SEQ ID NO: 7449202 - DNA, 16 bp, Homo sapiens
tttatttactagtgtt

SEQ ID NO: 7449203 - DNA, 16 bp, Homo sapiens
tttatttactagtgtt

SEQ ID NO: 7449204 - DNA, 16 bp, Homo sapiens
tttatttactagtgtt

SEQ ID NO: 7449205 - DNA, 22 bp, Homo sapiens
tttatttaccttatgtcctcca

SEQ ID NO: 7449206 - DNA, 22 bp, Homo sapiens
tttatttaccttatgtcctcca

SEQ ID NO: 7449207 - DNA, 22 bp, Homo sapiens
tttatttaccttatgtcctcca

SEQ ID NO: 7449208 - DNA, 22 bp, Homo sapiens
tttatttaccttatgtcctcca

SEQ ID NO: 7449209 - DNA, 22 bp, Homo sapiens
ctcctggcactcagtgtggaag

SEQ ID NO: 7449210 - DNA, 22 bp, Homo sapiens
ctcctggcactcagtgtggaag

SEQ ID NO: 7449211 - DNA, 22 bp, Homo sapiens
ctcctggatgcaggctgtctgc

SEQ ID NO: 7449212 - DNA, 22 bp, Homo sapiens
ctcctggatgcaggctgtctgc

SEQ ID NO: 7449213 - DNA, 22 bp, Homo sapiens
ctcctggatgcaggctgtctgc

SEQ ID NO: 7449214 - DNA, 22 bp, Homo sapiens
ctcctggatgcaggctgtctgc

SEQ ID NO: 7449215 - DNA, 22 bp, Homo sapiens
tttatttaccttatgtcctcca

SEQ ID NO: 7449216 - DNA, 22 bp, Homo sapiens
tttatttaccttatgtcctcca

SEQ ID NO: 7449217 - DNA, 22 bp, Homo sapiens
tttatttaccttatgtcctcca

SEQ ID NO: 7449218 - DNA, 22 bp, Homo sapiens
tttatttaccttatgtcctcca

SEQ ID NO: 7449219 - DNA, 22 bp, Homo sapiens
tttatttaccttatgtcctcca

SEQ ID NO: 7449220 - DNA, 22 bp, Homo sapiens
tttatttaccttatgtcctcca

SEQ ID NO: 7449221 - DNA, 22 bp, Homo sapiens
tttatttaccttatgtcctcca

SEQ ID NO: 7449222 - DNA, 22 bp, Homo sapiens
tttatttaccttatgtcctcca

SEQ ID NO: 7449223 - DNA, 22 bp, Homo sapiens
tttatttaccttatgtcctcca

SEQ ID NO: 7449224 - DNA, 22 bp, Homo sapiens
tttatttaaagtcgtgtgttaa

SEQ ID NO: 7449225 - DNA, 22 bp, Homo sapiens
tttatttaaagtcgtgtgttaa

SEQ ID NO: 7449226 - DNA, 22 bp, Homo sapiens
tttatttaaagtcgtgtgttaa

SEQ ID NO: 7449227 - DNA, 22 bp, Homo sapiens
tttatttaaagtcgtgtgttaa

SEQ ID NO: 7449228 - DNA, 22 bp, Homo sapiens
tttatttaaagtcgtgtgttaa

SEQ ID NO: 7449229 - DNA, 22 bp, Homo sapiens
tttatttaaagtcgtgtgttaa

SEQ ID NO: 7449230 - DNA, 22 bp, Homo sapiens
tttatttaaagtcgtgtgttaa

SEQ ID NO: 7449231 - DNA, 22 bp, Homo sapiens
tttatttaaagtcgtgtgttaa

SEQ ID NO: 7449232 - DNA, 22 bp, Homo sapiens
tttatttaaagtcgtgtgttaa

SEQ ID NO: 7449233 - DNA, 22 bp, Homo sapiens
tttatttaaagtcgtgtgttaa

SEQ ID NO: 7449234 - DNA, 22 bp, Homo sapiens
tttattgtttagaagggggctg

SEQ ID NO: 7449235 - DNA, 22 bp, Homo sapiens
tttattgtttagaagggggctg

SEQ ID NO: 7449236 - DNA, 22 bp, Homo sapiens
tttattgtttagaagggggctg

SEQ ID NO: 7449237 - DNA, 22 bp, Homo sapiens
tttatttaaagtcgtgtgttaa

SEQ ID NO: 7449238 - DNA, 22 bp, Homo sapiens
tttatttaaagtcgtgtgttaa

SEQ ID NO: 7449239 - DNA, 22 bp, Homo sapiens
tttattgtttagaagggggctg

SEQ ID NO: 7449240 - DNA, 22 bp, Homo sapiens
tttattgtttagaagggggctg

SEQ ID NO: 7449241 - DNA, 22 bp, Homo sapiens
tttattgttgttagtcataagt

SEQ ID NO: 7449242 - DNA, 22 bp, Homo sapiens
tttattgttgttagtcataagt

SEQ ID NO: 7449243 - DNA, 22 bp, Homo sapiens
tttattgttgttagtcataagt

SEQ ID NO: 7449244 - DNA, 22 bp, Homo sapiens
tttattgttgttagtcataagt

SEQ ID NO: 7449245 - DNA, 22 bp, Homo sapiens
tttattgttgttagtcataagt

SEQ ID NO: 7449246 - DNA, 22 bp, Homo sapiens
tttattgttgggtcttaagctg

SEQ ID NO: 7449247 - DNA, 22 bp, Homo sapiens
tttattgttgggtcttaagctg

SEQ ID NO: 7449248 - DNA, 22 bp, Homo sapiens
tttattgttgttagtcataagt

SEQ ID NO: 7449249 - DNA, 22 bp, Homo sapiens
tttattgttgttagtcataagt

SEQ ID NO: 7449250 - DNA, 22 bp, Homo sapiens
tttattgttgttagtcataagt

SEQ ID NO: 7449251 - DNA, 22 bp, Homo sapiens
tttattgttgttagtcataagt

SEQ ID NO: 7449252 - DNA, 22 bp, Homo sapiens
tttattgttgttagtcataagt

SEQ ID NO: 7449253 - DNA, 22 bp, Homo sapiens
tttattgtgttgaaactgaatt

SEQ ID NO: 7449254 - DNA, 22 bp, Homo sapiens
tttattgttatcatgggtgagt

SEQ ID NO: 7449255 - DNA, 22 bp, Homo sapiens
tttattgttatcatgggtgagt

SEQ ID NO: 7449256 - DNA, 22 bp, Homo sapiens
tttattgttatcatgggtgagt

SEQ ID NO: 7449257 - DNA, 22 bp, Homo sapiens
tttattgttgggtcttaagctg

SEQ ID NO: 7449258 - DNA, 22 bp, Homo sapiens
tttattgttatcatgggtgagt

SEQ ID NO: 7449259 - DNA, 22 bp, Homo sapiens
tttattgttgggtcttaagctg

SEQ ID NO: 7449260 - DNA, 22 bp, Homo sapiens
tttattgttgggtcttaagctg

SEQ ID NO: 7449261 - DNA, 22 bp, Homo sapiens
tttattgttgggtcttaagctg

SEQ ID NO: 7449262 - DNA, 22 bp, Homo sapiens
tttattgttgggtcttaagctg

SEQ ID NO: 7449263 - DNA, 22 bp, Homo sapiens
tttattgtgttgaaactgaatt

SEQ ID NO: 7449264 - DNA, 22 bp, Homo sapiens
tttattctaacttgctgctcta

SEQ ID NO: 7449265 - DNA, 18 bp, Homo sapiens
tttattcctgcccccagc

SEQ ID NO: 7449266 - DNA, 22 bp, Homo sapiens
tttattctaacttgctgctcta

SEQ ID NO: 7449267 - DNA, 22 bp, Homo sapiens
tttattctaacttgctgctcta

SEQ ID NO: 7449268 - DNA, 18 bp, Homo sapiens
tttattcctgcccccagc

SEQ ID NO: 7449269 - DNA, 22 bp, Homo sapiens
tttattccatgtgtctatgacc

SEQ ID NO: 7449270 - DNA, 22 bp, Homo sapiens
tttattccatgtgtctatgacc

SEQ ID NO: 7449271 - DNA, 22 bp, Homo sapiens
tttattccatgtgtctatgacc

SEQ ID NO: 7449272 - DNA, 22 bp, Homo sapiens
tttattccatgtgtctatgacc

SEQ ID NO: 7449273 - DNA, 22 bp, Homo sapiens
tttattccatgtgtctatgacc

SEQ ID NO: 7449274 - DNA, 22 bp, Homo sapiens
ctcctcccaattgccaagtgct

SEQ ID NO: 7449275 - DNA, 22 bp, Homo sapiens
ctcctcccaattgccaagtgct

SEQ ID NO: 7449276 - DNA, 22 bp, Homo sapiens
ctcctcccaattgccaagtgct

SEQ ID NO: 7449277 - DNA, 22 bp, Homo sapiens
ctcctcccaattgccaagtgct

SEQ ID NO: 7449278 - DNA, 22 bp, Homo sapiens
tttattccagtgtttctcaaat

SEQ ID NO: 7449279 - DNA, 22 bp, Homo sapiens
ctcctcccaattgccaagtgct

SEQ ID NO: 7449280 - DNA, 22 bp, Homo sapiens
ctcctcccaattgccaagtgct

SEQ ID NO: 7449281 - DNA, 22 bp, Homo sapiens
ctcctccagtgggtccctcagg

SEQ ID NO: 7449282 - DNA, 22 bp, Homo sapiens
ctcctccagtgggtccctcagg

SEQ ID NO: 7449283 - DNA, 22 bp, Homo sapiens
ctcctccagtgggtccctcagg

SEQ ID NO: 7449284 - DNA, 22 bp, Homo sapiens
ctcctccagtgggtccctcagg

SEQ ID NO: 7449285 - DNA, 22 bp, Homo sapiens
ctcctccagtgggtccctcagg

SEQ ID NO: 7449286 - DNA, 22 bp, Homo sapiens
ctcctccagtgggtccctcagg

SEQ ID NO: 7449287 - DNA, 22 bp, Homo sapiens
ctcctccagcttccagtggctc

SEQ ID NO: 7449288 - DNA, 22 bp, Homo sapiens
ctcctccagtcctccaaggaca

SEQ ID NO: 7449289 - DNA, 22 bp, Homo sapiens
ctcctccactaggcaaaatgtg

SEQ ID NO: 7449290 - DNA, 22 bp, Homo sapiens
ctcctccactaggcaaaatgtg

SEQ ID NO: 7449291 - DNA, 22 bp, Homo sapiens
ctcctccacccgctggggccca

SEQ ID NO: 7449292 - DNA, 22 bp, Homo sapiens
ctcctccagcttccagtggctc

SEQ ID NO: 7449293 - DNA, 22 bp, Homo sapiens
ctcctccagctctccctggggg

SEQ ID NO: 7449294 - DNA, 22 bp, Homo sapiens
ctcctccagcttccagtggctc

SEQ ID NO: 7449295 - DNA, 22 bp, Homo sapiens
ctcctccagctctccctggggg

SEQ ID NO: 7449296 - DNA, 22 bp, Homo sapiens
ctcctccagctctccctggggg

SEQ ID NO: 7449297 - DNA, 22 bp, Homo sapiens
ctccacagttgctgcttttaat

SEQ ID NO: 7449298 - DNA, 22 bp, Homo sapiens
ctccacagttgctgcttttaat

SEQ ID NO: 7449299 - DNA, 22 bp, Homo sapiens
ctccacagttgctgcttttaat

SEQ ID NO: 7449300 - DNA, 22 bp, Homo sapiens
ctccaccacacatctgtccacc

SEQ ID NO: 7449301 - DNA, 22 bp, Homo sapiens
ctccaccacacatctgtccacc

SEQ ID NO: 7449302 - DNA, 22 bp, Homo sapiens
ctccaccccgtgccggtgctgg

SEQ ID NO: 7449303 - DNA, 22 bp, Homo sapiens
ctccaccacacatctgtccacc

SEQ ID NO: 7449304 - DNA, 22 bp, Homo sapiens
ctccacccaaatctcaccttga

SEQ ID NO: 7449305 - DNA, 22 bp, Homo sapiens
ttggtcagatgtgtctcctcct

SEQ ID NO: 7449306 - DNA, 22 bp, Homo sapiens
ctccactcaacaagcccagtgt

SEQ ID NO: 7449307 - DNA, 22 bp, Homo sapiens
ctccactcaacaagcccagtgt

SEQ ID NO: 7449308 - DNA, 22 bp, Homo sapiens
ctccacggcccattgggcagga

SEQ ID NO: 7449309 - DNA, 22 bp, Homo sapiens
ctccaccccgtgccggtgctgg

SEQ ID NO: 7449310 - DNA, 22 bp, Homo sapiens
ttggtcagctaataaggacagg

SEQ ID NO: 7449311 - DNA, 22 bp, Homo sapiens
ttgtaattaatggcagcaatta

SEQ ID NO: 7449312 - DNA, 22 bp, Homo sapiens
ttggtcagctaataaggacagg

SEQ ID NO: 7449313 - DNA, 22 bp, Homo sapiens
ttgtaattaatggcagcaatta

SEQ ID NO: 7449314 - DNA, 22 bp, Homo sapiens
ttgtaattaatggcagcaatta

SEQ ID NO: 7449315 - DNA, 22 bp, Homo sapiens
ttgtaattactccaggggtaaa

SEQ ID NO: 7449316 - DNA, 22 bp, Homo sapiens
ttgtaattagtttttgatctgg

SEQ ID NO: 7449317 - DNA, 22 bp, Homo sapiens
ttgtaattagtttttgatctgg

SEQ ID NO: 7449318 - DNA, 22 bp, Homo sapiens
ttgtaatttgcaaatgtattgt

SEQ ID NO: 7449319 - DNA, 22 bp, Homo sapiens
ttgtaatttgcaaatgtattgt

SEQ ID NO: 7449320 - DNA, 22 bp, Homo sapiens
ttgtaatttgcaaatgtattgt

SEQ ID NO: 7449321 - DNA, 22 bp, Homo sapiens
ttgtaattgggtggtttgggac

SEQ ID NO: 7449322 - DNA, 22 bp, Homo sapiens
ttgtaattggacagccatcagg

SEQ ID NO: 7449323 - DNA, 22 bp, Homo sapiens
ttgtaattgaacccttaggctt

SEQ ID NO: 7449324 - DNA, 22 bp, Homo sapiens
ttgtacaaagatttcacagctc

SEQ ID NO: 7449325 - DNA, 22 bp, Homo sapiens
ttgtacaaagatttcacagctc

SEQ ID NO: 7449326 - DNA, 22 bp, Homo sapiens
ttgtacaaagatttcacagctc

SEQ ID NO: 7449327 - DNA, 22 bp, Homo sapiens
ttgtaatttttcatggtatcac

SEQ ID NO: 7449328 - DNA, 22 bp, Homo sapiens
ttgtaatttgttcccaagcaga

SEQ ID NO: 7449329 - DNA, 22 bp, Homo sapiens
ttgtaatttgttcccaagcaga

SEQ ID NO: 7449330 - DNA, 22 bp, Homo sapiens
ttgtacaaataggaacctctga

SEQ ID NO: 7449331 - DNA, 22 bp, Homo sapiens
ttgtacaaataggaacctctga

SEQ ID NO: 7449332 - DNA, 22 bp, Homo sapiens
ttgtacaaataggaacctctga

SEQ ID NO: 7449333 - DNA, 22 bp, Homo sapiens
ttgtacaaagatttcacagctc

SEQ ID NO: 7449334 - DNA, 22 bp, Homo sapiens
ttgtacaaaggatttggaagag

SEQ ID NO: 7449335 - DNA, 22 bp, Homo sapiens
ttgtacaaaggatttggaagag

SEQ ID NO: 7449336 - DNA, 22 bp, Homo sapiens
ttgtacaaaggatttggaagag

SEQ ID NO: 7449337 - DNA, 22 bp, Homo sapiens
ttgtacaaaggatttggaagag

SEQ ID NO: 7449338 - DNA, 22 bp, Homo sapiens
ttgtacaacacatattctacag

SEQ ID NO: 7449339 - DNA, 22 bp, Homo sapiens
ttgtacaacacatattctacag

SEQ ID NO: 7449340 - DNA, 22 bp, Homo sapiens
ttgtacaaatgcatattcctgg

SEQ ID NO: 7449341 - DNA, 22 bp, Homo sapiens
ttgtacaacacatattctacag

SEQ ID NO: 7449342 - DNA, 22 bp, Homo sapiens
ttgtacaacacatattctacag

SEQ ID NO: 7449343 - DNA, 22 bp, Homo sapiens
ttgtacaacacatattctacag

SEQ ID NO: 7449344 - DNA, 22 bp, Homo sapiens
ttgtacaacacatattctacag

SEQ ID NO: 7449345 - DNA, 22 bp, Homo sapiens
ttgtacaaatgcatattcctgg

SEQ ID NO: 7449346 - DNA, 22 bp, Homo sapiens
ttgtacaaatgcatattcctgg

SEQ ID NO: 7449347 - DNA, 22 bp, Homo sapiens
ttgtacaaatgcatattcctgg

SEQ ID NO: 7449348 - DNA, 22 bp, Homo sapiens
ttgtacaacgttttaaatttga

SEQ ID NO: 7449349 - DNA, 22 bp, Homo sapiens
ttgtacaacgttttaaatttga

SEQ ID NO: 7449350 - DNA, 22 bp, Homo sapiens
ttgtacaacgttttaaatttga

SEQ ID NO: 7449351 - DNA, 22 bp, Homo sapiens
ttgtacaacgttttaaatttga

SEQ ID NO: 7449352 - DNA, 22 bp, Homo sapiens
ttgtacaacgttttaaatttga

SEQ ID NO: 7449353 - DNA, 22 bp, Homo sapiens
ttgtacaacgttttaaatttga

SEQ ID NO: 7449354 - DNA, 22 bp, Homo sapiens
ttgtacaacgttttaaatttga

SEQ ID NO: 7449355 - DNA, 22 bp, Homo sapiens
ttgtacaacgttttaaatttga

SEQ ID NO: 7449356 - DNA, 22 bp, Homo sapiens
ctccagattccgtttattcagg

SEQ ID NO: 7449357 - DNA, 22 bp, Homo sapiens
ctccagattcctgctggcagaa

SEQ ID NO: 7449358 - DNA, 22 bp, Homo sapiens
ctccagattcctgctggcagaa

SEQ ID NO: 7449359 - DNA, 22 bp, Homo sapiens
ctccagattccgtttattcagg

SEQ ID NO: 7449360 - DNA, 22 bp, Homo sapiens
ctccagcagaaagggcgagtgg

SEQ ID NO: 7449361 - DNA, 22 bp, Homo sapiens
ctccagcagaaagggcgagtgg

SEQ ID NO: 7449362 - DNA, 22 bp, Homo sapiens
ctccagcagaaagggcgagtgg

SEQ ID NO: 7449363 - DNA, 22 bp, Homo sapiens
ctccagattctggatgactggg

SEQ ID NO: 7449364 - DNA, 22 bp, Homo sapiens
ctccagattctggatgactggg

SEQ ID NO: 7449365 - DNA, 22 bp, Homo sapiens
ctccagattcctgctggcagaa

SEQ ID NO: 7449366 - DNA, 22 bp, Homo sapiens
ctccagattctggatgactggg

SEQ ID NO: 7449367 - DNA, 22 bp, Homo sapiens
ctccagatccagctgagctgca

SEQ ID NO: 7449368 - DNA, 22 bp, Homo sapiens
ctccagattccgtttattcagg

SEQ ID NO: 7449369 - DNA, 22 bp, Homo sapiens
ctccagattccgtttattcagg

SEQ ID NO: 7449370 - DNA, 22 bp, Homo sapiens
ctccagattccgtttattcagg

SEQ ID NO: 7449371 - DNA, 22 bp, Homo sapiens
ctccagattccgtttattcagg

SEQ ID NO: 7449372 - DNA, 22 bp, Homo sapiens
ctccagattccgtttattcagg

SEQ ID NO: 7449373 - DNA, 22 bp, Homo sapiens
ttgtacaagtattatgtgaaca

SEQ ID NO: 7449374 - DNA, 22 bp, Homo sapiens
ttgtacaagtattatgtgaaca

SEQ ID NO: 7449375 - DNA, 22 bp, Homo sapiens
ctccagatccagctgagctgca

SEQ ID NO: 7449376 - DNA, 22 bp, Homo sapiens
ctccagatccagctgagctgca

SEQ ID NO: 7449377 - DNA, 22 bp, Homo sapiens
ttgtacaagtattatgtgaaca

SEQ ID NO: 7449378 - DNA, 22 bp, Homo sapiens
ttgtacaagtattatgtgaaca

SEQ ID NO: 7449379 - DNA, 22 bp, Homo sapiens
ttgtacaagtattatgtgaaca

SEQ ID NO: 7449380 - DNA, 22 bp, Homo sapiens
ttgtacaagtattatgtgaaca

SEQ ID NO: 7449381 - DNA, 22 bp, Homo sapiens
ttgtacaagtattatgtgaaca

SEQ ID NO: 7449382 - DNA, 22 bp, Homo sapiens
ctccacagagatgctgattgta

SEQ ID NO: 7449383 - DNA, 22 bp, Homo sapiens
ctccacagagatgctgattgta

SEQ ID NO: 7449384 - DNA, 22 bp, Homo sapiens
ctccacagagatgctgattgta

SEQ ID NO: 7449385 - DNA, 20 bp, Homo sapiens
ctccacacctgttcgcaggc

SEQ ID NO: 7449386 - DNA, 19 bp, Homo sapiens
ctccaagttaagagggagg

SEQ ID NO: 7449387 - DNA, 22 bp, Homo sapiens
ctccacagcccctccagtggca

SEQ ID NO: 7449388 - DNA, 22 bp, Homo sapiens
ctccacagcccctccagtggca

SEQ ID NO: 7449389 - DNA, 22 bp, Homo sapiens
ctccacagcccctccagtggca

SEQ ID NO: 7449390 - DNA, 22 bp, Homo sapiens
ctccacagcccctccagtggca

SEQ ID NO: 7449391 - DNA, 22 bp, Homo sapiens
ctccacagcccctccagtggca

SEQ ID NO: 7449392 - DNA, 22 bp, Homo sapiens
ctccacagcccctccagtggca

SEQ ID NO: 7449393 - DNA, 22 bp, Homo sapiens
ctccacagcccctccagtggca

SEQ ID NO: 7449394 - DNA, 22 bp, Homo sapiens
ctccacagagcatgcttatagg

SEQ ID NO: 7449395 - DNA, 22 bp, Homo sapiens
ctccacagagcatgcttatagg

SEQ ID NO: 7449396 - DNA, 22 bp, Homo sapiens
ctccaaggtttcagaacaaatg

SEQ ID NO: 7449397 - DNA, 22 bp, Homo sapiens
ctccaaggttttccctgtcctt

SEQ ID NO: 7449398 - DNA, 22 bp, Homo sapiens
ctccaaggttttccctgtcctt

SEQ ID NO: 7449399 - DNA, 22 bp, Homo sapiens
ctccaaggttttccctgtcctt

SEQ ID NO: 7449400 - DNA, 22 bp, Homo sapiens
ctccaagtatgttaaaatctaa

SEQ ID NO: 7449401 - DNA, 19 bp, Homo sapiens
ctccaagtgccaaggacag

SEQ ID NO: 7449402 - DNA, 19 bp, Homo sapiens
ctccaagtgccaaggacag

SEQ ID NO: 7449403 - DNA, 22 bp, Homo sapiens
ctccacagctcaggctcagagt

SEQ ID NO: 7449404 - DNA, 22 bp, Homo sapiens
ctccacagctcaggctcagagt

SEQ ID NO: 7449405 - DNA, 22 bp, Homo sapiens
ctccacagctcaggctcagagt

SEQ ID NO: 7449406 - DNA, 22 bp, Homo sapiens
ctccacagctcaggctcagagt

SEQ ID NO: 7449407 - DNA, 22 bp, Homo sapiens
ctccacagctcaggctcagagt

SEQ ID NO: 7449408 - DNA, 22 bp, Homo sapiens
ctccacagcccctccagtggca

SEQ ID NO: 7449409 - DNA, 22 bp, Homo sapiens
ctccacagcccctccagtggca

SEQ ID NO: 7449410 - DNA, 22 bp, Homo sapiens
ctccacagcccctccagtggca

SEQ ID NO: 7449411 - DNA, 22 bp, Homo sapiens
ctccacagcccctccagtggca

SEQ ID NO: 7449412 - DNA, 22 bp, Homo sapiens
ctccacagcccctccagtggca

SEQ ID NO: 7449413 - DNA, 22 bp, Homo sapiens
ctccacagcccctccagtggca

SEQ ID NO: 7449414 - DNA, 19 bp, Homo sapiens
ctccacagggattgtgatt

SEQ ID NO: 7449415 - DNA, 22 bp, Homo sapiens
ctccacagctcaggctcagagt

SEQ ID NO: 7449416 - DNA, 22 bp, Homo sapiens
ctccacagctgtaaatataggg

SEQ ID NO: 7449417 - DNA, 19 bp, Homo sapiens
ctccacagggattgtgatt

SEQ ID NO: 7449418 - DNA, 22 bp, Homo sapiens
ctccacaggtggtgtttgcttc

SEQ ID NO: 7449419 - DNA, 19 bp, Homo sapiens
ctccacagggattgtgatt

SEQ ID NO: 7449420 - DNA, 22 bp, Homo sapiens
ctccacaggtgtactgtacctt

SEQ ID NO: 7449421 - DNA, 22 bp, Homo sapiens
ctccacaggtgtactgtacctt

SEQ ID NO: 7449422 - DNA, 19 bp, Homo sapiens
ctccacagggattgtgatt

SEQ ID NO: 7449423 - DNA, 22 bp, Homo sapiens
ctccacaggtgtactgtacctt

SEQ ID NO: 7449424 - DNA, 22 bp, Homo sapiens
ctccacaggtgtactgtacctt

SEQ ID NO: 7449425 - DNA, 22 bp, Homo sapiens
ctccaaggaagccccaagggat

SEQ ID NO: 7449426 - DNA, 22 bp, Homo sapiens
ctccaaggaagccccaagggat

SEQ ID NO: 7449427 - DNA, 22 bp, Homo sapiens
ctccaaggaagccccaagggat

SEQ ID NO: 7449428 - DNA, 22 bp, Homo sapiens
ctccaaggaagccccaagggat

SEQ ID NO: 7449429 - DNA, 22 bp, Homo sapiens
ctccaagaggctataaaggcag

SEQ ID NO: 7449430 - DNA, 22 bp, Homo sapiens
ctccaagaggctataaaggcag

SEQ ID NO: 7449431 - DNA, 22 bp, Homo sapiens
ctccaacgaggctggggtacaa

SEQ ID NO: 7449432 - DNA, 22 bp, Homo sapiens
ctccaactgatctcacagcaga

SEQ ID NO: 7449433 - DNA, 22 bp, Homo sapiens
ctccaactgatctcacagcaga

SEQ ID NO: 7449434 - DNA, 22 bp, Homo sapiens
ctccaacgaggctggggtacaa

SEQ ID NO: 7449435 - DNA, 22 bp, Homo sapiens
ctccaacgaggctggggtacaa

SEQ ID NO: 7449436 - DNA, 22 bp, Homo sapiens
ctccaacgaggctggggtacaa

SEQ ID NO: 7449437 - DNA, 22 bp, Homo sapiens
ctccaaattcagtcacagtctg

SEQ ID NO: 7449438 - DNA, 22 bp, Homo sapiens
ctccaaattcagtcacagtctg

SEQ ID NO: 7449439 - DNA, 22 bp, Homo sapiens
ctccaaggctaggagcatgttc

SEQ ID NO: 7449440 - DNA, 23 bp, Homo sapiens
ctccaaggcccaactgtctaggc

SEQ ID NO: 7449441 - DNA, 22 bp, Homo sapiens
ctccaaggctaggagcatgttc

SEQ ID NO: 7449442 - DNA, 22 bp, Homo sapiens
ctccaaggctaggagcatgttc

SEQ ID NO: 7449443 - DNA, 22 bp, Homo sapiens
ctccaaggctaggagcatgttc

SEQ ID NO: 7449444 - DNA, 23 bp, Homo sapiens
ctccaaggcccaactgtctaggc

SEQ ID NO: 7449445 - DNA, 22 bp, Homo sapiens
ctccaaggattctggacccttg

SEQ ID NO: 7449446 - DNA, 22 bp, Homo sapiens
ctccaaggattctggacccttg

SEQ ID NO: 7449447 - DNA, 22 bp, Homo sapiens
ctccaaggagaaatgggcaaca

SEQ ID NO: 7449448 - DNA, 22 bp, Homo sapiens
ctccaaggagaaatgggcaaca

SEQ ID NO: 7449449 - DNA, 22 bp, Homo sapiens
ctccaaggagaaatgggcaaca

SEQ ID NO: 7449450 - DNA, 22 bp, Homo sapiens
ctccaaggagaaatgggcaaca

SEQ ID NO: 7449451 - DNA, 22 bp, Homo sapiens
ctccaagggctcccagacgtct

SEQ ID NO: 7449452 - DNA, 22 bp, Homo sapiens
ctccaagggctcccagacgtct

SEQ ID NO: 7449453 - DNA, 22 bp, Homo sapiens
ctccaagggctcccagacgtct

SEQ ID NO: 7449454 - DNA, 23 bp, Homo sapiens
ctccaagggagggcaaacaacag

SEQ ID NO: 7449455 - DNA, 23 bp, Homo sapiens
ctccaagggagggcaaacaacag

SEQ ID NO: 7449456 - DNA, 22 bp, Homo sapiens
ctccaaggctctggtgctgagg

SEQ ID NO: 7449457 - DNA, 22 bp, Homo sapiens
ctccaaggctctggtgctgagg

SEQ ID NO: 7449458 - DNA, 20 bp, Homo sapiens
ctccaaggcttgcaggaggc

SEQ ID NO: 7449459 - DNA, 20 bp, Homo sapiens
ctccaaggcttgcaggaggc

SEQ ID NO: 7449460 - DNA, 20 bp, Homo sapiens
ctccaaggcttgcaggaggc

SEQ ID NO: 7449461 - DNA, 20 bp, Homo sapiens
ctccaaggcttgcaggaggc

SEQ ID NO: 7449462 - DNA, 22 bp, Homo sapiens
ctccaaggtttcagaacaaatg

SEQ ID NO: 7449463 - DNA, 22 bp, Homo sapiens
ctccaaggtggttatttgagat

SEQ ID NO: 7449464 - DNA, 18 bp, Homo sapiens
ctccaaggtctctggctt

SEQ ID NO: 7449465 - DNA, 18 bp, Homo sapiens
ctccaaggtctctggctt

SEQ ID NO: 7449466 - DNA, 18 bp, Homo sapiens
ctccaaggtctctggctt

SEQ ID NO: 7449467 - DNA, 22 bp, Homo sapiens
ctccaagggttgtgggtggtca

SEQ ID NO: 7449468 - DNA, 22 bp, Homo sapiens
ctccaagggtcttccaccagga

SEQ ID NO: 7449469 - DNA, 22 bp, Homo sapiens
ctccaagggtcttccaccagga

SEQ ID NO: 7449470 - DNA, 22 bp, Homo sapiens
ctccaagggtcttccaccagga

SEQ ID NO: 7449471 - DNA, 22 bp, Homo sapiens
ctccaagggtcttccaccagga

SEQ ID NO: 7449472 - DNA, 22 bp, Homo sapiens
ctccaagggtcttccaccagga

SEQ ID NO: 7449473 - DNA, 22 bp, Homo sapiens
ctcatttaacagattaaaaagt

SEQ ID NO: 7449474 - DNA, 22 bp, Homo sapiens
ctcatctgtctgggctggtttt

SEQ ID NO: 7449475 - DNA, 22 bp, Homo sapiens
ctcatctgtatatagtgaatga

SEQ ID NO: 7449476 - DNA, 22 bp, Homo sapiens
ctcatctgtatatagtgaatga

SEQ ID NO: 7449477 - DNA, 22 bp, Homo sapiens
ctcatctgtatatagtgaatga

SEQ ID NO: 7449478 - DNA, 22 bp, Homo sapiens
ttgaaatatcaagttattagtg

SEQ ID NO: 7449479 - DNA, 22 bp, Homo sapiens
ttgaaatagatgcgtcagagat

SEQ ID NO: 7449480 - DNA, 22 bp, Homo sapiens
ttgaaatatcaagttattagtg

SEQ ID NO: 7449481 - DNA, 22 bp, Homo sapiens
ttgaaatatcaagttattagtg

SEQ ID NO: 7449482 - DNA, 22 bp, Homo sapiens
ttgaaatactgcattgttcagt

SEQ ID NO: 7449483 - DNA, 22 bp, Homo sapiens
ttgaaatactgcattgttcagt

SEQ ID NO: 7449484 - DNA, 22 bp, Homo sapiens
ttgaaatactgcattgttcagt

SEQ ID NO: 7449485 - DNA, 22 bp, Homo sapiens
ttgaaatactgcattgttcagt

SEQ ID NO: 7449486 - DNA, 22 bp, Homo sapiens
ttgaaatactgcattgttcagt

SEQ ID NO: 7449487 - DNA, 22 bp, Homo sapiens
ttgaaagtctctgcatgtagga

SEQ ID NO: 7449488 - DNA, 22 bp, Homo sapiens
ttgaaagtctaggcttacagta

SEQ ID NO: 7449489 - DNA, 22 bp, Homo sapiens
ttgaaagtccttcttgagttac

SEQ ID NO: 7449490 - DNA, 22 bp, Homo sapiens
ttgaaagtagcagctgcatatg

SEQ ID NO: 7449491 - DNA, 22 bp, Homo sapiens
ttgaaagtcacaatggcattaa

SEQ ID NO: 7449492 - DNA, 22 bp, Homo sapiens
ttgaaagtgatggggaagatgg

SEQ ID NO: 7449493 - DNA, 22 bp, Homo sapiens
ttgaaatactgcattgttcagt

SEQ ID NO: 7449494 - DNA, 22 bp, Homo sapiens
ttgaaataaggaagctcgaaat

SEQ ID NO: 7449495 - DNA, 22 bp, Homo sapiens
ttgaaagtctctgcatgtagga

SEQ ID NO: 7449496 - DNA, 22 bp, Homo sapiens
ttgaaagtttatggagtctgca

SEQ ID NO: 7449497 - DNA, 22 bp, Homo sapiens
ttgaaataaggaagctcgaaat

SEQ ID NO: 7449498 - DNA, 22 bp, Homo sapiens
ttgaaataaggaagctcgaaat

SEQ ID NO: 7449499 - DNA, 22 bp, Homo sapiens
ctcatttactcatctgcaaaac

SEQ ID NO: 7449500 - DNA, 22 bp, Homo sapiens
ctcatttactcatctgcaaaac

SEQ ID NO: 7449501 - DNA, 22 bp, Homo sapiens
ctcatttactcatctgcaaaac

SEQ ID NO: 7449502 - DNA, 22 bp, Homo sapiens
ctcatttactactcatgtgacc

SEQ ID NO: 7449503 - DNA, 22 bp, Homo sapiens
ctcatttactactcatgtgacc

SEQ ID NO: 7449504 - DNA, 22 bp, Homo sapiens
ctcatttagggggcatggtaca

SEQ ID NO: 7449505 - DNA, 22 bp, Homo sapiens
ctcatttactgtagaacagtta

SEQ ID NO: 7449506 - DNA, 22 bp, Homo sapiens
ctcatttactcatctgcaaaac

SEQ ID NO: 7449507 - DNA, 22 bp, Homo sapiens
ctcatttactcatctgcaaaac

SEQ ID NO: 7449508 - DNA, 22 bp, Homo sapiens
ctcatttactgtagaacagtta

SEQ ID NO: 7449509 - DNA, 22 bp, Homo sapiens
ctcatttactgtagaacagtta

SEQ ID NO: 7449510 - DNA, 22 bp, Homo sapiens
ctcatttacctttgcaatcaag

SEQ ID NO: 7449511 - DNA, 22 bp, Homo sapiens
ctcatttacactatgggaacta

SEQ ID NO: 7449512 - DNA, 22 bp, Homo sapiens
ctcatttacctttgcaatcaag

SEQ ID NO: 7449513 - DNA, 22 bp, Homo sapiens
ctcatttacactatgggaacta

SEQ ID NO: 7449514 - DNA, 22 bp, Homo sapiens
ctcatttaacagattaaaaagt

SEQ ID NO: 7449515 - DNA, 22 bp, Homo sapiens
ctcatttaacagattaaaaagt

SEQ ID NO: 7449516 - DNA, 22 bp, Homo sapiens
ctcattgttgggctttgctgga

SEQ ID NO: 7449517 - DNA, 22 bp, Homo sapiens
ctcatttaacagattaaaaagt

SEQ ID NO: 7449518 - DNA, 22 bp, Homo sapiens
ctcatttatgtaatgattaagg

SEQ ID NO: 7449519 - DNA, 22 bp, Homo sapiens
ctcatttatgtaatgattaagg

SEQ ID NO: 7449520 - DNA, 22 bp, Homo sapiens
ctcatttatgtaatgattaagg

SEQ ID NO: 7449521 - DNA, 22 bp, Homo sapiens
ctcatttatttctcccaaaaca

SEQ ID NO: 7449522 - DNA, 21 bp, Homo sapiens
ctcatttatttttgtgtccaa

SEQ ID NO: 7449523 - DNA, 22 bp, Homo sapiens
ctcatttgttacaattcatact

SEQ ID NO: 7449524 - DNA, 22 bp, Homo sapiens
ctcatttgtaattagttctcag

SEQ ID NO: 7449525 - DNA, 22 bp, Homo sapiens
ctcatttgtaattagttctcag

SEQ ID NO: 7449526 - DNA, 22 bp, Homo sapiens
ctcatttgttacaattcatact

SEQ ID NO: 7449527 - DNA, 22 bp, Homo sapiens
ctccaaatataatcacattgga

SEQ ID NO: 7449528 - DNA, 22 bp, Homo sapiens
ctccaaatataatcacattgga

SEQ ID NO: 7449529 - DNA, 22 bp, Homo sapiens
ctccaaatacagtcatcttggg

SEQ ID NO: 7449530 - DNA, 22 bp, Homo sapiens
ctccaaatacaatattgttgtt

SEQ ID NO: 7449531 - DNA, 22 bp, Homo sapiens
ctccaaaggataaaagcagagt

SEQ ID NO: 7449532 - DNA, 22 bp, Homo sapiens
ctccaaaggataaaagcagagt

SEQ ID NO: 7449533 - DNA, 22 bp, Homo sapiens
ctcatttgttggcctagagtgg

SEQ ID NO: 7449534 - DNA, 22 bp, Homo sapiens
ttcttttaatttctgtctgcag

SEQ ID NO: 7449535 - DNA, 22 bp, Homo sapiens
ttcttttaatttctgtctgcag

SEQ ID NO: 7449536 - DNA, 22 bp, Homo sapiens
ttcttttaattgtgggggagtg

SEQ ID NO: 7449537 - DNA, 22 bp, Homo sapiens
ttcttttaatttctgtctgcag

SEQ ID NO: 7449538 - DNA, 22 bp, Homo sapiens
ttcttttaatttctgtctgcag

SEQ ID NO: 7449539 - DNA, 22 bp, Homo sapiens
ttcttttaatttctgtctgcag

SEQ ID NO: 7449540 - DNA, 22 bp, Homo sapiens
ttctttcttagcaatctatggt

SEQ ID NO: 7449541 - DNA, 22 bp, Homo sapiens
ttctttcttagcaatctatggt

SEQ ID NO: 7449542 - DNA, 22 bp, Homo sapiens
ttctttcttagcaatctatggt

SEQ ID NO: 7449543 - DNA, 22 bp, Homo sapiens
ttctttcttagcaatctatggt

SEQ ID NO: 7449544 - DNA, 22 bp, Homo sapiens
ttctttcttagcaatctatggt

SEQ ID NO: 7449545 - DNA, 22 bp, Homo sapiens
ctcacaggttagttgtgtggat

SEQ ID NO: 7449546 - DNA, 22 bp, Homo sapiens
ttctttctgtccataatgagac

SEQ ID NO: 7449547 - DNA, 22 bp, Homo sapiens
ctcacaggttagttgtgtggat

SEQ ID NO: 7449548 - DNA, 22 bp, Homo sapiens
ttcttttacattaagatttcag

SEQ ID NO: 7449549 - DNA, 22 bp, Homo sapiens
ttcttttacattaagatttcag

SEQ ID NO: 7449550 - DNA, 22 bp, Homo sapiens
ttcttttacattaagatttcag

SEQ ID NO: 7449551 - DNA, 22 bp, Homo sapiens
ttcttttacattaagatttcag

SEQ ID NO: 7449552 - DNA, 22 bp, Homo sapiens
ttcttttacattaagatttcag

SEQ ID NO: 7449553 - DNA, 22 bp, Homo sapiens
ttcttttacattaagatttcag

SEQ ID NO: 7449554 - DNA, 22 bp, Homo sapiens
ttcttttacattaagatttcag

SEQ ID NO: 7449555 - DNA, 22 bp, Homo sapiens
ttcttttagaatttcctaaggt

SEQ ID NO: 7449556 - DNA, 22 bp, Homo sapiens
ttcttttagaatttcctaaggt

SEQ ID NO: 7449557 - DNA, 22 bp, Homo sapiens
ttcttttacattaagatttcag

SEQ ID NO: 7449558 - DNA, 22 bp, Homo sapiens
ttcttttacattaagatttcag

SEQ ID NO: 7449559 - DNA, 22 bp, Homo sapiens
ttcttttagtcattcagggaag

SEQ ID NO: 7449560 - DNA, 22 bp, Homo sapiens
ttcttttcaagaggggcaagga

SEQ ID NO: 7449561 - DNA, 22 bp, Homo sapiens
ttcttttagtcattcagggaag

SEQ ID NO: 7449562 - DNA, 22 bp, Homo sapiens
ttcttttagaatttcctaaggt

SEQ ID NO: 7449563 - DNA, 22 bp, Homo sapiens
ttcttttagtcattcagggaag

SEQ ID NO: 7449564 - DNA, 22 bp, Homo sapiens
ttcttttagaatttcctaaggt

SEQ ID NO: 7449565 - DNA, 22 bp, Homo sapiens
ttcttttagaatttcctaaggt

SEQ ID NO: 7449566 - DNA, 22 bp, Homo sapiens
ttcttttagaatttcctaaggt

SEQ ID NO: 7449567 - DNA, 22 bp, Homo sapiens
ttcttttagaatttcctaaggt

SEQ ID NO: 7449568 - DNA, 22 bp, Homo sapiens
ttgaaaggtgacattgttagag

SEQ ID NO: 7449569 - DNA, 22 bp, Homo sapiens
ttgaaaggtgaacatgatgcac

SEQ ID NO: 7449570 - DNA, 22 bp, Homo sapiens
ttgaaaggtgaacatgatgcac

SEQ ID NO: 7449571 - DNA, 22 bp, Homo sapiens
ttgaaaggtgctgtgtgctgat

SEQ ID NO: 7449572 - DNA, 22 bp, Homo sapiens
ttgaaagtaataactttgttca

SEQ ID NO: 7449573 - DNA, 21 bp, Homo sapiens
ttgaaagtaaattcagcagct

SEQ ID NO: 7449574 - DNA, 22 bp, Homo sapiens
ttcttttcggcctgtgagaagg

SEQ ID NO: 7449575 - DNA, 22 bp, Homo sapiens
ttcttttcggcctgtgagaagg

SEQ ID NO: 7449576 - DNA, 23 bp, Homo sapiens
ttgaaaggtagctggcagctaga

SEQ ID NO: 7449577 - DNA, 23 bp, Homo sapiens
ttgaaaggtagctggcagctaga

SEQ ID NO: 7449578 - DNA, 22 bp, Homo sapiens
ttcttttcctgtggctcatcca

SEQ ID NO: 7449579 - DNA, 22 bp, Homo sapiens
ttcttttcggcctgtgagaagg

SEQ ID NO: 7449580 - DNA, 22 bp, Homo sapiens
ttcttttcggcctgtgagaagg

SEQ ID NO: 7449581 - DNA, 22 bp, Homo sapiens
ttcttttcctgtggctcatcca

SEQ ID NO: 7449582 - DNA, 18 bp, Homo sapiens
ttcttttcatgtgatctc

SEQ ID NO: 7449583 - DNA, 18 bp, Homo sapiens
ttcttttcatgtgatctc

SEQ ID NO: 7449584 - DNA, 18 bp, Homo sapiens
ttcttttcatgtgatctc

SEQ ID NO: 7449585 - DNA, 18 bp, Homo sapiens
ttcttttcatgtgatctc

SEQ ID NO: 7449586 - DNA, 22 bp, Homo sapiens
ttcttttcccaatattttgctg

SEQ ID NO: 7449587 - DNA, 22 bp, Homo sapiens
ttcttttcccaatattttgctg

SEQ ID NO: 7449588 - DNA, 22 bp, Homo sapiens
ttcttttcccaatattttgctg

SEQ ID NO: 7449589 - DNA, 22 bp, Homo sapiens
ttcttttcccaatattttgctg

SEQ ID NO: 7449590 - DNA, 22 bp, Homo sapiens
ttcttttcccaatattttgctg

SEQ ID NO: 7449591 - DNA, 22 bp, Homo sapiens
ttcttttcccaatattttgctg

SEQ ID NO: 7449592 - DNA, 22 bp, Homo sapiens
ttcttttcctacacagcgattt

SEQ ID NO: 7449593 - DNA, 22 bp, Homo sapiens
ttcttttcctacacagcgattt

SEQ ID NO: 7449594 - DNA, 22 bp, Homo sapiens
ttcttttcctgtggctcatcca

SEQ ID NO: 7449595 - DNA, 22 bp, Homo sapiens
ttcttttcctgtggctcatcca

SEQ ID NO: 7449596 - DNA, 22 bp, Homo sapiens
ttcttttcctacacagcgattt

SEQ ID NO: 7449597 - DNA, 22 bp, Homo sapiens
ttcttttcctacacagcgattt

SEQ ID NO: 7449598 - DNA, 22 bp, Homo sapiens
ttcttttcctacacagcgattt

SEQ ID NO: 7449599 - DNA, 19 bp, Homo sapiens
ttgtcttagctgcataaga

SEQ ID NO: 7449600 - DNA, 19 bp, Homo sapiens
ttgtcttagctgcataaga

SEQ ID NO: 7449601 - DNA, 19 bp, Homo sapiens
ttgtcttagctgcataaga

SEQ ID NO: 7449602 - DNA, 22 bp, Homo sapiens
ttgtctttcccagcttctagag

SEQ ID NO: 7449603 - DNA, 22 bp, Homo sapiens
ttgtcttattttatcataagca

SEQ ID NO: 7449604 - DNA, 22 bp, Homo sapiens
ttgtcttattttatcataagca

SEQ ID NO: 7449605 - DNA, 22 bp, Homo sapiens
ttgtcttaaatggatggacaat

SEQ ID NO: 7449606 - DNA, 22 bp, Homo sapiens
ttgtcttaccaaatatgatgca

SEQ ID NO: 7449607 - DNA, 22 bp, Homo sapiens
ttgtcttagagtgaaaacttta

SEQ ID NO: 7449608 - DNA, 22 bp, Homo sapiens
ttgtcttagagtgaaaacttta

SEQ ID NO: 7449609 - DNA, 22 bp, Homo sapiens
ttgtcttaaatggatggacaat

SEQ ID NO: 7449610 - DNA, 22 bp, Homo sapiens
ttgtcttaaatggatggacaat

SEQ ID NO: 7449611 - DNA, 22 bp, Homo sapiens
ttgtcttaaatggatggacaat

SEQ ID NO: 7449612 - DNA, 22 bp, Homo sapiens
ttgtctgtcccagcttgtgcat

SEQ ID NO: 7449613 - DNA, 22 bp, Homo sapiens
ttgtctgtcccagcttgtgcat

SEQ ID NO: 7449614 - DNA, 22 bp, Homo sapiens
ttgtctgtcccagcttgtgcat

SEQ ID NO: 7449615 - DNA, 22 bp, Homo sapiens
ttgtctgtgaaatggaaatagt

SEQ ID NO: 7449616 - DNA, 22 bp, Homo sapiens
ttgtctgtgaaatggaaatagt

SEQ ID NO: 7449617 - DNA, 23 bp, Homo sapiens
ttgtctgtgcttttccagttgct

SEQ ID NO: 7449618 - DNA, 22 bp, Homo sapiens
ttgtctgtgaaatggaaatagt

SEQ ID NO: 7449619 - DNA, 22 bp, Homo sapiens
ttgtcttaaatggatggacaat

SEQ ID NO: 7449620 - DNA, 23 bp, Homo sapiens
ttgtctgtgcttttccagttgct

SEQ ID NO: 7449621 - DNA, 23 bp, Homo sapiens
ttgtctgtgcttttccagttgct

SEQ ID NO: 7449622 - DNA, 22 bp, Homo sapiens
ttgtctttcccagcttctagag

SEQ ID NO: 7449623 - DNA, 22 bp, Homo sapiens
ttgtctttcccagcttctagag

SEQ ID NO: 7449624 - DNA, 22 bp, Homo sapiens
ttgtctttcccagcttctagag

SEQ ID NO: 7449625 - DNA, 22 bp, Homo sapiens
ttgtctttcccagcttctagag

SEQ ID NO: 7449626 - DNA, 22 bp, Homo sapiens
ttgtctttggaaatttaatgtt

SEQ ID NO: 7449627 - DNA, 22 bp, Homo sapiens
ttgtctttggaaatttaatgtt

SEQ ID NO: 7449628 - DNA, 22 bp, Homo sapiens
ttgtctttggaaatttaatgtt

SEQ ID NO: 7449629 - DNA, 22 bp, Homo sapiens
ttgtctttcccagcttctagag

SEQ ID NO: 7449630 - DNA, 22 bp, Homo sapiens
ttgtctttcccagcttctagag

SEQ ID NO: 7449631 - DNA, 22 bp, Homo sapiens
ttgtctttcccagcttctagag

SEQ ID NO: 7449632 - DNA, 22 bp, Homo sapiens
ttgtcttttgtgggaaatatgg

SEQ ID NO: 7449633 - DNA, 22 bp, Homo sapiens
ttgtcttttgtgggaaatatgg

SEQ ID NO: 7449634 - DNA, 22 bp, Homo sapiens
ttgtcttttgtgggaaatatgg

SEQ ID NO: 7449635 - DNA, 22 bp, Homo sapiens
ttgtcttttgtgggaaatatgg

SEQ ID NO: 7449636 - DNA, 22 bp, Homo sapiens
ttgtctttggaaatttaatgtt

SEQ ID NO: 7449637 - DNA, 22 bp, Homo sapiens
ttgtctttggaaatttaatgtt

SEQ ID NO: 7449638 - DNA, 22 bp, Homo sapiens
ttgtctttggaaatttaatgtt

SEQ ID NO: 7449639 - DNA, 22 bp, Homo sapiens
ctccagccagagtgcctctgtt

SEQ ID NO: 7449640 - DNA, 22 bp, Homo sapiens
ctccagcaggtgcgtctcagag

SEQ ID NO: 7449641 - DNA, 22 bp, Homo sapiens
ctccagccagagtgcctctgtt

SEQ ID NO: 7449642 - DNA, 22 bp, Homo sapiens
ctccagccagagtgcctctgtt

SEQ ID NO: 7449643 - DNA, 22 bp, Homo sapiens
ctccagcaggtgcgtctcagag

SEQ ID NO: 7449644 - DNA, 22 bp, Homo sapiens
ctccagcaggtgcgtctcagag

SEQ ID NO: 7449645 - DNA, 22 bp, Homo sapiens
ctccagccagagtgcctctgtt

SEQ ID NO: 7449646 - DNA, 22 bp, Homo sapiens
ctccagccagagtgcctctgtt

SEQ ID NO: 7449647 - DNA, 22 bp, Homo sapiens
ctccagcaggtgcgtctcagag

SEQ ID NO: 7449648 - DNA, 22 bp, Homo sapiens
ctccagccagagtgcctctgtt

SEQ ID NO: 7449649 - DNA, 20 bp, Homo sapiens
ctccagcccctgccctggtc

SEQ ID NO: 7449650 - DNA, 20 bp, Homo sapiens
ctccagcccctgccctggtc

SEQ ID NO: 7449651 - DNA, 22 bp, Homo sapiens
ctccagccagagtgcctctgtt

SEQ ID NO: 7449652 - DNA, 20 bp, Homo sapiens
ctccagcccctgccctggtc

SEQ ID NO: 7449653 - DNA, 20 bp, Homo sapiens
ctccagcccctgccctggtc

SEQ ID NO: 7449654 - DNA, 20 bp, Homo sapiens
ctccagcccctgccctggtc

SEQ ID NO: 7449655 - DNA, 23 bp, Homo sapiens
ttgtatttttagtagagacaggg

SEQ ID NO: 7449656 - DNA, 23 bp, Homo sapiens
ttgtatttttagtagagacaggg

SEQ ID NO: 7449657 - DNA, 22 bp, Homo sapiens
ttgtctgtccaggcaccccaag

SEQ ID NO: 7449658 - DNA, 22 bp, Homo sapiens
ttgtctgtcccagcttgtgcat

SEQ ID NO: 7449659 - DNA, 22 bp, Homo sapiens
ttgtctgtccaggcaccccaag

SEQ ID NO: 7449660 - DNA, 22 bp, Homo sapiens
ttgtctgtccaggcaccccaag

SEQ ID NO: 7449661 - DNA, 22 bp, Homo sapiens
ttgtattttgttatgctactgc

SEQ ID NO: 7449662 - DNA, 23 bp, Homo sapiens
ttgtatttttagtagagacaggg

SEQ ID NO: 7449663 - DNA, 23 bp, Homo sapiens
ttgtatttttagtagagacaggg

SEQ ID NO: 7449664 - DNA, 23 bp, Homo sapiens
ttgtatttttagtagagacaggg

SEQ ID NO: 7449665 - DNA, 20 bp, Homo sapiens
ctccagcccctgccctggtc

SEQ ID NO: 7449666 - DNA, 22 bp, Homo sapiens
ctccagcctcagatgacggtac

SEQ ID NO: 7449667 - DNA, 22 bp, Homo sapiens
ctccagcctcagatgacggtac

SEQ ID NO: 7449668 - DNA, 20 bp, Homo sapiens
ctccagcccctgccctggtc

SEQ ID NO: 7449669 - DNA, 22 bp, Homo sapiens
ctccagcctcagatgacggtac

SEQ ID NO: 7449670 - DNA, 22 bp, Homo sapiens
ctccagcctcatctcctggctg

SEQ ID NO: 7449671 - DNA, 22 bp, Homo sapiens
ctccagcctcatctcctggctg

SEQ ID NO: 7449672 - DNA, 22 bp, Homo sapiens
ctccagcctcatctcctggctg

SEQ ID NO: 7449673 - DNA, 22 bp, Homo sapiens
ttgtattttgttatgctactgc

SEQ ID NO: 7449674 - DNA, 22 bp, Homo sapiens
ctccagcctcatctcctggctg

SEQ ID NO: 7449675 - DNA, 22 bp, Homo sapiens
ttgtggggcaacagcaggtgaa

SEQ ID NO: 7449676 - DNA, 22 bp, Homo sapiens
ttgtggggcaacagcaggtgaa

SEQ ID NO: 7449677 - DNA, 22 bp, Homo sapiens
ttgtggggcaacagcaggtgaa

SEQ ID NO: 7449678 - DNA, 22 bp, Homo sapiens
ttgtggggcaacagcaggtgaa

SEQ ID NO: 7449679 - DNA, 20 bp, Homo sapiens
ttgtgggggcaatggtatgc

SEQ ID NO: 7449680 - DNA, 20 bp, Homo sapiens
ttgtgggggcaatggtatgc

SEQ ID NO: 7449681 - DNA, 22 bp, Homo sapiens
ttgtgggccattcagctgctct

SEQ ID NO: 7449682 - DNA, 22 bp, Homo sapiens
ttgtgggcttgcctggctcttg

SEQ ID NO: 7449683 - DNA, 22 bp, Homo sapiens
ttgtgggcttgcctggctcttg

SEQ ID NO: 7449684 - DNA, 22 bp, Homo sapiens
ttgtggggaaacactgtttctt

SEQ ID NO: 7449685 - DNA, 22 bp, Homo sapiens
ttgtggggaacccctgtcccac

SEQ ID NO: 7449686 - DNA, 22 bp, Homo sapiens
ttgtggggaacccctgtcccac

SEQ ID NO: 7449687 - DNA, 22 bp, Homo sapiens
ttgtggggaggatttgatgaga

SEQ ID NO: 7449688 - DNA, 23 bp, Homo sapiens
ttgtgggcagattccatggggag

SEQ ID NO: 7449689 - DNA, 23 bp, Homo sapiens
ttgtgggcagattccatggggag

SEQ ID NO: 7449690 - DNA, 22 bp, Homo sapiens
ttgtgaaatcgtgtttggaagc

SEQ ID NO: 7449691 - DNA, 22 bp, Homo sapiens
ttgtgggatggctcttcccaaa

SEQ ID NO: 7449692 - DNA, 22 bp, Homo sapiens
ttgtgaaatcgtgtttggaagc

SEQ ID NO: 7449693 - DNA, 18 bp, Homo sapiens
ttgtgaaatattggagtc

SEQ ID NO: 7449694 - DNA, 18 bp, Homo sapiens
ttgtgaaatattggagtc

SEQ ID NO: 7449695 - DNA, 21 bp, Homo sapiens
ttgtgaaagtccaggaacaac

SEQ ID NO: 7449696 - DNA, 22 bp, Homo sapiens
ttgtgaaacattcatggatttg

SEQ ID NO: 7449697 - DNA, 22 bp, Homo sapiens
ttgtgaaacattcatggatttg

SEQ ID NO: 7449698 - DNA, 22 bp, Homo sapiens
ttgtgaaaagccgcaagtatag

SEQ ID NO: 7449699 - DNA, 22 bp, Homo sapiens
ttgtcttttgtgggaaatatgg

SEQ ID NO: 7449700 - DNA, 22 bp, Homo sapiens
ttgtgaaaagccgcaagtatag

SEQ ID NO: 7449701 - DNA, 22 bp, Homo sapiens
ttgtgaaaagccgcaagtatag

SEQ ID NO: 7449702 - DNA, 22 bp, Homo sapiens
ctccagtgcgcaggacagcccc

SEQ ID NO: 7449703 - DNA, 22 bp, Homo sapiens
ctccagtgctcatgccgttgac

SEQ ID NO: 7449704 - DNA, 22 bp, Homo sapiens
ctccagtgctcatgccgttgac

SEQ ID NO: 7449705 - DNA, 22 bp, Homo sapiens
ctccagtgcgtcttagtaaacc

SEQ ID NO: 7449706 - DNA, 22 bp, Homo sapiens
ttgtgtaacttgagcaaacaca

SEQ ID NO: 7449707 - DNA, 22 bp, Homo sapiens
ttgtgtaatctcttccctgccc

SEQ ID NO: 7449708 - DNA, 22 bp, Homo sapiens
ttgtgtaaggctgattaggaag

SEQ ID NO: 7449709 - DNA, 22 bp, Homo sapiens
ttgtgtaattagcaaacaaatc

SEQ ID NO: 7449710 - DNA, 22 bp, Homo sapiens
ttgtgtaatgaagttatcatgt

SEQ ID NO: 7449711 - DNA, 22 bp, Homo sapiens
ctccatggggaaatgaaggtgg

SEQ ID NO: 7449712 - DNA, 22 bp, Homo sapiens
ctccatggctttcgcatctgca

SEQ ID NO: 7449713 - DNA, 22 bp, Homo sapiens
ctccagtgctgtcatcccttcc

SEQ ID NO: 7449714 - DNA, 22 bp, Homo sapiens
ctccagtgctgtcatcccttcc

SEQ ID NO: 7449715 - DNA, 22 bp, Homo sapiens
ctccagtgcgcaggacagcccc

SEQ ID NO: 7449716 - DNA, 22 bp, Homo sapiens
ctccagtgcgtcttagtaaacc

SEQ ID NO: 7449717 - DNA, 22 bp, Homo sapiens
ctccatggaaccggggctgctt

SEQ ID NO: 7449718 - DNA, 22 bp, Homo sapiens
ctccatggaaccggggctgctt

SEQ ID NO: 7449719 - DNA, 22 bp, Homo sapiens
ctccatggaaccggggctgctt

SEQ ID NO: 7449720 - DNA, 22 bp, Homo sapiens
ttgtggttaaccgcacattttt

SEQ ID NO: 7449721 - DNA, 20 bp, Homo sapiens
ttgtggtttagattatctga

SEQ ID NO: 7449722 - DNA, 22 bp, Homo sapiens
ttgtggttgactaaatttgtaa

SEQ ID NO: 7449723 - DNA, 20 bp, Homo sapiens
ttgtggtttagattatctga

SEQ ID NO: 7449724 - DNA, 22 bp, Homo sapiens
ttgtgtaaaacctgtgatcttt

SEQ ID NO: 7449725 - DNA, 22 bp, Homo sapiens
ttgtgtaaatatctaaatgttt

SEQ ID NO: 7449726 - DNA, 22 bp, Homo sapiens
ttgtgtaaaacctgtgatcttt

SEQ ID NO: 7449727 - DNA, 22 bp, Homo sapiens
ttgtgtaaaacctgtgatcttt

SEQ ID NO: 7449728 - DNA, 20 bp, Homo sapiens
ttgtggtttagattatctga

SEQ ID NO: 7449729 - DNA, 22 bp, Homo sapiens
ttgtgtaacttgagcaaacaca

SEQ ID NO: 7449730 - DNA, 22 bp, Homo sapiens
ttgtgtaaatatctaaatgttt

SEQ ID NO: 7449731 - DNA, 22 bp, Homo sapiens
ttgtgtaaatgtctgtctttct

SEQ ID NO: 7449732 - DNA, 22 bp, Homo sapiens
ttgtggttaaccgcacattttt

SEQ ID NO: 7449733 - DNA, 22 bp, Homo sapiens
ttgtggttaaccgcacattttt

SEQ ID NO: 7449734 - DNA, 22 bp, Homo sapiens
ttgtggttaaccgcacattttt

SEQ ID NO: 7449735 - DNA, 22 bp, Homo sapiens
ttgtggttaaccgcacattttt

SEQ ID NO: 7449736 - DNA, 22 bp, Homo sapiens
ttgtggttaaccgcacattttt

SEQ ID NO: 7449737 - DNA, 22 bp, Homo sapiens
ttgtggggtgatttgccacggg

SEQ ID NO: 7449738 - DNA, 22 bp, Homo sapiens
ttgtgggggctgccctgtacgg

SEQ ID NO: 7449739 - DNA, 22 bp, Homo sapiens
ttgtggggtgatttgccacggg

SEQ ID NO: 7449740 - DNA, 22 bp, Homo sapiens
tttaatatctcacacttccatg

SEQ ID NO: 7449741 - DNA, 22 bp, Homo sapiens
tttaatatctcacacttccatg

SEQ ID NO: 7449742 - DNA, 22 bp, Homo sapiens
tttaatatctcacacttccatg

SEQ ID NO: 7449743 - DNA, 22 bp, Homo sapiens
tttaatatccagtggatacaaa

SEQ ID NO: 7449744 - DNA, 22 bp, Homo sapiens
tttaatatccagtggatacaaa

SEQ ID NO: 7449745 - DNA, 22 bp, Homo sapiens
tttaatatctcacacttccatg

SEQ ID NO: 7449746 - DNA, 22 bp, Homo sapiens
tttaatatccagtggatacaaa

SEQ ID NO: 7449747 - DNA, 22 bp, Homo sapiens
tttaatatccagtggatacaaa

SEQ ID NO: 7449748 - DNA, 22 bp, Homo sapiens
tttaatatccagtggatacaaa

SEQ ID NO: 7449749 - DNA, 22 bp, Homo sapiens
tttaatatccagtggatacaaa

SEQ ID NO: 7449750 - DNA, 22 bp, Homo sapiens
tttaatatccagtggatacaaa

SEQ ID NO: 7449751 - DNA, 22 bp, Homo sapiens
tttaatatccagtggatacaaa

SEQ ID NO: 7449752 - DNA, 22 bp, Homo sapiens
tttaatatccagtggatacaaa

SEQ ID NO: 7449753 - DNA, 22 bp, Homo sapiens
tttaatagggcccaatgagact

SEQ ID NO: 7449754 - DNA, 22 bp, Homo sapiens
tttaatagggcccaatgagact

SEQ ID NO: 7449755 - DNA, 22 bp, Homo sapiens
tttaatagggcccaatgagact

SEQ ID NO: 7449756 - DNA, 22 bp, Homo sapiens
tttaatactatggggatgaaca

SEQ ID NO: 7449757 - DNA, 22 bp, Homo sapiens
tttaatatttctttcctgaagc

SEQ ID NO: 7449758 - DNA, 22 bp, Homo sapiens
tttaatatttctttcctgaagc

SEQ ID NO: 7449759 - DNA, 22 bp, Homo sapiens
tttaatatttctttcctgaagc

SEQ ID NO: 7449760 - DNA, 22 bp, Homo sapiens
tttaatcaggcaaagcataata

SEQ ID NO: 7449761 - DNA, 22 bp, Homo sapiens
tttaatcaggcaaagcataata

SEQ ID NO: 7449762 - DNA, 22 bp, Homo sapiens
tttaatatttctttcctgaagc

SEQ ID NO: 7449763 - DNA, 22 bp, Homo sapiens
tttaatatttctttcctgaagc

SEQ ID NO: 7449764 - DNA, 22 bp, Homo sapiens
tttaatcaggcaaagcataata

SEQ ID NO: 7449765 - DNA, 22 bp, Homo sapiens
tttaatcaggcaaagcataata

SEQ ID NO: 7449766 - DNA, 22 bp, Homo sapiens
tttaatattctgcattctcctt

SEQ ID NO: 7449767 - DNA, 22 bp, Homo sapiens
tttaatattctgcattctcctt

SEQ ID NO: 7449768 - DNA, 22 bp, Homo sapiens
tttaatattctgcattctcctt

SEQ ID NO: 7449769 - DNA, 22 bp, Homo sapiens
tttaatatttctttcctgaagc

SEQ ID NO: 7449770 - DNA, 22 bp, Homo sapiens
tttaatatttctttcctgaagc

SEQ ID NO: 7449771 - DNA, 22 bp, Homo sapiens
tttaatatctcacacttccatg

SEQ ID NO: 7449772 - DNA, 22 bp, Homo sapiens
tttaatatctcacacttccatg

SEQ ID NO: 7449773 - DNA, 22 bp, Homo sapiens
ctcccaggccatgctctagcca

SEQ ID NO: 7449774 - DNA, 22 bp, Homo sapiens
ctcccaggccatgctctagcca

SEQ ID NO: 7449775 - DNA, 22 bp, Homo sapiens
ctcccaggccatgctctagcca

SEQ ID NO: 7449776 - DNA, 22 bp, Homo sapiens
ctcccaggccatgctctagcca

SEQ ID NO: 7449777 - DNA, 22 bp, Homo sapiens
ctcccaggcagggctgcccact

SEQ ID NO: 7449778 - DNA, 22 bp, Homo sapiens
ctcccaggcagggctgcccact

SEQ ID NO: 7449779 - DNA, 22 bp, Homo sapiens
ctcccaggcagggctgcccact

SEQ ID NO: 7449780 - DNA, 22 bp, Homo sapiens
ctcccaggcacagggaggagcc

SEQ ID NO: 7449781 - DNA, 22 bp, Homo sapiens
ctcccaggcacagggaggagcc

SEQ ID NO: 7449782 - DNA, 22 bp, Homo sapiens
ctcccaggcacagggaggagcc

SEQ ID NO: 7449783 - DNA, 22 bp, Homo sapiens
ctcccaggcacagggaggagcc

SEQ ID NO: 7449784 - DNA, 22 bp, Homo sapiens
ctcccaggcacagggaggagcc

SEQ ID NO: 7449785 - DNA, 22 bp, Homo sapiens
ctcccaggcacagggaggagcc

SEQ ID NO: 7449786 - DNA, 22 bp, Homo sapiens
ctcccaggcacagggaggagcc

SEQ ID NO: 7449787 - DNA, 22 bp, Homo sapiens
ctcccaggcacagggaggagcc

SEQ ID NO: 7449788 - DNA, 22 bp, Homo sapiens
ctcccaggactggctctaactg

SEQ ID NO: 7449789 - DNA, 22 bp, Homo sapiens
tttaagttccttttcaacaact

SEQ ID NO: 7449790 - DNA, 22 bp, Homo sapiens
tttaagttccttttcaacaact

SEQ ID NO: 7449791 - DNA, 22 bp, Homo sapiens
tttaagttccttttcaacaact

SEQ ID NO: 7449792 - DNA, 22 bp, Homo sapiens
tttaagttccttttcaacaact

SEQ ID NO: 7449793 - DNA, 22 bp, Homo sapiens
tttaatacagaacttgtcaggg

SEQ ID NO: 7449794 - DNA, 22 bp, Homo sapiens
tttaatacagaacttgtcaggg

SEQ ID NO: 7449795 - DNA, 22 bp, Homo sapiens
tttaatacagaacttgtcaggg

SEQ ID NO: 7449796 - DNA, 22 bp, Homo sapiens
tttaatacagaacttgtcaggg

SEQ ID NO: 7449797 - DNA, 22 bp, Homo sapiens
tttaacagatgtgaaattttca

SEQ ID NO: 7449798 - DNA, 22 bp, Homo sapiens
tttaacagatgtgaaattttca

SEQ ID NO: 7449799 - DNA, 22 bp, Homo sapiens
tttaagttccttttcaacaact

SEQ ID NO: 7449800 - DNA, 22 bp, Homo sapiens
tttaacagatgctatgtctacc

SEQ ID NO: 7449801 - DNA, 22 bp, Homo sapiens
ctcccaggccatgctctagcca

SEQ ID NO: 7449802 - DNA, 22 bp, Homo sapiens
ctcccacatggaatagcaggga

SEQ ID NO: 7449803 - DNA, 22 bp, Homo sapiens
ctcccaaggggtaagggagctg

SEQ ID NO: 7449804 - DNA, 22 bp, Homo sapiens
ctcccaaggggtaagggagctg

SEQ ID NO: 7449805 - DNA, 22 bp, Homo sapiens
ctcccacatggaatagcaggga

SEQ ID NO: 7449806 - DNA, 22 bp, Homo sapiens
ctcccaaggggtaagggagctg

SEQ ID NO: 7449807 - DNA, 22 bp, Homo sapiens
ctcccacatggaatagcaggga

SEQ ID NO: 7449808 - DNA, 22 bp, Homo sapiens
ctcccacatggaatagcaggga

SEQ ID NO: 7449809 - DNA, 22 bp, Homo sapiens
ctcccaagctgtgctgaactgt

SEQ ID NO: 7449810 - DNA, 22 bp, Homo sapiens
ctcccaagctgtgctgaactgt

SEQ ID NO: 7449811 - DNA, 22 bp, Homo sapiens
ctcccaaggggtaagggagctg

SEQ ID NO: 7449812 - DNA, 22 bp, Homo sapiens
ctcccaaggggtaagggagctg

SEQ ID NO: 7449813 - DNA, 22 bp, Homo sapiens
ctccattgaacatcctctcaga

SEQ ID NO: 7449814 - DNA, 22 bp, Homo sapiens
ctcccaagataaataaggcagt

SEQ ID NO: 7449815 - DNA, 22 bp, Homo sapiens
ctccatgtctgtaacacatgac

SEQ ID NO: 7449816 - DNA, 22 bp, Homo sapiens
ctccatgggggctggcctgtgt

SEQ ID NO: 7449817 - DNA, 22 bp, Homo sapiens
ctccatggggaaatgaaggtgg

SEQ ID NO: 7449818 - DNA, 22 bp, Homo sapiens
ctccatggggaaatgaaggtgg

SEQ ID NO: 7449819 - DNA, 22 bp, Homo sapiens
ctcccactcctggctcaccaca

SEQ ID NO: 7449820 - DNA, 22 bp, Homo sapiens
ctcccactcctggctcaccaca

SEQ ID NO: 7449821 - DNA, 22 bp, Homo sapiens
ctcccactcctggctcaccaca

SEQ ID NO: 7449822 - DNA, 22 bp, Homo sapiens
ctcccactcctggctcaccaca

SEQ ID NO: 7449823 - DNA, 22 bp, Homo sapiens
ctcccactcctggctcaccaca

SEQ ID NO: 7449824 - DNA, 22 bp, Homo sapiens
ctcccactcctggctcaccaca

SEQ ID NO: 7449825 - DNA, 22 bp, Homo sapiens
ctcccactcctggctcaccaca

SEQ ID NO: 7449826 - DNA, 22 bp, Homo sapiens
ctcccacatggaatagcaggga

SEQ ID NO: 7449827 - DNA, 22 bp, Homo sapiens
ctcccagacatgtgcctccttg

SEQ ID NO: 7449828 - DNA, 22 bp, Homo sapiens
ctcccagacatgtgcctccttg

SEQ ID NO: 7449829 - DNA, 22 bp, Homo sapiens
ctcccagacatgtgcctccttg

SEQ ID NO: 7449830 - DNA, 22 bp, Homo sapiens
ctcccagacatgtgcctccttg

SEQ ID NO: 7449831 - DNA, 22 bp, Homo sapiens
ctcccagaaaattctcagacaa

SEQ ID NO: 7449832 - DNA, 22 bp, Homo sapiens
ctcccagaaaattctcagacaa

SEQ ID NO: 7449833 - DNA, 22 bp, Homo sapiens
ctcccagaaaattctcagacaa

SEQ ID NO: 7449834 - DNA, 22 bp, Homo sapiens
ctcccagaaaattctcagacaa

SEQ ID NO: 7449835 - DNA, 22 bp, Homo sapiens
ctcccagaaaattctcagacaa

SEQ ID NO: 7449836 - DNA, 22 bp, Homo sapiens
ctcccagaaaattctcagacaa

SEQ ID NO: 7449837 - DNA, 22 bp, Homo sapiens
ctcccaggactcagaggagaag

SEQ ID NO: 7449838 - DNA, 22 bp, Homo sapiens
ctcccaggactcagaggagaag

SEQ ID NO: 7449839 - DNA, 22 bp, Homo sapiens
ctcccagccttcgccagtctga

SEQ ID NO: 7449840 - DNA, 22 bp, Homo sapiens
ctcccaggactcagaggagaag

SEQ ID NO: 7449841 - DNA, 22 bp, Homo sapiens
ctcccagccttcgccagtctga

SEQ ID NO: 7449842 - DNA, 22 bp, Homo sapiens
ctcccaggactcagaggagaag

SEQ ID NO: 7449843 - DNA, 22 bp, Homo sapiens
ctcccaggactcagaggagaag

SEQ ID NO: 7449844 - DNA, 22 bp, Homo sapiens
ctcccaggactcagaggagaag

SEQ ID NO: 7449845 - DNA, 22 bp, Homo sapiens
ctcccaggactcagaggagaag

SEQ ID NO: 7449846 - DNA, 22 bp, Homo sapiens
ctcccagccttcgccagtctga

SEQ ID NO: 7449847 - DNA, 22 bp, Homo sapiens
ctcccagccttcgccagtctga

SEQ ID NO: 7449848 - DNA, 22 bp, Homo sapiens
ctcccagccttcgccagtctga

SEQ ID NO: 7449849 - DNA, 22 bp, Homo sapiens
ctcccagccttcgccagtctga

SEQ ID NO: 7449850 - DNA, 22 bp, Homo sapiens
ctcccagccttcgccagtctga

SEQ ID NO: 7449851 - DNA, 22 bp, Homo sapiens
ctcccagccttcgccagtctga

SEQ ID NO: 7449852 - DNA, 22 bp, Homo sapiens
ctcccagccttcgccagtctga

SEQ ID NO: 7449853 - DNA, 22 bp, Homo sapiens
ctcccagccttcgccagtctga

SEQ ID NO: 7449854 - DNA, 22 bp, Homo sapiens
ctcccagccttcgccagtctga

SEQ ID NO: 7449855 - DNA, 22 bp, Homo sapiens
ctcccagagaccaagctgagaa

SEQ ID NO: 7449856 - DNA, 22 bp, Homo sapiens
ctcccagagaccaagctgagaa

SEQ ID NO: 7449857 - DNA, 22 bp, Homo sapiens
ctcccagagaccaagctgagaa

SEQ ID NO: 7449858 - DNA, 22 bp, Homo sapiens
ctcccagagaccaagctgagaa

SEQ ID NO: 7449859 - DNA, 22 bp, Homo sapiens
ctcccagagaccaagctgagaa

SEQ ID NO: 7449860 - DNA, 22 bp, Homo sapiens
ctcccagagaccaagctgagaa

SEQ ID NO: 7449861 - DNA, 22 bp, Homo sapiens
ctcccagagagcaggtgggccg

SEQ ID NO: 7449862 - DNA, 22 bp, Homo sapiens
ctcccagagagcaggtgggccg

SEQ ID NO: 7449863 - DNA, 22 bp, Homo sapiens
ctcccagagaccaagctgagaa

SEQ ID NO: 7449864 - DNA, 22 bp, Homo sapiens
ctcccagagaccaagctgagaa

SEQ ID NO: 7449865 - DNA, 22 bp, Homo sapiens
ctcccagaggtgtcattcgagc

SEQ ID NO: 7449866 - DNA, 22 bp, Homo sapiens
ctcccagaggtgtcattcgagc

SEQ ID NO: 7449867 - DNA, 22 bp, Homo sapiens
ctcccagagagcaggtgggccg

SEQ ID NO: 7449868 - DNA, 22 bp, Homo sapiens
ctcccagagagcaggtgggccg

SEQ ID NO: 7449869 - DNA, 22 bp, Homo sapiens
ctcccagagagcaggtgggccg

SEQ ID NO: 7449870 - DNA, 22 bp, Homo sapiens
ctcccagattcctgctgtggga

SEQ ID NO: 7449871 - DNA, 22 bp, Homo sapiens
ctcccagattcctgctgtggga

SEQ ID NO: 7449872 - DNA, 22 bp, Homo sapiens
ctcccagattcctgctgtggga

SEQ ID NO: 7449873 - DNA, 22 bp, Homo sapiens
ctcccagattcctgctgtggga

SEQ ID NO: 7449874 - DNA, 22 bp, Homo sapiens
ctcccagattcctgctgtggga

SEQ ID NO: 7449875 - DNA, 22 bp, Homo sapiens
ctcccagattcctgctgtggga

SEQ ID NO: 7449876 - DNA, 22 bp, Homo sapiens
ctcccagattcctgctgtggga

SEQ ID NO: 7449877 - DNA, 22 bp, Homo sapiens
ctcccagattcctgctgtggga

SEQ ID NO: 7449878 - DNA, 22 bp, Homo sapiens
ttttcagtggcttgcatatgtt

SEQ ID NO: 7449879 - DNA, 22 bp, Homo sapiens
ttttcagtggcttgcatatgtt

SEQ ID NO: 7449880 - DNA, 22 bp, Homo sapiens
ttttcagtggtatctttgtaaa

SEQ ID NO: 7449881 - DNA, 22 bp, Homo sapiens
ttttcagtgggcaatgatgtga

SEQ ID NO: 7449882 - DNA, 22 bp, Homo sapiens
ttttcagtaatgtctacataat

SEQ ID NO: 7449883 - DNA, 22 bp, Homo sapiens
ttttcagtaatgtctacataat

SEQ ID NO: 7449884 - DNA, 22 bp, Homo sapiens
ttttcagtaatgtctacataat

SEQ ID NO: 7449885 - DNA, 22 bp, Homo sapiens
ttttcagtaatgtctacataat

SEQ ID NO: 7449886 - DNA, 22 bp, Homo sapiens
ttttcaggccagaagatagacc

SEQ ID NO: 7449887 - DNA, 22 bp, Homo sapiens
ttttcagaggcctaagaggttt

SEQ ID NO: 7449888 - DNA, 22 bp, Homo sapiens
ttttcagaggcctaagaggttt

SEQ ID NO: 7449889 - DNA, 22 bp, Homo sapiens
ttttcagaggcctaagaggttt

SEQ ID NO: 7449890 - DNA, 22 bp, Homo sapiens
ttttcaccagcttgctacaatt

SEQ ID NO: 7449891 - DNA, 21 bp, Homo sapiens
ttttcaccaataaaaggactt

SEQ ID NO: 7449892 - DNA, 22 bp, Homo sapiens
ttttcaccatagacactggtcc

SEQ ID NO: 7449893 - DNA, 22 bp, Homo sapiens
ctcttcccagctccacgagagg

SEQ ID NO: 7449894 - DNA, 22 bp, Homo sapiens
ctcttcccagctccacgagagg

SEQ ID NO: 7449895 - DNA, 22 bp, Homo sapiens
ttttcacttaaggaatttcatg

SEQ ID NO: 7449896 - DNA, 22 bp, Homo sapiens
ttttcacttaaggaatttcatg

SEQ ID NO: 7449897 - DNA, 22 bp, Homo sapiens
ttttcacttaaggaatttcatg

SEQ ID NO: 7449898 - DNA, 22 bp, Homo sapiens
ttttcacttaaggaatttcatg

SEQ ID NO: 7449899 - DNA, 22 bp, Homo sapiens
ttttcacttaaggaatttcatg

SEQ ID NO: 7449900 - DNA, 22 bp, Homo sapiens
ttttcacttaaggaatttcatg

SEQ ID NO: 7449901 - DNA, 22 bp, Homo sapiens
ttttcagaaagatgagaaatta

SEQ ID NO: 7449902 - DNA, 22 bp, Homo sapiens
ttttcagaaagatgagaaatta

SEQ ID NO: 7449903 - DNA, 22 bp, Homo sapiens
ttttcacttaaggaatttcatg

SEQ ID NO: 7449904 - DNA, 22 bp, Homo sapiens
ttttcagaattagcataccatt

SEQ ID NO: 7449905 - DNA, 22 bp, Homo sapiens
ttttcagagagcttttatgtcc

SEQ ID NO: 7449906 - DNA, 22 bp, Homo sapiens
ttttcagagagcttttatgtcc

SEQ ID NO: 7449907 - DNA, 22 bp, Homo sapiens
ttttcagagagcttttatgtcc

SEQ ID NO: 7449908 - DNA, 22 bp, Homo sapiens
ctcttcttggcccccatgaggg

SEQ ID NO: 7449909 - DNA, 21 bp, Homo sapiens
ctcttgtctttgctcagtagc

SEQ ID NO: 7449910 - DNA, 22 bp, Homo sapiens
ctcttcttgctagactgagtgc

SEQ ID NO: 7449911 - DNA, 22 bp, Homo sapiens
ctcttcttgaaagaggaattca

SEQ ID NO: 7449912 - DNA, 22 bp, Homo sapiens
ctcttcttgcctgatgaggcag

SEQ ID NO: 7449913 - DNA, 22 bp, Homo sapiens
ttttcagttatagaatggtaga

SEQ ID NO: 7449914 - DNA, 22 bp, Homo sapiens
ttttcagttatagaatggtaga

SEQ ID NO: 7449915 - DNA, 22 bp, Homo sapiens
ttttcagttactgtttatgtga

SEQ ID NO: 7449916 - DNA, 22 bp, Homo sapiens
ttttcagtggtatctttgtaaa

SEQ ID NO: 7449917 - DNA, 22 bp, Homo sapiens
ttttcagttactgtttatgtga

SEQ ID NO: 7449918 - DNA, 22 bp, Homo sapiens
ttttcagttactgtttatgtga

SEQ ID NO: 7449919 - DNA, 22 bp, Homo sapiens
ctctttaagctcctaacagcca

SEQ ID NO: 7449920 - DNA, 22 bp, Homo sapiens
ctctttaagctcctaacagcca

SEQ ID NO: 7449921 - DNA, 22 bp, Homo sapiens
ctctttaagctcctaacagcca

SEQ ID NO: 7449922 - DNA, 22 bp, Homo sapiens
ctcttgtttcctttctgcagtc

SEQ ID NO: 7449923 - DNA, 22 bp, Homo sapiens
ctctttaactcccattctgtcc

SEQ ID NO: 7449924 - DNA, 22 bp, Homo sapiens
ctcttcttggcccccatgaggg

SEQ ID NO: 7449925 - DNA, 21 bp, Homo sapiens
ctcttgtgtcagagccagagg

SEQ ID NO: 7449926 - DNA, 22 bp, Homo sapiens
ctctttagtctgtgtggagaag

SEQ ID NO: 7449927 - DNA, 22 bp, Homo sapiens
ctctttagtcacagggcttcat

SEQ ID NO: 7449928 - DNA, 20 bp, Homo sapiens
ctctttacatgtctcttcct

SEQ ID NO: 7449929 - DNA, 22 bp, Homo sapiens
ctctttactgctactacaaaga

SEQ ID NO: 7449930 - DNA, 22 bp, Homo sapiens
ctctttactgctactacaaaga

SEQ ID NO: 7449931 - DNA, 22 bp, Homo sapiens
ctcttattgatgaaggtgctaa

SEQ ID NO: 7449932 - DNA, 22 bp, Homo sapiens
ctcttattgatgaaggtgctaa

SEQ ID NO: 7449933 - DNA, 22 bp, Homo sapiens
ctcttattcctacagtaacagg

SEQ ID NO: 7449934 - DNA, 22 bp, Homo sapiens
ctcttattcctacagtaacagg

SEQ ID NO: 7449935 - DNA, 22 bp, Homo sapiens
ctcttatagacactcttctata

SEQ ID NO: 7449936 - DNA, 22 bp, Homo sapiens
ctcttattcctacagtaacagg

SEQ ID NO: 7449937 - DNA, 22 bp, Homo sapiens
ctcttatacatatttttaggcg

SEQ ID NO: 7449938 - DNA, 20 bp, Homo sapiens
ctcttcaaatattttattct

SEQ ID NO: 7449939 - DNA, 22 bp, Homo sapiens
ctcttcaaaagtctaatcctta

SEQ ID NO: 7449940 - DNA, 20 bp, Homo sapiens
ctcttcaaatattttattct

SEQ ID NO: 7449941 - DNA, 22 bp, Homo sapiens
ctcttattttatggcatttgtg

SEQ ID NO: 7449942 - DNA, 20 bp, Homo sapiens
ctcttattgcattagtttct

SEQ ID NO: 7449943 - DNA, 20 bp, Homo sapiens
ctcttattgcattagtttct

SEQ ID NO: 7449944 - DNA, 22 bp, Homo sapiens
ctcttattttatggcatttgtg

SEQ ID NO: 7449945 - DNA, 22 bp, Homo sapiens
ctcttattttatggcatttgtg

SEQ ID NO: 7449946 - DNA, 22 bp, Homo sapiens
ctcttattttatggcatttgtg

SEQ ID NO: 7449947 - DNA, 22 bp, Homo sapiens
ttttagttactgcagtagcaaa

SEQ ID NO: 7449948 - DNA, 22 bp, Homo sapiens
ttttagttactgcagtagcaaa

SEQ ID NO: 7449949 - DNA, 22 bp, Homo sapiens
ttttagttactgcagtagcaaa

SEQ ID NO: 7449950 - DNA, 22 bp, Homo sapiens
ttttagttactgcagtagcaaa

SEQ ID NO: 7449951 - DNA, 23 bp, Homo sapiens
ttttagtgactcctttatctgcc

SEQ ID NO: 7449952 - DNA, 22 bp, Homo sapiens
ttttaggattcacatggattca

SEQ ID NO: 7449953 - DNA, 22 bp, Homo sapiens
ttttagtaccaaccagaagatg

SEQ ID NO: 7449954 - DNA, 22 bp, Homo sapiens
ttttagtaccaaccagaagatg

SEQ ID NO: 7449955 - DNA, 22 bp, Homo sapiens
ttttagtaccaaccagaagatg

SEQ ID NO: 7449956 - DNA, 22 bp, Homo sapiens
ttttagtaccaaccagaagatg

SEQ ID NO: 7449957 - DNA, 23 bp, Homo sapiens
ttttagtgactcctttatctgcc

SEQ ID NO: 7449958 - DNA, 22 bp, Homo sapiens
ctctgttaagccatgtaagtac

SEQ ID NO: 7449959 - DNA, 18 bp, Homo sapiens
ctctgtgttggtgtgaag

SEQ ID NO: 7449960 - DNA, 22 bp, Homo sapiens
ttttagttactgcagtagcaaa

SEQ ID NO: 7449961 - DNA, 22 bp, Homo sapiens
ctcttagtttgtaaaaataatt

SEQ ID NO: 7449962 - DNA, 22 bp, Homo sapiens
ctcttagtttatctttgacaaa

SEQ ID NO: 7449963 - DNA, 22 bp, Homo sapiens
ctctgtttctcagcctatttcc

SEQ ID NO: 7449964 - DNA, 22 bp, Homo sapiens
ctctgtttctcagcctatttcc

SEQ ID NO: 7449965 - DNA, 21 bp, Homo sapiens
ctcttcagtggtgagctcttc

SEQ ID NO: 7449966 - DNA, 21 bp, Homo sapiens
ctcttcagtggtgagctcttc

SEQ ID NO: 7449967 - DNA, 21 bp, Homo sapiens
ctcttcagtggtgagctcttc

SEQ ID NO: 7449968 - DNA, 22 bp, Homo sapiens
ctcttcagtaaatgacactgtt

SEQ ID NO: 7449969 - DNA, 22 bp, Homo sapiens
ctcttcagttggtcactattct

SEQ ID NO: 7449970 - DNA, 22 bp, Homo sapiens
ctcttcagttggtcactattct

SEQ ID NO: 7449971 - DNA, 22 bp, Homo sapiens
ctcttcagttgttgcatattct

SEQ ID NO: 7449972 - DNA, 22 bp, Homo sapiens
ctcttcagttgttgcatattct

SEQ ID NO: 7449973 - DNA, 22 bp, Homo sapiens
ctcttccacctccttcaggaga

SEQ ID NO: 7449974 - DNA, 22 bp, Homo sapiens
ctcttccacctccttcaggaga

SEQ ID NO: 7449975 - DNA, 22 bp, Homo sapiens
ctcttcattagttcctgtccca

SEQ ID NO: 7449976 - DNA, 22 bp, Homo sapiens
ctcttcatgtgtttaattttta

SEQ ID NO: 7449977 - DNA, 22 bp, Homo sapiens
ctcttcattagttcctgtccca

SEQ ID NO: 7449978 - DNA, 22 bp, Homo sapiens
ctcttccatattactcagggta

SEQ ID NO: 7449979 - DNA, 22 bp, Homo sapiens
ctcttccatattactcagggta

SEQ ID NO: 7449980 - DNA, 22 bp, Homo sapiens
ctcttccacctccttcaggaga

SEQ ID NO: 7449981 - DNA, 22 bp, Homo sapiens
ctcttcaggaatatgtcagtca

SEQ ID NO: 7449982 - DNA, 22 bp, Homo sapiens
ctcttcaggaatatgtcagtca

SEQ ID NO: 7449983 - DNA, 22 bp, Homo sapiens
ctcttcagcctatttgagtgca

SEQ ID NO: 7449984 - DNA, 22 bp, Homo sapiens
ctcttcagatatacagtactct

SEQ ID NO: 7449985 - DNA, 22 bp, Homo sapiens
ctcttcagatatacagtactct

SEQ ID NO: 7449986 - DNA, 22 bp, Homo sapiens
ctcttcagatatacagtactct

SEQ ID NO: 7449987 - DNA, 22 bp, Homo sapiens
ctcttcactgagataatcctag

SEQ ID NO: 7449988 - DNA, 22 bp, Homo sapiens
ctcttcagataaaagggatatt

SEQ ID NO: 7449989 - DNA, 22 bp, Homo sapiens
ctcttcaactgccaggcagtct

SEQ ID NO: 7449990 - DNA, 22 bp, Homo sapiens
ctcttcaggtttctgctctgga

SEQ ID NO: 7449991 - DNA, 22 bp, Homo sapiens
ctcttcaggaatatgtcagtca

SEQ ID NO: 7449992 - DNA, 22 bp, Homo sapiens
ctcttcaggatggcttgtgatg

SEQ ID NO: 7449993 - DNA, 22 bp, Homo sapiens
ctcttcagcaatgctttagtcc

SEQ ID NO: 7449994 - DNA, 22 bp, Homo sapiens
ctcttcaggaatatgtcagtca

SEQ ID NO: 7449995 - DNA, 22 bp, Homo sapiens
ctcttcaggatggcttgtgatg

SEQ ID NO: 7449996 - DNA, 22 bp, Homo sapiens
ctcttcagtaaatgacactgtt

SEQ ID NO: 7449997 - DNA, 22 bp, Homo sapiens
ctcttcaggatggcttgtgatg

SEQ ID NO: 7449998 - DNA, 22 bp, Homo sapiens
ctcttcagtaaatgacactgtt

SEQ ID NO: 7449999 - DNA, 22 bp, Homo sapiens
ctcttcagtaaatgacactgtt

SEQ ID NO: 7450000 - DNA, 22 bp, Homo sapiens
ctcttcaggtttctgctctgga

SEQ ID NO: 7450001 - DNA, 22 bp, Homo sapiens
ctcttcaggtttctgctctgga

SEQ ID NO: 7450002 - DNA, 22 bp, Homo sapiens
ctcttcaggtttctgctctgga

SEQ ID NO: 7450003 - DNA, 22 bp, Homo sapiens
ttttagatagtttaactgcact

SEQ ID NO: 7450004 - DNA, 22 bp, Homo sapiens
ttttagattataagtctaattc

SEQ ID NO: 7450005 - DNA, 22 bp, Homo sapiens
ttttagattataagtctaattc

SEQ ID NO: 7450006 - DNA, 22 bp, Homo sapiens
ttttagattataagtctaattc

SEQ ID NO: 7450007 - DNA, 22 bp, Homo sapiens
ttttagacttgtatgtaaagcc

SEQ ID NO: 7450008 - DNA, 22 bp, Homo sapiens
ttttagattataagtctaattc

SEQ ID NO: 7450009 - DNA, 22 bp, Homo sapiens
ttttagattgggaaatgtaaag

SEQ ID NO: 7450010 - DNA, 22 bp, Homo sapiens
ttttagattgggaaatgtaaag

SEQ ID NO: 7450011 - DNA, 22 bp, Homo sapiens
ttttagacttgtatgtaaagcc

SEQ ID NO: 7450012 - DNA, 22 bp, Homo sapiens
ttttagactccatctgattcag

SEQ ID NO: 7450013 - DNA, 22 bp, Homo sapiens
ttttagaatcaggttgtctggg

SEQ ID NO: 7450014 - DNA, 22 bp, Homo sapiens
ttttagaatcaggttgtctggg

SEQ ID NO: 7450015 - DNA, 22 bp, Homo sapiens
ttttaatactgctattgtagga

SEQ ID NO: 7450016 - DNA, 22 bp, Homo sapiens
ttttagaatcaggttgtctggg

SEQ ID NO: 7450017 - DNA, 22 bp, Homo sapiens
ttttagaatcaggttgtctggg

SEQ ID NO: 7450018 - DNA, 22 bp, Homo sapiens
ttttaatactgctattgtagga

SEQ ID NO: 7450019 - DNA, 22 bp, Homo sapiens
ttttagattgggaaatgtaaag

SEQ ID NO: 7450020 - DNA, 22 bp, Homo sapiens
ttttagattgggaaatgtaaag

SEQ ID NO: 7450021 - DNA, 22 bp, Homo sapiens
ttttagcacactttctttagcg

SEQ ID NO: 7450022 - DNA, 22 bp, Homo sapiens
ttttagcacactttctttagcg

SEQ ID NO: 7450023 - DNA, 22 bp, Homo sapiens
ttttagcaattggtctctcgtt

SEQ ID NO: 7450024 - DNA, 22 bp, Homo sapiens
ttttagcactaagtgatatgct

SEQ ID NO: 7450025 - DNA, 22 bp, Homo sapiens
ttttagcactaagtgatatgct

SEQ ID NO: 7450026 - DNA, 22 bp, Homo sapiens
ttttagcacactttctttagcg

SEQ ID NO: 7450027 - DNA, 20 bp, Homo sapiens
ttttagcagaaagaaagctc

SEQ ID NO: 7450028 - DNA, 20 bp, Homo sapiens
ttttagcacttgttatggtg

SEQ ID NO: 7450029 - DNA, 22 bp, Homo sapiens
ttttagctgttgattgttcccc

SEQ ID NO: 7450030 - DNA, 22 bp, Homo sapiens
ttttagctgttgattgttcccc

SEQ ID NO: 7450031 - DNA, 20 bp, Homo sapiens
ttttagcacttgttatggtg

SEQ ID NO: 7450032 - DNA, 22 bp, Homo sapiens
ttttagcactaagtgatatgct

SEQ ID NO: 7450033 - DNA, 22 bp, Homo sapiens
ttttagcactaagtgatatgct

SEQ ID NO: 7450034 - DNA, 22 bp, Homo sapiens
ttttagcactaagtgatatgct

SEQ ID NO: 7450035 - DNA, 22 bp, Homo sapiens
ttttaatactgctattgtagga

SEQ ID NO: 7450036 - DNA, 22 bp, Homo sapiens
ttttaatactgctattgtagga

SEQ ID NO: 7450037 - DNA, 22 bp, Homo sapiens
ttttaatactgctattgtagga

SEQ ID NO: 7450038 - DNA, 22 bp, Homo sapiens
ttttaatactgctattgtagga

SEQ ID NO: 7450039 - DNA, 22 bp, Homo sapiens
ttttaatactgctattgtagga

SEQ ID NO: 7450040 - DNA, 22 bp, Homo sapiens
ttttaatactgctattgtagga

SEQ ID NO: 7450041 - DNA, 22 bp, Homo sapiens
ttttaatactgctattgtagga

SEQ ID NO: 7450042 - DNA, 22 bp, Homo sapiens
ttttaatactgctattgtagga

SEQ ID NO: 7450043 - DNA, 22 bp, Homo sapiens
ttttaatactgctattgtagga

SEQ ID NO: 7450044 - DNA, 22 bp, Homo sapiens
ttttaagttggattgctaagta

SEQ ID NO: 7450045 - DNA, 22 bp, Homo sapiens
ttttaagtttattccagtacat

SEQ ID NO: 7450046 - DNA, 22 bp, Homo sapiens
ttttaagttggattgctaagta

SEQ ID NO: 7450047 - DNA, 22 bp, Homo sapiens
ttttaagttggattgctaagta

SEQ ID NO: 7450048 - DNA, 22 bp, Homo sapiens
ttttaagttggattgctaagta

SEQ ID NO: 7450049 - DNA, 22 bp, Homo sapiens
ttttaagttggattgctaagta

SEQ ID NO: 7450050 - DNA, 22 bp, Homo sapiens
ttttaagttaatataattgagg

SEQ ID NO: 7450051 - DNA, 22 bp, Homo sapiens
ttttaatactgctattgtagga

SEQ ID NO: 7450052 - DNA, 22 bp, Homo sapiens
ttttaatactgctattgtagga

SEQ ID NO: 7450053 - DNA, 22 bp, Homo sapiens
ttttaatactgctattgtagga

SEQ ID NO: 7450054 - DNA, 22 bp, Homo sapiens
ttttaatactgctattgtagga

SEQ ID NO: 7450055 - DNA, 22 bp, Homo sapiens
ttttaagttggattgctaagta

SEQ ID NO: 7450056 - DNA, 22 bp, Homo sapiens
ttttaagtttattccagtacat

SEQ ID NO: 7450057 - DNA, 19 bp, Homo sapiens
ttttaagtgccctttcttc

SEQ ID NO: 7450058 - DNA, 19 bp, Homo sapiens
ttttaagtgccctttcttc

SEQ ID NO: 7450059 - DNA, 22 bp, Homo sapiens
ttttaagttaatataattgagg

SEQ ID NO: 7450060 - DNA, 19 bp, Homo sapiens
ttttaagtgccctttcttc

SEQ ID NO: 7450061 - DNA, 22 bp, Homo sapiens
ttttaagtgcaatctgaatgcg

SEQ ID NO: 7450062 - DNA, 22 bp, Homo sapiens
ttttaagttaatataattgagg

SEQ ID NO: 7450063 - DNA, 22 bp, Homo sapiens
ttttaagttaatataattgagg

SEQ ID NO: 7450064 - DNA, 22 bp, Homo sapiens
ttttaagttaatataattgagg

SEQ ID NO: 7450065 - DNA, 22 bp, Homo sapiens
ttttaagttaatataattgagg

SEQ ID NO: 7450066 - DNA, 22 bp, Homo sapiens
ttttaagttaatataattgagg

SEQ ID NO: 7450067 - DNA, 19 bp, Homo sapiens
ttttaagtcctctctattc

SEQ ID NO: 7450068 - DNA, 19 bp, Homo sapiens
ttttaagtcctctctattc

SEQ ID NO: 7450069 - DNA, 22 bp, Homo sapiens
ttttaagcaaaagaatggtgtg

SEQ ID NO: 7450070 - DNA, 22 bp, Homo sapiens
ttttaagatgctagtatttcag

SEQ ID NO: 7450071 - DNA, 22 bp, Homo sapiens
ttttaagtgcaatctgaatgcg

SEQ ID NO: 7450072 - DNA, 22 bp, Homo sapiens
ttttaagtgcaatctgaatgcg

SEQ ID NO: 7450073 - DNA, 19 bp, Homo sapiens
ttttaagtcctctctattc

SEQ ID NO: 7450074 - DNA, 19 bp, Homo sapiens
ttttaagtcctctctattc

SEQ ID NO: 7450075 - DNA, 19 bp, Homo sapiens
ttttaagtcctctctattc

SEQ ID NO: 7450076 - DNA, 22 bp, Homo sapiens
ttttaagaggaggctgtttgaa

SEQ ID NO: 7450077 - DNA, 22 bp, Homo sapiens
ttttaagaggaggctgtttgaa

SEQ ID NO: 7450078 - DNA, 22 bp, Homo sapiens
ttttaagaactgttctgtgctt

SEQ ID NO: 7450079 - DNA, 22 bp, Homo sapiens
ttttaagaggaggctgtttgaa

SEQ ID NO: 7450080 - DNA, 22 bp, Homo sapiens
ttttaagaggaggctgtttgaa

SEQ ID NO: 7450081 - DNA, 22 bp, Homo sapiens
ttttaagaggaggctgtttgaa

SEQ ID NO: 7450082 - DNA, 22 bp, Homo sapiens
ttttaagatgctagtatttcag

SEQ ID NO: 7450083 - DNA, 22 bp, Homo sapiens
ttttaagatgctagtatttcag

SEQ ID NO: 7450084 - DNA, 22 bp, Homo sapiens
ttttaagatgctagtatttcag

SEQ ID NO: 7450085 - DNA, 22 bp, Homo sapiens
ttttaagatgctagtatttcag

SEQ ID NO: 7450086 - DNA, 22 bp, Homo sapiens
ttttaagatgctagtatttcag

SEQ ID NO: 7450087 - DNA, 22 bp, Homo sapiens
ttttaagatgctagtatttcag

SEQ ID NO: 7450088 - DNA, 22 bp, Homo sapiens
ttttaagaactgttctgtgctt

SEQ ID NO: 7450089 - DNA, 22 bp, Homo sapiens
ttttaagaactgttctgtgctt

SEQ ID NO: 7450090 - DNA, 22 bp, Homo sapiens
ttttaagaactgttctgtgctt

SEQ ID NO: 7450091 - DNA, 22 bp, Homo sapiens
ttttaagaactgttctgtgctt

SEQ ID NO: 7450092 - DNA, 22 bp, Homo sapiens
ttttaagaactgttctgtgctt

SEQ ID NO: 7450093 - DNA, 22 bp, Homo sapiens
tttgttctgaaaatcttccctt

SEQ ID NO: 7450094 - DNA, 22 bp, Homo sapiens
tttgttctgaaaatcttccctt

SEQ ID NO: 7450095 - DNA, 22 bp, Homo sapiens
tttgttctgaaaatcttccctt

SEQ ID NO: 7450096 - DNA, 22 bp, Homo sapiens
tttgttctgaaaatcttccctt

SEQ ID NO: 7450097 - DNA, 22 bp, Homo sapiens
tttgttctgaaaactcaagtcc

SEQ ID NO: 7450098 - DNA, 22 bp, Homo sapiens
tttgttctgaaaactcaagtcc

SEQ ID NO: 7450099 - DNA, 22 bp, Homo sapiens
tttgttctgaaaactcaagtcc

SEQ ID NO: 7450100 - DNA, 22 bp, Homo sapiens
tttgttctgaaaactcaagtcc

SEQ ID NO: 7450101 - DNA, 22 bp, Homo sapiens
tttgtacatataaatcttgtat

SEQ ID NO: 7450102 - DNA, 22 bp, Homo sapiens
tttgtacatataaatcttgtat

SEQ ID NO: 7450103 - DNA, 22 bp, Homo sapiens
tttgtacatataaatcttgtat

SEQ ID NO: 7450104 - DNA, 22 bp, Homo sapiens
tttgtacatataaatcttgtat

SEQ ID NO: 7450105 - DNA, 22 bp, Homo sapiens
tttgtacatataaatcttgtat

SEQ ID NO: 7450106 - DNA, 22 bp, Homo sapiens
tttgtacatataaatcttgtat

SEQ ID NO: 7450107 - DNA, 22 bp, Homo sapiens
tttgtacatatataaaatctgt

SEQ ID NO: 7450108 - DNA, 22 bp, Homo sapiens
tttgtacatatataaaatctgt

SEQ ID NO: 7450109 - DNA, 22 bp, Homo sapiens
tttgtacatatataaaatctgt

SEQ ID NO: 7450110 - DNA, 22 bp, Homo sapiens
tttgtacatatataaaatctgt

SEQ ID NO: 7450111 - DNA, 22 bp, Homo sapiens
tttgtacatatataaaatctgt

SEQ ID NO: 7450112 - DNA, 22 bp, Homo sapiens
tttgtacatatataaaatctgt

SEQ ID NO: 7450113 - DNA, 22 bp, Homo sapiens
tttgtacatatataaaatctgt

SEQ ID NO: 7450114 - DNA, 22 bp, Homo sapiens
tttgttctgaaaactcaagtcc

SEQ ID NO: 7450115 - DNA, 22 bp, Homo sapiens
tttgttctattttagagatgaa

SEQ ID NO: 7450116 - DNA, 22 bp, Homo sapiens
tttgttctattttagagatgaa

SEQ ID NO: 7450117 - DNA, 22 bp, Homo sapiens
tttgtacatcctaattctgagt

SEQ ID NO: 7450118 - DNA, 22 bp, Homo sapiens
tttgttctattttagagatgaa

SEQ ID NO: 7450119 - DNA, 22 bp, Homo sapiens
tttgtacatatttgtggggcac

SEQ ID NO: 7450120 - DNA, 22 bp, Homo sapiens
tttgtacatatttgtggggcac

SEQ ID NO: 7450121 - DNA, 22 bp, Homo sapiens
tttgtacatcctaattctgagt

SEQ ID NO: 7450122 - DNA, 22 bp, Homo sapiens
tttgtacatatataaaatctgt

SEQ ID NO: 7450123 - DNA, 22 bp, Homo sapiens
tttgtacatatttgtggggcac

SEQ ID NO: 7450124 - DNA, 22 bp, Homo sapiens
tttgtacatatttgtggggcac

SEQ ID NO: 7450125 - DNA, 22 bp, Homo sapiens
tttgtacatatataaaatctgt

SEQ ID NO: 7450126 - DNA, 22 bp, Homo sapiens
tttgtacatcctaattctgagt

SEQ ID NO: 7450127 - DNA, 22 bp, Homo sapiens
tttgtacatcctaattctgagt

SEQ ID NO: 7450128 - DNA, 22 bp, Homo sapiens
tttgtacacaggatgttataat

SEQ ID NO: 7450129 - DNA, 22 bp, Homo sapiens
tttgtacacaggatgttataat

SEQ ID NO: 7450130 - DNA, 22 bp, Homo sapiens
tttgtacacaggatgttataat

SEQ ID NO: 7450131 - DNA, 22 bp, Homo sapiens
tttgggcagaagctgaatgtct

SEQ ID NO: 7450132 - DNA, 22 bp, Homo sapiens
tttgggcagaaacatgcgcccc

SEQ ID NO: 7450133 - DNA, 20 bp, Homo sapiens
tttgggcacggctagatttt

SEQ ID NO: 7450134 - DNA, 22 bp, Homo sapiens
tttgggcacagatattaagtat

SEQ ID NO: 7450135 - DNA, 22 bp, Homo sapiens
tttgggcacacaaatattttat

SEQ ID NO: 7450136 - DNA, 22 bp, Homo sapiens
tttgtacactgtctactatgaa

SEQ ID NO: 7450137 - DNA, 22 bp, Homo sapiens
tttgtacactgtctactatgaa

SEQ ID NO: 7450138 - DNA, 22 bp, Homo sapiens
tttgtacacctacctaatacag

SEQ ID NO: 7450139 - DNA, 22 bp, Homo sapiens
tttgtacacctacctaatacag

SEQ ID NO: 7450140 - DNA, 22 bp, Homo sapiens
tttgtacacctacctaatacag

SEQ ID NO: 7450141 - DNA, 22 bp, Homo sapiens
tttgtacacctacctaatacag

SEQ ID NO: 7450142 - DNA, 22 bp, Homo sapiens
tttgtacacctacctaatacag

SEQ ID NO: 7450143 - DNA, 22 bp, Homo sapiens
tttgtacacctacctaatacag

SEQ ID NO: 7450144 - DNA, 22 bp, Homo sapiens
tttgtacacctacctaatacag

SEQ ID NO: 7450145 - DNA, 22 bp, Homo sapiens
tttgtacacaggtcattcaggg

SEQ ID NO: 7450146 - DNA, 22 bp, Homo sapiens
tttgtacacaggtcattcaggg

SEQ ID NO: 7450147 - DNA, 22 bp, Homo sapiens
tttgtacacaggtcattcaggg

SEQ ID NO: 7450148 - DNA, 22 bp, Homo sapiens
tttgtacacaggtcattcaggg

SEQ ID NO: 7450149 - DNA, 22 bp, Homo sapiens
tttgtacacaggtcattcaggg

SEQ ID NO: 7450150 - DNA, 22 bp, Homo sapiens
tttgtacacaggtcattcaggg

SEQ ID NO: 7450151 - DNA, 22 bp, Homo sapiens
tttgtacacaggtcattcaggg

SEQ ID NO: 7450152 - DNA, 23 bp, Homo sapiens
tttgtacagaattttgccttcag

SEQ ID NO: 7450153 - DNA, 23 bp, Homo sapiens
tttgtacagaattttgccttcag

SEQ ID NO: 7450154 - DNA, 23 bp, Homo sapiens
tttgtacagaattttgccttcag

SEQ ID NO: 7450155 - DNA, 22 bp, Homo sapiens
tttgtacaggtgcaggcatttg

SEQ ID NO: 7450156 - DNA, 22 bp, Homo sapiens
tttgtacaggtgcaggcatttg

SEQ ID NO: 7450157 - DNA, 22 bp, Homo sapiens
tttgtacagtgaaagcgaggtt

SEQ ID NO: 7450158 - DNA, 22 bp, Homo sapiens
tttgtacagtgaaagcgaggtt

SEQ ID NO: 7450159 - DNA, 22 bp, Homo sapiens
tttgtacaggtgcaggcatttg

SEQ ID NO: 7450160 - DNA, 22 bp, Homo sapiens
tttgtacaggtgcaggcatttg

SEQ ID NO: 7450161 - DNA, 22 bp, Homo sapiens
tttgtacaggtgcaggcatttg

SEQ ID NO: 7450162 - DNA, 22 bp, Homo sapiens
tttgtacagtgatgttgtatgc

SEQ ID NO: 7450163 - DNA, 22 bp, Homo sapiens
tttgtacagtgatgttgtatgc

SEQ ID NO: 7450164 - DNA, 22 bp, Homo sapiens
tttgtacaggtgcaggcatttg

SEQ ID NO: 7450165 - DNA, 22 bp, Homo sapiens
tttgtacagtgaaagcgaggtt

SEQ ID NO: 7450166 - DNA, 22 bp, Homo sapiens
tttgtacagtgaaagcgaggtt

SEQ ID NO: 7450167 - DNA, 22 bp, Homo sapiens
tttgtacagtgatgttgtatgc

SEQ ID NO: 7450168 - DNA, 22 bp, Homo sapiens
tttgtacagtgatgttgtatgc

SEQ ID NO: 7450169 - DNA, 22 bp, Homo sapiens
tttgtacagtgatgttgtatgc

SEQ ID NO: 7450170 - DNA, 22 bp, Homo sapiens
tttgtacactgtctactatgaa

SEQ ID NO: 7450171 - DNA, 22 bp, Homo sapiens
tttgtacactgtctactatgaa

SEQ ID NO: 7450172 - DNA, 22 bp, Homo sapiens
tttgtacactgtctactatgaa

SEQ ID NO: 7450173 - DNA, 22 bp, Homo sapiens
tttgtacactgtctactatgaa

SEQ ID NO: 7450174 - DNA, 22 bp, Homo sapiens
tttgtacactgtctactatgaa

SEQ ID NO: 7450175 - DNA, 22 bp, Homo sapiens
tttgtacactgtctactatgaa

SEQ ID NO: 7450176 - DNA, 22 bp, Homo sapiens
tttgtacactgtctactatgaa

SEQ ID NO: 7450177 - DNA, 22 bp, Homo sapiens
tttgtacactgtctactatgaa

SEQ ID NO: 7450178 - DNA, 22 bp, Homo sapiens
tttgtacactgtctactatgaa

SEQ ID NO: 7450179 - DNA, 22 bp, Homo sapiens
tttgtacactgtctactatgaa

SEQ ID NO: 7450180 - DNA, 22 bp, Homo sapiens
tttgtacactgtctactatgaa

SEQ ID NO: 7450181 - DNA, 22 bp, Homo sapiens
tttgtacactgtctactatgaa

SEQ ID NO: 7450182 - DNA, 22 bp, Homo sapiens
tttgtacactgtctactatgaa

SEQ ID NO: 7450183 - DNA, 21 bp, Homo sapiens
ctctgcccagggcctcctgcc

SEQ ID NO: 7450184 - DNA, 21 bp, Homo sapiens
ctctgcccagggcctcctgcc

SEQ ID NO: 7450185 - DNA, 22 bp, Homo sapiens
ctctgcccacgtcttgcccaga

SEQ ID NO: 7450186 - DNA, 21 bp, Homo sapiens
ctctgcccagggcctcctgcc

SEQ ID NO: 7450187 - DNA, 21 bp, Homo sapiens
ctctgcccagggcctcctgcc

SEQ ID NO: 7450188 - DNA, 21 bp, Homo sapiens
ctctgcccagggcctcctgcc

SEQ ID NO: 7450189 - DNA, 22 bp, Homo sapiens
ctctgcccacgtcttgcccaga

SEQ ID NO: 7450190 - DNA, 22 bp, Homo sapiens
ctctgcccacgtcttgcccaga

SEQ ID NO: 7450191 - DNA, 22 bp, Homo sapiens
ctctgcccacgtcttgcccaga

SEQ ID NO: 7450192 - DNA, 22 bp, Homo sapiens
ctctgcccacgtcttgcccaga

SEQ ID NO: 7450193 - DNA, 22 bp, Homo sapiens
ctctgccatttatcagaactgt

SEQ ID NO: 7450194 - DNA, 22 bp, Homo sapiens
ctctgccatttatcagaactgt

SEQ ID NO: 7450195 - DNA, 22 bp, Homo sapiens
ctctgccatcttggagctcaag

SEQ ID NO: 7450196 - DNA, 22 bp, Homo sapiens
ctctgcccacgtcttgcccaga

SEQ ID NO: 7450197 - DNA, 19 bp, Homo sapiens
ctctgccatttgctgcctg

SEQ ID NO: 7450198 - DNA, 22 bp, Homo sapiens
ctctgccatttatcagaactgt

SEQ ID NO: 7450199 - DNA, 22 bp, Homo sapiens
ctctgccagtttctggcctcag

SEQ ID NO: 7450200 - DNA, 22 bp, Homo sapiens
ctctgccagtttctggcctcag

SEQ ID NO: 7450201 - DNA, 22 bp, Homo sapiens
ctctgccaggcagaacggcttt

SEQ ID NO: 7450202 - DNA, 22 bp, Homo sapiens
ctctgccagccaaagtcatcac

SEQ ID NO: 7450203 - DNA, 22 bp, Homo sapiens
ctctgccagccaaagtcatcac

SEQ ID NO: 7450204 - DNA, 22 bp, Homo sapiens
ctctgccagccaaaatttatga

SEQ ID NO: 7450205 - DNA, 22 bp, Homo sapiens
ctctgccagccaaaatttatga

SEQ ID NO: 7450206 - DNA, 22 bp, Homo sapiens
ctctgccactcgaagtcaagga

SEQ ID NO: 7450207 - DNA, 22 bp, Homo sapiens
ctctgccatcttggagctcaag

SEQ ID NO: 7450208 - DNA, 22 bp, Homo sapiens
ctctgccatcttggagctcaag

SEQ ID NO: 7450209 - DNA, 22 bp, Homo sapiens
ctctgccatctcactgggtcct

SEQ ID NO: 7450210 - DNA, 22 bp, Homo sapiens
ctctgccatctcactgggtcct

SEQ ID NO: 7450211 - DNA, 22 bp, Homo sapiens
ctctgccatctcactgggtcct

SEQ ID NO: 7450212 - DNA, 22 bp, Homo sapiens
ctctgccatcagtttttctttg

SEQ ID NO: 7450213 - DNA, 22 bp, Homo sapiens
ctctgccagtttctggcctcag

SEQ ID NO: 7450214 - DNA, 22 bp, Homo sapiens
ctctgccagtttctggcctcag

SEQ ID NO: 7450215 - DNA, 22 bp, Homo sapiens
tttcctttccaaaattctgcct

SEQ ID NO: 7450216 - DNA, 22 bp, Homo sapiens
tttcctttccaaaattctgcct

SEQ ID NO: 7450217 - DNA, 22 bp, Homo sapiens
tttcctttccaaaattctgcct

SEQ ID NO: 7450218 - DNA, 22 bp, Homo sapiens
tttcctttccaaaattctgcct

SEQ ID NO: 7450219 - DNA, 20 bp, Homo sapiens
ctctgcagcaaggcctgggt

SEQ ID NO: 7450220 - DNA, 20 bp, Homo sapiens
ctctgcagcaaggcctgggt

SEQ ID NO: 7450221 - DNA, 22 bp, Homo sapiens
ctctgcagattcatcccttcac

SEQ ID NO: 7450222 - DNA, 22 bp, Homo sapiens
ctctgcagattcatcccttcac

SEQ ID NO: 7450223 - DNA, 22 bp, Homo sapiens
ctctgcagaggcccaaggctga

SEQ ID NO: 7450224 - DNA, 22 bp, Homo sapiens
ctctgccactcgaagtcaagga

SEQ ID NO: 7450225 - DNA, 22 bp, Homo sapiens
ctctgccactcgaagtcaagga

SEQ ID NO: 7450226 - DNA, 22 bp, Homo sapiens
ctctgccaccatgcttcctgac

SEQ ID NO: 7450227 - DNA, 22 bp, Homo sapiens
ctctgccaccatgcttcctgac

SEQ ID NO: 7450228 - DNA, 22 bp, Homo sapiens
ctctgccaccatgcttcctgac

SEQ ID NO: 7450229 - DNA, 22 bp, Homo sapiens
ctctgccaagatgacaggtaag

SEQ ID NO: 7450230 - DNA, 22 bp, Homo sapiens
ctctgccaagatgacaggtaag

SEQ ID NO: 7450231 - DNA, 20 bp, Homo sapiens
ctctgcagcaaggcctgggt

SEQ ID NO: 7450232 - DNA, 20 bp, Homo sapiens
ctctgcagcaaggcctgggt

SEQ ID NO: 7450233 - DNA, 22 bp, Homo sapiens
tttcctttatgacatcaccact

SEQ ID NO: 7450234 - DNA, 20 bp, Homo sapiens
tttcctttcattttagtacc

SEQ ID NO: 7450235 - DNA, 20 bp, Homo sapiens
tttcctttcattttagtacc

SEQ ID NO: 7450236 - DNA, 22 bp, Homo sapiens
tttcctttatgacatcaccact

SEQ ID NO: 7450237 - DNA, 22 bp, Homo sapiens
tttcctttatgacatcaccact

SEQ ID NO: 7450238 - DNA, 22 bp, Homo sapiens
tttcctttccaaaattctgcct

SEQ ID NO: 7450239 - DNA, 20 bp, Homo sapiens
tttcctttcattttagtacc

SEQ ID NO: 7450240 - DNA, 20 bp, Homo sapiens
tttcctttcattttagtacc

SEQ ID NO: 7450241 - DNA, 20 bp, Homo sapiens
tttcctttcattttagtacc

SEQ ID NO: 7450242 - DNA, 22 bp, Homo sapiens
tttccttgttattatttgtcct

SEQ ID NO: 7450243 - DNA, 22 bp, Homo sapiens
tttccttgttattatttgtcct

SEQ ID NO: 7450244 - DNA, 22 bp, Homo sapiens
tttccttgggtctcttagtggc

SEQ ID NO: 7450245 - DNA, 22 bp, Homo sapiens
tttccttgttattatttgtcct

SEQ ID NO: 7450246 - DNA, 22 bp, Homo sapiens
tttccttgttcatttgccctat

SEQ ID NO: 7450247 - DNA, 22 bp, Homo sapiens
tttccttgttcatttgccctat

SEQ ID NO: 7450248 - DNA, 22 bp, Homo sapiens
tttccttgttcatttgccctat

SEQ ID NO: 7450249 - DNA, 22 bp, Homo sapiens
tttccttgttcatttgccctat

SEQ ID NO: 7450250 - DNA, 22 bp, Homo sapiens
tttccttgttattatttgtcct

SEQ ID NO: 7450251 - DNA, 22 bp, Homo sapiens
tttcctttatgacatcaccact

SEQ ID NO: 7450252 - DNA, 22 bp, Homo sapiens
ctctgccctcgcacatctgcca

SEQ ID NO: 7450253 - DNA, 22 bp, Homo sapiens
ctctgccctcgcacatctgcca

SEQ ID NO: 7450254 - DNA, 22 bp, Homo sapiens
ctctgccctcgcacatctgcca

SEQ ID NO: 7450255 - DNA, 22 bp, Homo sapiens
ctctgccctcgcacatctgcca

SEQ ID NO: 7450256 - DNA, 22 bp, Homo sapiens
ctctgccctcgcacatctgcca

SEQ ID NO: 7450257 - DNA, 22 bp, Homo sapiens
ctctgcctcagtgatttcttta

SEQ ID NO: 7450258 - DNA, 19 bp, Homo sapiens
ctctgcctccctcctgggt

SEQ ID NO: 7450259 - DNA, 19 bp, Homo sapiens
ctctgcctccctcctgggt

SEQ ID NO: 7450260 - DNA, 19 bp, Homo sapiens
ctctgcctccctcctgggt

SEQ ID NO: 7450261 - DNA, 19 bp, Homo sapiens
ctctgcctccctcctgggt

SEQ ID NO: 7450262 - DNA, 22 bp, Homo sapiens
ctctgcctcccaggttcaagcg

SEQ ID NO: 7450263 - DNA, 19 bp, Homo sapiens
ctctgcctccctcctgggt

SEQ ID NO: 7450264 - DNA, 19 bp, Homo sapiens
ctctgcctccctcctgggt

SEQ ID NO: 7450265 - DNA, 19 bp, Homo sapiens
ctctgcctccctcctgggt

SEQ ID NO: 7450266 - DNA, 19 bp, Homo sapiens
ctctgcctccctcctgggt

SEQ ID NO: 7450267 - DNA, 22 bp, Homo sapiens
tttgcaaagtgcttgcagagta

SEQ ID NO: 7450268 - DNA, 19 bp, Homo sapiens
ctctgcctccctcctgggt

SEQ ID NO: 7450269 - DNA, 22 bp, Homo sapiens
tttgcaaagttatttagactca

SEQ ID NO: 7450270 - DNA, 22 bp, Homo sapiens
tttgcaaagttatttagactca

SEQ ID NO: 7450271 - DNA, 22 bp, Homo sapiens
tttgcaaagttatttagactca

SEQ ID NO: 7450272 - DNA, 22 bp, Homo sapiens
tttgcaaagttatttagactca

SEQ ID NO: 7450273 - DNA, 22 bp, Homo sapiens
tttgcaaagttatttagactca

SEQ ID NO: 7450274 - DNA, 22 bp, Homo sapiens
tttgcaaagttatttagactca

SEQ ID NO: 7450275 - DNA, 22 bp, Homo sapiens
tttgcattttgataagatcact

SEQ ID NO: 7450276 - DNA, 22 bp, Homo sapiens
tttgcattttgataagatcact

SEQ ID NO: 7450277 - DNA, 22 bp, Homo sapiens
tttgcattttgataagatcact

SEQ ID NO: 7450278 - DNA, 22 bp, Homo sapiens
tttgcattttgataagatcact

SEQ ID NO: 7450279 - DNA, 22 bp, Homo sapiens
tttgccacattctatacatttg

SEQ ID NO: 7450280 - DNA, 22 bp, Homo sapiens
tttgccaggcttgcatgaattt

SEQ ID NO: 7450281 - DNA, 22 bp, Homo sapiens
tttgcattttagatttaggcct

SEQ ID NO: 7450282 - DNA, 22 bp, Homo sapiens
tttgcattttagatttaggcct

SEQ ID NO: 7450283 - DNA, 22 bp, Homo sapiens
tttgcaaataaataagtgctcg

SEQ ID NO: 7450284 - DNA, 22 bp, Homo sapiens
tttgcattttagatttaggcct

SEQ ID NO: 7450285 - DNA, 22 bp, Homo sapiens
ctctgcccgtgcctttcccagt

SEQ ID NO: 7450286 - DNA, 22 bp, Homo sapiens
ctctgcccgtgcctttcccagt

SEQ ID NO: 7450287 - DNA, 22 bp, Homo sapiens
ctctgcccgtgcctttcccagt

SEQ ID NO: 7450288 - DNA, 22 bp, Homo sapiens
ctctgccctcacttggggcctg

SEQ ID NO: 7450289 - DNA, 22 bp, Homo sapiens
ctctgccctcacttggggcctg

SEQ ID NO: 7450290 - DNA, 22 bp, Homo sapiens
ctctgccctcacttggggcctg

SEQ ID NO: 7450291 - DNA, 22 bp, Homo sapiens
ctctgccctcacttggggcctg

SEQ ID NO: 7450292 - DNA, 19 bp, Homo sapiens
ctctgccctacagaaagct

SEQ ID NO: 7450293 - DNA, 22 bp, Homo sapiens
ctctgccctcgcacatctgcca

SEQ ID NO: 7450294 - DNA, 22 bp, Homo sapiens
ctctgccctcgcacatctgcca

SEQ ID NO: 7450295 - DNA, 22 bp, Homo sapiens
ctctgccctcacttggggcctg

SEQ ID NO: 7450296 - DNA, 22 bp, Homo sapiens
ctctgcccccagctggtgcttg

SEQ ID NO: 7450297 - DNA, 22 bp, Homo sapiens
ctctgcccgcggatgccacgtc

SEQ ID NO: 7450298 - DNA, 22 bp, Homo sapiens
ctctgcccgcggatgccacgtc

SEQ ID NO: 7450299 - DNA, 22 bp, Homo sapiens
ctctgcccgcggatgccacgtc

SEQ ID NO: 7450300 - DNA, 22 bp, Homo sapiens
ctctgcccgcggatgccacgtc

SEQ ID NO: 7450301 - DNA, 22 bp, Homo sapiens
ctctgcccgcggatgccacgtc

SEQ ID NO: 7450302 - DNA, 22 bp, Homo sapiens
ctctgcccgcggatgccacgtc

SEQ ID NO: 7450303 - DNA, 22 bp, Homo sapiens
ctctgcccgcggatgccacgtc

SEQ ID NO: 7450304 - DNA, 22 bp, Homo sapiens
ctctgcccccagctggtgcttg

SEQ ID NO: 7450305 - DNA, 22 bp, Homo sapiens
ctctgcccccagctggtgcttg

SEQ ID NO: 7450306 - DNA, 22 bp, Homo sapiens
ctctgcccccagctggtgcttg

SEQ ID NO: 7450307 - DNA, 22 bp, Homo sapiens
ctctgcccccagctggtgcttg

SEQ ID NO: 7450308 - DNA, 22 bp, Homo sapiens
ctctgcccccagctggtgcttg

SEQ ID NO: 7450309 - DNA, 22 bp, Homo sapiens
ctctgcccccagctggtgcttg

SEQ ID NO: 7450310 - DNA, 20 bp, Homo sapiens
ctctgcccccagactgacag

SEQ ID NO: 7450311 - DNA, 22 bp, Homo sapiens
ctctgcccagtgcccacaggag

SEQ ID NO: 7450312 - DNA, 22 bp, Homo sapiens
ctctgcccagtgcccacaggag

SEQ ID NO: 7450313 - DNA, 22 bp, Homo sapiens
ctctgcccagtgcccacaggag

SEQ ID NO: 7450314 - DNA, 21 bp, Homo sapiens
ctctgcccagggcctcctgcc

SEQ ID NO: 7450315 - DNA, 21 bp, Homo sapiens
ctctgcccagggcctcctgcc

SEQ ID NO: 7450316 - DNA, 22 bp, Homo sapiens
ctctgcccagtgcccacaggag

SEQ ID NO: 7450317 - DNA, 22 bp, Homo sapiens
ctctgcccagtgcccacaggag

SEQ ID NO: 7450318 - DNA, 21 bp, Homo sapiens
ctctgcccagggcctcctgcc

SEQ ID NO: 7450319 - DNA, 22 bp, Homo sapiens
ctctgcccagtgcccacaggag

SEQ ID NO: 7450320 - DNA, 22 bp, Homo sapiens
ctctgcccagtgcccacaggag

SEQ ID NO: 7450321 - DNA, 22 bp, Homo sapiens
ctctgcccagtgcccacaggag

SEQ ID NO: 7450322 - DNA, 22 bp, Homo sapiens
ctctgctttcctcttacacact

SEQ ID NO: 7450323 - DNA, 22 bp, Homo sapiens
ctctgctttcctcttacacact

SEQ ID NO: 7450324 - DNA, 22 bp, Homo sapiens
ctctgctttcctcttacacact

SEQ ID NO: 7450325 - DNA, 22 bp, Homo sapiens
ctctgctttctcaaaccctgtg

SEQ ID NO: 7450326 - DNA, 20 bp, Homo sapiens
ctctgctttccacctttcag

SEQ ID NO: 7450327 - DNA, 20 bp, Homo sapiens
ctctgctttccacctttcag

SEQ ID NO: 7450328 - DNA, 20 bp, Homo sapiens
ctctgctttccacctttcag

SEQ ID NO: 7450329 - DNA, 20 bp, Homo sapiens
ctctgctttaggagagtcag

SEQ ID NO: 7450330 - DNA, 22 bp, Homo sapiens
tttgctcttgctggaaaagttg

SEQ ID NO: 7450331 - DNA, 20 bp, Homo sapiens
ctctgctttaggagagtcag

SEQ ID NO: 7450332 - DNA, 22 bp, Homo sapiens
tttgctcttgctggaaaagttg

SEQ ID NO: 7450333 - DNA, 22 bp, Homo sapiens
tttgctcttatgaacaaggtgg

SEQ ID NO: 7450334 - DNA, 22 bp, Homo sapiens
tttgctctgctgttgccaggtg

SEQ ID NO: 7450335 - DNA, 22 bp, Homo sapiens
tttgctctgctgttgccaggtg

SEQ ID NO: 7450336 - DNA, 22 bp, Homo sapiens
tttgctctgacagtgccagaga

SEQ ID NO: 7450337 - DNA, 22 bp, Homo sapiens
tttgctctgacagtgccagaga

SEQ ID NO: 7450338 - DNA, 22 bp, Homo sapiens
tttgctctgacagtgccagaga

SEQ ID NO: 7450339 - DNA, 22 bp, Homo sapiens
tttgctctgacagtgccagaga

SEQ ID NO: 7450340 - DNA, 22 bp, Homo sapiens
tttgctctgacagtgccagaga

SEQ ID NO: 7450341 - DNA, 22 bp, Homo sapiens
tttgctcagttctctgtatttt

SEQ ID NO: 7450342 - DNA, 22 bp, Homo sapiens
tttgctctctcaggctcctggg

SEQ ID NO: 7450343 - DNA, 22 bp, Homo sapiens
tttgctcagttctctgtatttt

SEQ ID NO: 7450344 - DNA, 22 bp, Homo sapiens
tttgctatttttctgtgcagct

SEQ ID NO: 7450345 - DNA, 22 bp, Homo sapiens
ctctggaaaattgtgtgggggt

SEQ ID NO: 7450346 - DNA, 22 bp, Homo sapiens
ctctggaaaattgtgtgggggt

SEQ ID NO: 7450347 - DNA, 22 bp, Homo sapiens
ctctggaaatggccatagtcat

SEQ ID NO: 7450348 - DNA, 22 bp, Homo sapiens
ctctggaagaatacacttagaa

SEQ ID NO: 7450349 - DNA, 22 bp, Homo sapiens
ctctggaaatggccatagtcat

SEQ ID NO: 7450350 - DNA, 22 bp, Homo sapiens
ctctggaaaaccactagcagga

SEQ ID NO: 7450351 - DNA, 22 bp, Homo sapiens
ctctggaaaaccactagcagga

SEQ ID NO: 7450352 - DNA, 22 bp, Homo sapiens
ctctgctttttaaaaggagtcc

SEQ ID NO: 7450353 - DNA, 22 bp, Homo sapiens
ctctgctttttaaaaggagtcc

SEQ ID NO: 7450354 - DNA, 22 bp, Homo sapiens
ctctgcttttatgtgccggcgc

SEQ ID NO: 7450355 - DNA, 22 bp, Homo sapiens
ctctgctttgtaagttgtgagg

SEQ ID NO: 7450356 - DNA, 22 bp, Homo sapiens
ctctgctttgtaagttgtgagg

SEQ ID NO: 7450357 - DNA, 22 bp, Homo sapiens
ctctgctttgtaagttgtgagg

SEQ ID NO: 7450358 - DNA, 22 bp, Homo sapiens
ctctgctttttagggagcctag

SEQ ID NO: 7450359 - DNA, 22 bp, Homo sapiens
ctctgctttttaaaaggagtcc

SEQ ID NO: 7450360 - DNA, 22 bp, Homo sapiens
ctctgctttttagggagcctag

SEQ ID NO: 7450361 - DNA, 22 bp, Homo sapiens
ctctggaaaaccactagcagga

SEQ ID NO: 7450362 - DNA, 22 bp, Homo sapiens
ctctggaaaaccactagcagga

SEQ ID NO: 7450363 - DNA, 22 bp, Homo sapiens
tttgctagtacacagctgtttc

SEQ ID NO: 7450364 - DNA, 19 bp, Homo sapiens
tttgccttgcagctgtgtg

SEQ ID NO: 7450365 - DNA, 19 bp, Homo sapiens
tttgccttgcagctgtgtg

SEQ ID NO: 7450366 - DNA, 20 bp, Homo sapiens
tttgcgaggccaaggcgggc

SEQ ID NO: 7450367 - DNA, 20 bp, Homo sapiens
tttgcgaggccaaggcgggc

SEQ ID NO: 7450368 - DNA, 20 bp, Homo sapiens
tttgcgaggccaaggcgggc

SEQ ID NO: 7450369 - DNA, 22 bp, Homo sapiens
tttgctattgtgaatagtgcca

SEQ ID NO: 7450370 - DNA, 22 bp, Homo sapiens
tttgctatttttctgtgcagct

SEQ ID NO: 7450371 - DNA, 22 bp, Homo sapiens
tttgctattgtgaatagtgcca

SEQ ID NO: 7450372 - DNA, 20 bp, Homo sapiens
tttgctatgcatatctgacc

SEQ ID NO: 7450373 - DNA, 22 bp, Homo sapiens
tttgctattgtgaatagtgcca

SEQ ID NO: 7450374 - DNA, 22 bp, Homo sapiens
tttgctaatgcctctgaaatca

SEQ ID NO: 7450375 - DNA, 22 bp, Homo sapiens
tttgctataaaagggtcacacg

SEQ ID NO: 7450376 - DNA, 22 bp, Homo sapiens
tttgctataaaagggtcacacg

SEQ ID NO: 7450377 - DNA, 22 bp, Homo sapiens
tttgctataaaagggtcacacg

SEQ ID NO: 7450378 - DNA, 20 bp, Homo sapiens
tttgctatgcatatctgacc

SEQ ID NO: 7450379 - DNA, 22 bp, Homo sapiens
tttgccagtattttattgatga

SEQ ID NO: 7450380 - DNA, 22 bp, Homo sapiens
tttgccaggtaagtactatgct

SEQ ID NO: 7450381 - DNA, 22 bp, Homo sapiens
tttgccatgtaggttaatcatt

SEQ ID NO: 7450382 - DNA, 23 bp, Homo sapiens
tttgccattacttttaacggcag

SEQ ID NO: 7450383 - DNA, 22 bp, Homo sapiens
tttgccgtcaagtataggattg

SEQ ID NO: 7450384 - DNA, 22 bp, Homo sapiens
tttgccctggagtcaggataca

SEQ ID NO: 7450385 - DNA, 22 bp, Homo sapiens
tttgccctggtcccccgcaggc

SEQ ID NO: 7450386 - DNA, 20 bp, Homo sapiens
tttgcccttcctctgccttt

SEQ ID NO: 7450387 - DNA, 22 bp, Homo sapiens
tttgcctgattctaagagctca

SEQ ID NO: 7450388 - DNA, 22 bp, Homo sapiens
tttgcctctcagagtctacaca

SEQ ID NO: 7450389 - DNA, 22 bp, Homo sapiens
tttgcctgggaattctagtgta

SEQ ID NO: 7450390 - DNA, 21 bp, Homo sapiens
tttgccttcacgaagcatcct

SEQ ID NO: 7450391 - DNA, 22 bp, Homo sapiens
tttgcctgggaattctagtgta

SEQ ID NO: 7450392 - DNA, 22 bp, Homo sapiens
tttgcctgggaattctagtgta

SEQ ID NO: 7450393 - DNA, 19 bp, Homo sapiens
tttgccttgcagctgtgtg

SEQ ID NO: 7450394 - DNA, 22 bp, Homo sapiens
tttgccttctctgaacctattt

SEQ ID NO: 7450395 - DNA, 22 bp, Homo sapiens
tttgccttctctgaacctattt

SEQ ID NO: 7450396 - DNA, 22 bp, Homo sapiens
tttgccttctctgaacctattt

SEQ ID NO: 7450397 - DNA, 21 bp, Homo sapiens
tttgccttcacgaagcatcct

SEQ ID NO: 7450398 - DNA, 21 bp, Homo sapiens
tttgccttcacgaagcatcct

SEQ ID NO: 7450399 - DNA, 21 bp, Homo sapiens
tttgccttcacgaagcatcct

SEQ ID NO: 7450400 - DNA, 22 bp, Homo sapiens
tttgccttctctgaacctattt

SEQ ID NO: 7450401 - DNA, 21 bp, Homo sapiens
tttgccttcacgaagcatcct

SEQ ID NO: 7450402 - DNA, 22 bp, Homo sapiens
ctctggaagtgatggcaggtca

SEQ ID NO: 7450403 - DNA, 20 bp, Homo sapiens
ctctggaagagtttaaatgg

SEQ ID NO: 7450404 - DNA, 22 bp, Homo sapiens
ctctggaagaatacacttagaa

SEQ ID NO: 7450405 - DNA, 22 bp, Homo sapiens
ctctggaatgtttacatgccct

SEQ ID NO: 7450406 - DNA, 22 bp, Homo sapiens
ctctggaatgggtgtttctaac

SEQ ID NO: 7450407 - DNA, 22 bp, Homo sapiens
ctctggaatgggtgtttctaac

SEQ ID NO: 7450408 - DNA, 22 bp, Homo sapiens
ctctggaattaaggaagcctgt

SEQ ID NO: 7450409 - DNA, 22 bp, Homo sapiens
ctctggaattaaggaagcctgt

SEQ ID NO: 7450410 - DNA, 22 bp, Homo sapiens
ctctggaattaaggaagcctgt

SEQ ID NO: 7450411 - DNA, 22 bp, Homo sapiens
ctctggaatgtttacatgccct

SEQ ID NO: 7450412 - DNA, 22 bp, Homo sapiens
tttggacaaacagaatagagct

SEQ ID NO: 7450413 - DNA, 22 bp, Homo sapiens
tttgggaaatagtagaaaatgt

SEQ ID NO: 7450414 - DNA, 22 bp, Homo sapiens
tttgggaaatagtagaaaatgt

SEQ ID NO: 7450415 - DNA, 22 bp, Homo sapiens
tttgggaaatattgtgttcaag

SEQ ID NO: 7450416 - DNA, 22 bp, Homo sapiens
tttggaattggcattctattct

SEQ ID NO: 7450417 - DNA, 22 bp, Homo sapiens
tttggaattggcattctattct

SEQ ID NO: 7450418 - DNA, 22 bp, Homo sapiens
ctctggaattaaggaagcctgt

SEQ ID NO: 7450419 - DNA, 22 bp, Homo sapiens
tttggaattggtggaggaaggg

SEQ ID NO: 7450420 - DNA, 17 bp, Homo sapiens
tttggaatttaaaggca

SEQ ID NO: 7450421 - DNA, 22 bp, Homo sapiens
tttggaattggtggaggaaggg

SEQ ID NO: 7450422 - DNA, 22 bp, Homo sapiens
tttggacaaacagaatagagct

SEQ ID NO: 7450423 - DNA, 22 bp, Homo sapiens
tttggacaaacagaatagagct

SEQ ID NO: 7450424 - DNA, 22 bp, Homo sapiens
tttgggaagtttaaaataagta

SEQ ID NO: 7450425 - DNA, 22 bp, Homo sapiens
tttgggaatctttgtgcatgac

SEQ ID NO: 7450426 - DNA, 22 bp, Homo sapiens
tttgggaattgtagctgtcttg

SEQ ID NO: 7450427 - DNA, 21 bp, Homo sapiens
tttgggactctgatgggagct

SEQ ID NO: 7450428 - DNA, 22 bp, Homo sapiens
tttgggaattgtagctgtcttg

SEQ ID NO: 7450429 - DNA, 21 bp, Homo sapiens
tttgggcaaaattaaatgaga

SEQ ID NO: 7450430 - DNA, 18 bp, Homo sapiens
tttgggatcctcttttct

SEQ ID NO: 7450431 - DNA, 22 bp, Homo sapiens
tttgggcaaaggtagaaggaga

SEQ ID NO: 7450432 - DNA, 22 bp, Homo sapiens
tttgggcaaggtccagattcct

SEQ ID NO: 7450433 - DNA, 22 bp, Homo sapiens
tttgggcaagctcactgattca

SEQ ID NO: 7450434 - DNA, 22 bp, Homo sapiens
tttgggcaattcagtgggacct

SEQ ID NO: 7450435 - DNA, 22 bp, Homo sapiens
tttgggcaattcagtgggacct

SEQ ID NO: 7450436 - DNA, 22 bp, Homo sapiens
tttgggcaattcagtgggacct

SEQ ID NO: 7450437 - DNA, 22 bp, Homo sapiens
tttgggaagtgggagcaaggtg

SEQ ID NO: 7450438 - DNA, 22 bp, Homo sapiens
tttgggaaggcagacatcccac

SEQ ID NO: 7450439 - DNA, 19 bp, Homo sapiens
tttgggaagcccagagtgt

SEQ ID NO: 7450440 - DNA, 22 bp, Homo sapiens
tttgggaagaggaatctctgga

SEQ ID NO: 7450441 - DNA, 22 bp, Homo sapiens
tttgggaagaggaatctctgga

SEQ ID NO: 7450442 - DNA, 22 bp, Homo sapiens
tttgggaacttaattatgtctg

SEQ ID NO: 7450443 - DNA, 22 bp, Homo sapiens
tttgggaactggacttcctgct

SEQ ID NO: 7450444 - DNA, 22 bp, Homo sapiens
tttgggaagaagttgcaaattt

SEQ ID NO: 7450445 - DNA, 22 bp, Homo sapiens
tttgggaactggacttcctgct

SEQ ID NO: 7450446 - DNA, 22 bp, Homo sapiens
tttgggaaccagaagttcaaaa

SEQ ID NO: 7450447 - DNA, 22 bp, Homo sapiens
ctgacagggtagacagagggca

SEQ ID NO: 7450448 - DNA, 22 bp, Homo sapiens
ctgacagggtagacagagggca

SEQ ID NO: 7450449 - DNA, 22 bp, Homo sapiens
ctgacaggctgagatccctggt

SEQ ID NO: 7450450 - DNA, 22 bp, Homo sapiens
ctgacagggtagacagagggca

SEQ ID NO: 7450451 - DNA, 22 bp, Homo sapiens
ctgacagggtagacagagggca

SEQ ID NO: 7450452 - DNA, 22 bp, Homo sapiens
ctgacagggtagacagagggca

SEQ ID NO: 7450453 - DNA, 22 bp, Homo sapiens
ctgacagggtagacagagggca

SEQ ID NO: 7450454 - DNA, 22 bp, Homo sapiens
ctgacaggctgagatccctggt

SEQ ID NO: 7450455 - DNA, 22 bp, Homo sapiens
ctgacaggctgagatccctggt

SEQ ID NO: 7450456 - DNA, 22 bp, Homo sapiens
ctgacaggctgagatccctggt

SEQ ID NO: 7450457 - DNA, 22 bp, Homo sapiens
ctgacagctctggctagtagaa

SEQ ID NO: 7450458 - DNA, 22 bp, Homo sapiens
ctgacagctgaattgcttgcat

SEQ ID NO: 7450459 - DNA, 22 bp, Homo sapiens
ctgacagctgaattgcttgcat

SEQ ID NO: 7450460 - DNA, 22 bp, Homo sapiens
ctgacagctcctagtgctcact

SEQ ID NO: 7450461 - DNA, 22 bp, Homo sapiens
ctgacagctcctagtgctcact

SEQ ID NO: 7450462 - DNA, 22 bp, Homo sapiens
ctgacagcaaaggccagtggct

SEQ ID NO: 7450463 - DNA, 22 bp, Homo sapiens
ctgacagattagatgtgcatat

SEQ ID NO: 7450464 - DNA, 22 bp, Homo sapiens
ctgacagcagcaaatggagata

SEQ ID NO: 7450465 - DNA, 22 bp, Homo sapiens
ctgacagattagatgtgcatat

SEQ ID NO: 7450466 - DNA, 22 bp, Homo sapiens
ctgacagatctggatctgaact

SEQ ID NO: 7450467 - DNA, 22 bp, Homo sapiens
ctgacagatctggatctgaact

SEQ ID NO: 7450468 - DNA, 22 bp, Homo sapiens
ctgacagatctggatctgaact

SEQ ID NO: 7450469 - DNA, 22 bp, Homo sapiens
ctgacagattagatgtgcatat

SEQ ID NO: 7450470 - DNA, 22 bp, Homo sapiens
ctgacagattagatgtgcatat

SEQ ID NO: 7450471 - DNA, 22 bp, Homo sapiens
ctgacagattagatgtgcatat

SEQ ID NO: 7450472 - DNA, 22 bp, Homo sapiens
ctgacagattagatgtgcatat

SEQ ID NO: 7450473 - DNA, 22 bp, Homo sapiens
ctgacagatgctgctggcagta

SEQ ID NO: 7450474 - DNA, 22 bp, Homo sapiens
ctgacagatgctgctggcagta

SEQ ID NO: 7450475 - DNA, 22 bp, Homo sapiens
ctgacagatgctgctggcagta

SEQ ID NO: 7450476 - DNA, 22 bp, Homo sapiens
ctgaatattagtcatgtctgat

SEQ ID NO: 7450477 - DNA, 22 bp, Homo sapiens
ctgaatcatgccattttgctta

SEQ ID NO: 7450478 - DNA, 22 bp, Homo sapiens
ctgaatattagtcatgtctgat

SEQ ID NO: 7450479 - DNA, 22 bp, Homo sapiens
ctgaatatcatttatcattggc

SEQ ID NO: 7450480 - DNA, 22 bp, Homo sapiens
ctgaatcatggtcattagttta

SEQ ID NO: 7450481 - DNA, 22 bp, Homo sapiens
ctgacagatacttatgacataa

SEQ ID NO: 7450482 - DNA, 22 bp, Homo sapiens
ctgaatccacacaaggtgatgg

SEQ ID NO: 7450483 - DNA, 22 bp, Homo sapiens
ctgaatcatggtcattagttta

SEQ ID NO: 7450484 - DNA, 18 bp, Homo sapiens
ctgaccctggctctgggt

SEQ ID NO: 7450485 - DNA, 22 bp, Homo sapiens
ctgaccctggaggcatttctct

SEQ ID NO: 7450486 - DNA, 22 bp, Homo sapiens
ctgaccctggtcaagttgcctc

SEQ ID NO: 7450487 - DNA, 22 bp, Homo sapiens
ctgaccctggtcaagttgcctc

SEQ ID NO: 7450488 - DNA, 18 bp, Homo sapiens
ctgaccctggctctgggt

SEQ ID NO: 7450489 - DNA, 22 bp, Homo sapiens
ctgacccttgctcgggccctgt

SEQ ID NO: 7450490 - DNA, 22 bp, Homo sapiens
ctgaccctagcatctctgtgca

SEQ ID NO: 7450491 - DNA, 22 bp, Homo sapiens
ctgacccatataagagtggagg

SEQ ID NO: 7450492 - DNA, 19 bp, Homo sapiens
ctgacccaggacaccacgg

SEQ ID NO: 7450493 - DNA, 19 bp, Homo sapiens
ctgacccaggacaccacgg

SEQ ID NO: 7450494 - DNA, 20 bp, Homo sapiens
ctgaccagcagcctgtctcc

SEQ ID NO: 7450495 - DNA, 20 bp, Homo sapiens
ctgaccagcagcctgtctcc

SEQ ID NO: 7450496 - DNA, 20 bp, Homo sapiens
ctgaccagcagcctgtctcc

SEQ ID NO: 7450497 - DNA, 22 bp, Homo sapiens
ctgaccagccctgcccagggaa

SEQ ID NO: 7450498 - DNA, 22 bp, Homo sapiens
ctgaccagccctgcccagggaa

SEQ ID NO: 7450499 - DNA, 22 bp, Homo sapiens
ctgaccagggtagaggtgagag

SEQ ID NO: 7450500 - DNA, 22 bp, Homo sapiens
ctgaccatcatggtgaaacccc

SEQ ID NO: 7450501 - DNA, 20 bp, Homo sapiens
ctgacccaatctctgtcccc

SEQ ID NO: 7450502 - DNA, 20 bp, Homo sapiens
ctgacccaatctctgtcccc

SEQ ID NO: 7450503 - DNA, 20 bp, Homo sapiens
ctgacccaatctctgtcccc

SEQ ID NO: 7450504 - DNA, 22 bp, Homo sapiens
ctgacccagaggaactgcaaag

SEQ ID NO: 7450505 - DNA, 19 bp, Homo sapiens
ctgacccaggacaccacgg

SEQ ID NO: 7450506 - DNA, 22 bp, Homo sapiens
ctgaccagtccttagcacctgg

SEQ ID NO: 7450507 - DNA, 22 bp, Homo sapiens
ctgaccagtccttagcacctgg

SEQ ID NO: 7450508 - DNA, 22 bp, Homo sapiens
ctgaccagggtagaggtgagag

SEQ ID NO: 7450509 - DNA, 22 bp, Homo sapiens
ctgaccagggtagaggtgagag

SEQ ID NO: 7450510 - DNA, 22 bp, Homo sapiens
ctgaccatcatggtgaaacccc

SEQ ID NO: 7450511 - DNA, 22 bp, Homo sapiens
ctgacagtaactaatgtggaga

SEQ ID NO: 7450512 - DNA, 22 bp, Homo sapiens
ctgacaggttggtagctttgga

SEQ ID NO: 7450513 - DNA, 22 bp, Homo sapiens
ctgacaggttggtagctttgga

SEQ ID NO: 7450514 - DNA, 22 bp, Homo sapiens
ctgacagtctcattgatttgct

SEQ ID NO: 7450515 - DNA, 22 bp, Homo sapiens
ctgacagtcttgccaagtttct

SEQ ID NO: 7450516 - DNA, 22 bp, Homo sapiens
ctgacagtcttgccaagtttct

SEQ ID NO: 7450517 - DNA, 22 bp, Homo sapiens
ctgacagtttttgctgtattgt

SEQ ID NO: 7450518 - DNA, 22 bp, Homo sapiens
ctgacagtgtacactgacagct

SEQ ID NO: 7450519 - DNA, 22 bp, Homo sapiens
ctgacagtgtacactgacagct

SEQ ID NO: 7450520 - DNA, 22 bp, Homo sapiens
ctgacagtttttgctgtattgt

SEQ ID NO: 7450521 - DNA, 22 bp, Homo sapiens
ctgacatttactgagcacttac

SEQ ID NO: 7450522 - DNA, 22 bp, Homo sapiens
ctgaccacaggcctctaacagc

SEQ ID NO: 7450523 - DNA, 22 bp, Homo sapiens
ctgaccacaggcctctaacagc

SEQ ID NO: 7450524 - DNA, 22 bp, Homo sapiens
ctgaccagaccccaggaggctg

SEQ ID NO: 7450525 - DNA, 22 bp, Homo sapiens
ctgaccagaccccaggaggctg

SEQ ID NO: 7450526 - DNA, 22 bp, Homo sapiens
ctgaccaacatggtgaaacctt

SEQ ID NO: 7450527 - DNA, 22 bp, Homo sapiens
ctgacatttactgagcacttac

SEQ ID NO: 7450528 - DNA, 22 bp, Homo sapiens
ctgacatggggatccaccttag

SEQ ID NO: 7450529 - DNA, 22 bp, Homo sapiens
ctgacatgtataagctttaagt

SEQ ID NO: 7450530 - DNA, 22 bp, Homo sapiens
ctgacatttactgagcacttac

SEQ ID NO: 7450531 - DNA, 22 bp, Homo sapiens
ctgacatttactgagcacttac

SEQ ID NO: 7450532 - DNA, 22 bp, Homo sapiens
ctctttgaaatccatcactgct

SEQ ID NO: 7450533 - DNA, 18 bp, Homo sapiens
ctctttctttggcacaaa

SEQ ID NO: 7450534 - DNA, 22 bp, Homo sapiens
ctctttctggaaggcagagtgg

SEQ ID NO: 7450535 - DNA, 18 bp, Homo sapiens
ctctttctttggcacaaa

SEQ ID NO: 7450536 - DNA, 22 bp, Homo sapiens
ctctttctggaaggcagagtgg

SEQ ID NO: 7450537 - DNA, 22 bp, Homo sapiens
ctctttctggaaggcagagtgg

SEQ ID NO: 7450538 - DNA, 22 bp, Homo sapiens
ctctttctgattcgctgggacc

SEQ ID NO: 7450539 - DNA, 22 bp, Homo sapiens
ctctttggagaagcacgtatta

SEQ ID NO: 7450540 - DNA, 22 bp, Homo sapiens
ctctttggagaagcacgtatta

SEQ ID NO: 7450541 - DNA, 22 bp, Homo sapiens
ctctttggagaagcacgtatta

SEQ ID NO: 7450542 - DNA, 22 bp, Homo sapiens
ctctttgacgtgcccatgtccc

SEQ ID NO: 7450543 - DNA, 22 bp, Homo sapiens
ctctttgaaatccatcactgct

SEQ ID NO: 7450544 - DNA, 22 bp, Homo sapiens
ctctttgaaatccatcactgct

SEQ ID NO: 7450545 - DNA, 20 bp, Homo sapiens
ctctttgaaatgctcttggg

SEQ ID NO: 7450546 - DNA, 22 bp, Homo sapiens
ctctttgaaatccatcactgct

SEQ ID NO: 7450547 - DNA, 20 bp, Homo sapiens
ctctttgaaatgctcttggg

SEQ ID NO: 7450548 - DNA, 22 bp, Homo sapiens
ctctttgacgtgcccatgtccc

SEQ ID NO: 7450549 - DNA, 22 bp, Homo sapiens
ctctttggccagaaaatgtttt

SEQ ID NO: 7450550 - DNA, 22 bp, Homo sapiens
ctctttggccagaaaatgtttt

SEQ ID NO: 7450551 - DNA, 22 bp, Homo sapiens
ctgaatatcatttatcattggc

SEQ ID NO: 7450552 - DNA, 22 bp, Homo sapiens
ctctttggatgtttatgataag

SEQ ID NO: 7450553 - DNA, 22 bp, Homo sapiens
ctctttggatgtttatgataag

SEQ ID NO: 7450554 - DNA, 22 bp, Homo sapiens
ctctttggatgtttatgataag

SEQ ID NO: 7450555 - DNA, 22 bp, Homo sapiens
ctctttggatagaattacaaag

SEQ ID NO: 7450556 - DNA, 22 bp, Homo sapiens
ctctttggatgtttatgataag

SEQ ID NO: 7450557 - DNA, 19 bp, Homo sapiens
ctctttggagatccttgga

SEQ ID NO: 7450558 - DNA, 22 bp, Homo sapiens
ctctttggagaagcacgtatta

SEQ ID NO: 7450559 - DNA, 22 bp, Homo sapiens
ctctttggatagaattacaaag

SEQ ID NO: 7450560 - DNA, 19 bp, Homo sapiens
ctctttggagatccttgga

SEQ ID NO: 7450561 - DNA, 19 bp, Homo sapiens
ctctttggagatccttgga

SEQ ID NO: 7450562 - DNA, 19 bp, Homo sapiens
ctctttggagatccttgga

SEQ ID NO: 7450563 - DNA, 22 bp, Homo sapiens
ctctttggatagaattacaaag

SEQ ID NO: 7450564 - DNA, 22 bp, Homo sapiens
ctctttggatagaattacaaag

SEQ ID NO: 7450565 - DNA, 22 bp, Homo sapiens
ctctttggatagaattacaaag

SEQ ID NO: 7450566 - DNA, 22 bp, Homo sapiens
ctctttggatagaattacaaag

SEQ ID NO: 7450567 - DNA, 22 bp, Homo sapiens
ctctttggatagaattacaaag

SEQ ID NO: 7450568 - DNA, 22 bp, Homo sapiens
ctctttagtttgaaatccacat

SEQ ID NO: 7450569 - DNA, 22 bp, Homo sapiens
ctctttagtggtgatgatgcta

SEQ ID NO: 7450570 - DNA, 17 bp, Homo sapiens
ctctttataaagagtta

SEQ ID NO: 7450571 - DNA, 17 bp, Homo sapiens
ctctttataaagagtta

SEQ ID NO: 7450572 - DNA, 21 bp, Homo sapiens
ctctttatatagtaaagatat

SEQ ID NO: 7450573 - DNA, 21 bp, Homo sapiens
ctctttatatagtaaagatat

SEQ ID NO: 7450574 - DNA, 21 bp, Homo sapiens
ctctttatatagtaaagatat

SEQ ID NO: 7450575 - DNA, 21 bp, Homo sapiens
ctctttatatagtaaagatat

SEQ ID NO: 7450576 - DNA, 22 bp, Homo sapiens
ctctttcagttctgatagtctc

SEQ ID NO: 7450577 - DNA, 22 bp, Homo sapiens
ctctttcagttctgatagtctc

SEQ ID NO: 7450578 - DNA, 19 bp, Homo sapiens
ctctttccattgtatttgc

SEQ ID NO: 7450579 - DNA, 19 bp, Homo sapiens
ctctttccattgtatttgc

SEQ ID NO: 7450580 - DNA, 22 bp, Homo sapiens
ctctttccagggtaccccaggt

SEQ ID NO: 7450581 - DNA, 22 bp, Homo sapiens
ctctttccagggtaccccaggt

SEQ ID NO: 7450582 - DNA, 22 bp, Homo sapiens
ctctttccagggtaccccaggt

SEQ ID NO: 7450583 - DNA, 22 bp, Homo sapiens
ctctttcctcgatgggctcctg

SEQ ID NO: 7450584 - DNA, 22 bp, Homo sapiens
ctctttcctcgatgggctcctg

SEQ ID NO: 7450585 - DNA, 22 bp, Homo sapiens
ctctttcctcgatgggctcctg

SEQ ID NO: 7450586 - DNA, 22 bp, Homo sapiens
ctctttctcattgtcagcagaa

SEQ ID NO: 7450587 - DNA, 22 bp, Homo sapiens
ctctttcctcgatgggctcctg

SEQ ID NO: 7450588 - DNA, 22 bp, Homo sapiens
ctctttcctcagccacagtcta

SEQ ID NO: 7450589 - DNA, 22 bp, Homo sapiens
ctctttcctcagccacagtcta

SEQ ID NO: 7450590 - DNA, 22 bp, Homo sapiens
ctctttcctcagccacagtcta

SEQ ID NO: 7450591 - DNA, 22 bp, Homo sapiens
ctctttcctcagccacagtcta

SEQ ID NO: 7450592 - DNA, 22 bp, Homo sapiens
ctctttctcattgtcagcagaa

SEQ ID NO: 7450593 - DNA, 22 bp, Homo sapiens
ctctttctcgccgcccgcagtc

SEQ ID NO: 7450594 - DNA, 22 bp, Homo sapiens
ctctttctgattcgctgggacc

SEQ ID NO: 7450595 - DNA, 22 bp, Homo sapiens
ctctttctgattcgctgggacc

SEQ ID NO: 7450596 - DNA, 22 bp, Homo sapiens
ctctttctgattcgctgggacc

SEQ ID NO: 7450597 - DNA, 22 bp, Homo sapiens
ctctttctgattcgctgggacc

SEQ ID NO: 7450598 - DNA, 22 bp, Homo sapiens
ctgagcctcctgcttctatttc

SEQ ID NO: 7450599 - DNA, 22 bp, Homo sapiens
ctgagcctcctgcttctatttc

SEQ ID NO: 7450600 - DNA, 22 bp, Homo sapiens
ctgagcctcctgcttctatttc

SEQ ID NO: 7450601 - DNA, 22 bp, Homo sapiens
ctgagcctcctgcttctatttc

SEQ ID NO: 7450602 - DNA, 22 bp, Homo sapiens
ctgagcctcctgcttctatttc

SEQ ID NO: 7450603 - DNA, 22 bp, Homo sapiens
ctgaggcagagggcagaccaga

SEQ ID NO: 7450604 - DNA, 22 bp, Homo sapiens
ctgagcctgtgtttctctggca

SEQ ID NO: 7450605 - DNA, 22 bp, Homo sapiens
ctgagcctgtgtttctctggca

SEQ ID NO: 7450606 - DNA, 22 bp, Homo sapiens
ctgaggcagagggcagaccaga

SEQ ID NO: 7450607 - DNA, 22 bp, Homo sapiens
ctgagcctgtgtttctctggca

SEQ ID NO: 7450608 - DNA, 22 bp, Homo sapiens
ctgagcctgtgtttctctggca

SEQ ID NO: 7450609 - DNA, 21 bp, Homo sapiens
ctgaggcagcacagctagtca

SEQ ID NO: 7450610 - DNA, 21 bp, Homo sapiens
ctgaggcatgcaggcctgggc

SEQ ID NO: 7450611 - DNA, 22 bp, Homo sapiens
ctgaggcagagggcagaccaga

SEQ ID NO: 7450612 - DNA, 22 bp, Homo sapiens
ctgaggcagagggcagaccaga

SEQ ID NO: 7450613 - DNA, 22 bp, Homo sapiens
ctgaggcagagggcagaccaga

SEQ ID NO: 7450614 - DNA, 22 bp, Homo sapiens
ctgaggcagagggcagaccaga

SEQ ID NO: 7450615 - DNA, 22 bp, Homo sapiens
ctgaggcagagggcagaccaga

SEQ ID NO: 7450616 - DNA, 22 bp, Homo sapiens
ctgaggcagagggcagaccaga

SEQ ID NO: 7450617 - DNA, 22 bp, Homo sapiens
ctgagcccttgaacccaagtcc

SEQ ID NO: 7450618 - DNA, 22 bp, Homo sapiens
ctgagcccttgaacccaagtcc

SEQ ID NO: 7450619 - DNA, 22 bp, Homo sapiens
ctgagcccttgaacccaagtcc

SEQ ID NO: 7450620 - DNA, 22 bp, Homo sapiens
ctgagcccttgaacccaagtcc

SEQ ID NO: 7450621 - DNA, 22 bp, Homo sapiens
ctgagcccttgcttatgcttcc

SEQ ID NO: 7450622 - DNA, 22 bp, Homo sapiens
ctgagcccttgcttatgcttcc

SEQ ID NO: 7450623 - DNA, 22 bp, Homo sapiens
ctgagcccttgcttatgcttcc

SEQ ID NO: 7450624 - DNA, 22 bp, Homo sapiens
ctgagcccttgcttatgcttcc

SEQ ID NO: 7450625 - DNA, 22 bp, Homo sapiens
ctgagcccttgtcttcctggtc

SEQ ID NO: 7450626 - DNA, 19 bp, Homo sapiens
ctgagcctcagtttcctag

SEQ ID NO: 7450627 - DNA, 22 bp, Homo sapiens
ctgagcctccatttcatcaggt

SEQ ID NO: 7450628 - DNA, 22 bp, Homo sapiens
ctgagcctccatttcatcaggt

SEQ ID NO: 7450629 - DNA, 22 bp, Homo sapiens
ctgagccctgcctcttgtcact

SEQ ID NO: 7450630 - DNA, 22 bp, Homo sapiens
ctgagccctctgttttccctct

SEQ ID NO: 7450631 - DNA, 22 bp, Homo sapiens
ctgagccctggctcgcctggag

SEQ ID NO: 7450632 - DNA, 22 bp, Homo sapiens
ctgagccctgcctcttgtcact

SEQ ID NO: 7450633 - DNA, 22 bp, Homo sapiens
ctgagccctgcctcttgtcact

SEQ ID NO: 7450634 - DNA, 22 bp, Homo sapiens
ctgagccctgcctcttgtcact

SEQ ID NO: 7450635 - DNA, 20 bp, Homo sapiens
ctgagcccttcctgtgaacc

SEQ ID NO: 7450636 - DNA, 20 bp, Homo sapiens
ctgagcccttcctgtgaacc

SEQ ID NO: 7450637 - DNA, 20 bp, Homo sapiens
ctgagcccttcctgtgaacc

SEQ ID NO: 7450638 - DNA, 22 bp, Homo sapiens
ctgagccctggctcgcctggag

SEQ ID NO: 7450639 - DNA, 22 bp, Homo sapiens
ctgagccctggctcgcctggag

SEQ ID NO: 7450640 - DNA, 22 bp, Homo sapiens
ctgagcccaggcgggagctgag

SEQ ID NO: 7450641 - DNA, 22 bp, Homo sapiens
ctgagcccaggcgggagctgag

SEQ ID NO: 7450642 - DNA, 22 bp, Homo sapiens
ctgagcccaggcgggagctgag

SEQ ID NO: 7450643 - DNA, 22 bp, Homo sapiens
ctgagcccaggcgggagctgag

SEQ ID NO: 7450644 - DNA, 22 bp, Homo sapiens
ctgagccatgggtctaagcact

SEQ ID NO: 7450645 - DNA, 20 bp, Homo sapiens
ctgagcccagatcccaggtc

SEQ ID NO: 7450646 - DNA, 20 bp, Homo sapiens
ctgagcccagatcccaggtc

SEQ ID NO: 7450647 - DNA, 20 bp, Homo sapiens
ctgagcccagatcccaggtc

SEQ ID NO: 7450648 - DNA, 20 bp, Homo sapiens
ctgagcccagatcccaggtc

SEQ ID NO: 7450649 - DNA, 22 bp, Homo sapiens
ctgagcccattgggtgctgtta

SEQ ID NO: 7450650 - DNA, 22 bp, Homo sapiens
ctgagcccattgggtgctgtta

SEQ ID NO: 7450651 - DNA, 22 bp, Homo sapiens
ctgagcccattgggtgctgtta

SEQ ID NO: 7450652 - DNA, 22 bp, Homo sapiens
ctgagcccattgggtgctgtta

SEQ ID NO: 7450653 - DNA, 22 bp, Homo sapiens
ctgagcccattgggtgctgtta

SEQ ID NO: 7450654 - DNA, 22 bp, Homo sapiens
ctgagccccatctgaggtgccc

SEQ ID NO: 7450655 - DNA, 22 bp, Homo sapiens
ctgagccccatctgaggtgccc

SEQ ID NO: 7450656 - DNA, 22 bp, Homo sapiens
ctgagccccatctgaggtgccc

SEQ ID NO: 7450657 - DNA, 20 bp, Homo sapiens
ctgagcccccagcctgcagg

SEQ ID NO: 7450658 - DNA, 22 bp, Homo sapiens
ctgagccccatctgaggtgccc

SEQ ID NO: 7450659 - DNA, 22 bp, Homo sapiens
ctgagccccatctgaggtgccc

SEQ ID NO: 7450660 - DNA, 22 bp, Homo sapiens
ctgagccccatctgaggtgccc

SEQ ID NO: 7450661 - DNA, 22 bp, Homo sapiens
ctgagccctcctgcttgctgag

SEQ ID NO: 7450662 - DNA, 22 bp, Homo sapiens
ctgagccctcctgcttgctgag

SEQ ID NO: 7450663 - DNA, 22 bp, Homo sapiens
ctgagccctcctgcttgctgag

SEQ ID NO: 7450664 - DNA, 22 bp, Homo sapiens
ctgagcccgttgtgaatattcc

SEQ ID NO: 7450665 - DNA, 22 bp, Homo sapiens
ctgagcccctctgacctcagag

SEQ ID NO: 7450666 - DNA, 22 bp, Homo sapiens
ctgagcccctctgacctcagag

SEQ ID NO: 7450667 - DNA, 22 bp, Homo sapiens
ctgagcccctctgacctcagag

SEQ ID NO: 7450668 - DNA, 22 bp, Homo sapiens
ctgagcccgggtgctctacccc

SEQ ID NO: 7450669 - DNA, 22 bp, Homo sapiens
ctgagcccgggtgctctacccc

SEQ ID NO: 7450670 - DNA, 22 bp, Homo sapiens
ctgagcccgggtgctctacccc

SEQ ID NO: 7450671 - DNA, 20 bp, Homo sapiens
ctgagcccccagcctgcagg

SEQ ID NO: 7450672 - DNA, 20 bp, Homo sapiens
ctgagcccccagcctgcagg

SEQ ID NO: 7450673 - DNA, 20 bp, Homo sapiens
ctgagcccccagcctgcagg

SEQ ID NO: 7450674 - DNA, 20 bp, Homo sapiens
ctgagcccccagcctgcagg

SEQ ID NO: 7450675 - DNA, 17 bp, Homo sapiens
ctgagccccgggcagct

SEQ ID NO: 7450676 - DNA, 17 bp, Homo sapiens
ctgagccccgggcagct

SEQ ID NO: 7450677 - DNA, 17 bp, Homo sapiens
ctgagccccgggcagct

SEQ ID NO: 7450678 - DNA, 17 bp, Homo sapiens
ctgagccccgggcagct

SEQ ID NO: 7450679 - DNA, 22 bp, Homo sapiens
ctgagcccctctgacctcagag

SEQ ID NO: 7450680 - DNA, 22 bp, Homo sapiens
ctgagcccctctgacctcagag

SEQ ID NO: 7450681 - DNA, 17 bp, Homo sapiens
ctgagccccgggcagct

SEQ ID NO: 7450682 - DNA, 22 bp, Homo sapiens
ctgactgtaattctgttcttaa

SEQ ID NO: 7450683 - DNA, 22 bp, Homo sapiens
ctgactgtaattctgttcttaa

SEQ ID NO: 7450684 - DNA, 22 bp, Homo sapiens
ctgagccaaccacagcaggagc

SEQ ID NO: 7450685 - DNA, 22 bp, Homo sapiens
ctgactctctgagctcaaggtt

SEQ ID NO: 7450686 - DNA, 22 bp, Homo sapiens
ctgactctctgagctcaaggtt

SEQ ID NO: 7450687 - DNA, 20 bp, Homo sapiens
ctgactctccttggcttgga

SEQ ID NO: 7450688 - DNA, 22 bp, Homo sapiens
ctgactctctgagctcaaggtt

SEQ ID NO: 7450689 - DNA, 22 bp, Homo sapiens
ctgactcctatcacagtgttct

SEQ ID NO: 7450690 - DNA, 22 bp, Homo sapiens
ctgactcctatgccccatgggc

SEQ ID NO: 7450691 - DNA, 22 bp, Homo sapiens
ctgactccctgattctgggttt

SEQ ID NO: 7450692 - DNA, 18 bp, Homo sapiens
ctgactcctttgctgcca

SEQ ID NO: 7450693 - DNA, 22 bp, Homo sapiens
ctgactctcctgagatggggag

SEQ ID NO: 7450694 - DNA, 22 bp, Homo sapiens
ctgactccttaccatatgcttt

SEQ ID NO: 7450695 - DNA, 22 bp, Homo sapiens
ctgaccttcgggcgggctgcgg

SEQ ID NO: 7450696 - DNA, 22 bp, Homo sapiens
ctgaccttcccaggggctggaa

SEQ ID NO: 7450697 - DNA, 16 bp, Homo sapiens
ctgacctgtgcactgt

SEQ ID NO: 7450698 - DNA, 16 bp, Homo sapiens
ctgacctgtgcactgt

SEQ ID NO: 7450699 - DNA, 22 bp, Homo sapiens
ctgacctgttacactagggctg

SEQ ID NO: 7450700 - DNA, 22 bp, Homo sapiens
ctgacctgttacactagggctg

SEQ ID NO: 7450701 - DNA, 22 bp, Homo sapiens
ctgactatctttctcaaagtgg

SEQ ID NO: 7450702 - DNA, 22 bp, Homo sapiens
ctgactcactgtggctcttaat

SEQ ID NO: 7450703 - DNA, 22 bp, Homo sapiens
ctgactcccaaagaggacgcgt

SEQ ID NO: 7450704 - DNA, 22 bp, Homo sapiens
ctgactcccaagctagtgctct

SEQ ID NO: 7450705 - DNA, 22 bp, Homo sapiens
ctgactcccaagctagtgctct

SEQ ID NO: 7450706 - DNA, 23 bp, Homo sapiens
ctgactcatcccaccacctcctc

SEQ ID NO: 7450707 - DNA, 22 bp, Homo sapiens
ctgactatctttctcaaagtgg

SEQ ID NO: 7450708 - DNA, 23 bp, Homo sapiens
ctgactcatcccaccacctcctc

SEQ ID NO: 7450709 - DNA, 22 bp, Homo sapiens
ctgacctgtaactgtaagagac

SEQ ID NO: 7450710 - DNA, 22 bp, Homo sapiens
ctgacctgtaactgtaagagac

SEQ ID NO: 7450711 - DNA, 22 bp, Homo sapiens
ctgacctgctaagcccctgtcc

SEQ ID NO: 7450712 - DNA, 22 bp, Homo sapiens
ctgacctggccttggtgggcca

SEQ ID NO: 7450713 - DNA, 19 bp, Homo sapiens
ctgacctggctcagcaaag

SEQ ID NO: 7450714 - DNA, 19 bp, Homo sapiens
ctgacctggctcagcaaag

SEQ ID NO: 7450715 - DNA, 22 bp, Homo sapiens
ctgacctgagtggtacaaggca

SEQ ID NO: 7450716 - DNA, 22 bp, Homo sapiens
ctgacctgcccttaggcttctc

SEQ ID NO: 7450717 - DNA, 22 bp, Homo sapiens
ctgacctgcccttaggcttctc

SEQ ID NO: 7450718 - DNA, 22 bp, Homo sapiens
ctgacctgcggggaggagggcc

SEQ ID NO: 7450719 - DNA, 23 bp, Homo sapiens
ctgacctgacccataagcaagga

SEQ ID NO: 7450720 - DNA, 18 bp, Homo sapiens
ctgacctctgagcccctc

SEQ ID NO: 7450721 - DNA, 18 bp, Homo sapiens
ctgacctctgagcccctc

SEQ ID NO: 7450722 - DNA, 22 bp, Homo sapiens
ctgaccctttagggtatgttta

SEQ ID NO: 7450723 - DNA, 18 bp, Homo sapiens
ctgacccttttacattcc

SEQ ID NO: 7450724 - DNA, 18 bp, Homo sapiens
ctgacccttttacattcc

SEQ ID NO: 7450725 - DNA, 20 bp, Homo sapiens
ctgagccaactctcttcttg

SEQ ID NO: 7450726 - DNA, 20 bp, Homo sapiens
ctgagccaactctcttcttg

SEQ ID NO: 7450727 - DNA, 20 bp, Homo sapiens
ctgagccaactctcttcttg

SEQ ID NO: 7450728 - DNA, 22 bp, Homo sapiens
ctgagccaaccacagcaggagc

SEQ ID NO: 7450729 - DNA, 22 bp, Homo sapiens
ctgagccaaccacagcaggagc

SEQ ID NO: 7450730 - DNA, 22 bp, Homo sapiens
ctgagccaaccacagcaggagc

SEQ ID NO: 7450731 - DNA, 22 bp, Homo sapiens
ctgagccagtagtcagggacaa

SEQ ID NO: 7450732 - DNA, 20 bp, Homo sapiens
ctgagccaactctcttcttg

SEQ ID NO: 7450733 - DNA, 22 bp, Homo sapiens
ctgagccaaggggacagtgaca

SEQ ID NO: 7450734 - DNA, 22 bp, Homo sapiens
ctgagccataagggaggctggg

SEQ ID NO: 7450735 - DNA, 22 bp, Homo sapiens
ctgagccataagggaggctggg

SEQ ID NO: 7450736 - DNA, 22 bp, Homo sapiens
ctgagccataagggaggctggg

SEQ ID NO: 7450737 - DNA, 22 bp, Homo sapiens
ctgagccagtagtcagggacaa

SEQ ID NO: 7450738 - DNA, 22 bp, Homo sapiens
ctgagccagtagtcagggacaa

SEQ ID NO: 7450739 - DNA, 22 bp, Homo sapiens
ctgagccagtagtcagggacaa

SEQ ID NO: 7450740 - DNA, 22 bp, Homo sapiens
ctgagccatgagcctgcgccca

SEQ ID NO: 7450741 - DNA, 22 bp, Homo sapiens
ctgagccatccataccagctta

SEQ ID NO: 7450742 - DNA, 22 bp, Homo sapiens
ctgagccatccataccagctta

SEQ ID NO: 7450743 - DNA, 22 bp, Homo sapiens
ctgagccatccataccagctta

SEQ ID NO: 7450744 - DNA, 22 bp, Homo sapiens
ctgagccatccataccagctta

SEQ ID NO: 7450745 - DNA, 22 bp, Homo sapiens
ctgagccatccataccagctta

SEQ ID NO: 7450746 - DNA, 22 bp, Homo sapiens
ctgagccatccataccagctta

SEQ ID NO: 7450747 - DNA, 22 bp, Homo sapiens
ctgagccataagggaggctggg

SEQ ID NO: 7450748 - DNA, 22 bp, Homo sapiens
ctgagccataagggaggctggg

SEQ ID NO: 7450749 - DNA, 22 bp, Homo sapiens
ctgagccatgagcctgcgccca

SEQ ID NO: 7450750 - DNA, 22 bp, Homo sapiens
ctgagccatgggtctaagcact

SEQ ID NO: 7450751 - DNA, 22 bp, Homo sapiens
ctgagccatgggtctaagcact

SEQ ID NO: 7450752 - DNA, 22 bp, Homo sapiens
ctgagccatgggtctaagcact

SEQ ID NO: 7450753 - DNA, 22 bp, Homo sapiens
ctgagccatgagcctgcgccca

SEQ ID NO: 7450754 - DNA, 22 bp, Homo sapiens
ctgagccatgagcctgcgccca

SEQ ID NO: 7450755 - DNA, 22 bp, Homo sapiens
ctgagccatgagcctgcgccca

SEQ ID NO: 7450756 - DNA, 22 bp, Homo sapiens
ctgagccatgagcctgcgccca

SEQ ID NO: 7450757 - DNA, 22 bp, Homo sapiens
ctgagccatgagcctgcgccca

SEQ ID NO: 7450758 - DNA, 19 bp, Homo sapiens
ctgaggcccatgtaccatg

SEQ ID NO: 7450759 - DNA, 22 bp, Homo sapiens
ctgaggcccctctcttgagctt

SEQ ID NO: 7450760 - DNA, 19 bp, Homo sapiens
ctgaggcccatgtaccatg

SEQ ID NO: 7450761 - DNA, 22 bp, Homo sapiens
ctgaggcccctctcttgagctt

SEQ ID NO: 7450762 - DNA, 22 bp, Homo sapiens
ctgaggcccctctcttgagctt

SEQ ID NO: 7450763 - DNA, 22 bp, Homo sapiens
ctgaggcccctctcttgagctt

SEQ ID NO: 7450764 - DNA, 22 bp, Homo sapiens
ctgaggcccctcttgtgagcat

SEQ ID NO: 7450765 - DNA, 22 bp, Homo sapiens
ctgaggcccctcttgtgagcat

SEQ ID NO: 7450766 - DNA, 22 bp, Homo sapiens
ctgaggcccctcttgtgagcat

SEQ ID NO: 7450767 - DNA, 22 bp, Homo sapiens
ctgaggcccctctcttgagctt

SEQ ID NO: 7450768 - DNA, 22 bp, Homo sapiens
ctgaggcccctcttgtgagcat

SEQ ID NO: 7450769 - DNA, 22 bp, Homo sapiens
ctgaggccggagcactgaagag

SEQ ID NO: 7450770 - DNA, 22 bp, Homo sapiens
ctgaggccggagcactgaagag

SEQ ID NO: 7450771 - DNA, 22 bp, Homo sapiens
ctgaggccggagcactgaagag

SEQ ID NO: 7450772 - DNA, 22 bp, Homo sapiens
ctgaggcccctcttgtgagcat

SEQ ID NO: 7450773 - DNA, 22 bp, Homo sapiens
ctgaggcccctcttgtgagcat

SEQ ID NO: 7450774 - DNA, 22 bp, Homo sapiens
ctgaggccagctgcagagctct

SEQ ID NO: 7450775 - DNA, 22 bp, Homo sapiens
ctgaggccagctgcagagctct

SEQ ID NO: 7450776 - DNA, 22 bp, Homo sapiens
ctgaggccagctgcagagctct

SEQ ID NO: 7450777 - DNA, 22 bp, Homo sapiens
ctgaggccagctgcagagctct

SEQ ID NO: 7450778 - DNA, 22 bp, Homo sapiens
ctgaggccagctgcagagctct

SEQ ID NO: 7450779 - DNA, 18 bp, Homo sapiens
ctgaggcccagagagggc

SEQ ID NO: 7450780 - DNA, 18 bp, Homo sapiens
ctgaggcccagagagggc

SEQ ID NO: 7450781 - DNA, 18 bp, Homo sapiens
ctgaggcccagagagggc

SEQ ID NO: 7450782 - DNA, 18 bp, Homo sapiens
ctgaggcccagagagggc

SEQ ID NO: 7450783 - DNA, 18 bp, Homo sapiens
ctgaggcccagagagggc

SEQ ID NO: 7450784 - DNA, 17 bp, Homo sapiens
ctgaggcccagggccca

SEQ ID NO: 7450785 - DNA, 17 bp, Homo sapiens
ctgaggcccagggccca

SEQ ID NO: 7450786 - DNA, 17 bp, Homo sapiens
ctgaggcccagggccca

SEQ ID NO: 7450787 - DNA, 19 bp, Homo sapiens
ctgaggcccatgtaccatg

SEQ ID NO: 7450788 - DNA, 17 bp, Homo sapiens
ctgaggcccagggccca

SEQ ID NO: 7450789 - DNA, 17 bp, Homo sapiens
ctgaggcccagggccca

SEQ ID NO: 7450790 - DNA, 22 bp, Homo sapiens
ctgaggccagaacccgaccctg

SEQ ID NO: 7450791 - DNA, 22 bp, Homo sapiens
ctgaggccagaacccgaccctg

SEQ ID NO: 7450792 - DNA, 18 bp, Homo sapiens
ctgaggccaactacactg

SEQ ID NO: 7450793 - DNA, 18 bp, Homo sapiens
ctgaggccaactacactg

SEQ ID NO: 7450794 - DNA, 22 bp, Homo sapiens
ctgaggccagagtgggcctctt

SEQ ID NO: 7450795 - DNA, 22 bp, Homo sapiens
ctgaggccagagtgggcctctt

SEQ ID NO: 7450796 - DNA, 22 bp, Homo sapiens
ctgaggccagctgcagagctct

SEQ ID NO: 7450797 - DNA, 22 bp, Homo sapiens
ctgaggccagctgcagagctct

SEQ ID NO: 7450798 - DNA, 22 bp, Homo sapiens
ctgaggccagctgcagagctct

SEQ ID NO: 7450799 - DNA, 22 bp, Homo sapiens
ctgaggccagagtgggcctctt

SEQ ID NO: 7450800 - DNA, 22 bp, Homo sapiens
ctgaggccagagtgggcctctt

SEQ ID NO: 7450801 - DNA, 22 bp, Homo sapiens
ctgaggccagctgcagagctct

SEQ ID NO: 7450802 - DNA, 18 bp, Homo sapiens
ctgaggccaactacactg

SEQ ID NO: 7450803 - DNA, 22 bp, Homo sapiens
ctgaggcatgttacaggacata

SEQ ID NO: 7450804 - DNA, 22 bp, Homo sapiens
ctgaggcatgttacaggacata

SEQ ID NO: 7450805 - DNA, 22 bp, Homo sapiens
ctgaggcatgttacaggacata

SEQ ID NO: 7450806 - DNA, 22 bp, Homo sapiens
ctgaggcatgttacaggacata

SEQ ID NO: 7450807 - DNA, 22 bp, Homo sapiens
ctgaggcatgttacaggacata

SEQ ID NO: 7450808 - DNA, 22 bp, Homo sapiens
ctgaggcatgttacaggacata

SEQ ID NO: 7450809 - DNA, 22 bp, Homo sapiens
ctgaggcatgttacaggacata

SEQ ID NO: 7450810 - DNA, 22 bp, Homo sapiens
ctgaggcatgttacaggacata

SEQ ID NO: 7450811 - DNA, 22 bp, Homo sapiens
ctgaggcatgggaagttgggtg

SEQ ID NO: 7450812 - DNA, 22 bp, Homo sapiens
ctgaggcatgggaagttgggtg

SEQ ID NO: 7450813 - DNA, 22 bp, Homo sapiens
ctgaggcatgttacaggacata

SEQ ID NO: 7450814 - DNA, 22 bp, Homo sapiens
ctgaggcatgttacaggacata

SEQ ID NO: 7450815 - DNA, 22 bp, Homo sapiens
ctgaggcatgggaagttgggtg

SEQ ID NO: 7450816 - DNA, 22 bp, Homo sapiens
ctgaggcatgggaagttgggtg

SEQ ID NO: 7450817 - DNA, 22 bp, Homo sapiens
ctgaggcatgggaagttgggtg

SEQ ID NO: 7450818 - DNA, 22 bp, Homo sapiens
ctgcacagctggccagggagag

SEQ ID NO: 7450819 - DNA, 22 bp, Homo sapiens
ctgcacagctggccagggagag

SEQ ID NO: 7450820 - DNA, 22 bp, Homo sapiens
ctgcacagctgggcaagatata

SEQ ID NO: 7450821 - DNA, 22 bp, Homo sapiens
ctgcacagggatatggggagct

SEQ ID NO: 7450822 - DNA, 22 bp, Homo sapiens
ctgcacagcctgtctgggggcc

SEQ ID NO: 7450823 - DNA, 22 bp, Homo sapiens
ctgcacagcctgtctgggggcc

SEQ ID NO: 7450824 - DNA, 22 bp, Homo sapiens
ctgcacagctggccagggagag

SEQ ID NO: 7450825 - DNA, 22 bp, Homo sapiens
ctgcacagctggccagggagag

SEQ ID NO: 7450826 - DNA, 22 bp, Homo sapiens
ctgcacagcctgtctgggggcc

SEQ ID NO: 7450827 - DNA, 22 bp, Homo sapiens
ctgcacagccctcaagagcctg

SEQ ID NO: 7450828 - DNA, 22 bp, Homo sapiens
ctgcacagccctcaagagcctg

SEQ ID NO: 7450829 - DNA, 22 bp, Homo sapiens
ctgcacagtaagcttcagagat

SEQ ID NO: 7450830 - DNA, 22 bp, Homo sapiens
ctgcacaggggatgagggcagt

SEQ ID NO: 7450831 - DNA, 22 bp, Homo sapiens
ctgcacaggggatgagggcagt

SEQ ID NO: 7450832 - DNA, 22 bp, Homo sapiens
ctgcacaggggatgagggcagt

SEQ ID NO: 7450833 - DNA, 22 bp, Homo sapiens
ctgcacagggatatggggagct

SEQ ID NO: 7450834 - DNA, 22 bp, Homo sapiens
ctgcacagggatatggggagct

SEQ ID NO: 7450835 - DNA, 22 bp, Homo sapiens
ctgcacagggatatggggagct

SEQ ID NO: 7450836 - DNA, 22 bp, Homo sapiens
ctgcacagtgggtggggcgtca

SEQ ID NO: 7450837 - DNA, 22 bp, Homo sapiens
ctgcacagtgggtggggcgtca

SEQ ID NO: 7450838 - DNA, 22 bp, Homo sapiens
ctgcacagtgggtggggcgtca

SEQ ID NO: 7450839 - DNA, 22 bp, Homo sapiens
ctgcacagtggacagtgaagat

SEQ ID NO: 7450840 - DNA, 22 bp, Homo sapiens
ctgcacagtggacagtgaagat

SEQ ID NO: 7450841 - DNA, 22 bp, Homo sapiens
ctgcacagtggacagtgaagat

SEQ ID NO: 7450842 - DNA, 22 bp, Homo sapiens
ctgcacagtggacagtgaagat

SEQ ID NO: 7450843 - DNA, 22 bp, Homo sapiens
ctgaggccggagcactgaagag

SEQ ID NO: 7450844 - DNA, 22 bp, Homo sapiens
ctgaggccggagcactgaagag

SEQ ID NO: 7450845 - DNA, 22 bp, Homo sapiens
ctgaggccggagcactgaagag

SEQ ID NO: 7450846 - DNA, 20 bp, Homo sapiens
ctgcaaaatgacattaggaa

SEQ ID NO: 7450847 - DNA, 20 bp, Homo sapiens
ctgcaaaatgacattaggaa

SEQ ID NO: 7450848 - DNA, 22 bp, Homo sapiens
ctgaggccgtctgggtctgcag

SEQ ID NO: 7450849 - DNA, 20 bp, Homo sapiens
ctgcaaaatgacattaggaa

SEQ ID NO: 7450850 - DNA, 22 bp, Homo sapiens
ctgcaaaattgttctttgctcc

SEQ ID NO: 7450851 - DNA, 22 bp, Homo sapiens
ctgcaaaattgttctttgctcc

SEQ ID NO: 7450852 - DNA, 22 bp, Homo sapiens
ctgcaaagctgttcacaaattt

SEQ ID NO: 7450853 - DNA, 22 bp, Homo sapiens
ctgcaaagctgttcacaaattt

SEQ ID NO: 7450854 - DNA, 21 bp, Homo sapiens
ctgcaaatacctagttatctg

SEQ ID NO: 7450855 - DNA, 21 bp, Homo sapiens
ctgcaaatacctagttatctg

SEQ ID NO: 7450856 - DNA, 22 bp, Homo sapiens
ctgcaaaggtgggggaggagct

SEQ ID NO: 7450857 - DNA, 22 bp, Homo sapiens
ctgcaaataggaaaagggcata

SEQ ID NO: 7450858 - DNA, 21 bp, Homo sapiens
ctgcaaatacctagttatctg

SEQ ID NO: 7450859 - DNA, 22 bp, Homo sapiens
ctgcacacatatggcttctctc

SEQ ID NO: 7450860 - DNA, 22 bp, Homo sapiens
ctgcacacatcgcactgcccgt

SEQ ID NO: 7450861 - DNA, 22 bp, Homo sapiens
ctgcacacatcgcactgcccgt

SEQ ID NO: 7450862 - DNA, 22 bp, Homo sapiens
ctgcacacatcgcactgcccgt

SEQ ID NO: 7450863 - DNA, 22 bp, Homo sapiens
ctgcaaataggggtgtgaataa

SEQ ID NO: 7450864 - DNA, 22 bp, Homo sapiens
ctgcaaataggaaaagggcata

SEQ ID NO: 7450865 - DNA, 22 bp, Homo sapiens
ctgcacacatcgcactgcccgt

SEQ ID NO: 7450866 - DNA, 22 bp, Homo sapiens
ctgcacagagcagggcagacac

SEQ ID NO: 7450867 - DNA, 22 bp, Homo sapiens
ctgcacagagcggcagttctta

SEQ ID NO: 7450868 - DNA, 22 bp, Homo sapiens
ctgcacagagcggcagttctta

SEQ ID NO: 7450869 - DNA, 22 bp, Homo sapiens
ctgcacagagcggcagttctta

SEQ ID NO: 7450870 - DNA, 22 bp, Homo sapiens
ctgcacagagcagggcagacac

SEQ ID NO: 7450871 - DNA, 22 bp, Homo sapiens
ctgcacagagcagggcagacac

SEQ ID NO: 7450872 - DNA, 22 bp, Homo sapiens
ctgcacagagcggcagttctta

SEQ ID NO: 7450873 - DNA, 22 bp, Homo sapiens
ctgcacagaggtcggtctgcca

SEQ ID NO: 7450874 - DNA, 22 bp, Homo sapiens
ctgcacagaggtcggtctgcca

SEQ ID NO: 7450875 - DNA, 22 bp, Homo sapiens
ctgcacagaggtcggtctgcca

SEQ ID NO: 7450876 - DNA, 22 bp, Homo sapiens
ctgcacagaggtcggtctgcca

SEQ ID NO: 7450877 - DNA, 22 bp, Homo sapiens
ctgcacagaggtcggtctgcca

SEQ ID NO: 7450878 - DNA, 22 bp, Homo sapiens
ctgcacatgttcatcatgacaa

SEQ ID NO: 7450879 - DNA, 22 bp, Homo sapiens
ctgcaccacagcctgaggcagc

SEQ ID NO: 7450880 - DNA, 22 bp, Homo sapiens
ctgcaccacagcctgaggcagc

SEQ ID NO: 7450881 - DNA, 22 bp, Homo sapiens
ctgcaccacagcctgaggcagc

SEQ ID NO: 7450882 - DNA, 22 bp, Homo sapiens
ctgcaccacagcctgaggcagc

SEQ ID NO: 7450883 - DNA, 22 bp, Homo sapiens
ctgcacagtgttggaagctgcc

SEQ ID NO: 7450884 - DNA, 22 bp, Homo sapiens
ctgcacatagtaagtactcaat

SEQ ID NO: 7450885 - DNA, 22 bp, Homo sapiens
ctgcacagtttgatttcttgct

SEQ ID NO: 7450886 - DNA, 22 bp, Homo sapiens
ctgcaccatccttcatgctctg

SEQ ID NO: 7450887 - DNA, 22 bp, Homo sapiens
ctgcaccatccttcatgctctg

SEQ ID NO: 7450888 - DNA, 22 bp, Homo sapiens
ctgcaccatctggagcacctcc

SEQ ID NO: 7450889 - DNA, 22 bp, Homo sapiens
ctgcaccatctggagcacctcc

SEQ ID NO: 7450890 - DNA, 22 bp, Homo sapiens
ctgcaccatctggagcacctcc

SEQ ID NO: 7450891 - DNA, 22 bp, Homo sapiens
ctgcaccatctggagcacctcc

SEQ ID NO: 7450892 - DNA, 22 bp, Homo sapiens
ctgcaccctcaaactcctgggc

SEQ ID NO: 7450893 - DNA, 22 bp, Homo sapiens
ctgcacccaggcctggtcccag

SEQ ID NO: 7450894 - DNA, 22 bp, Homo sapiens
ctgcacccatgagctcaaggga

SEQ ID NO: 7450895 - DNA, 22 bp, Homo sapiens
ctgcacccatgagctcaaggga

SEQ ID NO: 7450896 - DNA, 22 bp, Homo sapiens
ctgcacccatgagctcaaggga

SEQ ID NO: 7450897 - DNA, 22 bp, Homo sapiens
ctgcaccctcaaactcctgggc

SEQ ID NO: 7450898 - DNA, 22 bp, Homo sapiens
ctgcaccctcaaactcctgggc

SEQ ID NO: 7450899 - DNA, 22 bp, Homo sapiens
ctgcaccctcaaactcctgggc

SEQ ID NO: 7450900 - DNA, 22 bp, Homo sapiens
ctgcactgagaccctctttgct

SEQ ID NO: 7450901 - DNA, 22 bp, Homo sapiens
ctgcactgagcatctaacctta

SEQ ID NO: 7450902 - DNA, 19 bp, Homo sapiens
ctgcactgagaaaaggagg

SEQ ID NO: 7450903 - DNA, 18 bp, Homo sapiens
ctgcactcccgcctgggc

SEQ ID NO: 7450904 - DNA, 22 bp, Homo sapiens
ctgcactgacttccccggctgc

SEQ ID NO: 7450905 - DNA, 22 bp, Homo sapiens
ctgcactgaagaaaggagctct

SEQ ID NO: 7450906 - DNA, 22 bp, Homo sapiens
ctgcactgaagaaaggagctct

SEQ ID NO: 7450907 - DNA, 22 bp, Homo sapiens
ctgcactgaagaaaggagctct

SEQ ID NO: 7450908 - DNA, 20 bp, Homo sapiens
ctgcactgaacatgtctgag

SEQ ID NO: 7450909 - DNA, 20 bp, Homo sapiens
ctgcactgaacatgtctgag

SEQ ID NO: 7450910 - DNA, 19 bp, Homo sapiens
ctgcactaggcctgtgctc

SEQ ID NO: 7450911 - DNA, 22 bp, Homo sapiens
ctgcaccgtgtctcgggctgcc

SEQ ID NO: 7450912 - DNA, 22 bp, Homo sapiens
ctgcaccctgcaggtacccctg

SEQ ID NO: 7450913 - DNA, 22 bp, Homo sapiens
ctgcaccctgcaggtacccctg

SEQ ID NO: 7450914 - DNA, 22 bp, Homo sapiens
ctgcacctacagccacatttac

SEQ ID NO: 7450915 - DNA, 22 bp, Homo sapiens
ctgcacctacagccacatttac

SEQ ID NO: 7450916 - DNA, 18 bp, Homo sapiens
ctgcacttcagcttgggc

SEQ ID NO: 7450917 - DNA, 22 bp, Homo sapiens
ctgcaggcccccttcctggagt

SEQ ID NO: 7450918 - DNA, 22 bp, Homo sapiens
ctgcaggcatttattcatgcaa

SEQ ID NO: 7450919 - DNA, 22 bp, Homo sapiens
ctgcaggcatttattcatgcaa

SEQ ID NO: 7450920 - DNA, 22 bp, Homo sapiens
ctgcactgctgatcccaggtct

SEQ ID NO: 7450921 - DNA, 22 bp, Homo sapiens
ctgcactgagaccctctttgct

SEQ ID NO: 7450922 - DNA, 22 bp, Homo sapiens
ctgcactgagctctcccagccc

SEQ ID NO: 7450923 - DNA, 22 bp, Homo sapiens
ctgcactgagctctcccagccc

SEQ ID NO: 7450924 - DNA, 22 bp, Homo sapiens
ctgcactgagctctcccagccc

SEQ ID NO: 7450925 - DNA, 22 bp, Homo sapiens
ctgcactgagctctcccagccc

SEQ ID NO: 7450926 - DNA, 22 bp, Homo sapiens
ctgcactgtgtaacagataact

SEQ ID NO: 7450927 - DNA, 22 bp, Homo sapiens
ctgcactgtgtaacagataact

SEQ ID NO: 7450928 - DNA, 18 bp, Homo sapiens
ctgcactgtgggtagctc

SEQ ID NO: 7450929 - DNA, 22 bp, Homo sapiens
ctgcaggctcgaagacacggat

SEQ ID NO: 7450930 - DNA, 22 bp, Homo sapiens
ctgcaggctcgaagacacggat

SEQ ID NO: 7450931 - DNA, 22 bp, Homo sapiens
ctgcagggagcagatggcgtgt

SEQ ID NO: 7450932 - DNA, 22 bp, Homo sapiens
ctgcaggctcgaagacacggat

SEQ ID NO: 7450933 - DNA, 22 bp, Homo sapiens
ctgcaggccgagctccttctcg

SEQ ID NO: 7450934 - DNA, 22 bp, Homo sapiens
ctgcagggagaggggacagcct

SEQ ID NO: 7450935 - DNA, 22 bp, Homo sapiens
ctgcaggccgagctccttctcg

SEQ ID NO: 7450936 - DNA, 22 bp, Homo sapiens
ctgcaggcccccttcctggagt

SEQ ID NO: 7450937 - DNA, 22 bp, Homo sapiens
ctgcaggcccccttcctggagt

SEQ ID NO: 7450938 - DNA, 22 bp, Homo sapiens
ctgcagggagcagatggcgtgt

SEQ ID NO: 7450939 - DNA, 22 bp, Homo sapiens
ctgcagggagcagatggcgtgt

SEQ ID NO: 7450940 - DNA, 22 bp, Homo sapiens
ctgcagggagcagatggcgtgt

SEQ ID NO: 7450941 - DNA, 22 bp, Homo sapiens
ctgcagggatgtgaggcccgtt

SEQ ID NO: 7450942 - DNA, 22 bp, Homo sapiens
ctgcagggaggttccttgttct

SEQ ID NO: 7450943 - DNA, 22 bp, Homo sapiens
ctgcagggaggttccttgttct

SEQ ID NO: 7450944 - DNA, 22 bp, Homo sapiens
ctgcagggagcagatggcgtgt

SEQ ID NO: 7450945 - DNA, 22 bp, Homo sapiens
ctgcagggaggttccttgttct

SEQ ID NO: 7450946 - DNA, 22 bp, Homo sapiens
ctgcagggcagaagggcataga

SEQ ID NO: 7450947 - DNA, 22 bp, Homo sapiens
ctgcagggcagggcctcctggc

SEQ ID NO: 7450948 - DNA, 22 bp, Homo sapiens
ctgcagggcagaagggcataga

SEQ ID NO: 7450949 - DNA, 22 bp, Homo sapiens
ctgcagggcagaagggcataga

SEQ ID NO: 7450950 - DNA, 22 bp, Homo sapiens
ctgcagggattgcttctgtata

SEQ ID NO: 7450951 - DNA, 22 bp, Homo sapiens
ctgcagggattgcttctgtata

SEQ ID NO: 7450952 - DNA, 22 bp, Homo sapiens
ctgcagggattgcttctgtata

SEQ ID NO: 7450953 - DNA, 22 bp, Homo sapiens
ctgcagggcagaagggcataga

SEQ ID NO: 7450954 - DNA, 22 bp, Homo sapiens
ctgcagggcagaagggcataga

SEQ ID NO: 7450955 - DNA, 22 bp, Homo sapiens
ctgcagggcattgtaactcttt

SEQ ID NO: 7450956 - DNA, 22 bp, Homo sapiens
ctgcagggcattgtaactcttt

SEQ ID NO: 7450957 - DNA, 22 bp, Homo sapiens
ctgcagggcattgtaactcttt

SEQ ID NO: 7450958 - DNA, 22 bp, Homo sapiens
ctgcagggcagggcctcctggc

SEQ ID NO: 7450959 - DNA, 22 bp, Homo sapiens
ctgcagggcagggcctcctggc

SEQ ID NO: 7450960 - DNA, 22 bp, Homo sapiens
ctgcagggcagggcctcctggc

SEQ ID NO: 7450961 - DNA, 22 bp, Homo sapiens
ctgcagggcagggcctcctggc

SEQ ID NO: 7450962 - DNA, 19 bp, Homo sapiens
ctgcagggatgtgcagagt

SEQ ID NO: 7450963 - DNA, 19 bp, Homo sapiens
ctgcagggatgtgcagagt

SEQ ID NO: 7450964 - DNA, 19 bp, Homo sapiens
ctgcagggatgtgcagagt

SEQ ID NO: 7450965 - DNA, 19 bp, Homo sapiens
ctgcagggatgtgcagagt

SEQ ID NO: 7450966 - DNA, 19 bp, Homo sapiens
ctgcagggatgtgcagagt

SEQ ID NO: 7450967 - DNA, 22 bp, Homo sapiens
ctgcagggatgtgaggcccgtt

SEQ ID NO: 7450968 - DNA, 19 bp, Homo sapiens
ctgcagggatgtgcagagt

SEQ ID NO: 7450969 - DNA, 19 bp, Homo sapiens
ctgcagggatgtgcagagt

SEQ ID NO: 7450970 - DNA, 22 bp, Homo sapiens
ctgcagggatgtgaggcccgtt

SEQ ID NO: 7450971 - DNA, 22 bp, Homo sapiens
ctgcagggatgtgaggcccgtt

SEQ ID NO: 7450972 - DNA, 22 bp, Homo sapiens
ctgcagggatgtgaggcccgtt

SEQ ID NO: 7450973 - DNA, 22 bp, Homo sapiens
ctgcagggcccgcctgagccct

SEQ ID NO: 7450974 - DNA, 22 bp, Homo sapiens
ctgcagggcccgcctgagccct

SEQ ID NO: 7450975 - DNA, 22 bp, Homo sapiens
ctgcagggcccgcctgagccct

SEQ ID NO: 7450976 - DNA, 22 bp, Homo sapiens
ctgcagggcccgcctgagccct

SEQ ID NO: 7450977 - DNA, 22 bp, Homo sapiens
ctgcagggcccgcctgagccct

SEQ ID NO: 7450978 - DNA, 22 bp, Homo sapiens
ctgcagggcccgcctgagccct

SEQ ID NO: 7450979 - DNA, 22 bp, Homo sapiens
ctgcagggcccgcctgagccct

SEQ ID NO: 7450980 - DNA, 22 bp, Homo sapiens
ctgcagggcccaaggtcaacgg

SEQ ID NO: 7450981 - DNA, 22 bp, Homo sapiens
ctgcagggcccaaggtcaacgg

SEQ ID NO: 7450982 - DNA, 22 bp, Homo sapiens
ctgcagggcccaaggtcaacgg

SEQ ID NO: 7450983 - DNA, 22 bp, Homo sapiens
ctgcagggcccaaggtcaacgg

SEQ ID NO: 7450984 - DNA, 22 bp, Homo sapiens
ctgcagggccatgggttctata

SEQ ID NO: 7450985 - DNA, 22 bp, Homo sapiens
ctgcagggccatgggttctata

SEQ ID NO: 7450986 - DNA, 22 bp, Homo sapiens
ctgcagggcccaaggtcaacgg

SEQ ID NO: 7450987 - DNA, 22 bp, Homo sapiens
ctgcagggcttaccttgctctg

SEQ ID NO: 7450988 - DNA, 22 bp, Homo sapiens
ctgcagggcttaccttgctctg

SEQ ID NO: 7450989 - DNA, 22 bp, Homo sapiens
ctgcagggcttaccttgctctg

SEQ ID NO: 7450990 - DNA, 22 bp, Homo sapiens
ctgcagggcttaccttgctctg

SEQ ID NO: 7450991 - DNA, 22 bp, Homo sapiens
ctgcaggggaccaaagtctgac

SEQ ID NO: 7450992 - DNA, 22 bp, Homo sapiens
ctgcaggggaccaaagtctgac

SEQ ID NO: 7450993 - DNA, 22 bp, Homo sapiens
ctgcaggggcctcgagcacagg

SEQ ID NO: 7450994 - DNA, 22 bp, Homo sapiens
ctgcaggggcctcgagcacagg

SEQ ID NO: 7450995 - DNA, 22 bp, Homo sapiens
ctgcaggggcctcgagcacagg

SEQ ID NO: 7450996 - DNA, 22 bp, Homo sapiens
ctgcaggggcagtccacttcct

SEQ ID NO: 7450997 - DNA, 22 bp, Homo sapiens
ctgcaggggcagtccacttcct

SEQ ID NO: 7450998 - DNA, 22 bp, Homo sapiens
ctgcaggggcctcgagcacagg

SEQ ID NO: 7450999 - DNA, 22 bp, Homo sapiens
ctgcaggggcagtccacttcct

SEQ ID NO: 7451000 - DNA, 22 bp, Homo sapiens
ctgcaggggcagtccacttcct

SEQ ID NO: 7451001 - DNA, 22 bp, Homo sapiens
ctgcaggggcagtccacttcct

SEQ ID NO: 7451002 - DNA, 22 bp, Homo sapiens
catttattcatttgctagggct

SEQ ID NO: 7451003 - DNA, 22 bp, Homo sapiens
catttattctcagatccttgtc

SEQ ID NO: 7451004 - DNA, 22 bp, Homo sapiens
catttattctcagatccttgtc

SEQ ID NO: 7451005 - DNA, 22 bp, Homo sapiens
catttattctcagatccttgtc

SEQ ID NO: 7451006 - DNA, 22 bp, Homo sapiens
catttattctcagatccttgtc

SEQ ID NO: 7451007 - DNA, 22 bp, Homo sapiens
catttattctcagatccttgtc

SEQ ID NO: 7451008 - DNA, 22 bp, Homo sapiens
catttattctcagatccttgtc

SEQ ID NO: 7451009 - DNA, 22 bp, Homo sapiens
catttattctcagatccttgtc

SEQ ID NO: 7451010 - DNA, 22 bp, Homo sapiens
catttattcatttgctagggct

SEQ ID NO: 7451011 - DNA, 22 bp, Homo sapiens
catttattgagtggccacagtg

SEQ ID NO: 7451012 - DNA, 22 bp, Homo sapiens
catttattgagtggccacagtg

SEQ ID NO: 7451013 - DNA, 22 bp, Homo sapiens
catttattgagtggccacagtg

SEQ ID NO: 7451014 - DNA, 22 bp, Homo sapiens
catttattgagtggccacagtg

SEQ ID NO: 7451015 - DNA, 22 bp, Homo sapiens
catttattgagtggccacagtg

SEQ ID NO: 7451016 - DNA, 22 bp, Homo sapiens
catttattctcagatccttgtc

SEQ ID NO: 7451017 - DNA, 22 bp, Homo sapiens
catttattctcagatccttgtc

SEQ ID NO: 7451018 - DNA, 22 bp, Homo sapiens
catttattctcagatccttgtc

SEQ ID NO: 7451019 - DNA, 22 bp, Homo sapiens
catttattcatgatctgtagct

SEQ ID NO: 7451020 - DNA, 22 bp, Homo sapiens
catttattcatgatctgtagct

SEQ ID NO: 7451021 - DNA, 22 bp, Homo sapiens
catttattcatgatctgtagct

SEQ ID NO: 7451022 - DNA, 22 bp, Homo sapiens
catttattcatgatctgtagct

SEQ ID NO: 7451023 - DNA, 22 bp, Homo sapiens
catttattcatgatctgtagct

SEQ ID NO: 7451024 - DNA, 22 bp, Homo sapiens
catttattcatgatctgtagct

SEQ ID NO: 7451025 - DNA, 22 bp, Homo sapiens
catttattcatgatctgtagct

SEQ ID NO: 7451026 - DNA, 22 bp, Homo sapiens
catttattcatgatctgtagct

SEQ ID NO: 7451027 - DNA, 22 bp, Homo sapiens
catttattcatgatctgtagct

SEQ ID NO: 7451028 - DNA, 22 bp, Homo sapiens
catttattcatttgctagggct

SEQ ID NO: 7451029 - DNA, 22 bp, Homo sapiens
catttattcatttgctagggct

SEQ ID NO: 7451030 - DNA, 22 bp, Homo sapiens
catttattcatttgctagggct

SEQ ID NO: 7451031 - DNA, 22 bp, Homo sapiens
catttattcatttgctagggct

SEQ ID NO: 7451032 - DNA, 22 bp, Homo sapiens
catttattcatttgctagggct

SEQ ID NO: 7451033 - DNA, 22 bp, Homo sapiens
catttattcatgatctgtagct

SEQ ID NO: 7451034 - DNA, 22 bp, Homo sapiens
catttattcatgatctgtagct

SEQ ID NO: 7451035 - DNA, 22 bp, Homo sapiens
catttattcagctcagtcggtt

SEQ ID NO: 7451036 - DNA, 22 bp, Homo sapiens
catttattcagctcagtcggtt

SEQ ID NO: 7451037 - DNA, 22 bp, Homo sapiens
catttattcagctcagtcggtt

SEQ ID NO: 7451038 - DNA, 22 bp, Homo sapiens
catttattcagctcagtcggtt

SEQ ID NO: 7451039 - DNA, 22 bp, Homo sapiens
catttattcagctcagtcggtt

SEQ ID NO: 7451040 - DNA, 22 bp, Homo sapiens
catttattcagctcagtcggtt

SEQ ID NO: 7451041 - DNA, 22 bp, Homo sapiens
catttattagttagttcgatgt

SEQ ID NO: 7451042 - DNA, 22 bp, Homo sapiens
tccctctctggctggggtgcgg

SEQ ID NO: 7451043 - DNA, 22 bp, Homo sapiens
tccctctctagcctgttcagta

SEQ ID NO: 7451044 - DNA, 22 bp, Homo sapiens
tccctctctagcctgttcagta

SEQ ID NO: 7451045 - DNA, 22 bp, Homo sapiens
tccctctctggctggggtgcgg

SEQ ID NO: 7451046 - DNA, 22 bp, Homo sapiens
tccctctcttgggcgtggctca

SEQ ID NO: 7451047 - DNA, 22 bp, Homo sapiens
tccctctccctattgcctggag

SEQ ID NO: 7451048 - DNA, 22 bp, Homo sapiens
tccctctccctattgcctggag

SEQ ID NO: 7451049 - DNA, 22 bp, Homo sapiens
tccctctccctattgcctggag

SEQ ID NO: 7451050 - DNA, 22 bp, Homo sapiens
tccctctccctattgcctggag

SEQ ID NO: 7451051 - DNA, 22 bp, Homo sapiens
tccctcctttatcaaaaagaga

SEQ ID NO: 7451052 - DNA, 22 bp, Homo sapiens
tccctcctttatcaaaaagaga

SEQ ID NO: 7451053 - DNA, 22 bp, Homo sapiens
tccctcgaagagcttattcttt

SEQ ID NO: 7451054 - DNA, 22 bp, Homo sapiens
tccctcgctagaaggccgggaa

SEQ ID NO: 7451055 - DNA, 22 bp, Homo sapiens
tccctctacagggaagcgcttt

SEQ ID NO: 7451056 - DNA, 22 bp, Homo sapiens
tccctctacagggaagcgcttt

SEQ ID NO: 7451057 - DNA, 22 bp, Homo sapiens
tccctctctagcctgttcagta

SEQ ID NO: 7451058 - DNA, 22 bp, Homo sapiens
tccctctctagcctgttcagta

SEQ ID NO: 7451059 - DNA, 22 bp, Homo sapiens
tccctctccctattgcctggag

SEQ ID NO: 7451060 - DNA, 22 bp, Homo sapiens
tccctctccctattgcctggag

SEQ ID NO: 7451061 - DNA, 22 bp, Homo sapiens
tccctctccctattgcctggag

SEQ ID NO: 7451062 - DNA, 22 bp, Homo sapiens
tccctctccctattgcctggag

SEQ ID NO: 7451063 - DNA, 22 bp, Homo sapiens
tccctctccctattgcctggag

SEQ ID NO: 7451064 - DNA, 22 bp, Homo sapiens
tccctctccctattgcctggag

SEQ ID NO: 7451065 - DNA, 22 bp, Homo sapiens
catttattgagtggccacagtg

SEQ ID NO: 7451066 - DNA, 22 bp, Homo sapiens
tccctgctttcttgtgagggga

SEQ ID NO: 7451067 - DNA, 22 bp, Homo sapiens
catttattgagtggccacagtg

SEQ ID NO: 7451068 - DNA, 22 bp, Homo sapiens
catttattgagtggccacagtg

SEQ ID NO: 7451069 - DNA, 22 bp, Homo sapiens
tccctggaacagagagacaacg

SEQ ID NO: 7451070 - DNA, 22 bp, Homo sapiens
tccctggaacagagagacaacg

SEQ ID NO: 7451071 - DNA, 22 bp, Homo sapiens
tccctggaacagagagacaacg

SEQ ID NO: 7451072 - DNA, 22 bp, Homo sapiens
tccctgctttcttgtgagggga

SEQ ID NO: 7451073 - DNA, 20 bp, Homo sapiens
tccctggggccctacttcct

SEQ ID NO: 7451074 - DNA, 20 bp, Homo sapiens
tccctggggccctacttcct

SEQ ID NO: 7451075 - DNA, 22 bp, Homo sapiens
tccctggaacagagagacaacg

SEQ ID NO: 7451076 - DNA, 18 bp, Homo sapiens
tccctggggctgccaccc

SEQ ID NO: 7451077 - DNA, 18 bp, Homo sapiens
tccctggggctgccaccc

SEQ ID NO: 7451078 - DNA, 18 bp, Homo sapiens
tccctggggctgccaccc

SEQ ID NO: 7451079 - DNA, 22 bp, Homo sapiens
tccctggggtaacattagaggg

SEQ ID NO: 7451080 - DNA, 22 bp, Homo sapiens
tccctggggtaacattagaggg

SEQ ID NO: 7451081 - DNA, 18 bp, Homo sapiens
tccctggggctgccaccc

SEQ ID NO: 7451082 - DNA, 18 bp, Homo sapiens
tccctggggctgccaccc

SEQ ID NO: 7451083 - DNA, 22 bp, Homo sapiens
tccctggggttcctccagccac

SEQ ID NO: 7451084 - DNA, 22 bp, Homo sapiens
tccctggggttcctccagccac

SEQ ID NO: 7451085 - DNA, 22 bp, Homo sapiens
tccctggggttcctccagccac

SEQ ID NO: 7451086 - DNA, 22 bp, Homo sapiens
tccctggggttcctccagccac

SEQ ID NO: 7451087 - DNA, 22 bp, Homo sapiens
tccctggggtatcgctgaggca

SEQ ID NO: 7451088 - DNA, 22 bp, Homo sapiens
tccctggggttcctccagccac

SEQ ID NO: 7451089 - DNA, 22 bp, Homo sapiens
tccctgggtcattctctggcac

SEQ ID NO: 7451090 - DNA, 22 bp, Homo sapiens
tccctggggttcctccagccac

SEQ ID NO: 7451091 - DNA, 22 bp, Homo sapiens
tccctggggtaacattagaggg

SEQ ID NO: 7451092 - DNA, 22 bp, Homo sapiens
tccctggggtatcgctgaggca

SEQ ID NO: 7451093 - DNA, 22 bp, Homo sapiens
tccctggggtatcgctgaggca

SEQ ID NO: 7451094 - DNA, 22 bp, Homo sapiens
tccctggggtatcgctgaggca

SEQ ID NO: 7451095 - DNA, 22 bp, Homo sapiens
tccctggggtatcgctgaggca

SEQ ID NO: 7451096 - DNA, 22 bp, Homo sapiens
tccctggggtatcgctgaggca

SEQ ID NO: 7451097 - DNA, 22 bp, Homo sapiens
tccctggggtatcgctgaggca

SEQ ID NO: 7451098 - DNA, 23 bp, Homo sapiens
tcctaactcaattcaggggtgtc

SEQ ID NO: 7451099 - DNA, 22 bp, Homo sapiens
tcctaactaatttgtagcaaaa

SEQ ID NO: 7451100 - DNA, 20 bp, Homo sapiens
tcctaactataaagtggctc

SEQ ID NO: 7451101 - DNA, 22 bp, Homo sapiens
tccctgggttcccgtggaagtg

SEQ ID NO: 7451102 - DNA, 22 bp, Homo sapiens
tccctgggttcccgtggaagtg

SEQ ID NO: 7451103 - DNA, 22 bp, Homo sapiens
tccctgggttcccgtggaagtg

SEQ ID NO: 7451104 - DNA, 22 bp, Homo sapiens
tcctaactccactagccttggg

SEQ ID NO: 7451105 - DNA, 23 bp, Homo sapiens
tcctaactcaattcaggggtgtc

SEQ ID NO: 7451106 - DNA, 23 bp, Homo sapiens
tcctaactcaattcaggggtgtc

SEQ ID NO: 7451107 - DNA, 23 bp, Homo sapiens
tcctaactgattctgcagtctct

SEQ ID NO: 7451108 - DNA, 23 bp, Homo sapiens
tcctaactgattctgcagtctct

SEQ ID NO: 7451109 - DNA, 22 bp, Homo sapiens
tcctaactgccctgggcaaggt

SEQ ID NO: 7451110 - DNA, 22 bp, Homo sapiens
tcctaactccactagccttggg

SEQ ID NO: 7451111 - DNA, 23 bp, Homo sapiens
tcctaactgattctgcagtctct

SEQ ID NO: 7451112 - DNA, 16 bp, Homo sapiens
tcctaactggcagttc

SEQ ID NO: 7451113 - DNA, 18 bp, Homo sapiens
tcctaacttagatactcc

SEQ ID NO: 7451114 - DNA, 22 bp, Homo sapiens
tccctgggtcctgcttgctctc

SEQ ID NO: 7451115 - DNA, 22 bp, Homo sapiens
tccctgggtcctgcttgctctc

SEQ ID NO: 7451116 - DNA, 22 bp, Homo sapiens
tccctgggtcctgcttgctctc

SEQ ID NO: 7451117 - DNA, 22 bp, Homo sapiens
tccctgggtcctgcttgctctc

SEQ ID NO: 7451118 - DNA, 22 bp, Homo sapiens
tccctgggtcctgcttgctctc

SEQ ID NO: 7451119 - DNA, 22 bp, Homo sapiens
tccctgggtcattctctggcac

SEQ ID NO: 7451120 - DNA, 22 bp, Homo sapiens
tccctgggtcattctctggcac

SEQ ID NO: 7451121 - DNA, 22 bp, Homo sapiens
tccctgggtcattctctggcac

SEQ ID NO: 7451122 - DNA, 22 bp, Homo sapiens
tccctgggtcattctctggcac

SEQ ID NO: 7451123 - DNA, 22 bp, Homo sapiens
tccctgggtcattctctggcac

SEQ ID NO: 7451124 - DNA, 22 bp, Homo sapiens
tccctgggttacctttcaaggt

SEQ ID NO: 7451125 - DNA, 22 bp, Homo sapiens
tccctgggttacctttcaaggt

SEQ ID NO: 7451126 - DNA, 22 bp, Homo sapiens
tccctgggttacctttcaaggt

SEQ ID NO: 7451127 - DNA, 22 bp, Homo sapiens
tccctgggttcccgtggaagtg

SEQ ID NO: 7451128 - DNA, 22 bp, Homo sapiens
tccctgggtcctgcttgctctc

SEQ ID NO: 7451129 - DNA, 22 bp, Homo sapiens
tccctgggtcctgcttgctctc

SEQ ID NO: 7451130 - DNA, 22 bp, Homo sapiens
tccctgggtcctgcttgctctc

SEQ ID NO: 7451131 - DNA, 22 bp, Homo sapiens
tccctccttaataagaggtctg

SEQ ID NO: 7451132 - DNA, 22 bp, Homo sapiens
tccctccttaataagaggtctg

SEQ ID NO: 7451133 - DNA, 22 bp, Homo sapiens
tccctccttaataagaggtctg

SEQ ID NO: 7451134 - DNA, 22 bp, Homo sapiens
tccctcctggtgatgatgcaaa

SEQ ID NO: 7451135 - DNA, 22 bp, Homo sapiens
tccctccttaataagaggtctg

SEQ ID NO: 7451136 - DNA, 22 bp, Homo sapiens
tccctcctggtgagcaggggct

SEQ ID NO: 7451137 - DNA, 22 bp, Homo sapiens
tccctcctggtgatgatgcaaa

SEQ ID NO: 7451138 - DNA, 22 bp, Homo sapiens
tccctcctggtgatgatgcaaa

SEQ ID NO: 7451139 - DNA, 22 bp, Homo sapiens
tccctcctggtgagcaggggct

SEQ ID NO: 7451140 - DNA, 22 bp, Homo sapiens
tccctcctggccgtcaccgctg

SEQ ID NO: 7451141 - DNA, 22 bp, Homo sapiens
tccctcctggccgtcaccgctg

SEQ ID NO: 7451142 - DNA, 22 bp, Homo sapiens
tccctcctggccgtcaccgctg

SEQ ID NO: 7451143 - DNA, 22 bp, Homo sapiens
tccctcctggccgtcaccgctg

SEQ ID NO: 7451144 - DNA, 22 bp, Homo sapiens
tccctcctggccgtcaccgctg

SEQ ID NO: 7451145 - DNA, 18 bp, Homo sapiens
tccctcctgcctgcttcc

SEQ ID NO: 7451146 - DNA, 22 bp, Homo sapiens
tccctcctgcatgaggctcggc

SEQ ID NO: 7451147 - DNA, 22 bp, Homo sapiens
tccctcctgcatgaggctcggc

SEQ ID NO: 7451148 - DNA, 18 bp, Homo sapiens
tccctcctgcctgcttcc

SEQ ID NO: 7451149 - DNA, 22 bp, Homo sapiens
catttacacttctaaccacaag

SEQ ID NO: 7451150 - DNA, 22 bp, Homo sapiens
catttacacttctaaccacaag

SEQ ID NO: 7451151 - DNA, 22 bp, Homo sapiens
catttacacttctaaccacaag

SEQ ID NO: 7451152 - DNA, 22 bp, Homo sapiens
catttacacttctaaccacaag

SEQ ID NO: 7451153 - DNA, 22 bp, Homo sapiens
catttacacttctaaccacaag

SEQ ID NO: 7451154 - DNA, 22 bp, Homo sapiens
catttacacttctaaccacaag

SEQ ID NO: 7451155 - DNA, 22 bp, Homo sapiens
catttacacttctaaccacaag

SEQ ID NO: 7451156 - DNA, 22 bp, Homo sapiens
tccctcagaaattctctctgaa

SEQ ID NO: 7451157 - DNA, 22 bp, Homo sapiens
tccctcagaaattctctctgaa

SEQ ID NO: 7451158 - DNA, 22 bp, Homo sapiens
catttacacttctaaccacaag

SEQ ID NO: 7451159 - DNA, 22 bp, Homo sapiens
catttacacttctaaccacaag

SEQ ID NO: 7451160 - DNA, 22 bp, Homo sapiens
catttacacttctaaccacaag

SEQ ID NO: 7451161 - DNA, 22 bp, Homo sapiens
tccctcctgcatgaggctcggc

SEQ ID NO: 7451162 - DNA, 22 bp, Homo sapiens
tccctcctgcatgaggctcggc

SEQ ID NO: 7451163 - DNA, 22 bp, Homo sapiens
tccctcctgcatgaggctcggc

SEQ ID NO: 7451164 - DNA, 22 bp, Homo sapiens
tccctcctgcatgaggctcggc

SEQ ID NO: 7451165 - DNA, 20 bp, Homo sapiens
tccctcctgcagatagagaa

SEQ ID NO: 7451166 - DNA, 20 bp, Homo sapiens
tccctcctgcagatagagaa

SEQ ID NO: 7451167 - DNA, 20 bp, Homo sapiens
tccctcctgcagatagagaa

SEQ ID NO: 7451168 - DNA, 21 bp, Homo sapiens
tccctcagaagctcttggtca

SEQ ID NO: 7451169 - DNA, 22 bp, Homo sapiens
tccctcagaaattctctctgaa

SEQ ID NO: 7451170 - DNA, 21 bp, Homo sapiens
tccctcagaagctcttggtca

SEQ ID NO: 7451171 - DNA, 22 bp, Homo sapiens
tccctcagaaattctctctgaa

SEQ ID NO: 7451172 - DNA, 22 bp, Homo sapiens
catttaatctggctcatgagca

SEQ ID NO: 7451173 - DNA, 22 bp, Homo sapiens
catttaatctggctcatgagca

SEQ ID NO: 7451174 - DNA, 22 bp, Homo sapiens
catttaatcctcacaagcctat

SEQ ID NO: 7451175 - DNA, 22 bp, Homo sapiens
catttaatcctcacaagcctat

SEQ ID NO: 7451176 - DNA, 22 bp, Homo sapiens
catttaatcctcacaagcctat

SEQ ID NO: 7451177 - DNA, 22 bp, Homo sapiens
catttaatgcctttgccatcca

SEQ ID NO: 7451178 - DNA, 22 bp, Homo sapiens
catttaatgcacggatgtagcc

SEQ ID NO: 7451179 - DNA, 22 bp, Homo sapiens
catttaatgcacggatgtagcc

SEQ ID NO: 7451180 - DNA, 22 bp, Homo sapiens
catttaatgcacggatgtagcc

SEQ ID NO: 7451181 - DNA, 22 bp, Homo sapiens
catttaatccatagaggaatgt

SEQ ID NO: 7451182 - DNA, 22 bp, Homo sapiens
catttaatagatgctgtttcag

SEQ ID NO: 7451183 - DNA, 22 bp, Homo sapiens
catttaatcctcacaagcctat

SEQ ID NO: 7451184 - DNA, 22 bp, Homo sapiens
catttaagagaaatatttagtt

SEQ ID NO: 7451185 - DNA, 22 bp, Homo sapiens
catttaaaggttgtgggtaaaa

SEQ ID NO: 7451186 - DNA, 22 bp, Homo sapiens
catttaatagatgctgtttcag

SEQ ID NO: 7451187 - DNA, 22 bp, Homo sapiens
catttaatagatgctgtttcag

SEQ ID NO: 7451188 - DNA, 22 bp, Homo sapiens
catttaatagatgctgtttcag

SEQ ID NO: 7451189 - DNA, 22 bp, Homo sapiens
catttaatagatgctgtttcag

SEQ ID NO: 7451190 - DNA, 22 bp, Homo sapiens
catttacaatgtacaggttgtg

SEQ ID NO: 7451191 - DNA, 22 bp, Homo sapiens
catttacaatgtacaggttgtg

SEQ ID NO: 7451192 - DNA, 22 bp, Homo sapiens
catttacaatgtacaggttgtg

SEQ ID NO: 7451193 - DNA, 22 bp, Homo sapiens
catttacaatgtacaggttgtg

SEQ ID NO: 7451194 - DNA, 22 bp, Homo sapiens
catttaatgcctttgccatcca

SEQ ID NO: 7451195 - DNA, 22 bp, Homo sapiens
catttaatgcctttgccatcca

SEQ ID NO: 7451196 - DNA, 22 bp, Homo sapiens
catttacaatgtacaggttgtg

SEQ ID NO: 7451197 - DNA, 22 bp, Homo sapiens
catttacaatgtacaggttgtg

SEQ ID NO: 7451198 - DNA, 22 bp, Homo sapiens
catttacaatgtacaggttgtg

SEQ ID NO: 7451199 - DNA, 22 bp, Homo sapiens
catttacaatgtacaggttgtg

SEQ ID NO: 7451200 - DNA, 22 bp, Homo sapiens
catttacaatgtacaggttgtg

SEQ ID NO: 7451201 - DNA, 22 bp, Homo sapiens
catttacaatgtacaggttgtg

SEQ ID NO: 7451202 - DNA, 22 bp, Homo sapiens
catttacacttctaaccacaag

SEQ ID NO: 7451203 - DNA, 22 bp, Homo sapiens
catttacacttctaaccacaag

SEQ ID NO: 7451204 - DNA, 22 bp, Homo sapiens
catttacacttctaaccacaag

SEQ ID NO: 7451205 - DNA, 22 bp, Homo sapiens
catttacacacagaggtgtgct

SEQ ID NO: 7451206 - DNA, 22 bp, Homo sapiens
catttacacacagaggtgtgct

SEQ ID NO: 7451207 - DNA, 22 bp, Homo sapiens
catttacacacagaggtgtgct

SEQ ID NO: 7451208 - DNA, 22 bp, Homo sapiens
catttacacacagaggtgtgct

SEQ ID NO: 7451209 - DNA, 22 bp, Homo sapiens
catttacacacagaggtgtgct

SEQ ID NO: 7451210 - DNA, 22 bp, Homo sapiens
catttacacacagaggtgtgct

SEQ ID NO: 7451211 - DNA, 22 bp, Homo sapiens
catttacacacagaggtgtgct

SEQ ID NO: 7451212 - DNA, 22 bp, Homo sapiens
catttacacacagaggtgtgct

SEQ ID NO: 7451213 - DNA, 22 bp, Homo sapiens
catttacacacagaggtgtgct

SEQ ID NO: 7451214 - DNA, 22 bp, Homo sapiens
catttacacacagaggtgtgct

SEQ ID NO: 7451215 - DNA, 22 bp, Homo sapiens
cattgtgctttcattcaatata

SEQ ID NO: 7451216 - DNA, 22 bp, Homo sapiens
cattgtgcagggataatgcagc

SEQ ID NO: 7451217 - DNA, 22 bp, Homo sapiens
cattgtgtatttctgtagtact

SEQ ID NO: 7451218 - DNA, 22 bp, Homo sapiens
cattgtgctttcattcaatata

SEQ ID NO: 7451219 - DNA, 22 bp, Homo sapiens
cattgttaattggtatcttaca

SEQ ID NO: 7451220 - DNA, 22 bp, Homo sapiens
cattgttaccatcttttaccta

SEQ ID NO: 7451221 - DNA, 22 bp, Homo sapiens
cattgttgctgcttcaagatat

SEQ ID NO: 7451222 - DNA, 22 bp, Homo sapiens
cattgttcaacactgacttgca

SEQ ID NO: 7451223 - DNA, 22 bp, Homo sapiens
cattgttcaacactgacttgca

SEQ ID NO: 7451224 - DNA, 22 bp, Homo sapiens
cattgttgtgagatcaagcagt

SEQ ID NO: 7451225 - DNA, 22 bp, Homo sapiens
cattgttgttaaacatagtaat

SEQ ID NO: 7451226 - DNA, 18 bp, Homo sapiens
cattgtttccagaagacc

SEQ ID NO: 7451227 - DNA, 18 bp, Homo sapiens
cattgtttccagaagacc

SEQ ID NO: 7451228 - DNA, 18 bp, Homo sapiens
cattgtttccagaagacc

SEQ ID NO: 7451229 - DNA, 22 bp, Homo sapiens
cattgtttgtaaaattccagta

SEQ ID NO: 7451230 - DNA, 22 bp, Homo sapiens
cattgtttgagcatctgggatc

SEQ ID NO: 7451231 - DNA, 22 bp, Homo sapiens
cattgtttgtaaaattccagta

SEQ ID NO: 7451232 - DNA, 22 bp, Homo sapiens
cattgtttgtaaaattccagta

SEQ ID NO: 7451233 - DNA, 18 bp, Homo sapiens
cattgtttccagaagacc

SEQ ID NO: 7451234 - DNA, 22 bp, Homo sapiens
cattgtttctggagggatctgt

SEQ ID NO: 7451235 - DNA, 22 bp, Homo sapiens
cattgtttgagcatctgggatc

SEQ ID NO: 7451236 - DNA, 22 bp, Homo sapiens
catttaaaggttgtgggtaaaa

SEQ ID NO: 7451237 - DNA, 22 bp, Homo sapiens
catttaaaggttgtgggtaaaa

SEQ ID NO: 7451238 - DNA, 22 bp, Homo sapiens
cattgttttgagaacaacctga

SEQ ID NO: 7451239 - DNA, 22 bp, Homo sapiens
catttaaaggttgtgggtaaaa

SEQ ID NO: 7451240 - DNA, 22 bp, Homo sapiens
cattgttttgagaacaacctga

SEQ ID NO: 7451241 - DNA, 22 bp, Homo sapiens
catttaaaggttgtgggtaaaa

SEQ ID NO: 7451242 - DNA, 22 bp, Homo sapiens
catttaaaggttgtgggtaaaa

SEQ ID NO: 7451243 - DNA, 22 bp, Homo sapiens
catttaaaggttgtgggtaaaa

SEQ ID NO: 7451244 - DNA, 22 bp, Homo sapiens
cattgtcacccaaagctcatag

SEQ ID NO: 7451245 - DNA, 22 bp, Homo sapiens
cattgtcacccaaagctcatag

SEQ ID NO: 7451246 - DNA, 22 bp, Homo sapiens
cattgtattgaggatacttaag

SEQ ID NO: 7451247 - DNA, 22 bp, Homo sapiens
cattgtattgaggatacttaag

SEQ ID NO: 7451248 - DNA, 22 bp, Homo sapiens
cattgtattgaggatacttaag

SEQ ID NO: 7451249 - DNA, 22 bp, Homo sapiens
cattgtacagttattttaaaat

SEQ ID NO: 7451250 - DNA, 22 bp, Homo sapiens
cattgtacagttattttaaaat

SEQ ID NO: 7451251 - DNA, 22 bp, Homo sapiens
cattgtacagttattttaaaat

SEQ ID NO: 7451252 - DNA, 22 bp, Homo sapiens
cattgtacagttattttaaaat

SEQ ID NO: 7451253 - DNA, 22 bp, Homo sapiens
cattgtgcagggataatgcagc

SEQ ID NO: 7451254 - DNA, 22 bp, Homo sapiens
cattgtctggtaggaagtgggc

SEQ ID NO: 7451255 - DNA, 22 bp, Homo sapiens
cattgtctcttgtcatttagta

SEQ ID NO: 7451256 - DNA, 22 bp, Homo sapiens
cattgtctcttgtcatttagta

SEQ ID NO: 7451257 - DNA, 22 bp, Homo sapiens
cattgtctggtaggaagtgggc

SEQ ID NO: 7451258 - DNA, 22 bp, Homo sapiens
cattgtcacccaaagctcatag

SEQ ID NO: 7451259 - DNA, 22 bp, Homo sapiens
cattgtcacccaaagctcatag

SEQ ID NO: 7451260 - DNA, 22 bp, Homo sapiens
cattgtcattctatgctattca

SEQ ID NO: 7451261 - DNA, 22 bp, Homo sapiens
tcccactcccaggcaggcctct

SEQ ID NO: 7451262 - DNA, 22 bp, Homo sapiens
tcccactcccaggcaggcctct

SEQ ID NO: 7451263 - DNA, 22 bp, Homo sapiens
tcccactcagtccttttcagtt

SEQ ID NO: 7451264 - DNA, 22 bp, Homo sapiens
tcccactcactgtctctgacac

SEQ ID NO: 7451265 - DNA, 22 bp, Homo sapiens
tcccactcactgtctctgacac

SEQ ID NO: 7451266 - DNA, 22 bp, Homo sapiens
tcccactcactgtctctgacac

SEQ ID NO: 7451267 - DNA, 22 bp, Homo sapiens
cattgcactccagcctgggcaa

SEQ ID NO: 7451268 - DNA, 22 bp, Homo sapiens
tcccactcccaggcaggcctct

SEQ ID NO: 7451269 - DNA, 22 bp, Homo sapiens
cattgcactccagcctgggcca

SEQ ID NO: 7451270 - DNA, 22 bp, Homo sapiens
cattgcactccagcctgggtaa

SEQ ID NO: 7451271 - DNA, 22 bp, Homo sapiens
cattgcactccagcctgggtga

SEQ ID NO: 7451272 - DNA, 22 bp, Homo sapiens
cattgcactcctgcctgggcaa

SEQ ID NO: 7451273 - DNA, 22 bp, Homo sapiens
cattgcactccagtctgggcca

SEQ ID NO: 7451274 - DNA, 22 bp, Homo sapiens
cattgcactccagctctgggcg

SEQ ID NO: 7451275 - DNA, 22 bp, Homo sapiens
tcccaaaatacttttctctcct

SEQ ID NO: 7451276 - DNA, 20 bp, Homo sapiens
tcccaaaattctactttatc

SEQ ID NO: 7451277 - DNA, 20 bp, Homo sapiens
tcccaaaattctactttatc

SEQ ID NO: 7451278 - DNA, 22 bp, Homo sapiens
tcccaaaaaaggtatgttgaag

SEQ ID NO: 7451279 - DNA, 22 bp, Homo sapiens
tccatttttcatgactcctcaa

SEQ ID NO: 7451280 - DNA, 22 bp, Homo sapiens
tccatttttcatgactcctcaa

SEQ ID NO: 7451281 - DNA, 22 bp, Homo sapiens
tccatttttcatgactcctcaa

SEQ ID NO: 7451282 - DNA, 22 bp, Homo sapiens
tccattttgtaggtatgctaca

SEQ ID NO: 7451283 - DNA, 22 bp, Homo sapiens
tccattttctaagtatcactta

SEQ ID NO: 7451284 - DNA, 22 bp, Homo sapiens
tccattttctaagtatcactta

SEQ ID NO: 7451285 - DNA, 22 bp, Homo sapiens
tccattttcttgctctaggtaa

SEQ ID NO: 7451286 - DNA, 22 bp, Homo sapiens
tccattttgtaggtatgctaca

SEQ ID NO: 7451287 - DNA, 22 bp, Homo sapiens
tccattttgtaggtatgctaca

SEQ ID NO: 7451288 - DNA, 22 bp, Homo sapiens
tccattttcatctcatgtataa

SEQ ID NO: 7451289 - DNA, 22 bp, Homo sapiens
tccattttcatctcatgtataa

SEQ ID NO: 7451290 - DNA, 22 bp, Homo sapiens
tccattttagagatgaagaaac

SEQ ID NO: 7451291 - DNA, 22 bp, Homo sapiens
tccattttagagatgaagaaac

SEQ ID NO: 7451292 - DNA, 22 bp, Homo sapiens
tccattttagagatgaagaaac

SEQ ID NO: 7451293 - DNA, 22 bp, Homo sapiens
tccattttagagatgaagaaac

SEQ ID NO: 7451294 - DNA, 22 bp, Homo sapiens
tccattttcatctcatgtataa

SEQ ID NO: 7451295 - DNA, 22 bp, Homo sapiens
tccattttcatctcatgtataa

SEQ ID NO: 7451296 - DNA, 22 bp, Homo sapiens
tccattttctaagtatcactta

SEQ ID NO: 7451297 - DNA, 22 bp, Homo sapiens
tccattttcatctcatgtataa

SEQ ID NO: 7451298 - DNA, 22 bp, Homo sapiens
catgggcccgtgagaggcaggg

SEQ ID NO: 7451299 - DNA, 22 bp, Homo sapiens
catgggcccgtgagaggcaggg

SEQ ID NO: 7451300 - DNA, 22 bp, Homo sapiens
catgggctacagaagcatgctg

SEQ ID NO: 7451301 - DNA, 22 bp, Homo sapiens
catgggctacagaagcatgctg

SEQ ID NO: 7451302 - DNA, 22 bp, Homo sapiens
catgggctacagaagcatgctg

SEQ ID NO: 7451303 - DNA, 22 bp, Homo sapiens
catgggctacagaagcatgctg

SEQ ID NO: 7451304 - DNA, 22 bp, Homo sapiens
catgggccatggtgaagccagg

SEQ ID NO: 7451305 - DNA, 22 bp, Homo sapiens
catgggccagagctcctctggg

SEQ ID NO: 7451306 - DNA, 22 bp, Homo sapiens
catgggcagttggcagggctca

SEQ ID NO: 7451307 - DNA, 22 bp, Homo sapiens
catgggcagaagtggcatcatt

SEQ ID NO: 7451308 - DNA, 22 bp, Homo sapiens
catgggcagttggcagggctca

SEQ ID NO: 7451309 - DNA, 22 bp, Homo sapiens
catgggcagttggcagggctca

SEQ ID NO: 7451310 - DNA, 22 bp, Homo sapiens
catgggcagttggcagggctca

SEQ ID NO: 7451311 - DNA, 22 bp, Homo sapiens
catgggcagaagtggcatcatt

SEQ ID NO: 7451312 - DNA, 22 bp, Homo sapiens
tccatattgcagcatgtgtcag

SEQ ID NO: 7451313 - DNA, 22 bp, Homo sapiens
tccatcaccacagaggacagag

SEQ ID NO: 7451314 - DNA, 22 bp, Homo sapiens
tccatattgcagcatgtgtcag

SEQ ID NO: 7451315 - DNA, 22 bp, Homo sapiens
tccatattgcagcatgtgtcag

SEQ ID NO: 7451316 - DNA, 22 bp, Homo sapiens
catgggctcaaccttgaccaca

SEQ ID NO: 7451317 - DNA, 22 bp, Homo sapiens
tccatattaactaaaactagaa

SEQ ID NO: 7451318 - DNA, 22 bp, Homo sapiens
catgggctctctgagctccagg

SEQ ID NO: 7451319 - DNA, 22 bp, Homo sapiens
catgggctcaaccttgaccaca

SEQ ID NO: 7451320 - DNA, 22 bp, Homo sapiens
catgggctctctgagctccagg

SEQ ID NO: 7451321 - DNA, 22 bp, Homo sapiens
tccatttgaaatgaaagtgata

SEQ ID NO: 7451322 - DNA, 22 bp, Homo sapiens
tccatttggcactctatttcca

SEQ ID NO: 7451323 - DNA, 22 bp, Homo sapiens
tccatttggcactctatttcca

SEQ ID NO: 7451324 - DNA, 22 bp, Homo sapiens
tccatttggcctctgtattgta

SEQ ID NO: 7451325 - DNA, 22 bp, Homo sapiens
tccatttggcctctgtattgta

SEQ ID NO: 7451326 - DNA, 22 bp, Homo sapiens
tccattttagaagaaaatccac

SEQ ID NO: 7451327 - DNA, 22 bp, Homo sapiens
tccatttggcctctgtattgta

SEQ ID NO: 7451328 - DNA, 22 bp, Homo sapiens
tccattttagaagaaaatccac

SEQ ID NO: 7451329 - DNA, 22 bp, Homo sapiens
tccattttagagatgaagaaac

SEQ ID NO: 7451330 - DNA, 22 bp, Homo sapiens
tccattttagagatgaagaaac

SEQ ID NO: 7451331 - DNA, 22 bp, Homo sapiens
catgggaggcctgctgctggtg

SEQ ID NO: 7451332 - DNA, 22 bp, Homo sapiens
catgggaggcctgctgctggtg

SEQ ID NO: 7451333 - DNA, 22 bp, Homo sapiens
catgggaggcctgctgctggtg

SEQ ID NO: 7451334 - DNA, 22 bp, Homo sapiens
catgggaggcctgctgctggtg

SEQ ID NO: 7451335 - DNA, 22 bp, Homo sapiens
catgggaggcctgctgctggtg

SEQ ID NO: 7451336 - DNA, 22 bp, Homo sapiens
tccaggagcatccaggtgaagc

SEQ ID NO: 7451337 - DNA, 22 bp, Homo sapiens
tccaggagcatccaggtgaagc

SEQ ID NO: 7451338 - DNA, 22 bp, Homo sapiens
tccaggagcatccaggtgaagc

SEQ ID NO: 7451339 - DNA, 22 bp, Homo sapiens
tccaggagcatccaggtgaagc

SEQ ID NO: 7451340 - DNA, 21 bp, Homo sapiens
tccaggagcacgggactagga

SEQ ID NO: 7451341 - DNA, 21 bp, Homo sapiens
tccaggagcacgggactagga

SEQ ID NO: 7451342 - DNA, 21 bp, Homo sapiens
tccaggagcacgggactagga

SEQ ID NO: 7451343 - DNA, 21 bp, Homo sapiens
tccaggagcacgggactagga

SEQ ID NO: 7451344 - DNA, 19 bp, Homo sapiens
tccaggagcaaagccagtt

SEQ ID NO: 7451345 - DNA, 21 bp, Homo sapiens
tccaggagcacgggactagga

SEQ ID NO: 7451346 - DNA, 21 bp, Homo sapiens
tccaggagcacgggactagga

SEQ ID NO: 7451347 - DNA, 19 bp, Homo sapiens
tccaggagcaaagccagtt

SEQ ID NO: 7451348 - DNA, 19 bp, Homo sapiens
tccaggagcaaagccagtt

SEQ ID NO: 7451349 - DNA, 22 bp, Homo sapiens
tccaggagattcattaggtcat

SEQ ID NO: 7451350 - DNA, 19 bp, Homo sapiens
tccaggagcaaagccagtt

SEQ ID NO: 7451351 - DNA, 19 bp, Homo sapiens
tccaggagcaaagccagtt

SEQ ID NO: 7451352 - DNA, 23 bp, Homo sapiens
catgggagtgagaatgccagctc

SEQ ID NO: 7451353 - DNA, 21 bp, Homo sapiens
tccaggagcacgggactagga

SEQ ID NO: 7451354 - DNA, 23 bp, Homo sapiens
catgggagtgagaatgccagctc

SEQ ID NO: 7451355 - DNA, 23 bp, Homo sapiens
catgggagtgagaatgccagctc

SEQ ID NO: 7451356 - DNA, 22 bp, Homo sapiens
catgggcaccttaaaatgaggc

SEQ ID NO: 7451357 - DNA, 22 bp, Homo sapiens
catgggcagaagtggcatcatt

SEQ ID NO: 7451358 - DNA, 22 bp, Homo sapiens
catgggcaccttaaaatgaggc

SEQ ID NO: 7451359 - DNA, 22 bp, Homo sapiens
catgggaggtctgcaaggtgct

SEQ ID NO: 7451360 - DNA, 22 bp, Homo sapiens
catgggaggtctgcaaggtgct

SEQ ID NO: 7451361 - DNA, 22 bp, Homo sapiens
catgggaggtctgcaaggtgct

SEQ ID NO: 7451362 - DNA, 22 bp, Homo sapiens
catgggaggcctgctgctggtg

SEQ ID NO: 7451363 - DNA, 22 bp, Homo sapiens
catgggaggtctgcaaggtgct

SEQ ID NO: 7451364 - DNA, 22 bp, Homo sapiens
catgggaggttggcttggcatg

SEQ ID NO: 7451365 - DNA, 22 bp, Homo sapiens
catgggaggttggcttggcatg

SEQ ID NO: 7451366 - DNA, 22 bp, Homo sapiens
catgggaggtctgcaaggtgct

SEQ ID NO: 7451367 - DNA, 17 bp, Homo sapiens
tccaggagaggcaatgg

SEQ ID NO: 7451368 - DNA, 17 bp, Homo sapiens
tccaggagaggcaatgg

SEQ ID NO: 7451369 - DNA, 22 bp, Homo sapiens
tccaggagaccagatgtaggcc

SEQ ID NO: 7451370 - DNA, 22 bp, Homo sapiens
tccaggagacacccttgtgtgt

SEQ ID NO: 7451371 - DNA, 17 bp, Homo sapiens
tccaggagaggcaatgg

SEQ ID NO: 7451372 - DNA, 17 bp, Homo sapiens
tccaggagaggcaatgg

SEQ ID NO: 7451373 - DNA, 17 bp, Homo sapiens
tccaggagaggcaatgg

SEQ ID NO: 7451374 - DNA, 22 bp, Homo sapiens
tccaggagaggcctgaccaggt

SEQ ID NO: 7451375 - DNA, 22 bp, Homo sapiens
tccaggagaggcctgaccaggt

SEQ ID NO: 7451376 - DNA, 23 bp, Homo sapiens
tccaggagaattccagggcccgg

SEQ ID NO: 7451377 - DNA, 22 bp, Homo sapiens
tccaggagacacaaggtacata

SEQ ID NO: 7451378 - DNA, 22 bp, Homo sapiens
tccaggagacacaaggtacata

SEQ ID NO: 7451379 - DNA, 22 bp, Homo sapiens
tccaggagacacaaggtacata

SEQ ID NO: 7451380 - DNA, 22 bp, Homo sapiens
tccaggagacacccttgtgtgt

SEQ ID NO: 7451381 - DNA, 22 bp, Homo sapiens
tccaggagacacaaggtacata

SEQ ID NO: 7451382 - DNA, 22 bp, Homo sapiens
tccaggagacacaaggtacata

SEQ ID NO: 7451383 - DNA, 22 bp, Homo sapiens
tccaggagacacccttgtgtgt

SEQ ID NO: 7451384 - DNA, 22 bp, Homo sapiens
tccaggagaccagatgtaggcc

SEQ ID NO: 7451385 - DNA, 22 bp, Homo sapiens
tccaggagaccagatgtaggcc

SEQ ID NO: 7451386 - DNA, 22 bp, Homo sapiens
tccaggagattcattaggtcat

SEQ ID NO: 7451387 - DNA, 22 bp, Homo sapiens
tccaggagattcattaggtcat

SEQ ID NO: 7451388 - DNA, 22 bp, Homo sapiens
tccaggagattcattaggtcat

SEQ ID NO: 7451389 - DNA, 22 bp, Homo sapiens
tccaggagatacactgcaccag

SEQ ID NO: 7451390 - DNA, 22 bp, Homo sapiens
tccaggagatacactgcaccag

SEQ ID NO: 7451391 - DNA, 22 bp, Homo sapiens
tccaggagatacactgcaccag

SEQ ID NO: 7451392 - DNA, 22 bp, Homo sapiens
tccaggagaggtgtggggactg

SEQ ID NO: 7451393 - DNA, 22 bp, Homo sapiens
tccaggagatacactgcaccag

SEQ ID NO: 7451394 - DNA, 22 bp, Homo sapiens
tccaggagatacactgcaccag

SEQ ID NO: 7451395 - DNA, 22 bp, Homo sapiens
tccaggagaggtgtggggactg

SEQ ID NO: 7451396 - DNA, 22 bp, Homo sapiens
tccaggagaggtagagggttcc

SEQ ID NO: 7451397 - DNA, 22 bp, Homo sapiens
tccaggagaggtgtggggactg

SEQ ID NO: 7451398 - DNA, 22 bp, Homo sapiens
tccaggagaggtgtggggactg

SEQ ID NO: 7451399 - DNA, 22 bp, Homo sapiens
tccaggagaggtgtggggactg

SEQ ID NO: 7451400 - DNA, 22 bp, Homo sapiens
tccaggagaggcctgaccaggt

SEQ ID NO: 7451401 - DNA, 22 bp, Homo sapiens
tccaggagaggtagagggttcc

SEQ ID NO: 7451402 - DNA, 22 bp, Homo sapiens
tccaggagaggcctgaccaggt

SEQ ID NO: 7451403 - DNA, 22 bp, Homo sapiens
tccaggagaggcctgaccaggt

SEQ ID NO: 7451404 - DNA, 22 bp, Homo sapiens
tccaggagaggcctgaccaggt

SEQ ID NO: 7451405 - DNA, 22 bp, Homo sapiens
tccaggagaggcctgaccaggt

SEQ ID NO: 7451406 - DNA, 22 bp, Homo sapiens
tccaggagaggcctgaccaggt

SEQ ID NO: 7451407 - DNA, 22 bp, Homo sapiens
tccaggagaggcctgaccaggt

SEQ ID NO: 7451408 - DNA, 22 bp, Homo sapiens
cattcttacacaatattttaat

SEQ ID NO: 7451409 - DNA, 22 bp, Homo sapiens
cattcttctggatagttagttg

SEQ ID NO: 7451410 - DNA, 22 bp, Homo sapiens
cattcttctcccttaccttcca

SEQ ID NO: 7451411 - DNA, 22 bp, Homo sapiens
cattcttctcccttaccttcca

SEQ ID NO: 7451412 - DNA, 22 bp, Homo sapiens
cattctgtgattctaaatccct

SEQ ID NO: 7451413 - DNA, 22 bp, Homo sapiens
cattcttacacaatattttaat

SEQ ID NO: 7451414 - DNA, 22 bp, Homo sapiens
cattcttacacaatattttaat

SEQ ID NO: 7451415 - DNA, 22 bp, Homo sapiens
cattctgtgattctaaatccct

SEQ ID NO: 7451416 - DNA, 22 bp, Homo sapiens
cattctgtgattctaaatccct

SEQ ID NO: 7451417 - DNA, 22 bp, Homo sapiens
cattctgggtctggctcaggga

SEQ ID NO: 7451418 - DNA, 22 bp, Homo sapiens
cattctgggtctggctcaggga

SEQ ID NO: 7451419 - DNA, 17 bp, Homo sapiens
cattctgtaatctttct

SEQ ID NO: 7451420 - DNA, 22 bp, Homo sapiens
cattctggaccaagctgggtgc

SEQ ID NO: 7451421 - DNA, 17 bp, Homo sapiens
cattctgtaatctttct

SEQ ID NO: 7451422 - DNA, 17 bp, Homo sapiens
cattctgtaatctttct

SEQ ID NO: 7451423 - DNA, 17 bp, Homo sapiens
cattctgtaatctttct

SEQ ID NO: 7451424 - DNA, 22 bp, Homo sapiens
cattctctgatcttcacatacc

SEQ ID NO: 7451425 - DNA, 22 bp, Homo sapiens
cattctctgatcttcacatacc

SEQ ID NO: 7451426 - DNA, 22 bp, Homo sapiens
cattctctctacttgttttcaa

SEQ ID NO: 7451427 - DNA, 22 bp, Homo sapiens
cattctctctacttgttttcaa

SEQ ID NO: 7451428 - DNA, 22 bp, Homo sapiens
cattctctctacttgttttcaa

SEQ ID NO: 7451429 - DNA, 22 bp, Homo sapiens
cattctctgatcttcacatacc

SEQ ID NO: 7451430 - DNA, 22 bp, Homo sapiens
cattctcttgacaggacagccc

SEQ ID NO: 7451431 - DNA, 22 bp, Homo sapiens
cattctgacagctgaggtcgtg

SEQ ID NO: 7451432 - DNA, 22 bp, Homo sapiens
cattctctgatcttcacatacc

SEQ ID NO: 7451433 - DNA, 22 bp, Homo sapiens
cattctctgatcttcacatacc

SEQ ID NO: 7451434 - DNA, 22 bp, Homo sapiens
cattctctgatcttcacatacc

SEQ ID NO: 7451435 - DNA, 22 bp, Homo sapiens
cattctgaccctatgatttaag

SEQ ID NO: 7451436 - DNA, 22 bp, Homo sapiens
cattctgagtcactctttagca

SEQ ID NO: 7451437 - DNA, 22 bp, Homo sapiens
cattctgcatttggaaggggca

SEQ ID NO: 7451438 - DNA, 22 bp, Homo sapiens
cattctgagtcactctttagca

SEQ ID NO: 7451439 - DNA, 22 bp, Homo sapiens
cattctgcgatcctcaagcaca

SEQ ID NO: 7451440 - DNA, 22 bp, Homo sapiens
cattctgggtctggctcaggga

SEQ ID NO: 7451441 - DNA, 22 bp, Homo sapiens
cattctgggtctggctcaggga

SEQ ID NO: 7451442 - DNA, 22 bp, Homo sapiens
cattcttgcaccgtgatggctt

SEQ ID NO: 7451443 - DNA, 22 bp, Homo sapiens
cattcttctggatagttagttg

SEQ ID NO: 7451444 - DNA, 22 bp, Homo sapiens
cattcttgaaccaggcactgtg

SEQ ID NO: 7451445 - DNA, 22 bp, Homo sapiens
cattcttgcaccgtgatggctt

SEQ ID NO: 7451446 - DNA, 22 bp, Homo sapiens
tcccacatgtgaatcctcaggt

SEQ ID NO: 7451447 - DNA, 22 bp, Homo sapiens
tcccacattaccctgactgaca

SEQ ID NO: 7451448 - DNA, 22 bp, Homo sapiens
tcccaccccctccaaggaggaa

SEQ ID NO: 7451449 - DNA, 22 bp, Homo sapiens
tcccaccaggtgaccatttcat

SEQ ID NO: 7451450 - DNA, 22 bp, Homo sapiens
tcccacccatcctgcatctctt

SEQ ID NO: 7451451 - DNA, 22 bp, Homo sapiens
tcccacccatcctgcatctctt

SEQ ID NO: 7451452 - DNA, 22 bp, Homo sapiens
tcccacccatcctgcatctctt

SEQ ID NO: 7451453 - DNA, 22 bp, Homo sapiens
tcccacccatcctgcatctctt

SEQ ID NO: 7451454 - DNA, 22 bp, Homo sapiens
tcccacccatcctgcatctctt

SEQ ID NO: 7451455 - DNA, 22 bp, Homo sapiens
tcccaccttccgtggaacccgt

SEQ ID NO: 7451456 - DNA, 22 bp, Homo sapiens
tcccaccttccgtggaacccgt

SEQ ID NO: 7451457 - DNA, 22 bp, Homo sapiens
tcccaccccggtcaagggctga

SEQ ID NO: 7451458 - DNA, 22 bp, Homo sapiens
tcccaccccttgactctttaag

SEQ ID NO: 7451459 - DNA, 22 bp, Homo sapiens
tcccaccccggtcaagggctga

SEQ ID NO: 7451460 - DNA, 22 bp, Homo sapiens
tcccaccccttgactctttaag

SEQ ID NO: 7451461 - DNA, 22 bp, Homo sapiens
tcccaccccttgactctttaag

SEQ ID NO: 7451462 - DNA, 22 bp, Homo sapiens
tcccaccccggtcaagggctga

SEQ ID NO: 7451463 - DNA, 22 bp, Homo sapiens
tcccaccccggtcaagggctga

SEQ ID NO: 7451464 - DNA, 22 bp, Homo sapiens
tcccaccccggtcaagggctga

SEQ ID NO: 7451465 - DNA, 22 bp, Homo sapiens
tcccaccccctccaaggaggaa

SEQ ID NO: 7451466 - DNA, 22 bp, Homo sapiens
tcccaccccggtcaagggctga

SEQ ID NO: 7451467 - DNA, 22 bp, Homo sapiens
tcccaccccggtcaagggctga

SEQ ID NO: 7451468 - DNA, 22 bp, Homo sapiens
tcccaccccctccaaggaggaa

SEQ ID NO: 7451469 - DNA, 22 bp, Homo sapiens
tcccaccccctccaaggaggaa

SEQ ID NO: 7451470 - DNA, 22 bp, Homo sapiens
tcccaccccctccaaggaggaa

SEQ ID NO: 7451471 - DNA, 22 bp, Homo sapiens
tcccaccccctccaaggaggaa

SEQ ID NO: 7451472 - DNA, 22 bp, Homo sapiens
cattctcaatagtagatgagta

SEQ ID NO: 7451473 - DNA, 22 bp, Homo sapiens
cattctcaatagtagatgagta

SEQ ID NO: 7451474 - DNA, 22 bp, Homo sapiens
cattctattgtagcaccctgta

SEQ ID NO: 7451475 - DNA, 22 bp, Homo sapiens
cattctctacactcctgccctg

SEQ ID NO: 7451476 - DNA, 22 bp, Homo sapiens
cattctccctattgaaaaagta

SEQ ID NO: 7451477 - DNA, 22 bp, Homo sapiens
cattctctacactcctgccctg

SEQ ID NO: 7451478 - DNA, 22 bp, Homo sapiens
cattctctacactcctgccctg

SEQ ID NO: 7451479 - DNA, 22 bp, Homo sapiens
cattctcaatagtagatgagta

SEQ ID NO: 7451480 - DNA, 22 bp, Homo sapiens
cattctcagtatcagccagccc

SEQ ID NO: 7451481 - DNA, 22 bp, Homo sapiens
cattatattacagcactgttaa

SEQ ID NO: 7451482 - DNA, 22 bp, Homo sapiens
cattcatttgcccagtaagtca

SEQ ID NO: 7451483 - DNA, 22 bp, Homo sapiens
cattcatttatgaaatatctat

SEQ ID NO: 7451484 - DNA, 22 bp, Homo sapiens
cattcatttgcccagtaagtca

SEQ ID NO: 7451485 - DNA, 22 bp, Homo sapiens
cattcatttatgaaatatctat

SEQ ID NO: 7451486 - DNA, 22 bp, Homo sapiens
cattctaggcctggcttgggcc

SEQ ID NO: 7451487 - DNA, 22 bp, Homo sapiens
cattctatcttggactggatct

SEQ ID NO: 7451488 - DNA, 22 bp, Homo sapiens
cattaggtatttaagcacacag

SEQ ID NO: 7451489 - DNA, 22 bp, Homo sapiens
cattagggtctctcagctgaat

SEQ ID NO: 7451490 - DNA, 21 bp, Homo sapiens
cattagggcagaagcaggaag

SEQ ID NO: 7451491 - DNA, 22 bp, Homo sapiens
cattagctatctgtttacatta

SEQ ID NO: 7451492 - DNA, 22 bp, Homo sapiens
cattagctatctgtttacatta

SEQ ID NO: 7451493 - DNA, 22 bp, Homo sapiens
cattagcattacttcaaagagt

SEQ ID NO: 7451494 - DNA, 22 bp, Homo sapiens
cattagcaggcactaagaaggt

SEQ ID NO: 7451495 - DNA, 22 bp, Homo sapiens
cattagcaagtcactattttat

SEQ ID NO: 7451496 - DNA, 22 bp, Homo sapiens
cattagcactctaaggaagaga

SEQ ID NO: 7451497 - DNA, 18 bp, Homo sapiens
cattagcaccacgtagag

SEQ ID NO: 7451498 - DNA, 22 bp, Homo sapiens
cattacatttcaaaatgtttcc

SEQ ID NO: 7451499 - DNA, 22 bp, Homo sapiens
cattacatttcaaaatgtttcc

SEQ ID NO: 7451500 - DNA, 22 bp, Homo sapiens
cattacatttcaaaatgtttcc

SEQ ID NO: 7451501 - DNA, 22 bp, Homo sapiens
cattacttctcatgcttcatgc

SEQ ID NO: 7451502 - DNA, 22 bp, Homo sapiens
cattacgagctctaaaatacta

SEQ ID NO: 7451503 - DNA, 22 bp, Homo sapiens
cattacatttcaaaatgtttcc

SEQ ID NO: 7451504 - DNA, 21 bp, Homo sapiens
cattacatggttttagtgaac

SEQ ID NO: 7451505 - DNA, 22 bp, Homo sapiens
cattacatggtccaggatatat

SEQ ID NO: 7451506 - DNA, 22 bp, Homo sapiens
cattacagtgtcagaggaactg

SEQ ID NO: 7451507 - DNA, 22 bp, Homo sapiens
tcccaaagaactgaatagtaat

SEQ ID NO: 7451508 - DNA, 22 bp, Homo sapiens
tcccaaagaactgaatagtaat

SEQ ID NO: 7451509 - DNA, 22 bp, Homo sapiens
cattagaagaacagttatatta

SEQ ID NO: 7451510 - DNA, 22 bp, Homo sapiens
cattagaactaagatgtccagg

SEQ ID NO: 7451511 - DNA, 22 bp, Homo sapiens
cattagaacctataaaaagcat

SEQ ID NO: 7451512 - DNA, 22 bp, Homo sapiens
cattacttctcatgcttcatgc

SEQ ID NO: 7451513 - DNA, 22 bp, Homo sapiens
cattagaactaagatgtccagg

SEQ ID NO: 7451514 - DNA, 22 bp, Homo sapiens
cattagaactaagatgtccagg

SEQ ID NO: 7451515 - DNA, 22 bp, Homo sapiens
cattagaacctataaaaagcat

SEQ ID NO: 7451516 - DNA, 22 bp, Homo sapiens
cattagaattaggttgtttacc

SEQ ID NO: 7451517 - DNA, 22 bp, Homo sapiens
cattagaaggttttaaaggaat

SEQ ID NO: 7451518 - DNA, 22 bp, Homo sapiens
cattagaagaacagttatatta

SEQ ID NO: 7451519 - DNA, 22 bp, Homo sapiens
cattagacacagatgtataaat

SEQ ID NO: 7451520 - DNA, 22 bp, Homo sapiens
cattagattggtgcaaaaataa

SEQ ID NO: 7451521 - DNA, 22 bp, Homo sapiens
cattagattggtgcaaaaataa

SEQ ID NO: 7451522 - DNA, 19 bp, Homo sapiens
tccttccccccagcacaga

SEQ ID NO: 7451523 - DNA, 19 bp, Homo sapiens
tccttccccccagcacaga

SEQ ID NO: 7451524 - DNA, 19 bp, Homo sapiens
tccttccccccagcacaga

SEQ ID NO: 7451525 - DNA, 19 bp, Homo sapiens
tccttccccccagcacaga

SEQ ID NO: 7451526 - DNA, 21 bp, Homo sapiens
tccttcccccttggcctggga

SEQ ID NO: 7451527 - DNA, 22 bp, Homo sapiens
tccttccccctcaagagaactt

SEQ ID NO: 7451528 - DNA, 21 bp, Homo sapiens
tccttcccccttggcctggga

SEQ ID NO: 7451529 - DNA, 21 bp, Homo sapiens
tccttcccccttggcctggga

SEQ ID NO: 7451530 - DNA, 22 bp, Homo sapiens
tccttccccctcaagagaactt

SEQ ID NO: 7451531 - DNA, 22 bp, Homo sapiens
tccttccccctcaagagaactt

SEQ ID NO: 7451532 - DNA, 22 bp, Homo sapiens
tccttccccctcaagagaactt

SEQ ID NO: 7451533 - DNA, 22 bp, Homo sapiens
tccttcctgcaggccaagtcct

SEQ ID NO: 7451534 - DNA, 22 bp, Homo sapiens
tccttcctcggggacccagatc

SEQ ID NO: 7451535 - DNA, 22 bp, Homo sapiens
tccttcctgcaggccaagtcct

SEQ ID NO: 7451536 - DNA, 22 bp, Homo sapiens
tccttcctcggggacccagatc

SEQ ID NO: 7451537 - DNA, 22 bp, Homo sapiens
tccttcctcggggacccagatc

SEQ ID NO: 7451538 - DNA, 22 bp, Homo sapiens
tccttcctcggggacccagatc

SEQ ID NO: 7451539 - DNA, 22 bp, Homo sapiens
tccttcctccatggtcttggtt

SEQ ID NO: 7451540 - DNA, 22 bp, Homo sapiens
tccttcctccatggtcttggtt

SEQ ID NO: 7451541 - DNA, 20 bp, Homo sapiens
tccttccctctctttttgca

SEQ ID NO: 7451542 - DNA, 20 bp, Homo sapiens
tccttccctctctttttgca

SEQ ID NO: 7451543 - DNA, 22 bp, Homo sapiens
tccttcctccatggtcttggtt

SEQ ID NO: 7451544 - DNA, 22 bp, Homo sapiens
tccttcctccatggtcttggtt

SEQ ID NO: 7451545 - DNA, 22 bp, Homo sapiens
tccttcctccatggtcttggtt

SEQ ID NO: 7451546 - DNA, 22 bp, Homo sapiens
tccttcctgcaggccaagtcct

SEQ ID NO: 7451547 - DNA, 22 bp, Homo sapiens
tccttcctgcaggccaagtcct

SEQ ID NO: 7451548 - DNA, 22 bp, Homo sapiens
tccttcctgcaggccaagtcct

SEQ ID NO: 7451549 - DNA, 22 bp, Homo sapiens
tccttcctgctctaacattcag

SEQ ID NO: 7451550 - DNA, 22 bp, Homo sapiens
tccttcctgcaggccaagtcct

SEQ ID NO: 7451551 - DNA, 22 bp, Homo sapiens
tccttcctgcaggccaagtcct

SEQ ID NO: 7451552 - DNA, 22 bp, Homo sapiens
tccttcctgctctaacattcag

SEQ ID NO: 7451553 - DNA, 22 bp, Homo sapiens
tccttcctgctctaacattcag

SEQ ID NO: 7451554 - DNA, 22 bp, Homo sapiens
tccttcctgctctaacattcag

SEQ ID NO: 7451555 - DNA, 22 bp, Homo sapiens
tccttcctgctctaacattcag

SEQ ID NO: 7451556 - DNA, 23 bp, Homo sapiens
tccttgggcctgcccagagtggt

SEQ ID NO: 7451557 - DNA, 23 bp, Homo sapiens
tccttgggcctgcccagagtggt

SEQ ID NO: 7451558 - DNA, 23 bp, Homo sapiens
tccttgggcctgcccagagtggt

SEQ ID NO: 7451559 - DNA, 23 bp, Homo sapiens
tccttgggcctgcccagagtggt

SEQ ID NO: 7451560 - DNA, 22 bp, Homo sapiens
tccttggggacgctgacatcgt

SEQ ID NO: 7451561 - DNA, 22 bp, Homo sapiens
tccttggggtaactccagcctg

SEQ ID NO: 7451562 - DNA, 22 bp, Homo sapiens
tccttggggtaactccagcctg

SEQ ID NO: 7451563 - DNA, 22 bp, Homo sapiens
tccttgggtcagtgagtgaggt

SEQ ID NO: 7451564 - DNA, 22 bp, Homo sapiens
tccttgggtcagtgagtgaggt

SEQ ID NO: 7451565 - DNA, 22 bp, Homo sapiens
tcctttatgtgagttgtttccc

SEQ ID NO: 7451566 - DNA, 22 bp, Homo sapiens
tcctttatgtgagttgtttccc

SEQ ID NO: 7451567 - DNA, 22 bp, Homo sapiens
tcctttatgtgagttgtttccc

SEQ ID NO: 7451568 - DNA, 22 bp, Homo sapiens
tcctttatgtgagttgtttccc

SEQ ID NO: 7451569 - DNA, 22 bp, Homo sapiens
ccactgctaacttgctgcagct

SEQ ID NO: 7451570 - DNA, 22 bp, Homo sapiens
ccactgctaacttgctgcagct

SEQ ID NO: 7451571 - DNA, 22 bp, Homo sapiens
ccactgctaacttgctgcagct

SEQ ID NO: 7451572 - DNA, 22 bp, Homo sapiens
ccactgctaacttgctgcagct

SEQ ID NO: 7451573 - DNA, 22 bp, Homo sapiens
ccactgctaacttgctgcagct

SEQ ID NO: 7451574 - DNA, 22 bp, Homo sapiens
ccactgctaacttgctgcagct

SEQ ID NO: 7451575 - DNA, 22 bp, Homo sapiens
ccactgcctgacttagatgaca

SEQ ID NO: 7451576 - DNA, 22 bp, Homo sapiens
tcctttatctgctcagaaagta

SEQ ID NO: 7451577 - DNA, 22 bp, Homo sapiens
tcctttatctgctcagaaagta

SEQ ID NO: 7451578 - DNA, 22 bp, Homo sapiens
tcctttatcaaggagccttaga

SEQ ID NO: 7451579 - DNA, 22 bp, Homo sapiens
tcctttatctgctcagaaagta

SEQ ID NO: 7451580 - DNA, 22 bp, Homo sapiens
tcctttagctttcttggacaaa

SEQ ID NO: 7451581 - DNA, 22 bp, Homo sapiens
tcctttatcaaggagccttaga

SEQ ID NO: 7451582 - DNA, 22 bp, Homo sapiens
tcctttatcaaggagccttaga

SEQ ID NO: 7451583 - DNA, 23 bp, Homo sapiens
tcctttaagatatcttattcctt

SEQ ID NO: 7451584 - DNA, 23 bp, Homo sapiens
tcctttaatgctggaatggctag

SEQ ID NO: 7451585 - DNA, 22 bp, Homo sapiens
tcctttaacttgattattttca

SEQ ID NO: 7451586 - DNA, 22 bp, Homo sapiens
tcctttaacttgattattttca

SEQ ID NO: 7451587 - DNA, 23 bp, Homo sapiens
tcctttaagatatcttattcctt

SEQ ID NO: 7451588 - DNA, 23 bp, Homo sapiens
tcctttaagatatcttattcctt

SEQ ID NO: 7451589 - DNA, 22 bp, Homo sapiens
tccttgtaacgttgggctgggg

SEQ ID NO: 7451590 - DNA, 19 bp, Homo sapiens
tccttgtgactgtgtgaaa

SEQ ID NO: 7451591 - DNA, 19 bp, Homo sapiens
tccttgtgactgtgtgaaa

SEQ ID NO: 7451592 - DNA, 22 bp, Homo sapiens
tcctttaaacaaccagctctca

SEQ ID NO: 7451593 - DNA, 22 bp, Homo sapiens
tccttgtaaaggagctctaaca

SEQ ID NO: 7451594 - DNA, 22 bp, Homo sapiens
tccttgggtcagtgagtgaggt

SEQ ID NO: 7451595 - DNA, 22 bp, Homo sapiens
tccttgggtcagtgagtgaggt

SEQ ID NO: 7451596 - DNA, 22 bp, Homo sapiens
tcctttaacttgattattttca

SEQ ID NO: 7451597 - DNA, 22 bp, Homo sapiens
tcctttaacttgattattttca

SEQ ID NO: 7451598 - DNA, 22 bp, Homo sapiens
tcctttaacttgattattttca

SEQ ID NO: 7451599 - DNA, 22 bp, Homo sapiens
tcctttaactagttaccatgtt

SEQ ID NO: 7451600 - DNA, 22 bp, Homo sapiens
tcctttaactagttaccatgtt

SEQ ID NO: 7451601 - DNA, 22 bp, Homo sapiens
tcctttaaagaactgtgctttt

SEQ ID NO: 7451602 - DNA, 22 bp, Homo sapiens
tcctttaactagttaccatgtt

SEQ ID NO: 7451603 - DNA, 22 bp, Homo sapiens
tcctttaactagttaccatgtt

SEQ ID NO: 7451604 - DNA, 22 bp, Homo sapiens
tcctttaaagaactgtgctttt

SEQ ID NO: 7451605 - DNA, 22 bp, Homo sapiens
tcctttaaagaactgtgctttt

SEQ ID NO: 7451606 - DNA, 22 bp, Homo sapiens
tcctttaaagaactgtgctttt

SEQ ID NO: 7451607 - DNA, 22 bp, Homo sapiens
tcctttaaactcctttcaagtc

SEQ ID NO: 7451608 - DNA, 22 bp, Homo sapiens
tcctttaaactcctttcaagtc

SEQ ID NO: 7451609 - DNA, 22 bp, Homo sapiens
tcctttaaactcctttcaagtc

SEQ ID NO: 7451610 - DNA, 22 bp, Homo sapiens
tcctttaaactcctttcaagtc

SEQ ID NO: 7451611 - DNA, 19 bp, Homo sapiens
tccttaaaaaagcagttct

SEQ ID NO: 7451612 - DNA, 22 bp, Homo sapiens
tccttaaacaacacactttgta

SEQ ID NO: 7451613 - DNA, 22 bp, Homo sapiens
tccttaaacaacacactttgta

SEQ ID NO: 7451614 - DNA, 22 bp, Homo sapiens
tccttaaacaacacactttgta

SEQ ID NO: 7451615 - DNA, 19 bp, Homo sapiens
tccttaaaaaagcagttct

SEQ ID NO: 7451616 - DNA, 19 bp, Homo sapiens
tcctggggaggggcatggc

SEQ ID NO: 7451617 - DNA, 19 bp, Homo sapiens
tcctggggaggggcatggc

SEQ ID NO: 7451618 - DNA, 22 bp, Homo sapiens
tcctgggctttgtttctctcct

SEQ ID NO: 7451619 - DNA, 22 bp, Homo sapiens
tcctgggcttgctcctccagct

SEQ ID NO: 7451620 - DNA, 19 bp, Homo sapiens
tcctggggaggggcatggc

SEQ ID NO: 7451621 - DNA, 19 bp, Homo sapiens
tcctggggaggggcatggc

SEQ ID NO: 7451622 - DNA, 19 bp, Homo sapiens
tcctggggaggggcatggc

SEQ ID NO: 7451623 - DNA, 19 bp, Homo sapiens
tcctggggaggggcatggc

SEQ ID NO: 7451624 - DNA, 19 bp, Homo sapiens
tcctggggaggggcatggc

SEQ ID NO: 7451625 - DNA, 19 bp, Homo sapiens
tcctggggaggggcatggc

SEQ ID NO: 7451626 - DNA, 22 bp, Homo sapiens
tcctgggcttagtggctaggtc

SEQ ID NO: 7451627 - DNA, 22 bp, Homo sapiens
tcctgggcttagtggctaggtc

SEQ ID NO: 7451628 - DNA, 22 bp, Homo sapiens
tcctgggcttcacagactctgt

SEQ ID NO: 7451629 - DNA, 22 bp, Homo sapiens
tcctgggcttcacagactctgt

SEQ ID NO: 7451630 - DNA, 22 bp, Homo sapiens
tcctgggcttcacagactctgt

SEQ ID NO: 7451631 - DNA, 22 bp, Homo sapiens
tcctgggcttcacagactctgt

SEQ ID NO: 7451632 - DNA, 22 bp, Homo sapiens
tcctgggcttcacagactctgt

SEQ ID NO: 7451633 - DNA, 22 bp, Homo sapiens
tcctgggcttcacagactctgt

SEQ ID NO: 7451634 - DNA, 22 bp, Homo sapiens
tcctgggcttgctcctccagct

SEQ ID NO: 7451635 - DNA, 22 bp, Homo sapiens
tcctgggcttgctcctccagct

SEQ ID NO: 7451636 - DNA, 22 bp, Homo sapiens
tcctgggcttgctcctccagct

SEQ ID NO: 7451637 - DNA, 22 bp, Homo sapiens
tcctgggcttgctcctccagct

SEQ ID NO: 7451638 - DNA, 22 bp, Homo sapiens
tcctgggcttgctcctccagct

SEQ ID NO: 7451639 - DNA, 22 bp, Homo sapiens
tcctgggcttgctcctccagct

SEQ ID NO: 7451640 - DNA, 22 bp, Homo sapiens
tcctgggcttgctcctccagct

SEQ ID NO: 7451641 - DNA, 17 bp, Homo sapiens
tccttcagtgcctctgc

SEQ ID NO: 7451642 - DNA, 22 bp, Homo sapiens
tccttcagtcttctgagccata

SEQ ID NO: 7451643 - DNA, 21 bp, Homo sapiens
tccttcagtctagatgattgt

SEQ ID NO: 7451644 - DNA, 21 bp, Homo sapiens
tccttcagtctagatgattgt

SEQ ID NO: 7451645 - DNA, 22 bp, Homo sapiens
tccttcagtcttctgagccata

SEQ ID NO: 7451646 - DNA, 22 bp, Homo sapiens
tccttaaagtgcacctcctcat

SEQ ID NO: 7451647 - DNA, 22 bp, Homo sapiens
tccttaaagtgcacctcctcat

SEQ ID NO: 7451648 - DNA, 22 bp, Homo sapiens
tccttaaaggactagaagtcaa

SEQ ID NO: 7451649 - DNA, 22 bp, Homo sapiens
tccttaaaggactagaagtcaa

SEQ ID NO: 7451650 - DNA, 22 bp, Homo sapiens
tccttaaaggactagaagtcaa

SEQ ID NO: 7451651 - DNA, 22 bp, Homo sapiens
tccttaaatatttactgttaac

SEQ ID NO: 7451652 - DNA, 17 bp, Homo sapiens
tccttcagtgcctctgc

SEQ ID NO: 7451653 - DNA, 17 bp, Homo sapiens
tccttcagtgcctctgc

SEQ ID NO: 7451654 - DNA, 17 bp, Homo sapiens
tccttcagtgcctctgc

SEQ ID NO: 7451655 - DNA, 22 bp, Homo sapiens
tccttcagtgtcccgctcaggt

SEQ ID NO: 7451656 - DNA, 22 bp, Homo sapiens
tccttcagttaaagatctcaca

SEQ ID NO: 7451657 - DNA, 22 bp, Homo sapiens
tccttcagttaaagatctcaca

SEQ ID NO: 7451658 - DNA, 22 bp, Homo sapiens
tccttccaggtccagggatgtg

SEQ ID NO: 7451659 - DNA, 22 bp, Homo sapiens
tccttccaggtccagggatgtg

SEQ ID NO: 7451660 - DNA, 22 bp, Homo sapiens
tccttcatgcctgtaatcccag

SEQ ID NO: 7451661 - DNA, 19 bp, Homo sapiens
tccttccagttcctggggt

SEQ ID NO: 7451662 - DNA, 19 bp, Homo sapiens
tccttccagttcctggggt

SEQ ID NO: 7451663 - DNA, 19 bp, Homo sapiens
tccttccagttcctggggt

SEQ ID NO: 7451664 - DNA, 22 bp, Homo sapiens
tccttccatggtggggctgctt

SEQ ID NO: 7451665 - DNA, 22 bp, Homo sapiens
tccttccatggtggggctgctt

SEQ ID NO: 7451666 - DNA, 22 bp, Homo sapiens
tccttccatggtggggctgctt

SEQ ID NO: 7451667 - DNA, 22 bp, Homo sapiens
tccttccatggtggggctgctt

SEQ ID NO: 7451668 - DNA, 22 bp, Homo sapiens
tccttcccaggtgtcgccgcct

SEQ ID NO: 7451669 - DNA, 22 bp, Homo sapiens
tccttcccaggtgtcgccgcct

SEQ ID NO: 7451670 - DNA, 22 bp, Homo sapiens
tccttcccaggtgtcgccgcct

SEQ ID NO: 7451671 - DNA, 22 bp, Homo sapiens
tccttcccaggtgtcgccgcct

SEQ ID NO: 7451672 - DNA, 22 bp, Homo sapiens
tccttcagttatcacagtactg

SEQ ID NO: 7451673 - DNA, 22 bp, Homo sapiens
tccttcagttatcacagtactg

SEQ ID NO: 7451674 - DNA, 22 bp, Homo sapiens
tccttcagttcaattagtccgt

SEQ ID NO: 7451675 - DNA, 21 bp, Homo sapiens
tccttcagttctgcactttct

SEQ ID NO: 7451676 - DNA, 21 bp, Homo sapiens
tccttcagttctgcactttct

SEQ ID NO: 7451677 - DNA, 22 bp, Homo sapiens
tccttcatgatgcttagcagag

SEQ ID NO: 7451678 - DNA, 22 bp, Homo sapiens
ccagagaattttagacaaaaat

SEQ ID NO: 7451679 - DNA, 22 bp, Homo sapiens
ccagagaattttagacaaaaat

SEQ ID NO: 7451680 - DNA, 22 bp, Homo sapiens
ccagagacaaggagctggagtc

SEQ ID NO: 7451681 - DNA, 22 bp, Homo sapiens
ccagagacaaggagctggagtc

SEQ ID NO: 7451682 - DNA, 19 bp, Homo sapiens
ccagagacattggcatctt

SEQ ID NO: 7451683 - DNA, 19 bp, Homo sapiens
ccagagacattggcatctt

SEQ ID NO: 7451684 - DNA, 19 bp, Homo sapiens
ccagagacattggcatctt

SEQ ID NO: 7451685 - DNA, 22 bp, Homo sapiens
ccagagaccagaacatggggat

SEQ ID NO: 7451686 - DNA, 22 bp, Homo sapiens
ccagagaccagaacatggggat

SEQ ID NO: 7451687 - DNA, 22 bp, Homo sapiens
ccagagaattttagacaaaaat

SEQ ID NO: 7451688 - DNA, 22 bp, Homo sapiens
ccagagaattttagacaaaaat

SEQ ID NO: 7451689 - DNA, 22 bp, Homo sapiens
ccagagaattttagacaaaaat

SEQ ID NO: 7451690 - DNA, 22 bp, Homo sapiens
ccagagaatccggagagtccat

SEQ ID NO: 7451691 - DNA, 22 bp, Homo sapiens
ccagagaatccggagagtccat

SEQ ID NO: 7451692 - DNA, 22 bp, Homo sapiens
ccagagaatccggagagtccat

SEQ ID NO: 7451693 - DNA, 22 bp, Homo sapiens
ccagagaatccggagagtccat

SEQ ID NO: 7451694 - DNA, 22 bp, Homo sapiens
ccagagaatccggagagtccat

SEQ ID NO: 7451695 - DNA, 22 bp, Homo sapiens
ccagagaaggtggagcttgtgt

SEQ ID NO: 7451696 - DNA, 22 bp, Homo sapiens
ccagagaaggtggagcttgtgt

SEQ ID NO: 7451697 - DNA, 22 bp, Homo sapiens
ccagagaaggtggagcttgtgt

SEQ ID NO: 7451698 - DNA, 22 bp, Homo sapiens
ccagagaagtcttgcctggatt

SEQ ID NO: 7451699 - DNA, 22 bp, Homo sapiens
ccagagaagtcttgcctggatt

SEQ ID NO: 7451700 - DNA, 22 bp, Homo sapiens
ccagagaagtcttgcctggatt

SEQ ID NO: 7451701 - DNA, 22 bp, Homo sapiens
ccagagaagtcttgcctggatt

SEQ ID NO: 7451702 - DNA, 22 bp, Homo sapiens
ccagacaggggctgttcctgct

SEQ ID NO: 7451703 - DNA, 22 bp, Homo sapiens
ccagagaaataaggggaaaatg

SEQ ID NO: 7451704 - DNA, 22 bp, Homo sapiens
ccagagaaataaggggaaaatg

SEQ ID NO: 7451705 - DNA, 22 bp, Homo sapiens
ccagagaaataaggggaaaatg

SEQ ID NO: 7451706 - DNA, 22 bp, Homo sapiens
ccagacagttccttgaggttca

SEQ ID NO: 7451707 - DNA, 22 bp, Homo sapiens
ccagagaaccatctgcttgagg

SEQ ID NO: 7451708 - DNA, 22 bp, Homo sapiens
ccagagaaccatctgcttgagg

SEQ ID NO: 7451709 - DNA, 22 bp, Homo sapiens
ccagagaaccatctgcttgagg

SEQ ID NO: 7451710 - DNA, 22 bp, Homo sapiens
ccagagaaccatctgcttgagg

SEQ ID NO: 7451711 - DNA, 22 bp, Homo sapiens
ccagagaaccatctgcttgagg

SEQ ID NO: 7451712 - DNA, 22 bp, Homo sapiens
ccagagaaccatctgcttgagg

SEQ ID NO: 7451713 - DNA, 22 bp, Homo sapiens
ccagagaaccatctgcttgagg

SEQ ID NO: 7451714 - DNA, 22 bp, Homo sapiens
ccagagaagaaaagcacctttt

SEQ ID NO: 7451715 - DNA, 22 bp, Homo sapiens
ccagagaaggtggagcttgtgt

SEQ ID NO: 7451716 - DNA, 22 bp, Homo sapiens
ccagagaaggtggagcttgtgt

SEQ ID NO: 7451717 - DNA, 22 bp, Homo sapiens
ccagagaaggtggagcttgtgt

SEQ ID NO: 7451718 - DNA, 22 bp, Homo sapiens
ccagagaaggtggagcttgtgt

SEQ ID NO: 7451719 - DNA, 22 bp, Homo sapiens
ccagagaagaaaagcacctttt

SEQ ID NO: 7451720 - DNA, 22 bp, Homo sapiens
ccagagaagaaaagcacctttt

SEQ ID NO: 7451721 - DNA, 22 bp, Homo sapiens
ccagagaagaaaagcacctttt

SEQ ID NO: 7451722 - DNA, 22 bp, Homo sapiens
ccagagaaccttgagctgtgag

SEQ ID NO: 7451723 - DNA, 22 bp, Homo sapiens
ccagagaaccttgagctgtgag

SEQ ID NO: 7451724 - DNA, 22 bp, Homo sapiens
ccagagaaccttgagctgtgag

SEQ ID NO: 7451725 - DNA, 22 bp, Homo sapiens
ccagagaaccttgagctgtgag

SEQ ID NO: 7451726 - DNA, 22 bp, Homo sapiens
ccagagaaccttgagctgtgag

SEQ ID NO: 7451727 - DNA, 22 bp, Homo sapiens
ccagagaaccttgagctgtgag

SEQ ID NO: 7451728 - DNA, 22 bp, Homo sapiens
ccagagaaccttgagctgtgag

SEQ ID NO: 7451729 - DNA, 22 bp, Homo sapiens
ccagacagttccttgaggttca

SEQ ID NO: 7451730 - DNA, 22 bp, Homo sapiens
ccagagaaccttgagctgtgag

SEQ ID NO: 7451731 - DNA, 22 bp, Homo sapiens
ccagacaggggctgttcctgct

SEQ ID NO: 7451732 - DNA, 22 bp, Homo sapiens
tctaatccttgctacctgggtg

SEQ ID NO: 7451733 - DNA, 22 bp, Homo sapiens
ccagacaggggctgttcctgct

SEQ ID NO: 7451734 - DNA, 22 bp, Homo sapiens
ccagacaggggctgttcctgct

SEQ ID NO: 7451735 - DNA, 22 bp, Homo sapiens
tctaatcctatggtggggaggg

SEQ ID NO: 7451736 - DNA, 22 bp, Homo sapiens
tctaatcctatggtggggaggg

SEQ ID NO: 7451737 - DNA, 22 bp, Homo sapiens
tctaatccttgctacctgggtg

SEQ ID NO: 7451738 - DNA, 22 bp, Homo sapiens
tctaatccttgctacctgggtg

SEQ ID NO: 7451739 - DNA, 22 bp, Homo sapiens
tctaagttttaattggcaatgt

SEQ ID NO: 7451740 - DNA, 22 bp, Homo sapiens
tctaagtttggtgattaccaat

SEQ ID NO: 7451741 - DNA, 22 bp, Homo sapiens
tctaataaataaatgctctagg

SEQ ID NO: 7451742 - DNA, 22 bp, Homo sapiens
tctaataaataaatgctctagg

SEQ ID NO: 7451743 - DNA, 22 bp, Homo sapiens
tctaataaataaatgctctagg

SEQ ID NO: 7451744 - DNA, 22 bp, Homo sapiens
tctaataaataaatgctctagg

SEQ ID NO: 7451745 - DNA, 22 bp, Homo sapiens
tctaatcctatggtggggaggg

SEQ ID NO: 7451746 - DNA, 22 bp, Homo sapiens
tctaatcctatggtggggaggg

SEQ ID NO: 7451747 - DNA, 22 bp, Homo sapiens
tctaatcctatggtggggaggg

SEQ ID NO: 7451748 - DNA, 22 bp, Homo sapiens
tctaatcctatggtggggaggg

SEQ ID NO: 7451749 - DNA, 22 bp, Homo sapiens
tctaaggagcgctccagaaaaa

SEQ ID NO: 7451750 - DNA, 22 bp, Homo sapiens
tctaagggaaggtgatatgtta

SEQ ID NO: 7451751 - DNA, 22 bp, Homo sapiens
tctaagtaaaaggggatccagg

SEQ ID NO: 7451752 - DNA, 22 bp, Homo sapiens
tctaagtaaaatttgtcatttc

SEQ ID NO: 7451753 - DNA, 22 bp, Homo sapiens
tctaaggagcgctccagaaaaa

SEQ ID NO: 7451754 - DNA, 22 bp, Homo sapiens
tctaaggccttcatgtcagtat

SEQ ID NO: 7451755 - DNA, 22 bp, Homo sapiens
tctaaggagccaggactattag

SEQ ID NO: 7451756 - DNA, 22 bp, Homo sapiens
tctaaggacattggctttggag

SEQ ID NO: 7451757 - DNA, 22 bp, Homo sapiens
tctaaggacattggctttggag

SEQ ID NO: 7451758 - DNA, 22 bp, Homo sapiens
tctaaggagccaggactattag

SEQ ID NO: 7451759 - DNA, 22 bp, Homo sapiens
tctaagctagtggctcatgtga

SEQ ID NO: 7451760 - DNA, 22 bp, Homo sapiens
tctaagctagtggctcatgtga

SEQ ID NO: 7451761 - DNA, 22 bp, Homo sapiens
tctaaggaaggacaccctggct

SEQ ID NO: 7451762 - DNA, 21 bp, Homo sapiens
tctaagccttgcagatgggtt

SEQ ID NO: 7451763 - DNA, 22 bp, Homo sapiens
tctaaggacaaggtcttggaga

SEQ ID NO: 7451764 - DNA, 22 bp, Homo sapiens
tctaaggacagttattactggg

SEQ ID NO: 7451765 - DNA, 22 bp, Homo sapiens
tctaaggaaggacaccctggct

SEQ ID NO: 7451766 - DNA, 22 bp, Homo sapiens
tctaaggacaaggtcttggaga

SEQ ID NO: 7451767 - DNA, 22 bp, Homo sapiens
tctaaggacaaggtcttggaga

SEQ ID NO: 7451768 - DNA, 22 bp, Homo sapiens
tctaaggacagttattactggg

SEQ ID NO: 7451769 - DNA, 22 bp, Homo sapiens
tctaaggacattggctttggag

SEQ ID NO: 7451770 - DNA, 22 bp, Homo sapiens
ccactgctagagatgcatcccc

SEQ ID NO: 7451771 - DNA, 22 bp, Homo sapiens
ccactgctagagatgcatcccc

SEQ ID NO: 7451772 - DNA, 22 bp, Homo sapiens
ccactgggggctgctcccaggt

SEQ ID NO: 7451773 - DNA, 22 bp, Homo sapiens
ccactgggggctgctcccaggt

SEQ ID NO: 7451774 - DNA, 22 bp, Homo sapiens
ccactgggggctgctcccaggt

SEQ ID NO: 7451775 - DNA, 22 bp, Homo sapiens
ccactgtaagtttgaaaataac

SEQ ID NO: 7451776 - DNA, 22 bp, Homo sapiens
ccactgtaagtttgaaaataac

SEQ ID NO: 7451777 - DNA, 22 bp, Homo sapiens
ccactgtataagcaaaatgaaa

SEQ ID NO: 7451778 - DNA, 22 bp, Homo sapiens
ccactgtataagcaaaatgaaa

SEQ ID NO: 7451779 - DNA, 22 bp, Homo sapiens
ccactgtagttatgatgaagtt

SEQ ID NO: 7451780 - DNA, 22 bp, Homo sapiens
ccactgtctgcaggcctcagca

SEQ ID NO: 7451781 - DNA, 22 bp, Homo sapiens
ccactgtcagaggggctgtgcc

SEQ ID NO: 7451782 - DNA, 22 bp, Homo sapiens
ccactgtattttggaagcagat

SEQ ID NO: 7451783 - DNA, 22 bp, Homo sapiens
ccactgtataagcaaaatgaaa

SEQ ID NO: 7451784 - DNA, 22 bp, Homo sapiens
ccactgtgagcatgaacaggac

SEQ ID NO: 7451785 - DNA, 22 bp, Homo sapiens
ccactgtcttttccaggctgaa

SEQ ID NO: 7451786 - DNA, 22 bp, Homo sapiens
ccactgtcttttccaggctgaa

SEQ ID NO: 7451787 - DNA, 22 bp, Homo sapiens
ccactgtctgtgacatcagaaa

SEQ ID NO: 7451788 - DNA, 22 bp, Homo sapiens
ccactgtcttttccaggctgaa

SEQ ID NO: 7451789 - DNA, 22 bp, Homo sapiens
ccactgtctgtgacatcagaaa

SEQ ID NO: 7451790 - DNA, 22 bp, Homo sapiens
ccactgtctgtgacatcagaaa

SEQ ID NO: 7451791 - DNA, 22 bp, Homo sapiens
tctaagaagggttttaaatatt

SEQ ID NO: 7451792 - DNA, 22 bp, Homo sapiens
tctaagaatactcatatcttct

SEQ ID NO: 7451793 - DNA, 22 bp, Homo sapiens
tctaagaatactcatatcttct

SEQ ID NO: 7451794 - DNA, 22 bp, Homo sapiens
tctaagaagggttttaaatatt

SEQ ID NO: 7451795 - DNA, 22 bp, Homo sapiens
tctaagaagggttttaaatatt

SEQ ID NO: 7451796 - DNA, 22 bp, Homo sapiens
tctaagaagggttttaaatatt

SEQ ID NO: 7451797 - DNA, 22 bp, Homo sapiens
tctaagaagggttttaaatatt

SEQ ID NO: 7451798 - DNA, 22 bp, Homo sapiens
tctaagaaatcagatgatgagg

SEQ ID NO: 7451799 - DNA, 22 bp, Homo sapiens
tctaagaaatcagatgatgagg

SEQ ID NO: 7451800 - DNA, 22 bp, Homo sapiens
ccacttgaaacttagtggcata

SEQ ID NO: 7451801 - DNA, 22 bp, Homo sapiens
ccacttcctgcaggtaaggagc

SEQ ID NO: 7451802 - DNA, 22 bp, Homo sapiens
tctaagcccccgcaccgcagga

SEQ ID NO: 7451803 - DNA, 22 bp, Homo sapiens
tctaagccaggactgagagacg

SEQ ID NO: 7451804 - DNA, 22 bp, Homo sapiens
tctaagatctactatacatgtg

SEQ ID NO: 7451805 - DNA, 22 bp, Homo sapiens
tctaagaggcatcaagacaagc

SEQ ID NO: 7451806 - DNA, 22 bp, Homo sapiens
tctaagaggcatcaagacaagc

SEQ ID NO: 7451807 - DNA, 22 bp, Homo sapiens
tctaagatctactatacatgtg

SEQ ID NO: 7451808 - DNA, 22 bp, Homo sapiens
ccacttcatcccagctcagata

SEQ ID NO: 7451809 - DNA, 22 bp, Homo sapiens
ccacttcatcccagctcagata

SEQ ID NO: 7451810 - DNA, 22 bp, Homo sapiens
ccacttcatcccagctcagata

SEQ ID NO: 7451811 - DNA, 22 bp, Homo sapiens
ccacttcatcccagctcagata

SEQ ID NO: 7451812 - DNA, 22 bp, Homo sapiens
ccacttaagagaacagctatag

SEQ ID NO: 7451813 - DNA, 22 bp, Homo sapiens
ccacttcatcagtgctccattt

SEQ ID NO: 7451814 - DNA, 22 bp, Homo sapiens
ccacttcatcagtgctccattt

SEQ ID NO: 7451815 - DNA, 22 bp, Homo sapiens
ccactgtttttcagttaacttt

SEQ ID NO: 7451816 - DNA, 22 bp, Homo sapiens
ccactgtttcctttctgctggc

SEQ ID NO: 7451817 - DNA, 22 bp, Homo sapiens
ccactgttaccagtcaatcaca

SEQ ID NO: 7451818 - DNA, 22 bp, Homo sapiens
ccactgttggcccgaaggggtc

SEQ ID NO: 7451819 - DNA, 22 bp, Homo sapiens
ccactgtgagcatgaacaggac

SEQ ID NO: 7451820 - DNA, 22 bp, Homo sapiens
ccactgtgcccagcctcatggg

SEQ ID NO: 7451821 - DNA, 22 bp, Homo sapiens
ccactgtggaaagcagttcaga

SEQ ID NO: 7451822 - DNA, 22 bp, Homo sapiens
ccactgtgtccaccaggaatgc

SEQ ID NO: 7451823 - DNA, 22 bp, Homo sapiens
ccactgtgtccaccaggaatgc

SEQ ID NO: 7451824 - DNA, 22 bp, Homo sapiens
ccactgtgtccaccaggaatgc

SEQ ID NO: 7451825 - DNA, 22 bp, Homo sapiens
tcctgggagacccagctgtgga

SEQ ID NO: 7451826 - DNA, 22 bp, Homo sapiens
tcctgggagacccagctgtgga

SEQ ID NO: 7451827 - DNA, 22 bp, Homo sapiens
tcctgggactttcaaggctagg

SEQ ID NO: 7451828 - DNA, 22 bp, Homo sapiens
tcctgggactttcaaggctagg

SEQ ID NO: 7451829 - DNA, 22 bp, Homo sapiens
tcctgggactttcaaggctagg

SEQ ID NO: 7451830 - DNA, 22 bp, Homo sapiens
tcctgggagagtgggactgtat

SEQ ID NO: 7451831 - DNA, 22 bp, Homo sapiens
tcctgggagacccagctgtgga

SEQ ID NO: 7451832 - DNA, 22 bp, Homo sapiens
tcctgggagagtgggactgtat

SEQ ID NO: 7451833 - DNA, 22 bp, Homo sapiens
tcctgggagagtgggactgtat

SEQ ID NO: 7451834 - DNA, 22 bp, Homo sapiens
tcctggctcctgatctgtcact

SEQ ID NO: 7451835 - DNA, 22 bp, Homo sapiens
tcctggctcctgatctgtcact

SEQ ID NO: 7451836 - DNA, 22 bp, Homo sapiens
tcctggctcctgatctgtcact

SEQ ID NO: 7451837 - DNA, 22 bp, Homo sapiens
tcctggctcctgatctgtcact

SEQ ID NO: 7451838 - DNA, 22 bp, Homo sapiens
tcctgggactctttatcagaga

SEQ ID NO: 7451839 - DNA, 22 bp, Homo sapiens
tcctgggactctttatcagaga

SEQ ID NO: 7451840 - DNA, 22 bp, Homo sapiens
tcctggctccagcagctcttcc

SEQ ID NO: 7451841 - DNA, 22 bp, Homo sapiens
tcctggctccagcagctcttcc

SEQ ID NO: 7451842 - DNA, 22 bp, Homo sapiens
tcctggctccagcagctcttcc

SEQ ID NO: 7451843 - DNA, 22 bp, Homo sapiens
tcctggctccagcagctcttcc

SEQ ID NO: 7451844 - DNA, 22 bp, Homo sapiens
ccacagaagatggggagagtgg

SEQ ID NO: 7451845 - DNA, 22 bp, Homo sapiens
ccacagaagatggggagagtgg

SEQ ID NO: 7451846 - DNA, 22 bp, Homo sapiens
ccacagaagatggggagagtgg

SEQ ID NO: 7451847 - DNA, 22 bp, Homo sapiens
ccacagaacctcagctttgagc

SEQ ID NO: 7451848 - DNA, 22 bp, Homo sapiens
ccacagaaagttgtctagagta

SEQ ID NO: 7451849 - DNA, 22 bp, Homo sapiens
ccacagaaagttgtctagagta

SEQ ID NO: 7451850 - DNA, 22 bp, Homo sapiens
ccacagaacctcagctttgagc

SEQ ID NO: 7451851 - DNA, 22 bp, Homo sapiens
ccacagaaagttgtctagagta

SEQ ID NO: 7451852 - DNA, 22 bp, Homo sapiens
ccacagaaagttgtctagagta

SEQ ID NO: 7451853 - DNA, 22 bp, Homo sapiens
ccacagaaagttgtctagagta

SEQ ID NO: 7451854 - DNA, 22 bp, Homo sapiens
tcctgggcttagtggctaggtc

SEQ ID NO: 7451855 - DNA, 22 bp, Homo sapiens
tcctgggcttagtggctaggtc

SEQ ID NO: 7451856 - DNA, 22 bp, Homo sapiens
tcctgggcttaagtgatcctcc

SEQ ID NO: 7451857 - DNA, 22 bp, Homo sapiens
tcctgggcttaagtgatcctcc

SEQ ID NO: 7451858 - DNA, 22 bp, Homo sapiens
tcctgggaggaacatttaccta

SEQ ID NO: 7451859 - DNA, 22 bp, Homo sapiens
tcctgggaggaacatttaccta

SEQ ID NO: 7451860 - DNA, 22 bp, Homo sapiens
tcctgggctgtgtgccactctg

SEQ ID NO: 7451861 - DNA, 22 bp, Homo sapiens
tcctgggagcccttgctccacc

SEQ ID NO: 7451862 - DNA, 22 bp, Homo sapiens
tcctgggagcccttgctccacc

SEQ ID NO: 7451863 - DNA, 22 bp, Homo sapiens
tcctgggagcccttgctccacc

SEQ ID NO: 7451864 - DNA, 22 bp, Homo sapiens
tcctgggagcccttgctccacc

SEQ ID NO: 7451865 - DNA, 22 bp, Homo sapiens
tcctgggagcccttgctccacc

SEQ ID NO: 7451866 - DNA, 22 bp, Homo sapiens
tcctgggagcatgaagagggat

SEQ ID NO: 7451867 - DNA, 22 bp, Homo sapiens
tcctgggagcatgaagagggat

SEQ ID NO: 7451868 - DNA, 22 bp, Homo sapiens
tcctgggagcacatggtcctgc

SEQ ID NO: 7451869 - DNA, 22 bp, Homo sapiens
tcctgggagcacatggtcctgc

SEQ ID NO: 7451870 - DNA, 22 bp, Homo sapiens
tcctgggagcacatggtcctgc

SEQ ID NO: 7451871 - DNA, 22 bp, Homo sapiens
tcctgggagcacatggtcctgc

SEQ ID NO: 7451872 - DNA, 22 bp, Homo sapiens
tcctgggagcacatggtcctgc

SEQ ID NO: 7451873 - DNA, 22 bp, Homo sapiens
tcctgggagagtttgattcatt

SEQ ID NO: 7451874 - DNA, 22 bp, Homo sapiens
tcctgggagcatggtgccgtga

SEQ ID NO: 7451875 - DNA, 22 bp, Homo sapiens
tcctgggagcatgaagagggat

SEQ ID NO: 7451876 - DNA, 22 bp, Homo sapiens
tcctgggagcccttgctccacc

SEQ ID NO: 7451877 - DNA, 22 bp, Homo sapiens
tcctgggagcccttgctccacc

SEQ ID NO: 7451878 - DNA, 22 bp, Homo sapiens
tcctgggagcatggtgccgtga

SEQ ID NO: 7451879 - DNA, 22 bp, Homo sapiens
tcctgggagcatggtgccgtga

SEQ ID NO: 7451880 - DNA, 22 bp, Homo sapiens
ccacactccccgcaggcgtagg

SEQ ID NO: 7451881 - DNA, 22 bp, Homo sapiens
ccacactccccgcaggcgtagg

SEQ ID NO: 7451882 - DNA, 22 bp, Homo sapiens
ccacactccccgcaggcgtagg

SEQ ID NO: 7451883 - DNA, 22 bp, Homo sapiens
ccacactgaacctcagtgtctt

SEQ ID NO: 7451884 - DNA, 22 bp, Homo sapiens
ccacactgaacctcagtgtctt

SEQ ID NO: 7451885 - DNA, 22 bp, Homo sapiens
ccacactaaactgctcaaacca

SEQ ID NO: 7451886 - DNA, 17 bp, Homo sapiens
ccacaccctttccttcc

SEQ ID NO: 7451887 - DNA, 19 bp, Homo sapiens
ccacacagtgtgcaattta

SEQ ID NO: 7451888 - DNA, 19 bp, Homo sapiens
ccacacagtgtgcaattta

SEQ ID NO: 7451889 - DNA, 19 bp, Homo sapiens
ccacacagtgtgcaattta

SEQ ID NO: 7451890 - DNA, 22 bp, Homo sapiens
ccacacagtcagtttccaagaa

SEQ ID NO: 7451891 - DNA, 22 bp, Homo sapiens
ccacacagtcagtttccaagaa

SEQ ID NO: 7451892 - DNA, 18 bp, Homo sapiens
tcctggcagtcagagagg

SEQ ID NO: 7451893 - DNA, 22 bp, Homo sapiens
ccacactgaccagctgtgagac

SEQ ID NO: 7451894 - DNA, 22 bp, Homo sapiens
ccacactggcatgggatggagg

SEQ ID NO: 7451895 - DNA, 22 bp, Homo sapiens
ccacactgaccagctgtgagac

SEQ ID NO: 7451896 - DNA, 22 bp, Homo sapiens
ccacagaaaataaagcacgatt

SEQ ID NO: 7451897 - DNA, 22 bp, Homo sapiens
ccacagaaaataaagcacgatt

SEQ ID NO: 7451898 - DNA, 22 bp, Homo sapiens
ccacactgtctaacaaggcata

SEQ ID NO: 7451899 - DNA, 22 bp, Homo sapiens
ccacagaaaataaagcacgatt

SEQ ID NO: 7451900 - DNA, 22 bp, Homo sapiens
ccacagaaaataaagcacgatt

SEQ ID NO: 7451901 - DNA, 22 bp, Homo sapiens
ccacagaaaataaagcacgatt

SEQ ID NO: 7451902 - DNA, 22 bp, Homo sapiens
ccacagaaaataaagcacgatt

SEQ ID NO: 7451903 - DNA, 22 bp, Homo sapiens
ccacagaaagcctgggaagtgg

SEQ ID NO: 7451904 - DNA, 22 bp, Homo sapiens
ccacagaaagcctgggaagtgg

SEQ ID NO: 7451905 - DNA, 22 bp, Homo sapiens
tcctggcaggtctgagaggtct

SEQ ID NO: 7451906 - DNA, 22 bp, Homo sapiens
tcctggcaggtcagcaggagca

SEQ ID NO: 7451907 - DNA, 22 bp, Homo sapiens
tcctggcaggtcagcaggagca

SEQ ID NO: 7451908 - DNA, 22 bp, Homo sapiens
tcctggcagggtggcagcgggt

SEQ ID NO: 7451909 - DNA, 22 bp, Homo sapiens
tcctggcaggtcagcaggagca

SEQ ID NO: 7451910 - DNA, 22 bp, Homo sapiens
tcctggcaggtcagcaggagca

SEQ ID NO: 7451911 - DNA, 22 bp, Homo sapiens
tcctggcaggtcagcaggagca

SEQ ID NO: 7451912 - DNA, 18 bp, Homo sapiens
tcctggcagtcagagagg

SEQ ID NO: 7451913 - DNA, 22 bp, Homo sapiens
tcctggcagtcaaataaccttg

SEQ ID NO: 7451914 - DNA, 22 bp, Homo sapiens
tcctggcaggtgtattggctgt

SEQ ID NO: 7451915 - DNA, 22 bp, Homo sapiens
tcctggcaggtcagcaggagca

SEQ ID NO: 7451916 - DNA, 22 bp, Homo sapiens
tcctggcaggtctgagaggtct

SEQ ID NO: 7451917 - DNA, 22 bp, Homo sapiens
tcctggcaggtgtattggctgt

SEQ ID NO: 7451918 - DNA, 22 bp, Homo sapiens
tcctggcaggtctgagaggtct

SEQ ID NO: 7451919 - DNA, 22 bp, Homo sapiens
tcctggcaggtctgagaggtct

SEQ ID NO: 7451920 - DNA, 22 bp, Homo sapiens
tcctggcagggtggcagcgggt

SEQ ID NO: 7451921 - DNA, 22 bp, Homo sapiens
tcctggcagggtggcagcgggt

SEQ ID NO: 7451922 - DNA, 22 bp, Homo sapiens
tcctggcagggtggcagcgggt

SEQ ID NO: 7451923 - DNA, 22 bp, Homo sapiens
tcctggcagggtggcagcgggt

SEQ ID NO: 7451924 - DNA, 22 bp, Homo sapiens
tcctggcagggtggcagcgggt

SEQ ID NO: 7451925 - DNA, 22 bp, Homo sapiens
tcctggcagggtctaggtctag

SEQ ID NO: 7451926 - DNA, 22 bp, Homo sapiens
tcctggcagggtctaggtctag

SEQ ID NO: 7451927 - DNA, 22 bp, Homo sapiens
tcctggcagggtctaggtctag

SEQ ID NO: 7451928 - DNA, 22 bp, Homo sapiens
tcctggcagggtctaggtctag

SEQ ID NO: 7451929 - DNA, 22 bp, Homo sapiens
tcctggcagggaacttgtcagc

SEQ ID NO: 7451930 - DNA, 22 bp, Homo sapiens
tcctggcagggaacttgtcagc

SEQ ID NO: 7451931 - DNA, 22 bp, Homo sapiens
tcctggcagcccgcaggtgctg

SEQ ID NO: 7451932 - DNA, 22 bp, Homo sapiens
tcctggcagcccgcaggtgctg

SEQ ID NO: 7451933 - DNA, 22 bp, Homo sapiens
tcctggcagcccgcaggtgctg

SEQ ID NO: 7451934 - DNA, 21 bp, Homo sapiens
tcctggcaggcccaggaccct

SEQ ID NO: 7451935 - DNA, 21 bp, Homo sapiens
tcctggcaggcccaggaccct

SEQ ID NO: 7451936 - DNA, 21 bp, Homo sapiens
tcctggcaggcccaggaccct

SEQ ID NO: 7451937 - DNA, 21 bp, Homo sapiens
tcctggcaggcccaggaccct

SEQ ID NO: 7451938 - DNA, 21 bp, Homo sapiens
tcctggcaggcccaggaccct

SEQ ID NO: 7451939 - DNA, 22 bp, Homo sapiens
tcctacagaaccaggctaggtg

SEQ ID NO: 7451940 - DNA, 22 bp, Homo sapiens
tcctacagaaccaggctaggtg

SEQ ID NO: 7451941 - DNA, 22 bp, Homo sapiens
tcctacacagataacagagacg

SEQ ID NO: 7451942 - DNA, 22 bp, Homo sapiens
tcctaattgcttcatgtgttgt

SEQ ID NO: 7451943 - DNA, 22 bp, Homo sapiens
tcctacaatgcacagaatagcc

SEQ ID NO: 7451944 - DNA, 20 bp, Homo sapiens
tcctaataacctgaagaaat

SEQ ID NO: 7451945 - DNA, 18 bp, Homo sapiens
tcctaacttagatactcc

SEQ ID NO: 7451946 - DNA, 22 bp, Homo sapiens
tcctacagatactaaggagatc

SEQ ID NO: 7451947 - DNA, 22 bp, Homo sapiens
tcctacatcagctctcagtagc

SEQ ID NO: 7451948 - DNA, 20 bp, Homo sapiens
tcctactcttttaatatgtg

SEQ ID NO: 7451949 - DNA, 22 bp, Homo sapiens
tcctagaaagatgtcttttcac

SEQ ID NO: 7451950 - DNA, 22 bp, Homo sapiens
tcctagaacagcccacctggaa

SEQ ID NO: 7451951 - DNA, 22 bp, Homo sapiens
tcctagaactccaggacagtcc

SEQ ID NO: 7451952 - DNA, 22 bp, Homo sapiens
tcctagaactccaggacagtcc

SEQ ID NO: 7451953 - DNA, 22 bp, Homo sapiens
ccaaggagctcatattcttgtt

SEQ ID NO: 7451954 - DNA, 22 bp, Homo sapiens
ccaaggagctgcaggcacttgt

SEQ ID NO: 7451955 - DNA, 22 bp, Homo sapiens
ccaaggagcaaggctcaacaag

SEQ ID NO: 7451956 - DNA, 22 bp, Homo sapiens
ccaaggagcaagtttacacctg

SEQ ID NO: 7451957 - DNA, 22 bp, Homo sapiens
ccaaggagaatgacaccatgga

SEQ ID NO: 7451958 - DNA, 22 bp, Homo sapiens
ccaagaggttgtgaggcaggca

SEQ ID NO: 7451959 - DNA, 22 bp, Homo sapiens
ccaagaggttgaggctgcagtg

SEQ ID NO: 7451960 - DNA, 22 bp, Homo sapiens
tcctagaactccaggacagtcc

SEQ ID NO: 7451961 - DNA, 22 bp, Homo sapiens
ccaagaggttgaggctgcagtg

SEQ ID NO: 7451962 - DNA, 22 bp, Homo sapiens
ccaaggagaatgacaccatgga

SEQ ID NO: 7451963 - DNA, 22 bp, Homo sapiens
ccaaggagaatgacaccatgga

SEQ ID NO: 7451964 - DNA, 22 bp, Homo sapiens
ccaagagtaaattcatgatgcc

SEQ ID NO: 7451965 - DNA, 22 bp, Homo sapiens
ccaagaggttgtgaggcaggca

SEQ ID NO: 7451966 - DNA, 22 bp, Homo sapiens
ccaagaggttgtgaggcaggca

SEQ ID NO: 7451967 - DNA, 22 bp, Homo sapiens
ccaagaggttgtgaggcaggca

SEQ ID NO: 7451968 - DNA, 22 bp, Homo sapiens
ccaaggaggccccaggtcagct

SEQ ID NO: 7451969 - DNA, 22 bp, Homo sapiens
ccaaggaggccccaggtcagct

SEQ ID NO: 7451970 - DNA, 22 bp, Homo sapiens
ccaaggaggccccaggtcagct

SEQ ID NO: 7451971 - DNA, 22 bp, Homo sapiens
ccaaggaggccccaggtcagct

SEQ ID NO: 7451972 - DNA, 22 bp, Homo sapiens
ccaaggaggccccaggtcagct

SEQ ID NO: 7451973 - DNA, 22 bp, Homo sapiens
ccaaggagtagagcaggaagct

SEQ ID NO: 7451974 - DNA, 22 bp, Homo sapiens
ccaaggagtagagcaggaagct

SEQ ID NO: 7451975 - DNA, 22 bp, Homo sapiens
ccaaggagtagagcaggaagct

SEQ ID NO: 7451976 - DNA, 22 bp, Homo sapiens
ccaaggagtagagcaggaagct

SEQ ID NO: 7451977 - DNA, 22 bp, Homo sapiens
ccaaggatccagcccttcactc

SEQ ID NO: 7451978 - DNA, 22 bp, Homo sapiens
ccaaggagtagagcaggaagct

SEQ ID NO: 7451979 - DNA, 20 bp, Homo sapiens
ccaaggattggcaagcagca

SEQ ID NO: 7451980 - DNA, 22 bp, Homo sapiens
ccaaggatctggttctttttac

SEQ ID NO: 7451981 - DNA, 22 bp, Homo sapiens
ccaaggatgacagtacagtcac

SEQ ID NO: 7451982 - DNA, 22 bp, Homo sapiens
ccaaggcaacgttggtgtcagg

SEQ ID NO: 7451983 - DNA, 22 bp, Homo sapiens
ccaaggatgaggctcaaggagg

SEQ ID NO: 7451984 - DNA, 22 bp, Homo sapiens
ccaaggatgaggctcaaggagg

SEQ ID NO: 7451985 - DNA, 22 bp, Homo sapiens
ccaaggcaacgttggtgtcagg

SEQ ID NO: 7451986 - DNA, 22 bp, Homo sapiens
ccaaggcaacgttggtgtcagg

SEQ ID NO: 7451987 - DNA, 18 bp, Homo sapiens
ccaaggatgctgccggcc

SEQ ID NO: 7451988 - DNA, 22 bp, Homo sapiens
ccaaggcaacgttggtgtcagg

SEQ ID NO: 7451989 - DNA, 22 bp, Homo sapiens
ccaaggcaatgtgcagctggtg

SEQ ID NO: 7451990 - DNA, 22 bp, Homo sapiens
ccaaggcaacgttggtgtcagg

SEQ ID NO: 7451991 - DNA, 22 bp, Homo sapiens
ccaaggcaacgttggtgtcagg

SEQ ID NO: 7451992 - DNA, 22 bp, Homo sapiens
ccaaggcaatgtgcagctggtg

SEQ ID NO: 7451993 - DNA, 22 bp, Homo sapiens
ccaaggcaatgtgcagctggtg

SEQ ID NO: 7451994 - DNA, 22 bp, Homo sapiens
ccaaggcacactctgcaaggtt

SEQ ID NO: 7451995 - DNA, 22 bp, Homo sapiens
ccaaggcacactctgcaaggtt

SEQ ID NO: 7451996 - DNA, 22 bp, Homo sapiens
ccaaggcacactctgcaaggtt

SEQ ID NO: 7451997 - DNA, 22 bp, Homo sapiens
ccaaggcacactctgcaaggtt

SEQ ID NO: 7451998 - DNA, 22 bp, Homo sapiens
ccaaggcacactctgcaaggtt

SEQ ID NO: 7451999 - DNA, 22 bp, Homo sapiens
ccaaggcagaagatggctcttg

SEQ ID NO: 7452000 - DNA, 22 bp, Homo sapiens
ccaaggcagaagatggctcttg

SEQ ID NO: 7452001 - DNA, 22 bp, Homo sapiens
ccaaggcagaagatggctcttg

SEQ ID NO: 7452002 - DNA, 22 bp, Homo sapiens
ccaaggcagaagatggctcttg

SEQ ID NO: 7452003 - DNA, 22 bp, Homo sapiens
ccaaggcagaagatggctcttg

SEQ ID NO: 7452004 - DNA, 22 bp, Homo sapiens
ccaaggcatatggctgaaacca

SEQ ID NO: 7452005 - DNA, 22 bp, Homo sapiens
ccaaggcatatggctgaaacca

SEQ ID NO: 7452006 - DNA, 22 bp, Homo sapiens
ccaaggcaggggatcaaagttt

SEQ ID NO: 7452007 - DNA, 22 bp, Homo sapiens
ccaaggcaatgtgcagctggtg

SEQ ID NO: 7452008 - DNA, 22 bp, Homo sapiens
ccaaggcatatggctgaaacca

SEQ ID NO: 7452009 - DNA, 22 bp, Homo sapiens
ccaaggcaggggatcaaagttt

SEQ ID NO: 7452010 - DNA, 22 bp, Homo sapiens
ccaaggcaggggatcaaagttt

SEQ ID NO: 7452011 - DNA, 22 bp, Homo sapiens
ccaaggccacaaacagcctggc

SEQ ID NO: 7452012 - DNA, 22 bp, Homo sapiens
ccaaggccacaaacagcctggc

SEQ ID NO: 7452013 - DNA, 22 bp, Homo sapiens
ccaaggccacaaacagcctggc

SEQ ID NO: 7452014 - DNA, 22 bp, Homo sapiens
ccaaggccatcaggtaggtcct

SEQ ID NO: 7452015 - DNA, 22 bp, Homo sapiens
ccaaggccacaaacagcctggc

SEQ ID NO: 7452016 - DNA, 22 bp, Homo sapiens
ccaaggccacaaacagcctggc

SEQ ID NO: 7452017 - DNA, 22 bp, Homo sapiens
ccaaggcttcctgacctacatg

SEQ ID NO: 7452018 - DNA, 22 bp, Homo sapiens
ccaaggcttcccagagatgctc

SEQ ID NO: 7452019 - DNA, 22 bp, Homo sapiens
ccaaggcttcctgacctacatg

SEQ ID NO: 7452020 - DNA, 22 bp, Homo sapiens
ccaagggaaaccgagaggctgg

SEQ ID NO: 7452021 - DNA, 22 bp, Homo sapiens
ccaaggcttcctgacctacatg

SEQ ID NO: 7452022 - DNA, 22 bp, Homo sapiens
ccaaggcttcctgacctacatg

SEQ ID NO: 7452023 - DNA, 22 bp, Homo sapiens
ccaagggaaaccgagaggctgg

SEQ ID NO: 7452024 - DNA, 22 bp, Homo sapiens
ccaagggaaaccgagaggctgg

SEQ ID NO: 7452025 - DNA, 22 bp, Homo sapiens
ccaagggaaaccgagaggctgg

SEQ ID NO: 7452026 - DNA, 22 bp, Homo sapiens
ccaagggaaggatgtatatgat

SEQ ID NO: 7452027 - DNA, 22 bp, Homo sapiens
tcctggaggacagaggcatctc

SEQ ID NO: 7452028 - DNA, 22 bp, Homo sapiens
ccaaggcttcccagagatgctc

SEQ ID NO: 7452029 - DNA, 22 bp, Homo sapiens
ccaaggcttcccagagatgctc

SEQ ID NO: 7452030 - DNA, 22 bp, Homo sapiens
ccaaggcttcccagagatgctc

SEQ ID NO: 7452031 - DNA, 22 bp, Homo sapiens
ccaaggcttcccagagatgctc

SEQ ID NO: 7452032 - DNA, 22 bp, Homo sapiens
tcctggcagagagcatgaggcc

SEQ ID NO: 7452033 - DNA, 22 bp, Homo sapiens
tcctggcagagagcatgaggcc

SEQ ID NO: 7452034 - DNA, 22 bp, Homo sapiens
tcctggcagagagcatgaggcc

SEQ ID NO: 7452035 - DNA, 22 bp, Homo sapiens
tcctggcagaaatggggctgtg

SEQ ID NO: 7452036 - DNA, 22 bp, Homo sapiens
tcctggcagcccgcaggtgctg

SEQ ID NO: 7452037 - DNA, 22 bp, Homo sapiens
tcctggcagcccgcaggtgctg

SEQ ID NO: 7452038 - DNA, 22 bp, Homo sapiens
tcctggcagagggcggcctcga

SEQ ID NO: 7452039 - DNA, 22 bp, Homo sapiens
tcctggcagagggcggcctcga

SEQ ID NO: 7452040 - DNA, 22 bp, Homo sapiens
tcctggcactttgggggctcgc

SEQ ID NO: 7452041 - DNA, 22 bp, Homo sapiens
tcctggcactttgggggctcgc

SEQ ID NO: 7452042 - DNA, 22 bp, Homo sapiens
tcctggcactttgggggctcgc

SEQ ID NO: 7452043 - DNA, 22 bp, Homo sapiens
tcctggaggagatccaatctga

SEQ ID NO: 7452044 - DNA, 22 bp, Homo sapiens
tcctggaggacagaggcatctc

SEQ ID NO: 7452045 - DNA, 22 bp, Homo sapiens
tcctggaggagatccaatctga

SEQ ID NO: 7452046 - DNA, 22 bp, Homo sapiens
tcctggaggacagaggcatctc

SEQ ID NO: 7452047 - DNA, 22 bp, Homo sapiens
tcctggaggacagaggcatctc

SEQ ID NO: 7452048 - DNA, 22 bp, Homo sapiens
ccaaggccatcaggtaggtcct

SEQ ID NO: 7452049 - DNA, 18 bp, Homo sapiens
ccaaggcccctgctgggg

SEQ ID NO: 7452050 - DNA, 22 bp, Homo sapiens
ccaaggccatcaggtaggtcct

SEQ ID NO: 7452051 - DNA, 18 bp, Homo sapiens
ccaaggcccctgctgggg

SEQ ID NO: 7452052 - DNA, 18 bp, Homo sapiens
ccaaggcccctgctgggg

SEQ ID NO: 7452053 - DNA, 22 bp, Homo sapiens
ccaaggcccctgtggtctagcc

SEQ ID NO: 7452054 - DNA, 18 bp, Homo sapiens
ccaaggcccctgctgggg

SEQ ID NO: 7452055 - DNA, 22 bp, Homo sapiens
ccaaggcccctgtggtctagcc

SEQ ID NO: 7452056 - DNA, 22 bp, Homo sapiens
ccaaggcccctgtggtctagcc

SEQ ID NO: 7452057 - DNA, 22 bp, Homo sapiens
ccaaggcccctgtggtctagcc

SEQ ID NO: 7452058 - DNA, 17 bp, Homo sapiens
ccaaggctatttgtagt

SEQ ID NO: 7452059 - DNA, 17 bp, Homo sapiens
ccaaggctatttgtagt

SEQ ID NO: 7452060 - DNA, 22 bp, Homo sapiens
ccaaggctcctcagctggtctt

SEQ ID NO: 7452061 - DNA, 22 bp, Homo sapiens
ccaaggctcctcagctggtctt

SEQ ID NO: 7452062 - DNA, 22 bp, Homo sapiens
ccaaggcccctgtggtctagcc

SEQ ID NO: 7452063 - DNA, 22 bp, Homo sapiens
ccaaggcccctgtggtctagcc

SEQ ID NO: 7452064 - DNA, 22 bp, Homo sapiens
ccaaggccttgaaggcgcgggg

SEQ ID NO: 7452065 - DNA, 22 bp, Homo sapiens
ccaaggccttgaaggcgcgggg

SEQ ID NO: 7452066 - DNA, 22 bp, Homo sapiens
ccaaggccttgaaggcgcgggg

SEQ ID NO: 7452067 - DNA, 22 bp, Homo sapiens
ccaaggctgtggggctgtgcag

SEQ ID NO: 7452068 - DNA, 22 bp, Homo sapiens
ccaaggctgtggggctgtgcag

SEQ ID NO: 7452069 - DNA, 22 bp, Homo sapiens
ccaaggctgtggggctgtgcag

SEQ ID NO: 7452070 - DNA, 22 bp, Homo sapiens
ccaaggctgtggggctgtgcag

SEQ ID NO: 7452071 - DNA, 22 bp, Homo sapiens
ccaaggctgtggggctgtgcag

SEQ ID NO: 7452072 - DNA, 22 bp, Homo sapiens
ccaaggctgtggggctgtgcag

SEQ ID NO: 7452073 - DNA, 22 bp, Homo sapiens
ccaaggctggagtgcagtggcg

SEQ ID NO: 7452074 - DNA, 22 bp, Homo sapiens
ccaaggctggagtgcagtggcg

SEQ ID NO: 7452075 - DNA, 22 bp, Homo sapiens
ccaaggctgtcattcagtagct

SEQ ID NO: 7452076 - DNA, 22 bp, Homo sapiens
ccaaggctgtcattcagtagct

SEQ ID NO: 7452077 - DNA, 22 bp, Homo sapiens
ccaaggctggagtgcagtggcg

SEQ ID NO: 7452078 - DNA, 22 bp, Homo sapiens
ccaaggctggagggcttatgta

SEQ ID NO: 7452079 - DNA, 22 bp, Homo sapiens
ccaaggctggagtgcagtggcg

SEQ ID NO: 7452080 - DNA, 22 bp, Homo sapiens
ccaaggctggagtgcagtggcg

SEQ ID NO: 7452081 - DNA, 22 bp, Homo sapiens
ccaaggctggagtgcagtggcg

SEQ ID NO: 7452082 - DNA, 22 bp, Homo sapiens
ccaaggctggagggcttatgta

SEQ ID NO: 7452083 - DNA, 22 bp, Homo sapiens
ccaaggctggagggcttatgta

SEQ ID NO: 7452084 - DNA, 22 bp, Homo sapiens
ccaaggctgaggtttccagttg

SEQ ID NO: 7452085 - DNA, 22 bp, Homo sapiens
ccaaggctgaggtttccagttg

SEQ ID NO: 7452086 - DNA, 22 bp, Homo sapiens
ccaaggctcctcagctggtctt

SEQ ID NO: 7452087 - DNA, 22 bp, Homo sapiens
cataaaagccacctatttaaag

SEQ ID NO: 7452088 - DNA, 22 bp, Homo sapiens
cataaaagccacctatttaaag

SEQ ID NO: 7452089 - DNA, 22 bp, Homo sapiens
cataaaagccacctatttaaag

SEQ ID NO: 7452090 - DNA, 22 bp, Homo sapiens
cataaaagccacctatttaaag

SEQ ID NO: 7452091 - DNA, 22 bp, Homo sapiens
cataaaagccacctatttaaag

SEQ ID NO: 7452092 - DNA, 22 bp, Homo sapiens
cataaaagccacctatttaaag

SEQ ID NO: 7452093 - DNA, 22 bp, Homo sapiens
cataaaaggtagcagtttgaaa

SEQ ID NO: 7452094 - DNA, 22 bp, Homo sapiens
cataaaaggtagcagtttgaaa

SEQ ID NO: 7452095 - DNA, 22 bp, Homo sapiens
cataaaaggtagcagtttgaaa

SEQ ID NO: 7452096 - DNA, 22 bp, Homo sapiens
cataaaaggtagcagtttgaaa

SEQ ID NO: 7452097 - DNA, 22 bp, Homo sapiens
cataaaaggtagcagtttgaaa

SEQ ID NO: 7452098 - DNA, 23 bp, Homo sapiens
cataaaatattagtatggtagca

SEQ ID NO: 7452099 - DNA, 23 bp, Homo sapiens
cataaaatattagtatggtagca

SEQ ID NO: 7452100 - DNA, 23 bp, Homo sapiens
cataaaatattagtatggtagca

SEQ ID NO: 7452101 - DNA, 23 bp, Homo sapiens
cataaaatattagtatggtagca

SEQ ID NO: 7452102 - DNA, 23 bp, Homo sapiens
cataaaatattagtatggtagca

SEQ ID NO: 7452103 - DNA, 23 bp, Homo sapiens
cataaaatattagtatggtagca

SEQ ID NO: 7452104 - DNA, 22 bp, Homo sapiens
cataaaatggcttgttctttaa

SEQ ID NO: 7452105 - DNA, 23 bp, Homo sapiens
cataaaatattagtatggtagca

SEQ ID NO: 7452106 - DNA, 23 bp, Homo sapiens
cataaaatattagtatggtagca

SEQ ID NO: 7452107 - DNA, 23 bp, Homo sapiens
cataaaatattagtatggtagca

SEQ ID NO: 7452108 - DNA, 23 bp, Homo sapiens
cataaaatattagtatggtagca

SEQ ID NO: 7452109 - DNA, 22 bp, Homo sapiens
cagtttttagattagttggtgg

SEQ ID NO: 7452110 - DNA, 18 bp, Homo sapiens
cagtttttatatctggca

SEQ ID NO: 7452111 - DNA, 22 bp, Homo sapiens
cagtttttcaaaattacatgat

SEQ ID NO: 7452112 - DNA, 22 bp, Homo sapiens
cagtttttcaaaattacatgat

SEQ ID NO: 7452113 - DNA, 18 bp, Homo sapiens
cagtttttatatctggca

SEQ ID NO: 7452114 - DNA, 22 bp, Homo sapiens
cagtttttcaaaattacatgat

SEQ ID NO: 7452115 - DNA, 22 bp, Homo sapiens
cagtttttcaaaattacatgat

SEQ ID NO: 7452116 - DNA, 22 bp, Homo sapiens
cagtttttcaaaattacatgat

SEQ ID NO: 7452117 - DNA, 22 bp, Homo sapiens
cagtttttcaaaattacatgat

SEQ ID NO: 7452118 - DNA, 22 bp, Homo sapiens
cagtttttcaaaattacatgat

SEQ ID NO: 7452119 - DNA, 22 bp, Homo sapiens
cagtttttgccattaagagtaa

SEQ ID NO: 7452120 - DNA, 22 bp, Homo sapiens
cagtttttgccattaagagtaa

SEQ ID NO: 7452121 - DNA, 22 bp, Homo sapiens
cagtttttcaaaattacatgat

SEQ ID NO: 7452122 - DNA, 22 bp, Homo sapiens
cagtttttcaaaattacatgat

SEQ ID NO: 7452123 - DNA, 22 bp, Homo sapiens
cagtttttgccattaagagtaa

SEQ ID NO: 7452124 - DNA, 17 bp, Homo sapiens
cataaaacagttctatt

SEQ ID NO: 7452125 - DNA, 22 bp, Homo sapiens
cagtttttgccattaagagtaa

SEQ ID NO: 7452126 - DNA, 22 bp, Homo sapiens
cagtttttgccattaagagtaa

SEQ ID NO: 7452127 - DNA, 22 bp, Homo sapiens
cagtttttgccattaagagtaa

SEQ ID NO: 7452128 - DNA, 22 bp, Homo sapiens
cataaaagccacctatttaaag

SEQ ID NO: 7452129 - DNA, 22 bp, Homo sapiens
cataaaagccacctatttaaag

SEQ ID NO: 7452130 - DNA, 17 bp, Homo sapiens
cataaaacagttctatt

SEQ ID NO: 7452131 - DNA, 17 bp, Homo sapiens
cataaaacagttctatt

SEQ ID NO: 7452132 - DNA, 17 bp, Homo sapiens
cataaaacagttctatt

SEQ ID NO: 7452133 - DNA, 17 bp, Homo sapiens
cataaaacagttctatt

SEQ ID NO: 7452134 - DNA, 17 bp, Homo sapiens
cataaaacagttctatt

SEQ ID NO: 7452135 - DNA, 22 bp, Homo sapiens
cagtttttagattagttggtgg

SEQ ID NO: 7452136 - DNA, 22 bp, Homo sapiens
cagtttttagattagttggtgg

SEQ ID NO: 7452137 - DNA, 22 bp, Homo sapiens
cagttttcttgttatatttggg

SEQ ID NO: 7452138 - DNA, 22 bp, Homo sapiens
cagttttctatggtagaagcat

SEQ ID NO: 7452139 - DNA, 22 bp, Homo sapiens
cagttttcttgttatatttggg

SEQ ID NO: 7452140 - DNA, 22 bp, Homo sapiens
cagttttcttgttatatttggg

SEQ ID NO: 7452141 - DNA, 22 bp, Homo sapiens
cagttttggtcctttctaggta

SEQ ID NO: 7452142 - DNA, 22 bp, Homo sapiens
cagttttggtcctttctaggta

SEQ ID NO: 7452143 - DNA, 22 bp, Homo sapiens
cagtttgtgctaggcactattt

SEQ ID NO: 7452144 - DNA, 22 bp, Homo sapiens
cagtttgtgctaggcactattt

SEQ ID NO: 7452145 - DNA, 22 bp, Homo sapiens
cagttttaaattgttagataat

SEQ ID NO: 7452146 - DNA, 22 bp, Homo sapiens
cagttttccatgactcagagag

SEQ ID NO: 7452147 - DNA, 22 bp, Homo sapiens
cagttttccatgactcagagag

SEQ ID NO: 7452148 - DNA, 22 bp, Homo sapiens
cagttttctatggtagaagcat

SEQ ID NO: 7452149 - DNA, 22 bp, Homo sapiens
cagttttctaaagtctctttaa

SEQ ID NO: 7452150 - DNA, 22 bp, Homo sapiens
cagttttctatggtagaagcat

SEQ ID NO: 7452151 - DNA, 22 bp, Homo sapiens
tcagatccgagtgtgccaagga

SEQ ID NO: 7452152 - DNA, 22 bp, Homo sapiens
tcagatctaattggattattat

SEQ ID NO: 7452153 - DNA, 22 bp, Homo sapiens
tcagatctggtgaagttatagt

SEQ ID NO: 7452154 - DNA, 22 bp, Homo sapiens
tcagatccgagtgtgccaagga

SEQ ID NO: 7452155 - DNA, 22 bp, Homo sapiens
cagtttgtcttgattcagaaca

SEQ ID NO: 7452156 - DNA, 22 bp, Homo sapiens
cagtttgtcttgattcagaaca

SEQ ID NO: 7452157 - DNA, 22 bp, Homo sapiens
cagtttgtcttgattcagaaca

SEQ ID NO: 7452158 - DNA, 22 bp, Homo sapiens
tcagatattctctaagaacaat

SEQ ID NO: 7452159 - DNA, 22 bp, Homo sapiens
tcagatattctctaagaacaat

SEQ ID NO: 7452160 - DNA, 22 bp, Homo sapiens
tcagatcaggatgcagcaacat

SEQ ID NO: 7452161 - DNA, 22 bp, Homo sapiens
tcagatcaggatgcagcaacat

SEQ ID NO: 7452162 - DNA, 22 bp, Homo sapiens
tcagatcatcagctgctttata

SEQ ID NO: 7452163 - DNA, 22 bp, Homo sapiens
tcagatcatggatctattactt

SEQ ID NO: 7452164 - DNA, 22 bp, Homo sapiens
tcagatcatttgtggattcact

SEQ ID NO: 7452165 - DNA, 22 bp, Homo sapiens
tcagaggatcatgtccctactc

SEQ ID NO: 7452166 - DNA, 22 bp, Homo sapiens
tcagaggatcatgtccctactc

SEQ ID NO: 7452167 - DNA, 22 bp, Homo sapiens
tcagaggatcatgtccctactc

SEQ ID NO: 7452168 - DNA, 22 bp, Homo sapiens
tcagaggatagaaatacttatt

SEQ ID NO: 7452169 - DNA, 22 bp, Homo sapiens
tcagaggagggactcagaccca

SEQ ID NO: 7452170 - DNA, 22 bp, Homo sapiens
tcagaggatagaaatacttatt

SEQ ID NO: 7452171 - DNA, 23 bp, Homo sapiens
tcagaggatcatcaaacgttttc

SEQ ID NO: 7452172 - DNA, 22 bp, Homo sapiens
tcagaggatagaaatacttatt

SEQ ID NO: 7452173 - DNA, 22 bp, Homo sapiens
tcagaggaggcatttaaacaga

SEQ ID NO: 7452174 - DNA, 22 bp, Homo sapiens
tcagaggagggactcagaccca

SEQ ID NO: 7452175 - DNA, 22 bp, Homo sapiens
tcagaggagctgcagaacgctg

SEQ ID NO: 7452176 - DNA, 22 bp, Homo sapiens
tcagaggagggactcagaccca

SEQ ID NO: 7452177 - DNA, 22 bp, Homo sapiens
tcagaggagggactcagaccca

SEQ ID NO: 7452178 - DNA, 22 bp, Homo sapiens
tcagaggaggcatttaaacaga

SEQ ID NO: 7452179 - DNA, 22 bp, Homo sapiens
tcagaggaggcatttaaacaga

SEQ ID NO: 7452180 - DNA, 22 bp, Homo sapiens
tcagaggagctgcagaacgctg

SEQ ID NO: 7452181 - DNA, 22 bp, Homo sapiens
tcagaggagctgcagaacgctg

SEQ ID NO: 7452182 - DNA, 22 bp, Homo sapiens
tcagaggagctgcagaacgctg

SEQ ID NO: 7452183 - DNA, 22 bp, Homo sapiens
tcagaggagccaaagttctgag

SEQ ID NO: 7452184 - DNA, 22 bp, Homo sapiens
tcagaggagcaaaagaggggat

SEQ ID NO: 7452185 - DNA, 22 bp, Homo sapiens
tcagaggagcaaaagaggggat

SEQ ID NO: 7452186 - DNA, 22 bp, Homo sapiens
tcagaggagcaaaagaggggat

SEQ ID NO: 7452187 - DNA, 22 bp, Homo sapiens
tcagaggagcaaaagaggggat

SEQ ID NO: 7452188 - DNA, 22 bp, Homo sapiens
tcagaggagcaaaagaggggat

SEQ ID NO: 7452189 - DNA, 22 bp, Homo sapiens
tcagaggagctgcagaacgctg

SEQ ID NO: 7452190 - DNA, 22 bp, Homo sapiens
tcagaggagccaaagttctgag

SEQ ID NO: 7452191 - DNA, 22 bp, Homo sapiens
tcagaggagccaaagttctgag

SEQ ID NO: 7452192 - DNA, 22 bp, Homo sapiens
tcagaggagccaaagttctgag

SEQ ID NO: 7452193 - DNA, 22 bp, Homo sapiens
tcagaggagccaaagttctgag

SEQ ID NO: 7452194 - DNA, 22 bp, Homo sapiens
tcagaggagcaaaagaggggat

SEQ ID NO: 7452195 - DNA, 22 bp, Homo sapiens
tcagaggagcaaaagaggggat

SEQ ID NO: 7452196 - DNA, 22 bp, Homo sapiens
tcagaggagcaaaagaggggat

SEQ ID NO: 7452197 - DNA, 22 bp, Homo sapiens
tcagaggagcaaaagaggggat

SEQ ID NO: 7452198 - DNA, 22 bp, Homo sapiens
tcagaggagcaaaagaggggat

SEQ ID NO: 7452199 - DNA, 22 bp, Homo sapiens
tcagaggagatggttaccaggg

SEQ ID NO: 7452200 - DNA, 23 bp, Homo sapiens
tcagagcaagatgatgtatgagc

SEQ ID NO: 7452201 - DNA, 23 bp, Homo sapiens
tcagagcaagatgatgtatgagc

SEQ ID NO: 7452202 - DNA, 18 bp, Homo sapiens
tcagaggagatacctaaa

SEQ ID NO: 7452203 - DNA, 18 bp, Homo sapiens
tcagaggagatacctaaa

SEQ ID NO: 7452204 - DNA, 22 bp, Homo sapiens
tcagagtttctgatttagtagg

SEQ ID NO: 7452205 - DNA, 22 bp, Homo sapiens
tcagagtttctagtcaaatcca

SEQ ID NO: 7452206 - DNA, 22 bp, Homo sapiens
tcagagtttctagtcaaatcca

SEQ ID NO: 7452207 - DNA, 22 bp, Homo sapiens
tcagagtttcaggatacaaata

SEQ ID NO: 7452208 - DNA, 22 bp, Homo sapiens
tcagagtttcaggatacaaata

SEQ ID NO: 7452209 - DNA, 22 bp, Homo sapiens
tcagagttttattttattccgg

SEQ ID NO: 7452210 - DNA, 22 bp, Homo sapiens
tcagagtttggatcattccttg

SEQ ID NO: 7452211 - DNA, 22 bp, Homo sapiens
tcagataaaggagagcttagca

SEQ ID NO: 7452212 - DNA, 22 bp, Homo sapiens
tcagataaaggagagcttagca

SEQ ID NO: 7452213 - DNA, 20 bp, Homo sapiens
tcagataaggtgatctgtgg

SEQ ID NO: 7452214 - DNA, 22 bp, Homo sapiens
tcagataagtgaagcaaagttt

SEQ ID NO: 7452215 - DNA, 22 bp, Homo sapiens
tcagataagtgaagcaaagttt

SEQ ID NO: 7452216 - DNA, 22 bp, Homo sapiens
tcagagtttcaggatacaaata

SEQ ID NO: 7452217 - DNA, 22 bp, Homo sapiens
tcagagtttcaggatacaaata

SEQ ID NO: 7452218 - DNA, 22 bp, Homo sapiens
tcagagttggcagtaaaacaca

SEQ ID NO: 7452219 - DNA, 22 bp, Homo sapiens
tcagagttggcagtaaaacaca

SEQ ID NO: 7452220 - DNA, 22 bp, Homo sapiens
tcagagttggcctttctgtatt

SEQ ID NO: 7452221 - DNA, 22 bp, Homo sapiens
tcagagttgagctgttttgtgg

SEQ ID NO: 7452222 - DNA, 22 bp, Homo sapiens
tcagaggattgcctcagcgagc

SEQ ID NO: 7452223 - DNA, 22 bp, Homo sapiens
tcagaggattgcctcagcgagc

SEQ ID NO: 7452224 - DNA, 22 bp, Homo sapiens
tcagaggattgcctcagcgagc

SEQ ID NO: 7452225 - DNA, 22 bp, Homo sapiens
tcagaggatgctgttctttaat

SEQ ID NO: 7452226 - DNA, 22 bp, Homo sapiens
tcagaggatgctgttctttaat

SEQ ID NO: 7452227 - DNA, 22 bp, Homo sapiens
tcagaggatgctgttctttaat

SEQ ID NO: 7452228 - DNA, 22 bp, Homo sapiens
tcagatatagtcatttaaataa

SEQ ID NO: 7452229 - DNA, 22 bp, Homo sapiens
tcagatatgaattcatatctct

SEQ ID NO: 7452230 - DNA, 22 bp, Homo sapiens
tcagatatgaattcatatctct

SEQ ID NO: 7452231 - DNA, 22 bp, Homo sapiens
tcagatattcaattaagttaaa

SEQ ID NO: 7452232 - DNA, 22 bp, Homo sapiens
tcagatatggagtctaaaacca

SEQ ID NO: 7452233 - DNA, 22 bp, Homo sapiens
tcagatactagctctcagcctc

SEQ ID NO: 7452234 - DNA, 22 bp, Homo sapiens
tcagatagtgataatagcatgt

SEQ ID NO: 7452235 - DNA, 22 bp, Homo sapiens
tcagatactgtggcttatgggc

SEQ ID NO: 7452236 - DNA, 22 bp, Homo sapiens
tcagataccattgaatttgttg

SEQ ID NO: 7452237 - DNA, 22 bp, Homo sapiens
tcagatactagctctcagcctc

SEQ ID NO: 7452238 - DNA, 22 bp, Homo sapiens
tcagatagtgataatagcatgt

SEQ ID NO: 7452239 - DNA, 22 bp, Homo sapiens
tcagataccattgaatttgttg

SEQ ID NO: 7452240 - DNA, 21 bp, Homo sapiens
tcagataccagactcaagggg

SEQ ID NO: 7452241 - DNA, 22 bp, Homo sapiens
tcagataattaatcatgaaatt

SEQ ID NO: 7452242 - DNA, 22 bp, Homo sapiens
tcagataagttttgagttttaa

SEQ ID NO: 7452243 - DNA, 22 bp, Homo sapiens
tcagataatgactgagttttac

SEQ ID NO: 7452244 - DNA, 22 bp, Homo sapiens
tcagataagtgaagcaaagttt

SEQ ID NO: 7452245 - DNA, 22 bp, Homo sapiens
tcaatgaaagagcatgcatttt

SEQ ID NO: 7452246 - DNA, 22 bp, Homo sapiens
tcaatgaaagagcatgcatttt

SEQ ID NO: 7452247 - DNA, 22 bp, Homo sapiens
tcaatctgttccattagaacat

SEQ ID NO: 7452248 - DNA, 22 bp, Homo sapiens
tcaatctagagattaaaatagg

SEQ ID NO: 7452249 - DNA, 22 bp, Homo sapiens
tcaatcataatgaagtgaagaa

SEQ ID NO: 7452250 - DNA, 22 bp, Homo sapiens
tcaatcataatgaagtgaagaa

SEQ ID NO: 7452251 - DNA, 22 bp, Homo sapiens
tcaatcatagtccttctctaga

SEQ ID NO: 7452252 - DNA, 22 bp, Homo sapiens
tcaatcacgtgttccatgttct

SEQ ID NO: 7452253 - DNA, 22 bp, Homo sapiens
tcaatcacgtgttccatgttct

SEQ ID NO: 7452254 - DNA, 22 bp, Homo sapiens
tcaatcacgtgttccatgttct

SEQ ID NO: 7452255 - DNA, 22 bp, Homo sapiens
tcaatcaatgtgtcagttccca

SEQ ID NO: 7452256 - DNA, 22 bp, Homo sapiens
tcaatatttttatgagcataga

SEQ ID NO: 7452257 - DNA, 22 bp, Homo sapiens
tcaatatttttatgagcataga

SEQ ID NO: 7452258 - DNA, 22 bp, Homo sapiens
tcaatcaatggtttccaaattt

SEQ ID NO: 7452259 - DNA, 22 bp, Homo sapiens
tcaatcaatggtttccaaattt

SEQ ID NO: 7452260 - DNA, 22 bp, Homo sapiens
tcaatcaaagcactgggctttg

SEQ ID NO: 7452261 - DNA, 22 bp, Homo sapiens
tcaatcaaagcactgggctttg

SEQ ID NO: 7452262 - DNA, 22 bp, Homo sapiens
tcaatcaaagccagatgtcctt

SEQ ID NO: 7452263 - DNA, 22 bp, Homo sapiens
tcaatcaaagccagatgtcctt

SEQ ID NO: 7452264 - DNA, 22 bp, Homo sapiens
tcaatagctcagtgtggaagct

SEQ ID NO: 7452265 - DNA, 22 bp, Homo sapiens
tcaatatagcagtgtacttgag

SEQ ID NO: 7452266 - DNA, 22 bp, Homo sapiens
tcaatatagcagtgtacttgag

SEQ ID NO: 7452267 - DNA, 22 bp, Homo sapiens
tcaatagattaggtattagatt

SEQ ID NO: 7452268 - DNA, 22 bp, Homo sapiens
tcaatagcatagcaattaatgt

SEQ ID NO: 7452269 - DNA, 22 bp, Homo sapiens
tcaatagcaatcaagccttcca

SEQ ID NO: 7452270 - DNA, 22 bp, Homo sapiens
tcaatagattaggtattagatt

SEQ ID NO: 7452271 - DNA, 22 bp, Homo sapiens
tcaatatattccatgttttctc

SEQ ID NO: 7452272 - DNA, 22 bp, Homo sapiens
tcaatatattccatgttttctc

SEQ ID NO: 7452273 - DNA, 22 bp, Homo sapiens
tcaatatattccatgttttctc

SEQ ID NO: 7452274 - DNA, 22 bp, Homo sapiens
tcaatattcttctttagtagga

SEQ ID NO: 7452275 - DNA, 22 bp, Homo sapiens
tcaatattcttctttagtagga

SEQ ID NO: 7452276 - DNA, 22 bp, Homo sapiens
tcaatattcttctttagtagga

SEQ ID NO: 7452277 - DNA, 22 bp, Homo sapiens
tcaatatttttatgagcataga

SEQ ID NO: 7452278 - DNA, 22 bp, Homo sapiens
cagttgaggactcacctttgaa

SEQ ID NO: 7452279 - DNA, 22 bp, Homo sapiens
cagttgaggactcacctttgaa

SEQ ID NO: 7452280 - DNA, 17 bp, Homo sapiens
cagttgaaatgtttgga

SEQ ID NO: 7452281 - DNA, 22 bp, Homo sapiens
cagttgaatggtcagacaaggc

SEQ ID NO: 7452282 - DNA, 22 bp, Homo sapiens
cagttgaaaagattttattctg

SEQ ID NO: 7452283 - DNA, 20 bp, Homo sapiens
cagttgaaataatttgtttg

SEQ ID NO: 7452284 - DNA, 20 bp, Homo sapiens
cagttgaaataatttgtttg

SEQ ID NO: 7452285 - DNA, 22 bp, Homo sapiens
cagttcttaataccatgtggtt

SEQ ID NO: 7452286 - DNA, 22 bp, Homo sapiens
cagttcttggacactctggagt

SEQ ID NO: 7452287 - DNA, 22 bp, Homo sapiens
cagttctttgtggggagttctc

SEQ ID NO: 7452288 - DNA, 22 bp, Homo sapiens
cagttgattgacttaagtacct

SEQ ID NO: 7452289 - DNA, 22 bp, Homo sapiens
cagttgatgtttagactctgca

SEQ ID NO: 7452290 - DNA, 22 bp, Homo sapiens
cagttgatgtttagactctgca

SEQ ID NO: 7452291 - DNA, 23 bp, Homo sapiens
cagttgatgttaccttccttaga

SEQ ID NO: 7452292 - DNA, 22 bp, Homo sapiens
cagttgatgggactcatgtggg

SEQ ID NO: 7452293 - DNA, 22 bp, Homo sapiens
cagttgatcactataggcttca

SEQ ID NO: 7452294 - DNA, 22 bp, Homo sapiens
cagttgatcactataggcttca

SEQ ID NO: 7452295 - DNA, 22 bp, Homo sapiens
cagttgatattgcagacaagca

SEQ ID NO: 7452296 - DNA, 22 bp, Homo sapiens
cagttgatatagaaaaaagtga

SEQ ID NO: 7452297 - DNA, 21 bp, Homo sapiens
cagttgatagagatcttgagc

SEQ ID NO: 7452298 - DNA, 22 bp, Homo sapiens
cagttgaaaagattttattctg

SEQ ID NO: 7452299 - DNA, 21 bp, Homo sapiens
cagttgatagagatcttgagc

SEQ ID NO: 7452300 - DNA, 22 bp, Homo sapiens
cagttgataataccagagagag

SEQ ID NO: 7452301 - DNA, 22 bp, Homo sapiens
cagttgagtctgctagctagga

SEQ ID NO: 7452302 - DNA, 22 bp, Homo sapiens
cagttgataataccagagagag

SEQ ID NO: 7452303 - DNA, 22 bp, Homo sapiens
tcaatgaaagagcatgcatttt

SEQ ID NO: 7452304 - DNA, 22 bp, Homo sapiens
tcaatcattcttgccatttatt

SEQ ID NO: 7452305 - DNA, 22 bp, Homo sapiens
tcaatgaagagatttaaatcat

SEQ ID NO: 7452306 - DNA, 22 bp, Homo sapiens
tcaatgaagagatttaaatcat

SEQ ID NO: 7452307 - DNA, 22 bp, Homo sapiens
cagttactgtatgtcaaagact

SEQ ID NO: 7452308 - DNA, 22 bp, Homo sapiens
cagttagaggaggtaaagatgc

SEQ ID NO: 7452309 - DNA, 22 bp, Homo sapiens
cagttagaggaggtaaagatgc

SEQ ID NO: 7452310 - DNA, 22 bp, Homo sapiens
cagttagtaaagcttgttcatg

SEQ ID NO: 7452311 - DNA, 22 bp, Homo sapiens
cagttataagactaagctattc

SEQ ID NO: 7452312 - DNA, 22 bp, Homo sapiens
cagttataagactaagctattc

SEQ ID NO: 7452313 - DNA, 22 bp, Homo sapiens
cagttataagactaagctattc

SEQ ID NO: 7452314 - DNA, 22 bp, Homo sapiens
cagttctggagtttcattcttt

SEQ ID NO: 7452315 - DNA, 22 bp, Homo sapiens
cagttctggagtttcattcttt

SEQ ID NO: 7452316 - DNA, 22 bp, Homo sapiens
cagttctggagtttcattcttt

SEQ ID NO: 7452317 - DNA, 22 bp, Homo sapiens
cagttctggaggctccacatct

SEQ ID NO: 7452318 - DNA, 22 bp, Homo sapiens
cagttctggaggctccacatct

SEQ ID NO: 7452319 - DNA, 22 bp, Homo sapiens
cagttataagactaagctattc

SEQ ID NO: 7452320 - DNA, 22 bp, Homo sapiens
cagttagttataaatgaggaag

SEQ ID NO: 7452321 - DNA, 22 bp, Homo sapiens
cagttctggtttgcagatatat

SEQ ID NO: 7452322 - DNA, 22 bp, Homo sapiens
cagttctggtttgcagatatat

SEQ ID NO: 7452323 - DNA, 22 bp, Homo sapiens
cagttgtccccaaaatatacgg

SEQ ID NO: 7452324 - DNA, 22 bp, Homo sapiens
cagttgttcccagcaatgaaag

SEQ ID NO: 7452325 - DNA, 22 bp, Homo sapiens
cagttgtaatgctttcctctga

SEQ ID NO: 7452326 - DNA, 22 bp, Homo sapiens
cagttgtaggcatgtgcatgga

SEQ ID NO: 7452327 - DNA, 22 bp, Homo sapiens
cagttgtaggcatgtgcatgga

SEQ ID NO: 7452328 - DNA, 22 bp, Homo sapiens
cagttggttttgaggctgtact

SEQ ID NO: 7452329 - DNA, 22 bp, Homo sapiens
cagttggtgatgaggctagtag

SEQ ID NO: 7452330 - DNA, 22 bp, Homo sapiens
tcagagagtcctggtcatttgc

SEQ ID NO: 7452331 - DNA, 22 bp, Homo sapiens
tcagagagtgcaaaatatagct

SEQ ID NO: 7452332 - DNA, 21 bp, Homo sapiens
tcagagagtcacagtgaactg

SEQ ID NO: 7452333 - DNA, 21 bp, Homo sapiens
tcagagagtcacagtgaactg

SEQ ID NO: 7452334 - DNA, 21 bp, Homo sapiens
tcagagagtcacagtgaactg

SEQ ID NO: 7452335 - DNA, 22 bp, Homo sapiens
cagttgttcccagcaatgaaag

SEQ ID NO: 7452336 - DNA, 21 bp, Homo sapiens
tcagagagtcacagtgaactg

SEQ ID NO: 7452337 - DNA, 21 bp, Homo sapiens
tcagagagtcacagtgaactg

SEQ ID NO: 7452338 - DNA, 21 bp, Homo sapiens
tcagagagtcacagtgaactg

SEQ ID NO: 7452339 - DNA, 17 bp, Homo sapiens
cagttggagacaagtcc

SEQ ID NO: 7452340 - DNA, 22 bp, Homo sapiens
cagttggaggaatgaggctgta

SEQ ID NO: 7452341 - DNA, 23 bp, Homo sapiens
cagttggaggtacagagacactg

SEQ ID NO: 7452342 - DNA, 17 bp, Homo sapiens
cagttggagacaagtcc

SEQ ID NO: 7452343 - DNA, 22 bp, Homo sapiens
cagttggaggaatgaggctgta

SEQ ID NO: 7452344 - DNA, 22 bp, Homo sapiens
cagttggtcttcccttggagca

SEQ ID NO: 7452345 - DNA, 22 bp, Homo sapiens
cagttggtcttcccttggagca

SEQ ID NO: 7452346 - DNA, 23 bp, Homo sapiens
cagttggaggtacagagacactg

SEQ ID NO: 7452347 - DNA, 23 bp, Homo sapiens
cagttggaggtacagagacactg

SEQ ID NO: 7452348 - DNA, 22 bp, Homo sapiens
cagttgcagaggcagagtgcta

SEQ ID NO: 7452349 - DNA, 22 bp, Homo sapiens
cagttgatttttatggtgtgaa

SEQ ID NO: 7452350 - DNA, 22 bp, Homo sapiens
cagttgcctactacatggcagg

SEQ ID NO: 7452351 - DNA, 22 bp, Homo sapiens
cagttgcactagccacatttca

SEQ ID NO: 7452352 - DNA, 22 bp, Homo sapiens
cagttgcagaggcagagtgcta

SEQ ID NO: 7452353 - DNA, 22 bp, Homo sapiens
cagttgcagctgtgacattgcg

SEQ ID NO: 7452354 - DNA, 22 bp, Homo sapiens
cagttgcctactacatggcagg

SEQ ID NO: 7452355 - DNA, 22 bp, Homo sapiens
cagttgcctgtttccttgtgtg

SEQ ID NO: 7452356 - DNA, 22 bp, Homo sapiens
cagttgccttatttccttgctg

SEQ ID NO: 7452357 - DNA, 22 bp, Homo sapiens
cagttgctacagttcaagtgtg

SEQ ID NO: 7452358 - DNA, 22 bp, Homo sapiens
cagttgctacagttcaagtgtg

SEQ ID NO: 7452359 - DNA, 22 bp, Homo sapiens
cagttgctggatgtgcagctct

SEQ ID NO: 7452360 - DNA, 22 bp, Homo sapiens
tcagagatgcagtgccacctac

SEQ ID NO: 7452361 - DNA, 22 bp, Homo sapiens
tcagagatgcagtgccacctac

SEQ ID NO: 7452362 - DNA, 22 bp, Homo sapiens
tcagagatgcagtgccacctac

SEQ ID NO: 7452363 - DNA, 22 bp, Homo sapiens
tcagagatcttcaggatgggac

SEQ ID NO: 7452364 - DNA, 22 bp, Homo sapiens
tcagagatctggagtacaactg

SEQ ID NO: 7452365 - DNA, 22 bp, Homo sapiens
tcagagatcttcaggatgggac

SEQ ID NO: 7452366 - DNA, 22 bp, Homo sapiens
tcagagattcacgtcagtccca

SEQ ID NO: 7452367 - DNA, 22 bp, Homo sapiens
tcagagattcacgtcagtccca

SEQ ID NO: 7452368 - DNA, 22 bp, Homo sapiens
tcagagatggagttagcagtga

SEQ ID NO: 7452369 - DNA, 23 bp, Homo sapiens
tcagagatggaaagcagaccacg

SEQ ID NO: 7452370 - DNA, 22 bp, Homo sapiens
tcagagcaacttttcctgcttt

SEQ ID NO: 7452371 - DNA, 22 bp, Homo sapiens
tcagagcaacttttcctgcttt

SEQ ID NO: 7452372 - DNA, 22 bp, Homo sapiens
tcagagcaaattcctgtgagcc

SEQ ID NO: 7452373 - DNA, 22 bp, Homo sapiens
tcagagcaaattcctgtgagcc

SEQ ID NO: 7452374 - DNA, 23 bp, Homo sapiens
tcagagcaaagggtgcctccgtt

SEQ ID NO: 7452375 - DNA, 22 bp, Homo sapiens
tcagagcaaattcctgtgagcc

SEQ ID NO: 7452376 - DNA, 22 bp, Homo sapiens
tcagagcaaattcctgtgagcc

SEQ ID NO: 7452377 - DNA, 23 bp, Homo sapiens
tcagagcaaagggtgcctccgtt

SEQ ID NO: 7452378 - DNA, 18 bp, Homo sapiens
tcagagcaaacagaagcc

SEQ ID NO: 7452379 - DNA, 22 bp, Homo sapiens
tcagagattgaaaacatatcca

SEQ ID NO: 7452380 - DNA, 23 bp, Homo sapiens
tcagagatggaaagcagaccacg

SEQ ID NO: 7452381 - DNA, 22 bp, Homo sapiens
tcagagatggagttagcagtga

SEQ ID NO: 7452382 - DNA, 22 bp, Homo sapiens
tcagagattcacgtcagtccca

SEQ ID NO: 7452383 - DNA, 22 bp, Homo sapiens
tcagagattgaaaacatatcca

SEQ ID NO: 7452384 - DNA, 22 bp, Homo sapiens
tcagagagtgcaaaatatagct

SEQ ID NO: 7452385 - DNA, 22 bp, Homo sapiens
tcagagagttacacaaattgtt

SEQ ID NO: 7452386 - DNA, 22 bp, Homo sapiens
tcagagagttacacaaattgtt

SEQ ID NO: 7452387 - DNA, 22 bp, Homo sapiens
tcagagagttagtgtcttagct

SEQ ID NO: 7452388 - DNA, 22 bp, Homo sapiens
tcagagagttagtgtcttagct

SEQ ID NO: 7452389 - DNA, 22 bp, Homo sapiens
tcagagagttagtgtcttagct

SEQ ID NO: 7452390 - DNA, 22 bp, Homo sapiens
tcagagagttagtgtcttagct

SEQ ID NO: 7452391 - DNA, 22 bp, Homo sapiens
tcagagagttttcactagggtg

SEQ ID NO: 7452392 - DNA, 22 bp, Homo sapiens
tcagagagttttcactagggtg

SEQ ID NO: 7452393 - DNA, 22 bp, Homo sapiens
tcagagagttttcactagggtg

SEQ ID NO: 7452394 - DNA, 22 bp, Homo sapiens
tcagagagttttcactagggtg

SEQ ID NO: 7452395 - DNA, 22 bp, Homo sapiens
tcagagagttttcactagggtg

SEQ ID NO: 7452396 - DNA, 22 bp, Homo sapiens
tcagagagttttcactagggtg

SEQ ID NO: 7452397 - DNA, 22 bp, Homo sapiens
tcagagatctggagtacaactg

SEQ ID NO: 7452398 - DNA, 22 bp, Homo sapiens
tcagagatctggagtacaactg

SEQ ID NO: 7452399 - DNA, 22 bp, Homo sapiens
tcagagatcttcaggatgggac

SEQ ID NO: 7452400 - DNA, 22 bp, Homo sapiens
tcagagatcttcaggatgggac

SEQ ID NO: 7452401 - DNA, 17 bp, Homo sapiens
tcagcagtaatggtggg

SEQ ID NO: 7452402 - DNA, 22 bp, Homo sapiens
tcagcagtagagggggcacagt

SEQ ID NO: 7452403 - DNA, 22 bp, Homo sapiens
tcagcaggtggtgggcaggtga

SEQ ID NO: 7452404 - DNA, 22 bp, Homo sapiens
tcagcaggtggtgggcaggtga

SEQ ID NO: 7452405 - DNA, 22 bp, Homo sapiens
tcagcaggtggtgggcaggtga

SEQ ID NO: 7452406 - DNA, 22 bp, Homo sapiens
tcagcaggtgcctcagattctt

SEQ ID NO: 7452407 - DNA, 22 bp, Homo sapiens
tcagcaggtggtgggcaggtga

SEQ ID NO: 7452408 - DNA, 22 bp, Homo sapiens
tcagcaggtggtgggcaggtga

SEQ ID NO: 7452409 - DNA, 22 bp, Homo sapiens
tcagcaggtggtgggcaggtga

SEQ ID NO: 7452410 - DNA, 22 bp, Homo sapiens
tcagcaggtgctttgtttactc

SEQ ID NO: 7452411 - DNA, 22 bp, Homo sapiens
tcagcaggtgctttgtttactc

SEQ ID NO: 7452412 - DNA, 22 bp, Homo sapiens
tcagcaggtggtgggcaggtga

SEQ ID NO: 7452413 - DNA, 22 bp, Homo sapiens
tcagcaggtggtgggcaggtga

SEQ ID NO: 7452414 - DNA, 22 bp, Homo sapiens
tcagcaggtggtgggcaggtga

SEQ ID NO: 7452415 - DNA, 22 bp, Homo sapiens
tcagcaggtgctttgtttactc

SEQ ID NO: 7452416 - DNA, 22 bp, Homo sapiens
tcagcaggtgcctcagattctt

SEQ ID NO: 7452417 - DNA, 22 bp, Homo sapiens
tcagcagggtttgacttctaat

SEQ ID NO: 7452418 - DNA, 22 bp, Homo sapiens
tcagcagggtttgacttctaat

SEQ ID NO: 7452419 - DNA, 22 bp, Homo sapiens
tcagcagggtttgacttctaat

SEQ ID NO: 7452420 - DNA, 22 bp, Homo sapiens
tcagcaggtctgaggcggggcc

SEQ ID NO: 7452421 - DNA, 22 bp, Homo sapiens
tcagcagggtttgacttctaat

SEQ ID NO: 7452422 - DNA, 22 bp, Homo sapiens
tcagcagggtttgacttctaat

SEQ ID NO: 7452423 - DNA, 22 bp, Homo sapiens
tcagcaggtctgaggcggggcc

SEQ ID NO: 7452424 - DNA, 22 bp, Homo sapiens
tcagcaggtctgaggcggggcc

SEQ ID NO: 7452425 - DNA, 22 bp, Homo sapiens
tcagcaggtctgaggcggggcc

SEQ ID NO: 7452426 - DNA, 22 bp, Homo sapiens
tcagcaggtgaacatcatgcca

SEQ ID NO: 7452427 - DNA, 22 bp, Homo sapiens
tcagcaggtgaacatcatgcca

SEQ ID NO: 7452428 - DNA, 22 bp, Homo sapiens
tcagcaggtgaacatcatgcca

SEQ ID NO: 7452429 - DNA, 22 bp, Homo sapiens
tcagcaggtctgaggcggggcc

SEQ ID NO: 7452430 - DNA, 22 bp, Homo sapiens
tcagcaggtgcctcagattctt

SEQ ID NO: 7452431 - DNA, 22 bp, Homo sapiens
tcagcaggtgcctcagattctt

SEQ ID NO: 7452432 - DNA, 22 bp, Homo sapiens
tcagcaggtgaacatcatgcca

SEQ ID NO: 7452433 - DNA, 22 bp, Homo sapiens
tcagcaggtgaacatcatgcca

SEQ ID NO: 7452434 - DNA, 22 bp, Homo sapiens
tcagcaggtgaacatcatgcca

SEQ ID NO: 7452435 - DNA, 22 bp, Homo sapiens
cataatcagatgtgtacataag

SEQ ID NO: 7452436 - DNA, 22 bp, Homo sapiens
cataatcagatgtgtacataag

SEQ ID NO: 7452437 - DNA, 22 bp, Homo sapiens
cataatgtctgacacagtaaga

SEQ ID NO: 7452438 - DNA, 22 bp, Homo sapiens
cataatgtctgacacagtaaga

SEQ ID NO: 7452439 - DNA, 22 bp, Homo sapiens
cataatgtgtgtcatacagact

SEQ ID NO: 7452440 - DNA, 22 bp, Homo sapiens
cataatgtgtgtcatacagact

SEQ ID NO: 7452441 - DNA, 22 bp, Homo sapiens
cataatgtgtgtcatacagact

SEQ ID NO: 7452442 - DNA, 22 bp, Homo sapiens
cataatgaacattagctactgt

SEQ ID NO: 7452443 - DNA, 22 bp, Homo sapiens
cataatgtatgcattttccagc

SEQ ID NO: 7452444 - DNA, 22 bp, Homo sapiens
cataatgaacattagctactgt

SEQ ID NO: 7452445 - DNA, 22 bp, Homo sapiens
cataatgaacattagctactgt

SEQ ID NO: 7452446 - DNA, 22 bp, Homo sapiens
cataatgtctgacacagtaaga

SEQ ID NO: 7452447 - DNA, 22 bp, Homo sapiens
cataatatctccgattacttgc

SEQ ID NO: 7452448 - DNA, 22 bp, Homo sapiens
cataatatctccgattacttgc

SEQ ID NO: 7452449 - DNA, 22 bp, Homo sapiens
cataatatctccgattacttgc

SEQ ID NO: 7452450 - DNA, 22 bp, Homo sapiens
cataacatccttgctactttga

SEQ ID NO: 7452451 - DNA, 22 bp, Homo sapiens
cataatatctccgattacttgc

SEQ ID NO: 7452452 - DNA, 22 bp, Homo sapiens
cataatatctccgattacttgc

SEQ ID NO: 7452453 - DNA, 22 bp, Homo sapiens
tcagcagtcctccaggatcaag

SEQ ID NO: 7452454 - DNA, 22 bp, Homo sapiens
tcagcagtcctccaggatcaag

SEQ ID NO: 7452455 - DNA, 22 bp, Homo sapiens
cataacatccttgctactttga

SEQ ID NO: 7452456 - DNA, 22 bp, Homo sapiens
cataacatccttgctactttga

SEQ ID NO: 7452457 - DNA, 22 bp, Homo sapiens
tcagcagtcacatgttgtccca

SEQ ID NO: 7452458 - DNA, 22 bp, Homo sapiens
tcagcagtcacatgttgtccca

SEQ ID NO: 7452459 - DNA, 22 bp, Homo sapiens
tcagcagtcctccaggatcaag

SEQ ID NO: 7452460 - DNA, 22 bp, Homo sapiens
tcagcagtcaaagagaatctct

SEQ ID NO: 7452461 - DNA, 22 bp, Homo sapiens
tcagcagtagagggggcacagt

SEQ ID NO: 7452462 - DNA, 22 bp, Homo sapiens
tcagcagtcaaagagaatctct

SEQ ID NO: 7452463 - DNA, 22 bp, Homo sapiens
tcagcagtcacatgttgtccca

SEQ ID NO: 7452464 - DNA, 22 bp, Homo sapiens
cataattaggcagttgatcatt

SEQ ID NO: 7452465 - DNA, 22 bp, Homo sapiens
cataattaggcagttgatcatt

SEQ ID NO: 7452466 - DNA, 22 bp, Homo sapiens
cataattaggcagttgatcatt

SEQ ID NO: 7452467 - DNA, 22 bp, Homo sapiens
cataattagagaattcatgtta

SEQ ID NO: 7452468 - DNA, 22 bp, Homo sapiens
cataattactgatatgctgatt

SEQ ID NO: 7452469 - DNA, 22 bp, Homo sapiens
cataattactgatatgctgatt

SEQ ID NO: 7452470 - DNA, 22 bp, Homo sapiens
cataattactgatatgctgatt

SEQ ID NO: 7452471 - DNA, 22 bp, Homo sapiens
cataatgttaatcttgactcca

SEQ ID NO: 7452472 - DNA, 22 bp, Homo sapiens
cataattaaattctgggcaaga

SEQ ID NO: 7452473 - DNA, 22 bp, Homo sapiens
cataattaaattctgggcaaga

SEQ ID NO: 7452474 - DNA, 22 bp, Homo sapiens
cataattaaattctgggcaaga

SEQ ID NO: 7452475 - DNA, 22 bp, Homo sapiens
cataattactgatatgctgatt

SEQ ID NO: 7452476 - DNA, 22 bp, Homo sapiens
cataatttcccaagagattgaa

SEQ ID NO: 7452477 - DNA, 22 bp, Homo sapiens
cataatttcccaagagattgaa

SEQ ID NO: 7452478 - DNA, 22 bp, Homo sapiens
cataatttcactgtcgtatggc

SEQ ID NO: 7452479 - DNA, 22 bp, Homo sapiens
cataatttctaccagggccata

SEQ ID NO: 7452480 - DNA, 22 bp, Homo sapiens
cataatttcccaagagattgaa

SEQ ID NO: 7452481 - DNA, 22 bp, Homo sapiens
cataattagtcatgttatgcat

SEQ ID NO: 7452482 - DNA, 22 bp, Homo sapiens
cataattaggcagttgatcatt

SEQ ID NO: 7452483 - DNA, 22 bp, Homo sapiens
cataattaggcagttgatcatt

SEQ ID NO: 7452484 - DNA, 22 bp, Homo sapiens
cataattataaacgcaagttca

SEQ ID NO: 7452485 - DNA, 22 bp, Homo sapiens
cataattagtcatgttatgcat

SEQ ID NO: 7452486 - DNA, 22 bp, Homo sapiens
cataattataaacgcaagttca

SEQ ID NO: 7452487 - DNA, 22 bp, Homo sapiens
cataattagtcatgttatgcat

SEQ ID NO: 7452488 - DNA, 22 bp, Homo sapiens
tcaggcccagagtcacggatcc

SEQ ID NO: 7452489 - DNA, 22 bp, Homo sapiens
tcaggcccagagtcacggatcc

SEQ ID NO: 7452490 - DNA, 22 bp, Homo sapiens
tcaggcagagtggaagctgcaa

SEQ ID NO: 7452491 - DNA, 22 bp, Homo sapiens
tcaggcagagttaatttgctcc

SEQ ID NO: 7452492 - DNA, 22 bp, Homo sapiens
tcaggccaggagatcagattga

SEQ ID NO: 7452493 - DNA, 22 bp, Homo sapiens
tcaggcagagtggaagctgcaa

SEQ ID NO: 7452494 - DNA, 22 bp, Homo sapiens
tcaggcagagtggaagctgcaa

SEQ ID NO: 7452495 - DNA, 22 bp, Homo sapiens
tcaggcagagtggaagctgcaa

SEQ ID NO: 7452496 - DNA, 18 bp, Homo sapiens
cataattttctttcttta

SEQ ID NO: 7452497 - DNA, 18 bp, Homo sapiens
cataattttctttcttta

SEQ ID NO: 7452498 - DNA, 18 bp, Homo sapiens
cataattttctttcttta

SEQ ID NO: 7452499 - DNA, 22 bp, Homo sapiens
cataatttgatatgcttgatgg

SEQ ID NO: 7452500 - DNA, 22 bp, Homo sapiens
cataatttgatatgcttgatgg

SEQ ID NO: 7452501 - DNA, 22 bp, Homo sapiens
cataatttctgtatcagcacca

SEQ ID NO: 7452502 - DNA, 22 bp, Homo sapiens
cataattttccatggtttgcta

SEQ ID NO: 7452503 - DNA, 22 bp, Homo sapiens
cataattttccatggtttgcta

SEQ ID NO: 7452504 - DNA, 18 bp, Homo sapiens
cataattttctttcttta

SEQ ID NO: 7452505 - DNA, 18 bp, Homo sapiens
cataattttctttcttta

SEQ ID NO: 7452506 - DNA, 18 bp, Homo sapiens
cataattttctttcttta

SEQ ID NO: 7452507 - DNA, 18 bp, Homo sapiens
cataattttctttcttta

SEQ ID NO: 7452508 - DNA, 22 bp, Homo sapiens
catagaaactgagacaaggatt

SEQ ID NO: 7452509 - DNA, 22 bp, Homo sapiens
catagaaactgagacaaggatt

SEQ ID NO: 7452510 - DNA, 22 bp, Homo sapiens
catagaaactgagacaaggatt

SEQ ID NO: 7452511 - DNA, 22 bp, Homo sapiens
catagaaactgagacaaggatt

SEQ ID NO: 7452512 - DNA, 22 bp, Homo sapiens
catagaaactgagacaaggatt

SEQ ID NO: 7452513 - DNA, 22 bp, Homo sapiens
catagaaactgagacaaggatt

SEQ ID NO: 7452514 - DNA, 22 bp, Homo sapiens
catagaaactgagacaaggatt

SEQ ID NO: 7452515 - DNA, 22 bp, Homo sapiens
tcaggcctgagaaaaatccttt

SEQ ID NO: 7452516 - DNA, 22 bp, Homo sapiens
tcaggcctgagaaaaatccttt

SEQ ID NO: 7452517 - DNA, 22 bp, Homo sapiens
tcaggcctgagaaaaatccttt

SEQ ID NO: 7452518 - DNA, 22 bp, Homo sapiens
tcaggcctgagaaaaatccttt

SEQ ID NO: 7452519 - DNA, 22 bp, Homo sapiens
catagaaaagagtaggtaatgt

SEQ ID NO: 7452520 - DNA, 22 bp, Homo sapiens
catagaaactgagacaaggatt

SEQ ID NO: 7452521 - DNA, 22 bp, Homo sapiens
catagaaacttgcagcaagcac

SEQ ID NO: 7452522 - DNA, 22 bp, Homo sapiens
catagaaacttgcagcaagcac

SEQ ID NO: 7452523 - DNA, 22 bp, Homo sapiens
catagaaacttgcagcaagcac

SEQ ID NO: 7452524 - DNA, 22 bp, Homo sapiens
catagaaactgagacaaggatt

SEQ ID NO: 7452525 - DNA, 22 bp, Homo sapiens
catagaaactgagacaaggatt

SEQ ID NO: 7452526 - DNA, 22 bp, Homo sapiens
catagaaagtattatggaattt

SEQ ID NO: 7452527 - DNA, 22 bp, Homo sapiens
catagaaacttgcagcaagcac

SEQ ID NO: 7452528 - DNA, 22 bp, Homo sapiens
catagaaagtattatggaattt

SEQ ID NO: 7452529 - DNA, 22 bp, Homo sapiens
catagaaagtattatggaattt

SEQ ID NO: 7452530 - DNA, 22 bp, Homo sapiens
catagaaagtattatggaattt

SEQ ID NO: 7452531 - DNA, 22 bp, Homo sapiens
catagaaagtattatggaattt

SEQ ID NO: 7452532 - DNA, 22 bp, Homo sapiens
catagaaatcaggtgagaatct

SEQ ID NO: 7452533 - DNA, 22 bp, Homo sapiens
catagaaatcaggtgagaatct

SEQ ID NO: 7452534 - DNA, 22 bp, Homo sapiens
catagaaatcaggtgagaatct

SEQ ID NO: 7452535 - DNA, 22 bp, Homo sapiens
catagaaatcaggtgagaatct

SEQ ID NO: 7452536 - DNA, 22 bp, Homo sapiens
catagaaatcaggtgagaatct

SEQ ID NO: 7452537 - DNA, 22 bp, Homo sapiens
catagaaatcaggtgagaatct

SEQ ID NO: 7452538 - DNA, 22 bp, Homo sapiens
catagaaatcaggtgagaatct

SEQ ID NO: 7452539 - DNA, 22 bp, Homo sapiens
catagaaatcaggtgagaatct

SEQ ID NO: 7452540 - DNA, 22 bp, Homo sapiens
catagaaatcaggtgagaatct

SEQ ID NO: 7452541 - DNA, 22 bp, Homo sapiens
catagaaatcaggtgagaatct

SEQ ID NO: 7452542 - DNA, 22 bp, Homo sapiens
tcaggccccatcccagacttat

SEQ ID NO: 7452543 - DNA, 22 bp, Homo sapiens
tcaggccccatcccagacttat

SEQ ID NO: 7452544 - DNA, 22 bp, Homo sapiens
tcaggccccatcccagacttat

SEQ ID NO: 7452545 - DNA, 22 bp, Homo sapiens
tcaggccccatcccagacttat

SEQ ID NO: 7452546 - DNA, 22 bp, Homo sapiens
tcaggcccagagtcacggatcc

SEQ ID NO: 7452547 - DNA, 22 bp, Homo sapiens
tcaggccccttgtcagctctgt

SEQ ID NO: 7452548 - DNA, 22 bp, Homo sapiens
tcaggccccttgtcagctctgt

SEQ ID NO: 7452549 - DNA, 22 bp, Homo sapiens
tcaggccccttgtcagctctgt

SEQ ID NO: 7452550 - DNA, 22 bp, Homo sapiens
tcaggccccttgtcagctctgt

SEQ ID NO: 7452551 - DNA, 22 bp, Homo sapiens
tcaggccccttgtcagctctgt

SEQ ID NO: 7452552 - DNA, 22 bp, Homo sapiens
tcaggccccatcccagacttat

SEQ ID NO: 7452553 - DNA, 22 bp, Homo sapiens
tcaggcccttctcccaggactc

SEQ ID NO: 7452554 - DNA, 22 bp, Homo sapiens
tcaggcccttctcccaggactc

SEQ ID NO: 7452555 - DNA, 22 bp, Homo sapiens
tcaggcccttctcccaggactc

SEQ ID NO: 7452556 - DNA, 22 bp, Homo sapiens
tcaggcccttctcccaggactc

SEQ ID NO: 7452557 - DNA, 22 bp, Homo sapiens
tcaggccctttgctgctgcccc

SEQ ID NO: 7452558 - DNA, 22 bp, Homo sapiens
tcaggccctttgctgctgcccc

SEQ ID NO: 7452559 - DNA, 22 bp, Homo sapiens
tcaggccctttgctgctgcccc

SEQ ID NO: 7452560 - DNA, 22 bp, Homo sapiens
tcaggcccttctcccaggactc

SEQ ID NO: 7452561 - DNA, 22 bp, Homo sapiens
tcaggcctccaggttaccattt

SEQ ID NO: 7452562 - DNA, 22 bp, Homo sapiens
tcaggcctccaggttaccattt

SEQ ID NO: 7452563 - DNA, 22 bp, Homo sapiens
tcaggcctcagcagcccacagg

SEQ ID NO: 7452564 - DNA, 22 bp, Homo sapiens
tcaggcctcagcagcccacagg

SEQ ID NO: 7452565 - DNA, 22 bp, Homo sapiens
tcaggcctccaggttaccattt

SEQ ID NO: 7452566 - DNA, 22 bp, Homo sapiens
tcaggcctcagcagcccacagg

SEQ ID NO: 7452567 - DNA, 22 bp, Homo sapiens
tcaggcctcagaaattgcactg

SEQ ID NO: 7452568 - DNA, 22 bp, Homo sapiens
tcaggcctcaagctgctttaag

SEQ ID NO: 7452569 - DNA, 22 bp, Homo sapiens
tcaggcctcaagctgctttaag

SEQ ID NO: 7452570 - DNA, 22 bp, Homo sapiens
tcaggcctcaagctgctttaag

SEQ ID NO: 7452571 - DNA, 22 bp, Homo sapiens
tcaggcctagggagaaaattca

SEQ ID NO: 7452572 - DNA, 22 bp, Homo sapiens
tcaggcctagaacacagcagat

SEQ ID NO: 7452573 - DNA, 22 bp, Homo sapiens
tcaggcctagaacacagcagat

SEQ ID NO: 7452574 - DNA, 22 bp, Homo sapiens
tcaggcctagaacacagcagat

SEQ ID NO: 7452575 - DNA, 22 bp, Homo sapiens
tcaggcctagaacacagcagat

SEQ ID NO: 7452576 - DNA, 22 bp, Homo sapiens
tcaggccctttgctgctgcccc

SEQ ID NO: 7452577 - DNA, 22 bp, Homo sapiens
tcaggcctagggagccacacca

SEQ ID NO: 7452578 - DNA, 22 bp, Homo sapiens
tcaggcctagggagccacacca

SEQ ID NO: 7452579 - DNA, 22 bp, Homo sapiens
tcaggcctagggagccacacca

SEQ ID NO: 7452580 - DNA, 22 bp, Homo sapiens
tcaggcctagggagccacacca

SEQ ID NO: 7452581 - DNA, 22 bp, Homo sapiens
tcaggcctagggagccacacca

SEQ ID NO: 7452582 - DNA, 22 bp, Homo sapiens
tcaggcctagggagaaaattca

SEQ ID NO: 7452583 - DNA, 22 bp, Homo sapiens
tcagggagagtgacccatccac

SEQ ID NO: 7452584 - DNA, 22 bp, Homo sapiens
tcagggagagtgacccatccac

SEQ ID NO: 7452585 - DNA, 22 bp, Homo sapiens
tcagggagaggtgagagcctgt

SEQ ID NO: 7452586 - DNA, 22 bp, Homo sapiens
tcagggagaggtgagagcctgt

SEQ ID NO: 7452587 - DNA, 22 bp, Homo sapiens
tcagggagaggtgagagcctgt

SEQ ID NO: 7452588 - DNA, 22 bp, Homo sapiens
tcagggagaggtgagagcctgt

SEQ ID NO: 7452589 - DNA, 22 bp, Homo sapiens
tcagggagaggtgagagcctgt

SEQ ID NO: 7452590 - DNA, 22 bp, Homo sapiens
tcagggagaggtgagagcctgt

SEQ ID NO: 7452591 - DNA, 22 bp, Homo sapiens
tcaggctgtgtctttaaacaat

SEQ ID NO: 7452592 - DNA, 22 bp, Homo sapiens
tcaggctgtgggcactggccat

SEQ ID NO: 7452593 - DNA, 22 bp, Homo sapiens
tcaggctgtgtctttaaacaat

SEQ ID NO: 7452594 - DNA, 22 bp, Homo sapiens
tcaggctgttagccacctcctc

SEQ ID NO: 7452595 - DNA, 22 bp, Homo sapiens
tcaggctgttagccacctcctc

SEQ ID NO: 7452596 - DNA, 22 bp, Homo sapiens
tcaggctgttagccacctcctc

SEQ ID NO: 7452597 - DNA, 22 bp, Homo sapiens
tcaggctgtgtctttaaacaat

SEQ ID NO: 7452598 - DNA, 22 bp, Homo sapiens
tcaggctgttagccacctcctc

SEQ ID NO: 7452599 - DNA, 22 bp, Homo sapiens
tcaggctgtggcttcagttctt

SEQ ID NO: 7452600 - DNA, 22 bp, Homo sapiens
tcaggctgtggcttcagttctt

SEQ ID NO: 7452601 - DNA, 17 bp, Homo sapiens
tcaggctgtgcctggta

SEQ ID NO: 7452602 - DNA, 17 bp, Homo sapiens
tcaggctgtgcctggta

SEQ ID NO: 7452603 - DNA, 17 bp, Homo sapiens
tcaggctgtgcctggta

SEQ ID NO: 7452604 - DNA, 22 bp, Homo sapiens
tcaggctgtggctttgaccgca

SEQ ID NO: 7452605 - DNA, 22 bp, Homo sapiens
tcaggctgtggcttcagttctt

SEQ ID NO: 7452606 - DNA, 22 bp, Homo sapiens
tcaggctgtggcttcagttctt

SEQ ID NO: 7452607 - DNA, 22 bp, Homo sapiens
tcaggctgtgggcactggccat

SEQ ID NO: 7452608 - DNA, 22 bp, Homo sapiens
tcaggctgtgggcactggccat

SEQ ID NO: 7452609 - DNA, 22 bp, Homo sapiens
tcaggctgtggctttgaccgca

SEQ ID NO: 7452610 - DNA, 22 bp, Homo sapiens
tcaggctgtgggcactggccat

SEQ ID NO: 7452611 - DNA, 22 bp, Homo sapiens
tcaggctgtgggcactggccat

SEQ ID NO: 7452612 - DNA, 22 bp, Homo sapiens
tcaggctgtgggcactggccat

SEQ ID NO: 7452613 - DNA, 22 bp, Homo sapiens
tcaggctgtgggcactggccat

SEQ ID NO: 7452614 - DNA, 22 bp, Homo sapiens
catagaatatgtgtgattgtta

SEQ ID NO: 7452615 - DNA, 22 bp, Homo sapiens
catagaaatcaggtgagaatct

SEQ ID NO: 7452616 - DNA, 22 bp, Homo sapiens
catagaaatcaggtgagaatct

SEQ ID NO: 7452617 - DNA, 22 bp, Homo sapiens
catagaatatgtgtgattgtta

SEQ ID NO: 7452618 - DNA, 22 bp, Homo sapiens
tcaggctgcctatcagactgtg

SEQ ID NO: 7452619 - DNA, 22 bp, Homo sapiens
tcaggctgcctatcagactgtg

SEQ ID NO: 7452620 - DNA, 22 bp, Homo sapiens
tcaggctgcctatcagactgtg

SEQ ID NO: 7452621 - DNA, 22 bp, Homo sapiens
catagaatcatagcacatttga

SEQ ID NO: 7452622 - DNA, 22 bp, Homo sapiens
tcaggctgcctatcagactgtg

SEQ ID NO: 7452623 - DNA, 21 bp, Homo sapiens
tcaggctgtctgctggttcca

SEQ ID NO: 7452624 - DNA, 22 bp, Homo sapiens
tcaggctgcctatcagactgtg

SEQ ID NO: 7452625 - DNA, 21 bp, Homo sapiens
tcaggctgtctgctggttcca

SEQ ID NO: 7452626 - DNA, 21 bp, Homo sapiens
tcaggctgtctgctggttcca

SEQ ID NO: 7452627 - DNA, 22 bp, Homo sapiens
tcaggctgtatatcttgcactc

SEQ ID NO: 7452628 - DNA, 22 bp, Homo sapiens
tcaggctgtatatcttgcactc

SEQ ID NO: 7452629 - DNA, 21 bp, Homo sapiens
tcaggctgtctgctggttcca

SEQ ID NO: 7452630 - DNA, 17 bp, Homo sapiens
tcaggctgtgcctggta

SEQ ID NO: 7452631 - DNA, 21 bp, Homo sapiens
tcaggctgtctgctggttcca

SEQ ID NO: 7452632 - DNA, 17 bp, Homo sapiens
tcaggctgtgcctggta

SEQ ID NO: 7452633 - DNA, 17 bp, Homo sapiens
tcaggctgtgcctggta

SEQ ID NO: 7452634 - DNA, 17 bp, Homo sapiens
tcaggctgtgcctggta

SEQ ID NO: 7452635 - DNA, 17 bp, Homo sapiens
tcaggctgtgcctggta

SEQ ID NO: 7452636 - DNA, 17 bp, Homo sapiens
tcaggctgtgcctggta

SEQ ID NO: 7452637 - DNA, 17 bp, Homo sapiens
tcaggctgtgcctggta

SEQ ID NO: 7452638 - DNA, 17 bp, Homo sapiens
tcaggctgtgcctggta

SEQ ID NO: 7452639 - DNA, 17 bp, Homo sapiens
tcaggctgtgcctggta

SEQ ID NO: 7452640 - DNA, 19 bp, Homo sapiens
catctggatgattctcctg

SEQ ID NO: 7452641 - DNA, 19 bp, Homo sapiens
catctggatgattctcctg

SEQ ID NO: 7452642 - DNA, 19 bp, Homo sapiens
catctggatgattctcctg

SEQ ID NO: 7452643 - DNA, 19 bp, Homo sapiens
catctggatgattctcctg

SEQ ID NO: 7452644 - DNA, 22 bp, Homo sapiens
catctggctagctatcattgtg

SEQ ID NO: 7452645 - DNA, 22 bp, Homo sapiens
catctggcagaccctgcctccg

SEQ ID NO: 7452646 - DNA, 22 bp, Homo sapiens
catctggcagaccctgcctccg

SEQ ID NO: 7452647 - DNA, 19 bp, Homo sapiens
catctggatgattctcctg

SEQ ID NO: 7452648 - DNA, 22 bp, Homo sapiens
catctggcagaccctgcctccg

SEQ ID NO: 7452649 - DNA, 22 bp, Homo sapiens
catctggacaaaactctgaagg

SEQ ID NO: 7452650 - DNA, 22 bp, Homo sapiens
catctgctgttccttggactca

SEQ ID NO: 7452651 - DNA, 22 bp, Homo sapiens
catctggacaaaactctgaagg

SEQ ID NO: 7452652 - DNA, 22 bp, Homo sapiens
catctgctgttccttggactca

SEQ ID NO: 7452653 - DNA, 22 bp, Homo sapiens
catctgctgttccttggactca

SEQ ID NO: 7452654 - DNA, 22 bp, Homo sapiens
catctgctgttccttggactca

SEQ ID NO: 7452655 - DNA, 22 bp, Homo sapiens
catctgctgttccttggactca

SEQ ID NO: 7452656 - DNA, 22 bp, Homo sapiens
catctgctgttccttggactca

SEQ ID NO: 7452657 - DNA, 22 bp, Homo sapiens
catctgctgttccttggactca

SEQ ID NO: 7452658 - DNA, 19 bp, Homo sapiens
catctgtaaggacagaaac

SEQ ID NO: 7452659 - DNA, 22 bp, Homo sapiens
catctgtagctccatgacaatt

SEQ ID NO: 7452660 - DNA, 22 bp, Homo sapiens
catctgtagctccatgacaatt

SEQ ID NO: 7452661 - DNA, 22 bp, Homo sapiens
catctgtaaggaagaggatcaa

SEQ ID NO: 7452662 - DNA, 19 bp, Homo sapiens
catctgtaaggacagaaac

SEQ ID NO: 7452663 - DNA, 22 bp, Homo sapiens
catctgtcaggcagaacccaga

SEQ ID NO: 7452664 - DNA, 22 bp, Homo sapiens
catctgtcaacagagacggtca

SEQ ID NO: 7452665 - DNA, 22 bp, Homo sapiens
catctgtcatcaaccctggcta

SEQ ID NO: 7452666 - DNA, 22 bp, Homo sapiens
catctgtaggtgacacatgagt

SEQ ID NO: 7452667 - DNA, 22 bp, Homo sapiens
catctgtcacctgtgaatgttg

SEQ ID NO: 7452668 - DNA, 22 bp, Homo sapiens
catctgtaggtgacacatgagt

SEQ ID NO: 7452669 - DNA, 22 bp, Homo sapiens
catctgtagctccatgacaatt

SEQ ID NO: 7452670 - DNA, 22 bp, Homo sapiens
catctggggctgtctgctaatc

SEQ ID NO: 7452671 - DNA, 23 bp, Homo sapiens
catctggggacatcattaggctg

SEQ ID NO: 7452672 - DNA, 22 bp, Homo sapiens
catctggctagctatcattgtg

SEQ ID NO: 7452673 - DNA, 22 bp, Homo sapiens
catctggtttaaaagaagaaag

SEQ ID NO: 7452674 - DNA, 22 bp, Homo sapiens
catctgtaaagtaggaatattg

SEQ ID NO: 7452675 - DNA, 22 bp, Homo sapiens
catctggttagttgatgaaact

SEQ ID NO: 7452676 - DNA, 22 bp, Homo sapiens
catctgcaggggaagccagttt

SEQ ID NO: 7452677 - DNA, 22 bp, Homo sapiens
catctgccactctctcccacca

SEQ ID NO: 7452678 - DNA, 22 bp, Homo sapiens
catctgccactctctcccacca

SEQ ID NO: 7452679 - DNA, 22 bp, Homo sapiens
catctgatgggaatataagagc

SEQ ID NO: 7452680 - DNA, 22 bp, Homo sapiens
catctgaatatcccaggcatat

SEQ ID NO: 7452681 - DNA, 22 bp, Homo sapiens
catctgaatttgccttagtttc

SEQ ID NO: 7452682 - DNA, 20 bp, Homo sapiens
catctgagcccacagaagtc

SEQ ID NO: 7452683 - DNA, 20 bp, Homo sapiens
catctgagcccacagaagtc

SEQ ID NO: 7452684 - DNA, 20 bp, Homo sapiens
catctgagcccacagaagtc

SEQ ID NO: 7452685 - DNA, 22 bp, Homo sapiens
catctgagggaaaacatgtagt

SEQ ID NO: 7452686 - DNA, 22 bp, Homo sapiens
catctgagggaaaacatgtagt

SEQ ID NO: 7452687 - DNA, 22 bp, Homo sapiens
catctgaaatctgcctacaagc

SEQ ID NO: 7452688 - DNA, 22 bp, Homo sapiens
catctgaaatctgcctacaagc

SEQ ID NO: 7452689 - DNA, 22 bp, Homo sapiens
catctgaagagctttgcaagag

SEQ ID NO: 7452690 - DNA, 22 bp, Homo sapiens
catctgaagagctttgcaagag

SEQ ID NO: 7452691 - DNA, 22 bp, Homo sapiens
catctgaagtgaattgcttttt

SEQ ID NO: 7452692 - DNA, 22 bp, Homo sapiens
catctgaagtgaattgcttttt

SEQ ID NO: 7452693 - DNA, 22 bp, Homo sapiens
catctgaataaagacttgcaga

SEQ ID NO: 7452694 - DNA, 22 bp, Homo sapiens
catctgaatatcccaggcatat

SEQ ID NO: 7452695 - DNA, 22 bp, Homo sapiens
catctgaatatcccaggcatat

SEQ ID NO: 7452696 - DNA, 22 bp, Homo sapiens
catctgaatttgccttagtttc

SEQ ID NO: 7452697 - DNA, 22 bp, Homo sapiens
catctgccactctctcccacca

SEQ ID NO: 7452698 - DNA, 22 bp, Homo sapiens
catctgcctaagtggccctgtt

SEQ ID NO: 7452699 - DNA, 22 bp, Homo sapiens
catctgcctaagtggccctgtt

SEQ ID NO: 7452700 - DNA, 22 bp, Homo sapiens
catctgcctaagtggccctgtt

SEQ ID NO: 7452701 - DNA, 22 bp, Homo sapiens
catctgcctaagtggccctgtt

SEQ ID NO: 7452702 - DNA, 17 bp, Homo sapiens
catctgctctgcccctt

SEQ ID NO: 7452703 - DNA, 22 bp, Homo sapiens
catctgctctgtctgccatgtt

SEQ ID NO: 7452704 - DNA, 17 bp, Homo sapiens
catctgctctgcccctt

SEQ ID NO: 7452705 - DNA, 17 bp, Homo sapiens
catctgctctgcccctt

SEQ ID NO: 7452706 - DNA, 17 bp, Homo sapiens
catctgctctgcccctt

SEQ ID NO: 7452707 - DNA, 22 bp, Homo sapiens
catctgctgctacaaaaagctt

SEQ ID NO: 7452708 - DNA, 22 bp, Homo sapiens
catctgctgctgaagccagcat

SEQ ID NO: 7452709 - DNA, 22 bp, Homo sapiens
catctgctgacttgacaagtac

SEQ ID NO: 7452710 - DNA, 22 bp, Homo sapiens
catctgctctgtctgccatgtt

SEQ ID NO: 7452711 - DNA, 22 bp, Homo sapiens
catctgctgtaattaacaagcc

SEQ ID NO: 7452712 - DNA, 22 bp, Homo sapiens
catctgctgctgaagccagcat

SEQ ID NO: 7452713 - DNA, 22 bp, Homo sapiens
catctgctgttccttggactca

SEQ ID NO: 7452714 - DNA, 22 bp, Homo sapiens
catctgctgttccttggactca

SEQ ID NO: 7452715 - DNA, 22 bp, Homo sapiens
catctgctgttccttggactca

SEQ ID NO: 7452716 - DNA, 22 bp, Homo sapiens
catctgctgttccttggactca

SEQ ID NO: 7452717 - DNA, 22 bp, Homo sapiens
catctgttaaagtctaatgaaa

SEQ ID NO: 7452718 - DNA, 22 bp, Homo sapiens
catctgtgccgggtgtttgtca

SEQ ID NO: 7452719 - DNA, 22 bp, Homo sapiens
catctgttctatccacgttgct

SEQ ID NO: 7452720 - DNA, 22 bp, Homo sapiens
catctgttctatccacgttgct

SEQ ID NO: 7452721 - DNA, 22 bp, Homo sapiens
catctgttaaagtctaatgaaa

SEQ ID NO: 7452722 - DNA, 22 bp, Homo sapiens
catctgtcttttgttacaaggc

SEQ ID NO: 7452723 - DNA, 22 bp, Homo sapiens
catctgtcttttgttacaaggc

SEQ ID NO: 7452724 - DNA, 22 bp, Homo sapiens
catctgtctgctgttagctgca

SEQ ID NO: 7452725 - DNA, 22 bp, Homo sapiens
catctgtctgcatgctctgggt

SEQ ID NO: 7452726 - DNA, 22 bp, Homo sapiens
catctgtctgctgttagctgca

SEQ ID NO: 7452727 - DNA, 22 bp, Homo sapiens
catctgtcatcaaccctggcta

SEQ ID NO: 7452728 - DNA, 22 bp, Homo sapiens
catctgtcatcaaccctggcta

SEQ ID NO: 7452729 - DNA, 22 bp, Homo sapiens
catctgtctcctcatcgcctgt

SEQ ID NO: 7452730 - DNA, 22 bp, Homo sapiens
catctgtctgcatgctctgggt

SEQ ID NO: 7452731 - DNA, 22 bp, Homo sapiens
catcttaaaatgtgtcataact

SEQ ID NO: 7452732 - DNA, 22 bp, Homo sapiens
catcttaaaatgtgtcataact

SEQ ID NO: 7452733 - DNA, 22 bp, Homo sapiens
catcttaaattaaagcttaagg

SEQ ID NO: 7452734 - DNA, 22 bp, Homo sapiens
catcttaaattaaagcttaagg

SEQ ID NO: 7452735 - DNA, 22 bp, Homo sapiens
catctgttgagttctccgtgct

SEQ ID NO: 7452736 - DNA, 22 bp, Homo sapiens
catctgttgcttcctaacaagt

SEQ ID NO: 7452737 - DNA, 22 bp, Homo sapiens
catctgtttttgtcaattacat

SEQ ID NO: 7452738 - DNA, 22 bp, Homo sapiens
catgaaatttgaagtacagcaa

SEQ ID NO: 7452739 - DNA, 22 bp, Homo sapiens
catgaacaaatcctgcgagtat

SEQ ID NO: 7452740 - DNA, 22 bp, Homo sapiens
catgaaatttgaagtacagcaa

SEQ ID NO: 7452741 - DNA, 22 bp, Homo sapiens
catgaaatttgaagtacagcaa

SEQ ID NO: 7452742 - DNA, 22 bp, Homo sapiens
catgaaattgtattggcctcaa

SEQ ID NO: 7452743 - DNA, 22 bp, Homo sapiens
catgaaattgtattggcctcaa

SEQ ID NO: 7452744 - DNA, 22 bp, Homo sapiens
catgaaattgtattggcctcaa

SEQ ID NO: 7452745 - DNA, 22 bp, Homo sapiens
catgaaattgctcctttggtgc

SEQ ID NO: 7452746 - DNA, 22 bp, Homo sapiens
catgaaattgctcctttggtgc

SEQ ID NO: 7452747 - DNA, 22 bp, Homo sapiens
catgaaattgctcctttggtgc

SEQ ID NO: 7452748 - DNA, 22 bp, Homo sapiens
catgaaaataacattgttgtga

SEQ ID NO: 7452749 - DNA, 22 bp, Homo sapiens
catgaaaataacattgttgtga

SEQ ID NO: 7452750 - DNA, 22 bp, Homo sapiens
catgaaaataacattgttgtga

SEQ ID NO: 7452751 - DNA, 22 bp, Homo sapiens
catgaaaataacattgttgtga

SEQ ID NO: 7452752 - DNA, 22 bp, Homo sapiens
catgaaaataacattgttgtga

SEQ ID NO: 7452753 - DNA, 22 bp, Homo sapiens
catgaaaataacattgttgtga

SEQ ID NO: 7452754 - DNA, 22 bp, Homo sapiens
catgaacagctaacattttggg

SEQ ID NO: 7452755 - DNA, 21 bp, Homo sapiens
catgaacatgcttatcctcag

SEQ ID NO: 7452756 - DNA, 21 bp, Homo sapiens
catgaacatgcttatcctcag

SEQ ID NO: 7452757 - DNA, 22 bp, Homo sapiens
catgaacattcagaaatacagc

SEQ ID NO: 7452758 - DNA, 22 bp, Homo sapiens
catgaacattcagaaatacagc

SEQ ID NO: 7452759 - DNA, 22 bp, Homo sapiens
catgaacagctaacattttggg

SEQ ID NO: 7452760 - DNA, 22 bp, Homo sapiens
catgaacagctaacattttggg

SEQ ID NO: 7452761 - DNA, 22 bp, Homo sapiens
catgaacagctaacattttggg

SEQ ID NO: 7452762 - DNA, 22 bp, Homo sapiens
catgaacagattcttcatttct

SEQ ID NO: 7452763 - DNA, 22 bp, Homo sapiens
catgaacagattcttcatttct

SEQ ID NO: 7452764 - DNA, 22 bp, Homo sapiens
catgaacaccaggcatgaacaa

SEQ ID NO: 7452765 - DNA, 22 bp, Homo sapiens
catgaacaccaggcatgaacaa

SEQ ID NO: 7452766 - DNA, 22 bp, Homo sapiens
catgaacaccaggcatgaacaa

SEQ ID NO: 7452767 - DNA, 22 bp, Homo sapiens
catgaacaccaggcatgaacaa

SEQ ID NO: 7452768 - DNA, 22 bp, Homo sapiens
catgaacaccaggcatgaacaa

SEQ ID NO: 7452769 - DNA, 22 bp, Homo sapiens
catgaacaatttgctcactgat

SEQ ID NO: 7452770 - DNA, 22 bp, Homo sapiens
catgaacaccaggcatgaacaa

SEQ ID NO: 7452771 - DNA, 22 bp, Homo sapiens
catgaacaatttgctcactgat

SEQ ID NO: 7452772 - DNA, 22 bp, Homo sapiens
catgaacaatttgctcactgat

SEQ ID NO: 7452773 - DNA, 22 bp, Homo sapiens
catgaacaaattctgtttgagg

SEQ ID NO: 7452774 - DNA, 22 bp, Homo sapiens
catgaacattcagaaatacagc

SEQ ID NO: 7452775 - DNA, 22 bp, Homo sapiens
catgaacattcagaaatacagc

SEQ ID NO: 7452776 - DNA, 22 bp, Homo sapiens
catgaacattcagaaatacagc

SEQ ID NO: 7452777 - DNA, 22 bp, Homo sapiens
catgaacattcagaaatacagc

SEQ ID NO: 7452778 - DNA, 22 bp, Homo sapiens
catgaacattcagaaatacagc

SEQ ID NO: 7452779 - DNA, 22 bp, Homo sapiens
catgaacattgcagggatgtga

SEQ ID NO: 7452780 - DNA, 21 bp, Homo sapiens
catgaagaatcaagacccttg

SEQ ID NO: 7452781 - DNA, 22 bp, Homo sapiens
catgaacatttgtttacatctg

SEQ ID NO: 7452782 - DNA, 22 bp, Homo sapiens
catgaacatttgtttacatctg

SEQ ID NO: 7452783 - DNA, 22 bp, Homo sapiens
catgaagatcctgtatgttttt

SEQ ID NO: 7452784 - DNA, 22 bp, Homo sapiens
catgaagcatgttttgtcatga

SEQ ID NO: 7452785 - DNA, 22 bp, Homo sapiens
catgaagcacagctctcttttt

SEQ ID NO: 7452786 - DNA, 22 bp, Homo sapiens
catgaagcatgttttgtcatga

SEQ ID NO: 7452787 - DNA, 22 bp, Homo sapiens
catgaagcatgttttgtcatga

SEQ ID NO: 7452788 - DNA, 22 bp, Homo sapiens
catgaagccctcatcagtctga

SEQ ID NO: 7452789 - DNA, 22 bp, Homo sapiens
catgaagccctcatcagtctga

SEQ ID NO: 7452790 - DNA, 21 bp, Homo sapiens
catgaagccggttccctgttt

SEQ ID NO: 7452791 - DNA, 22 bp, Homo sapiens
catgaagctcttgcacctctag

SEQ ID NO: 7452792 - DNA, 22 bp, Homo sapiens
catgaagctcttgcacctctag

SEQ ID NO: 7452793 - DNA, 22 bp, Homo sapiens
catgaagcttgaagcagtccac

SEQ ID NO: 7452794 - DNA, 22 bp, Homo sapiens
catgaagcttgaagcagtccac

SEQ ID NO: 7452795 - DNA, 22 bp, Homo sapiens
tcagtcccttctccaggtcagc

SEQ ID NO: 7452796 - DNA, 22 bp, Homo sapiens
tcagtcccttaaaggtggcagc

SEQ ID NO: 7452797 - DNA, 22 bp, Homo sapiens
tcagtccctcgcaccctgccat

SEQ ID NO: 7452798 - DNA, 21 bp, Homo sapiens
tcagtccctgggtgtgtccca

SEQ ID NO: 7452799 - DNA, 22 bp, Homo sapiens
tcagtgccaattctgccatggg

SEQ ID NO: 7452800 - DNA, 22 bp, Homo sapiens
tcagtgccatgggcagacaggc

SEQ ID NO: 7452801 - DNA, 22 bp, Homo sapiens
tcagtgccagtttgctccttct

SEQ ID NO: 7452802 - DNA, 22 bp, Homo sapiens
tcagtgccagtttgctccttct

SEQ ID NO: 7452803 - DNA, 22 bp, Homo sapiens
tcagtgcattgttcattgtagg

SEQ ID NO: 7452804 - DNA, 22 bp, Homo sapiens
tcagtgccaattctgccatggg

SEQ ID NO: 7452805 - DNA, 22 bp, Homo sapiens
tcagtgcattgttcattgtagg

SEQ ID NO: 7452806 - DNA, 22 bp, Homo sapiens
tcagtgcattctaccaaaaggc

SEQ ID NO: 7452807 - DNA, 22 bp, Homo sapiens
tcagtgcattctaccaaaaggc

SEQ ID NO: 7452808 - DNA, 22 bp, Homo sapiens
tcagtccagctcctcatttccc

SEQ ID NO: 7452809 - DNA, 22 bp, Homo sapiens
tcagtccagctcctcatttccc

SEQ ID NO: 7452810 - DNA, 19 bp, Homo sapiens
tcagtccagctgtgaagac

SEQ ID NO: 7452811 - DNA, 19 bp, Homo sapiens
tcagtccagctgtgaagac

SEQ ID NO: 7452812 - DNA, 22 bp, Homo sapiens
tcagtccaggattgggagtgac

SEQ ID NO: 7452813 - DNA, 22 bp, Homo sapiens
tcagtccaggggctgtgatgtc

SEQ ID NO: 7452814 - DNA, 22 bp, Homo sapiens
tcagtccaggggctgtgatgtc

SEQ ID NO: 7452815 - DNA, 22 bp, Homo sapiens
tcagtccaggggctgtgatgtc

SEQ ID NO: 7452816 - DNA, 22 bp, Homo sapiens
tcagtccataggtgggcctgag

SEQ ID NO: 7452817 - DNA, 22 bp, Homo sapiens
tcagtccataggtgggcctgag

SEQ ID NO: 7452818 - DNA, 22 bp, Homo sapiens
tcagtccataggtgggcctgag

SEQ ID NO: 7452819 - DNA, 22 bp, Homo sapiens
tcagtccataggtgggcctgag

SEQ ID NO: 7452820 - DNA, 22 bp, Homo sapiens
tcagtcccaaggtcctgaggtg

SEQ ID NO: 7452821 - DNA, 22 bp, Homo sapiens
tcagtgctgctttatgacagtt

SEQ ID NO: 7452822 - DNA, 22 bp, Homo sapiens
tcagtgctgccatggcagggcc

SEQ ID NO: 7452823 - DNA, 22 bp, Homo sapiens
tcagtgctgccatggcagggcc

SEQ ID NO: 7452824 - DNA, 22 bp, Homo sapiens
tcagtgctctgaggtccagggt

SEQ ID NO: 7452825 - DNA, 22 bp, Homo sapiens
tcagtgctgagtagcgtgcacc

SEQ ID NO: 7452826 - DNA, 22 bp, Homo sapiens
tcagtgctctgaggtccagggt

SEQ ID NO: 7452827 - DNA, 22 bp, Homo sapiens
catctcacagcaaactgctgaa

SEQ ID NO: 7452828 - DNA, 22 bp, Homo sapiens
catctattttctgtgaggtatc

SEQ ID NO: 7452829 - DNA, 22 bp, Homo sapiens
catctattttctgtgaggtatc

SEQ ID NO: 7452830 - DNA, 22 bp, Homo sapiens
tcagtgctgctttatgacagtt

SEQ ID NO: 7452831 - DNA, 22 bp, Homo sapiens
tcagtgctgctttatgacagtt

SEQ ID NO: 7452832 - DNA, 22 bp, Homo sapiens
catctcagtgtacagggagtct

SEQ ID NO: 7452833 - DNA, 22 bp, Homo sapiens
catctcagtgtacagggagtct

SEQ ID NO: 7452834 - DNA, 21 bp, Homo sapiens
catctcagtgggttggtggat

SEQ ID NO: 7452835 - DNA, 22 bp, Homo sapiens
catctcaggtctgtggttcact

SEQ ID NO: 7452836 - DNA, 22 bp, Homo sapiens
catctcacttccctgcagcatc

SEQ ID NO: 7452837 - DNA, 22 bp, Homo sapiens
tcagtgcctactttgatcaatt

SEQ ID NO: 7452838 - DNA, 22 bp, Homo sapiens
tcagtgccatgggcagacaggc

SEQ ID NO: 7452839 - DNA, 22 bp, Homo sapiens
tcagtgcctactttgatcaatt

SEQ ID NO: 7452840 - DNA, 22 bp, Homo sapiens
tcagtgctaaaagagctggtgt

SEQ ID NO: 7452841 - DNA, 20 bp, Homo sapiens
tcagtgctcaggcaccaggt

SEQ ID NO: 7452842 - DNA, 20 bp, Homo sapiens
tcagtgctcaggcaccaggt

SEQ ID NO: 7452843 - DNA, 22 bp, Homo sapiens
tcagtgctcaggggagccgagg

SEQ ID NO: 7452844 - DNA, 22 bp, Homo sapiens
tcagtgctcctaaagtgaatgc

SEQ ID NO: 7452845 - DNA, 22 bp, Homo sapiens
tcagtgctcctaaagtgaatgc

SEQ ID NO: 7452846 - DNA, 22 bp, Homo sapiens
tcagtgctcctaaagtgaatgc

SEQ ID NO: 7452847 - DNA, 22 bp, Homo sapiens
tcagtgctcctaaagtgaatgc

SEQ ID NO: 7452848 - DNA, 19 bp, Homo sapiens
tcagtgctcctatgtcctt

SEQ ID NO: 7452849 - DNA, 19 bp, Homo sapiens
tcagtgctcctatgtcctt

SEQ ID NO: 7452850 - DNA, 22 bp, Homo sapiens
tcagtgctcctaaagtgaatgc

SEQ ID NO: 7452851 - DNA, 22 bp, Homo sapiens
tcagggagtagtttgtgctatg

SEQ ID NO: 7452852 - DNA, 22 bp, Homo sapiens
tcagggagtagtttgtgctatg

SEQ ID NO: 7452853 - DNA, 22 bp, Homo sapiens
tcagggaggtgtctgccagaga

SEQ ID NO: 7452854 - DNA, 22 bp, Homo sapiens
tcagggaggtgtctgccagaga

SEQ ID NO: 7452855 - DNA, 22 bp, Homo sapiens
tcagggaggtgtctgccagaga

SEQ ID NO: 7452856 - DNA, 22 bp, Homo sapiens
tcagggagggacctgaggctgg

SEQ ID NO: 7452857 - DNA, 22 bp, Homo sapiens
tcagggaggtgtctgccagaga

SEQ ID NO: 7452858 - DNA, 22 bp, Homo sapiens
tcagggaggtgtctgccagaga

SEQ ID NO: 7452859 - DNA, 22 bp, Homo sapiens
tcagggaggtgtctgccagaga

SEQ ID NO: 7452860 - DNA, 19 bp, Homo sapiens
tcagggagtttacagcatg

SEQ ID NO: 7452861 - DNA, 22 bp, Homo sapiens
tcagggagtgttggcaggatca

SEQ ID NO: 7452862 - DNA, 19 bp, Homo sapiens
tcagggagtttacagcatg

SEQ ID NO: 7452863 - DNA, 19 bp, Homo sapiens
tcagggagtttacagcatg

SEQ ID NO: 7452864 - DNA, 22 bp, Homo sapiens
tcagggagtgttggcaggatca

SEQ ID NO: 7452865 - DNA, 22 bp, Homo sapiens
tcagggagtgttggcaggatca

SEQ ID NO: 7452866 - DNA, 22 bp, Homo sapiens
tcagggagtgttggcaggatca

SEQ ID NO: 7452867 - DNA, 22 bp, Homo sapiens
tcagggagtagtttgtgctatg

SEQ ID NO: 7452868 - DNA, 22 bp, Homo sapiens
tcagggagtgttggcaggatca

SEQ ID NO: 7452869 - DNA, 22 bp, Homo sapiens
tcagggagtgttggcaggatca

SEQ ID NO: 7452870 - DNA, 22 bp, Homo sapiens
tcagggagtgttggcaggatca

SEQ ID NO: 7452871 - DNA, 22 bp, Homo sapiens
tcagggagatttggggactcaa

SEQ ID NO: 7452872 - DNA, 22 bp, Homo sapiens
tcagggagagtgacccatccac

SEQ ID NO: 7452873 - DNA, 22 bp, Homo sapiens
tcagggagatttggggactcaa

SEQ ID NO: 7452874 - DNA, 22 bp, Homo sapiens
tcagggagatttggggactcaa

SEQ ID NO: 7452875 - DNA, 22 bp, Homo sapiens
tcagggagatttggggactcaa

SEQ ID NO: 7452876 - DNA, 22 bp, Homo sapiens
tcagggagcctggacttcaagg

SEQ ID NO: 7452877 - DNA, 22 bp, Homo sapiens
tcagggagcctggacttcaagg

SEQ ID NO: 7452878 - DNA, 22 bp, Homo sapiens
tcagggagatttggggactcaa

SEQ ID NO: 7452879 - DNA, 22 bp, Homo sapiens
tcagggagatttggggactcaa

SEQ ID NO: 7452880 - DNA, 22 bp, Homo sapiens
tcagggagggacctgaggctgg

SEQ ID NO: 7452881 - DNA, 22 bp, Homo sapiens
tcagggagggacctgaggctgg

SEQ ID NO: 7452882 - DNA, 22 bp, Homo sapiens
tcagggagggacctgaggctgg

SEQ ID NO: 7452883 - DNA, 22 bp, Homo sapiens
tcagggagggacctgaggctgg

SEQ ID NO: 7452884 - DNA, 22 bp, Homo sapiens
tcagggagggacctgaggctgg

SEQ ID NO: 7452885 - DNA, 22 bp, Homo sapiens
tcagggagggacctgaggctgg

SEQ ID NO: 7452886 - DNA, 22 bp, Homo sapiens
tcagggagggacctgaggctgg

SEQ ID NO: 7452887 - DNA, 22 bp, Homo sapiens
tcagggagggacctgaggctgg

SEQ ID NO: 7452888 - DNA, 22 bp, Homo sapiens
tcagtcatctctgacagctagc

SEQ ID NO: 7452889 - DNA, 22 bp, Homo sapiens
tcagtccagccatcatttattc

SEQ ID NO: 7452890 - DNA, 22 bp, Homo sapiens
tcagtccactaagacccttgtt

SEQ ID NO: 7452891 - DNA, 22 bp, Homo sapiens
tcagtccactaagacccttgtt

SEQ ID NO: 7452892 - DNA, 22 bp, Homo sapiens
tcagtccactaagacccttgtt

SEQ ID NO: 7452893 - DNA, 20 bp, Homo sapiens
tcagtccaagcgaatgcccc

SEQ ID NO: 7452894 - DNA, 20 bp, Homo sapiens
tcagtccaagcgaatgcccc

SEQ ID NO: 7452895 - DNA, 22 bp, Homo sapiens
tcagtccaatgattgtaggaca

SEQ ID NO: 7452896 - DNA, 22 bp, Homo sapiens
tcagtccaatgattgtaggaca

SEQ ID NO: 7452897 - DNA, 22 bp, Homo sapiens
tcagtcacttttgcctgctaca

SEQ ID NO: 7452898 - DNA, 22 bp, Homo sapiens
tcagtcaggagatgccagagat

SEQ ID NO: 7452899 - DNA, 22 bp, Homo sapiens
tcagtcacttttgcctgctaca

SEQ ID NO: 7452900 - DNA, 22 bp, Homo sapiens
tcagtcaccaatgggaggagga

SEQ ID NO: 7452901 - DNA, 22 bp, Homo sapiens
tcagtcacttttgcctgctaca

SEQ ID NO: 7452902 - DNA, 19 bp, Homo sapiens
tcagtcatatatctgcacc

SEQ ID NO: 7452903 - DNA, 18 bp, Homo sapiens
tcagtcagtcctgtgaag

SEQ ID NO: 7452904 - DNA, 22 bp, Homo sapiens
tcagtcagtgcgcaagtggtta

SEQ ID NO: 7452905 - DNA, 22 bp, Homo sapiens
tcagtcatagtttggagagaat

SEQ ID NO: 7452906 - DNA, 18 bp, Homo sapiens
tcagtcagtcctgtgaag

SEQ ID NO: 7452907 - DNA, 22 bp, Homo sapiens
tcagtcaggagatgccagagat

SEQ ID NO: 7452908 - DNA, 22 bp, Homo sapiens
tcagtattgctagagttcactg

SEQ ID NO: 7452909 - DNA, 22 bp, Homo sapiens
tcagtattgctagagttcactg

SEQ ID NO: 7452910 - DNA, 22 bp, Homo sapiens
tcagggattaaggtcaaaggtg

SEQ ID NO: 7452911 - DNA, 21 bp, Homo sapiens
tcagggatggctgtacaatgg

SEQ ID NO: 7452912 - DNA, 22 bp, Homo sapiens
tcagggattgcaaaattcatcc

SEQ ID NO: 7452913 - DNA, 22 bp, Homo sapiens
tcagggattgcaaaattcatcc

SEQ ID NO: 7452914 - DNA, 22 bp, Homo sapiens
tcagggattgcaaaattcatcc

SEQ ID NO: 7452915 - DNA, 22 bp, Homo sapiens
tcagggattgcaaaattcatcc

SEQ ID NO: 7452916 - DNA, 22 bp, Homo sapiens
tcagtcaccttgactatagctg

SEQ ID NO: 7452917 - DNA, 22 bp, Homo sapiens
tcagtcaccttgactatagctg

SEQ ID NO: 7452918 - DNA, 22 bp, Homo sapiens
tcagtcaccaatgggaggagga

SEQ ID NO: 7452919 - DNA, 22 bp, Homo sapiens
tcagtcacactcactgaggtag

SEQ ID NO: 7452920 - DNA, 22 bp, Homo sapiens
tcagtcacactcactgaggtag

SEQ ID NO: 7452921 - DNA, 22 bp, Homo sapiens
tcagtcaaggaaaaatacctcc

SEQ ID NO: 7452922 - DNA, 22 bp, Homo sapiens
tcagtcaatgtgtcagctctcc

SEQ ID NO: 7452923 - DNA, 22 bp, Homo sapiens
tcagtatttctaaacattggct

SEQ ID NO: 7452924 - DNA, 22 bp, Homo sapiens
catgacagtcctgaagagaacg

SEQ ID NO: 7452925 - DNA, 22 bp, Homo sapiens
catgacagtcctgaagagaacg

SEQ ID NO: 7452926 - DNA, 22 bp, Homo sapiens
catgacagtcctgaagagaacg

SEQ ID NO: 7452927 - DNA, 22 bp, Homo sapiens
catgacagatgcaaaggattgg

SEQ ID NO: 7452928 - DNA, 22 bp, Homo sapiens
catgacatctgcttagtatgaa

SEQ ID NO: 7452929 - DNA, 22 bp, Homo sapiens
catgacatctgcttagtatgaa

SEQ ID NO: 7452930 - DNA, 22 bp, Homo sapiens
catgacagatgcaaaggattgg

SEQ ID NO: 7452931 - DNA, 20 bp, Homo sapiens
catgacactgttcctctgcc

SEQ ID NO: 7452932 - DNA, 20 bp, Homo sapiens
catgacactgttcctctgcc

SEQ ID NO: 7452933 - DNA, 22 bp, Homo sapiens
catgacagatgcaaaggattgg

SEQ ID NO: 7452934 - DNA, 22 bp, Homo sapiens
catgactgtgttagaagaatga

SEQ ID NO: 7452935 - DNA, 22 bp, Homo sapiens
catgagaaccaggtctgtgttt

SEQ ID NO: 7452936 - DNA, 22 bp, Homo sapiens
catgactgtgttagaagaatga

SEQ ID NO: 7452937 - DNA, 22 bp, Homo sapiens
catgaccctgaccctgtgctcc

SEQ ID NO: 7452938 - DNA, 22 bp, Homo sapiens
catgaccccccaaggcctgcag

SEQ ID NO: 7452939 - DNA, 22 bp, Homo sapiens
catgaccccccaaggcctgcag

SEQ ID NO: 7452940 - DNA, 22 bp, Homo sapiens
catgaccccccaaggcctgcag

SEQ ID NO: 7452941 - DNA, 22 bp, Homo sapiens
catgacccatttttcttgctgt

SEQ ID NO: 7452942 - DNA, 22 bp, Homo sapiens
catgacattttaaaaagaacat

SEQ ID NO: 7452943 - DNA, 22 bp, Homo sapiens
catgacattttaaaaagaacat

SEQ ID NO: 7452944 - DNA, 22 bp, Homo sapiens
catgaccaaaatcattacactg

SEQ ID NO: 7452945 - DNA, 22 bp, Homo sapiens
catgaccaaaatcattacactg

SEQ ID NO: 7452946 - DNA, 22 bp, Homo sapiens
catgacatcctgaagctgcaca

SEQ ID NO: 7452947 - DNA, 22 bp, Homo sapiens
catgcacactgcaacaaggact

SEQ ID NO: 7452948 - DNA, 22 bp, Homo sapiens
catgcaggcctatggagcagtg

SEQ ID NO: 7452949 - DNA, 22 bp, Homo sapiens
catgcacacacgtgcatgtacg

SEQ ID NO: 7452950 - DNA, 22 bp, Homo sapiens
catgcacacacgtgcatgtacg

SEQ ID NO: 7452951 - DNA, 22 bp, Homo sapiens
catgcacacacgtgcatgtacg

SEQ ID NO: 7452952 - DNA, 22 bp, Homo sapiens
catgcacacacgtgcatgtacg

SEQ ID NO: 7452953 - DNA, 22 bp, Homo sapiens
catgcacacacgtgcatgtacg

SEQ ID NO: 7452954 - DNA, 22 bp, Homo sapiens
catgcacacacagttctaatta

SEQ ID NO: 7452955 - DNA, 22 bp, Homo sapiens
catgagaaggggtggagttaga

SEQ ID NO: 7452956 - DNA, 22 bp, Homo sapiens
catgcacacacagttctaatta

SEQ ID NO: 7452957 - DNA, 20 bp, Homo sapiens
catgagaagggcagtgtgag

SEQ ID NO: 7452958 - DNA, 20 bp, Homo sapiens
catgagaagggcagtgtgag

SEQ ID NO: 7452959 - DNA, 22 bp, Homo sapiens
catgaatttttctgtgggttaa

SEQ ID NO: 7452960 - DNA, 22 bp, Homo sapiens
catgaatttttctgtgggttaa

SEQ ID NO: 7452961 - DNA, 22 bp, Homo sapiens
catgaatttatattattagtga

SEQ ID NO: 7452962 - DNA, 22 bp, Homo sapiens
catgaattttaagactgttttt

SEQ ID NO: 7452963 - DNA, 22 bp, Homo sapiens
catgaattttaagactgttttt

SEQ ID NO: 7452964 - DNA, 22 bp, Homo sapiens
catgaatttatattattagtga

SEQ ID NO: 7452965 - DNA, 22 bp, Homo sapiens
catgaatttatattattagtga

SEQ ID NO: 7452966 - DNA, 22 bp, Homo sapiens
catgaatttatattattagtga

SEQ ID NO: 7452967 - DNA, 22 bp, Homo sapiens
catgaatttatattattagtga

SEQ ID NO: 7452968 - DNA, 22 bp, Homo sapiens
catgaattatttttcacaagat

SEQ ID NO: 7452969 - DNA, 22 bp, Homo sapiens
catgaattatttttcacaagat

SEQ ID NO: 7452970 - DNA, 22 bp, Homo sapiens
catgaattatttttcacaagat

SEQ ID NO: 7452971 - DNA, 22 bp, Homo sapiens
catgaattatttttcacaagat

SEQ ID NO: 7452972 - DNA, 22 bp, Homo sapiens
catgaattatttttcacaagat

SEQ ID NO: 7452973 - DNA, 22 bp, Homo sapiens
catgaattatttttcacaagat

SEQ ID NO: 7452974 - DNA, 22 bp, Homo sapiens
catgacacctaccatattaagt

SEQ ID NO: 7452975 - DNA, 22 bp, Homo sapiens
catgacacctaccatattaagt

SEQ ID NO: 7452976 - DNA, 22 bp, Homo sapiens
catgacacccaggcatagcacc

SEQ ID NO: 7452977 - DNA, 22 bp, Homo sapiens
catgacaataagccagcagaaa

SEQ ID NO: 7452978 - DNA, 22 bp, Homo sapiens
catgacaatatgttctttcatt

SEQ ID NO: 7452979 - DNA, 23 bp, Homo sapiens
catgacaaaggatctcatgggcc

SEQ ID NO: 7452980 - DNA, 23 bp, Homo sapiens
catgacaaaggatctcatgggcc

SEQ ID NO: 7452981 - DNA, 22 bp, Homo sapiens
catgacaaataaacctttgcca

SEQ ID NO: 7452982 - DNA, 22 bp, Homo sapiens
catgacaaatcagaggggcttg

SEQ ID NO: 7452983 - DNA, 22 bp, Homo sapiens
catgacaaatcagaggggcttg

SEQ ID NO: 7452984 - DNA, 22 bp, Homo sapiens
catgacaataagccagcagaaa

SEQ ID NO: 7452985 - DNA, 22 bp, Homo sapiens
catgacaataagccagcagaaa

SEQ ID NO: 7452986 - DNA, 22 bp, Homo sapiens
catgacaataagccagcagaaa

SEQ ID NO: 7452987 - DNA, 22 bp, Homo sapiens
catgaaggctgccagcaggcat

SEQ ID NO: 7452988 - DNA, 22 bp, Homo sapiens
catgaaggctgccagcaggcat

SEQ ID NO: 7452989 - DNA, 22 bp, Homo sapiens
catgaaggaattaaggtaagga

SEQ ID NO: 7452990 - DNA, 22 bp, Homo sapiens
catgaagtcactggagctttca

SEQ ID NO: 7452991 - DNA, 22 bp, Homo sapiens
catgaagtcactggagctttca

SEQ ID NO: 7452992 - DNA, 22 bp, Homo sapiens
catgaagtcaggatttccatga

SEQ ID NO: 7452993 - DNA, 22 bp, Homo sapiens
catgaatatacatcctgatggc

SEQ ID NO: 7452994 - DNA, 22 bp, Homo sapiens
catgaatatttagtatttactt

SEQ ID NO: 7452995 - DNA, 22 bp, Homo sapiens
catgaatgagtaatttacaaag

SEQ ID NO: 7452996 - DNA, 22 bp, Homo sapiens
catgaatgctgggttcatgtaa

SEQ ID NO: 7452997 - DNA, 22 bp, Homo sapiens
catgaatgctgggttcatgtaa

SEQ ID NO: 7452998 - DNA, 22 bp, Homo sapiens
catgaattagcaatggtgtgca

SEQ ID NO: 7452999 - DNA, 22 bp, Homo sapiens
catgaatacggatgctcggaga

SEQ ID NO: 7453000 - DNA, 22 bp, Homo sapiens
catgaatatacatcctgatggc

SEQ ID NO: 7453001 - DNA, 22 bp, Homo sapiens
catgaatatttagtatttactt

SEQ ID NO: 7453002 - DNA, 22 bp, Homo sapiens
catgcaggttatatgtgcttct

SEQ ID NO: 7453003 - DNA, 22 bp, Homo sapiens
catgcaggttatatgtgcttct

SEQ ID NO: 7453004 - DNA, 22 bp, Homo sapiens
catgcagtattcaggacagttc

SEQ ID NO: 7453005 - DNA, 22 bp, Homo sapiens
catgcagtcaataaacatgtgt

SEQ ID NO: 7453006 - DNA, 22 bp, Homo sapiens
catgcagtgatgcactgcatca

SEQ ID NO: 7453007 - DNA, 22 bp, Homo sapiens
catgcagtgactcagacacagg

SEQ ID NO: 7453008 - DNA, 22 bp, Homo sapiens
catgcagtgactcagacacagg

SEQ ID NO: 7453009 - DNA, 22 bp, Homo sapiens
catgcagtgactcagacacagg

SEQ ID NO: 7453010 - DNA, 22 bp, Homo sapiens
catgcagtgactcagacacagg

SEQ ID NO: 7453011 - DNA, 22 bp, Homo sapiens
catgcagtctggagccttctgt

SEQ ID NO: 7453012 - DNA, 22 bp, Homo sapiens
catgcagtctggagccttctgt

SEQ ID NO: 7453013 - DNA, 22 bp, Homo sapiens
catgcagtctggagccttctgt

SEQ ID NO: 7453014 - DNA, 22 bp, Homo sapiens
catgcaggtgaccaggtgtggg

SEQ ID NO: 7453015 - DNA, 22 bp, Homo sapiens
catgcagggagcagaggagaca

SEQ ID NO: 7453016 - DNA, 22 bp, Homo sapiens
catgcaggtctggagcttgggg

SEQ ID NO: 7453017 - DNA, 22 bp, Homo sapiens
catgcagggactagagaacagg

SEQ ID NO: 7453018 - DNA, 22 bp, Homo sapiens
catgcagggactagagaacagg

SEQ ID NO: 7453019 - DNA, 22 bp, Homo sapiens
catgcagggacttgtgctccat

SEQ ID NO: 7453020 - DNA, 22 bp, Homo sapiens
catgcagggacttgtgctccat

SEQ ID NO: 7453021 - DNA, 22 bp, Homo sapiens
catgcagggagcagaggagaca

SEQ ID NO: 7453022 - DNA, 22 bp, Homo sapiens
catgcatatatgctacatgcaa

SEQ ID NO: 7453023 - DNA, 22 bp, Homo sapiens
catgcatatgtcaaaaaagcta

SEQ ID NO: 7453024 - DNA, 22 bp, Homo sapiens
catgcatatgtcaaaaaagcta

SEQ ID NO: 7453025 - DNA, 22 bp, Homo sapiens
catgcatatgtcaaaaaagcta

SEQ ID NO: 7453026 - DNA, 22 bp, Homo sapiens
catgcatatgtcaaaaaagcta

SEQ ID NO: 7453027 - DNA, 22 bp, Homo sapiens
catgcatatatgctacatgcaa

SEQ ID NO: 7453028 - DNA, 22 bp, Homo sapiens
catgcatattactagcacagca

SEQ ID NO: 7453029 - DNA, 22 bp, Homo sapiens
catgcatattactagcacagca

SEQ ID NO: 7453030 - DNA, 22 bp, Homo sapiens
catgcatatgtcaaaaaagcta

SEQ ID NO: 7453031 - DNA, 22 bp, Homo sapiens
catgcataggaaatgttttttg

SEQ ID NO: 7453032 - DNA, 22 bp, Homo sapiens
catgcataggaaatgttttttg

SEQ ID NO: 7453033 - DNA, 22 bp, Homo sapiens
catgcatagctttggagctagg

SEQ ID NO: 7453034 - DNA, 22 bp, Homo sapiens
catgcatagctttggagctagg

SEQ ID NO: 7453035 - DNA, 22 bp, Homo sapiens
catgcatagctttggagctagg

SEQ ID NO: 7453036 - DNA, 22 bp, Homo sapiens
catgcatagtttttctagaagg

SEQ ID NO: 7453037 - DNA, 22 bp, Homo sapiens
catgcatatatgctacatgcaa

SEQ ID NO: 7453038 - DNA, 22 bp, Homo sapiens
catgcatagtttttctagaagg

SEQ ID NO: 7453039 - DNA, 22 bp, Homo sapiens
catgcatgccgggctgacagag

SEQ ID NO: 7453040 - DNA, 22 bp, Homo sapiens
catgcatgccgggctgacagag

SEQ ID NO: 7453041 - DNA, 22 bp, Homo sapiens
catgcatgccgggctgacagag

SEQ ID NO: 7453042 - DNA, 21 bp, Homo sapiens
catgcatacatatacaagctt

SEQ ID NO: 7453043 - DNA, 20 bp, Homo sapiens
catgcatgacactggaaagg

SEQ ID NO: 7453044 - DNA, 20 bp, Homo sapiens
catgcatgacactggaaagg

SEQ ID NO: 7453045 - DNA, 22 bp, Homo sapiens
catgcatattactagcacagca

SEQ ID NO: 7453046 - DNA, 22 bp, Homo sapiens
catgcatattactagcacagca

SEQ ID NO: 7453047 - DNA, 22 bp, Homo sapiens
catgcatattactagcacagca

SEQ ID NO: 7453048 - DNA, 22 bp, Homo sapiens
catgcatcagaatcacctagag

SEQ ID NO: 7453049 - DNA, 22 bp, Homo sapiens
catgcatcagaatcacctagag

SEQ ID NO: 7453050 - DNA, 22 bp, Homo sapiens
catgcatcgatgaatgcgtggg

SEQ ID NO: 7453051 - DNA, 22 bp, Homo sapiens
catgcagtttctctatgcgtag

SEQ ID NO: 7453052 - DNA, 22 bp, Homo sapiens
catgcatacacaggtcaggcag

SEQ ID NO: 7453053 - DNA, 22 bp, Homo sapiens
catgcatacacaggtcaggcag

SEQ ID NO: 7453054 - DNA, 22 bp, Homo sapiens
catgcatagaatgaagaggctg

SEQ ID NO: 7453055 - DNA, 22 bp, Homo sapiens
catgcatagaatgaagaggctg

SEQ ID NO: 7453056 - DNA, 22 bp, Homo sapiens
catgcatagaatgaagaggctg

SEQ ID NO: 7453057 - DNA, 21 bp, Homo sapiens
catgcatacatatacaagctt

SEQ ID NO: 7453058 - DNA, 16 bp, Homo sapiens
catgcataaacgatgg

SEQ ID NO: 7453059 - DNA, 16 bp, Homo sapiens
catgcataaacgatgg

SEQ ID NO: 7453060 - DNA, 22 bp, Homo sapiens
catgcatacacaggtcaggcag

SEQ ID NO: 7453061 - DNA, 22 bp, Homo sapiens
catgcatagagcagaacttggc

SEQ ID NO: 7453062 - DNA, 22 bp, Homo sapiens
catgcatagagcagaacttggc

SEQ ID NO: 7453063 - DNA, 22 bp, Homo sapiens
catgcatagccagcattgtatg

SEQ ID NO: 7453064 - DNA, 22 bp, Homo sapiens
catgcatagccagcattgtatg

SEQ ID NO: 7453065 - DNA, 22 bp, Homo sapiens
catgcatagccagcattgtatg

SEQ ID NO: 7453066 - DNA, 22 bp, Homo sapiens
catgcagtgctttgcgccgggc

SEQ ID NO: 7453067 - DNA, 22 bp, Homo sapiens
catgcagtggtaaaaagtcagg

SEQ ID NO: 7453068 - DNA, 22 bp, Homo sapiens
catgcagtggtaaaaagtcagg

SEQ ID NO: 7453069 - DNA, 22 bp, Homo sapiens
catgcagtggtaaaaagtcagg

SEQ ID NO: 7453070 - DNA, 22 bp, Homo sapiens
catgcagttgaagcacagagag

SEQ ID NO: 7453071 - DNA, 22 bp, Homo sapiens
catgcagttgaagcacagagag

SEQ ID NO: 7453072 - DNA, 22 bp, Homo sapiens
catgcagttgaagcacagagag

SEQ ID NO: 7453073 - DNA, 22 bp, Homo sapiens
catgcatgcctggctcacagag

SEQ ID NO: 7453074 - DNA, 22 bp, Homo sapiens
catgcatgcctggctcacagag

SEQ ID NO: 7453075 - DNA, 22 bp, Homo sapiens
catgcatgcctggctcacagag

SEQ ID NO: 7453076 - DNA, 22 bp, Homo sapiens
catgcatggagctcaccctccc

SEQ ID NO: 7453077 - DNA, 22 bp, Homo sapiens
catgcatggtcatgctgggact

SEQ ID NO: 7453078 - DNA, 22 bp, Homo sapiens
catgcatggtcatgctgggact

SEQ ID NO: 7453079 - DNA, 22 bp, Homo sapiens
catgcatgtgcagaaaggggtt

SEQ ID NO: 7453080 - DNA, 22 bp, Homo sapiens
catgcatgtgcagaaaggggtt

SEQ ID NO: 7453081 - DNA, 22 bp, Homo sapiens
catgcatgtcagggatcctgga

SEQ ID NO: 7453082 - DNA, 22 bp, Homo sapiens
catgcatgtcagggatcctgga

SEQ ID NO: 7453083 - DNA, 22 bp, Homo sapiens
catgcatgtttactacagtgac

SEQ ID NO: 7453084 - DNA, 22 bp, Homo sapiens
catgcatgtttactacagtgac

SEQ ID NO: 7453085 - DNA, 22 bp, Homo sapiens
catgcattcagaatctctcaca

SEQ ID NO: 7453086 - DNA, 22 bp, Homo sapiens
catgcattacaattgcatagta

SEQ ID NO: 7453087 - DNA, 22 bp, Homo sapiens
catgcatgtttactacagtgac

SEQ ID NO: 7453088 - DNA, 22 bp, Homo sapiens
catgcatggtcatgctgggact

SEQ ID NO: 7453089 - DNA, 22 bp, Homo sapiens
catgcattacaattgcatagta

SEQ ID NO: 7453090 - DNA, 22 bp, Homo sapiens
catgcattcctcctctgcctta

SEQ ID NO: 7453091 - DNA, 22 bp, Homo sapiens
catgcattcagaatctctcaca

SEQ ID NO: 7453092 - DNA, 22 bp, Homo sapiens
catgcattgtaatttttagtct

SEQ ID NO: 7453093 - DNA, 22 bp, Homo sapiens
catgcattcctcctctgcctta

SEQ ID NO: 7453094 - DNA, 22 bp, Homo sapiens
catgcattcctcctctgcctta

SEQ ID NO: 7453095 - DNA, 22 bp, Homo sapiens
catggaaggcaaaagacacaga

SEQ ID NO: 7453096 - DNA, 22 bp, Homo sapiens
catggaaggcaaaagacacaga

SEQ ID NO: 7453097 - DNA, 22 bp, Homo sapiens
catggcagagaaggggaactgg

SEQ ID NO: 7453098 - DNA, 22 bp, Homo sapiens
catggaaggcaaaagacacaga

SEQ ID NO: 7453099 - DNA, 22 bp, Homo sapiens
catggaaggcaaaagacacaga

SEQ ID NO: 7453100 - DNA, 22 bp, Homo sapiens
catggcagagaaggggaactgg

SEQ ID NO: 7453101 - DNA, 22 bp, Homo sapiens
catggcagagcctgcaggtggg

SEQ ID NO: 7453102 - DNA, 22 bp, Homo sapiens
catggcagagcctgcaggtggg

SEQ ID NO: 7453103 - DNA, 22 bp, Homo sapiens
catggcagagcctgcaggtggg

SEQ ID NO: 7453104 - DNA, 22 bp, Homo sapiens
catggcagagcctgcaggtggg

SEQ ID NO: 7453105 - DNA, 22 bp, Homo sapiens
catgcatttctaccaaggaata

SEQ ID NO: 7453106 - DNA, 22 bp, Homo sapiens
catgcattgtaatttttagtct

SEQ ID NO: 7453107 - DNA, 22 bp, Homo sapiens
catgcatttctaccaaggaata

SEQ ID NO: 7453108 - DNA, 22 bp, Homo sapiens
catgcatttggagttttcaagt

SEQ ID NO: 7453109 - DNA, 22 bp, Homo sapiens
catgcatttctaccaaggaata

SEQ ID NO: 7453110 - DNA, 22 bp, Homo sapiens
catgcatttggagttttcaagt

SEQ ID NO: 7453111 - DNA, 22 bp, Homo sapiens
catggaactgtataaaggcact

SEQ ID NO: 7453112 - DNA, 22 bp, Homo sapiens
catgcatttggagttttcaagt

SEQ ID NO: 7453113 - DNA, 22 bp, Homo sapiens
catgcattttctattcactcag

SEQ ID NO: 7453114 - DNA, 22 bp, Homo sapiens
catggaaggcaaaagacacaga

SEQ ID NO: 7453115 - DNA, 22 bp, Homo sapiens
catggaactgtataaaggcact

SEQ ID NO: 7453116 - DNA, 22 bp, Homo sapiens
catggaactgtgctgaaaagtg

SEQ ID NO: 7453117 - DNA, 22 bp, Homo sapiens
catggaacttcaagaagaaagc

SEQ ID NO: 7453118 - DNA, 22 bp, Homo sapiens
catggcagctttgggaggagga

SEQ ID NO: 7453119 - DNA, 22 bp, Homo sapiens
catggcagctttgggaggagga

SEQ ID NO: 7453120 - DNA, 22 bp, Homo sapiens
catggcagctttgggaggagga

SEQ ID NO: 7453121 - DNA, 22 bp, Homo sapiens
catggcagctttgggaggagga

SEQ ID NO: 7453122 - DNA, 22 bp, Homo sapiens
catggcagctttgggaggagga

SEQ ID NO: 7453123 - DNA, 22 bp, Homo sapiens
catggcagctttgggaggagga

SEQ ID NO: 7453124 - DNA, 22 bp, Homo sapiens
catggcagctcctccagtgtga

SEQ ID NO: 7453125 - DNA, 22 bp, Homo sapiens
catggcagctttgggaggagga

SEQ ID NO: 7453126 - DNA, 22 bp, Homo sapiens
catggcaggaaaatgaacaggc

SEQ ID NO: 7453127 - DNA, 22 bp, Homo sapiens
catggcaggaaaatgaacaggc

SEQ ID NO: 7453128 - DNA, 22 bp, Homo sapiens
catggcagctttgggaggagga

SEQ ID NO: 7453129 - DNA, 22 bp, Homo sapiens
catggcaggaaggacatgcact

SEQ ID NO: 7453130 - DNA, 22 bp, Homo sapiens
catggcaggaaggacatgcact

SEQ ID NO: 7453131 - DNA, 22 bp, Homo sapiens
catggcaggaaggacatgcact

SEQ ID NO: 7453132 - DNA, 22 bp, Homo sapiens
catggcaggaaggacatgcact

SEQ ID NO: 7453133 - DNA, 22 bp, Homo sapiens
catggcaggaaggacatgcact

SEQ ID NO: 7453134 - DNA, 22 bp, Homo sapiens
catggcaggaaggacatgcact

SEQ ID NO: 7453135 - DNA, 22 bp, Homo sapiens
catggcaggaaaatgaacaggc

SEQ ID NO: 7453136 - DNA, 22 bp, Homo sapiens
catggcaggaaaatgaacaggc

SEQ ID NO: 7453137 - DNA, 22 bp, Homo sapiens
catggcaggaaaatgaacaggc

SEQ ID NO: 7453138 - DNA, 22 bp, Homo sapiens
catggcaggaaaatgaacaggc

SEQ ID NO: 7453139 - DNA, 23 bp, Homo sapiens
catggcagcaagagctcatggcc

SEQ ID NO: 7453140 - DNA, 23 bp, Homo sapiens
catggcagcaagagctcatggcc

SEQ ID NO: 7453141 - DNA, 22 bp, Homo sapiens
catggcagcaattttcctgact

SEQ ID NO: 7453142 - DNA, 23 bp, Homo sapiens
catggcagcaagagctcatggcc

SEQ ID NO: 7453143 - DNA, 22 bp, Homo sapiens
catggcagcctgccctgcttgc

SEQ ID NO: 7453144 - DNA, 22 bp, Homo sapiens
catggcagcctgccctgcttgc

SEQ ID NO: 7453145 - DNA, 22 bp, Homo sapiens
catggcagctcctccagtgtga

SEQ ID NO: 7453146 - DNA, 22 bp, Homo sapiens
catggcagctcctccagtgtga

SEQ ID NO: 7453147 - DNA, 22 bp, Homo sapiens
catggcagctcctccagtgtga

SEQ ID NO: 7453148 - DNA, 22 bp, Homo sapiens
catggcagcctgccctgcttgc

SEQ ID NO: 7453149 - DNA, 22 bp, Homo sapiens
catggcagcctgccctgcttgc

SEQ ID NO: 7453150 - DNA, 22 bp, Homo sapiens
catggcagagcctgcaggtggg

SEQ ID NO: 7453151 - DNA, 22 bp, Homo sapiens
catggcagagcctgcaggtggg

SEQ ID NO: 7453152 - DNA, 22 bp, Homo sapiens
catggcagagcctgcaggtggg

SEQ ID NO: 7453153 - DNA, 22 bp, Homo sapiens
catggcagagcctgcaggtggg

SEQ ID NO: 7453154 - DNA, 23 bp, Homo sapiens
catggcagcaagagctcatggcc

SEQ ID NO: 7453155 - DNA, 23 bp, Homo sapiens
catggcagcaagagctcatggcc

SEQ ID NO: 7453156 - DNA, 23 bp, Homo sapiens
catggcagcaagagctcatggcc

SEQ ID NO: 7453157 - DNA, 23 bp, Homo sapiens
catggcagcaagagctcatggcc

SEQ ID NO: 7453158 - DNA, 22 bp, Homo sapiens
catggcagagcctgcaggtggg

SEQ ID NO: 7453159 - DNA, 22 bp, Homo sapiens
catggcagggctgtgggcaggt

SEQ ID NO: 7453160 - DNA, 22 bp, Homo sapiens
catggcagggctgtgggcaggt

SEQ ID NO: 7453161 - DNA, 22 bp, Homo sapiens
catggcagggctgtgggcaggt

SEQ ID NO: 7453162 - DNA, 22 bp, Homo sapiens
catggcagggctgtgggcaggt

SEQ ID NO: 7453163 - DNA, 22 bp, Homo sapiens
catggcaggatctgggcccaca

SEQ ID NO: 7453164 - DNA, 22 bp, Homo sapiens
catggcaggatctgggcccaca

SEQ ID NO: 7453165 - DNA, 22 bp, Homo sapiens
catggcaggcttcttcagcctt

SEQ ID NO: 7453166 - DNA, 22 bp, Homo sapiens
catggcaggatctgggcccaca

SEQ ID NO: 7453167 - DNA, 22 bp, Homo sapiens
catggcaggaggctgctggcag

SEQ ID NO: 7453168 - DNA, 22 bp, Homo sapiens
catggcaggatctgggcccaca

SEQ ID NO: 7453169 - DNA, 22 bp, Homo sapiens
catggcaggatctgggcccaca

SEQ ID NO: 7453170 - DNA, 22 bp, Homo sapiens
catggcaggatctgggcccaca

SEQ ID NO: 7453171 - DNA, 22 bp, Homo sapiens
catggcaggaaggacatgcact

SEQ ID NO: 7453172 - DNA, 22 bp, Homo sapiens
catggcaggaggctgctggcag

SEQ ID NO: 7453173 - DNA, 22 bp, Homo sapiens
catggcaggaggctgctggcag

SEQ ID NO: 7453174 - DNA, 22 bp, Homo sapiens
catggcaggaaggacatgcact

SEQ ID NO: 7453175 - DNA, 22 bp, Homo sapiens
catggcaggaaggacatgcact

SEQ ID NO: 7453176 - DNA, 22 bp, Homo sapiens
catggcaggaggctgctggcag

SEQ ID NO: 7453177 - DNA, 22 bp, Homo sapiens
catggcaggaggctgctggcag

SEQ ID NO: 7453178 - DNA, 22 bp, Homo sapiens
catggcaggaggctgctggcag

SEQ ID NO: 7453179 - DNA, 22 bp, Homo sapiens
catggcaggaggctgctggcag

SEQ ID NO: 7453180 - DNA, 22 bp, Homo sapiens
catggcagtgattcagcctttg

SEQ ID NO: 7453181 - DNA, 22 bp, Homo sapiens
catggcagtgattcagcctttg

SEQ ID NO: 7453182 - DNA, 22 bp, Homo sapiens
catggcagtgattcagcctttg

SEQ ID NO: 7453183 - DNA, 22 bp, Homo sapiens
catggcagtgattcagcctttg

SEQ ID NO: 7453184 - DNA, 22 bp, Homo sapiens
catggcagtgattcagcctttg

SEQ ID NO: 7453185 - DNA, 22 bp, Homo sapiens
catggcattgcataacggggct

SEQ ID NO: 7453186 - DNA, 22 bp, Homo sapiens
catggcattgcataacggggct

SEQ ID NO: 7453187 - DNA, 22 bp, Homo sapiens
catggcagtgattcagcctttg

SEQ ID NO: 7453188 - DNA, 22 bp, Homo sapiens
catggcagggctgtgggcaggt

SEQ ID NO: 7453189 - DNA, 22 bp, Homo sapiens
catggcagggctgtgggcaggt

SEQ ID NO: 7453190 - DNA, 22 bp, Homo sapiens
catggcaggtgcagattctgtg

SEQ ID NO: 7453191 - DNA, 22 bp, Homo sapiens
catggcaggtgcagattctgtg

SEQ ID NO: 7453192 - DNA, 22 bp, Homo sapiens
catggcaggtgcagattctgtg

SEQ ID NO: 7453193 - DNA, 22 bp, Homo sapiens
catggcagggctgtgggcaggt

SEQ ID NO: 7453194 - DNA, 22 bp, Homo sapiens
catggcagggctgtgggcaggt

SEQ ID NO: 7453195 - DNA, 22 bp, Homo sapiens
catggcagggctgtgggcaggt

SEQ ID NO: 7453196 - DNA, 22 bp, Homo sapiens
catggcagggctgtgggcaggt

SEQ ID NO: 7453197 - DNA, 22 bp, Homo sapiens
catggcagggctgtgggcaggt

SEQ ID NO: 7453198 - DNA, 23 bp, Homo sapiens
tccaggagaattccagggcccgg

SEQ ID NO: 7453199 - DNA, 23 bp, Homo sapiens
tccaggagaattccagggcccgg

SEQ ID NO: 7453200 - DNA, 23 bp, Homo sapiens
tccaggagaattccagggcccgg

SEQ ID NO: 7453201 - DNA, 22 bp, Homo sapiens
tccaggagaaggccatccagcg

SEQ ID NO: 7453202 - DNA, 22 bp, Homo sapiens
tccaggagaaggccatccagcg

SEQ ID NO: 7453203 - DNA, 22 bp, Homo sapiens
tccaggagaaggccatccagcg

SEQ ID NO: 7453204 - DNA, 22 bp, Homo sapiens
tccaggagaaggccatccagcg

SEQ ID NO: 7453205 - DNA, 22 bp, Homo sapiens
tccaggagaaggccatccagcg

SEQ ID NO: 7453206 - DNA, 22 bp, Homo sapiens
tccaggagaaggccatccagcg

SEQ ID NO: 7453207 - DNA, 22 bp, Homo sapiens
tccagctggggacatgggcttc

SEQ ID NO: 7453208 - DNA, 22 bp, Homo sapiens
tccagctggggacatgggcttc

SEQ ID NO: 7453209 - DNA, 22 bp, Homo sapiens
tccagctggggacatgggcttc

SEQ ID NO: 7453210 - DNA, 20 bp, Homo sapiens
tccagctgggaacagctgat

SEQ ID NO: 7453211 - DNA, 22 bp, Homo sapiens
tccaggagaaggccatccagcg

SEQ ID NO: 7453212 - DNA, 22 bp, Homo sapiens
tccaggagaaggccatccagcg

SEQ ID NO: 7453213 - DNA, 22 bp, Homo sapiens
tccaggagaaggccatccagcg

SEQ ID NO: 7453214 - DNA, 22 bp, Homo sapiens
tccagctggggacatgggcttc

SEQ ID NO: 7453215 - DNA, 22 bp, Homo sapiens
catggccagcccccagttcctc

SEQ ID NO: 7453216 - DNA, 20 bp, Homo sapiens
tccagctgggaacagctgat

SEQ ID NO: 7453217 - DNA, 20 bp, Homo sapiens
tccagctgggaacagctgat

SEQ ID NO: 7453218 - DNA, 22 bp, Homo sapiens
catggccacatctagctgcaag

SEQ ID NO: 7453219 - DNA, 22 bp, Homo sapiens
catggccacattggaccgaagc

SEQ ID NO: 7453220 - DNA, 22 bp, Homo sapiens
catggccacatgataatcaagt

SEQ ID NO: 7453221 - DNA, 22 bp, Homo sapiens
catggccacatctagctgcaag

SEQ ID NO: 7453222 - DNA, 22 bp, Homo sapiens
catggccacatctagctgcaag

SEQ ID NO: 7453223 - DNA, 22 bp, Homo sapiens
catggccagcccccagttcctc

SEQ ID NO: 7453224 - DNA, 22 bp, Homo sapiens
catggccagcccccagttcctc

SEQ ID NO: 7453225 - DNA, 22 bp, Homo sapiens
catggccagcccccagttcctc

SEQ ID NO: 7453226 - DNA, 22 bp, Homo sapiens
catggccagattctttcttctc

SEQ ID NO: 7453227 - DNA, 22 bp, Homo sapiens
catggccacattggaccgaagc

SEQ ID NO: 7453228 - DNA, 22 bp, Homo sapiens
catggccagattctttcttctc

SEQ ID NO: 7453229 - DNA, 22 bp, Homo sapiens
catggccagcccccagttcctc

SEQ ID NO: 7453230 - DNA, 22 bp, Homo sapiens
catggccagcccccagttcctc

SEQ ID NO: 7453231 - DNA, 22 bp, Homo sapiens
catggccacatctagctgcaag

SEQ ID NO: 7453232 - DNA, 22 bp, Homo sapiens
catggccacatctagctgcaag

SEQ ID NO: 7453233 - DNA, 22 bp, Homo sapiens
catggccacatctagctgcaag

SEQ ID NO: 7453234 - DNA, 22 bp, Homo sapiens
catggccacatctagctgcaag

SEQ ID NO: 7453235 - DNA, 22 bp, Homo sapiens
catggccacatctagctgcaag

SEQ ID NO: 7453236 - DNA, 22 bp, Homo sapiens
catggccaaggatgctcaacca

SEQ ID NO: 7453237 - DNA, 22 bp, Homo sapiens
catggccaaagaattatatttt

SEQ ID NO: 7453238 - DNA, 22 bp, Homo sapiens
catggccaaggatgctcaacca

SEQ ID NO: 7453239 - DNA, 22 bp, Homo sapiens
catggccaaggatgctcaacca

SEQ ID NO: 7453240 - DNA, 22 bp, Homo sapiens
catggcattttttcatggagac

SEQ ID NO: 7453241 - DNA, 22 bp, Homo sapiens
catggcattttttcatggagac

SEQ ID NO: 7453242 - DNA, 22 bp, Homo sapiens
catggccaaagaattatatttt

SEQ ID NO: 7453243 - DNA, 22 bp, Homo sapiens
taatccaatggcacaatgtatg

SEQ ID NO: 7453244 - DNA, 19 bp, Homo sapiens
taatccaaggctgctctta

SEQ ID NO: 7453245 - DNA, 22 bp, Homo sapiens
taatccacaatagagattatct

SEQ ID NO: 7453246 - DNA, 22 bp, Homo sapiens
taatccaaaactgaatctgtgg

SEQ ID NO: 7453247 - DNA, 22 bp, Homo sapiens
taatccaatggcacaatgtatg

SEQ ID NO: 7453248 - DNA, 22 bp, Homo sapiens
taatcagaagttacattagggt

SEQ ID NO: 7453249 - DNA, 22 bp, Homo sapiens
taatcagggatgaaaaatgtca

SEQ ID NO: 7453250 - DNA, 22 bp, Homo sapiens
taatcatatgggtaatccaatg

SEQ ID NO: 7453251 - DNA, 22 bp, Homo sapiens
taatccaaaactgaatctgtgg

SEQ ID NO: 7453252 - DNA, 22 bp, Homo sapiens
taatccaaaactgaatctgtgg

SEQ ID NO: 7453253 - DNA, 22 bp, Homo sapiens
taatcactgtgagtctgttttc

SEQ ID NO: 7453254 - DNA, 22 bp, Homo sapiens
taatcactgtgagtctgttttc

SEQ ID NO: 7453255 - DNA, 22 bp, Homo sapiens
taatcactgtcaacctttgttc

SEQ ID NO: 7453256 - DNA, 20 bp, Homo sapiens
taatcacttataagacaatg

SEQ ID NO: 7453257 - DNA, 22 bp, Homo sapiens
taatcactgggcgtttggtact

SEQ ID NO: 7453258 - DNA, 22 bp, Homo sapiens
taatcactgggcgtttggtact

SEQ ID NO: 7453259 - DNA, 22 bp, Homo sapiens
taatcacatcagggtaaatggg

SEQ ID NO: 7453260 - DNA, 22 bp, Homo sapiens
taatcacatcagggtaaatggg

SEQ ID NO: 7453261 - DNA, 20 bp, Homo sapiens
taatcacttataagacaatg

SEQ ID NO: 7453262 - DNA, 20 bp, Homo sapiens
taatcacttataagacaatg

SEQ ID NO: 7453263 - DNA, 22 bp, Homo sapiens
taatcacttttcattagtacct

SEQ ID NO: 7453264 - DNA, 22 bp, Homo sapiens
taatcatatgggtaatccaatg

SEQ ID NO: 7453265 - DNA, 22 bp, Homo sapiens
taatcatatgggtaatccaatg

SEQ ID NO: 7453266 - DNA, 22 bp, Homo sapiens
taatgtcaaggtcattctagag

SEQ ID NO: 7453267 - DNA, 20 bp, Homo sapiens
taatgtcaaagtcacaaggt

SEQ ID NO: 7453268 - DNA, 22 bp, Homo sapiens
taatgtatttgttcagaagagt

SEQ ID NO: 7453269 - DNA, 22 bp, Homo sapiens
taatgtatttgttcagaagagt

SEQ ID NO: 7453270 - DNA, 20 bp, Homo sapiens
taatgtcaaagtcacaaggt

SEQ ID NO: 7453271 - DNA, 22 bp, Homo sapiens
taatgtatttgttcagaagagt

SEQ ID NO: 7453272 - DNA, 22 bp, Homo sapiens
taatgtataacaaatactcatc

SEQ ID NO: 7453273 - DNA, 22 bp, Homo sapiens
taatgtataacaaatactcatc

SEQ ID NO: 7453274 - DNA, 22 bp, Homo sapiens
taatgtataacaaatactcatc

SEQ ID NO: 7453275 - DNA, 22 bp, Homo sapiens
taatgtactgatgggaagtggt

SEQ ID NO: 7453276 - DNA, 22 bp, Homo sapiens
taatgtataacaaatactcatc

SEQ ID NO: 7453277 - DNA, 22 bp, Homo sapiens
taatgtataacaaatactcatc

SEQ ID NO: 7453278 - DNA, 22 bp, Homo sapiens
taatgtataacaaatactcatc

SEQ ID NO: 7453279 - DNA, 22 bp, Homo sapiens
taatgtataacaaatactcatc

SEQ ID NO: 7453280 - DNA, 22 bp, Homo sapiens
taatgtataacaaatactcatc

SEQ ID NO: 7453281 - DNA, 22 bp, Homo sapiens
taatccacggaccggcagcatt

SEQ ID NO: 7453282 - DNA, 22 bp, Homo sapiens
taatccagcgggtgattgcaca

SEQ ID NO: 7453283 - DNA, 18 bp, Homo sapiens
taatccagggcaggtgat

SEQ ID NO: 7453284 - DNA, 22 bp, Homo sapiens
taatgtacaagaggctagggtg

SEQ ID NO: 7453285 - DNA, 22 bp, Homo sapiens
taatatttctaccctgctgcct

SEQ ID NO: 7453286 - DNA, 22 bp, Homo sapiens
taatatttctaccctgctgcct

SEQ ID NO: 7453287 - DNA, 22 bp, Homo sapiens
taatatttctaccctgctgcct

SEQ ID NO: 7453288 - DNA, 22 bp, Homo sapiens
taatatttctaccctgctgcct

SEQ ID NO: 7453289 - DNA, 22 bp, Homo sapiens
taatatttctaccctgctgcct

SEQ ID NO: 7453290 - DNA, 22 bp, Homo sapiens
taatatttctaccctgctgcct

SEQ ID NO: 7453291 - DNA, 22 bp, Homo sapiens
taatatgtgttactgacttttt

SEQ ID NO: 7453292 - DNA, 22 bp, Homo sapiens
taatatttctaccctgctgcct

SEQ ID NO: 7453293 - DNA, 22 bp, Homo sapiens
taatacagacaacttgccaaat

SEQ ID NO: 7453294 - DNA, 22 bp, Homo sapiens
taatacagacaacttgccaaat

SEQ ID NO: 7453295 - DNA, 22 bp, Homo sapiens
taatacagacaacttgccaaat

SEQ ID NO: 7453296 - DNA, 22 bp, Homo sapiens
taatacagaagtgtattaaaat

SEQ ID NO: 7453297 - DNA, 22 bp, Homo sapiens
taatacagacaacttgccaaat

SEQ ID NO: 7453298 - DNA, 22 bp, Homo sapiens
taatacagacaacttgccaaat

SEQ ID NO: 7453299 - DNA, 22 bp, Homo sapiens
taatacagatacaaaggaggac

SEQ ID NO: 7453300 - DNA, 22 bp, Homo sapiens
taatatctacttcatagagttt

SEQ ID NO: 7453301 - DNA, 22 bp, Homo sapiens
taatatctacttcatagagttt

SEQ ID NO: 7453302 - DNA, 22 bp, Homo sapiens
taatatctggcattcaaacatg

SEQ ID NO: 7453303 - DNA, 22 bp, Homo sapiens
taatatctggcattcaaacatg

SEQ ID NO: 7453304 - DNA, 22 bp, Homo sapiens
taatcacaattcagatgtctta

SEQ ID NO: 7453305 - DNA, 22 bp, Homo sapiens
taatcacagaaacagactgttt

SEQ ID NO: 7453306 - DNA, 22 bp, Homo sapiens
taatcacaattcagatgtctta

SEQ ID NO: 7453307 - DNA, 22 bp, Homo sapiens
taatcacaattcagatgtctta

SEQ ID NO: 7453308 - DNA, 22 bp, Homo sapiens
taatatttctaccctgctgcct

SEQ ID NO: 7453309 - DNA, 22 bp, Homo sapiens
taatatttctaccctgctgcct

SEQ ID NO: 7453310 - DNA, 22 bp, Homo sapiens
taatatttctaccctgctgcct

SEQ ID NO: 7453311 - DNA, 22 bp, Homo sapiens
taatcacaattcagatgtctta

SEQ ID NO: 7453312 - DNA, 22 bp, Homo sapiens
taatcacatcagggtaaatggg

SEQ ID NO: 7453313 - DNA, 22 bp, Homo sapiens
taatcacatcagggtaaatggg

SEQ ID NO: 7453314 - DNA, 22 bp, Homo sapiens
taatcacatcagggtaaatggg

SEQ ID NO: 7453315 - DNA, 22 bp, Homo sapiens
taatcacatcagggtaaatggg

SEQ ID NO: 7453316 - DNA, 22 bp, Homo sapiens
taatcacagaaatgcccattca

SEQ ID NO: 7453317 - DNA, 22 bp, Homo sapiens
taatcacagaaacagactgttt

SEQ ID NO: 7453318 - DNA, 22 bp, Homo sapiens
taatcacagaaacagactgttt

SEQ ID NO: 7453319 - DNA, 22 bp, Homo sapiens
taatcacagaaacagactgttt

SEQ ID NO: 7453320 - DNA, 22 bp, Homo sapiens
taatcacagaaacagactgttt

SEQ ID NO: 7453321 - DNA, 22 bp, Homo sapiens
taatcacagaaacagactgttt

SEQ ID NO: 7453322 - DNA, 22 bp, Homo sapiens
taatcacagaaacagactgttt

SEQ ID NO: 7453323 - DNA, 22 bp, Homo sapiens
caggcatggatctggaatcatt

SEQ ID NO: 7453324 - DNA, 22 bp, Homo sapiens
caggcatggatctggaatcatt

SEQ ID NO: 7453325 - DNA, 22 bp, Homo sapiens
caggcatggagaggcagagact

SEQ ID NO: 7453326 - DNA, 22 bp, Homo sapiens
caggcatgggccatgggaagtg

SEQ ID NO: 7453327 - DNA, 22 bp, Homo sapiens
caggcatggatctggaatcatt

SEQ ID NO: 7453328 - DNA, 22 bp, Homo sapiens
caggcatggagaggcagagact

SEQ ID NO: 7453329 - DNA, 22 bp, Homo sapiens
caggcatggagaggcagagact

SEQ ID NO: 7453330 - DNA, 22 bp, Homo sapiens
caggcatggagaggcagagact

SEQ ID NO: 7453331 - DNA, 22 bp, Homo sapiens
caggcatggagaggcagagact

SEQ ID NO: 7453332 - DNA, 22 bp, Homo sapiens
caggcatggagaggcagagact

SEQ ID NO: 7453333 - DNA, 22 bp, Homo sapiens
caggcatggagaggcagagact

SEQ ID NO: 7453334 - DNA, 22 bp, Homo sapiens
caggcatggagaggcagagact

SEQ ID NO: 7453335 - DNA, 22 bp, Homo sapiens
caggcatggagaggcagagact

SEQ ID NO: 7453336 - DNA, 22 bp, Homo sapiens
caggcatggagaggcagagact

SEQ ID NO: 7453337 - DNA, 22 bp, Homo sapiens
caggcatggagaggcagagact

SEQ ID NO: 7453338 - DNA, 22 bp, Homo sapiens
caggcatggaaaagcccagagg

SEQ ID NO: 7453339 - DNA, 22 bp, Homo sapiens
caggcatggaaaagcccagagg

SEQ ID NO: 7453340 - DNA, 22 bp, Homo sapiens
caggcatggaaaagcccagagg

SEQ ID NO: 7453341 - DNA, 22 bp, Homo sapiens
caggcatggaaaagcccagagg

SEQ ID NO: 7453342 - DNA, 22 bp, Homo sapiens
caggcatggaaaagcccagagg

SEQ ID NO: 7453343 - DNA, 22 bp, Homo sapiens
caggcatggaaaagcccagagg

SEQ ID NO: 7453344 - DNA, 22 bp, Homo sapiens
caggcatggaaaagcccagagg

SEQ ID NO: 7453345 - DNA, 22 bp, Homo sapiens
caggcatgcttctgtctgggca

SEQ ID NO: 7453346 - DNA, 22 bp, Homo sapiens
caggcatgcttctgtctgggca

SEQ ID NO: 7453347 - DNA, 22 bp, Homo sapiens
caggcatgatgggaagtgcctg

SEQ ID NO: 7453348 - DNA, 22 bp, Homo sapiens
caggcatgatgggaagtgcctg

SEQ ID NO: 7453349 - DNA, 22 bp, Homo sapiens
caggcatgatcataggagttta

SEQ ID NO: 7453350 - DNA, 22 bp, Homo sapiens
caggcagggagctggaaaggat

SEQ ID NO: 7453351 - DNA, 22 bp, Homo sapiens
caggcagggagctggaaaggat

SEQ ID NO: 7453352 - DNA, 22 bp, Homo sapiens
caggcagggagctggaaaggat

SEQ ID NO: 7453353 - DNA, 22 bp, Homo sapiens
caggcagggagctggaaaggat

SEQ ID NO: 7453354 - DNA, 22 bp, Homo sapiens
caggcatgatcataggagttta

SEQ ID NO: 7453355 - DNA, 22 bp, Homo sapiens
caggcatgatcataggagttta

SEQ ID NO: 7453356 - DNA, 22 bp, Homo sapiens
caggcatgagccaggcccctcc

SEQ ID NO: 7453357 - DNA, 22 bp, Homo sapiens
caggcatgagccaggcccctcc

SEQ ID NO: 7453358 - DNA, 22 bp, Homo sapiens
caggcatgagccaggcccctcc

SEQ ID NO: 7453359 - DNA, 22 bp, Homo sapiens
taatgtctagatcagacctcga

SEQ ID NO: 7453360 - DNA, 22 bp, Homo sapiens
taatgtctagatcagacctcga

SEQ ID NO: 7453361 - DNA, 22 bp, Homo sapiens
taatgtctatgggccagataat

SEQ ID NO: 7453362 - DNA, 22 bp, Homo sapiens
taatgtctatgggccagataat

SEQ ID NO: 7453363 - DNA, 22 bp, Homo sapiens
taatgtcaaggtgatagatttg

SEQ ID NO: 7453364 - DNA, 22 bp, Homo sapiens
taatgtctgatagtgatggctc

SEQ ID NO: 7453365 - DNA, 22 bp, Homo sapiens
taatgtctgatagtgatggctc

SEQ ID NO: 7453366 - DNA, 22 bp, Homo sapiens
taatgtctgtgtttcagtgcag

SEQ ID NO: 7453367 - DNA, 22 bp, Homo sapiens
taatgtctgatagtgatggctc

SEQ ID NO: 7453368 - DNA, 22 bp, Homo sapiens
taatgtctccagggttgaccta

SEQ ID NO: 7453369 - DNA, 22 bp, Homo sapiens
taatgtctccagggttgaccta

SEQ ID NO: 7453370 - DNA, 22 bp, Homo sapiens
taatgtctatgggccagataat

SEQ ID NO: 7453371 - DNA, 22 bp, Homo sapiens
taatgtctgtgtttcagtgcag

SEQ ID NO: 7453372 - DNA, 22 bp, Homo sapiens
taatgtcttagtaccttaattt

SEQ ID NO: 7453373 - DNA, 22 bp, Homo sapiens
taatgtcttgccttcctccccc

SEQ ID NO: 7453374 - DNA, 22 bp, Homo sapiens
taatgtcttcttttaatttggc

SEQ ID NO: 7453375 - DNA, 22 bp, Homo sapiens
taatgtcttgtgagagctggag

SEQ ID NO: 7453376 - DNA, 22 bp, Homo sapiens
taatgtctttaagagcattggg

SEQ ID NO: 7453377 - DNA, 22 bp, Homo sapiens
taatgtcttgtgagagctggag

SEQ ID NO: 7453378 - DNA, 22 bp, Homo sapiens
taatgtctttaagagcattggg

SEQ ID NO: 7453379 - DNA, 22 bp, Homo sapiens
taatgtctttaagagcattggg

SEQ ID NO: 7453380 - DNA, 22 bp, Homo sapiens
taatgtgaagacataaatcaga

SEQ ID NO: 7453381 - DNA, 22 bp, Homo sapiens
taatgtgatattcctgtccttt

SEQ ID NO: 7453382 - DNA, 22 bp, Homo sapiens
taatgtgtcctgaaagcttctg

SEQ ID NO: 7453383 - DNA, 22 bp, Homo sapiens
taatgtgaagacataaatcaga

SEQ ID NO: 7453384 - DNA, 22 bp, Homo sapiens
taatgtgaagacataaatcaga

SEQ ID NO: 7453385 - DNA, 22 bp, Homo sapiens
taatgtgtgtcatcagtagagt

SEQ ID NO: 7453386 - DNA, 22 bp, Homo sapiens
taatgtgtgtcatcagtagagt

SEQ ID NO: 7453387 - DNA, 22 bp, Homo sapiens
taatgtgtcctgaaagcttctg

SEQ ID NO: 7453388 - DNA, 22 bp, Homo sapiens
caggcagggagctggaaaggat

SEQ ID NO: 7453389 - DNA, 22 bp, Homo sapiens
caggcagggagctggaaaggat

SEQ ID NO: 7453390 - DNA, 22 bp, Homo sapiens
caggcagggagctggaaaggat

SEQ ID NO: 7453391 - DNA, 22 bp, Homo sapiens
caggcagggagctggaaaggat

SEQ ID NO: 7453392 - DNA, 22 bp, Homo sapiens
caggcagggagctggaaaggat

SEQ ID NO: 7453393 - DNA, 22 bp, Homo sapiens
caggcagggagctggaaaggat

SEQ ID NO: 7453394 - DNA, 22 bp, Homo sapiens
taatgttacactgcatggttca

SEQ ID NO: 7453395 - DNA, 22 bp, Homo sapiens
taatgtgtgtcatcagtagagt

SEQ ID NO: 7453396 - DNA, 22 bp, Homo sapiens
taatgtgtgtcatcagtagagt

SEQ ID NO: 7453397 - DNA, 22 bp, Homo sapiens
taatgtgttgaatatttgtaca

SEQ ID NO: 7453398 - DNA, 22 bp, Homo sapiens
taatgtgttgaatatttgtaca

SEQ ID NO: 7453399 - DNA, 22 bp, Homo sapiens
taatgttacactgcatggttca

SEQ ID NO: 7453400 - DNA, 22 bp, Homo sapiens
taatgttacactgcatggttca

SEQ ID NO: 7453401 - DNA, 19 bp, Homo sapiens
caggccagtgtcagggggc

SEQ ID NO: 7453402 - DNA, 19 bp, Homo sapiens
caggccagtgtcagggggc

SEQ ID NO: 7453403 - DNA, 22 bp, Homo sapiens
caggccagtgggaaatagggat

SEQ ID NO: 7453404 - DNA, 19 bp, Homo sapiens
caggccagtgtcagggggc

SEQ ID NO: 7453405 - DNA, 19 bp, Homo sapiens
caggccagtgtcagggggc

SEQ ID NO: 7453406 - DNA, 19 bp, Homo sapiens
caggccagtgtcagggggc

SEQ ID NO: 7453407 - DNA, 19 bp, Homo sapiens
caggccagtgtcagggggc

SEQ ID NO: 7453408 - DNA, 19 bp, Homo sapiens
caggccagtgtcagggggc

SEQ ID NO: 7453409 - DNA, 19 bp, Homo sapiens
caggccagtgtcagggggc

SEQ ID NO: 7453410 - DNA, 22 bp, Homo sapiens
caggccagtgggaaatagggat

SEQ ID NO: 7453411 - DNA, 22 bp, Homo sapiens
caggccagtgggaaatagggat

SEQ ID NO: 7453412 - DNA, 22 bp, Homo sapiens
caggccagtgggaaatagggat

SEQ ID NO: 7453413 - DNA, 22 bp, Homo sapiens
caggccagtgggaaatagggat

SEQ ID NO: 7453414 - DNA, 22 bp, Homo sapiens
caggccagtgggaaatagggat

SEQ ID NO: 7453415 - DNA, 22 bp, Homo sapiens
caggccaggtggcaggcaaaac

SEQ ID NO: 7453416 - DNA, 22 bp, Homo sapiens
caggccaggtggcaggcaaaac

SEQ ID NO: 7453417 - DNA, 22 bp, Homo sapiens
caggccaggtggcaggcaaaac

SEQ ID NO: 7453418 - DNA, 22 bp, Homo sapiens
caggccaggtggcaggcaaaac

SEQ ID NO: 7453419 - DNA, 22 bp, Homo sapiens
caggccagggttgagaagagaa

SEQ ID NO: 7453420 - DNA, 22 bp, Homo sapiens
caggccagggttgagaagagaa

SEQ ID NO: 7453421 - DNA, 22 bp, Homo sapiens
caggccagggttgagaagagaa

SEQ ID NO: 7453422 - DNA, 22 bp, Homo sapiens
caggccagggttgagaagagaa

SEQ ID NO: 7453423 - DNA, 22 bp, Homo sapiens
caggccagggttgagaagagaa

SEQ ID NO: 7453424 - DNA, 22 bp, Homo sapiens
caggccagggttgagaagagaa

SEQ ID NO: 7453425 - DNA, 22 bp, Homo sapiens
caggccaggtgctctagaatca

SEQ ID NO: 7453426 - DNA, 22 bp, Homo sapiens
caggccagggttgagaagagaa

SEQ ID NO: 7453427 - DNA, 22 bp, Homo sapiens
caggccaggtgctctagaatca

SEQ ID NO: 7453428 - DNA, 22 bp, Homo sapiens
caggccaggtgctctagaatca

SEQ ID NO: 7453429 - DNA, 22 bp, Homo sapiens
caggccaggtgctctagaatca

SEQ ID NO: 7453430 - DNA, 22 bp, Homo sapiens
caggccaggtggcaggcaaaac

SEQ ID NO: 7453431 - DNA, 22 bp, Homo sapiens
caggcccactgcttgtctagtc

SEQ ID NO: 7453432 - DNA, 22 bp, Homo sapiens
caggcccactgcttgtctagtc

SEQ ID NO: 7453433 - DNA, 22 bp, Homo sapiens
caggcccactgcttgtctagtc

SEQ ID NO: 7453434 - DNA, 22 bp, Homo sapiens
caggcccactgcttgtctagtc

SEQ ID NO: 7453435 - DNA, 22 bp, Homo sapiens
caggcccactgcttgtctagtc

SEQ ID NO: 7453436 - DNA, 22 bp, Homo sapiens
caggcccagaggcctcttccca

SEQ ID NO: 7453437 - DNA, 22 bp, Homo sapiens
caggcccacgaggcacacagag

SEQ ID NO: 7453438 - DNA, 22 bp, Homo sapiens
caggcccactgcttgtctagtc

SEQ ID NO: 7453439 - DNA, 22 bp, Homo sapiens
caggcccactgcttgtctagtc

SEQ ID NO: 7453440 - DNA, 22 bp, Homo sapiens
caggcccaagactgatgagtct

SEQ ID NO: 7453441 - DNA, 22 bp, Homo sapiens
caggcccaagactgatgagtct

SEQ ID NO: 7453442 - DNA, 22 bp, Homo sapiens
caggcccaagactgatgagtct

SEQ ID NO: 7453443 - DNA, 22 bp, Homo sapiens
caggcccaagactgatgagtct

SEQ ID NO: 7453444 - DNA, 22 bp, Homo sapiens
caggcccaagactgatgagtct

SEQ ID NO: 7453445 - DNA, 22 bp, Homo sapiens
caggcccaaatgcaaccttctt

SEQ ID NO: 7453446 - DNA, 22 bp, Homo sapiens
caggcccaaatgcaaccttctt

SEQ ID NO: 7453447 - DNA, 22 bp, Homo sapiens
caggccattaccgctgagaccc

SEQ ID NO: 7453448 - DNA, 22 bp, Homo sapiens
caggcccaaatgcaaccttctt

SEQ ID NO: 7453449 - DNA, 22 bp, Homo sapiens
caggcccaagactgatgagtct

SEQ ID NO: 7453450 - DNA, 22 bp, Homo sapiens
caggcccacgaggcacacagag

SEQ ID NO: 7453451 - DNA, 22 bp, Homo sapiens
caggcccaagactgatgagtct

SEQ ID NO: 7453452 - DNA, 22 bp, Homo sapiens
caggcccacgaggcacacagag

SEQ ID NO: 7453453 - DNA, 22 bp, Homo sapiens
caggcccacgaggcacacagag

SEQ ID NO: 7453454 - DNA, 22 bp, Homo sapiens
caggcccacgaggcacacagag

SEQ ID NO: 7453455 - DNA, 22 bp, Homo sapiens
caggcccaagactgatgagtct

SEQ ID NO: 7453456 - DNA, 22 bp, Homo sapiens
caggcccacgaggcacacagag

SEQ ID NO: 7453457 - DNA, 22 bp, Homo sapiens
caggcccacgaggcacacagag

SEQ ID NO: 7453458 - DNA, 22 bp, Homo sapiens
caggccattaccgctgagaccc

SEQ ID NO: 7453459 - DNA, 22 bp, Homo sapiens
caggcccaaatgcaaccttctt

SEQ ID NO: 7453460 - DNA, 22 bp, Homo sapiens
caggccagttttgatttaagcc

SEQ ID NO: 7453461 - DNA, 22 bp, Homo sapiens
caggccagtgtgcttcccaggc

SEQ ID NO: 7453462 - DNA, 22 bp, Homo sapiens
caggccagtgtgcttcccaggc

SEQ ID NO: 7453463 - DNA, 22 bp, Homo sapiens
caggccagtgtgcttcccaggc

SEQ ID NO: 7453464 - DNA, 22 bp, Homo sapiens
caggccagtgtgcttcccaggc

SEQ ID NO: 7453465 - DNA, 22 bp, Homo sapiens
caggccagtgtgcttcccaggc

SEQ ID NO: 7453466 - DNA, 19 bp, Homo sapiens
caggccagtgtcagggggc

SEQ ID NO: 7453467 - DNA, 19 bp, Homo sapiens
caggccagtgtcagggggc

SEQ ID NO: 7453468 - DNA, 22 bp, Homo sapiens
caggccagtgtgcttcccaggc

SEQ ID NO: 7453469 - DNA, 22 bp, Homo sapiens
caggccagtgtgcttcccaggc

SEQ ID NO: 7453470 - DNA, 22 bp, Homo sapiens
caggccagtgtgcttcccaggc

SEQ ID NO: 7453471 - DNA, 22 bp, Homo sapiens
tacaaaaaattgatactgacga

SEQ ID NO: 7453472 - DNA, 22 bp, Homo sapiens
tacaaaaaattgatactgacga

SEQ ID NO: 7453473 - DNA, 22 bp, Homo sapiens
tacaaaaaattgatactgacga

SEQ ID NO: 7453474 - DNA, 22 bp, Homo sapiens
tacaaaaaattgatactgacga

SEQ ID NO: 7453475 - DNA, 22 bp, Homo sapiens
tacaaaaaattgatactgacga

SEQ ID NO: 7453476 - DNA, 22 bp, Homo sapiens
tacaaaaaattgatactgacga

SEQ ID NO: 7453477 - DNA, 22 bp, Homo sapiens
caggcatttcgcaaaggctgag

SEQ ID NO: 7453478 - DNA, 22 bp, Homo sapiens
tacaaaaaattgatactgacga

SEQ ID NO: 7453479 - DNA, 22 bp, Homo sapiens
tacaaaaaattgatactgacga

SEQ ID NO: 7453480 - DNA, 22 bp, Homo sapiens
tacaaaaaattgatactgacga

SEQ ID NO: 7453481 - DNA, 22 bp, Homo sapiens
tacaaaaaattgatactgacga

SEQ ID NO: 7453482 - DNA, 22 bp, Homo sapiens
caggcatttcgcaaaggctgag

SEQ ID NO: 7453483 - DNA, 22 bp, Homo sapiens
caggcattgtgacgagtgttct

SEQ ID NO: 7453484 - DNA, 22 bp, Homo sapiens
caggcattgttctaggttctca

SEQ ID NO: 7453485 - DNA, 22 bp, Homo sapiens
caggcatgtggcccaggggtga

SEQ ID NO: 7453486 - DNA, 22 bp, Homo sapiens
caggcattagagaattgtgata

SEQ ID NO: 7453487 - DNA, 22 bp, Homo sapiens
caggcattcctctatgaatatt

SEQ ID NO: 7453488 - DNA, 22 bp, Homo sapiens
caggcatgggccatgggaagtg

SEQ ID NO: 7453489 - DNA, 22 bp, Homo sapiens
caggcatgggccatgggaagtg

SEQ ID NO: 7453490 - DNA, 22 bp, Homo sapiens
caggcatgggccatgggaagtg

SEQ ID NO: 7453491 - DNA, 22 bp, Homo sapiens
caggcatggatctggaatcatt

SEQ ID NO: 7453492 - DNA, 22 bp, Homo sapiens
caggcatggtgagaactcagcc

SEQ ID NO: 7453493 - DNA, 22 bp, Homo sapiens
caggcatgtggcccaggggtga

SEQ ID NO: 7453494 - DNA, 22 bp, Homo sapiens
caggcatgtggcccaggggtga

SEQ ID NO: 7453495 - DNA, 22 bp, Homo sapiens
caggcatgtggcccaggggtga

SEQ ID NO: 7453496 - DNA, 22 bp, Homo sapiens
caggcatgggccatgggaagtg

SEQ ID NO: 7453497 - DNA, 22 bp, Homo sapiens
tacaaaaggaagagggatctta

SEQ ID NO: 7453498 - DNA, 22 bp, Homo sapiens
tacaaaaggaagagggatctta

SEQ ID NO: 7453499 - DNA, 22 bp, Homo sapiens
tacaaaaggaagagggatctta

SEQ ID NO: 7453500 - DNA, 22 bp, Homo sapiens
tacaaaaggaagagggatctta

SEQ ID NO: 7453501 - DNA, 22 bp, Homo sapiens
tacaaaacagtgctctggtcct

SEQ ID NO: 7453502 - DNA, 22 bp, Homo sapiens
tacaaaagtaattacggttttt

SEQ ID NO: 7453503 - DNA, 22 bp, Homo sapiens
tacaaaaggaagagggatctta

SEQ ID NO: 7453504 - DNA, 22 bp, Homo sapiens
tacaaaacagtgctctggtcct

SEQ ID NO: 7453505 - DNA, 22 bp, Homo sapiens
tacaaaacagtgctctggtcct

SEQ ID NO: 7453506 - DNA, 22 bp, Homo sapiens
tacaaaacagtgctctggtcct

SEQ ID NO: 7453507 - DNA, 22 bp, Homo sapiens
tacaaaaaattgatactgacga

SEQ ID NO: 7453508 - DNA, 22 bp, Homo sapiens
tacaaaacagtgctctggtcct

SEQ ID NO: 7453509 - DNA, 22 bp, Homo sapiens
tacaaaacagtgctctggtcct

SEQ ID NO: 7453510 - DNA, 22 bp, Homo sapiens
tacaaaacagtgctctggtcct

SEQ ID NO: 7453511 - DNA, 20 bp, Homo sapiens
tacaaacctccacactggtg

SEQ ID NO: 7453512 - DNA, 22 bp, Homo sapiens
tacaaaccagcagaataggtcc

SEQ ID NO: 7453513 - DNA, 22 bp, Homo sapiens
caggccagagcgcgtggttggg

SEQ ID NO: 7453514 - DNA, 22 bp, Homo sapiens
tacaaaccagcagaataggtcc

SEQ ID NO: 7453515 - DNA, 22 bp, Homo sapiens
caggccagagcgcgtggttggg

SEQ ID NO: 7453516 - DNA, 22 bp, Homo sapiens
caggccagagcgcgtggttggg

SEQ ID NO: 7453517 - DNA, 22 bp, Homo sapiens
caggccagagcgcgtggttggg

SEQ ID NO: 7453518 - DNA, 22 bp, Homo sapiens
caggccagggttgagaagagaa

SEQ ID NO: 7453519 - DNA, 22 bp, Homo sapiens
caggccagaggctgttgttgcg

SEQ ID NO: 7453520 - DNA, 22 bp, Homo sapiens
caggccagggttgagaagagaa

SEQ ID NO: 7453521 - DNA, 22 bp, Homo sapiens
caggccagggttgagaagagaa

SEQ ID NO: 7453522 - DNA, 22 bp, Homo sapiens
caggccagggttgagaagagaa

SEQ ID NO: 7453523 - DNA, 22 bp, Homo sapiens
caggccagagcgcgtggttggg

SEQ ID NO: 7453524 - DNA, 22 bp, Homo sapiens
caggccagagcgcgtggttggg

SEQ ID NO: 7453525 - DNA, 22 bp, Homo sapiens
tacaaaccaaggaacagtgatc

SEQ ID NO: 7453526 - DNA, 20 bp, Homo sapiens
tacaaacctccacactggtg

SEQ ID NO: 7453527 - DNA, 20 bp, Homo sapiens
tacaaacctccacactggtg

SEQ ID NO: 7453528 - DNA, 22 bp, Homo sapiens
tacaaaagtaattacggttttt

SEQ ID NO: 7453529 - DNA, 22 bp, Homo sapiens
tacaaaagtaattacggttttt

SEQ ID NO: 7453530 - DNA, 22 bp, Homo sapiens
tacaaaagtaattacggttttt

SEQ ID NO: 7453531 - DNA, 22 bp, Homo sapiens
tacaaaagtaattacggttttt

SEQ ID NO: 7453532 - DNA, 22 bp, Homo sapiens
caggcagatgctgacaagagtt

SEQ ID NO: 7453533 - DNA, 22 bp, Homo sapiens
caggcagatgctgacaagagtt

SEQ ID NO: 7453534 - DNA, 22 bp, Homo sapiens
caggcagatgctgacaagagtt

SEQ ID NO: 7453535 - DNA, 22 bp, Homo sapiens
caggcagatatgttcgctttaa

SEQ ID NO: 7453536 - DNA, 22 bp, Homo sapiens
caggcagatatgttcgctttaa

SEQ ID NO: 7453537 - DNA, 22 bp, Homo sapiens
caggcagatatgttcgctttaa

SEQ ID NO: 7453538 - DNA, 22 bp, Homo sapiens
caggcagatgctgacaagagtt

SEQ ID NO: 7453539 - DNA, 22 bp, Homo sapiens
caggcagatgctgacaagagtt

SEQ ID NO: 7453540 - DNA, 22 bp, Homo sapiens
caggcagatgctgacaagagtt

SEQ ID NO: 7453541 - DNA, 22 bp, Homo sapiens
caggcagatgctgacaagagtt

SEQ ID NO: 7453542 - DNA, 22 bp, Homo sapiens
caggcagatgctgacaagagtt

SEQ ID NO: 7453543 - DNA, 22 bp, Homo sapiens
caggcagagttagtgatttagg

SEQ ID NO: 7453544 - DNA, 22 bp, Homo sapiens
caggcagagttagtgatttagg

SEQ ID NO: 7453545 - DNA, 22 bp, Homo sapiens
caggcagagttagtgatttagg

SEQ ID NO: 7453546 - DNA, 22 bp, Homo sapiens
caggcagagttagtgatttagg

SEQ ID NO: 7453547 - DNA, 22 bp, Homo sapiens
caggcagatatgttcgctttaa

SEQ ID NO: 7453548 - DNA, 22 bp, Homo sapiens
caggcagatatgttcgctttaa

SEQ ID NO: 7453549 - DNA, 22 bp, Homo sapiens
caggcagagttagtgatttagg

SEQ ID NO: 7453550 - DNA, 22 bp, Homo sapiens
caggcagagttagtgatttagg

SEQ ID NO: 7453551 - DNA, 22 bp, Homo sapiens
caggcagagttagagcaactgg

SEQ ID NO: 7453552 - DNA, 22 bp, Homo sapiens
caggcagagttagagcaactgg

SEQ ID NO: 7453553 - DNA, 22 bp, Homo sapiens
caggcagagctgaagatagatg

SEQ ID NO: 7453554 - DNA, 22 bp, Homo sapiens
caggcagagccaatcgtggggt

SEQ ID NO: 7453555 - DNA, 22 bp, Homo sapiens
caggcagagctgaagatagatg

SEQ ID NO: 7453556 - DNA, 22 bp, Homo sapiens
caggcagagctgaagatagatg

SEQ ID NO: 7453557 - DNA, 22 bp, Homo sapiens
caggcagagctgaagatagatg

SEQ ID NO: 7453558 - DNA, 22 bp, Homo sapiens
caggcacgggggcatggcctct

SEQ ID NO: 7453559 - DNA, 22 bp, Homo sapiens
caggcagagccaatcgtggggt

SEQ ID NO: 7453560 - DNA, 22 bp, Homo sapiens
caggcagagccaatcgtggggt

SEQ ID NO: 7453561 - DNA, 22 bp, Homo sapiens
caggcagagttagagcaactgg

SEQ ID NO: 7453562 - DNA, 22 bp, Homo sapiens
caggcagagttagagcaactgg

SEQ ID NO: 7453563 - DNA, 22 bp, Homo sapiens
caggcagagttagagcaactgg

SEQ ID NO: 7453564 - DNA, 22 bp, Homo sapiens
caggcagagctgaagatagatg

SEQ ID NO: 7453565 - DNA, 22 bp, Homo sapiens
caggcagagttagagcaactgg

SEQ ID NO: 7453566 - DNA, 22 bp, Homo sapiens
caggcagagttagagcaactgg

SEQ ID NO: 7453567 - DNA, 22 bp, Homo sapiens
caggcagagttagagcaactgg

SEQ ID NO: 7453568 - DNA, 22 bp, Homo sapiens
caggcagagttagagcaactgg

SEQ ID NO: 7453569 - DNA, 22 bp, Homo sapiens
caggcaccccaggtgagcactg

SEQ ID NO: 7453570 - DNA, 22 bp, Homo sapiens
caggcaccccaggtgagcactg

SEQ ID NO: 7453571 - DNA, 22 bp, Homo sapiens
caggcaccccaggtgagcactg

SEQ ID NO: 7453572 - DNA, 22 bp, Homo sapiens
caggcaccccaggtgagcactg

SEQ ID NO: 7453573 - DNA, 22 bp, Homo sapiens
caggcacccagcccagtcgcac

SEQ ID NO: 7453574 - DNA, 22 bp, Homo sapiens
caggcacccagcccagtcgcac

SEQ ID NO: 7453575 - DNA, 22 bp, Homo sapiens
caggcacccagcccagtcgcac

SEQ ID NO: 7453576 - DNA, 22 bp, Homo sapiens
caggcaccccaggtgagcactg

SEQ ID NO: 7453577 - DNA, 22 bp, Homo sapiens
caggcacccagcccagtcgcac

SEQ ID NO: 7453578 - DNA, 22 bp, Homo sapiens
caggcacccagcccagtcgcac

SEQ ID NO: 7453579 - DNA, 22 bp, Homo sapiens
caggcaccagtgagaagggcct

SEQ ID NO: 7453580 - DNA, 22 bp, Homo sapiens
caggcaccagtgagaagggcct

SEQ ID NO: 7453581 - DNA, 22 bp, Homo sapiens
caggcaccacactaggggctga

SEQ ID NO: 7453582 - DNA, 22 bp, Homo sapiens
caggcaccagtgagaagggcct

SEQ ID NO: 7453583 - DNA, 22 bp, Homo sapiens
caggcaccacactaggggctga

SEQ ID NO: 7453584 - DNA, 22 bp, Homo sapiens
caggcaccaatagggatcgtgg

SEQ ID NO: 7453585 - DNA, 22 bp, Homo sapiens
caggcaccaatagggatcgtgg

SEQ ID NO: 7453586 - DNA, 22 bp, Homo sapiens
caggcaccaatagggatcgtgg

SEQ ID NO: 7453587 - DNA, 22 bp, Homo sapiens
caggcaccacactaggggctga

SEQ ID NO: 7453588 - DNA, 22 bp, Homo sapiens
caggcaccacactaggggctga

SEQ ID NO: 7453589 - DNA, 22 bp, Homo sapiens
caggcaccctctgaggggaagc

SEQ ID NO: 7453590 - DNA, 22 bp, Homo sapiens
caggcaccctctgaggggaagc

SEQ ID NO: 7453591 - DNA, 22 bp, Homo sapiens
caggcacctcacgtgggtccca

SEQ ID NO: 7453592 - DNA, 22 bp, Homo sapiens
caggcacctcacgtgggtccca

SEQ ID NO: 7453593 - DNA, 22 bp, Homo sapiens
caggcaccctctgaggggaagc

SEQ ID NO: 7453594 - DNA, 22 bp, Homo sapiens
caggcaccctctgaggggaagc

SEQ ID NO: 7453595 - DNA, 22 bp, Homo sapiens
caggcacctcacgtgggtccca

SEQ ID NO: 7453596 - DNA, 22 bp, Homo sapiens
caggcacctgtgtgtctcaggg

SEQ ID NO: 7453597 - DNA, 22 bp, Homo sapiens
caggcacctgtgtgtctcaggg

SEQ ID NO: 7453598 - DNA, 22 bp, Homo sapiens
caggcacctgtgtgtctcaggg

SEQ ID NO: 7453599 - DNA, 22 bp, Homo sapiens
caggcacctgtgtgtctcaggg

SEQ ID NO: 7453600 - DNA, 22 bp, Homo sapiens
caggcacctcacgtgggtccca

SEQ ID NO: 7453601 - DNA, 22 bp, Homo sapiens
caggcacctgtgtgtctcaggg

SEQ ID NO: 7453602 - DNA, 22 bp, Homo sapiens
caggcacctttgtgcatgggca

SEQ ID NO: 7453603 - DNA, 22 bp, Homo sapiens
caggcacctttgtgcatgggca

SEQ ID NO: 7453604 - DNA, 22 bp, Homo sapiens
caggcagcagaggagtgtggga

SEQ ID NO: 7453605 - DNA, 22 bp, Homo sapiens
caggcagcagccactctggtat

SEQ ID NO: 7453606 - DNA, 22 bp, Homo sapiens
taataattaacagtgatgggtc

SEQ ID NO: 7453607 - DNA, 22 bp, Homo sapiens
taataattagttattgatcgtg

SEQ ID NO: 7453608 - DNA, 22 bp, Homo sapiens
taataattagttattgatcgtg

SEQ ID NO: 7453609 - DNA, 22 bp, Homo sapiens
taataattagttattgatcgtg

SEQ ID NO: 7453610 - DNA, 21 bp, Homo sapiens
taataattccactacagagta

SEQ ID NO: 7453611 - DNA, 21 bp, Homo sapiens
taataattccactacagagta

SEQ ID NO: 7453612 - DNA, 21 bp, Homo sapiens
taataattccactacagagta

SEQ ID NO: 7453613 - DNA, 21 bp, Homo sapiens
taataattccactacagagta

SEQ ID NO: 7453614 - DNA, 21 bp, Homo sapiens
taataattccactacagagta

SEQ ID NO: 7453615 - DNA, 21 bp, Homo sapiens
taataattccactacagagta

SEQ ID NO: 7453616 - DNA, 22 bp, Homo sapiens
taataattagttattgatcgtg

SEQ ID NO: 7453617 - DNA, 21 bp, Homo sapiens
taataattccactacagagta

SEQ ID NO: 7453618 - DNA, 21 bp, Homo sapiens
taataattccactacagagta

SEQ ID NO: 7453619 - DNA, 21 bp, Homo sapiens
taataattccactacagagta

SEQ ID NO: 7453620 - DNA, 22 bp, Homo sapiens
caggcagcagaggagtgtggga

SEQ ID NO: 7453621 - DNA, 22 bp, Homo sapiens
caggcagatttgctgccctcca

SEQ ID NO: 7453622 - DNA, 22 bp, Homo sapiens
caggcagcagaggagtgtggga

SEQ ID NO: 7453623 - DNA, 22 bp, Homo sapiens
caggcagcagaggagtgtggga

SEQ ID NO: 7453624 - DNA, 22 bp, Homo sapiens
caggcagatttgctgccctcca

SEQ ID NO: 7453625 - DNA, 22 bp, Homo sapiens
caggcagatttgctgccctcca

SEQ ID NO: 7453626 - DNA, 22 bp, Homo sapiens
caggcagatttgctgccctcca

SEQ ID NO: 7453627 - DNA, 22 bp, Homo sapiens
caggcagatttgctgccctcca

SEQ ID NO: 7453628 - DNA, 22 bp, Homo sapiens
caggcagatttgctgccctcca

SEQ ID NO: 7453629 - DNA, 22 bp, Homo sapiens
caggcagatttgctgccctcca

SEQ ID NO: 7453630 - DNA, 22 bp, Homo sapiens
caggcagatttgctgccctcca

SEQ ID NO: 7453631 - DNA, 22 bp, Homo sapiens
caggcagatgctgacaagagtt

SEQ ID NO: 7453632 - DNA, 22 bp, Homo sapiens
caggcagatgctgacaagagtt

SEQ ID NO: 7453633 - DNA, 22 bp, Homo sapiens
caggcagatgctgacaagagtt

SEQ ID NO: 7453634 - DNA, 22 bp, Homo sapiens
caggcagatgctgacaagagtt

SEQ ID NO: 7453635 - DNA, 22 bp, Homo sapiens
taatacaaggcaggaagcagta

SEQ ID NO: 7453636 - DNA, 22 bp, Homo sapiens
taatacaaggcaggaagcagta

SEQ ID NO: 7453637 - DNA, 22 bp, Homo sapiens
taatacaaggcaggaagcagta

SEQ ID NO: 7453638 - DNA, 22 bp, Homo sapiens
taatacaaggcaggaagcagta

SEQ ID NO: 7453639 - DNA, 22 bp, Homo sapiens
taatacaatggagttgggcccc

SEQ ID NO: 7453640 - DNA, 22 bp, Homo sapiens
taatacaatggagttgggcccc

SEQ ID NO: 7453641 - DNA, 22 bp, Homo sapiens
taatacaatggagttgggcccc

SEQ ID NO: 7453642 - DNA, 22 bp, Homo sapiens
taatacaatggagttgggcccc

SEQ ID NO: 7453643 - DNA, 22 bp, Homo sapiens
taatacaaggcaggaagcagta

SEQ ID NO: 7453644 - DNA, 22 bp, Homo sapiens
taatacactgctttttgtaact

SEQ ID NO: 7453645 - DNA, 22 bp, Homo sapiens
taatacacaagggccagctctt

SEQ ID NO: 7453646 - DNA, 22 bp, Homo sapiens
taatacacactctcattcctaa

SEQ ID NO: 7453647 - DNA, 22 bp, Homo sapiens
taatacacaagggccagctctt

SEQ ID NO: 7453648 - DNA, 22 bp, Homo sapiens
taatacaatggagttgggcccc

SEQ ID NO: 7453649 - DNA, 22 bp, Homo sapiens
taatacaatggagttgggcccc

SEQ ID NO: 7453650 - DNA, 22 bp, Homo sapiens
taatacactgctttttgtaact

SEQ ID NO: 7453651 - DNA, 22 bp, Homo sapiens
taatacagaagtgtattaaaat

SEQ ID NO: 7453652 - DNA, 22 bp, Homo sapiens
taatacagaagtgtattaaaat

SEQ ID NO: 7453653 - DNA, 22 bp, Homo sapiens
taatacagaagtgtattaaaat

SEQ ID NO: 7453654 - DNA, 22 bp, Homo sapiens
taatacagaagtgtattaaaat

SEQ ID NO: 7453655 - DNA, 22 bp, Homo sapiens
taataattggctaaccctggga

SEQ ID NO: 7453656 - DNA, 22 bp, Homo sapiens
taataattggctaaccctggga

SEQ ID NO: 7453657 - DNA, 22 bp, Homo sapiens
taataattggctaaccctggga

SEQ ID NO: 7453658 - DNA, 22 bp, Homo sapiens
taataattggctaaccctggga

SEQ ID NO: 7453659 - DNA, 22 bp, Homo sapiens
taataattttaaagaaggctag

SEQ ID NO: 7453660 - DNA, 22 bp, Homo sapiens
taataattttaaagaaggctag

SEQ ID NO: 7453661 - DNA, 22 bp, Homo sapiens
taataattttaaagaaggctag

SEQ ID NO: 7453662 - DNA, 22 bp, Homo sapiens
taataattttaaagaaggctag

SEQ ID NO: 7453663 - DNA, 22 bp, Homo sapiens
taataattggcaatgttgagca

SEQ ID NO: 7453664 - DNA, 22 bp, Homo sapiens
taataattggcaatgttgagca

SEQ ID NO: 7453665 - DNA, 21 bp, Homo sapiens
taataattccactacagagta

SEQ ID NO: 7453666 - DNA, 22 bp, Homo sapiens
taataattggcaatgttgagca

SEQ ID NO: 7453667 - DNA, 22 bp, Homo sapiens
taataattggcaatgttgagca

SEQ ID NO: 7453668 - DNA, 22 bp, Homo sapiens
taataattggcaatgttgagca

SEQ ID NO: 7453669 - DNA, 20 bp, Homo sapiens
gtgcttcagaagccattgct

SEQ ID NO: 7453670 - DNA, 22 bp, Homo sapiens
gtgcttatgtgggagggagagg

SEQ ID NO: 7453671 - DNA, 20 bp, Homo sapiens
gtgcttcagaagccattgct

SEQ ID NO: 7453672 - DNA, 22 bp, Homo sapiens
gtgcttcactgacctgttttca

SEQ ID NO: 7453673 - DNA, 22 bp, Homo sapiens
gtgcttcactgacctgttttca

SEQ ID NO: 7453674 - DNA, 22 bp, Homo sapiens
gtgcttatgtgggagggagagg

SEQ ID NO: 7453675 - DNA, 22 bp, Homo sapiens
gtgcttaatacatgtcaataac

SEQ ID NO: 7453676 - DNA, 22 bp, Homo sapiens
gtgcttatccccattctggagg

SEQ ID NO: 7453677 - DNA, 22 bp, Homo sapiens
gtgcttaacctagtttctagta

SEQ ID NO: 7453678 - DNA, 22 bp, Homo sapiens
gtgcttaacctagtttctagta

SEQ ID NO: 7453679 - DNA, 22 bp, Homo sapiens
gtgcttaaaacagaaaacattg

SEQ ID NO: 7453680 - DNA, 22 bp, Homo sapiens
gtgcttatccccattctggagg

SEQ ID NO: 7453681 - DNA, 22 bp, Homo sapiens
gtgcttaaggcagtctgtcaaa

SEQ ID NO: 7453682 - DNA, 22 bp, Homo sapiens
gtgcttaagcttctgctttatg

SEQ ID NO: 7453683 - DNA, 22 bp, Homo sapiens
gtgcttccccaagccacagcct

SEQ ID NO: 7453684 - DNA, 22 bp, Homo sapiens
gtgcttcctgtattgattccat

SEQ ID NO: 7453685 - DNA, 22 bp, Homo sapiens
gtgcttcctgtattgattccat

SEQ ID NO: 7453686 - DNA, 22 bp, Homo sapiens
gtgcttctccgttctgcagcac

SEQ ID NO: 7453687 - DNA, 22 bp, Homo sapiens
gtgcttctccgttctgcagcac

SEQ ID NO: 7453688 - DNA, 22 bp, Homo sapiens
gtgcttctccgttctgcagcac

SEQ ID NO: 7453689 - DNA, 22 bp, Homo sapiens
gtgcttctccgttctgcagcac

SEQ ID NO: 7453690 - DNA, 22 bp, Homo sapiens
gtgcttctttctcctcaagcct

SEQ ID NO: 7453691 - DNA, 22 bp, Homo sapiens
gtgcttctcttcacacccaact

SEQ ID NO: 7453692 - DNA, 22 bp, Homo sapiens
cagctcacccatcacgtctgct

SEQ ID NO: 7453693 - DNA, 22 bp, Homo sapiens
cagctcacagccacgccattcc

SEQ ID NO: 7453694 - DNA, 22 bp, Homo sapiens
cagctcacagccacgccattcc

SEQ ID NO: 7453695 - DNA, 22 bp, Homo sapiens
cagctcacagccacgccattcc

SEQ ID NO: 7453696 - DNA, 22 bp, Homo sapiens
cagctcacccatcacgtctgct

SEQ ID NO: 7453697 - DNA, 22 bp, Homo sapiens
cagctcacccatcacgtctgct

SEQ ID NO: 7453698 - DNA, 22 bp, Homo sapiens
cagctcacttgtttcatcttct

SEQ ID NO: 7453699 - DNA, 22 bp, Homo sapiens
cagctcacttgtttcatcttct

SEQ ID NO: 7453700 - DNA, 22 bp, Homo sapiens
cagctcacttgtttcatcttct

SEQ ID NO: 7453701 - DNA, 22 bp, Homo sapiens
cagctattttgcctatcatggt

SEQ ID NO: 7453702 - DNA, 22 bp, Homo sapiens
cagctcaagtttcccaggtcag

SEQ ID NO: 7453703 - DNA, 22 bp, Homo sapiens
cagctcaatagcctaccttaat

SEQ ID NO: 7453704 - DNA, 22 bp, Homo sapiens
cagctcagacgcaggtcgagca

SEQ ID NO: 7453705 - DNA, 22 bp, Homo sapiens
cagctcagacgcaggtcgagca

SEQ ID NO: 7453706 - DNA, 22 bp, Homo sapiens
cagctcagacgcaggtcgagca

SEQ ID NO: 7453707 - DNA, 22 bp, Homo sapiens
cagctcagacgcaggtcgagca

SEQ ID NO: 7453708 - DNA, 22 bp, Homo sapiens
cagctcagacgcaggtcgagca

SEQ ID NO: 7453709 - DNA, 22 bp, Homo sapiens
cagctcagacgcaggtcgagca

SEQ ID NO: 7453710 - DNA, 22 bp, Homo sapiens
cagctcagacgcaggtcgagca

SEQ ID NO: 7453711 - DNA, 22 bp, Homo sapiens
cagctcagacgcaggtcgagca

SEQ ID NO: 7453712 - DNA, 22 bp, Homo sapiens
cagctcagacgcaggtcgagca

SEQ ID NO: 7453713 - DNA, 22 bp, Homo sapiens
cagctcagacgcaggtcgagca

SEQ ID NO: 7453714 - DNA, 22 bp, Homo sapiens
cagctcagacgcaggtcgagca

SEQ ID NO: 7453715 - DNA, 22 bp, Homo sapiens
cagctattggcaagaagtggtg

SEQ ID NO: 7453716 - DNA, 22 bp, Homo sapiens
cagctattggtccacaggtatg

SEQ ID NO: 7453717 - DNA, 22 bp, Homo sapiens
cagctattggtccacaggtatg

SEQ ID NO: 7453718 - DNA, 22 bp, Homo sapiens
cagctattggtccacaggtatg

SEQ ID NO: 7453719 - DNA, 22 bp, Homo sapiens
cagctattggtccacaggtatg

SEQ ID NO: 7453720 - DNA, 22 bp, Homo sapiens
cagctattgataaatgttgggg

SEQ ID NO: 7453721 - DNA, 22 bp, Homo sapiens
gtgcttctgccaactaattaac

SEQ ID NO: 7453722 - DNA, 22 bp, Homo sapiens
cagctattgataaatgttgggg

SEQ ID NO: 7453723 - DNA, 22 bp, Homo sapiens
cagctattggcaagaagtggtg

SEQ ID NO: 7453724 - DNA, 22 bp, Homo sapiens
cagctattgttctgtataatga

SEQ ID NO: 7453725 - DNA, 22 bp, Homo sapiens
cagctatttatctttcatgata

SEQ ID NO: 7453726 - DNA, 22 bp, Homo sapiens
cagctattgttctgtataatga

SEQ ID NO: 7453727 - DNA, 22 bp, Homo sapiens
cagctattgttctgtataatga

SEQ ID NO: 7453728 - DNA, 22 bp, Homo sapiens
cagctattggtccacaggtatg

SEQ ID NO: 7453729 - DNA, 22 bp, Homo sapiens
cagctatttgtaggaaaactgt

SEQ ID NO: 7453730 - DNA, 22 bp, Homo sapiens
cagctattttctcattaaggat

SEQ ID NO: 7453731 - DNA, 22 bp, Homo sapiens
cagctattttctcattaaggat

SEQ ID NO: 7453732 - DNA, 18 bp, Homo sapiens
taagtcattttgccagca

SEQ ID NO: 7453733 - DNA, 22 bp, Homo sapiens
taagtcatttggagccactgga

SEQ ID NO: 7453734 - DNA, 18 bp, Homo sapiens
taagtcatttgaaatgcc

SEQ ID NO: 7453735 - DNA, 18 bp, Homo sapiens
taagtcatttgaaatgcc

SEQ ID NO: 7453736 - DNA, 22 bp, Homo sapiens
taagtcattaggctgagttcaa

SEQ ID NO: 7453737 - DNA, 22 bp, Homo sapiens
taagtcatggagctgggattga

SEQ ID NO: 7453738 - DNA, 22 bp, Homo sapiens
taagtccaagggtatgagttgg

SEQ ID NO: 7453739 - DNA, 22 bp, Homo sapiens
taagtccaagggtatgagttgg

SEQ ID NO: 7453740 - DNA, 22 bp, Homo sapiens
taagtccacaggagttgtgttc

SEQ ID NO: 7453741 - DNA, 22 bp, Homo sapiens
taagtccacaggctgacagcgg

SEQ ID NO: 7453742 - DNA, 22 bp, Homo sapiens
taagtccataatggcagtaaat

SEQ ID NO: 7453743 - DNA, 22 bp, Homo sapiens
taagtcctagatgattcacaga

SEQ ID NO: 7453744 - DNA, 22 bp, Homo sapiens
taagtccataatggcagtaaat

SEQ ID NO: 7453745 - DNA, 22 bp, Homo sapiens
taagtccacctcattcttcagc

SEQ ID NO: 7453746 - DNA, 22 bp, Homo sapiens
taagtccacctcattcttcagc

SEQ ID NO: 7453747 - DNA, 22 bp, Homo sapiens
taagtccactatatccttctct

SEQ ID NO: 7453748 - DNA, 22 bp, Homo sapiens
taagtccagtgttctctctgtg

SEQ ID NO: 7453749 - DNA, 22 bp, Homo sapiens
taagtcgtggatgattcttcgg

SEQ ID NO: 7453750 - DNA, 22 bp, Homo sapiens
taagtcgtggatgattcttcgg

SEQ ID NO: 7453751 - DNA, 22 bp, Homo sapiens
taagtcgtggatgattcttcgg

SEQ ID NO: 7453752 - DNA, 22 bp, Homo sapiens
taagtctctcgtttgattcatt

SEQ ID NO: 7453753 - DNA, 22 bp, Homo sapiens
taagtcttcatagtctaatgtc

SEQ ID NO: 7453754 - DNA, 22 bp, Homo sapiens
taagtcctaatggcagaagtct

SEQ ID NO: 7453755 - DNA, 22 bp, Homo sapiens
taagtcctattccaggtctctc

SEQ ID NO: 7453756 - DNA, 22 bp, Homo sapiens
taagtcattaggctgagttcaa

SEQ ID NO: 7453757 - DNA, 22 bp, Homo sapiens
taagtcctagatgattcacaga

SEQ ID NO: 7453758 - DNA, 22 bp, Homo sapiens
taagtgaaatggtgcatcaaat

SEQ ID NO: 7453759 - DNA, 22 bp, Homo sapiens
caggcaccaatagggatcgtgg

SEQ ID NO: 7453760 - DNA, 22 bp, Homo sapiens
taagtgaaataagtcagataca

SEQ ID NO: 7453761 - DNA, 22 bp, Homo sapiens
taagtgaaatggtgcatcaaat

SEQ ID NO: 7453762 - DNA, 22 bp, Homo sapiens
taagtcttgaaatatttcctat

SEQ ID NO: 7453763 - DNA, 22 bp, Homo sapiens
taagtcttcatagtctaatgtc

SEQ ID NO: 7453764 - DNA, 22 bp, Homo sapiens
taagtcttgaaatatttcctat

SEQ ID NO: 7453765 - DNA, 22 bp, Homo sapiens
taagtcttgaaatatttcctat

SEQ ID NO: 7453766 - DNA, 22 bp, Homo sapiens
taagtgaaaatggtttcccagc

SEQ ID NO: 7453767 - DNA, 22 bp, Homo sapiens
taagtgaaaatggtttcccagc

SEQ ID NO: 7453768 - DNA, 22 bp, Homo sapiens
taagtgaaataagtcagataca

SEQ ID NO: 7453769 - DNA, 22 bp, Homo sapiens
taagtgaaataagtcagataca

SEQ ID NO: 7453770 - DNA, 22 bp, Homo sapiens
taagtcatcacattgcagagat

SEQ ID NO: 7453771 - DNA, 22 bp, Homo sapiens
taagtcatatgtgtcccaagtc

SEQ ID NO: 7453772 - DNA, 22 bp, Homo sapiens
taagtcatagattaatggccac

SEQ ID NO: 7453773 - DNA, 22 bp, Homo sapiens
taagtcatagagcggaagacca

SEQ ID NO: 7453774 - DNA, 22 bp, Homo sapiens
taagtcataagtcatgatgtta

SEQ ID NO: 7453775 - DNA, 22 bp, Homo sapiens
taagtcatgattctgtgttact

SEQ ID NO: 7453776 - DNA, 22 bp, Homo sapiens
taagtcatcgcaggagtttggt

SEQ ID NO: 7453777 - DNA, 22 bp, Homo sapiens
taagtcatcccataacagtgct

SEQ ID NO: 7453778 - DNA, 22 bp, Homo sapiens
taagtcatcccataacagtgct

SEQ ID NO: 7453779 - DNA, 22 bp, Homo sapiens
taagtcataagtcaacaaagga

SEQ ID NO: 7453780 - DNA, 22 bp, Homo sapiens
taagtcaggaggtctcctgaca

SEQ ID NO: 7453781 - DNA, 22 bp, Homo sapiens
taagtcacttattccacaagat

SEQ ID NO: 7453782 - DNA, 22 bp, Homo sapiens
taagtcacttaagtttgcatgt

SEQ ID NO: 7453783 - DNA, 22 bp, Homo sapiens
taagtcacttaagtttgcatgt

SEQ ID NO: 7453784 - DNA, 22 bp, Homo sapiens
taagtcaaggtggcatttgaga

SEQ ID NO: 7453785 - DNA, 22 bp, Homo sapiens
taagtcaaggtggcatttgaga

SEQ ID NO: 7453786 - DNA, 22 bp, Homo sapiens
taagtattggcctatagctaga

SEQ ID NO: 7453787 - DNA, 22 bp, Homo sapiens
taagtattggcctatagctaga

SEQ ID NO: 7453788 - DNA, 22 bp, Homo sapiens
taagtattggcctatagctaga

SEQ ID NO: 7453789 - DNA, 23 bp, Homo sapiens
cagctcagcacataggaggtact

SEQ ID NO: 7453790 - DNA, 23 bp, Homo sapiens
cagctcagcacataggaggtact

SEQ ID NO: 7453791 - DNA, 23 bp, Homo sapiens
cagctcagagtgtgtcctgtttc

SEQ ID NO: 7453792 - DNA, 23 bp, Homo sapiens
cagctcagagtgtgtcctgtttc

SEQ ID NO: 7453793 - DNA, 23 bp, Homo sapiens
cagctcagagtgtgtcctgtttc

SEQ ID NO: 7453794 - DNA, 22 bp, Homo sapiens
taaggcagctgagcttctaaca

SEQ ID NO: 7453795 - DNA, 22 bp, Homo sapiens
taaggcagcctcagggtagggt

SEQ ID NO: 7453796 - DNA, 23 bp, Homo sapiens
cagctcagcacataggaggtact

SEQ ID NO: 7453797 - DNA, 23 bp, Homo sapiens
cagctcagcacataggaggtact

SEQ ID NO: 7453798 - DNA, 22 bp, Homo sapiens
taaggcagctgagcttctaaca

SEQ ID NO: 7453799 - DNA, 22 bp, Homo sapiens
taaggcaggaactggctgtttt

SEQ ID NO: 7453800 - DNA, 19 bp, Homo sapiens
taagtagtcaaatagtaac

SEQ ID NO: 7453801 - DNA, 22 bp, Homo sapiens
taaggcaggaactggctgtttt

SEQ ID NO: 7453802 - DNA, 22 bp, Homo sapiens
taagtatgttagaaaatcaagt

SEQ ID NO: 7453803 - DNA, 22 bp, Homo sapiens
taagtagtcctgatttaacctt

SEQ ID NO: 7453804 - DNA, 22 bp, Homo sapiens
taaggcagctgagcttctaaca

SEQ ID NO: 7453805 - DNA, 22 bp, Homo sapiens
taagtattggcctatagctaga

SEQ ID NO: 7453806 - DNA, 22 bp, Homo sapiens
tagaaaatgttccactgccatt

SEQ ID NO: 7453807 - DNA, 22 bp, Homo sapiens
tagaaaatgttccactgccatt

SEQ ID NO: 7453808 - DNA, 22 bp, Homo sapiens
tagaaaatgttccactgccatt

SEQ ID NO: 7453809 - DNA, 22 bp, Homo sapiens
tagaaaatgttccactgccatt

SEQ ID NO: 7453810 - DNA, 22 bp, Homo sapiens
tagaaaatgttccactgccatt

SEQ ID NO: 7453811 - DNA, 22 bp, Homo sapiens
tagaaacaaaatctgatgactc

SEQ ID NO: 7453812 - DNA, 22 bp, Homo sapiens
tagaaacaaaatctgatgactc

SEQ ID NO: 7453813 - DNA, 22 bp, Homo sapiens
tagaaacaaaatctgatgactc

SEQ ID NO: 7453814 - DNA, 22 bp, Homo sapiens
tagaaaatgttccactgccatt

SEQ ID NO: 7453815 - DNA, 22 bp, Homo sapiens
tagaaaatgttccactgccatt

SEQ ID NO: 7453816 - DNA, 22 bp, Homo sapiens
tagaaaatgttccactgccatt

SEQ ID NO: 7453817 - DNA, 22 bp, Homo sapiens
tagaaacaaagacctgggtgct

SEQ ID NO: 7453818 - DNA, 22 bp, Homo sapiens
tagaaacaaagacctgggtgct

SEQ ID NO: 7453819 - DNA, 22 bp, Homo sapiens
tagaaacaaagacctgggtgct

SEQ ID NO: 7453820 - DNA, 22 bp, Homo sapiens
tagaaacaaagacctgggtgct

SEQ ID NO: 7453821 - DNA, 22 bp, Homo sapiens
tagaaacaaagacctgggtgct

SEQ ID NO: 7453822 - DNA, 22 bp, Homo sapiens
tagaaacaaaatctgatgactc

SEQ ID NO: 7453823 - DNA, 22 bp, Homo sapiens
tagaaacaaaatctgatgactc

SEQ ID NO: 7453824 - DNA, 22 bp, Homo sapiens
tagaaacaaaatctgatgactc

SEQ ID NO: 7453825 - DNA, 22 bp, Homo sapiens
tagaaacaaaatctgatgactc

SEQ ID NO: 7453826 - DNA, 22 bp, Homo sapiens
tagaaacaaaatctgatgactc

SEQ ID NO: 7453827 - DNA, 22 bp, Homo sapiens
tagaaaatagggcctgtggagc

SEQ ID NO: 7453828 - DNA, 22 bp, Homo sapiens
tagaaaatagggcctgtggagc

SEQ ID NO: 7453829 - DNA, 22 bp, Homo sapiens
tagaaaagtatgggactgacat

SEQ ID NO: 7453830 - DNA, 22 bp, Homo sapiens
tagaaaagtatgggactgacat

SEQ ID NO: 7453831 - DNA, 22 bp, Homo sapiens
tagaaaatagggcctgtggagc

SEQ ID NO: 7453832 - DNA, 22 bp, Homo sapiens
tagaaaatagggcctgtggagc

SEQ ID NO: 7453833 - DNA, 22 bp, Homo sapiens
tagaaaatagggcctgtggagc

SEQ ID NO: 7453834 - DNA, 22 bp, Homo sapiens
tagaaaatagggcctgtggagc

SEQ ID NO: 7453835 - DNA, 22 bp, Homo sapiens
tagaaaatccagtgtggggaga

SEQ ID NO: 7453836 - DNA, 22 bp, Homo sapiens
tagaaaatccagtgtggggaga

SEQ ID NO: 7453837 - DNA, 22 bp, Homo sapiens
tagaaaatagggcctgtggagc

SEQ ID NO: 7453838 - DNA, 22 bp, Homo sapiens
tagaaaatggccaagcaggact

SEQ ID NO: 7453839 - DNA, 22 bp, Homo sapiens
tagaaaatggccaagcaggact

SEQ ID NO: 7453840 - DNA, 22 bp, Homo sapiens
tagaaaatggccaagcaggact

SEQ ID NO: 7453841 - DNA, 22 bp, Homo sapiens
tagaaaatggccaagcaggact

SEQ ID NO: 7453842 - DNA, 22 bp, Homo sapiens
tagaaaatggccaagcaggact

SEQ ID NO: 7453843 - DNA, 22 bp, Homo sapiens
tagaaaatggccaagcaggact

SEQ ID NO: 7453844 - DNA, 22 bp, Homo sapiens
tagaaaagtatgggactgacat

SEQ ID NO: 7453845 - DNA, 22 bp, Homo sapiens
tagaaaagtatgggactgacat

SEQ ID NO: 7453846 - DNA, 22 bp, Homo sapiens
tagaaaagtatgggactgacat

SEQ ID NO: 7453847 - DNA, 22 bp, Homo sapiens
tagaaaagccccagctggaggg

SEQ ID NO: 7453848 - DNA, 22 bp, Homo sapiens
tagaaaagctctaaggcctctc

SEQ ID NO: 7453849 - DNA, 22 bp, Homo sapiens
caggctgggcagcctccccggc

SEQ ID NO: 7453850 - DNA, 22 bp, Homo sapiens
tagaaaagctctaaggcctctc

SEQ ID NO: 7453851 - DNA, 22 bp, Homo sapiens
tagaaaagctctaaggcctctc

SEQ ID NO: 7453852 - DNA, 22 bp, Homo sapiens
caggctgggcagcctccccggc

SEQ ID NO: 7453853 - DNA, 22 bp, Homo sapiens
caggctgggactgacccctgct

SEQ ID NO: 7453854 - DNA, 22 bp, Homo sapiens
caggctgggactgacccctgct

SEQ ID NO: 7453855 - DNA, 22 bp, Homo sapiens
caggctgggactgacccctgct

SEQ ID NO: 7453856 - DNA, 22 bp, Homo sapiens
caggctgggactgacccctgct

SEQ ID NO: 7453857 - DNA, 22 bp, Homo sapiens
caggctgggactgacccctgct

SEQ ID NO: 7453858 - DNA, 22 bp, Homo sapiens
caggctgggactgacccctgct

SEQ ID NO: 7453859 - DNA, 22 bp, Homo sapiens
caggctgggaacgccacccgct

SEQ ID NO: 7453860 - DNA, 22 bp, Homo sapiens
caggctgggactgacccctgct

SEQ ID NO: 7453861 - DNA, 22 bp, Homo sapiens
caggctgggactgacccctgct

SEQ ID NO: 7453862 - DNA, 22 bp, Homo sapiens
caggctgggaacgccacccgct

SEQ ID NO: 7453863 - DNA, 22 bp, Homo sapiens
caggctggcaatgcgtcaagca

SEQ ID NO: 7453864 - DNA, 22 bp, Homo sapiens
caggctggcaatgcgtcaagca

SEQ ID NO: 7453865 - DNA, 22 bp, Homo sapiens
caggctggcaatgcgtcaagca

SEQ ID NO: 7453866 - DNA, 22 bp, Homo sapiens
caggctggcaatgcgtcaagca

SEQ ID NO: 7453867 - DNA, 22 bp, Homo sapiens
caggctgggactgacccctgct

SEQ ID NO: 7453868 - DNA, 22 bp, Homo sapiens
caggctgggaacgccacccgct

SEQ ID NO: 7453869 - DNA, 22 bp, Homo sapiens
caggctgggaacgccacccgct

SEQ ID NO: 7453870 - DNA, 22 bp, Homo sapiens
caggctgggaacgccacccgct

SEQ ID NO: 7453871 - DNA, 22 bp, Homo sapiens
caggctgggaacgccacccgct

SEQ ID NO: 7453872 - DNA, 22 bp, Homo sapiens
caggctgggaacgccacccgct

SEQ ID NO: 7453873 - DNA, 22 bp, Homo sapiens
caggctgggaacgccacccgct

SEQ ID NO: 7453874 - DNA, 22 bp, Homo sapiens
caggctgggaacgccacccgct

SEQ ID NO: 7453875 - DNA, 22 bp, Homo sapiens
caggctgggaacgccacccgct

SEQ ID NO: 7453876 - DNA, 22 bp, Homo sapiens
caggctgccaaggctggggagg

SEQ ID NO: 7453877 - DNA, 22 bp, Homo sapiens
caggctgccaaggctggggagg

SEQ ID NO: 7453878 - DNA, 22 bp, Homo sapiens
caggctgcccggcaagttgcgc

SEQ ID NO: 7453879 - DNA, 22 bp, Homo sapiens
caggctgcccggcaagttgcgc

SEQ ID NO: 7453880 - DNA, 22 bp, Homo sapiens
caggctgcccggcaagttgcgc

SEQ ID NO: 7453881 - DNA, 22 bp, Homo sapiens
caggctgccaaggctggggagg

SEQ ID NO: 7453882 - DNA, 22 bp, Homo sapiens
caggctgccaaggctggggagg

SEQ ID NO: 7453883 - DNA, 22 bp, Homo sapiens
caggctgccaaggctggggagg

SEQ ID NO: 7453884 - DNA, 22 bp, Homo sapiens
caggctgccaaggctggggagg

SEQ ID NO: 7453885 - DNA, 22 bp, Homo sapiens
caggctgccaaggctggggagg

SEQ ID NO: 7453886 - DNA, 22 bp, Homo sapiens
caggctgccaaggctggggagg

SEQ ID NO: 7453887 - DNA, 22 bp, Homo sapiens
caggctgcatggaggggtacag

SEQ ID NO: 7453888 - DNA, 22 bp, Homo sapiens
caggctgccaaggctggggagg

SEQ ID NO: 7453889 - DNA, 22 bp, Homo sapiens
caggctgcatggaggggtacag

SEQ ID NO: 7453890 - DNA, 22 bp, Homo sapiens
caggctgcatggaggggtacag

SEQ ID NO: 7453891 - DNA, 22 bp, Homo sapiens
caggctgcatggaggggtacag

SEQ ID NO: 7453892 - DNA, 22 bp, Homo sapiens
caggctgcatggaggggtacag

SEQ ID NO: 7453893 - DNA, 22 bp, Homo sapiens
caggctgcagtgcagtggctat

SEQ ID NO: 7453894 - DNA, 22 bp, Homo sapiens
caggctgcagtgcagtggctat

SEQ ID NO: 7453895 - DNA, 22 bp, Homo sapiens
caggctgcagtgcagtggctat

SEQ ID NO: 7453896 - DNA, 22 bp, Homo sapiens
caggctgcagtgcagtggctat

SEQ ID NO: 7453897 - DNA, 22 bp, Homo sapiens
caggctgcagtgcagtggctat

SEQ ID NO: 7453898 - DNA, 22 bp, Homo sapiens
caggctgcagtgcagtggctat

SEQ ID NO: 7453899 - DNA, 22 bp, Homo sapiens
caggctgccctagcttggacat

SEQ ID NO: 7453900 - DNA, 22 bp, Homo sapiens
caggctgccctagcttggacat

SEQ ID NO: 7453901 - DNA, 22 bp, Homo sapiens
caggctgccctagcttggacat

SEQ ID NO: 7453902 - DNA, 22 bp, Homo sapiens
caggctgcccggcaagttgcgc

SEQ ID NO: 7453903 - DNA, 22 bp, Homo sapiens
caggctgccctagcttggacat

SEQ ID NO: 7453904 - DNA, 22 bp, Homo sapiens
caggctgccgaggctgcagaat

SEQ ID NO: 7453905 - DNA, 22 bp, Homo sapiens
caggctgccgaggctgcagaat

SEQ ID NO: 7453906 - DNA, 22 bp, Homo sapiens
caggctgccgaggctgcagaat

SEQ ID NO: 7453907 - DNA, 22 bp, Homo sapiens
caggctgccctagcttggacat

SEQ ID NO: 7453908 - DNA, 22 bp, Homo sapiens
caggctgccgaggctgcagaat

SEQ ID NO: 7453909 - DNA, 22 bp, Homo sapiens
caggctgccgaggctgcagaat

SEQ ID NO: 7453910 - DNA, 22 bp, Homo sapiens
caggctgccgtgaagcaggcct

SEQ ID NO: 7453911 - DNA, 22 bp, Homo sapiens
caggctgccgtgaagcaggcct

SEQ ID NO: 7453912 - DNA, 22 bp, Homo sapiens
caggctgccgtgaagcaggcct

SEQ ID NO: 7453913 - DNA, 22 bp, Homo sapiens
caggctgccgtgaagcaggcct

SEQ ID NO: 7453914 - DNA, 22 bp, Homo sapiens
caggctgccgtgaagcaggcct

SEQ ID NO: 7453915 - DNA, 22 bp, Homo sapiens
caggctgccgaggctgcagaat

SEQ ID NO: 7453916 - DNA, 22 bp, Homo sapiens
caggctgccgaggctgcagaat

SEQ ID NO: 7453917 - DNA, 22 bp, Homo sapiens
caggctgccgtgaagcaggcct

SEQ ID NO: 7453918 - DNA, 22 bp, Homo sapiens
caggctgccgtgaagcaggcct

SEQ ID NO: 7453919 - DNA, 22 bp, Homo sapiens
caggctgccgtggggtccaggc

SEQ ID NO: 7453920 - DNA, 22 bp, Homo sapiens
caggctgccgtggggtccaggc

SEQ ID NO: 7453921 - DNA, 22 bp, Homo sapiens
caggctgccgtggggtccaggc

SEQ ID NO: 7453922 - DNA, 22 bp, Homo sapiens
caggctgccgtggggtccaggc

SEQ ID NO: 7453923 - DNA, 22 bp, Homo sapiens
caggctgccgtgaagcaggcct

SEQ ID NO: 7453924 - DNA, 22 bp, Homo sapiens
caggctgccgtgaagcaggcct

SEQ ID NO: 7453925 - DNA, 22 bp, Homo sapiens
caggctgccgtgaagcaggcct

SEQ ID NO: 7453926 - DNA, 22 bp, Homo sapiens
caggctggagtgcagtggtgcc

SEQ ID NO: 7453927 - DNA, 22 bp, Homo sapiens
caggctggagtgcagtggtgcc

SEQ ID NO: 7453928 - DNA, 22 bp, Homo sapiens
caggctggagtgcagtggtgcc

SEQ ID NO: 7453929 - DNA, 22 bp, Homo sapiens
caggctggagtgcagtggtgcc

SEQ ID NO: 7453930 - DNA, 22 bp, Homo sapiens
caggctggagtgcagtggtgcc

SEQ ID NO: 7453931 - DNA, 22 bp, Homo sapiens
caggctggagtgcagtggtgcc

SEQ ID NO: 7453932 - DNA, 22 bp, Homo sapiens
caggctggagttcagtggtgtg

SEQ ID NO: 7453933 - DNA, 22 bp, Homo sapiens
caggctggagtgcagtggtgcc

SEQ ID NO: 7453934 - DNA, 22 bp, Homo sapiens
caggctggagtgcagtggtgcc

SEQ ID NO: 7453935 - DNA, 22 bp, Homo sapiens
caggctggagtgcagtggtgcc

SEQ ID NO: 7453936 - DNA, 22 bp, Homo sapiens
caggctggagtgcagtggtgcc

SEQ ID NO: 7453937 - DNA, 22 bp, Homo sapiens
caggctggagtgcagtggtgcc

SEQ ID NO: 7453938 - DNA, 22 bp, Homo sapiens
caggctggagttcagtggtgtg

SEQ ID NO: 7453939 - DNA, 22 bp, Homo sapiens
caggctggagttcagtggtgtg

SEQ ID NO: 7453940 - DNA, 22 bp, Homo sapiens
caggctggagttcagtggtgtg

SEQ ID NO: 7453941 - DNA, 22 bp, Homo sapiens
caggctggagttcagtggtgtg

SEQ ID NO: 7453942 - DNA, 22 bp, Homo sapiens
caggctggagttcagtggtgtg

SEQ ID NO: 7453943 - DNA, 22 bp, Homo sapiens
caggctggagttcagtggtgtg

SEQ ID NO: 7453944 - DNA, 22 bp, Homo sapiens
caggctggagttcagtggtgtg

SEQ ID NO: 7453945 - DNA, 22 bp, Homo sapiens
caggctggagttcagtggtgtg

SEQ ID NO: 7453946 - DNA, 22 bp, Homo sapiens
caggctggagttcagtggtgtg

SEQ ID NO: 7453947 - DNA, 22 bp, Homo sapiens
caggctggagttcagtggtgtg

SEQ ID NO: 7453948 - DNA, 22 bp, Homo sapiens
caggctggagttcagtggtgtg

SEQ ID NO: 7453949 - DNA, 22 bp, Homo sapiens
caggctggagttcagtggtgtg

SEQ ID NO: 7453950 - DNA, 22 bp, Homo sapiens
caggctggcaatgcgtcaagca

SEQ ID NO: 7453951 - DNA, 22 bp, Homo sapiens
caggctggagttcagtggtgtg

SEQ ID NO: 7453952 - DNA, 22 bp, Homo sapiens
caggctggagttcagtggtgtg

SEQ ID NO: 7453953 - DNA, 22 bp, Homo sapiens
caggctggagttcagtggtgtg

SEQ ID NO: 7453954 - DNA, 22 bp, Homo sapiens
caggctggagttcagtggtgtg

SEQ ID NO: 7453955 - DNA, 22 bp, Homo sapiens
caggctggagttcagtggtgtg

SEQ ID NO: 7453956 - DNA, 22 bp, Homo sapiens
cagggaaggctgcaaatgttaa

SEQ ID NO: 7453957 - DNA, 22 bp, Homo sapiens
cagggaaggctgcaaatgttaa

SEQ ID NO: 7453958 - DNA, 22 bp, Homo sapiens
cagggacaaacaaggttgggga

SEQ ID NO: 7453959 - DNA, 22 bp, Homo sapiens
cagggacaaacaaggttgggga

SEQ ID NO: 7453960 - DNA, 22 bp, Homo sapiens
cagggacaaacaaggttgggga

SEQ ID NO: 7453961 - DNA, 22 bp, Homo sapiens
cagggacaaacaaggttgggga

SEQ ID NO: 7453962 - DNA, 22 bp, Homo sapiens
cagggacaaagtgagaaaggaa

SEQ ID NO: 7453963 - DNA, 22 bp, Homo sapiens
cagggacaaagtgagaaaggaa

SEQ ID NO: 7453964 - DNA, 22 bp, Homo sapiens
cagggacaaagtgagaaaggaa

SEQ ID NO: 7453965 - DNA, 22 bp, Homo sapiens
cagggacaaagtgagaaaggaa

SEQ ID NO: 7453966 - DNA, 22 bp, Homo sapiens
cagggacaaagtgagaaaggaa

SEQ ID NO: 7453967 - DNA, 22 bp, Homo sapiens
cagggacaaagtgagaaaggaa

SEQ ID NO: 7453968 - DNA, 22 bp, Homo sapiens
cagggacaatggcagagcctga

SEQ ID NO: 7453969 - DNA, 22 bp, Homo sapiens
cagggacaatggcagagcctga

SEQ ID NO: 7453970 - DNA, 22 bp, Homo sapiens
cagggacaaggaataagattag

SEQ ID NO: 7453971 - DNA, 22 bp, Homo sapiens
cagggacaatggcagagcctga

SEQ ID NO: 7453972 - DNA, 22 bp, Homo sapiens
cagggacaaggaataagattag

SEQ ID NO: 7453973 - DNA, 22 bp, Homo sapiens
cagggacaatggcagagcctga

SEQ ID NO: 7453974 - DNA, 22 bp, Homo sapiens
cagggacaatggcagagcctga

SEQ ID NO: 7453975 - DNA, 22 bp, Homo sapiens
cagggacaatggcagagcctga

SEQ ID NO: 7453976 - DNA, 22 bp, Homo sapiens
cagggacaatggcagagcctga

SEQ ID NO: 7453977 - DNA, 22 bp, Homo sapiens
cagggacagcactaaactcttg

SEQ ID NO: 7453978 - DNA, 22 bp, Homo sapiens
cagggacagcactaaactcttg

SEQ ID NO: 7453979 - DNA, 22 bp, Homo sapiens
cagggacagcactaaactcttg

SEQ ID NO: 7453980 - DNA, 22 bp, Homo sapiens
cagggacagcactaaactcttg

SEQ ID NO: 7453981 - DNA, 20 bp, Homo sapiens
cagggacagcagtgggtttt

SEQ ID NO: 7453982 - DNA, 20 bp, Homo sapiens
cagggacagcagtgggtttt

SEQ ID NO: 7453983 - DNA, 20 bp, Homo sapiens
cagggacagcagtgggtttt

SEQ ID NO: 7453984 - DNA, 20 bp, Homo sapiens
cagggacagcagtgggtttt

SEQ ID NO: 7453985 - DNA, 22 bp, Homo sapiens
cagggacagagactgcaccttg

SEQ ID NO: 7453986 - DNA, 22 bp, Homo sapiens
cagggacagagactgcaccttg

SEQ ID NO: 7453987 - DNA, 22 bp, Homo sapiens
cagggacagagactgcaccttg

SEQ ID NO: 7453988 - DNA, 22 bp, Homo sapiens
cagggacagagactgcaccttg

SEQ ID NO: 7453989 - DNA, 22 bp, Homo sapiens
cagggacagagactgcaccttg

SEQ ID NO: 7453990 - DNA, 22 bp, Homo sapiens
cagggacaatggcagagcctga

SEQ ID NO: 7453991 - DNA, 22 bp, Homo sapiens
cagggacagagactgcaccttg

SEQ ID NO: 7453992 - DNA, 22 bp, Homo sapiens
cagggacagacagatatatttg

SEQ ID NO: 7453993 - DNA, 22 bp, Homo sapiens
cagggacagagactgcaccttg

SEQ ID NO: 7453994 - DNA, 22 bp, Homo sapiens
cagggacagagactgcaccttg

SEQ ID NO: 7453995 - DNA, 22 bp, Homo sapiens
tagattcatgcagtatgctagt

SEQ ID NO: 7453996 - DNA, 22 bp, Homo sapiens
tagattcattttagcaaaagtt

SEQ ID NO: 7453997 - DNA, 22 bp, Homo sapiens
tagattctaagattctaagaat

SEQ ID NO: 7453998 - DNA, 22 bp, Homo sapiens
tagattcatgcagtatgctagt

SEQ ID NO: 7453999 - DNA, 22 bp, Homo sapiens
tagattcagatatttaggacaa

SEQ ID NO: 7454000 - DNA, 22 bp, Homo sapiens
tagattcatgcagtatgctagt

SEQ ID NO: 7454001 - DNA, 22 bp, Homo sapiens
tagattcatgcagtatgctagt

SEQ ID NO: 7454002 - DNA, 22 bp, Homo sapiens
tagattcagatatttaggacaa

SEQ ID NO: 7454003 - DNA, 22 bp, Homo sapiens
tagattcagatatttaggacaa

SEQ ID NO: 7454004 - DNA, 22 bp, Homo sapiens
tagattcagatatttaggacaa

SEQ ID NO: 7454005 - DNA, 22 bp, Homo sapiens
tagattcagatatttaggacaa

SEQ ID NO: 7454006 - DNA, 22 bp, Homo sapiens
tagattcagatatttaggacaa

SEQ ID NO: 7454007 - DNA, 22 bp, Homo sapiens
tagattcaagtattcagtttgg

SEQ ID NO: 7454008 - DNA, 22 bp, Homo sapiens
tagattatccctgatttgtcca

SEQ ID NO: 7454009 - DNA, 22 bp, Homo sapiens
tagattcaagtattcagtttgg

SEQ ID NO: 7454010 - DNA, 22 bp, Homo sapiens
tagattcaagtattcagtttgg

SEQ ID NO: 7454011 - DNA, 22 bp, Homo sapiens
tagatacaggctctctgagcct

SEQ ID NO: 7454012 - DNA, 22 bp, Homo sapiens
tagatacacacacagtcatgtg

SEQ ID NO: 7454013 - DNA, 22 bp, Homo sapiens
tagatacaggcaagattatgaa

SEQ ID NO: 7454014 - DNA, 22 bp, Homo sapiens
tagatacacacacagtcatgtg

SEQ ID NO: 7454015 - DNA, 22 bp, Homo sapiens
cagggacagccttggggtggcg

SEQ ID NO: 7454016 - DNA, 22 bp, Homo sapiens
tagattctggagagacagcagt

SEQ ID NO: 7454017 - DNA, 22 bp, Homo sapiens
tagattctgaccctctttttac

SEQ ID NO: 7454018 - DNA, 22 bp, Homo sapiens
tagattctctgctggctgacat

SEQ ID NO: 7454019 - DNA, 22 bp, Homo sapiens
tagattctcccatcatgagatg

SEQ ID NO: 7454020 - DNA, 22 bp, Homo sapiens
tagattctcccatcatgagatg

SEQ ID NO: 7454021 - DNA, 22 bp, Homo sapiens
tagattctcccacctgccaggc

SEQ ID NO: 7454022 - DNA, 22 bp, Homo sapiens
tagattctcccacctgccaggc

SEQ ID NO: 7454023 - DNA, 22 bp, Homo sapiens
tagattctcccacctgccaggc

SEQ ID NO: 7454024 - DNA, 22 bp, Homo sapiens
tagattctccacatgtagcaat

SEQ ID NO: 7454025 - DNA, 22 bp, Homo sapiens
tagattctccacatgtagcaat

SEQ ID NO: 7454026 - DNA, 22 bp, Homo sapiens
tagattctcagaattttagaaa

SEQ ID NO: 7454027 - DNA, 22 bp, Homo sapiens
tagattctactgtcacttagtt

SEQ ID NO: 7454028 - DNA, 22 bp, Homo sapiens
tagattctacagctcagctgtc

SEQ ID NO: 7454029 - DNA, 22 bp, Homo sapiens
tagattctacagctcagctgtc

SEQ ID NO: 7454030 - DNA, 22 bp, Homo sapiens
tagattcttctaggtctttagc

SEQ ID NO: 7454031 - DNA, 22 bp, Homo sapiens
tagattcttagtttcatagaat

SEQ ID NO: 7454032 - DNA, 22 bp, Homo sapiens
tagattcttgaaccagtgcctc

SEQ ID NO: 7454033 - DNA, 22 bp, Homo sapiens
tagattcttcttttgagtctct

SEQ ID NO: 7454034 - DNA, 22 bp, Homo sapiens
tagattcttgaaccagtgcctc

SEQ ID NO: 7454035 - DNA, 22 bp, Homo sapiens
tagattcttctaggtctttagc

SEQ ID NO: 7454036 - DNA, 22 bp, Homo sapiens
tagattcttcttttgagtctct

SEQ ID NO: 7454037 - DNA, 22 bp, Homo sapiens
tagattctgtttcctctggttt

SEQ ID NO: 7454038 - DNA, 22 bp, Homo sapiens
tagattctgtgagagtcaaagt

SEQ ID NO: 7454039 - DNA, 20 bp, Homo sapiens
tagattctgtctgtccaaac

SEQ ID NO: 7454040 - DNA, 22 bp, Homo sapiens
tagattctgtgagagtcaaagt

SEQ ID NO: 7454041 - DNA, 22 bp, Homo sapiens
tagattctgtatgtctgctctc

SEQ ID NO: 7454042 - DNA, 20 bp, Homo sapiens
tagattctgtctgtccaaac

SEQ ID NO: 7454043 - DNA, 22 bp, Homo sapiens
tagattctgtaaataatcaagg

SEQ ID NO: 7454044 - DNA, 22 bp, Homo sapiens
tagattctgtatgtctgctctc

SEQ ID NO: 7454045 - DNA, 22 bp, Homo sapiens
cagggaagagccgatgctgcag

SEQ ID NO: 7454046 - DNA, 22 bp, Homo sapiens
cagggaagagccgatgctgcag

SEQ ID NO: 7454047 - DNA, 22 bp, Homo sapiens
cagggaaggctgcaaatgttaa

SEQ ID NO: 7454048 - DNA, 22 bp, Homo sapiens
cagggaaggctgcaaatgttaa

SEQ ID NO: 7454049 - DNA, 22 bp, Homo sapiens
cagggaagagccgatgctgcag

SEQ ID NO: 7454050 - DNA, 22 bp, Homo sapiens
cagggaagagccgatgctgcag

SEQ ID NO: 7454051 - DNA, 22 bp, Homo sapiens
cagggaagagccgatgctgcag

SEQ ID NO: 7454052 - DNA, 22 bp, Homo sapiens
cagggaagagccgatgctgcag

SEQ ID NO: 7454053 - DNA, 22 bp, Homo sapiens
cagggaagagccgatgctgcag

SEQ ID NO: 7454054 - DNA, 22 bp, Homo sapiens
cagggaagagccgatgctgcag

SEQ ID NO: 7454055 - DNA, 22 bp, Homo sapiens
cagggaagagccgatgctgcag

SEQ ID NO: 7454056 - DNA, 22 bp, Homo sapiens
cagggaagagccgatgctgcag

SEQ ID NO: 7454057 - DNA, 22 bp, Homo sapiens
cagggaagaatagttagcaaag

SEQ ID NO: 7454058 - DNA, 22 bp, Homo sapiens
cagggaagaatagttagcaaag

SEQ ID NO: 7454059 - DNA, 22 bp, Homo sapiens
cagggaacaagatgagaatgga

SEQ ID NO: 7454060 - DNA, 22 bp, Homo sapiens
cagggaagaatagttagcaaag

SEQ ID NO: 7454061 - DNA, 22 bp, Homo sapiens
cagggaagaatagttagcaaag

SEQ ID NO: 7454062 - DNA, 22 bp, Homo sapiens
cagggaaagttcttgtccactc

SEQ ID NO: 7454063 - DNA, 22 bp, Homo sapiens
cagggaaagttcttgtccactc

SEQ ID NO: 7454064 - DNA, 22 bp, Homo sapiens
cagggaaagttcttgtccactc

SEQ ID NO: 7454065 - DNA, 22 bp, Homo sapiens
cagggaaagttcttgtccactc

SEQ ID NO: 7454066 - DNA, 22 bp, Homo sapiens
cagggaaattaagtgacgatga

SEQ ID NO: 7454067 - DNA, 22 bp, Homo sapiens
cagggaaattaagtgacgatga

SEQ ID NO: 7454068 - DNA, 22 bp, Homo sapiens
cagggaaagttcttgtccactc

SEQ ID NO: 7454069 - DNA, 22 bp, Homo sapiens
cagggaacaagatgagaatgga

SEQ ID NO: 7454070 - DNA, 22 bp, Homo sapiens
cagggaacaagatgagaatgga

SEQ ID NO: 7454071 - DNA, 22 bp, Homo sapiens
caggcttttatgaatttcagtg

SEQ ID NO: 7454072 - DNA, 22 bp, Homo sapiens
caggcttttgcatagcactggg

SEQ ID NO: 7454073 - DNA, 22 bp, Homo sapiens
caggctttactttctctctgaa

SEQ ID NO: 7454074 - DNA, 18 bp, Homo sapiens
caggctttgattttggag

SEQ ID NO: 7454075 - DNA, 22 bp, Homo sapiens
cagggaaactaggaaataagct

SEQ ID NO: 7454076 - DNA, 22 bp, Homo sapiens
cagggaaactaggaaataagct

SEQ ID NO: 7454077 - DNA, 22 bp, Homo sapiens
caggctttttctgctgtcctct

SEQ ID NO: 7454078 - DNA, 22 bp, Homo sapiens
caggctttttctgctgtcctct

SEQ ID NO: 7454079 - DNA, 22 bp, Homo sapiens
caggctttttctgctgtcctct

SEQ ID NO: 7454080 - DNA, 22 bp, Homo sapiens
cagggaaagtcccaccccacac

SEQ ID NO: 7454081 - DNA, 22 bp, Homo sapiens
cagggaaagtcccaccccacac

SEQ ID NO: 7454082 - DNA, 22 bp, Homo sapiens
cagggaaagtcccaccccacac

SEQ ID NO: 7454083 - DNA, 22 bp, Homo sapiens
caggcttggttggggcgaggga

SEQ ID NO: 7454084 - DNA, 22 bp, Homo sapiens
caggcttgggttctctgagtta

SEQ ID NO: 7454085 - DNA, 22 bp, Homo sapiens
caggcttggttggggcgaggga

SEQ ID NO: 7454086 - DNA, 22 bp, Homo sapiens
caggcttggttggggcgaggga

SEQ ID NO: 7454087 - DNA, 22 bp, Homo sapiens
caggcttggttggggcgaggga

SEQ ID NO: 7454088 - DNA, 22 bp, Homo sapiens
caggcttggttggggcgaggga

SEQ ID NO: 7454089 - DNA, 22 bp, Homo sapiens
caggcttgtgactattccaaag

SEQ ID NO: 7454090 - DNA, 22 bp, Homo sapiens
caggcttgtgctccactttcag

SEQ ID NO: 7454091 - DNA, 22 bp, Homo sapiens
caggcttgtgctccactttcag

SEQ ID NO: 7454092 - DNA, 22 bp, Homo sapiens
caggcttgtgtctcagctgcag

SEQ ID NO: 7454093 - DNA, 22 bp, Homo sapiens
caggcttgtgtctcagctgcag

SEQ ID NO: 7454094 - DNA, 22 bp, Homo sapiens
caggcttgtgtctcagctgcag

SEQ ID NO: 7454095 - DNA, 22 bp, Homo sapiens
caggctttactttctctctgaa

SEQ ID NO: 7454096 - DNA, 22 bp, Homo sapiens
caggcttgggagcagagccact

SEQ ID NO: 7454097 - DNA, 22 bp, Homo sapiens
caggcttgggttctctgagtta

SEQ ID NO: 7454098 - DNA, 22 bp, Homo sapiens
caggcttgggttctctgagtta

SEQ ID NO: 7454099 - DNA, 22 bp, Homo sapiens
caggcttgggagcagagccact

SEQ ID NO: 7454100 - DNA, 22 bp, Homo sapiens
caggcttgggagcagagccact

SEQ ID NO: 7454101 - DNA, 22 bp, Homo sapiens
caggcttggcagggaggctggt

SEQ ID NO: 7454102 - DNA, 22 bp, Homo sapiens
caggcttggcagggaggctggt

SEQ ID NO: 7454103 - DNA, 22 bp, Homo sapiens
caggcttgggagcagagccact

SEQ ID NO: 7454104 - DNA, 22 bp, Homo sapiens
caggcttggcagggaggctggt

SEQ ID NO: 7454105 - DNA, 22 bp, Homo sapiens
caggcttggcagggaggctggt

SEQ ID NO: 7454106 - DNA, 22 bp, Homo sapiens
caggcttggcagggaggctggt

SEQ ID NO: 7454107 - DNA, 22 bp, Homo sapiens
caggcttggcagggaggctggt

SEQ ID NO: 7454108 - DNA, 22 bp, Homo sapiens
caggcttggcagggaggctggt

SEQ ID NO: 7454109 - DNA, 22 bp, Homo sapiens
caggcttggagggcagtggcat

SEQ ID NO: 7454110 - DNA, 22 bp, Homo sapiens
caggcttggagggcagtggcat

SEQ ID NO: 7454111 - DNA, 22 bp, Homo sapiens
caggcttggagggcagtggcat

SEQ ID NO: 7454112 - DNA, 22 bp, Homo sapiens
caggcttggagggcagtggcat

SEQ ID NO: 7454113 - DNA, 22 bp, Homo sapiens
caggctgtctgaatggaggccc

SEQ ID NO: 7454114 - DNA, 22 bp, Homo sapiens
caggctgtctgaatggaggccc

SEQ ID NO: 7454115 - DNA, 22 bp, Homo sapiens
caggctgtctgaatggaggccc

SEQ ID NO: 7454116 - DNA, 22 bp, Homo sapiens
caggcttgctgctagagcactt

SEQ ID NO: 7454117 - DNA, 22 bp, Homo sapiens
caggcttggagggcagtggcat

SEQ ID NO: 7454118 - DNA, 22 bp, Homo sapiens
caggcttggagggcagtggcat

SEQ ID NO: 7454119 - DNA, 22 bp, Homo sapiens
caggcttggagggcagtggcat

SEQ ID NO: 7454120 - DNA, 22 bp, Homo sapiens
tagaaacaagggagaggattct

SEQ ID NO: 7454121 - DNA, 22 bp, Homo sapiens
tagaaacaagggagaggattct

SEQ ID NO: 7454122 - DNA, 22 bp, Homo sapiens
tagaaacaagggagaggattct

SEQ ID NO: 7454123 - DNA, 22 bp, Homo sapiens
caggctgtctgaatggaggccc

SEQ ID NO: 7454124 - DNA, 22 bp, Homo sapiens
caggctgtctgaatggaggccc

SEQ ID NO: 7454125 - DNA, 22 bp, Homo sapiens
caggctgtctgaatggaggccc

SEQ ID NO: 7454126 - DNA, 22 bp, Homo sapiens
caggctgtccaggctcctttgg

SEQ ID NO: 7454127 - DNA, 22 bp, Homo sapiens
tagaaacaagggagaggattct

SEQ ID NO: 7454128 - DNA, 22 bp, Homo sapiens
tagaaacaagggagaggattct

SEQ ID NO: 7454129 - DNA, 19 bp, Homo sapiens
caggcctcttaccctctct

SEQ ID NO: 7454130 - DNA, 19 bp, Homo sapiens
caggcctcttaccctctct

SEQ ID NO: 7454131 - DNA, 19 bp, Homo sapiens
caggcctcttaccctctct

SEQ ID NO: 7454132 - DNA, 19 bp, Homo sapiens
caggcctcttaccctctct

SEQ ID NO: 7454133 - DNA, 22 bp, Homo sapiens
caggcctcttccatgcagcagc

SEQ ID NO: 7454134 - DNA, 22 bp, Homo sapiens
caggcctcttccatgcagcagc

SEQ ID NO: 7454135 - DNA, 22 bp, Homo sapiens
caggcctcttccatgcagcagc

SEQ ID NO: 7454136 - DNA, 22 bp, Homo sapiens
caggcctcttccatgcagcagc

SEQ ID NO: 7454137 - DNA, 22 bp, Homo sapiens
caggcctcttccatgcagcagc

SEQ ID NO: 7454138 - DNA, 22 bp, Homo sapiens
caggcctcttccatgcagcagc

SEQ ID NO: 7454139 - DNA, 22 bp, Homo sapiens
caggcctcttccatgcagcagc

SEQ ID NO: 7454140 - DNA, 18 bp, Homo sapiens
caggcctcttgatcttcc

SEQ ID NO: 7454141 - DNA, 18 bp, Homo sapiens
caggcctcttgatcttcc

SEQ ID NO: 7454142 - DNA, 18 bp, Homo sapiens
caggcctcttgatcttcc

SEQ ID NO: 7454143 - DNA, 22 bp, Homo sapiens
caggcctcttccatgcagcagc

SEQ ID NO: 7454144 - DNA, 22 bp, Homo sapiens
caggcctgaccctgagcttcac

SEQ ID NO: 7454145 - DNA, 22 bp, Homo sapiens
caggcctgaccctgagcttcac

SEQ ID NO: 7454146 - DNA, 18 bp, Homo sapiens
caggcctcttgatcttcc

SEQ ID NO: 7454147 - DNA, 22 bp, Homo sapiens
caggcctgaccctgagcttcac

SEQ ID NO: 7454148 - DNA, 22 bp, Homo sapiens
caggcctgaccctgagcttcac

SEQ ID NO: 7454149 - DNA, 22 bp, Homo sapiens
caggcctgaccctgagcttcac

SEQ ID NO: 7454150 - DNA, 22 bp, Homo sapiens
caggcctgaccctgagcttcac

SEQ ID NO: 7454151 - DNA, 22 bp, Homo sapiens
caggcctgagacatctgagata

SEQ ID NO: 7454152 - DNA, 22 bp, Homo sapiens
caggcctgagacatctgagata

SEQ ID NO: 7454153 - DNA, 22 bp, Homo sapiens
caggcctgagacatctgagata

SEQ ID NO: 7454154 - DNA, 22 bp, Homo sapiens
caggcctgagacatctgagata

SEQ ID NO: 7454155 - DNA, 22 bp, Homo sapiens
caggcctgagacatctgagata

SEQ ID NO: 7454156 - DNA, 22 bp, Homo sapiens
caggcctgagacatctgagata

SEQ ID NO: 7454157 - DNA, 22 bp, Homo sapiens
caggcctgagtgtggaagtctt

SEQ ID NO: 7454158 - DNA, 22 bp, Homo sapiens
caggcctgcttcttacccttca

SEQ ID NO: 7454159 - DNA, 22 bp, Homo sapiens
caggcctggagtgcaatggcac

SEQ ID NO: 7454160 - DNA, 22 bp, Homo sapiens
caggcctgcttcttacccttca

SEQ ID NO: 7454161 - DNA, 22 bp, Homo sapiens
tacatgttcaaatttgtctttc

SEQ ID NO: 7454162 - DNA, 22 bp, Homo sapiens
tacatgttcaaatttgtctttc

SEQ ID NO: 7454163 - DNA, 22 bp, Homo sapiens
caggcctgcttcttacccttca

SEQ ID NO: 7454164 - DNA, 22 bp, Homo sapiens
caggcctgcaggaaaggctccc

SEQ ID NO: 7454165 - DNA, 22 bp, Homo sapiens
caggcctgagacatctgagata

SEQ ID NO: 7454166 - DNA, 22 bp, Homo sapiens
caggcctgagtgtggaagtctt

SEQ ID NO: 7454167 - DNA, 22 bp, Homo sapiens
caggcctgagtgtggaagtctt

SEQ ID NO: 7454168 - DNA, 22 bp, Homo sapiens
caggcctgcaggaaaggctccc

SEQ ID NO: 7454169 - DNA, 22 bp, Homo sapiens
caggcctgatacactgaactct

SEQ ID NO: 7454170 - DNA, 22 bp, Homo sapiens
caggcctgcaggaaaggctccc

SEQ ID NO: 7454171 - DNA, 22 bp, Homo sapiens
caggcctgcaggaaaggctccc

SEQ ID NO: 7454172 - DNA, 22 bp, Homo sapiens
tacattgtacttacaaatagtg

SEQ ID NO: 7454173 - DNA, 22 bp, Homo sapiens
tacattgtacttacaaatagtg

SEQ ID NO: 7454174 - DNA, 22 bp, Homo sapiens
tacattgtacttacaaatagtg

SEQ ID NO: 7454175 - DNA, 20 bp, Homo sapiens
tacattgtagaaatattcaa

SEQ ID NO: 7454176 - DNA, 20 bp, Homo sapiens
tacattgtagaaatattcaa

SEQ ID NO: 7454177 - DNA, 20 bp, Homo sapiens
tacattgtagaaatattcaa

SEQ ID NO: 7454178 - DNA, 20 bp, Homo sapiens
tacattgtagaaatattcaa

SEQ ID NO: 7454179 - DNA, 22 bp, Homo sapiens
tacatgtttactccaagtcagg

SEQ ID NO: 7454180 - DNA, 22 bp, Homo sapiens
tacatgtttactccaagtcagg

SEQ ID NO: 7454181 - DNA, 22 bp, Homo sapiens
tacatgtttggtaaatgatggc

SEQ ID NO: 7454182 - DNA, 22 bp, Homo sapiens
tacatgtttggtaaatgatggc

SEQ ID NO: 7454183 - DNA, 22 bp, Homo sapiens
tacatgtttggtaaatgatggc

SEQ ID NO: 7454184 - DNA, 22 bp, Homo sapiens
tacatgtttactccaagtcagg

SEQ ID NO: 7454185 - DNA, 22 bp, Homo sapiens
tacattgattcaggatataggc

SEQ ID NO: 7454186 - DNA, 22 bp, Homo sapiens
caggcccagcccttagccaggt

SEQ ID NO: 7454187 - DNA, 22 bp, Homo sapiens
caggcccaggccagtggttccc

SEQ ID NO: 7454188 - DNA, 22 bp, Homo sapiens
caggcccaggccagtggttccc

SEQ ID NO: 7454189 - DNA, 22 bp, Homo sapiens
caggcccaggccagtggttccc

SEQ ID NO: 7454190 - DNA, 22 bp, Homo sapiens
caggcccaggccagtggttccc

SEQ ID NO: 7454191 - DNA, 22 bp, Homo sapiens
caggcccagggagggagaccaa

SEQ ID NO: 7454192 - DNA, 22 bp, Homo sapiens
caggcccagcccttagccaggt

SEQ ID NO: 7454193 - DNA, 22 bp, Homo sapiens
caggcccagcccttagccaggt

SEQ ID NO: 7454194 - DNA, 22 bp, Homo sapiens
caggcccagcccttagccaggt

SEQ ID NO: 7454195 - DNA, 22 bp, Homo sapiens
caggcccagcccttagccaggt

SEQ ID NO: 7454196 - DNA, 22 bp, Homo sapiens
caggcccagaggcctcttccca

SEQ ID NO: 7454197 - DNA, 22 bp, Homo sapiens
caggcccagaggcctcttccca

SEQ ID NO: 7454198 - DNA, 22 bp, Homo sapiens
caggcccagaggcctcttccca

SEQ ID NO: 7454199 - DNA, 22 bp, Homo sapiens
caggcccagaggcctcttccca

SEQ ID NO: 7454200 - DNA, 22 bp, Homo sapiens
caggcccagcccagcccttcga

SEQ ID NO: 7454201 - DNA, 22 bp, Homo sapiens
caggcccagcccagcccttcga

SEQ ID NO: 7454202 - DNA, 22 bp, Homo sapiens
caggcccagaggcctcttccca

SEQ ID NO: 7454203 - DNA, 22 bp, Homo sapiens
caggcccagcccagcccttcga

SEQ ID NO: 7454204 - DNA, 22 bp, Homo sapiens
caggcccagcccttagccaggt

SEQ ID NO: 7454205 - DNA, 22 bp, Homo sapiens
caggcccagcccttagccaggt

SEQ ID NO: 7454206 - DNA, 22 bp, Homo sapiens
caggcccagcccttagccaggt

SEQ ID NO: 7454207 - DNA, 22 bp, Homo sapiens
caggcccagcccttagccaggt

SEQ ID NO: 7454208 - DNA, 22 bp, Homo sapiens
caggcccagcccagcccttcga

SEQ ID NO: 7454209 - DNA, 22 bp, Homo sapiens
caggcccagcccagcccttcga

SEQ ID NO: 7454210 - DNA, 22 bp, Homo sapiens
caggcctcgaggagacagctac

SEQ ID NO: 7454211 - DNA, 22 bp, Homo sapiens
caggcctcgaggagacagctac

SEQ ID NO: 7454212 - DNA, 22 bp, Homo sapiens
caggcctcctatgagcactagc

SEQ ID NO: 7454213 - DNA, 22 bp, Homo sapiens
caggcctcctatgagcactagc

SEQ ID NO: 7454214 - DNA, 22 bp, Homo sapiens
caggcctcctatgagcactagc

SEQ ID NO: 7454215 - DNA, 21 bp, Homo sapiens
caggccgggtgagcaggcagc

SEQ ID NO: 7454216 - DNA, 21 bp, Homo sapiens
caggccgggtgagcaggcagc

SEQ ID NO: 7454217 - DNA, 22 bp, Homo sapiens
caggcctcctatgagcactagc

SEQ ID NO: 7454218 - DNA, 22 bp, Homo sapiens
caggcctcctatgagcactagc

SEQ ID NO: 7454219 - DNA, 22 bp, Homo sapiens
caggcctcctatgagcactagc

SEQ ID NO: 7454220 - DNA, 22 bp, Homo sapiens
caggcctcctatgagcactagc

SEQ ID NO: 7454221 - DNA, 22 bp, Homo sapiens
caggcctcctatgagcactagc

SEQ ID NO: 7454222 - DNA, 22 bp, Homo sapiens
caggcctcctatgagcactagc

SEQ ID NO: 7454223 - DNA, 22 bp, Homo sapiens
caggccgggcactgcgctaggt

SEQ ID NO: 7454224 - DNA, 22 bp, Homo sapiens
caggcccagggagggagaccaa

SEQ ID NO: 7454225 - DNA, 22 bp, Homo sapiens
caggccggggcggcgccatctt

SEQ ID NO: 7454226 - DNA, 22 bp, Homo sapiens
caggccgggcactgcgctaggt

SEQ ID NO: 7454227 - DNA, 22 bp, Homo sapiens
caggcccagggagggagaccaa

SEQ ID NO: 7454228 - DNA, 22 bp, Homo sapiens
caggcccagggagggagaccaa

SEQ ID NO: 7454229 - DNA, 22 bp, Homo sapiens
caggcccagggagggagaccaa

SEQ ID NO: 7454230 - DNA, 22 bp, Homo sapiens
caggcccagggagggagaccaa

SEQ ID NO: 7454231 - DNA, 22 bp, Homo sapiens
caggcccaggccagtggttccc

SEQ ID NO: 7454232 - DNA, 22 bp, Homo sapiens
caggcccagggagggagaccaa

SEQ ID NO: 7454233 - DNA, 22 bp, Homo sapiens
caggcccagggagggagaccaa

SEQ ID NO: 7454234 - DNA, 22 bp, Homo sapiens
caggcccagggagggagaccaa

SEQ ID NO: 7454235 - DNA, 22 bp, Homo sapiens
caggcctctatggtcagctgag

SEQ ID NO: 7454236 - DNA, 22 bp, Homo sapiens
caggcctctatggtcagctgag

SEQ ID NO: 7454237 - DNA, 22 bp, Homo sapiens
caggcctctatggtcagctgag

SEQ ID NO: 7454238 - DNA, 22 bp, Homo sapiens
caggcctctatggtcagctgag

SEQ ID NO: 7454239 - DNA, 22 bp, Homo sapiens
caggcctctatggtcagctgag

SEQ ID NO: 7454240 - DNA, 22 bp, Homo sapiens
caggcctctatggtcagctgag

SEQ ID NO: 7454241 - DNA, 22 bp, Homo sapiens
caggcctctatggtcagctgag

SEQ ID NO: 7454242 - DNA, 22 bp, Homo sapiens
caggcctcgaggagacagctac

SEQ ID NO: 7454243 - DNA, 22 bp, Homo sapiens
caggcctcgaggagacagctac

SEQ ID NO: 7454244 - DNA, 22 bp, Homo sapiens
caggcctcgaggagacagctac

SEQ ID NO: 7454245 - DNA, 22 bp, Homo sapiens
caggcctcgaggagacagctac

SEQ ID NO: 7454246 - DNA, 22 bp, Homo sapiens
caggcctcgaggagacagctac

SEQ ID NO: 7454247 - DNA, 22 bp, Homo sapiens
caggcctctatggtcagctgag

SEQ ID NO: 7454248 - DNA, 22 bp, Homo sapiens
caggcctctatggtcagctgag

SEQ ID NO: 7454249 - DNA, 22 bp, Homo sapiens
caggcctctccttagtctggca

SEQ ID NO: 7454250 - DNA, 22 bp, Homo sapiens
caggcctctatggtcagctgag

SEQ ID NO: 7454251 - DNA, 22 bp, Homo sapiens
caggcctctatggtcagctgag

SEQ ID NO: 7454252 - DNA, 19 bp, Homo sapiens
caggcctctggtctgctgt

SEQ ID NO: 7454253 - DNA, 20 bp, Homo sapiens
caggcctctgggggccctgg

SEQ ID NO: 7454254 - DNA, 20 bp, Homo sapiens
caggcctctgggggccctgg

SEQ ID NO: 7454255 - DNA, 20 bp, Homo sapiens
caggcctctgggggccctgg

SEQ ID NO: 7454256 - DNA, 19 bp, Homo sapiens
caggcctcttaccctctct

SEQ ID NO: 7454257 - DNA, 19 bp, Homo sapiens
caggcctctggtctgctgt

SEQ ID NO: 7454258 - DNA, 19 bp, Homo sapiens
caggcctctggtctgctgt

SEQ ID NO: 7454259 - DNA, 19 bp, Homo sapiens
caggcctctggtctgctgt

SEQ ID NO: 7454260 - DNA, 19 bp, Homo sapiens
caggcctctggtctgctgt

SEQ ID NO: 7454261 - DNA, 19 bp, Homo sapiens
caggcctctggtctgctgt

SEQ ID NO: 7454262 - DNA, 19 bp, Homo sapiens
caggcctctggtctgctgt

SEQ ID NO: 7454263 - DNA, 20 bp, Homo sapiens
caggcctctgggggccctgg

SEQ ID NO: 7454264 - DNA, 20 bp, Homo sapiens
caggcctctgggggccctgg

SEQ ID NO: 7454265 - DNA, 20 bp, Homo sapiens
caggcctctgggggccctgg

SEQ ID NO: 7454266 - DNA, 22 bp, Homo sapiens
caggcctctccttagtctggca

SEQ ID NO: 7454267 - DNA, 22 bp, Homo sapiens
caggcctctccttagtctggca

SEQ ID NO: 7454268 - DNA, 22 bp, Homo sapiens
caggcctctccttagtctggca

SEQ ID NO: 7454269 - DNA, 22 bp, Homo sapiens
caggcctctccttagtctggca

SEQ ID NO: 7454270 - DNA, 22 bp, Homo sapiens
tactttaaagaggtgtaatgag

SEQ ID NO: 7454271 - DNA, 22 bp, Homo sapiens
tactttaaagaggtgtaatgag

SEQ ID NO: 7454272 - DNA, 22 bp, Homo sapiens
tactttaaagaggtgtaatgag

SEQ ID NO: 7454273 - DNA, 22 bp, Homo sapiens
tactttaaagaggtgtaatgag

SEQ ID NO: 7454274 - DNA, 22 bp, Homo sapiens
tactttaaagaggtgtaatgag

SEQ ID NO: 7454275 - DNA, 22 bp, Homo sapiens
tactttaaaaactgataattca

SEQ ID NO: 7454276 - DNA, 22 bp, Homo sapiens
tactttaatatatgtgaagttc

SEQ ID NO: 7454277 - DNA, 22 bp, Homo sapiens
tactttaatatatgtgaagttc

SEQ ID NO: 7454278 - DNA, 22 bp, Homo sapiens
tactttaatatatgtgaagttc

SEQ ID NO: 7454279 - DNA, 22 bp, Homo sapiens
tactttaatatatgtgaagttc

SEQ ID NO: 7454280 - DNA, 22 bp, Homo sapiens
tactttacagtattagataatt

SEQ ID NO: 7454281 - DNA, 22 bp, Homo sapiens
tactttacagtattagataatt

SEQ ID NO: 7454282 - DNA, 22 bp, Homo sapiens
tactttatcagcgtcaaaggta

SEQ ID NO: 7454283 - DNA, 22 bp, Homo sapiens
tactttatcagcgtcaaaggta

SEQ ID NO: 7454284 - DNA, 22 bp, Homo sapiens
tactttatattgtggctggcca

SEQ ID NO: 7454285 - DNA, 22 bp, Homo sapiens
tactttatcagcgtcaaaggta

SEQ ID NO: 7454286 - DNA, 22 bp, Homo sapiens
tactttatcagcgtcaaaggta

SEQ ID NO: 7454287 - DNA, 22 bp, Homo sapiens
tactttacagtattagataatt

SEQ ID NO: 7454288 - DNA, 22 bp, Homo sapiens
tactttacagtattagataatt

SEQ ID NO: 7454289 - DNA, 22 bp, Homo sapiens
tactttagaaggaaataagttc

SEQ ID NO: 7454290 - DNA, 22 bp, Homo sapiens
tactttagaaggaaataagttc

SEQ ID NO: 7454291 - DNA, 22 bp, Homo sapiens
tactttatattgtggctggcca

SEQ ID NO: 7454292 - DNA, 22 bp, Homo sapiens
tactttagaaggaaataagttc

SEQ ID NO: 7454293 - DNA, 22 bp, Homo sapiens
tactttattgtaaatgctgatg

SEQ ID NO: 7454294 - DNA, 22 bp, Homo sapiens
tactttattgtaaatgctgatg

SEQ ID NO: 7454295 - DNA, 22 bp, Homo sapiens
tactttattgtaaatgctgatg

SEQ ID NO: 7454296 - DNA, 22 bp, Homo sapiens
tactttattgtaaatgctgatg

SEQ ID NO: 7454297 - DNA, 18 bp, Homo sapiens
tactttattccccctcca

SEQ ID NO: 7454298 - DNA, 22 bp, Homo sapiens
tactttattgtaaatgctgatg

SEQ ID NO: 7454299 - DNA, 22 bp, Homo sapiens
tactttatcagcgtcaaaggta

SEQ ID NO: 7454300 - DNA, 22 bp, Homo sapiens
tactttattcaggaaggctggt

SEQ ID NO: 7454301 - DNA, 18 bp, Homo sapiens
tactttattccccctcca

SEQ ID NO: 7454302 - DNA, 22 bp, Homo sapiens
tactttattcaggaaggctggt

SEQ ID NO: 7454303 - DNA, 22 bp, Homo sapiens
caggctactggggcttggatgg

SEQ ID NO: 7454304 - DNA, 22 bp, Homo sapiens
caggctactggggcttggatgg

SEQ ID NO: 7454305 - DNA, 22 bp, Homo sapiens
caggctacatttgctctgagaa

SEQ ID NO: 7454306 - DNA, 22 bp, Homo sapiens
caggctaaggaaaggctcaggt

SEQ ID NO: 7454307 - DNA, 22 bp, Homo sapiens
caggctacatttgctctgagaa

SEQ ID NO: 7454308 - DNA, 22 bp, Homo sapiens
caggctacatttgctctgagaa

SEQ ID NO: 7454309 - DNA, 22 bp, Homo sapiens
caggctagattggggccagtag

SEQ ID NO: 7454310 - DNA, 22 bp, Homo sapiens
caggctagattggggccagtag

SEQ ID NO: 7454311 - DNA, 22 bp, Homo sapiens
caggctagattggggccagtag

SEQ ID NO: 7454312 - DNA, 22 bp, Homo sapiens
caggctcaaggctgacttccat

SEQ ID NO: 7454313 - DNA, 22 bp, Homo sapiens
caggctcaaggctgacttccat

SEQ ID NO: 7454314 - DNA, 22 bp, Homo sapiens
tactgtgggatgttgtgattag

SEQ ID NO: 7454315 - DNA, 22 bp, Homo sapiens
caggctcaagccctgcttatat

SEQ ID NO: 7454316 - DNA, 22 bp, Homo sapiens
caggctcaagccctgcttatat

SEQ ID NO: 7454317 - DNA, 22 bp, Homo sapiens
caggctcaagccctgcttatat

SEQ ID NO: 7454318 - DNA, 22 bp, Homo sapiens
tactttaaaaactgataattca

SEQ ID NO: 7454319 - DNA, 22 bp, Homo sapiens
tactttaaaaactgataattca

SEQ ID NO: 7454320 - DNA, 22 bp, Homo sapiens
tactttaaaaactgataattca

SEQ ID NO: 7454321 - DNA, 22 bp, Homo sapiens
tactttaaaaactgataattca

SEQ ID NO: 7454322 - DNA, 22 bp, Homo sapiens
tactttaaaaactgataattca

SEQ ID NO: 7454323 - DNA, 22 bp, Homo sapiens
tactttaaaaactgataattca

SEQ ID NO: 7454324 - DNA, 22 bp, Homo sapiens
tactgtggtaacattttaaatt

SEQ ID NO: 7454325 - DNA, 22 bp, Homo sapiens
tactgtggggatattgattgta

SEQ ID NO: 7454326 - DNA, 22 bp, Homo sapiens
tactgtgtcttaggatgtggaa

SEQ ID NO: 7454327 - DNA, 22 bp, Homo sapiens
tacttgttatcatcttttcctt

SEQ ID NO: 7454328 - DNA, 22 bp, Homo sapiens
tacttgttctttcaagagatag

SEQ ID NO: 7454329 - DNA, 22 bp, Homo sapiens
caggccttttttcctgcagtgt

SEQ ID NO: 7454330 - DNA, 22 bp, Homo sapiens
caggcgacccctaggagcaaca

SEQ ID NO: 7454331 - DNA, 22 bp, Homo sapiens
caggccttttttcctgcagtgt

SEQ ID NO: 7454332 - DNA, 22 bp, Homo sapiens
caggccttttttcctgcagtgt

SEQ ID NO: 7454333 - DNA, 22 bp, Homo sapiens
caggccttttttcctgcagtgt

SEQ ID NO: 7454334 - DNA, 22 bp, Homo sapiens
caggccttttttcctgcagtgt

SEQ ID NO: 7454335 - DNA, 22 bp, Homo sapiens
caggcgagggccctgaggagcc

SEQ ID NO: 7454336 - DNA, 22 bp, Homo sapiens
caggcgagggccctgaggagcc

SEQ ID NO: 7454337 - DNA, 22 bp, Homo sapiens
caggcgagggccctgaggagcc

SEQ ID NO: 7454338 - DNA, 22 bp, Homo sapiens
caggcgagtgaacagactctca

SEQ ID NO: 7454339 - DNA, 22 bp, Homo sapiens
caggctaaagctttgagcatgt

SEQ ID NO: 7454340 - DNA, 22 bp, Homo sapiens
caggcgggacgtgggaggatca

SEQ ID NO: 7454341 - DNA, 22 bp, Homo sapiens
caggcgggacgtgggaggatca

SEQ ID NO: 7454342 - DNA, 22 bp, Homo sapiens
caggcgggacgtgggaggatca

SEQ ID NO: 7454343 - DNA, 22 bp, Homo sapiens
caggcgggcaggtgcggcccct

SEQ ID NO: 7454344 - DNA, 22 bp, Homo sapiens
caggcgggcaggtgcggcccct

SEQ ID NO: 7454345 - DNA, 22 bp, Homo sapiens
caggcgagtgaacagactctca

SEQ ID NO: 7454346 - DNA, 22 bp, Homo sapiens
caggcggccatgatctggcagg

SEQ ID NO: 7454347 - DNA, 22 bp, Homo sapiens
caggcgggacgtgggaggatca

SEQ ID NO: 7454348 - DNA, 22 bp, Homo sapiens
caggcgggacgtgggaggatca

SEQ ID NO: 7454349 - DNA, 22 bp, Homo sapiens
caggcggccatgatctggcagg

SEQ ID NO: 7454350 - DNA, 22 bp, Homo sapiens
caggcctttcttggggcttaga

SEQ ID NO: 7454351 - DNA, 22 bp, Homo sapiens
caggcctttctggggaagtgag

SEQ ID NO: 7454352 - DNA, 22 bp, Homo sapiens
caggcctttctggggaagtgag

SEQ ID NO: 7454353 - DNA, 22 bp, Homo sapiens
caggcctttctggggaagtgag

SEQ ID NO: 7454354 - DNA, 22 bp, Homo sapiens
caggcctttctggggaagtgag

SEQ ID NO: 7454355 - DNA, 22 bp, Homo sapiens
tacatttcctgtcagagatata

SEQ ID NO: 7454356 - DNA, 22 bp, Homo sapiens
tacatttcctgtcagagatata

SEQ ID NO: 7454357 - DNA, 22 bp, Homo sapiens
tacatttcctgtcagagatata

SEQ ID NO: 7454358 - DNA, 22 bp, Homo sapiens
tacatttcctgtcagagatata

SEQ ID NO: 7454359 - DNA, 22 bp, Homo sapiens
tacatttcctgtcagagatata

SEQ ID NO: 7454360 - DNA, 22 bp, Homo sapiens
caggccttgtcaagaaaatgcc

SEQ ID NO: 7454361 - DNA, 18 bp, Homo sapiens
caggcctttgagacagaa

SEQ ID NO: 7454362 - DNA, 18 bp, Homo sapiens
caggcctttgagacagaa

SEQ ID NO: 7454363 - DNA, 18 bp, Homo sapiens
caggcctttgagacagaa

SEQ ID NO: 7454364 - DNA, 18 bp, Homo sapiens
caggcctttgagacagaa

SEQ ID NO: 7454365 - DNA, 22 bp, Homo sapiens
caggcctttcttggggcttaga

SEQ ID NO: 7454366 - DNA, 22 bp, Homo sapiens
caggcctttcttggggcttaga

SEQ ID NO: 7454367 - DNA, 18 bp, Homo sapiens
caggcctttgagacagaa

SEQ ID NO: 7454368 - DNA, 22 bp, Homo sapiens
caggcctttgcacgtgcagttg

SEQ ID NO: 7454369 - DNA, 22 bp, Homo sapiens
caggcctttgcagggagagaga

SEQ ID NO: 7454370 - DNA, 22 bp, Homo sapiens
caggcctttgcagggagagaga

SEQ ID NO: 7454371 - DNA, 22 bp, Homo sapiens
caggcctttgcagggagagaga

SEQ ID NO: 7454372 - DNA, 22 bp, Homo sapiens
caggcctttgggaatcaccaca

SEQ ID NO: 7454373 - DNA, 22 bp, Homo sapiens
caggcctttgggaatcaccaca

SEQ ID NO: 7454374 - DNA, 22 bp, Homo sapiens
tacattgtgatgtttcaataca

SEQ ID NO: 7454375 - DNA, 22 bp, Homo sapiens
tacattgtgataggaagtcacc

SEQ ID NO: 7454376 - DNA, 22 bp, Homo sapiens
tacattgtgatgtttcaataca

SEQ ID NO: 7454377 - DNA, 22 bp, Homo sapiens
tacattgtgatgtttcaataca

SEQ ID NO: 7454378 - DNA, 22 bp, Homo sapiens
tacattgtatcaaccctcaact

SEQ ID NO: 7454379 - DNA, 20 bp, Homo sapiens
tacattgtagaaatattcaa

SEQ ID NO: 7454380 - DNA, 22 bp, Homo sapiens
tacattgtctgcaattttctct

SEQ ID NO: 7454381 - DNA, 22 bp, Homo sapiens
tacattgtctgcaattttctct

SEQ ID NO: 7454382 - DNA, 20 bp, Homo sapiens
tacattgtgagactaatgga

SEQ ID NO: 7454383 - DNA, 22 bp, Homo sapiens
tacattgtgttaaaacagaaga

SEQ ID NO: 7454384 - DNA, 23 bp, Homo sapiens
tacattgtggatggagtcctggg

SEQ ID NO: 7454385 - DNA, 23 bp, Homo sapiens
tacattgtggatggagtcctggg

SEQ ID NO: 7454386 - DNA, 23 bp, Homo sapiens
tacattgtggatggagtcctggg

SEQ ID NO: 7454387 - DNA, 22 bp, Homo sapiens
tacattgtgtctctatctagtc

SEQ ID NO: 7454388 - DNA, 22 bp, Homo sapiens
tacattgttcatgcatgagaaa

SEQ ID NO: 7454389 - DNA, 22 bp, Homo sapiens
tacattgtgttaaaacagaaga

SEQ ID NO: 7454390 - DNA, 22 bp, Homo sapiens
tacattgtgttaaaacagaaga

SEQ ID NO: 7454391 - DNA, 22 bp, Homo sapiens
tacattgttcatgcatgagaaa

SEQ ID NO: 7454392 - DNA, 22 bp, Homo sapiens
tacattgtttgagatagtttgt

SEQ ID NO: 7454393 - DNA, 22 bp, Homo sapiens
tacattgtttgagatagtttgt

SEQ ID NO: 7454394 - DNA, 22 bp, Homo sapiens
tacattgttcatgcatgagaaa

SEQ ID NO: 7454395 - DNA, 22 bp, Homo sapiens
tacattgttcatgcatgagaaa

SEQ ID NO: 7454396 - DNA, 22 bp, Homo sapiens
tacatttcagagctcctctctg

SEQ ID NO: 7454397 - DNA, 22 bp, Homo sapiens
tacatttcagagctcctctctg

SEQ ID NO: 7454398 - DNA, 22 bp, Homo sapiens
tacatttcagagctcctctctg

SEQ ID NO: 7454399 - DNA, 22 bp, Homo sapiens
tacatttataaggcttctctgt

SEQ ID NO: 7454400 - DNA, 22 bp, Homo sapiens
tacatttataaggcttctctgt

SEQ ID NO: 7454401 - DNA, 22 bp, Homo sapiens
tacatttataaggcttctctgt

SEQ ID NO: 7454402 - DNA, 22 bp, Homo sapiens
tacatttataaggcttctctgt

SEQ ID NO: 7454403 - DNA, 22 bp, Homo sapiens
tacatttataaggcttctctgt

SEQ ID NO: 7454404 - DNA, 22 bp, Homo sapiens
tacattgtttgagatagtttgt

SEQ ID NO: 7454405 - DNA, 22 bp, Homo sapiens
tacattgttttttcttgccatc

SEQ ID NO: 7454406 - DNA, 22 bp, Homo sapiens
tacattgttttttcttgccatc

SEQ ID NO: 7454407 - DNA, 22 bp, Homo sapiens
tacattgttttttcttgccatc

SEQ ID NO: 7454408 - DNA, 22 bp, Homo sapiens
tacatttacagagccttctctg

SEQ ID NO: 7454409 - DNA, 22 bp, Homo sapiens
tacatttataaggcttctctgt

SEQ ID NO: 7454410 - DNA, 22 bp, Homo sapiens
tacatttataaggcttctctgt

SEQ ID NO: 7454411 - DNA, 22 bp, Homo sapiens
tacatttataaggcttctctgt

SEQ ID NO: 7454412 - DNA, 22 bp, Homo sapiens
cagtcaccttgaggactcagac

SEQ ID NO: 7454413 - DNA, 22 bp, Homo sapiens
cagtcactggaatagctgagga

SEQ ID NO: 7454414 - DNA, 22 bp, Homo sapiens
cagtcactccagcctgcctcag

SEQ ID NO: 7454415 - DNA, 22 bp, Homo sapiens
cagtcactccagcctgcctcag

SEQ ID NO: 7454416 - DNA, 22 bp, Homo sapiens
cagtcacctgaagacttgacca

SEQ ID NO: 7454417 - DNA, 22 bp, Homo sapiens
cagtcacctgaagacttgacca

SEQ ID NO: 7454418 - DNA, 22 bp, Homo sapiens
cagtcacctagacagaacttac

SEQ ID NO: 7454419 - DNA, 22 bp, Homo sapiens
cagtcacctagacagaacttac

SEQ ID NO: 7454420 - DNA, 22 bp, Homo sapiens
cagtcaccatagaataaaacat

SEQ ID NO: 7454421 - DNA, 22 bp, Homo sapiens
cagtcaccatagaataaaacat

SEQ ID NO: 7454422 - DNA, 22 bp, Homo sapiens
cagtcacatttcgacataacta

SEQ ID NO: 7454423 - DNA, 22 bp, Homo sapiens
cagtcaccaccaggtggcagta

SEQ ID NO: 7454424 - DNA, 22 bp, Homo sapiens
cagtcaccaccaggtggcagta

SEQ ID NO: 7454425 - DNA, 22 bp, Homo sapiens
cagtcaccaccaggtggcagta

SEQ ID NO: 7454426 - DNA, 22 bp, Homo sapiens
cagtcacatttcgacataacta

SEQ ID NO: 7454427 - DNA, 22 bp, Homo sapiens
cagtcacatttcgacataacta

SEQ ID NO: 7454428 - DNA, 22 bp, Homo sapiens
cagtcacatttcgacataacta

SEQ ID NO: 7454429 - DNA, 22 bp, Homo sapiens
cagtcacattgccctgcattta

SEQ ID NO: 7454430 - DNA, 22 bp, Homo sapiens
cagtcacatggatgatggatag

SEQ ID NO: 7454431 - DNA, 22 bp, Homo sapiens
cagtcacattgccctgcattta

SEQ ID NO: 7454432 - DNA, 22 bp, Homo sapiens
cagtcacattgccctgcattta

SEQ ID NO: 7454433 - DNA, 22 bp, Homo sapiens
cagtcacatggatgatggatag

SEQ ID NO: 7454434 - DNA, 22 bp, Homo sapiens
cagtcacatggatgatggatag

SEQ ID NO: 7454435 - DNA, 22 bp, Homo sapiens
cagtcacatggatgatggatag

SEQ ID NO: 7454436 - DNA, 22 bp, Homo sapiens
cagtcacaggtggagaaccgag

SEQ ID NO: 7454437 - DNA, 22 bp, Homo sapiens
cagtcacaggtggagaaccgag

SEQ ID NO: 7454438 - DNA, 22 bp, Homo sapiens
cagtcacagtgacaggatgtgg

SEQ ID NO: 7454439 - DNA, 22 bp, Homo sapiens
cagtcacagtgacaggatgtgg

SEQ ID NO: 7454440 - DNA, 22 bp, Homo sapiens
cagtcacataggtatacacata

SEQ ID NO: 7454441 - DNA, 22 bp, Homo sapiens
cagtcacataggtatacacata

SEQ ID NO: 7454442 - DNA, 22 bp, Homo sapiens
cagtcacataggtatacacata

SEQ ID NO: 7454443 - DNA, 17 bp, Homo sapiens
cagtcacaggtcttttc

SEQ ID NO: 7454444 - DNA, 22 bp, Homo sapiens
cagtcacacaagtggacttggg

SEQ ID NO: 7454445 - DNA, 22 bp, Homo sapiens
cagtcacacaagtggacttggg

SEQ ID NO: 7454446 - DNA, 22 bp, Homo sapiens
cagtcacacaagtggacttggg

SEQ ID NO: 7454447 - DNA, 22 bp, Homo sapiens
cagtcacaagcgtacctaattt

SEQ ID NO: 7454448 - DNA, 22 bp, Homo sapiens
cagtcacaagcgtacctaattt

SEQ ID NO: 7454449 - DNA, 22 bp, Homo sapiens
cagtcaaacttataggcacatt

SEQ ID NO: 7454450 - DNA, 22 bp, Homo sapiens
cagtcacaagcgtacctaattt

SEQ ID NO: 7454451 - DNA, 22 bp, Homo sapiens
cagtcaacagagagcccgtcag

SEQ ID NO: 7454452 - DNA, 21 bp, Homo sapiens
cagtattttaagcagtgagtt

SEQ ID NO: 7454453 - DNA, 21 bp, Homo sapiens
cagtattttaagcagtgagtt

SEQ ID NO: 7454454 - DNA, 22 bp, Homo sapiens
cagtatctccacatgtaaagtg

SEQ ID NO: 7454455 - DNA, 22 bp, Homo sapiens
cagtatctccacatgtaaagtg

SEQ ID NO: 7454456 - DNA, 19 bp, Homo sapiens
cagtatcattgcacatagt

SEQ ID NO: 7454457 - DNA, 22 bp, Homo sapiens
cagtatattctgcagagcctta

SEQ ID NO: 7454458 - DNA, 22 bp, Homo sapiens
cagtatattttagagaagtccc

SEQ ID NO: 7454459 - DNA, 22 bp, Homo sapiens
cagtatattctgcagagcctta

SEQ ID NO: 7454460 - DNA, 22 bp, Homo sapiens
cagtatattctgcagagcctta

SEQ ID NO: 7454461 - DNA, 22 bp, Homo sapiens
cagtatttttaagctgctttgt

SEQ ID NO: 7454462 - DNA, 22 bp, Homo sapiens
cagtattttccttgttaactta

SEQ ID NO: 7454463 - DNA, 22 bp, Homo sapiens
cagtattttcaggatttggaag

SEQ ID NO: 7454464 - DNA, 22 bp, Homo sapiens
cagtattttcaggatttggaag

SEQ ID NO: 7454465 - DNA, 22 bp, Homo sapiens
cagtattttcaggatttggaag

SEQ ID NO: 7454466 - DNA, 22 bp, Homo sapiens
cagtattttcaggatttggaag

SEQ ID NO: 7454467 - DNA, 22 bp, Homo sapiens
cagtattttcaggatttggaag

SEQ ID NO: 7454468 - DNA, 22 bp, Homo sapiens
cagtatatgctctttcatcaaa

SEQ ID NO: 7454469 - DNA, 19 bp, Homo sapiens
caggtggtaatctgagcct

SEQ ID NO: 7454470 - DNA, 22 bp, Homo sapiens
caggtggtacttaaagtcagaa

SEQ ID NO: 7454471 - DNA, 22 bp, Homo sapiens
caggtgggtgtatgaatgcaaa

SEQ ID NO: 7454472 - DNA, 22 bp, Homo sapiens
caggtgggtgtatgaatgcaaa

SEQ ID NO: 7454473 - DNA, 22 bp, Homo sapiens
caggtgggtgtatgaatgcaaa

SEQ ID NO: 7454474 - DNA, 22 bp, Homo sapiens
caggtgggtgtatgaatgcaaa

SEQ ID NO: 7454475 - DNA, 22 bp, Homo sapiens
caggtgggtgtatgaatgcaaa

SEQ ID NO: 7454476 - DNA, 22 bp, Homo sapiens
caggtgggtgtatgaatgcaaa

SEQ ID NO: 7454477 - DNA, 22 bp, Homo sapiens
cagtcatccaggaaatgtatcc

SEQ ID NO: 7454478 - DNA, 22 bp, Homo sapiens
cagtcatcagagactcttgatt

SEQ ID NO: 7454479 - DNA, 22 bp, Homo sapiens
cagtcagttatccacacaccag

SEQ ID NO: 7454480 - DNA, 22 bp, Homo sapiens
cagtcaggggtgggatcaaggc

SEQ ID NO: 7454481 - DNA, 22 bp, Homo sapiens
cagtcagtaatgtggcacctgt

SEQ ID NO: 7454482 - DNA, 22 bp, Homo sapiens
cagtcagtaatgtggcacctgt

SEQ ID NO: 7454483 - DNA, 22 bp, Homo sapiens
cagtcagtaatgtggcacctgt

SEQ ID NO: 7454484 - DNA, 22 bp, Homo sapiens
cagtcattatgggagttaatcc

SEQ ID NO: 7454485 - DNA, 22 bp, Homo sapiens
cagtcattcctaaccaagaaca

SEQ ID NO: 7454486 - DNA, 22 bp, Homo sapiens
cagtcattcctaaccaagaaca

SEQ ID NO: 7454487 - DNA, 22 bp, Homo sapiens
cagtcattggctaaagctccct

SEQ ID NO: 7454488 - DNA, 22 bp, Homo sapiens
cagtccaacctgccccttgggc

SEQ ID NO: 7454489 - DNA, 22 bp, Homo sapiens
cagtcatttggcacctactgta

SEQ ID NO: 7454490 - DNA, 22 bp, Homo sapiens
cagtcattttatttgaaaatta

SEQ ID NO: 7454491 - DNA, 22 bp, Homo sapiens
cagtcagggacaccagctagga

SEQ ID NO: 7454492 - DNA, 22 bp, Homo sapiens
cagtcaggggtgggatcaaggc

SEQ ID NO: 7454493 - DNA, 22 bp, Homo sapiens
cagtcagggacaccagctagga

SEQ ID NO: 7454494 - DNA, 22 bp, Homo sapiens
cagtcagggacaccagctagga

SEQ ID NO: 7454495 - DNA, 22 bp, Homo sapiens
cagtcagggacaccagctagga

SEQ ID NO: 7454496 - DNA, 22 bp, Homo sapiens
cagtcagggacaccagctagga

SEQ ID NO: 7454497 - DNA, 22 bp, Homo sapiens
cagtcaggaatgcctccttcct

SEQ ID NO: 7454498 - DNA, 22 bp, Homo sapiens
cagtcaggaatgcctccttcct

SEQ ID NO: 7454499 - DNA, 22 bp, Homo sapiens
cagtcagagtcacagtaatttg

SEQ ID NO: 7454500 - DNA, 22 bp, Homo sapiens
cagtcagaggtcttctaaaaca

SEQ ID NO: 7454501 - DNA, 22 bp, Homo sapiens
cagtcagagtcacagtaatttg

SEQ ID NO: 7454502 - DNA, 22 bp, Homo sapiens
cagtcagagtcacagtaatttg

SEQ ID NO: 7454503 - DNA, 22 bp, Homo sapiens
cagtcaggctgcgcttctctga

SEQ ID NO: 7454504 - DNA, 22 bp, Homo sapiens
cagtcaggctgcgcttctctga

SEQ ID NO: 7454505 - DNA, 22 bp, Homo sapiens
cagtcaggaatgcctccttcct

SEQ ID NO: 7454506 - DNA, 22 bp, Homo sapiens
cagtcaggctgcgcttctctga

SEQ ID NO: 7454507 - DNA, 22 bp, Homo sapiens
cagtcagaaggaagatgcttaa

SEQ ID NO: 7454508 - DNA, 22 bp, Homo sapiens
cagtcagaaggaagatgcttaa

SEQ ID NO: 7454509 - DNA, 22 bp, Homo sapiens
cagtcacttacaaaaatataat

SEQ ID NO: 7454510 - DNA, 22 bp, Homo sapiens
cagtcagaaggaagatgcttaa

SEQ ID NO: 7454511 - DNA, 22 bp, Homo sapiens
cagtcagaaggaagatgcttaa

SEQ ID NO: 7454512 - DNA, 22 bp, Homo sapiens
cagtcagaggtcttctaaaaca

SEQ ID NO: 7454513 - DNA, 22 bp, Homo sapiens
cagtcacttacaaaaatataat

SEQ ID NO: 7454514 - DNA, 22 bp, Homo sapiens
cagtcactggttctataggccc

SEQ ID NO: 7454515 - DNA, 22 bp, Homo sapiens
cagtcactggaatagctgagga

SEQ ID NO: 7454516 - DNA, 22 bp, Homo sapiens
cagtcactggttctataggccc

SEQ ID NO: 7454517 - DNA, 22 bp, Homo sapiens
cagtcactggaatagctgagga

SEQ ID NO: 7454518 - DNA, 22 bp, Homo sapiens
cagtcactccagcctgcctcag

SEQ ID NO: 7454519 - DNA, 22 bp, Homo sapiens
cagtcactggaatagctgagga

SEQ ID NO: 7454520 - DNA, 22 bp, Homo sapiens
tattttaaagtgaagggtcttg

SEQ ID NO: 7454521 - DNA, 22 bp, Homo sapiens
tattttaaagtgaagggtcttg

SEQ ID NO: 7454522 - DNA, 22 bp, Homo sapiens
tattttaaagtgaagggtcttg

SEQ ID NO: 7454523 - DNA, 22 bp, Homo sapiens
tattttaaagtgaagggtcttg

SEQ ID NO: 7454524 - DNA, 22 bp, Homo sapiens
tattttaaagtgaagggtcttg

SEQ ID NO: 7454525 - DNA, 22 bp, Homo sapiens
tattttaaagtgaagggtcttg

SEQ ID NO: 7454526 - DNA, 22 bp, Homo sapiens
tattttaaagtgaagggtcttg

SEQ ID NO: 7454527 - DNA, 22 bp, Homo sapiens
tattttaaagtgaagggtcttg

SEQ ID NO: 7454528 - DNA, 22 bp, Homo sapiens
tattttaaagtgaagggtcttg

SEQ ID NO: 7454529 - DNA, 22 bp, Homo sapiens
tattttaaagtgaagggtcttg

SEQ ID NO: 7454530 - DNA, 22 bp, Homo sapiens
tattttacaaatgggaatgctg

SEQ ID NO: 7454531 - DNA, 22 bp, Homo sapiens
tattttacaaatgggaatgctg

SEQ ID NO: 7454532 - DNA, 22 bp, Homo sapiens
tattttacagactactttagat

SEQ ID NO: 7454533 - DNA, 22 bp, Homo sapiens
tattttacagactactttagat

SEQ ID NO: 7454534 - DNA, 22 bp, Homo sapiens
tattttacagactactttagat

SEQ ID NO: 7454535 - DNA, 22 bp, Homo sapiens
tattttacagactactttagat

SEQ ID NO: 7454536 - DNA, 22 bp, Homo sapiens
tattttacagactactttagat

SEQ ID NO: 7454537 - DNA, 22 bp, Homo sapiens
tattttacagactactttagat

SEQ ID NO: 7454538 - DNA, 22 bp, Homo sapiens
tattttacagactactttagat

SEQ ID NO: 7454539 - DNA, 22 bp, Homo sapiens
tattttacagactactttagat

SEQ ID NO: 7454540 - DNA, 22 bp, Homo sapiens
tattttacagactactttagat

SEQ ID NO: 7454541 - DNA, 22 bp, Homo sapiens
tattttacagactactttagat

SEQ ID NO: 7454542 - DNA, 22 bp, Homo sapiens
tattttaaagactgccagccta

SEQ ID NO: 7454543 - DNA, 22 bp, Homo sapiens
tattttaaagactgccagccta

SEQ ID NO: 7454544 - DNA, 22 bp, Homo sapiens
tattttaaagactgccagccta

SEQ ID NO: 7454545 - DNA, 22 bp, Homo sapiens
tattttaaagactgccagccta

SEQ ID NO: 7454546 - DNA, 22 bp, Homo sapiens
tattttaaagactgccagccta

SEQ ID NO: 7454547 - DNA, 22 bp, Homo sapiens
tattttaaagactgccagccta

SEQ ID NO: 7454548 - DNA, 22 bp, Homo sapiens
tattttaaagactgccagccta

SEQ ID NO: 7454549 - DNA, 22 bp, Homo sapiens
tatttgaaggcatacattttga

SEQ ID NO: 7454550 - DNA, 22 bp, Homo sapiens
tatttgaagattcttctgatgt

SEQ ID NO: 7454551 - DNA, 22 bp, Homo sapiens
tatttgaagacagggtctttaa

SEQ ID NO: 7454552 - DNA, 20 bp, Homo sapiens
tatttgaaatggccaagtgt

SEQ ID NO: 7454553 - DNA, 20 bp, Homo sapiens
cagtccaatcagaggccacc

SEQ ID NO: 7454554 - DNA, 22 bp, Homo sapiens
cagtccaagagagataaaatgg

SEQ ID NO: 7454555 - DNA, 20 bp, Homo sapiens
cagtccaatcagaggccacc

SEQ ID NO: 7454556 - DNA, 22 bp, Homo sapiens
tatttgaagacagggtctttaa

SEQ ID NO: 7454557 - DNA, 20 bp, Homo sapiens
tatttgaaatggccaagtgt

SEQ ID NO: 7454558 - DNA, 22 bp, Homo sapiens
tcaaaaattttctgaggatgag

SEQ ID NO: 7454559 - DNA, 22 bp, Homo sapiens
tcaaaaattttctgaggatgag

SEQ ID NO: 7454560 - DNA, 22 bp, Homo sapiens
tcaaaaatgttttatattggta

SEQ ID NO: 7454561 - DNA, 22 bp, Homo sapiens
tcaaaaatgttttatattggta

SEQ ID NO: 7454562 - DNA, 22 bp, Homo sapiens
tcaaaaatgttttatattggta

SEQ ID NO: 7454563 - DNA, 22 bp, Homo sapiens
tattttcaccatgtatccctgt

SEQ ID NO: 7454564 - DNA, 22 bp, Homo sapiens
tattttcaccatgtatccctgt

SEQ ID NO: 7454565 - DNA, 22 bp, Homo sapiens
tattttatctgccagagtggag

SEQ ID NO: 7454566 - DNA, 22 bp, Homo sapiens
tattttatctgccagagtggag

SEQ ID NO: 7454567 - DNA, 22 bp, Homo sapiens
tattttatctgccagagtggag

SEQ ID NO: 7454568 - DNA, 22 bp, Homo sapiens
tattttatctgccagagtggag

SEQ ID NO: 7454569 - DNA, 22 bp, Homo sapiens
tattttcaccatgtatccctgt

SEQ ID NO: 7454570 - DNA, 22 bp, Homo sapiens
tattttatctgccagagtggag

SEQ ID NO: 7454571 - DNA, 22 bp, Homo sapiens
tattttaggtaatatccattgt

SEQ ID NO: 7454572 - DNA, 22 bp, Homo sapiens
tattttaggtaatatccattgt

SEQ ID NO: 7454573 - DNA, 22 bp, Homo sapiens
tattttaggtaatatccattgt

SEQ ID NO: 7454574 - DNA, 22 bp, Homo sapiens
tattttaggtaatatccattgt

SEQ ID NO: 7454575 - DNA, 22 bp, Homo sapiens
tattttaggtaatatccattgt

SEQ ID NO: 7454576 - DNA, 22 bp, Homo sapiens
tattttactttaaagcgagaga

SEQ ID NO: 7454577 - DNA, 22 bp, Homo sapiens
tattttactttaaagcgagaga

SEQ ID NO: 7454578 - DNA, 22 bp, Homo sapiens
tattttactatttggcaaagtc

SEQ ID NO: 7454579 - DNA, 22 bp, Homo sapiens
tattttactatttggcaaagtc

SEQ ID NO: 7454580 - DNA, 22 bp, Homo sapiens
tattttacatgatccagagttg

SEQ ID NO: 7454581 - DNA, 22 bp, Homo sapiens
tattttacatgacaggtgttta

SEQ ID NO: 7454582 - DNA, 22 bp, Homo sapiens
tattttacatgacaggtgttta

SEQ ID NO: 7454583 - DNA, 22 bp, Homo sapiens
tattttacatgacaggtgttta

SEQ ID NO: 7454584 - DNA, 22 bp, Homo sapiens
tattttacatgatccagagttg

SEQ ID NO: 7454585 - DNA, 22 bp, Homo sapiens
tcaaaaattttctgaggatgag

SEQ ID NO: 7454586 - DNA, 22 bp, Homo sapiens
tcaaaaattttctgaggatgag

SEQ ID NO: 7454587 - DNA, 22 bp, Homo sapiens
tcaaaaattttctgaggatgag

SEQ ID NO: 7454588 - DNA, 22 bp, Homo sapiens
tcaaaaattttctgaggatgag

SEQ ID NO: 7454589 - DNA, 22 bp, Homo sapiens
tcaaaacaacactcaggtgtaa

SEQ ID NO: 7454590 - DNA, 22 bp, Homo sapiens
tcaaaacaacactcaggtgtaa

SEQ ID NO: 7454591 - DNA, 22 bp, Homo sapiens
tcaaaacaacactcaggtgtaa

SEQ ID NO: 7454592 - DNA, 22 bp, Homo sapiens
tcaaaacaacactcaggtgtaa

SEQ ID NO: 7454593 - DNA, 22 bp, Homo sapiens
tcaaaacaacactcaggtgtaa

SEQ ID NO: 7454594 - DNA, 22 bp, Homo sapiens
tcaaaacaacactcaggtgtaa

SEQ ID NO: 7454595 - DNA, 22 bp, Homo sapiens
tcaaaacaacactcaggtgtaa

SEQ ID NO: 7454596 - DNA, 22 bp, Homo sapiens
tcaaaacaacactcaggtgtaa

SEQ ID NO: 7454597 - DNA, 22 bp, Homo sapiens
tcaaaacaacactcaggtgtaa

SEQ ID NO: 7454598 - DNA, 22 bp, Homo sapiens
tcaaaacaatcattggatgtgc

SEQ ID NO: 7454599 - DNA, 22 bp, Homo sapiens
tcaaaacaatcattggatgtgc

SEQ ID NO: 7454600 - DNA, 22 bp, Homo sapiens
tcaaaacaatcattggatgtgc

SEQ ID NO: 7454601 - DNA, 22 bp, Homo sapiens
tcaaaacaatcattggatgtgc

SEQ ID NO: 7454602 - DNA, 22 bp, Homo sapiens
tcaaaacaatcattggatgtgc

SEQ ID NO: 7454603 - DNA, 22 bp, Homo sapiens
tcaaaacaatcattggatgtgc

SEQ ID NO: 7454604 - DNA, 22 bp, Homo sapiens
tcaaaacaacactcaggtgtaa

SEQ ID NO: 7454605 - DNA, 22 bp, Homo sapiens
tcaaaacaatcattggatgtgc

SEQ ID NO: 7454606 - DNA, 22 bp, Homo sapiens
tcaaaacaatcattggatgtgc

SEQ ID NO: 7454607 - DNA, 22 bp, Homo sapiens
tcaaaacactattacctttaat

SEQ ID NO: 7454608 - DNA, 22 bp, Homo sapiens
tcaaaacactattacctttaat

SEQ ID NO: 7454609 - DNA, 22 bp, Homo sapiens
tcaaaacactattacctttaat

SEQ ID NO: 7454610 - DNA, 22 bp, Homo sapiens
tcaaaacactattacctttaat

SEQ ID NO: 7454611 - DNA, 22 bp, Homo sapiens
tcaaaacactattacctttaat

SEQ ID NO: 7454612 - DNA, 22 bp, Homo sapiens
tcaaaacactattacctttaat

SEQ ID NO: 7454613 - DNA, 22 bp, Homo sapiens
tcaaaacactattacctttaat

SEQ ID NO: 7454614 - DNA, 19 bp, Homo sapiens
tcaaaacacaaatggttga

SEQ ID NO: 7454615 - DNA, 19 bp, Homo sapiens
tcaaaacacaaatggttga

SEQ ID NO: 7454616 - DNA, 19 bp, Homo sapiens
tcaaaacacaaatggttga

SEQ ID NO: 7454617 - DNA, 19 bp, Homo sapiens
tcaaaacacaaatggttga

SEQ ID NO: 7454618 - DNA, 19 bp, Homo sapiens
tcaaaacacaaatggttga

SEQ ID NO: 7454619 - DNA, 19 bp, Homo sapiens
tcaaaacacaaatggttga

SEQ ID NO: 7454620 - DNA, 19 bp, Homo sapiens
tcaaaacacaaatggttga

SEQ ID NO: 7454621 - DNA, 19 bp, Homo sapiens
tcaaaacacaaatggttga

SEQ ID NO: 7454622 - DNA, 19 bp, Homo sapiens
tcaaaacacaaatggttga

SEQ ID NO: 7454623 - DNA, 19 bp, Homo sapiens
tcaaaacacaaatggttga

SEQ ID NO: 7454624 - DNA, 19 bp, Homo sapiens
tcaaaacacaaatggttga

SEQ ID NO: 7454625 - DNA, 19 bp, Homo sapiens
tcaaaacacaaatggttga

SEQ ID NO: 7454626 - DNA, 19 bp, Homo sapiens
tcaaaacacaaatggttga

SEQ ID NO: 7454627 - DNA, 19 bp, Homo sapiens
tcaaaacacaaatggttga

SEQ ID NO: 7454628 - DNA, 22 bp, Homo sapiens
tcaagcagggtagcaagctggt

SEQ ID NO: 7454629 - DNA, 19 bp, Homo sapiens
tcaagcagtctgatttagg

SEQ ID NO: 7454630 - DNA, 19 bp, Homo sapiens
tcaagcagtctgatttagg

SEQ ID NO: 7454631 - DNA, 19 bp, Homo sapiens
tcaagcagtctgatttagg

SEQ ID NO: 7454632 - DNA, 19 bp, Homo sapiens
tcaagcagtctgatttagg

SEQ ID NO: 7454633 - DNA, 22 bp, Homo sapiens
tcaagcagcagatcaagagcta

SEQ ID NO: 7454634 - DNA, 22 bp, Homo sapiens
tcaagcagcttttacagaagag

SEQ ID NO: 7454635 - DNA, 22 bp, Homo sapiens
tcaagcagcttttacagaagag

SEQ ID NO: 7454636 - DNA, 22 bp, Homo sapiens
tcaagcagcttttacagaagag

SEQ ID NO: 7454637 - DNA, 22 bp, Homo sapiens
tcaagcagggtagcaagctggt

SEQ ID NO: 7454638 - DNA, 22 bp, Homo sapiens
tcaagcagagtcaaaagtacca

SEQ ID NO: 7454639 - DNA, 23 bp, Homo sapiens
tcaagcaattctcctgcctcggc

SEQ ID NO: 7454640 - DNA, 22 bp, Homo sapiens
tcaagcagagtcaaaagtacca

SEQ ID NO: 7454641 - DNA, 22 bp, Homo sapiens
tcaagcagcagatcaagagcta

SEQ ID NO: 7454642 - DNA, 22 bp, Homo sapiens
tcaagcagagtcaaaagtacca

SEQ ID NO: 7454643 - DNA, 22 bp, Homo sapiens
tcaagcaatctctgtgtccctg

SEQ ID NO: 7454644 - DNA, 22 bp, Homo sapiens
tcaagcaattctcctgcctcag

SEQ ID NO: 7454645 - DNA, 23 bp, Homo sapiens
tcaagcaataattggtaatagtg

SEQ ID NO: 7454646 - DNA, 23 bp, Homo sapiens
tcaagcaataattggtaatagtg

SEQ ID NO: 7454647 - DNA, 22 bp, Homo sapiens
tcaagcatcttggtctacgatc

SEQ ID NO: 7454648 - DNA, 22 bp, Homo sapiens
tcaagccactggcagaagatta

SEQ ID NO: 7454649 - DNA, 22 bp, Homo sapiens
tcaagccactggcagaagatta

SEQ ID NO: 7454650 - DNA, 22 bp, Homo sapiens
tcaagccactggcagaagatta

SEQ ID NO: 7454651 - DNA, 22 bp, Homo sapiens
tcaagccatcaggcagcgggtt

SEQ ID NO: 7454652 - DNA, 22 bp, Homo sapiens
tcaagctattggctgaggctgc

SEQ ID NO: 7454653 - DNA, 22 bp, Homo sapiens
tcaagcggactgagatactctg

SEQ ID NO: 7454654 - DNA, 20 bp, Homo sapiens
tcaagctagtttccaaagtt

SEQ ID NO: 7454655 - DNA, 22 bp, Homo sapiens
tcaagctacaaccatattcatt

SEQ ID NO: 7454656 - DNA, 23 bp, Homo sapiens
tcaagcccaggaactgaaagaga

SEQ ID NO: 7454657 - DNA, 22 bp, Homo sapiens
tcaatagattaggtattagatt

SEQ ID NO: 7454658 - DNA, 22 bp, Homo sapiens
tcaatagataaagctacataaa

SEQ ID NO: 7454659 - DNA, 22 bp, Homo sapiens
tcaatagataaagctacataaa

SEQ ID NO: 7454660 - DNA, 22 bp, Homo sapiens
tcaatagagccttctttcaggt

SEQ ID NO: 7454661 - DNA, 22 bp, Homo sapiens
tcaatagagccttctttcaggt

SEQ ID NO: 7454662 - DNA, 22 bp, Homo sapiens
tcaagctgcatcagtgcagtga

SEQ ID NO: 7454663 - DNA, 22 bp, Homo sapiens
tcaagctgcatcagtgcagtga

SEQ ID NO: 7454664 - DNA, 22 bp, Homo sapiens
tcaacaaatacttaaagcagag

SEQ ID NO: 7454665 - DNA, 22 bp, Homo sapiens
tcaacaaatacttaaagcagag

SEQ ID NO: 7454666 - DNA, 22 bp, Homo sapiens
tcaacaaatacttaaagcagag

SEQ ID NO: 7454667 - DNA, 22 bp, Homo sapiens
tcaaaacccagccatcaggact

SEQ ID NO: 7454668 - DNA, 22 bp, Homo sapiens
tcaaaacactattacctttaat

SEQ ID NO: 7454669 - DNA, 22 bp, Homo sapiens
tcaaaacactattacctttaat

SEQ ID NO: 7454670 - DNA, 22 bp, Homo sapiens
tcaaaacactattacctttaat

SEQ ID NO: 7454671 - DNA, 22 bp, Homo sapiens
tcaaaacactattacctttaat

SEQ ID NO: 7454672 - DNA, 22 bp, Homo sapiens
tcaagatgaaccaggacattca

SEQ ID NO: 7454673 - DNA, 22 bp, Homo sapiens
tcaacaaatacttaaagcagag

SEQ ID NO: 7454674 - DNA, 22 bp, Homo sapiens
tcaacaaatacttaaagcagag

SEQ ID NO: 7454675 - DNA, 20 bp, Homo sapiens
tcaagatgaggtcatactgg

SEQ ID NO: 7454676 - DNA, 22 bp, Homo sapiens
tcaagatgcatgggtggcataa

SEQ ID NO: 7454677 - DNA, 22 bp, Homo sapiens
tcaagatgattgcttcaggccc

SEQ ID NO: 7454678 - DNA, 19 bp, Homo sapiens
tcaagatggatggctccca

SEQ ID NO: 7454679 - DNA, 19 bp, Homo sapiens
tcaagatggatggctccca

SEQ ID NO: 7454680 - DNA, 22 bp, Homo sapiens
tcaagcaaagatacaaatggaa

SEQ ID NO: 7454681 - DNA, 22 bp, Homo sapiens
tcaagcaaagatacaaatggaa

SEQ ID NO: 7454682 - DNA, 22 bp, Homo sapiens
tcaagcaaagtttagctggtta

SEQ ID NO: 7454683 - DNA, 22 bp, Homo sapiens
tcaagcaaagtttagctggtta

SEQ ID NO: 7454684 - DNA, 22 bp, Homo sapiens
tcaagcaaatgtccttttgttc

SEQ ID NO: 7454685 - DNA, 22 bp, Homo sapiens
tcaagatgtccagtgcctataa

SEQ ID NO: 7454686 - DNA, 22 bp, Homo sapiens
tcaagatgtgatgtaacttttg

SEQ ID NO: 7454687 - DNA, 22 bp, Homo sapiens
tcaagcaaagatacaaatggaa

SEQ ID NO: 7454688 - DNA, 22 bp, Homo sapiens
tcaagcaaactctgagaaataa

SEQ ID NO: 7454689 - DNA, 22 bp, Homo sapiens
tcaagcaaactctgagaaataa

SEQ ID NO: 7454690 - DNA, 22 bp, Homo sapiens
tcaagcaaactctgagaaataa

SEQ ID NO: 7454691 - DNA, 22 bp, Homo sapiens
tcaagcaactgaattctaaaag

SEQ ID NO: 7454692 - DNA, 22 bp, Homo sapiens
tcaagcaagttgcatattgcta

SEQ ID NO: 7454693 - DNA, 22 bp, Homo sapiens
tcaagcaagttgcatattgcta

SEQ ID NO: 7454694 - DNA, 22 bp, Homo sapiens
tcaagcaagtgtttggtgtaaa

SEQ ID NO: 7454695 - DNA, 22 bp, Homo sapiens
tcaagcaagtgtttggtgtaaa

SEQ ID NO: 7454696 - DNA, 22 bp, Homo sapiens
tcaagcaaatgtccttttgttc

SEQ ID NO: 7454697 - DNA, 22 bp, Homo sapiens
tcaagcaacagaactgtgagac

SEQ ID NO: 7454698 - DNA, 22 bp, Homo sapiens
tcaagcaacagaactgtgagac

SEQ ID NO: 7454699 - DNA, 22 bp, Homo sapiens
tcaagcaactgaattctaaaag

SEQ ID NO: 7454700 - DNA, 22 bp, Homo sapiens
tcaagcaactgaattctaaaag

SEQ ID NO: 7454701 - DNA, 22 bp, Homo sapiens
caggtagcttttgatattaggg

SEQ ID NO: 7454702 - DNA, 22 bp, Homo sapiens
caggtagctgctggccatgtac

SEQ ID NO: 7454703 - DNA, 22 bp, Homo sapiens
caggtagctgcagagactattt

SEQ ID NO: 7454704 - DNA, 22 bp, Homo sapiens
caggtagctgctggccatgtac

SEQ ID NO: 7454705 - DNA, 22 bp, Homo sapiens
caggtagctgcagagactattt

SEQ ID NO: 7454706 - DNA, 22 bp, Homo sapiens
caggtagaggctgccatcagct

SEQ ID NO: 7454707 - DNA, 17 bp, Homo sapiens
caggtacattgctactg

SEQ ID NO: 7454708 - DNA, 22 bp, Homo sapiens
caggtaggaggctccctagtcc

SEQ ID NO: 7454709 - DNA, 22 bp, Homo sapiens
caggtaggaggctccctagtcc

SEQ ID NO: 7454710 - DNA, 22 bp, Homo sapiens
caggtaggaggctccctagtcc

SEQ ID NO: 7454711 - DNA, 22 bp, Homo sapiens
caggtaggatggaagggctcaa

SEQ ID NO: 7454712 - DNA, 22 bp, Homo sapiens
caggtaggaaaagggtgtcagg

SEQ ID NO: 7454713 - DNA, 22 bp, Homo sapiens
caggtaggaaaagggtgtcagg

SEQ ID NO: 7454714 - DNA, 22 bp, Homo sapiens
caggtagctgctggccatgtac

SEQ ID NO: 7454715 - DNA, 22 bp, Homo sapiens
caggtaggaaaagggtgtcagg

SEQ ID NO: 7454716 - DNA, 22 bp, Homo sapiens
caggtaggatggaagggctcaa

SEQ ID NO: 7454717 - DNA, 22 bp, Homo sapiens
caggtaggatggaagggctcaa

SEQ ID NO: 7454718 - DNA, 22 bp, Homo sapiens
caggtaggatggaagggctcaa

SEQ ID NO: 7454719 - DNA, 22 bp, Homo sapiens
caggtaggcagccggtctctgg

SEQ ID NO: 7454720 - DNA, 22 bp, Homo sapiens
caggtaaaaataaatttgtgag

SEQ ID NO: 7454721 - DNA, 22 bp, Homo sapiens
caggtaaaaataaatttgtgag

SEQ ID NO: 7454722 - DNA, 22 bp, Homo sapiens
caggtaaagcttcaaatcactt

SEQ ID NO: 7454723 - DNA, 22 bp, Homo sapiens
caggtaaaggttaactattaga

SEQ ID NO: 7454724 - DNA, 22 bp, Homo sapiens
caggtaaaggttaactattaga

SEQ ID NO: 7454725 - DNA, 22 bp, Homo sapiens
cagggtggggctggctatcaaa

SEQ ID NO: 7454726 - DNA, 22 bp, Homo sapiens
cagggtttctgttgagaagtcc

SEQ ID NO: 7454727 - DNA, 22 bp, Homo sapiens
caggtaaggtcacattctgaag

SEQ ID NO: 7454728 - DNA, 22 bp, Homo sapiens
caggtaaggtcacattctgaag

SEQ ID NO: 7454729 - DNA, 22 bp, Homo sapiens
caggtaagaccgtttaggcagt

SEQ ID NO: 7454730 - DNA, 22 bp, Homo sapiens
caggtacactcccttgtgctga

SEQ ID NO: 7454731 - DNA, 22 bp, Homo sapiens
caggtacactcccttgtgctga

SEQ ID NO: 7454732 - DNA, 22 bp, Homo sapiens
caggtacactcccttgtgctga

SEQ ID NO: 7454733 - DNA, 22 bp, Homo sapiens
caggtacaaagctactgcctga

SEQ ID NO: 7454734 - DNA, 23 bp, Homo sapiens
caggtattgatttttcttctagg

SEQ ID NO: 7454735 - DNA, 22 bp, Homo sapiens
caggtcaaaggttagttatgtt

SEQ ID NO: 7454736 - DNA, 22 bp, Homo sapiens
caggtcagaggcgcagccccca

SEQ ID NO: 7454737 - DNA, 22 bp, Homo sapiens
caggtcagaggtagatgagatg

SEQ ID NO: 7454738 - DNA, 22 bp, Homo sapiens
caggtcagaggcgcagccccca

SEQ ID NO: 7454739 - DNA, 22 bp, Homo sapiens
caggtcagaggcgcagccccca

SEQ ID NO: 7454740 - DNA, 22 bp, Homo sapiens
caggtcagaggtagatgagatg

SEQ ID NO: 7454741 - DNA, 22 bp, Homo sapiens
caggtcagaggtagatgagatg

SEQ ID NO: 7454742 - DNA, 22 bp, Homo sapiens
caggtcagaggtagatgagatg

SEQ ID NO: 7454743 - DNA, 22 bp, Homo sapiens
caggtcagaggtagatgagatg

SEQ ID NO: 7454744 - DNA, 22 bp, Homo sapiens
caggtaggggagagctccaaca

SEQ ID NO: 7454745 - DNA, 22 bp, Homo sapiens
caggtaggcagccggtctctgg

SEQ ID NO: 7454746 - DNA, 22 bp, Homo sapiens
caggtagggatatgatggtgat

SEQ ID NO: 7454747 - DNA, 22 bp, Homo sapiens
caggtaggccaatgttttccaa

SEQ ID NO: 7454748 - DNA, 22 bp, Homo sapiens
caggtaggcagccggtctctgg

SEQ ID NO: 7454749 - DNA, 22 bp, Homo sapiens
caggtaggcagccggtctctgg

SEQ ID NO: 7454750 - DNA, 22 bp, Homo sapiens
caggtaggcagccggtctctgg

SEQ ID NO: 7454751 - DNA, 22 bp, Homo sapiens
caggtagggatatgatggtgat

SEQ ID NO: 7454752 - DNA, 22 bp, Homo sapiens
caggtagggatatgatggtgat

SEQ ID NO: 7454753 - DNA, 22 bp, Homo sapiens
caggtagggatatgatggtgat

SEQ ID NO: 7454754 - DNA, 22 bp, Homo sapiens
caggtagggatatgatggtgat

SEQ ID NO: 7454755 - DNA, 22 bp, Homo sapiens
caggtaggtatggtgcagtctt

SEQ ID NO: 7454756 - DNA, 22 bp, Homo sapiens
caggtaggtatggtgcagtctt

SEQ ID NO: 7454757 - DNA, 22 bp, Homo sapiens
caggtaggttttaggctaaaca

SEQ ID NO: 7454758 - DNA, 22 bp, Homo sapiens
caggtaggtatggtgcagtctt

SEQ ID NO: 7454759 - DNA, 22 bp, Homo sapiens
caggtatatgtgcatccataga

SEQ ID NO: 7454760 - DNA, 22 bp, Homo sapiens
caggtatgaggacactgacagc

SEQ ID NO: 7454761 - DNA, 22 bp, Homo sapiens
caggtatgaggacactgacagc

SEQ ID NO: 7454762 - DNA, 22 bp, Homo sapiens
caggtgacatcaacaggaccac

SEQ ID NO: 7454763 - DNA, 22 bp, Homo sapiens
caggtgcccagctcctgctgtg

SEQ ID NO: 7454764 - DNA, 22 bp, Homo sapiens
caggtgcccagctcctgctgtg

SEQ ID NO: 7454765 - DNA, 22 bp, Homo sapiens
caggtgcccagctcctgctgtg

SEQ ID NO: 7454766 - DNA, 22 bp, Homo sapiens
caggtgaatcacttgagtccag

SEQ ID NO: 7454767 - DNA, 22 bp, Homo sapiens
caggtccacagcccatcactgc

SEQ ID NO: 7454768 - DNA, 22 bp, Homo sapiens
caggtgacaagacaggtaatat

SEQ ID NO: 7454769 - DNA, 22 bp, Homo sapiens
caggtccaccatgcctcaagcc

SEQ ID NO: 7454770 - DNA, 22 bp, Homo sapiens
caggtgaatcacttgagtccag

SEQ ID NO: 7454771 - DNA, 22 bp, Homo sapiens
caggtgaagaggataaaaagtt

SEQ ID NO: 7454772 - DNA, 22 bp, Homo sapiens
caggtgaagaggataaaaagtt

SEQ ID NO: 7454773 - DNA, 22 bp, Homo sapiens
caggtccaccatgcctcaagcc

SEQ ID NO: 7454774 - DNA, 22 bp, Homo sapiens
caggtccaattgcgctaaaatc

SEQ ID NO: 7454775 - DNA, 22 bp, Homo sapiens
caggtccaattgcgctaaaatc

SEQ ID NO: 7454776 - DNA, 22 bp, Homo sapiens
caggtccaagagatcctcctac

SEQ ID NO: 7454777 - DNA, 22 bp, Homo sapiens
caggtccaaggttcctgaatag

SEQ ID NO: 7454778 - DNA, 22 bp, Homo sapiens
caggtccaaggttcctgaatag

SEQ ID NO: 7454779 - DNA, 22 bp, Homo sapiens
caggtccacagcccatcactgc

SEQ ID NO: 7454780 - DNA, 22 bp, Homo sapiens
caggtccacagcccatcactgc

SEQ ID NO: 7454781 - DNA, 22 bp, Homo sapiens
caggtccacagcccatcactgc

SEQ ID NO: 7454782 - DNA, 22 bp, Homo sapiens
caggtccaattgcgctaaaatc

SEQ ID NO: 7454783 - DNA, 22 bp, Homo sapiens
caggtccacagcccatcactgc

SEQ ID NO: 7454784 - DNA, 22 bp, Homo sapiens
caggtccacagcccatcactgc

SEQ ID NO: 7454785 - DNA, 22 bp, Homo sapiens
caggtcagctggtgccccaggt

SEQ ID NO: 7454786 - DNA, 22 bp, Homo sapiens
caggtcagctggtgccccaggt

SEQ ID NO: 7454787 - DNA, 18 bp, Homo sapiens
caggtcagcctggcctca

SEQ ID NO: 7454788 - DNA, 22 bp, Homo sapiens
caggtccaagagatcctcctac

SEQ ID NO: 7454789 - DNA, 22 bp, Homo sapiens
caggtccaagagatcctcctac

SEQ ID NO: 7454790 - DNA, 22 bp, Homo sapiens
caggtccaactatttatctgtg

SEQ ID NO: 7454791 - DNA, 22 bp, Homo sapiens
caggtccaactatttatctgtg

SEQ ID NO: 7454792 - DNA, 22 bp, Homo sapiens
caggtccaactatttatctgtg

SEQ ID NO: 7454793 - DNA, 22 bp, Homo sapiens
caggtcagctggtgccccaggt

SEQ ID NO: 7454794 - DNA, 18 bp, Homo sapiens
caggtcagcctggcctca

SEQ ID NO: 7454795 - DNA, 22 bp, Homo sapiens
caggtcagcacttggaggtgca

SEQ ID NO: 7454796 - DNA, 22 bp, Homo sapiens
caggtcagcacttggaggtgca

SEQ ID NO: 7454797 - DNA, 22 bp, Homo sapiens
caggtcagcacttggaggtgca

SEQ ID NO: 7454798 - DNA, 22 bp, Homo sapiens
caggtcagcacttggaggtgca

SEQ ID NO: 7454799 - DNA, 22 bp, Homo sapiens
caggtcagcacttggaggtgca

SEQ ID NO: 7454800 - DNA, 22 bp, Homo sapiens
caggtcagagtccccctgtcct

SEQ ID NO: 7454801 - DNA, 22 bp, Homo sapiens
caggtgcctcaggatgagacaa

SEQ ID NO: 7454802 - DNA, 22 bp, Homo sapiens
caggtgcctcaggatgagacaa

SEQ ID NO: 7454803 - DNA, 16 bp, Homo sapiens
caggtgcctctcccga

SEQ ID NO: 7454804 - DNA, 22 bp, Homo sapiens
caggtgctcccagagaagtgct

SEQ ID NO: 7454805 - DNA, 22 bp, Homo sapiens
caggtgctcccagagaagtgct

SEQ ID NO: 7454806 - DNA, 22 bp, Homo sapiens
caggtgcctcaggatgagacaa

SEQ ID NO: 7454807 - DNA, 22 bp, Homo sapiens
caggtgcctcaggatgagacaa

SEQ ID NO: 7454808 - DNA, 22 bp, Homo sapiens
caggtgcctcaggatgagacaa

SEQ ID NO: 7454809 - DNA, 22 bp, Homo sapiens
caggtgccgggaatgcagcaat

SEQ ID NO: 7454810 - DNA, 22 bp, Homo sapiens
caggtgcccagctcctgctgtg

SEQ ID NO: 7454811 - DNA, 22 bp, Homo sapiens
caggtgcccaggggacagtggc

SEQ ID NO: 7454812 - DNA, 22 bp, Homo sapiens
caggtgccgggaatgcagcaat

SEQ ID NO: 7454813 - DNA, 22 bp, Homo sapiens
caggtgccgggaatgcagcaat

SEQ ID NO: 7454814 - DNA, 22 bp, Homo sapiens
caggtgccgggaatgcagcaat

SEQ ID NO: 7454815 - DNA, 22 bp, Homo sapiens
caggtgcccagctcctgctgtg

SEQ ID NO: 7454816 - DNA, 22 bp, Homo sapiens
caggtgcccaggggacagtggc

SEQ ID NO: 7454817 - DNA, 22 bp, Homo sapiens
caggtgcccagctcctgctgtg

SEQ ID NO: 7454818 - DNA, 22 bp, Homo sapiens
caggtgctgtcctgcacatgtc

SEQ ID NO: 7454819 - DNA, 22 bp, Homo sapiens
caggtgctgtcctgcacatgtc

SEQ ID NO: 7454820 - DNA, 22 bp, Homo sapiens
caggtgctgtgaatcttcataa

SEQ ID NO: 7454821 - DNA, 22 bp, Homo sapiens
caggtgctgtcctgcacatgtc

SEQ ID NO: 7454822 - DNA, 22 bp, Homo sapiens
caggtgctgtcctgcacatgtc

SEQ ID NO: 7454823 - DNA, 22 bp, Homo sapiens
caggtgctgcgtggcggagctg

SEQ ID NO: 7454824 - DNA, 22 bp, Homo sapiens
caggtgctgcgtggcggagctg

SEQ ID NO: 7454825 - DNA, 22 bp, Homo sapiens
caggtgctgcgtggcggagctg

SEQ ID NO: 7454826 - DNA, 22 bp, Homo sapiens
caggtgctgcagggctggcgtc

SEQ ID NO: 7454827 - DNA, 22 bp, Homo sapiens
caggtgctctgctgcaggtaag

SEQ ID NO: 7454828 - DNA, 22 bp, Homo sapiens
caggtgctctgctgcaggtaag

SEQ ID NO: 7454829 - DNA, 22 bp, Homo sapiens
caggtgctctgctgcaggtaag

SEQ ID NO: 7454830 - DNA, 22 bp, Homo sapiens
caggtgctgcagggctggcgtc

SEQ ID NO: 7454831 - DNA, 22 bp, Homo sapiens
caggtgctgcagggctggcgtc

SEQ ID NO: 7454832 - DNA, 22 bp, Homo sapiens
caggtgctgcgtggcggagctg

SEQ ID NO: 7454833 - DNA, 22 bp, Homo sapiens
caggtgctgcgtggcggagctg

SEQ ID NO: 7454834 - DNA, 22 bp, Homo sapiens
caggtgctgcagggctggcgtc

SEQ ID NO: 7454835 - DNA, 22 bp, Homo sapiens
caggtggcatgactgcctacaa

SEQ ID NO: 7454836 - DNA, 22 bp, Homo sapiens
caggtggcattgtcccgccagc

SEQ ID NO: 7454837 - DNA, 22 bp, Homo sapiens
caggtggcattgtcccgccagc

SEQ ID NO: 7454838 - DNA, 22 bp, Homo sapiens
caggtggcattgtcccgccagc

SEQ ID NO: 7454839 - DNA, 22 bp, Homo sapiens
caggtggcattgtcccgccagc

SEQ ID NO: 7454840 - DNA, 22 bp, Homo sapiens
caggtggcatgactgcctacaa

SEQ ID NO: 7454841 - DNA, 22 bp, Homo sapiens
caggtggcatgactgcctacaa

SEQ ID NO: 7454842 - DNA, 22 bp, Homo sapiens
caggtggcatgactgcctacaa

SEQ ID NO: 7454843 - DNA, 22 bp, Homo sapiens
caggtggcatgactgcctacaa

SEQ ID NO: 7454844 - DNA, 22 bp, Homo sapiens
caggtggcatgactgcctacaa

SEQ ID NO: 7454845 - DNA, 22 bp, Homo sapiens
caggtggcatgactgcctacaa

SEQ ID NO: 7454846 - DNA, 22 bp, Homo sapiens
caggtggccttgccatctcctg

SEQ ID NO: 7454847 - DNA, 22 bp, Homo sapiens
caggtggccttgccatctcctg

SEQ ID NO: 7454848 - DNA, 22 bp, Homo sapiens
caggtggccttgccatctcctg

SEQ ID NO: 7454849 - DNA, 22 bp, Homo sapiens
caggtggccttgccatctcctg

SEQ ID NO: 7454850 - DNA, 22 bp, Homo sapiens
caggtggccttgccatctcctg

SEQ ID NO: 7454851 - DNA, 22 bp, Homo sapiens
caggtggccttgccatctcctg

SEQ ID NO: 7454852 - DNA, 22 bp, Homo sapiens
caggtggccttgccatctcctg

SEQ ID NO: 7454853 - DNA, 22 bp, Homo sapiens
caggtggccagtactcaaggat

SEQ ID NO: 7454854 - DNA, 22 bp, Homo sapiens
caggtggccagtactcaaggat

SEQ ID NO: 7454855 - DNA, 22 bp, Homo sapiens
caggtggccagtactcaaggat

SEQ ID NO: 7454856 - DNA, 22 bp, Homo sapiens
caggtggccagtactcaaggat

SEQ ID NO: 7454857 - DNA, 22 bp, Homo sapiens
caggtggccagtactcaaggat

SEQ ID NO: 7454858 - DNA, 22 bp, Homo sapiens
caggtggccagtactcaaggat

SEQ ID NO: 7454859 - DNA, 22 bp, Homo sapiens
caggtggagctgactgagggca

SEQ ID NO: 7454860 - DNA, 22 bp, Homo sapiens
caggtggatctctaaggactga

SEQ ID NO: 7454861 - DNA, 22 bp, Homo sapiens
caggtggagctgactgagggca

SEQ ID NO: 7454862 - DNA, 22 bp, Homo sapiens
caggtggagctgactgagggca

SEQ ID NO: 7454863 - DNA, 22 bp, Homo sapiens
caggtggcaaatgagtagcatt

SEQ ID NO: 7454864 - DNA, 22 bp, Homo sapiens
caggtggcaaatgagtagcatt

SEQ ID NO: 7454865 - DNA, 22 bp, Homo sapiens
caggtggcaaatgagtagcatt

SEQ ID NO: 7454866 - DNA, 22 bp, Homo sapiens
caggtggcaaatgagtagcatt

SEQ ID NO: 7454867 - DNA, 22 bp, Homo sapiens
caggtggcaaatgagtagcatt

SEQ ID NO: 7454868 - DNA, 22 bp, Homo sapiens
caggtggcagaggtctctggaa

SEQ ID NO: 7454869 - DNA, 22 bp, Homo sapiens
caggtggcaaatgagtagcatt

SEQ ID NO: 7454870 - DNA, 22 bp, Homo sapiens
caggtggcagaggtctctggaa

SEQ ID NO: 7454871 - DNA, 22 bp, Homo sapiens
caggtggcagaggtctctggaa

SEQ ID NO: 7454872 - DNA, 22 bp, Homo sapiens
caggtggcagaggtctctggaa

SEQ ID NO: 7454873 - DNA, 22 bp, Homo sapiens
caggtggcagaggtctctggaa

SEQ ID NO: 7454874 - DNA, 22 bp, Homo sapiens
caggtggcagtgcctgcattct

SEQ ID NO: 7454875 - DNA, 22 bp, Homo sapiens
caggtggcagaggtctctggaa

SEQ ID NO: 7454876 - DNA, 22 bp, Homo sapiens
caggtggcagaggtctctggaa

SEQ ID NO: 7454877 - DNA, 22 bp, Homo sapiens
caggtggcagtgcctgcattct

SEQ ID NO: 7454878 - DNA, 22 bp, Homo sapiens
caggtggcagtgcctgcattct

SEQ ID NO: 7454879 - DNA, 22 bp, Homo sapiens
caggtggcagtgcctgcattct

SEQ ID NO: 7454880 - DNA, 19 bp, Homo sapiens
caggtggcgctctacaggg

SEQ ID NO: 7454881 - DNA, 19 bp, Homo sapiens
caggtggcgctctacaggg

SEQ ID NO: 7454882 - DNA, 22 bp, Homo sapiens
caggtggccttgccatctcctg

SEQ ID NO: 7454883 - DNA, 19 bp, Homo sapiens
caggtggcgctctacaggg

SEQ ID NO: 7454884 - DNA, 19 bp, Homo sapiens
caggtggcgctctacaggg

SEQ ID NO: 7454885 - DNA, 19 bp, Homo sapiens
caggtggcgctctacaggg

SEQ ID NO: 7454886 - DNA, 19 bp, Homo sapiens
caggtggcgctctacaggg

SEQ ID NO: 7454887 - DNA, 22 bp, Homo sapiens
caggtggctaacggcctcatag

SEQ ID NO: 7454888 - DNA, 22 bp, Homo sapiens
caggtggctaacggcctcatag

SEQ ID NO: 7454889 - DNA, 22 bp, Homo sapiens
caggtggctaacggcctcatag

SEQ ID NO: 7454890 - DNA, 22 bp, Homo sapiens
caggtggctaacggcctcatag

SEQ ID NO: 7454891 - DNA, 19 bp, Homo sapiens
caggtggcgctctacaggg

SEQ ID NO: 7454892 - DNA, 19 bp, Homo sapiens
caggtggcgctctacaggg

SEQ ID NO: 7454893 - DNA, 19 bp, Homo sapiens
caggtggcgctctacaggg

SEQ ID NO: 7454894 - DNA, 23 bp, Homo sapiens
caggtggctccacgaggggtggg

SEQ ID NO: 7454895 - DNA, 23 bp, Homo sapiens
caggtggctccacgaggggtggg

SEQ ID NO: 7454896 - DNA, 23 bp, Homo sapiens
caggtggctccacgaggggtggg

SEQ ID NO: 7454897 - DNA, 23 bp, Homo sapiens
caggtggctccacgaggggtggg

SEQ ID NO: 7454898 - DNA, 23 bp, Homo sapiens
caggtggctccacgaggggtggg

SEQ ID NO: 7454899 - DNA, 22 bp, Homo sapiens
caggtggctaacggcctcatag

SEQ ID NO: 7454900 - DNA, 22 bp, Homo sapiens
caggtggctaacggcctcatag

SEQ ID NO: 7454901 - DNA, 23 bp, Homo sapiens
caggtggctccacgaggggtggg

SEQ ID NO: 7454902 - DNA, 23 bp, Homo sapiens
caggtggctccacgaggggtggg

SEQ ID NO: 7454903 - DNA, 23 bp, Homo sapiens
caggtggctccacgaggggtggg

SEQ ID NO: 7454904 - DNA, 22 bp, Homo sapiens
tattaaatgttatttgggttgt

SEQ ID NO: 7454905 - DNA, 22 bp, Homo sapiens
tattaaatgttatttgggttgt

SEQ ID NO: 7454906 - DNA, 22 bp, Homo sapiens
caggtggctgagctgacctttg

SEQ ID NO: 7454907 - DNA, 22 bp, Homo sapiens
caggtggctgagctgacctttg

SEQ ID NO: 7454908 - DNA, 22 bp, Homo sapiens
tattaaattatggatttaggag

SEQ ID NO: 7454909 - DNA, 22 bp, Homo sapiens
tattaaattatggatttaggag

SEQ ID NO: 7454910 - DNA, 22 bp, Homo sapiens
tattaaatgttatttgggttgt

SEQ ID NO: 7454911 - DNA, 22 bp, Homo sapiens
tattaaatgttatttgggttgt

SEQ ID NO: 7454912 - DNA, 22 bp, Homo sapiens
tattagtagcttgaaattggtg

SEQ ID NO: 7454913 - DNA, 22 bp, Homo sapiens
tattagtaatacctgtctcata

SEQ ID NO: 7454914 - DNA, 22 bp, Homo sapiens
tattaggttggtgcaacagtaa

SEQ ID NO: 7454915 - DNA, 22 bp, Homo sapiens
tattaggttggtgcaaaattaa

SEQ ID NO: 7454916 - DNA, 22 bp, Homo sapiens
tattaggtatgaactggcaacc

SEQ ID NO: 7454917 - DNA, 22 bp, Homo sapiens
caggtggggggcttccgagcct

SEQ ID NO: 7454918 - DNA, 22 bp, Homo sapiens
caggtgggtacatcacagagac

SEQ ID NO: 7454919 - DNA, 22 bp, Homo sapiens
caggtgggtacatcacagagac

SEQ ID NO: 7454920 - DNA, 22 bp, Homo sapiens
caggtggggggcttccgagcct

SEQ ID NO: 7454921 - DNA, 22 bp, Homo sapiens
tattattaaatggcagaatttt

SEQ ID NO: 7454922 - DNA, 22 bp, Homo sapiens
tattattaaatggcagaatttt

SEQ ID NO: 7454923 - DNA, 22 bp, Homo sapiens
tattattaaatggcagaatttt

SEQ ID NO: 7454924 - DNA, 22 bp, Homo sapiens
tattattaaatggcagaatttt

SEQ ID NO: 7454925 - DNA, 22 bp, Homo sapiens
tattattaaatggcagaatttt

SEQ ID NO: 7454926 - DNA, 22 bp, Homo sapiens
tattattaaatggcagaatttt

SEQ ID NO: 7454927 - DNA, 22 bp, Homo sapiens
tattattaaatggcagaatttt

SEQ ID NO: 7454928 - DNA, 22 bp, Homo sapiens
tattatggggggaacatcactc

SEQ ID NO: 7454929 - DNA, 22 bp, Homo sapiens
tattatgtagagtaagggttaa

SEQ ID NO: 7454930 - DNA, 22 bp, Homo sapiens
tattatgtagagtaagggttaa

SEQ ID NO: 7454931 - DNA, 22 bp, Homo sapiens
tattattaaatggcagaatttt

SEQ ID NO: 7454932 - DNA, 22 bp, Homo sapiens
tattatggttgtaggttaacaa

SEQ ID NO: 7454933 - DNA, 22 bp, Homo sapiens
tattatggggggaacatcactc

SEQ ID NO: 7454934 - DNA, 22 bp, Homo sapiens
tattatggggggaacatcactc

SEQ ID NO: 7454935 - DNA, 22 bp, Homo sapiens
tattatggcagcattcagtatg

SEQ ID NO: 7454936 - DNA, 18 bp, Homo sapiens
caggtgggtctcctgccc

SEQ ID NO: 7454937 - DNA, 22 bp, Homo sapiens
caggtgggtacatcacagagac

SEQ ID NO: 7454938 - DNA, 22 bp, Homo sapiens
caggtgggtacatcacagagac

SEQ ID NO: 7454939 - DNA, 22 bp, Homo sapiens
caggtgggtacatcacagagac

SEQ ID NO: 7454940 - DNA, 22 bp, Homo sapiens
caggtgggtacatcacagagac

SEQ ID NO: 7454941 - DNA, 22 bp, Homo sapiens
caggtgggtacatcacagagac

SEQ ID NO: 7454942 - DNA, 22 bp, Homo sapiens
caggtgggtacatcacagagac

SEQ ID NO: 7454943 - DNA, 18 bp, Homo sapiens
caggtgggtctcctgccc

SEQ ID NO: 7454944 - DNA, 18 bp, Homo sapiens
caggtgggtctcctgccc

SEQ ID NO: 7454945 - DNA, 18 bp, Homo sapiens
caggtgggtctcctgccc

SEQ ID NO: 7454946 - DNA, 18 bp, Homo sapiens
caggtgggtctcctgccc

SEQ ID NO: 7454947 - DNA, 18 bp, Homo sapiens
caggtgggtctcctgccc

SEQ ID NO: 7454948 - DNA, 18 bp, Homo sapiens
caggtgggtctcctgccc

SEQ ID NO: 7454949 - DNA, 18 bp, Homo sapiens
caggtgggtctcctgccc

SEQ ID NO: 7454950 - DNA, 18 bp, Homo sapiens
caggtgggtctcctgccc

SEQ ID NO: 7454951 - DNA, 18 bp, Homo sapiens
caggtgggtctcctgccc

SEQ ID NO: 7454952 - DNA, 18 bp, Homo sapiens
caggtgggtctcctgccc

SEQ ID NO: 7454953 - DNA, 18 bp, Homo sapiens
caggtgggtctcctgccc

SEQ ID NO: 7454954 - DNA, 22 bp, Homo sapiens
tattagtgaaagaattagtttg

SEQ ID NO: 7454955 - DNA, 22 bp, Homo sapiens
tattataaaattactggcaggg

SEQ ID NO: 7454956 - DNA, 22 bp, Homo sapiens
tattagttgcaaaacattgact

SEQ ID NO: 7454957 - DNA, 22 bp, Homo sapiens
tattataatttagggcttggat

SEQ ID NO: 7454958 - DNA, 22 bp, Homo sapiens
tattataatttagggcttggat

SEQ ID NO: 7454959 - DNA, 22 bp, Homo sapiens
tattatcagagctatttggaat

SEQ ID NO: 7454960 - DNA, 22 bp, Homo sapiens
tattatcagagctatttggaat

SEQ ID NO: 7454961 - DNA, 22 bp, Homo sapiens
tattatcagagctatttggaat

SEQ ID NO: 7454962 - DNA, 22 bp, Homo sapiens
tattatatttagtaatgtggag

SEQ ID NO: 7454963 - DNA, 22 bp, Homo sapiens
tattatatttagtaatgtggag

SEQ ID NO: 7454964 - DNA, 22 bp, Homo sapiens
tattataatttagggcttggat

SEQ ID NO: 7454965 - DNA, 22 bp, Homo sapiens
tattatatttagtaatgtggag

SEQ ID NO: 7454966 - DNA, 22 bp, Homo sapiens
tattatcattaactgttgaatt

SEQ ID NO: 7454967 - DNA, 22 bp, Homo sapiens
tattatcattggtaatatggtc

SEQ ID NO: 7454968 - DNA, 22 bp, Homo sapiens
tattatcattaactgttgaatt

SEQ ID NO: 7454969 - DNA, 22 bp, Homo sapiens
tattatcattggtaatatggtc

SEQ ID NO: 7454970 - DNA, 22 bp, Homo sapiens
tattatcattggtaatatggtc

SEQ ID NO: 7454971 - DNA, 22 bp, Homo sapiens
tattatcatgttaattagtggg

SEQ ID NO: 7454972 - DNA, 22 bp, Homo sapiens
tattatcattaactgttgaatt

SEQ ID NO: 7454973 - DNA, 22 bp, Homo sapiens
tattatcattaactgttgaatt

SEQ ID NO: 7454974 - DNA, 22 bp, Homo sapiens
tattatcatgttaattagtggg

SEQ ID NO: 7454975 - DNA, 22 bp, Homo sapiens
tattatgcaaatattcctacct

SEQ ID NO: 7454976 - DNA, 22 bp, Homo sapiens
tattatgattcggacgtggcag

SEQ ID NO: 7454977 - DNA, 22 bp, Homo sapiens
tattatgaggtatttggacttt

SEQ ID NO: 7454978 - DNA, 22 bp, Homo sapiens
tattatgatcccagccctggag

SEQ ID NO: 7454979 - DNA, 22 bp, Homo sapiens
tattatgatcgtgactcaagga

SEQ ID NO: 7454980 - DNA, 22 bp, Homo sapiens
tattatgaggactggtgtaagg

SEQ ID NO: 7454981 - DNA, 22 bp, Homo sapiens
tattatgaggcttagggatgac

SEQ ID NO: 7454982 - DNA, 22 bp, Homo sapiens
tattatgaggggcagagggcat

SEQ ID NO: 7454983 - DNA, 22 bp, Homo sapiens
tattatccaaagagctgggagc

SEQ ID NO: 7454984 - DNA, 22 bp, Homo sapiens
tattatctagtaactgatagtg

SEQ ID NO: 7454985 - DNA, 22 bp, Homo sapiens
tattatctagtaactgatagtg

SEQ ID NO: 7454986 - DNA, 22 bp, Homo sapiens
tattatctagtaactgatagtg

SEQ ID NO: 7454987 - DNA, 20 bp, Homo sapiens
tattatgacctgtgttctgg

SEQ ID NO: 7454988 - DNA, 20 bp, Homo sapiens
tattatgacctgtgttctgg

SEQ ID NO: 7454989 - DNA, 22 bp, Homo sapiens
tattatgagccaggtgctgtct

SEQ ID NO: 7454990 - DNA, 22 bp, Homo sapiens
tagcttctcataatttatgctg

SEQ ID NO: 7454991 - DNA, 22 bp, Homo sapiens
tagcttctcataatttatgctg

SEQ ID NO: 7454992 - DNA, 22 bp, Homo sapiens
tagcttctcataatttatgctg

SEQ ID NO: 7454993 - DNA, 22 bp, Homo sapiens
tagcttctcataatttatgctg

SEQ ID NO: 7454994 - DNA, 22 bp, Homo sapiens
tagcttctaatacttaccaatt

SEQ ID NO: 7454995 - DNA, 22 bp, Homo sapiens
tagcttctaatacttaccaatt

SEQ ID NO: 7454996 - DNA, 22 bp, Homo sapiens
tagcttcagggaaaccactgct

SEQ ID NO: 7454997 - DNA, 22 bp, Homo sapiens
tagcttccagaatttaatgtca

SEQ ID NO: 7454998 - DNA, 22 bp, Homo sapiens
tagcttcagtggccctagacac

SEQ ID NO: 7454999 - DNA, 22 bp, Homo sapiens
tagcttatcccacagtgcccag

SEQ ID NO: 7455000 - DNA, 22 bp, Homo sapiens
tagcttatcccacagtgcccag

SEQ ID NO: 7455001 - DNA, 22 bp, Homo sapiens
tagcttatcccacagtgcccag

SEQ ID NO: 7455002 - DNA, 22 bp, Homo sapiens
tagcttatctatacagactttt

SEQ ID NO: 7455003 - DNA, 22 bp, Homo sapiens
tagcttatggtctctagggaat

SEQ ID NO: 7455004 - DNA, 22 bp, Homo sapiens
tagcttctcttttcaacatctt

SEQ ID NO: 7455005 - DNA, 22 bp, Homo sapiens
tagcttctgggagtgtttacta

SEQ ID NO: 7455006 - DNA, 22 bp, Homo sapiens
tagcttgactattctatgatgt

SEQ ID NO: 7455007 - DNA, 22 bp, Homo sapiens
tagcttctgggagtgtttacta

SEQ ID NO: 7455008 - DNA, 22 bp, Homo sapiens
tagcttcttgagaaagggtgcc

SEQ ID NO: 7455009 - DNA, 22 bp, Homo sapiens
tagcttcttgagaaagggtgcc

SEQ ID NO: 7455010 - DNA, 21 bp, Homo sapiens
tagcttcttgaggcttggccg

SEQ ID NO: 7455011 - DNA, 22 bp, Homo sapiens
tagcttggaataaaatgagaat

SEQ ID NO: 7455012 - DNA, 20 bp, Homo sapiens
tagcttgaagaactccagag

SEQ ID NO: 7455013 - DNA, 22 bp, Homo sapiens
tagcttggaataaaatgagaat

SEQ ID NO: 7455014 - DNA, 22 bp, Homo sapiens
tagctttaaaaatcatcaaagc

SEQ ID NO: 7455015 - DNA, 22 bp, Homo sapiens
tagctttaaaaatcatcaaagc

SEQ ID NO: 7455016 - DNA, 22 bp, Homo sapiens
tagctttaaaaatcatcaaagc

SEQ ID NO: 7455017 - DNA, 22 bp, Homo sapiens
tagctttaaaaatcatcaaagc

SEQ ID NO: 7455018 - DNA, 22 bp, Homo sapiens
taggaggcagtcgttcttcagt

SEQ ID NO: 7455019 - DNA, 22 bp, Homo sapiens
tagcttgcctctggctgcacgg

SEQ ID NO: 7455020 - DNA, 22 bp, Homo sapiens
tagctttaagacatggtgaatg

SEQ ID NO: 7455021 - DNA, 22 bp, Homo sapiens
tagctttaagacatggtgaatg

SEQ ID NO: 7455022 - DNA, 22 bp, Homo sapiens
tagctttaaaaatcatcaaagc

SEQ ID NO: 7455023 - DNA, 22 bp, Homo sapiens
taggccaaggacagtaaggaca

SEQ ID NO: 7455024 - DNA, 22 bp, Homo sapiens
taggccaacgtggaagggtcca

SEQ ID NO: 7455025 - DNA, 22 bp, Homo sapiens
taggccaaatgacttgatgttt

SEQ ID NO: 7455026 - DNA, 22 bp, Homo sapiens
taggcatgcaaataaatgtgca

SEQ ID NO: 7455027 - DNA, 22 bp, Homo sapiens
taggcatgcaaataaatgtgca

SEQ ID NO: 7455028 - DNA, 22 bp, Homo sapiens
taggcatgcaaataaatgtgca

SEQ ID NO: 7455029 - DNA, 22 bp, Homo sapiens
taggcatgcaaataaatgtgca

SEQ ID NO: 7455030 - DNA, 22 bp, Homo sapiens
taggcagtagcaggatctgcca

SEQ ID NO: 7455031 - DNA, 22 bp, Homo sapiens
taggcaggtgtgcactgcccac

SEQ ID NO: 7455032 - DNA, 22 bp, Homo sapiens
taggcagtgctctgtgcttcag

SEQ ID NO: 7455033 - DNA, 22 bp, Homo sapiens
taggagggccctgaaaatggca

SEQ ID NO: 7455034 - DNA, 22 bp, Homo sapiens
taggagggccctgaaaatggca

SEQ ID NO: 7455035 - DNA, 22 bp, Homo sapiens
taggcagggattagggttgatt

SEQ ID NO: 7455036 - DNA, 22 bp, Homo sapiens
taggaggcttaaagctgctcag

SEQ ID NO: 7455037 - DNA, 22 bp, Homo sapiens
taggaggccatccagcctgcct

SEQ ID NO: 7455038 - DNA, 22 bp, Homo sapiens
taggaggcatttgctcccaggg

SEQ ID NO: 7455039 - DNA, 22 bp, Homo sapiens
taggaggctcatgttacaggaa

SEQ ID NO: 7455040 - DNA, 22 bp, Homo sapiens
taggcagggattagggttgatt

SEQ ID NO: 7455041 - DNA, 22 bp, Homo sapiens
taggcaggtgtgcactgcccac

SEQ ID NO: 7455042 - DNA, 22 bp, Homo sapiens
taggcaggtgtgcactgcccac

SEQ ID NO: 7455043 - DNA, 22 bp, Homo sapiens
taggcaggtgtgcactgcccac

SEQ ID NO: 7455044 - DNA, 22 bp, Homo sapiens
taggcaggtgtgcactgcccac

SEQ ID NO: 7455045 - DNA, 22 bp, Homo sapiens
taggcaggtgtgcactgcccac

SEQ ID NO: 7455046 - DNA, 22 bp, Homo sapiens
taggccacagagaggagatttc

SEQ ID NO: 7455047 - DNA, 22 bp, Homo sapiens
taggccacaaataagatcctgt

SEQ ID NO: 7455048 - DNA, 22 bp, Homo sapiens
taggccaccagggttccattta

SEQ ID NO: 7455049 - DNA, 21 bp, Homo sapiens
taggccacatgggttggagat

SEQ ID NO: 7455050 - DNA, 22 bp, Homo sapiens
taggccacagatgagacataag

SEQ ID NO: 7455051 - DNA, 21 bp, Homo sapiens
taggccacatgggttggagat

SEQ ID NO: 7455052 - DNA, 19 bp, Homo sapiens
taggccagaagttttccac

SEQ ID NO: 7455053 - DNA, 22 bp, Homo sapiens
taggccactctcctttgtctca

SEQ ID NO: 7455054 - DNA, 22 bp, Homo sapiens
taggccagaggagcagctttgg

SEQ ID NO: 7455055 - DNA, 22 bp, Homo sapiens
taggccacggaaagcaggttgc

SEQ ID NO: 7455056 - DNA, 22 bp, Homo sapiens
taggccacgaaggagatgatag

SEQ ID NO: 7455057 - DNA, 22 bp, Homo sapiens
cagggcccaagacacaatgagg

SEQ ID NO: 7455058 - DNA, 22 bp, Homo sapiens
cagggccattggcgtggctgtc

SEQ ID NO: 7455059 - DNA, 22 bp, Homo sapiens
cagggccattggcgtggctgtc

SEQ ID NO: 7455060 - DNA, 22 bp, Homo sapiens
cagggcccaagacacaatgagg

SEQ ID NO: 7455061 - DNA, 22 bp, Homo sapiens
cagggcccaagacacaatgagg

SEQ ID NO: 7455062 - DNA, 22 bp, Homo sapiens
cagggcccaagacacaatgagg

SEQ ID NO: 7455063 - DNA, 22 bp, Homo sapiens
cagggcccaggccactgggttg

SEQ ID NO: 7455064 - DNA, 22 bp, Homo sapiens
cagggcccaggccactgggttg

SEQ ID NO: 7455065 - DNA, 22 bp, Homo sapiens
cagggcccagtccctgctgtca

SEQ ID NO: 7455066 - DNA, 22 bp, Homo sapiens
cagggcccaggccactgggttg

SEQ ID NO: 7455067 - DNA, 22 bp, Homo sapiens
cagggcccagtccctgctgtca

SEQ ID NO: 7455068 - DNA, 22 bp, Homo sapiens
cagggcccagtccctgctgtca

SEQ ID NO: 7455069 - DNA, 22 bp, Homo sapiens
cagggcccagtccctgctgtca

SEQ ID NO: 7455070 - DNA, 22 bp, Homo sapiens
cagggcccaggccactgggttg

SEQ ID NO: 7455071 - DNA, 22 bp, Homo sapiens
cagggcccagtccctgctgtca

SEQ ID NO: 7455072 - DNA, 22 bp, Homo sapiens
cagggcccagtccctgctgtca

SEQ ID NO: 7455073 - DNA, 22 bp, Homo sapiens
cagggcccagtccctgctgtca

SEQ ID NO: 7455074 - DNA, 20 bp, Homo sapiens
cagggcctatgattgagctt

SEQ ID NO: 7455075 - DNA, 20 bp, Homo sapiens
cagggcctatgattgagctt

SEQ ID NO: 7455076 - DNA, 20 bp, Homo sapiens
cagggcctaagagctgaaaa

SEQ ID NO: 7455077 - DNA, 20 bp, Homo sapiens
cagggcctaagagctgaaaa

SEQ ID NO: 7455078 - DNA, 20 bp, Homo sapiens
cagggcctaagagctgaaaa

SEQ ID NO: 7455079 - DNA, 23 bp, Homo sapiens
cagggccctgctcaatttctcca

SEQ ID NO: 7455080 - DNA, 22 bp, Homo sapiens
cagggccctaagatacacatca

SEQ ID NO: 7455081 - DNA, 22 bp, Homo sapiens
cagggccctaagatacacatca

SEQ ID NO: 7455082 - DNA, 22 bp, Homo sapiens
cagggccctgctcaatttctcc

SEQ ID NO: 7455083 - DNA, 23 bp, Homo sapiens
cagggccctgctcaatttctcca

SEQ ID NO: 7455084 - DNA, 20 bp, Homo sapiens
cagggcctaagagctgaaaa

SEQ ID NO: 7455085 - DNA, 22 bp, Homo sapiens
cagggccctgctcaatttctcc

SEQ ID NO: 7455086 - DNA, 23 bp, Homo sapiens
cagggccctgctcaatttctcca

SEQ ID NO: 7455087 - DNA, 23 bp, Homo sapiens
cagggccctgctcaatttctcca

SEQ ID NO: 7455088 - DNA, 18 bp, Homo sapiens
cagggccccagaattatc

SEQ ID NO: 7455089 - DNA, 18 bp, Homo sapiens
cagggccccagaattatc

SEQ ID NO: 7455090 - DNA, 22 bp, Homo sapiens
cagggccccagggatgtctgct

SEQ ID NO: 7455091 - DNA, 22 bp, Homo sapiens
cagggccccagggatgtctgct

SEQ ID NO: 7455092 - DNA, 22 bp, Homo sapiens
cagggccccagggatgtctgct

SEQ ID NO: 7455093 - DNA, 22 bp, Homo sapiens
cagggccctaagatacacatca

SEQ ID NO: 7455094 - DNA, 22 bp, Homo sapiens
cagggccccagggatgtctgct

SEQ ID NO: 7455095 - DNA, 22 bp, Homo sapiens
cagggcccatggctcaggtagg

SEQ ID NO: 7455096 - DNA, 22 bp, Homo sapiens
cagggcccatggctcaggtagg

SEQ ID NO: 7455097 - DNA, 22 bp, Homo sapiens
cagggcccatggctcaggtagg

SEQ ID NO: 7455098 - DNA, 22 bp, Homo sapiens
cagggcccatggctcaggtagg

SEQ ID NO: 7455099 - DNA, 22 bp, Homo sapiens
cagggcctcatggccggggtgc

SEQ ID NO: 7455100 - DNA, 22 bp, Homo sapiens
cagggctccatgcagggactcc

SEQ ID NO: 7455101 - DNA, 22 bp, Homo sapiens
cagggctccatgcagggactcc

SEQ ID NO: 7455102 - DNA, 22 bp, Homo sapiens
cagggcctcattgtcagtcctg

SEQ ID NO: 7455103 - DNA, 22 bp, Homo sapiens
cagggctccatgcagggactcc

SEQ ID NO: 7455104 - DNA, 22 bp, Homo sapiens
cagggctccatgcagggactcc

SEQ ID NO: 7455105 - DNA, 22 bp, Homo sapiens
cagggctccatgcagggactcc

SEQ ID NO: 7455106 - DNA, 22 bp, Homo sapiens
cagggctccatgcagggactcc

SEQ ID NO: 7455107 - DNA, 22 bp, Homo sapiens
cagggctccatgcagggactcc

SEQ ID NO: 7455108 - DNA, 22 bp, Homo sapiens
cagggctccatgcagggactcc

SEQ ID NO: 7455109 - DNA, 22 bp, Homo sapiens
cagggcctcatcctcagagatt

SEQ ID NO: 7455110 - DNA, 22 bp, Homo sapiens
cagggcctcatcctcagagatt

SEQ ID NO: 7455111 - DNA, 22 bp, Homo sapiens
cagggcctcatcctcagagatt

SEQ ID NO: 7455112 - DNA, 22 bp, Homo sapiens
cagggcctcatcctcagagatt

SEQ ID NO: 7455113 - DNA, 22 bp, Homo sapiens
cagggagccaccagataattac

SEQ ID NO: 7455114 - DNA, 22 bp, Homo sapiens
cagggagccccaattccatgcc

SEQ ID NO: 7455115 - DNA, 22 bp, Homo sapiens
cagggagcaggctctgtccatc

SEQ ID NO: 7455116 - DNA, 22 bp, Homo sapiens
cagggagccccaattccatgcc

SEQ ID NO: 7455117 - DNA, 22 bp, Homo sapiens
cagggagcctccaaagctttca

SEQ ID NO: 7455118 - DNA, 22 bp, Homo sapiens
cagggagccccaattccatgcc

SEQ ID NO: 7455119 - DNA, 22 bp, Homo sapiens
cagggagccccaattccatgcc

SEQ ID NO: 7455120 - DNA, 22 bp, Homo sapiens
cagggccactgcatgaggttca

SEQ ID NO: 7455121 - DNA, 22 bp, Homo sapiens
cagggagcctccaaagctttca

SEQ ID NO: 7455122 - DNA, 22 bp, Homo sapiens
cagggccactgcatgaggttca

SEQ ID NO: 7455123 - DNA, 22 bp, Homo sapiens
cagggccactgcatgaggttca

SEQ ID NO: 7455124 - DNA, 22 bp, Homo sapiens
cagggccactgcatgaggttca

SEQ ID NO: 7455125 - DNA, 22 bp, Homo sapiens
cagggccactgcatgaggttca

SEQ ID NO: 7455126 - DNA, 22 bp, Homo sapiens
cagggccactgtagatgaggag

SEQ ID NO: 7455127 - DNA, 22 bp, Homo sapiens
cagggccaggctgatggcctgg

SEQ ID NO: 7455128 - DNA, 22 bp, Homo sapiens
cagggccactgtagatgaggag

SEQ ID NO: 7455129 - DNA, 22 bp, Homo sapiens
cagggccactgtagatgaggag

SEQ ID NO: 7455130 - DNA, 22 bp, Homo sapiens
cagggccagggctatggtgaag

SEQ ID NO: 7455131 - DNA, 22 bp, Homo sapiens
cagggccagggacacgctgtca

SEQ ID NO: 7455132 - DNA, 22 bp, Homo sapiens
cagggccagggctatggtgaag

SEQ ID NO: 7455133 - DNA, 22 bp, Homo sapiens
cagggccaggctgatggcctgg

SEQ ID NO: 7455134 - DNA, 22 bp, Homo sapiens
cagggccagggctatggtgaag

SEQ ID NO: 7455135 - DNA, 22 bp, Homo sapiens
cagggccagggctatggtgaag

SEQ ID NO: 7455136 - DNA, 22 bp, Homo sapiens
cagggccagggacacgctgtca

SEQ ID NO: 7455137 - DNA, 22 bp, Homo sapiens
cagggccaggctgatggcctgg

SEQ ID NO: 7455138 - DNA, 22 bp, Homo sapiens
cagggccaggctgatggcctgg

SEQ ID NO: 7455139 - DNA, 22 bp, Homo sapiens
cagggccaggctgatggcctgg

SEQ ID NO: 7455140 - DNA, 22 bp, Homo sapiens
cagggccaggctgatggcctgg

SEQ ID NO: 7455141 - DNA, 22 bp, Homo sapiens
cagggccaggctgatggcctgg

SEQ ID NO: 7455142 - DNA, 22 bp, Homo sapiens
cagggccagggctccatttcct

SEQ ID NO: 7455143 - DNA, 22 bp, Homo sapiens
cagggccagggctccatttcct

SEQ ID NO: 7455144 - DNA, 22 bp, Homo sapiens
cagggccagttctcgcagcagt

SEQ ID NO: 7455145 - DNA, 22 bp, Homo sapiens
cagggccagggctatggtgaag

SEQ ID NO: 7455146 - DNA, 22 bp, Homo sapiens
cagggccagggctatggtgaag

SEQ ID NO: 7455147 - DNA, 22 bp, Homo sapiens
cagggccagttctcgcagcagt

SEQ ID NO: 7455148 - DNA, 22 bp, Homo sapiens
cagggccagttctcgcagcagt

SEQ ID NO: 7455149 - DNA, 22 bp, Homo sapiens
cagggccagttctcgcagcagt

SEQ ID NO: 7455150 - DNA, 22 bp, Homo sapiens
cagggccagttctcgcagcagt

SEQ ID NO: 7455151 - DNA, 22 bp, Homo sapiens
cagggccagttctcgcagcagt

SEQ ID NO: 7455152 - DNA, 22 bp, Homo sapiens
cagggccattggcgtggctgtc

SEQ ID NO: 7455153 - DNA, 22 bp, Homo sapiens
cagggccattggcgtggctgtc

SEQ ID NO: 7455154 - DNA, 22 bp, Homo sapiens
cagggccattggcgtggctgtc

SEQ ID NO: 7455155 - DNA, 22 bp, Homo sapiens
cagggccattggcgtggctgtc

SEQ ID NO: 7455156 - DNA, 22 bp, Homo sapiens
cagggccattggcgtggctgtc

SEQ ID NO: 7455157 - DNA, 22 bp, Homo sapiens
cagggccattggaacaaagagg

SEQ ID NO: 7455158 - DNA, 22 bp, Homo sapiens
tagcttaacagcaaaactgttg

SEQ ID NO: 7455159 - DNA, 22 bp, Homo sapiens
tagcttaaggagtaccagatca

SEQ ID NO: 7455160 - DNA, 22 bp, Homo sapiens
tagcttaaggagtaccagatca

SEQ ID NO: 7455161 - DNA, 22 bp, Homo sapiens
tagcttaaggagtaccagatca

SEQ ID NO: 7455162 - DNA, 22 bp, Homo sapiens
tagcttaaggcaggcccttgtc

SEQ ID NO: 7455163 - DNA, 22 bp, Homo sapiens
tagcttaatatgaaacacataa

SEQ ID NO: 7455164 - DNA, 22 bp, Homo sapiens
tagcttaatatgaaacacataa

SEQ ID NO: 7455165 - DNA, 22 bp, Homo sapiens
tagcttaatatgaaacacataa

SEQ ID NO: 7455166 - DNA, 22 bp, Homo sapiens
cagggccattggaacaaagagg

SEQ ID NO: 7455167 - DNA, 22 bp, Homo sapiens
cagggccattggaacaaagagg

SEQ ID NO: 7455168 - DNA, 22 bp, Homo sapiens
cagggccattggcgtggctgtc

SEQ ID NO: 7455169 - DNA, 22 bp, Homo sapiens
cagggccattggaacaaagagg

SEQ ID NO: 7455170 - DNA, 22 bp, Homo sapiens
cagggccatgaggcacagggtc

SEQ ID NO: 7455171 - DNA, 22 bp, Homo sapiens
cagggccatgaggcacagggtc

SEQ ID NO: 7455172 - DNA, 22 bp, Homo sapiens
cagggccatgaggcacagggtc

SEQ ID NO: 7455173 - DNA, 22 bp, Homo sapiens
cagggccatgaggcacagggtc

SEQ ID NO: 7455174 - DNA, 22 bp, Homo sapiens
cagggccatgaggcacagggtc

SEQ ID NO: 7455175 - DNA, 22 bp, Homo sapiens
cagggccatgaggcacagggtc

SEQ ID NO: 7455176 - DNA, 22 bp, Homo sapiens
cagggccatgaggcacagggtc

SEQ ID NO: 7455177 - DNA, 22 bp, Homo sapiens
cagggccatgaggcacagggtc

SEQ ID NO: 7455178 - DNA, 22 bp, Homo sapiens
cagggccatgaggcacagggtc

SEQ ID NO: 7455179 - DNA, 22 bp, Homo sapiens
cagggccatgaggcacagggtc

SEQ ID NO: 7455180 - DNA, 22 bp, Homo sapiens
cagggccatgaggcacagggtc

SEQ ID NO: 7455181 - DNA, 22 bp, Homo sapiens
cagggccatgaggcacagggtc

SEQ ID NO: 7455182 - DNA, 22 bp, Homo sapiens
cagggccatatcttgtgcacca

SEQ ID NO: 7455183 - DNA, 22 bp, Homo sapiens
cagggccatatcttgtgcacca

SEQ ID NO: 7455184 - DNA, 22 bp, Homo sapiens
cagggccatatcttgtgcacca

SEQ ID NO: 7455185 - DNA, 22 bp, Homo sapiens
cagggccatatcttgtgcacca

SEQ ID NO: 7455186 - DNA, 22 bp, Homo sapiens
cagggccatatcttgtgcacca

SEQ ID NO: 7455187 - DNA, 22 bp, Homo sapiens
cagggccatatcttgtgcacca

SEQ ID NO: 7455188 - DNA, 22 bp, Homo sapiens
cagggccatatcttgtgcacca

SEQ ID NO: 7455189 - DNA, 22 bp, Homo sapiens
cagggccatatcttgtgcacca

SEQ ID NO: 7455190 - DNA, 22 bp, Homo sapiens
cagggccatatcttgtgcacca

SEQ ID NO: 7455191 - DNA, 22 bp, Homo sapiens
cagggccagttctcgcagcagt

SEQ ID NO: 7455192 - DNA, 22 bp, Homo sapiens
cagggccagttctcgcagcagt

SEQ ID NO: 7455193 - DNA, 22 bp, Homo sapiens
cagggccagttctcgcagcagt

SEQ ID NO: 7455194 - DNA, 23 bp, Homo sapiens
tagattgctacaagtcattgaat

SEQ ID NO: 7455195 - DNA, 22 bp, Homo sapiens
tagattgcatatggaatgtatt

SEQ ID NO: 7455196 - DNA, 22 bp, Homo sapiens
tagattctttgctagatcattg

SEQ ID NO: 7455197 - DNA, 22 bp, Homo sapiens
tagattctttgctagatcattg

SEQ ID NO: 7455198 - DNA, 22 bp, Homo sapiens
tagattgtgaacaagtatttgg

SEQ ID NO: 7455199 - DNA, 22 bp, Homo sapiens
tagattgtgaacaagtatttgg

SEQ ID NO: 7455200 - DNA, 22 bp, Homo sapiens
tagattgtagatcatgagactt

SEQ ID NO: 7455201 - DNA, 22 bp, Homo sapiens
tagattgttcttaactttataa

SEQ ID NO: 7455202 - DNA, 22 bp, Homo sapiens
tagatttaagaccctgaatttg

SEQ ID NO: 7455203 - DNA, 22 bp, Homo sapiens
tagatttcaggagacaaaatgg

SEQ ID NO: 7455204 - DNA, 22 bp, Homo sapiens
tagatttcaggagacaaaatgg

SEQ ID NO: 7455205 - DNA, 22 bp, Homo sapiens
tagatttcaggagacaaaatgg

SEQ ID NO: 7455206 - DNA, 22 bp, Homo sapiens
tagatttcctcttcctcattcc

SEQ ID NO: 7455207 - DNA, 22 bp, Homo sapiens
tagatttcctcttcctcattcc

SEQ ID NO: 7455208 - DNA, 22 bp, Homo sapiens
tagatttcgctgcatctcaatc

SEQ ID NO: 7455209 - DNA, 20 bp, Homo sapiens
tagatttcatacttctcttt

SEQ ID NO: 7455210 - DNA, 22 bp, Homo sapiens
tagatttgaatgatgtaaagag

SEQ ID NO: 7455211 - DNA, 22 bp, Homo sapiens
tagatttctcattcatagattg

SEQ ID NO: 7455212 - DNA, 22 bp, Homo sapiens
tagatttctaacagtgtgcttg

SEQ ID NO: 7455213 - DNA, 22 bp, Homo sapiens
tagatttcgctgcatctcaatc

SEQ ID NO: 7455214 - DNA, 22 bp, Homo sapiens
tagatttgatgcaattggattg

SEQ ID NO: 7455215 - DNA, 22 bp, Homo sapiens
tagatttgaatgatgtaaagag

SEQ ID NO: 7455216 - DNA, 19 bp, Homo sapiens
tagatttgatcatctggat

SEQ ID NO: 7455217 - DNA, 22 bp, Homo sapiens
tagatttgatgtaagcatagtc

SEQ ID NO: 7455218 - DNA, 22 bp, Homo sapiens
tagatttgatgtaagcatagtc

SEQ ID NO: 7455219 - DNA, 22 bp, Homo sapiens
tagatttgatgtaagcatagtc

SEQ ID NO: 7455220 - DNA, 22 bp, Homo sapiens
tagatttgtgtttgggatgaga

SEQ ID NO: 7455221 - DNA, 22 bp, Homo sapiens
tagatttgtgcaagaagggatt

SEQ ID NO: 7455222 - DNA, 22 bp, Homo sapiens
tagatttgtgcaagaagggatt

SEQ ID NO: 7455223 - DNA, 22 bp, Homo sapiens
tagatttgctccaatgagttaa

SEQ ID NO: 7455224 - DNA, 22 bp, Homo sapiens
tagatttgcctgggaaagctca

SEQ ID NO: 7455225 - DNA, 22 bp, Homo sapiens
tagatttgcctgggaaagctca

SEQ ID NO: 7455226 - DNA, 22 bp, Homo sapiens
tagatttgcctgggaaagctca

SEQ ID NO: 7455227 - DNA, 22 bp, Homo sapiens
tagatttgtttccttctctcca

SEQ ID NO: 7455228 - DNA, 22 bp, Homo sapiens
tagatttgtttccttctctcca

SEQ ID NO: 7455229 - DNA, 22 bp, Homo sapiens
tagatttgtgtttgggatgaga

SEQ ID NO: 7455230 - DNA, 22 bp, Homo sapiens
cagggagatcttggctcctggt

SEQ ID NO: 7455231 - DNA, 22 bp, Homo sapiens
cagggagatcttggctcctggt

SEQ ID NO: 7455232 - DNA, 22 bp, Homo sapiens
tagatttgtttccttctctcca

SEQ ID NO: 7455233 - DNA, 22 bp, Homo sapiens
cagggagatcttggctcctggt

SEQ ID NO: 7455234 - DNA, 22 bp, Homo sapiens
cagggagcagcatgggcaaagg

SEQ ID NO: 7455235 - DNA, 22 bp, Homo sapiens
cagggagcagcatgggcaaagg

SEQ ID NO: 7455236 - DNA, 22 bp, Homo sapiens
cagggagcagcccctagaagta

SEQ ID NO: 7455237 - DNA, 22 bp, Homo sapiens
cagggagcagcccctagaagta

SEQ ID NO: 7455238 - DNA, 22 bp, Homo sapiens
cagggagcagcccctagaagta

SEQ ID NO: 7455239 - DNA, 22 bp, Homo sapiens
cagggagcactgcgagcggcag

SEQ ID NO: 7455240 - DNA, 22 bp, Homo sapiens
cagggagcactgcgagcggcag

SEQ ID NO: 7455241 - DNA, 22 bp, Homo sapiens
cagggagcagcatgggcaaagg

SEQ ID NO: 7455242 - DNA, 22 bp, Homo sapiens
cagggagcactgcgagcggcag

SEQ ID NO: 7455243 - DNA, 22 bp, Homo sapiens
cagggagcactgcgagcggcag

SEQ ID NO: 7455244 - DNA, 22 bp, Homo sapiens
cagggagcactgcgagcggcag

SEQ ID NO: 7455245 - DNA, 22 bp, Homo sapiens
cagggagcactgcgagcggcag

SEQ ID NO: 7455246 - DNA, 22 bp, Homo sapiens
cagggagcactgcgagcggcag

SEQ ID NO: 7455247 - DNA, 22 bp, Homo sapiens
cagggagatcttggctcctggt

SEQ ID NO: 7455248 - DNA, 22 bp, Homo sapiens
cagggagatcttggctcctggt

SEQ ID NO: 7455249 - DNA, 22 bp, Homo sapiens
cagggagatcttggctcctggt

SEQ ID NO: 7455250 - DNA, 22 bp, Homo sapiens
cagggagatcttggctcctggt

SEQ ID NO: 7455251 - DNA, 22 bp, Homo sapiens
cagggagatcttggctcctggt

SEQ ID NO: 7455252 - DNA, 22 bp, Homo sapiens
cagggagcaggctctgtccatc

SEQ ID NO: 7455253 - DNA, 22 bp, Homo sapiens
cagggagcaggctctgtccatc

SEQ ID NO: 7455254 - DNA, 22 bp, Homo sapiens
cagggagcaggctctgtccatc

SEQ ID NO: 7455255 - DNA, 22 bp, Homo sapiens
cagggagcaggctctgtccatc

SEQ ID NO: 7455256 - DNA, 22 bp, Homo sapiens
cagggagcagcgctggggcctc

SEQ ID NO: 7455257 - DNA, 22 bp, Homo sapiens
cagggagcagcgctggggcctc

SEQ ID NO: 7455258 - DNA, 22 bp, Homo sapiens
cagggagcaggctctgtccatc

SEQ ID NO: 7455259 - DNA, 22 bp, Homo sapiens
cagggagcagcccctagaagta

SEQ ID NO: 7455260 - DNA, 22 bp, Homo sapiens
cagggagcagcccctagaagta

SEQ ID NO: 7455261 - DNA, 22 bp, Homo sapiens
cagggagcagcccctagaagta

SEQ ID NO: 7455262 - DNA, 22 bp, Homo sapiens
cagggagcagcgctggggcctc

SEQ ID NO: 7455263 - DNA, 22 bp, Homo sapiens
cagggagcagcgctggggcctc

SEQ ID NO: 7455264 - DNA, 22 bp, Homo sapiens
cagggagcagcgctggggcctc

SEQ ID NO: 7455265 - DNA, 22 bp, Homo sapiens
cagggagcagcccctagaagta

SEQ ID NO: 7455266 - DNA, 22 bp, Homo sapiens
cagggagcagcgctggggcctc

SEQ ID NO: 7455267 - DNA, 22 bp, Homo sapiens
cagggtccccgggtctcctgtg

SEQ ID NO: 7455268 - DNA, 22 bp, Homo sapiens
cagggtccggctgcctggctgt

SEQ ID NO: 7455269 - DNA, 22 bp, Homo sapiens
cagggtccggctgcctggctgt

SEQ ID NO: 7455270 - DNA, 22 bp, Homo sapiens
cagggtccggctgcctggctgt

SEQ ID NO: 7455271 - DNA, 22 bp, Homo sapiens
cagggtcccaggagctgctttc

SEQ ID NO: 7455272 - DNA, 22 bp, Homo sapiens
cagggtccccgggtctcctgtg

SEQ ID NO: 7455273 - DNA, 22 bp, Homo sapiens
cagggtctgatggtcctcactt

SEQ ID NO: 7455274 - DNA, 22 bp, Homo sapiens
cagggtggggctggctatcaaa

SEQ ID NO: 7455275 - DNA, 22 bp, Homo sapiens
cagggtggggctggctatcaaa

SEQ ID NO: 7455276 - DNA, 22 bp, Homo sapiens
cagggtggggctggctatcaaa

SEQ ID NO: 7455277 - DNA, 22 bp, Homo sapiens
cagggtggggctggctatcaaa

SEQ ID NO: 7455278 - DNA, 22 bp, Homo sapiens
cagggtggggctggctatcaaa

SEQ ID NO: 7455279 - DNA, 22 bp, Homo sapiens
cagggtctgatggtcctcactt

SEQ ID NO: 7455280 - DNA, 22 bp, Homo sapiens
cagggtctgatggtcctcactt

SEQ ID NO: 7455281 - DNA, 22 bp, Homo sapiens
cagggtcccaggagctgctttc

SEQ ID NO: 7455282 - DNA, 22 bp, Homo sapiens
cagggtccatctttcatcactg

SEQ ID NO: 7455283 - DNA, 22 bp, Homo sapiens
cagggtcatggcacctgcacgg

SEQ ID NO: 7455284 - DNA, 22 bp, Homo sapiens
cagggtcatggcacctgcacgg

SEQ ID NO: 7455285 - DNA, 22 bp, Homo sapiens
cagggtcaggctgctagaagct

SEQ ID NO: 7455286 - DNA, 22 bp, Homo sapiens
cagggtcaggctgctagaagct

SEQ ID NO: 7455287 - DNA, 22 bp, Homo sapiens
cagggtcatggcacctgcacgg

SEQ ID NO: 7455288 - DNA, 22 bp, Homo sapiens
cagggtcaagagactccagcag

SEQ ID NO: 7455289 - DNA, 22 bp, Homo sapiens
cagggtcaagagactccagcag

SEQ ID NO: 7455290 - DNA, 22 bp, Homo sapiens
cagggtagtaatttaatacaag

SEQ ID NO: 7455291 - DNA, 22 bp, Homo sapiens
cagggtagtaatttaatacaag

SEQ ID NO: 7455292 - DNA, 22 bp, Homo sapiens
cagggtcaggctgctagaagct

SEQ ID NO: 7455293 - DNA, 22 bp, Homo sapiens
cagggtcaggaggatctggctt

SEQ ID NO: 7455294 - DNA, 22 bp, Homo sapiens
cagggtcaggaggatctggctt

SEQ ID NO: 7455295 - DNA, 22 bp, Homo sapiens
cagggtcaccagagatctgcat

SEQ ID NO: 7455296 - DNA, 22 bp, Homo sapiens
cagggtagggcaagggaacctg

SEQ ID NO: 7455297 - DNA, 22 bp, Homo sapiens
cagggtagggcaagggaacctg

SEQ ID NO: 7455298 - DNA, 22 bp, Homo sapiens
cagggtagggcaagggaacctg

SEQ ID NO: 7455299 - DNA, 22 bp, Homo sapiens
cagggtagacagtaggtgtctg

SEQ ID NO: 7455300 - DNA, 22 bp, Homo sapiens
cagggtagacagtaggtgtctg

SEQ ID NO: 7455301 - DNA, 22 bp, Homo sapiens
cagggtagggcaagggaacctg

SEQ ID NO: 7455302 - DNA, 22 bp, Homo sapiens
cagggtagacagtaggtgtctg

SEQ ID NO: 7455303 - DNA, 22 bp, Homo sapiens
cagggtagacagtaggtgtctg

SEQ ID NO: 7455304 - DNA, 22 bp, Homo sapiens
cagggtacagagttttctaaac

SEQ ID NO: 7455305 - DNA, 22 bp, Homo sapiens
cagggtagacagtaggtgtctg

SEQ ID NO: 7455306 - DNA, 22 bp, Homo sapiens
caggggtgtttttggccaggag

SEQ ID NO: 7455307 - DNA, 22 bp, Homo sapiens
caggggtgtttttggccaggag

SEQ ID NO: 7455308 - DNA, 22 bp, Homo sapiens
caggggtgtttttggccaggag

SEQ ID NO: 7455309 - DNA, 22 bp, Homo sapiens
caggggtgtttttggccaggag

SEQ ID NO: 7455310 - DNA, 22 bp, Homo sapiens
caggggtgtttttggccaggag

SEQ ID NO: 7455311 - DNA, 22 bp, Homo sapiens
cagggggtggtccaggctgcgc

SEQ ID NO: 7455312 - DNA, 22 bp, Homo sapiens
cagggggtggtccaggctgcgc

SEQ ID NO: 7455313 - DNA, 22 bp, Homo sapiens
cagggggtggtccaggctgcgc

SEQ ID NO: 7455314 - DNA, 22 bp, Homo sapiens
cagggggtggtccaggctgcgc

SEQ ID NO: 7455315 - DNA, 22 bp, Homo sapiens
cagggggtggtccaggctgcgc

SEQ ID NO: 7455316 - DNA, 22 bp, Homo sapiens
caggggtattcaaggtagttta

SEQ ID NO: 7455317 - DNA, 22 bp, Homo sapiens
caggggtattcaaggtagttta

SEQ ID NO: 7455318 - DNA, 22 bp, Homo sapiens
cagggggtggtccaggctgcgc

SEQ ID NO: 7455319 - DNA, 22 bp, Homo sapiens
caggggtggctgcagcagaggt

SEQ ID NO: 7455320 - DNA, 22 bp, Homo sapiens
caggggtggctgcagcagaggt

SEQ ID NO: 7455321 - DNA, 22 bp, Homo sapiens
caggggtggctgcagcagaggt

SEQ ID NO: 7455322 - DNA, 22 bp, Homo sapiens
caggggtgtttttggccaggag

SEQ ID NO: 7455323 - DNA, 22 bp, Homo sapiens
caggggtgtttttggccaggag

SEQ ID NO: 7455324 - DNA, 22 bp, Homo sapiens
caggggtggctgcagcagaggt

SEQ ID NO: 7455325 - DNA, 22 bp, Homo sapiens
caggggtggctgcagcagaggt

SEQ ID NO: 7455326 - DNA, 22 bp, Homo sapiens
caggggtggctgcagcagaggt

SEQ ID NO: 7455327 - DNA, 22 bp, Homo sapiens
caggggtggctgcagcagaggt

SEQ ID NO: 7455328 - DNA, 22 bp, Homo sapiens
cagggctgtggctttgtgctgt

SEQ ID NO: 7455329 - DNA, 22 bp, Homo sapiens
cagggctgtggctttgtgctgt

SEQ ID NO: 7455330 - DNA, 22 bp, Homo sapiens
cagggctgtggctttgtgctgt

SEQ ID NO: 7455331 - DNA, 22 bp, Homo sapiens
cagggctgtggctttgtgctgt

SEQ ID NO: 7455332 - DNA, 22 bp, Homo sapiens
cagggctgtggaaaactggtgc

SEQ ID NO: 7455333 - DNA, 22 bp, Homo sapiens
cagggctgtggaaaactggtgc

SEQ ID NO: 7455334 - DNA, 22 bp, Homo sapiens
cagggctgtgcccatcttcccc

SEQ ID NO: 7455335 - DNA, 22 bp, Homo sapiens
cagggctgtggaaaactggtgc

SEQ ID NO: 7455336 - DNA, 22 bp, Homo sapiens
cagggctgtgcccatcttcccc

SEQ ID NO: 7455337 - DNA, 22 bp, Homo sapiens
cagggctgtggaaaactggtgc

SEQ ID NO: 7455338 - DNA, 22 bp, Homo sapiens
cagggctgtggctttgtgctgt

SEQ ID NO: 7455339 - DNA, 22 bp, Homo sapiens
cagggctgtggaaaactggtgc

SEQ ID NO: 7455340 - DNA, 17 bp, Homo sapiens
cagggctgtctgcctag

SEQ ID NO: 7455341 - DNA, 17 bp, Homo sapiens
cagggctgtctgcctag

SEQ ID NO: 7455342 - DNA, 17 bp, Homo sapiens
cagggctgtctgcctag

SEQ ID NO: 7455343 - DNA, 22 bp, Homo sapiens
cagggctgtctccaaaggcccc

SEQ ID NO: 7455344 - DNA, 17 bp, Homo sapiens
cagggctgtctgcctag

SEQ ID NO: 7455345 - DNA, 17 bp, Homo sapiens
cagggctgtctgcctag

SEQ ID NO: 7455346 - DNA, 17 bp, Homo sapiens
cagggctgtctgcctag

SEQ ID NO: 7455347 - DNA, 22 bp, Homo sapiens
cagggctgtgcccatcttcccc

SEQ ID NO: 7455348 - DNA, 22 bp, Homo sapiens
cagggctgtgcccatcttcccc

SEQ ID NO: 7455349 - DNA, 22 bp, Homo sapiens
cagggctgtgcccatcttcccc

SEQ ID NO: 7455350 - DNA, 17 bp, Homo sapiens
cagggctgtctgcctag

SEQ ID NO: 7455351 - DNA, 17 bp, Homo sapiens
cagggctgtctgcctag

SEQ ID NO: 7455352 - DNA, 17 bp, Homo sapiens
cagggctgtctgcctag

SEQ ID NO: 7455353 - DNA, 22 bp, Homo sapiens
cagggggctcaaaggagagtgc

SEQ ID NO: 7455354 - DNA, 22 bp, Homo sapiens
cagggggctcaaaggagagtgc

SEQ ID NO: 7455355 - DNA, 22 bp, Homo sapiens
cagggggctcaaaggagagtgc

SEQ ID NO: 7455356 - DNA, 22 bp, Homo sapiens
cagggggctcaaaggagagtgc

SEQ ID NO: 7455357 - DNA, 22 bp, Homo sapiens
cagggggctcaaaggagagtgc

SEQ ID NO: 7455358 - DNA, 22 bp, Homo sapiens
cagggggcagcgtagaaaatga

SEQ ID NO: 7455359 - DNA, 22 bp, Homo sapiens
cagggggcagcgtagaaaatga

SEQ ID NO: 7455360 - DNA, 22 bp, Homo sapiens
cagggggcagcgtagaaaatga

SEQ ID NO: 7455361 - DNA, 22 bp, Homo sapiens
cagggggctcaaaggagagtgc

SEQ ID NO: 7455362 - DNA, 22 bp, Homo sapiens
cagggggtgcaggccctgtgac

SEQ ID NO: 7455363 - DNA, 22 bp, Homo sapiens
cagggggtgcaggccctgtgac

SEQ ID NO: 7455364 - DNA, 22 bp, Homo sapiens
cagggggtggtccaggctgcgc

SEQ ID NO: 7455365 - DNA, 22 bp, Homo sapiens
cagggggtgcaggccctgtgac

SEQ ID NO: 7455366 - DNA, 22 bp, Homo sapiens
cagggggctgtggctgtccagt

SEQ ID NO: 7455367 - DNA, 22 bp, Homo sapiens
cagggggctgtggctgtccagt

SEQ ID NO: 7455368 - DNA, 22 bp, Homo sapiens
cagggggctgtggctgtccagt

SEQ ID NO: 7455369 - DNA, 22 bp, Homo sapiens
cagggggctgtggctgtccagt

SEQ ID NO: 7455370 - DNA, 22 bp, Homo sapiens
cagggggctgtggctgtccagt

SEQ ID NO: 7455371 - DNA, 22 bp, Homo sapiens
cagggggctgtggctgtccagt

SEQ ID NO: 7455372 - DNA, 22 bp, Homo sapiens
cagggggctgtggctgtccagt

SEQ ID NO: 7455373 - DNA, 22 bp, Homo sapiens
caggggcgggtaaaaggcctcc

SEQ ID NO: 7455374 - DNA, 22 bp, Homo sapiens
caggggcctgtcctggcttctg

SEQ ID NO: 7455375 - DNA, 22 bp, Homo sapiens
caggggcctgtcctggcttctg

SEQ ID NO: 7455376 - DNA, 22 bp, Homo sapiens
caggggctgtttgcctcaggcc

SEQ ID NO: 7455377 - DNA, 22 bp, Homo sapiens
caggggctgtttgcctcaggcc

SEQ ID NO: 7455378 - DNA, 22 bp, Homo sapiens
caggggcggtggctcacgcctg

SEQ ID NO: 7455379 - DNA, 22 bp, Homo sapiens
caggggctgtttgcctcaggcc

SEQ ID NO: 7455380 - DNA, 22 bp, Homo sapiens
caggggcttaagtgacagaagg

SEQ ID NO: 7455381 - DNA, 22 bp, Homo sapiens
caggggcttaagtgacagaagg

SEQ ID NO: 7455382 - DNA, 22 bp, Homo sapiens
caggggcttaagtgacagaagg

SEQ ID NO: 7455383 - DNA, 22 bp, Homo sapiens
caggggcttaagtgacagaagg

SEQ ID NO: 7455384 - DNA, 22 bp, Homo sapiens
caggggcttttcctctataagg

SEQ ID NO: 7455385 - DNA, 22 bp, Homo sapiens
caggggcttttcctctataagg

SEQ ID NO: 7455386 - DNA, 22 bp, Homo sapiens
cagggctgtaaattagtgctga

SEQ ID NO: 7455387 - DNA, 22 bp, Homo sapiens
cagggctgtaaattagtgctga

SEQ ID NO: 7455388 - DNA, 22 bp, Homo sapiens
cagggctgtaaattagtgctga

SEQ ID NO: 7455389 - DNA, 22 bp, Homo sapiens
cagggctgtaaattagtgctga

SEQ ID NO: 7455390 - DNA, 22 bp, Homo sapiens
cagggctgtaaattagtgctga

SEQ ID NO: 7455391 - DNA, 22 bp, Homo sapiens
cagggctgtaaattagtgctga

SEQ ID NO: 7455392 - DNA, 22 bp, Homo sapiens
cagggctgtaaattagtgctga

SEQ ID NO: 7455393 - DNA, 22 bp, Homo sapiens
cagggctgtaaattagtgctga

SEQ ID NO: 7455394 - DNA, 22 bp, Homo sapiens
cagggctgtctccaaaggcccc

SEQ ID NO: 7455395 - DNA, 22 bp, Homo sapiens
cagggctgtctccaaaggcccc

SEQ ID NO: 7455396 - DNA, 22 bp, Homo sapiens
cagggctgtctccaaaggcccc

SEQ ID NO: 7455397 - DNA, 22 bp, Homo sapiens
cagggctgtctccaaaggcccc

SEQ ID NO: 7455398 - DNA, 22 bp, Homo sapiens
cagggctgtctccaaaggcccc

SEQ ID NO: 7455399 - DNA, 22 bp, Homo sapiens
cagggctgtctccaaaggcccc

SEQ ID NO: 7455400 - DNA, 22 bp, Homo sapiens
cagggctgtctccaaaggcccc

SEQ ID NO: 7455401 - DNA, 22 bp, Homo sapiens
cagggctgtaaattagtgctga

SEQ ID NO: 7455402 - DNA, 22 bp, Homo sapiens
cagggctgtaaattagtgctga

SEQ ID NO: 7455403 - DNA, 23 bp, Homo sapiens
cagggctggtagggaagagcgtg

SEQ ID NO: 7455404 - DNA, 23 bp, Homo sapiens
cagggctggtagggaagagcgtg

SEQ ID NO: 7455405 - DNA, 23 bp, Homo sapiens
cagggctggtagggaagagcgtg

SEQ ID NO: 7455406 - DNA, 23 bp, Homo sapiens
cagggctggtagggaagagcgtg

SEQ ID NO: 7455407 - DNA, 23 bp, Homo sapiens
cagggctggtagggaagagcgtg

SEQ ID NO: 7455408 - DNA, 23 bp, Homo sapiens
cagggctggtagggaagagcgtg

SEQ ID NO: 7455409 - DNA, 22 bp, Homo sapiens
cagggctggtttgtcgaagaaa

SEQ ID NO: 7455410 - DNA, 22 bp, Homo sapiens
cagggctggtttgtcgaagaaa

SEQ ID NO: 7455411 - DNA, 22 bp, Homo sapiens
cagggctggtttgtcgaagaaa

SEQ ID NO: 7455412 - DNA, 22 bp, Homo sapiens
cagggctggtttgtcgaagaaa

SEQ ID NO: 7455413 - DNA, 22 bp, Homo sapiens
cagggctggtttgtcgaagaaa

SEQ ID NO: 7455414 - DNA, 22 bp, Homo sapiens
cagggctggtttgtcgaagaaa

SEQ ID NO: 7455415 - DNA, 22 bp, Homo sapiens
tagggaagctcctgattcccct

SEQ ID NO: 7455416 - DNA, 22 bp, Homo sapiens
cagggctggatttcatttctag

SEQ ID NO: 7455417 - DNA, 22 bp, Homo sapiens
tagggaaatatagatttagggc

SEQ ID NO: 7455418 - DNA, 22 bp, Homo sapiens
tagggaaatatagatttagggc

SEQ ID NO: 7455419 - DNA, 22 bp, Homo sapiens
tagggaaaagacttcactgttt

SEQ ID NO: 7455420 - DNA, 22 bp, Homo sapiens
tagggaaatatagatttagggc

SEQ ID NO: 7455421 - DNA, 22 bp, Homo sapiens
tagggaagagcattcaaccttt

SEQ ID NO: 7455422 - DNA, 22 bp, Homo sapiens
tagggaaatatagatttagggc

SEQ ID NO: 7455423 - DNA, 23 bp, Homo sapiens
cagggctggtagggaagagcgtg

SEQ ID NO: 7455424 - DNA, 22 bp, Homo sapiens
cagggctgggttaaaagcaggg

SEQ ID NO: 7455425 - DNA, 23 bp, Homo sapiens
cagggctggtagggaagagcgtg

SEQ ID NO: 7455426 - DNA, 23 bp, Homo sapiens
cagggctggtagggaagagcgtg

SEQ ID NO: 7455427 - DNA, 22 bp, Homo sapiens
cagggctgggttaaaagcaggg

SEQ ID NO: 7455428 - DNA, 22 bp, Homo sapiens
cagggctgggttaaaagcaggg

SEQ ID NO: 7455429 - DNA, 22 bp, Homo sapiens
cagggctggatttcatttctag

SEQ ID NO: 7455430 - DNA, 22 bp, Homo sapiens
cagggctggatttcatttctag

SEQ ID NO: 7455431 - DNA, 22 bp, Homo sapiens
cagggctggatttcatttctag

SEQ ID NO: 7455432 - DNA, 22 bp, Homo sapiens
cagggctgggttaaaagcaggg

SEQ ID NO: 7455433 - DNA, 22 bp, Homo sapiens
taggctttcacagctggactcc

SEQ ID NO: 7455434 - DNA, 22 bp, Homo sapiens
taggctttccttgttgccatgt

SEQ ID NO: 7455435 - DNA, 22 bp, Homo sapiens
tagggaaaagacttcactgttt

SEQ ID NO: 7455436 - DNA, 22 bp, Homo sapiens
taggcttttccagtataagaga

SEQ ID NO: 7455437 - DNA, 22 bp, Homo sapiens
taggctttgtgcaggatacagg

SEQ ID NO: 7455438 - DNA, 22 bp, Homo sapiens
taggcttccgagtcttggtatc

SEQ ID NO: 7455439 - DNA, 23 bp, Homo sapiens
taggcttctgctgtccccgacgc

SEQ ID NO: 7455440 - DNA, 22 bp, Homo sapiens
taggcttcccgctcacatgccc

SEQ ID NO: 7455441 - DNA, 22 bp, Homo sapiens
taggcttgcaattaggatggaa

SEQ ID NO: 7455442 - DNA, 22 bp, Homo sapiens
taggcttgcaattaggatggaa

SEQ ID NO: 7455443 - DNA, 22 bp, Homo sapiens
taggcttgcaattaggatggaa

SEQ ID NO: 7455444 - DNA, 23 bp, Homo sapiens
taggcttctgctgtccccgacgc

SEQ ID NO: 7455445 - DNA, 22 bp, Homo sapiens
taggcttgctgcagaatctgcc

SEQ ID NO: 7455446 - DNA, 22 bp, Homo sapiens
taggcttgcttctcctccacag

SEQ ID NO: 7455447 - DNA, 22 bp, Homo sapiens
taggcttgcttctcctccacag

SEQ ID NO: 7455448 - DNA, 22 bp, Homo sapiens
taggcttgctgttattttgaag

SEQ ID NO: 7455449 - DNA, 22 bp, Homo sapiens
taggcttggctttagtttctgt

SEQ ID NO: 7455450 - DNA, 22 bp, Homo sapiens
taggcttggttattggggtgct

SEQ ID NO: 7455451 - DNA, 22 bp, Homo sapiens
taggcttgttacaaaacagtca

SEQ ID NO: 7455452 - DNA, 22 bp, Homo sapiens
taggcttgttacaaaacagtca

SEQ ID NO: 7455453 - DNA, 20 bp, Homo sapiens
cagggctctgggcctggcct

SEQ ID NO: 7455454 - DNA, 22 bp, Homo sapiens
cagggctcttcatcacacagta

SEQ ID NO: 7455455 - DNA, 22 bp, Homo sapiens
cagggctcttcatcacacagta

SEQ ID NO: 7455456 - DNA, 20 bp, Homo sapiens
cagggctctgggcctggcct

SEQ ID NO: 7455457 - DNA, 20 bp, Homo sapiens
cagggctctgggcctggcct

SEQ ID NO: 7455458 - DNA, 22 bp, Homo sapiens
cagggctccatgcagggactcc

SEQ ID NO: 7455459 - DNA, 22 bp, Homo sapiens
cagggctccatgcagggactcc

SEQ ID NO: 7455460 - DNA, 20 bp, Homo sapiens
cagggctctgggcctggcct

SEQ ID NO: 7455461 - DNA, 20 bp, Homo sapiens
cagggctctgggcctggcct

SEQ ID NO: 7455462 - DNA, 20 bp, Homo sapiens
cagggctctgggcctggcct

SEQ ID NO: 7455463 - DNA, 22 bp, Homo sapiens
cagggctcttccggagcaggga

SEQ ID NO: 7455464 - DNA, 22 bp, Homo sapiens
cagggctcttccggagcaggga

SEQ ID NO: 7455465 - DNA, 22 bp, Homo sapiens
cagggctcttccggagcaggga

SEQ ID NO: 7455466 - DNA, 22 bp, Homo sapiens
cagggctcttccggagcaggga

SEQ ID NO: 7455467 - DNA, 22 bp, Homo sapiens
cagggctcttccggagcaggga

SEQ ID NO: 7455468 - DNA, 22 bp, Homo sapiens
cagggctcttccggagcaggga

SEQ ID NO: 7455469 - DNA, 22 bp, Homo sapiens
cagggctcttcatcacacagta

SEQ ID NO: 7455470 - DNA, 22 bp, Homo sapiens
cagggctcttcatcacacagta

SEQ ID NO: 7455471 - DNA, 22 bp, Homo sapiens
cagggctgaactgagcttgtga

SEQ ID NO: 7455472 - DNA, 22 bp, Homo sapiens
cagggctgaactgagcttgtga

SEQ ID NO: 7455473 - DNA, 22 bp, Homo sapiens
cagggctgaactgagcttgtga

SEQ ID NO: 7455474 - DNA, 22 bp, Homo sapiens
cagggctgaactgagcttgtga

SEQ ID NO: 7455475 - DNA, 22 bp, Homo sapiens
cagggctgaaatcaaggtgtag

SEQ ID NO: 7455476 - DNA, 22 bp, Homo sapiens
cagggctgaactgagcttgtga

SEQ ID NO: 7455477 - DNA, 22 bp, Homo sapiens
cagggctcttccggagcaggga

SEQ ID NO: 7455478 - DNA, 22 bp, Homo sapiens
cagggctcttccggagcaggga

SEQ ID NO: 7455479 - DNA, 22 bp, Homo sapiens
cagggctgaaatcaaggtgtag

SEQ ID NO: 7455480 - DNA, 22 bp, Homo sapiens
cagggctgaaatcaaggtgtag

SEQ ID NO: 7455481 - DNA, 22 bp, Homo sapiens
cagggctgaaatcaaggtgtag

SEQ ID NO: 7455482 - DNA, 22 bp, Homo sapiens
cagggctgaaatcaaggtgtag

SEQ ID NO: 7455483 - DNA, 22 bp, Homo sapiens
cagggctgaaatcaaggtgtag

SEQ ID NO: 7455484 - DNA, 22 bp, Homo sapiens
cagggctgaaatcaaggtgtag

SEQ ID NO: 7455485 - DNA, 22 bp, Homo sapiens
cagggctgaaatcaaggtgtag

SEQ ID NO: 7455486 - DNA, 22 bp, Homo sapiens
taggctgggcctgccttccagg

SEQ ID NO: 7455487 - DNA, 22 bp, Homo sapiens
taggctgggcctgccttccagg

SEQ ID NO: 7455488 - DNA, 22 bp, Homo sapiens
taggctgggctgagctggacgg

SEQ ID NO: 7455489 - DNA, 22 bp, Homo sapiens
taggctgggcctgccttccagg

SEQ ID NO: 7455490 - DNA, 22 bp, Homo sapiens
cagggctgagaatttagagaca

SEQ ID NO: 7455491 - DNA, 22 bp, Homo sapiens
cagggctgaagaaattcaaaag

SEQ ID NO: 7455492 - DNA, 22 bp, Homo sapiens
cagggctgagaatttagagaca

SEQ ID NO: 7455493 - DNA, 22 bp, Homo sapiens
cagggctgaagaaattcaaaag

SEQ ID NO: 7455494 - DNA, 22 bp, Homo sapiens
cagggctgagaatttagagaca

SEQ ID NO: 7455495 - DNA, 22 bp, Homo sapiens
cagggctgaagaaattcaaaag

SEQ ID NO: 7455496 - DNA, 22 bp, Homo sapiens
cagggctgaagaaattcaaaag

SEQ ID NO: 7455497 - DNA, 22 bp, Homo sapiens
cagggctgaagaaattcaaaag

SEQ ID NO: 7455498 - DNA, 22 bp, Homo sapiens
cagggctgaagaaattcaaaag

SEQ ID NO: 7455499 - DNA, 22 bp, Homo sapiens
cagggctgaactgagcttgtga

SEQ ID NO: 7455500 - DNA, 22 bp, Homo sapiens
cagggctgaactgagcttgtga

SEQ ID NO: 7455501 - DNA, 22 bp, Homo sapiens
taggctgggggtaggaattgag

SEQ ID NO: 7455502 - DNA, 22 bp, Homo sapiens
taggctgggggtaggaattgag

SEQ ID NO: 7455503 - DNA, 22 bp, Homo sapiens
taggctgtaagagagggcagag

SEQ ID NO: 7455504 - DNA, 18 bp, Homo sapiens
taggctgggggctgtagt

SEQ ID NO: 7455505 - DNA, 18 bp, Homo sapiens
taggctgggggctgtagt

SEQ ID NO: 7455506 - DNA, 18 bp, Homo sapiens
taggctgggggctgtagt

SEQ ID NO: 7455507 - DNA, 22 bp, Homo sapiens
taggctgggggtaggaattgag

SEQ ID NO: 7455508 - DNA, 18 bp, Homo sapiens
taggctgggggctgtagt

SEQ ID NO: 7455509 - DNA, 22 bp, Homo sapiens
taggctgggctgagctggacgg

SEQ ID NO: 7455510 - DNA, 22 bp, Homo sapiens
taggctgggctgagctggacgg

SEQ ID NO: 7455511 - DNA, 22 bp, Homo sapiens
taggctgggctgagctggacgg

SEQ ID NO: 7455512 - DNA, 22 bp, Homo sapiens
taggctgggctgagctggacgg

SEQ ID NO: 7455513 - DNA, 22 bp, Homo sapiens
taggctgggctgagctggacgg

SEQ ID NO: 7455514 - DNA, 22 bp, Homo sapiens
taggctgggctgagctggacgg

SEQ ID NO: 7455515 - DNA, 22 bp, Homo sapiens
taggctgggctgagctggacgg

SEQ ID NO: 7455516 - DNA, 18 bp, Homo sapiens
taggctgggggctgtagt

SEQ ID NO: 7455517 - DNA, 22 bp, Homo sapiens
cctcagtgttaggataagagaa

SEQ ID NO: 7455518 - DNA, 22 bp, Homo sapiens
cctcagtttatcctctgtaaca

SEQ ID NO: 7455519 - DNA, 22 bp, Homo sapiens
cctcagtgtgtggatgttagag

SEQ ID NO: 7455520 - DNA, 22 bp, Homo sapiens
cctcagtgtgtggatgttagag

SEQ ID NO: 7455521 - DNA, 22 bp, Homo sapiens
cctcagtgtgtttggggtgagg

SEQ ID NO: 7455522 - DNA, 22 bp, Homo sapiens
cctcagtgtgtttggggtgagg

SEQ ID NO: 7455523 - DNA, 22 bp, Homo sapiens
cctcagtgtgcagcagcatctg

SEQ ID NO: 7455524 - DNA, 22 bp, Homo sapiens
cctcagtgtgtggatgttagag

SEQ ID NO: 7455525 - DNA, 20 bp, Homo sapiens
cctcagtgtcctggactggg

SEQ ID NO: 7455526 - DNA, 22 bp, Homo sapiens
cctcagtgtgcagcagcatctg

SEQ ID NO: 7455527 - DNA, 21 bp, Homo sapiens
cctcatcaaactttcacttgc

SEQ ID NO: 7455528 - DNA, 20 bp, Homo sapiens
cctcatctcaagggcagtcc

SEQ ID NO: 7455529 - DNA, 22 bp, Homo sapiens
cctcatcgtttccagaatgtgg

SEQ ID NO: 7455530 - DNA, 20 bp, Homo sapiens
cctcatctcaagggcagtcc

SEQ ID NO: 7455531 - DNA, 22 bp, Homo sapiens
cctcatctgtcatcctagggaa

SEQ ID NO: 7455532 - DNA, 19 bp, Homo sapiens
cctcatcttggtgtgtgca

SEQ ID NO: 7455533 - DNA, 19 bp, Homo sapiens
cctcatcttggtgtgtgca

SEQ ID NO: 7455534 - DNA, 22 bp, Homo sapiens
cctcatctgtcatcctagggaa

SEQ ID NO: 7455535 - DNA, 18 bp, Homo sapiens
cctcagggagagagacgc

SEQ ID NO: 7455536 - DNA, 18 bp, Homo sapiens
cctcagggagagagacgc

SEQ ID NO: 7455537 - DNA, 18 bp, Homo sapiens
cctcagggagagagacgc

SEQ ID NO: 7455538 - DNA, 22 bp, Homo sapiens
cctcagggactccatgctgcag

SEQ ID NO: 7455539 - DNA, 18 bp, Homo sapiens
cctcagggagagagacgc

SEQ ID NO: 7455540 - DNA, 22 bp, Homo sapiens
cctcagggactccatgctgcag

SEQ ID NO: 7455541 - DNA, 22 bp, Homo sapiens
cctcagggactccatgctgcag

SEQ ID NO: 7455542 - DNA, 20 bp, Homo sapiens
cctcagtgtcctggactggg

SEQ ID NO: 7455543 - DNA, 20 bp, Homo sapiens
cctcagtgtcctggactggg

SEQ ID NO: 7455544 - DNA, 22 bp, Homo sapiens
cctcagtgcgtactgaacagtg

SEQ ID NO: 7455545 - DNA, 20 bp, Homo sapiens
cctcagtgtcctggactggg

SEQ ID NO: 7455546 - DNA, 18 bp, Homo sapiens
cctcagggagatccagtg

SEQ ID NO: 7455547 - DNA, 22 bp, Homo sapiens
cctcagtgcgtactgaacagtg

SEQ ID NO: 7455548 - DNA, 22 bp, Homo sapiens
cctcagtgagtgtttccttctt

SEQ ID NO: 7455549 - DNA, 22 bp, Homo sapiens
cctcagtgagtgtttccttctt

SEQ ID NO: 7455550 - DNA, 18 bp, Homo sapiens
cctcagggagagagacgc

SEQ ID NO: 7455551 - DNA, 18 bp, Homo sapiens
cctcagggagatccagtg

SEQ ID NO: 7455552 - DNA, 22 bp, Homo sapiens
cctcatggccttgagctgaggg

SEQ ID NO: 7455553 - DNA, 22 bp, Homo sapiens
cctcatgctgcatctctgaggt

SEQ ID NO: 7455554 - DNA, 22 bp, Homo sapiens
cctcatgctgcatctctgaggt

SEQ ID NO: 7455555 - DNA, 22 bp, Homo sapiens
cctcatgatttttagcccattg

SEQ ID NO: 7455556 - DNA, 19 bp, Homo sapiens
cctcatcttggtgtgtgca

SEQ ID NO: 7455557 - DNA, 23 bp, Homo sapiens
cctcatgaaggtctgcttcctgg

SEQ ID NO: 7455558 - DNA, 22 bp, Homo sapiens
cctcatgagaactgggctcctg

SEQ ID NO: 7455559 - DNA, 23 bp, Homo sapiens
cctcatgaaggtctgcttcctgg

SEQ ID NO: 7455560 - DNA, 23 bp, Homo sapiens
cctcatgaaggtctgcttcctgg

SEQ ID NO: 7455561 - DNA, 22 bp, Homo sapiens
cctcatgaggcaggcagggtag

SEQ ID NO: 7455562 - DNA, 22 bp, Homo sapiens
cctcatgagttcttctgcccat

SEQ ID NO: 7455563 - DNA, 22 bp, Homo sapiens
cctcatgatttttagcccattg

SEQ ID NO: 7455564 - DNA, 22 bp, Homo sapiens
cctccaaccataggtccagggg

SEQ ID NO: 7455565 - DNA, 22 bp, Homo sapiens
cctcatttatagccaaagtaaa

SEQ ID NO: 7455566 - DNA, 22 bp, Homo sapiens
cctcatttatagccaaagtaaa

SEQ ID NO: 7455567 - DNA, 22 bp, Homo sapiens
cctcattaacacaatgtcattt

SEQ ID NO: 7455568 - DNA, 22 bp, Homo sapiens
cctcattaacacaatgtcattt

SEQ ID NO: 7455569 - DNA, 22 bp, Homo sapiens
cctcatggtacttactgtagct

SEQ ID NO: 7455570 - DNA, 22 bp, Homo sapiens
cctcatgttgctcgcatctgca

SEQ ID NO: 7455571 - DNA, 22 bp, Homo sapiens
cctcatggccttgagctgaggg

SEQ ID NO: 7455572 - DNA, 22 bp, Homo sapiens
cctcatggccttgagctgaggg

SEQ ID NO: 7455573 - DNA, 22 bp, Homo sapiens
tggcctggctgccctgtctgga

SEQ ID NO: 7455574 - DNA, 22 bp, Homo sapiens
tggcctggctgccctgtctgga

SEQ ID NO: 7455575 - DNA, 22 bp, Homo sapiens
tggcctggctgccctgtctgga

SEQ ID NO: 7455576 - DNA, 22 bp, Homo sapiens
tggcctggctgccctgtctgga

SEQ ID NO: 7455577 - DNA, 22 bp, Homo sapiens
tggcctggctgccctgtctgga

SEQ ID NO: 7455578 - DNA, 22 bp, Homo sapiens
tggcctggctgccctgtctgga

SEQ ID NO: 7455579 - DNA, 22 bp, Homo sapiens
tggcctggctgccctgtctgga

SEQ ID NO: 7455580 - DNA, 22 bp, Homo sapiens
tggcctggctcacagtgagatt

SEQ ID NO: 7455581 - DNA, 18 bp, Homo sapiens
cctccaagtccccagcct

SEQ ID NO: 7455582 - DNA, 22 bp, Homo sapiens
tggcctggctgccctgtctgga

SEQ ID NO: 7455583 - DNA, 22 bp, Homo sapiens
cctccaaggtgagagaggatgg

SEQ ID NO: 7455584 - DNA, 22 bp, Homo sapiens
cctccaaggctgagttaatgaa

SEQ ID NO: 7455585 - DNA, 22 bp, Homo sapiens
cctccaagcttcatctcaacca

SEQ ID NO: 7455586 - DNA, 22 bp, Homo sapiens
cctccaagctggtcctctgtgt

SEQ ID NO: 7455587 - DNA, 22 bp, Homo sapiens
cctccaagctggtcctctgtgt

SEQ ID NO: 7455588 - DNA, 22 bp, Homo sapiens
cctccaagctggtcctctgtgt

SEQ ID NO: 7455589 - DNA, 22 bp, Homo sapiens
cctccaagcttcatctcaacca

SEQ ID NO: 7455590 - DNA, 22 bp, Homo sapiens
cctccaagcttcatctcaacca

SEQ ID NO: 7455591 - DNA, 18 bp, Homo sapiens
cctccaagtccccagcct

SEQ ID NO: 7455592 - DNA, 18 bp, Homo sapiens
cctccaagtccccagcct

SEQ ID NO: 7455593 - DNA, 21 bp, Homo sapiens
tggctctgggtaggagagtgc

SEQ ID NO: 7455594 - DNA, 21 bp, Homo sapiens
tggctctgggtaggagagtgc

SEQ ID NO: 7455595 - DNA, 22 bp, Homo sapiens
tggctctggggacagtaagtcc

SEQ ID NO: 7455596 - DNA, 21 bp, Homo sapiens
tggctctgggtaggagagtgc

SEQ ID NO: 7455597 - DNA, 21 bp, Homo sapiens
tggctctgggtaggagagtgc

SEQ ID NO: 7455598 - DNA, 22 bp, Homo sapiens
tggctctggtaacattgggtag

SEQ ID NO: 7455599 - DNA, 21 bp, Homo sapiens
tggctctgggtaggagagtgc

SEQ ID NO: 7455600 - DNA, 21 bp, Homo sapiens
tggctctgggtaggagagtgc

SEQ ID NO: 7455601 - DNA, 21 bp, Homo sapiens
tggctctgggtaggagagtgc

SEQ ID NO: 7455602 - DNA, 22 bp, Homo sapiens
tggctctgagacacaggctctc

SEQ ID NO: 7455603 - DNA, 22 bp, Homo sapiens
tggctctgagacacaggctctc

SEQ ID NO: 7455604 - DNA, 22 bp, Homo sapiens
tggctctgagacacaggctctc

SEQ ID NO: 7455605 - DNA, 22 bp, Homo sapiens
tggctctgagacacaggctctc

SEQ ID NO: 7455606 - DNA, 22 bp, Homo sapiens
tggctctgagacacaggctctc

SEQ ID NO: 7455607 - DNA, 22 bp, Homo sapiens
tggctctgagacacaggctctc

SEQ ID NO: 7455608 - DNA, 21 bp, Homo sapiens
tggctctgggtaggagagtgc

SEQ ID NO: 7455609 - DNA, 21 bp, Homo sapiens
tggctctgggtaggagagtgc

SEQ ID NO: 7455610 - DNA, 22 bp, Homo sapiens
tggctctgaccaggtagaggag

SEQ ID NO: 7455611 - DNA, 22 bp, Homo sapiens
tggctctgagacacaggctctc

SEQ ID NO: 7455612 - DNA, 22 bp, Homo sapiens
tggctctgagacacaggctctc

SEQ ID NO: 7455613 - DNA, 22 bp, Homo sapiens
tggctctgaccaggtagaggag

SEQ ID NO: 7455614 - DNA, 22 bp, Homo sapiens
tggctctgaccaggtagaggag

SEQ ID NO: 7455615 - DNA, 22 bp, Homo sapiens
tggctctggtgcgggctcctgc

SEQ ID NO: 7455616 - DNA, 22 bp, Homo sapiens
tggctctggtaacattgggtag

SEQ ID NO: 7455617 - DNA, 22 bp, Homo sapiens
tggctctggtaacattgggtag

SEQ ID NO: 7455618 - DNA, 22 bp, Homo sapiens
tggctctggtaacattgggtag

SEQ ID NO: 7455619 - DNA, 22 bp, Homo sapiens
tggctctggtaacattgggtag

SEQ ID NO: 7455620 - DNA, 22 bp, Homo sapiens
tggctctggtgcgggctcctgc

SEQ ID NO: 7455621 - DNA, 22 bp, Homo sapiens
tggctctggtgcgggctcctgc

SEQ ID NO: 7455622 - DNA, 22 bp, Homo sapiens
tggctctggtgcgggctcctgc

SEQ ID NO: 7455623 - DNA, 22 bp, Homo sapiens
tggctctggtgcgggctcctgc

SEQ ID NO: 7455624 - DNA, 22 bp, Homo sapiens
tggctctggtgcgggctcctgc

SEQ ID NO: 7455625 - DNA, 22 bp, Homo sapiens
tggctctggtgcgggctcctgc

SEQ ID NO: 7455626 - DNA, 22 bp, Homo sapiens
tggctctggtgcgggctcctgc

SEQ ID NO: 7455627 - DNA, 22 bp, Homo sapiens
tggctctggtgcgggctcctgc

SEQ ID NO: 7455628 - DNA, 22 bp, Homo sapiens
tggctctggtgcgggctcctgc

SEQ ID NO: 7455629 - DNA, 22 bp, Homo sapiens
tggctctgtcaaactgcacaca

SEQ ID NO: 7455630 - DNA, 22 bp, Homo sapiens
tggctctgtcaaactgcacaca

SEQ ID NO: 7455631 - DNA, 22 bp, Homo sapiens
tggctctgtcaaactgcacaca

SEQ ID NO: 7455632 - DNA, 22 bp, Homo sapiens
tggctctgtcaaactgcacaca

SEQ ID NO: 7455633 - DNA, 22 bp, Homo sapiens
tggctctgtcaaactgcacaca

SEQ ID NO: 7455634 - DNA, 22 bp, Homo sapiens
tggctctgtcaaactgcacaca

SEQ ID NO: 7455635 - DNA, 22 bp, Homo sapiens
tggctctgtcaaactgcacaca

SEQ ID NO: 7455636 - DNA, 22 bp, Homo sapiens
tggctctgtcactgtgagctat

SEQ ID NO: 7455637 - DNA, 22 bp, Homo sapiens
tggctctgtcaaactgcacaca

SEQ ID NO: 7455638 - DNA, 22 bp, Homo sapiens
tggctctgtcactgtgagctat

SEQ ID NO: 7455639 - DNA, 22 bp, Homo sapiens
tggcctgggcctgccggtgcaa

SEQ ID NO: 7455640 - DNA, 22 bp, Homo sapiens
tggcctgggcctgccggtgcaa

SEQ ID NO: 7455641 - DNA, 22 bp, Homo sapiens
tggcctgggcctgccggtgcaa

SEQ ID NO: 7455642 - DNA, 22 bp, Homo sapiens
tggcctgggcctgccggtgcaa

SEQ ID NO: 7455643 - DNA, 22 bp, Homo sapiens
tggcctggggaagaccatgggc

SEQ ID NO: 7455644 - DNA, 22 bp, Homo sapiens
tggcctggggaagaccatgggc

SEQ ID NO: 7455645 - DNA, 22 bp, Homo sapiens
tggcctggggaagaccatgggc

SEQ ID NO: 7455646 - DNA, 22 bp, Homo sapiens
tggcctggggaagaccatgggc

SEQ ID NO: 7455647 - DNA, 22 bp, Homo sapiens
tggcctggggaagaccatgggc

SEQ ID NO: 7455648 - DNA, 22 bp, Homo sapiens
tggcctggggaagaccatgggc

SEQ ID NO: 7455649 - DNA, 22 bp, Homo sapiens
tggcctggggacctgtgagacc

SEQ ID NO: 7455650 - DNA, 22 bp, Homo sapiens
tggcctggggacctgtgagacc

SEQ ID NO: 7455651 - DNA, 22 bp, Homo sapiens
tggcctggggacctgtgagacc

SEQ ID NO: 7455652 - DNA, 22 bp, Homo sapiens
tggcctggggacctgtgagacc

SEQ ID NO: 7455653 - DNA, 22 bp, Homo sapiens
tggcctggggacctgtgagacc

SEQ ID NO: 7455654 - DNA, 22 bp, Homo sapiens
tggcctggctgccctgtctgga

SEQ ID NO: 7455655 - DNA, 22 bp, Homo sapiens
tggcctggctgccctgtctgga

SEQ ID NO: 7455656 - DNA, 22 bp, Homo sapiens
tggcctgggcatgaagcatcgt

SEQ ID NO: 7455657 - DNA, 22 bp, Homo sapiens
tggcctgggcatgaagcatcgt

SEQ ID NO: 7455658 - DNA, 22 bp, Homo sapiens
tggcctgggcctgccggtgcaa

SEQ ID NO: 7455659 - DNA, 22 bp, Homo sapiens
tggcctgggcctgccggtgcaa

SEQ ID NO: 7455660 - DNA, 22 bp, Homo sapiens
tggcctgggcctgccggtgcaa

SEQ ID NO: 7455661 - DNA, 22 bp, Homo sapiens
tggcctgggccggcagatatac

SEQ ID NO: 7455662 - DNA, 22 bp, Homo sapiens
tggcctgggccggcagatatac

SEQ ID NO: 7455663 - DNA, 22 bp, Homo sapiens
tggcctgggccggcagatatac

SEQ ID NO: 7455664 - DNA, 22 bp, Homo sapiens
tggcctgggccggcagatatac

SEQ ID NO: 7455665 - DNA, 22 bp, Homo sapiens
tggcctgggccggcagatatac

SEQ ID NO: 7455666 - DNA, 22 bp, Homo sapiens
tggcccagagcactgctgggca

SEQ ID NO: 7455667 - DNA, 22 bp, Homo sapiens
tggcccagagcactgctgggca

SEQ ID NO: 7455668 - DNA, 22 bp, Homo sapiens
cctcagcatcctcctgctcagt

SEQ ID NO: 7455669 - DNA, 22 bp, Homo sapiens
cctcagcatcctcctgctcagt

SEQ ID NO: 7455670 - DNA, 22 bp, Homo sapiens
cctcagcatcctcctgctcagt

SEQ ID NO: 7455671 - DNA, 22 bp, Homo sapiens
cctcagcatcctcatgctcagt

SEQ ID NO: 7455672 - DNA, 22 bp, Homo sapiens
cctcagcatcctcatgctcagt

SEQ ID NO: 7455673 - DNA, 22 bp, Homo sapiens
cctcagcatcctcatgctcagt

SEQ ID NO: 7455674 - DNA, 22 bp, Homo sapiens
cctcagcatcctcatgctcagt

SEQ ID NO: 7455675 - DNA, 22 bp, Homo sapiens
cctcagcagacacgcttctcac

SEQ ID NO: 7455676 - DNA, 22 bp, Homo sapiens
cctcagatgtcttaaggcactg

SEQ ID NO: 7455677 - DNA, 22 bp, Homo sapiens
cctcagcagacacgcttctcac

SEQ ID NO: 7455678 - DNA, 22 bp, Homo sapiens
cctcagcagacacgcttctcac

SEQ ID NO: 7455679 - DNA, 22 bp, Homo sapiens
cctcagagtttaagatgtcaga

SEQ ID NO: 7455680 - DNA, 22 bp, Homo sapiens
cctcagagtttaagatgtcaga

SEQ ID NO: 7455681 - DNA, 22 bp, Homo sapiens
cctcagagtttaagatgtcaga

SEQ ID NO: 7455682 - DNA, 22 bp, Homo sapiens
cctcagagttggccacgagagc

SEQ ID NO: 7455683 - DNA, 22 bp, Homo sapiens
cctcagagtaggtctcagctgt

SEQ ID NO: 7455684 - DNA, 22 bp, Homo sapiens
cctcagagtaggtctcagctgt

SEQ ID NO: 7455685 - DNA, 22 bp, Homo sapiens
cctcagagtaggtctcagctgt

SEQ ID NO: 7455686 - DNA, 22 bp, Homo sapiens
cctcagagtaggtctcagctgt

SEQ ID NO: 7455687 - DNA, 22 bp, Homo sapiens
cctcagagtctagtaaataata

SEQ ID NO: 7455688 - DNA, 22 bp, Homo sapiens
cctcagaggttttcattctgta

SEQ ID NO: 7455689 - DNA, 22 bp, Homo sapiens
cctcagaggttttcattctgta

SEQ ID NO: 7455690 - DNA, 22 bp, Homo sapiens
cctcagaggttttcattctgta

SEQ ID NO: 7455691 - DNA, 22 bp, Homo sapiens
cctcagagttggaatcacattt

SEQ ID NO: 7455692 - DNA, 22 bp, Homo sapiens
cctcagagttggaatcacattt

SEQ ID NO: 7455693 - DNA, 22 bp, Homo sapiens
cctcagagttggccacgagagc

SEQ ID NO: 7455694 - DNA, 22 bp, Homo sapiens
cctcagagttatttgaagtgaa

SEQ ID NO: 7455695 - DNA, 22 bp, Homo sapiens
cctcagagttggaatcacattt

SEQ ID NO: 7455696 - DNA, 22 bp, Homo sapiens
cctcagagttatttgaagtgaa

SEQ ID NO: 7455697 - DNA, 22 bp, Homo sapiens
cctcagagttatttgaagtgaa

SEQ ID NO: 7455698 - DNA, 22 bp, Homo sapiens
cctcagagttatttgaagtgaa

SEQ ID NO: 7455699 - DNA, 22 bp, Homo sapiens
cctcagagttatttgaagtgaa

SEQ ID NO: 7455700 - DNA, 22 bp, Homo sapiens
tggcccagcagttctgccccag

SEQ ID NO: 7455701 - DNA, 22 bp, Homo sapiens
tggcccagcagttctgccccag

SEQ ID NO: 7455702 - DNA, 22 bp, Homo sapiens
tggcccagcagttctgccccag

SEQ ID NO: 7455703 - DNA, 22 bp, Homo sapiens
tggcccagcactccaagtaggg

SEQ ID NO: 7455704 - DNA, 22 bp, Homo sapiens
tggcccagcactccaagtaggg

SEQ ID NO: 7455705 - DNA, 22 bp, Homo sapiens
tggcccagcactccaagtaggg

SEQ ID NO: 7455706 - DNA, 22 bp, Homo sapiens
tggcccagcagttctgccccag

SEQ ID NO: 7455707 - DNA, 17 bp, Homo sapiens
cctcagcttctttcctc

SEQ ID NO: 7455708 - DNA, 17 bp, Homo sapiens
cctcagcttctttcctc

SEQ ID NO: 7455709 - DNA, 22 bp, Homo sapiens
cctcagcttgatttctgcagag

SEQ ID NO: 7455710 - DNA, 17 bp, Homo sapiens
cctcagcttctttcctc

SEQ ID NO: 7455711 - DNA, 22 bp, Homo sapiens
tggcccagcactccaagtaggg

SEQ ID NO: 7455712 - DNA, 22 bp, Homo sapiens
tggcccagcactccaagtaggg

SEQ ID NO: 7455713 - DNA, 22 bp, Homo sapiens
tggcccagatctctgaccttga

SEQ ID NO: 7455714 - DNA, 22 bp, Homo sapiens
tggcccagcactccaagtaggg

SEQ ID NO: 7455715 - DNA, 22 bp, Homo sapiens
tggcccagcactccaagtaggg

SEQ ID NO: 7455716 - DNA, 20 bp, Homo sapiens
tggcccagcacgacgaggac

SEQ ID NO: 7455717 - DNA, 20 bp, Homo sapiens
tggcccagcacgacgaggac

SEQ ID NO: 7455718 - DNA, 19 bp, Homo sapiens
tggcccagatggtcctggg

SEQ ID NO: 7455719 - DNA, 20 bp, Homo sapiens
tggcccagcacgacgaggac

SEQ ID NO: 7455720 - DNA, 20 bp, Homo sapiens
tggcccagcacgacgaggac

SEQ ID NO: 7455721 - DNA, 20 bp, Homo sapiens
tggcccagcacgacgaggac

SEQ ID NO: 7455722 - DNA, 22 bp, Homo sapiens
tggcccagatctctgaccttga

SEQ ID NO: 7455723 - DNA, 22 bp, Homo sapiens
tggcccagatctctgaccttga

SEQ ID NO: 7455724 - DNA, 22 bp, Homo sapiens
tggcccagatctctgaccttga

SEQ ID NO: 7455725 - DNA, 22 bp, Homo sapiens
tggcccagagcactgctgggca

SEQ ID NO: 7455726 - DNA, 22 bp, Homo sapiens
tggcccagatctctgaccttga

SEQ ID NO: 7455727 - DNA, 22 bp, Homo sapiens
tggcccagagcactgctgggca

SEQ ID NO: 7455728 - DNA, 22 bp, Homo sapiens
tggcccagagcactgctgggca

SEQ ID NO: 7455729 - DNA, 19 bp, Homo sapiens
tggcccagatggtcctggg

SEQ ID NO: 7455730 - DNA, 19 bp, Homo sapiens
tggcccagatggtcctggg

SEQ ID NO: 7455731 - DNA, 19 bp, Homo sapiens
tggcccagatggtcctggg

SEQ ID NO: 7455732 - DNA, 19 bp, Homo sapiens
tggcccagatggtcctggg

SEQ ID NO: 7455733 - DNA, 19 bp, Homo sapiens
tggcccagatggtcctggg

SEQ ID NO: 7455734 - DNA, 19 bp, Homo sapiens
tggcccagatggtcctggg

SEQ ID NO: 7455735 - DNA, 19 bp, Homo sapiens
tggcccagatggtcctggg

SEQ ID NO: 7455736 - DNA, 19 bp, Homo sapiens
tggcccagatggtcctggg

SEQ ID NO: 7455737 - DNA, 19 bp, Homo sapiens
tggcccagatggtcctggg

SEQ ID NO: 7455738 - DNA, 19 bp, Homo sapiens
tggcccagatggtcctggg

SEQ ID NO: 7455739 - DNA, 22 bp, Homo sapiens
cctcaggctagctactgtccct

SEQ ID NO: 7455740 - DNA, 22 bp, Homo sapiens
cctcaggctagctactgtccct

SEQ ID NO: 7455741 - DNA, 22 bp, Homo sapiens
cctcaggctagctactgtccct

SEQ ID NO: 7455742 - DNA, 22 bp, Homo sapiens
cctcaggctagctactgtccct

SEQ ID NO: 7455743 - DNA, 22 bp, Homo sapiens
cctcaggctagctactgtccct

SEQ ID NO: 7455744 - DNA, 22 bp, Homo sapiens
cctcaggctagctactgtccct

SEQ ID NO: 7455745 - DNA, 22 bp, Homo sapiens
cctcaggctctgggtgcctacc

SEQ ID NO: 7455746 - DNA, 22 bp, Homo sapiens
cctcaggctagctactgtccct

SEQ ID NO: 7455747 - DNA, 22 bp, Homo sapiens
cctcaggctctgggtgcctacc

SEQ ID NO: 7455748 - DNA, 22 bp, Homo sapiens
cctcaggctctgggtgcctacc

SEQ ID NO: 7455749 - DNA, 22 bp, Homo sapiens
cctcaggcctgccagagcccca

SEQ ID NO: 7455750 - DNA, 22 bp, Homo sapiens
cctcaggcctgccagagcccca

SEQ ID NO: 7455751 - DNA, 22 bp, Homo sapiens
cctcaggcctgccagagcccca

SEQ ID NO: 7455752 - DNA, 22 bp, Homo sapiens
cctcaggcctgccagagcccca

SEQ ID NO: 7455753 - DNA, 22 bp, Homo sapiens
cctcaggcctgccagagcccca

SEQ ID NO: 7455754 - DNA, 22 bp, Homo sapiens
cctcaggcctgccagagcccca

SEQ ID NO: 7455755 - DNA, 22 bp, Homo sapiens
cctcaggcctctgcctcattgg

SEQ ID NO: 7455756 - DNA, 22 bp, Homo sapiens
cctcagcttgatttctgcagag

SEQ ID NO: 7455757 - DNA, 22 bp, Homo sapiens
cctcagcttgatttctgcagag

SEQ ID NO: 7455758 - DNA, 22 bp, Homo sapiens
cctcaggcctctgcctcattgg

SEQ ID NO: 7455759 - DNA, 22 bp, Homo sapiens
cctcaggctgctcacacttgtc

SEQ ID NO: 7455760 - DNA, 22 bp, Homo sapiens
cctcaggctctgggtgcctacc

SEQ ID NO: 7455761 - DNA, 22 bp, Homo sapiens
cctcaggctctgggtgcctacc

SEQ ID NO: 7455762 - DNA, 22 bp, Homo sapiens
cctcaggctctgggtgcctacc

SEQ ID NO: 7455763 - DNA, 22 bp, Homo sapiens
cctcaggctgctcacacttgtc

SEQ ID NO: 7455764 - DNA, 22 bp, Homo sapiens
cctcaggctgctcacacttgtc

SEQ ID NO: 7455765 - DNA, 22 bp, Homo sapiens
cctcaggctgctcacacttgtc

SEQ ID NO: 7455766 - DNA, 22 bp, Homo sapiens
cctcaggctgctcacacttgtc

SEQ ID NO: 7455767 - DNA, 22 bp, Homo sapiens
cctcaggctgggctgcccctgg

SEQ ID NO: 7455768 - DNA, 22 bp, Homo sapiens
cctcaggctgggctgcccctgg

SEQ ID NO: 7455769 - DNA, 22 bp, Homo sapiens
cctcaggctgggctgcccctgg

SEQ ID NO: 7455770 - DNA, 22 bp, Homo sapiens
cctcaggctgggctgcccctgg

SEQ ID NO: 7455771 - DNA, 22 bp, Homo sapiens
cctcaggctgctcacacttgtc

SEQ ID NO: 7455772 - DNA, 22 bp, Homo sapiens
cctcaggctgggctgcccctgg

SEQ ID NO: 7455773 - DNA, 22 bp, Homo sapiens
cctcaggctgggctgcccctgg

SEQ ID NO: 7455774 - DNA, 22 bp, Homo sapiens
cctcaggctgggctgcccctgg

SEQ ID NO: 7455775 - DNA, 22 bp, Homo sapiens
cctcaggcttacgggcaatgga

SEQ ID NO: 7455776 - DNA, 22 bp, Homo sapiens
cctcaggcttacgggcaatgga

SEQ ID NO: 7455777 - DNA, 22 bp, Homo sapiens
cctcaggcttacgggcaatgga

SEQ ID NO: 7455778 - DNA, 22 bp, Homo sapiens
cctcaggcttacgggcaatgga

SEQ ID NO: 7455779 - DNA, 22 bp, Homo sapiens
cctcaggcttaacttgtcttga

SEQ ID NO: 7455780 - DNA, 22 bp, Homo sapiens
cctcaggctgtcttccttctgg

SEQ ID NO: 7455781 - DNA, 22 bp, Homo sapiens
cctcaggctgtcttccttctgg

SEQ ID NO: 7455782 - DNA, 22 bp, Homo sapiens
cctcaggcttcgtcttccaccc

SEQ ID NO: 7455783 - DNA, 22 bp, Homo sapiens
cctcaggcttacgggcaatgga

SEQ ID NO: 7455784 - DNA, 22 bp, Homo sapiens
cctcaggcttacgggcaatgga

SEQ ID NO: 7455785 - DNA, 22 bp, Homo sapiens
cctcaggcttcgtcttccaccc

SEQ ID NO: 7455786 - DNA, 22 bp, Homo sapiens
cctcaggcttcgtcttccaccc

SEQ ID NO: 7455787 - DNA, 22 bp, Homo sapiens
cctcaggcttcgtcttccaccc

SEQ ID NO: 7455788 - DNA, 22 bp, Homo sapiens
cctcaggcttcgtcttccaccc

SEQ ID NO: 7455789 - DNA, 22 bp, Homo sapiens
cctcagggaatgggaggctggg

SEQ ID NO: 7455790 - DNA, 22 bp, Homo sapiens
cctcagggaatgggaggctggg

SEQ ID NO: 7455791 - DNA, 22 bp, Homo sapiens
cctcagggaatgggaggctggg

SEQ ID NO: 7455792 - DNA, 22 bp, Homo sapiens
cctcagggaatgggaggctggg

SEQ ID NO: 7455793 - DNA, 22 bp, Homo sapiens
cctcagggaatgggaggctggg

SEQ ID NO: 7455794 - DNA, 22 bp, Homo sapiens
cctcagggaatgggaggctggg

SEQ ID NO: 7455795 - DNA, 22 bp, Homo sapiens
cctcagggaatgggaggctggg

SEQ ID NO: 7455796 - DNA, 22 bp, Homo sapiens
cctcagggaatgggaggctggg

SEQ ID NO: 7455797 - DNA, 22 bp, Homo sapiens
cctcaggcttgtgagccttcag

SEQ ID NO: 7455798 - DNA, 22 bp, Homo sapiens
cctcaggcttgtgagccttcag

SEQ ID NO: 7455799 - DNA, 22 bp, Homo sapiens
cctcaggcttgtgagccttcag

SEQ ID NO: 7455800 - DNA, 22 bp, Homo sapiens
cctcaggcttgtgagccttcag

SEQ ID NO: 7455801 - DNA, 22 bp, Homo sapiens
cctcaggcttgtgagccttcag

SEQ ID NO: 7455802 - DNA, 22 bp, Homo sapiens
cctcaggcttctagttcagtga

SEQ ID NO: 7455803 - DNA, 22 bp, Homo sapiens
cctcaggcttctagttcagtga

SEQ ID NO: 7455804 - DNA, 22 bp, Homo sapiens
cctcaggcttctagttcagtga

SEQ ID NO: 7455805 - DNA, 22 bp, Homo sapiens
cctagactagaggcagggagcc

SEQ ID NO: 7455806 - DNA, 22 bp, Homo sapiens
cctagactagaggcagggagcc

SEQ ID NO: 7455807 - DNA, 18 bp, Homo sapiens
cctagagcagatggaagt

SEQ ID NO: 7455808 - DNA, 22 bp, Homo sapiens
cctagagccgcacctcctccac

SEQ ID NO: 7455809 - DNA, 22 bp, Homo sapiens
cctagagctctgctttatctaa

SEQ ID NO: 7455810 - DNA, 18 bp, Homo sapiens
cctagagcagatgggagt

SEQ ID NO: 7455811 - DNA, 22 bp, Homo sapiens
cctagagccgcacctcctccac

SEQ ID NO: 7455812 - DNA, 22 bp, Homo sapiens
cctagagctctgctttatctaa

SEQ ID NO: 7455813 - DNA, 22 bp, Homo sapiens
cctagagctctgctttatctaa

SEQ ID NO: 7455814 - DNA, 19 bp, Homo sapiens
cctagagcagtacctggta

SEQ ID NO: 7455815 - DNA, 22 bp, Homo sapiens
cctagaggctgcaaggagaggc

SEQ ID NO: 7455816 - DNA, 22 bp, Homo sapiens
cctagaggctgcaaggagaggc

SEQ ID NO: 7455817 - DNA, 22 bp, Homo sapiens
cctagaggctgcaaggagaggc

SEQ ID NO: 7455818 - DNA, 19 bp, Homo sapiens
cctagagggaaggcaggac

SEQ ID NO: 7455819 - DNA, 19 bp, Homo sapiens
cctagagggaaggcaggac

SEQ ID NO: 7455820 - DNA, 22 bp, Homo sapiens
cctagaggctgcaaggagaggc

SEQ ID NO: 7455821 - DNA, 22 bp, Homo sapiens
cctagagtgctattaaaaattc

SEQ ID NO: 7455822 - DNA, 22 bp, Homo sapiens
cctagatgggatggcggccggg

SEQ ID NO: 7455823 - DNA, 19 bp, Homo sapiens
cctagagggaaggcaggac

SEQ ID NO: 7455824 - DNA, 22 bp, Homo sapiens
cctagcagggaagcagtgagga

SEQ ID NO: 7455825 - DNA, 22 bp, Homo sapiens
cctagcagggaagcagtgagga

SEQ ID NO: 7455826 - DNA, 22 bp, Homo sapiens
cctagcagggagaggatacctg

SEQ ID NO: 7455827 - DNA, 22 bp, Homo sapiens
cctagcagggaagcagtgagga

SEQ ID NO: 7455828 - DNA, 21 bp, Homo sapiens
cctagcctcttacccagcttt

SEQ ID NO: 7455829 - DNA, 22 bp, Homo sapiens
cctagcagaagctgcaatgcct

SEQ ID NO: 7455830 - DNA, 21 bp, Homo sapiens
cctagcctcttacccagcttt

SEQ ID NO: 7455831 - DNA, 22 bp, Homo sapiens
cctagccccagatatctcacac

SEQ ID NO: 7455832 - DNA, 18 bp, Homo sapiens
cctagcctccaagctcat

SEQ ID NO: 7455833 - DNA, 22 bp, Homo sapiens
cctagccttcggcctacccatc

SEQ ID NO: 7455834 - DNA, 22 bp, Homo sapiens
cctagccttcggcctacccatc

SEQ ID NO: 7455835 - DNA, 18 bp, Homo sapiens
cctaggaaagggaggcaa

SEQ ID NO: 7455836 - DNA, 22 bp, Homo sapiens
cctagccttcggcctacccatc

SEQ ID NO: 7455837 - DNA, 22 bp, Homo sapiens
tggcagaggaggctcagattga

SEQ ID NO: 7455838 - DNA, 22 bp, Homo sapiens
tggcagaggaggctcagattga

SEQ ID NO: 7455839 - DNA, 22 bp, Homo sapiens
tggcagaggaggctcagattga

SEQ ID NO: 7455840 - DNA, 22 bp, Homo sapiens
tggcagaggaggctcagattga

SEQ ID NO: 7455841 - DNA, 22 bp, Homo sapiens
tggcagaggagaattaagatta

SEQ ID NO: 7455842 - DNA, 22 bp, Homo sapiens
tggcagaggagaattaagatta

SEQ ID NO: 7455843 - DNA, 22 bp, Homo sapiens
tggcagaggagaattaagatta

SEQ ID NO: 7455844 - DNA, 22 bp, Homo sapiens
tggcagaggagaattaagatta

SEQ ID NO: 7455845 - DNA, 22 bp, Homo sapiens
tggcagaggagaattaagatta

SEQ ID NO: 7455846 - DNA, 19 bp, Homo sapiens
tggcagaggcagtttgtac

SEQ ID NO: 7455847 - DNA, 19 bp, Homo sapiens
tggcagaggcagtttgtac

SEQ ID NO: 7455848 - DNA, 19 bp, Homo sapiens
tggcagaggcagtttgtac

SEQ ID NO: 7455849 - DNA, 19 bp, Homo sapiens
tggcagaggcagtttgtac

SEQ ID NO: 7455850 - DNA, 19 bp, Homo sapiens
tggcagaggcagtttgtac

SEQ ID NO: 7455851 - DNA, 19 bp, Homo sapiens
tggcagaggcagtttgtac

SEQ ID NO: 7455852 - DNA, 22 bp, Homo sapiens
tggcagaggctctgtgatgttg

SEQ ID NO: 7455853 - DNA, 22 bp, Homo sapiens
tggcagaggctctgtgatgttg

SEQ ID NO: 7455854 - DNA, 22 bp, Homo sapiens
tggcagaggctctgtgatgttg

SEQ ID NO: 7455855 - DNA, 22 bp, Homo sapiens
tggcagaggctctgtgatgttg

SEQ ID NO: 7455856 - DNA, 22 bp, Homo sapiens
tggcagaggctctgtgatgttg

SEQ ID NO: 7455857 - DNA, 22 bp, Homo sapiens
tggcagaggctctgtgatgttg

SEQ ID NO: 7455858 - DNA, 22 bp, Homo sapiens
tggcagaggctctgtgatgttg

SEQ ID NO: 7455859 - DNA, 22 bp, Homo sapiens
tggcagaggctctgtgatgttg

SEQ ID NO: 7455860 - DNA, 22 bp, Homo sapiens
tggcagaggctctgtgatgttg

SEQ ID NO: 7455861 - DNA, 22 bp, Homo sapiens
tggcagaggctctgtgatgttg

SEQ ID NO: 7455862 - DNA, 22 bp, Homo sapiens
tggcagaggtaattcaaatccc

SEQ ID NO: 7455863 - DNA, 22 bp, Homo sapiens
tggcagaggtaattcaaatccc

SEQ ID NO: 7455864 - DNA, 22 bp, Homo sapiens
tggcagaggtaattcaaatccc

SEQ ID NO: 7455865 - DNA, 18 bp, Homo sapiens
cctaagctccagccccag

SEQ ID NO: 7455866 - DNA, 22 bp, Homo sapiens
cctaagagattattgctcctgc

SEQ ID NO: 7455867 - DNA, 22 bp, Homo sapiens
cctaagaattaatgaatacacc

SEQ ID NO: 7455868 - DNA, 22 bp, Homo sapiens
cctaagaattaatgaatacacc

SEQ ID NO: 7455869 - DNA, 22 bp, Homo sapiens
cctaagaattaatgaatacacc

SEQ ID NO: 7455870 - DNA, 22 bp, Homo sapiens
cctaagaattaatgaatacacc

SEQ ID NO: 7455871 - DNA, 22 bp, Homo sapiens
tggcagaggtaattcaaatccc

SEQ ID NO: 7455872 - DNA, 22 bp, Homo sapiens
tggcagaggtaattcaaatccc

SEQ ID NO: 7455873 - DNA, 22 bp, Homo sapiens
tggcagggttggccaccttacc

SEQ ID NO: 7455874 - DNA, 22 bp, Homo sapiens
tggcagggttggccaccttacc

SEQ ID NO: 7455875 - DNA, 22 bp, Homo sapiens
tggcagggtgggcttcagcccc

SEQ ID NO: 7455876 - DNA, 22 bp, Homo sapiens
tggcagggttggccaccttacc

SEQ ID NO: 7455877 - DNA, 22 bp, Homo sapiens
tggcagggttggccaccttacc

SEQ ID NO: 7455878 - DNA, 22 bp, Homo sapiens
tggcagggtgggcttcagcccc

SEQ ID NO: 7455879 - DNA, 22 bp, Homo sapiens
tggcagggtgggcttcagcccc

SEQ ID NO: 7455880 - DNA, 22 bp, Homo sapiens
tggcagggtgggcttcagcccc

SEQ ID NO: 7455881 - DNA, 22 bp, Homo sapiens
tggcagggtgggcttcagcccc

SEQ ID NO: 7455882 - DNA, 22 bp, Homo sapiens
tggcagggtgggcttcagcccc

SEQ ID NO: 7455883 - DNA, 22 bp, Homo sapiens
tggcagggtgggcttcagcccc

SEQ ID NO: 7455884 - DNA, 22 bp, Homo sapiens
tggcagggtgggcttcagcccc

SEQ ID NO: 7455885 - DNA, 22 bp, Homo sapiens
cctaggagaggtaatgaagttc

SEQ ID NO: 7455886 - DNA, 22 bp, Homo sapiens
cctaggaaggagtatagtaaat

SEQ ID NO: 7455887 - DNA, 22 bp, Homo sapiens
cctaggaaggagtatagtaaat

SEQ ID NO: 7455888 - DNA, 22 bp, Homo sapiens
cctaggaagctgagattgcagt

SEQ ID NO: 7455889 - DNA, 22 bp, Homo sapiens
cctaggagaggtaatgaagttc

SEQ ID NO: 7455890 - DNA, 22 bp, Homo sapiens
cctaggagttcgaagctgcagt

SEQ ID NO: 7455891 - DNA, 22 bp, Homo sapiens
cctaggagttgaggtggccaga

SEQ ID NO: 7455892 - DNA, 22 bp, Homo sapiens
cctaggagttcgaagctgcagt

SEQ ID NO: 7455893 - DNA, 22 bp, Homo sapiens
cctaggcccattaattcccctt

SEQ ID NO: 7455894 - DNA, 22 bp, Homo sapiens
cctaggcccattaattcccctt

SEQ ID NO: 7455895 - DNA, 22 bp, Homo sapiens
tggcagggtggcaacttttggt

SEQ ID NO: 7455896 - DNA, 22 bp, Homo sapiens
cctaggagttcgaagctgcagt

SEQ ID NO: 7455897 - DNA, 22 bp, Homo sapiens
cctaggagttgaggtggccaga

SEQ ID NO: 7455898 - DNA, 22 bp, Homo sapiens
cctaggcaagagttggtgtgga

SEQ ID NO: 7455899 - DNA, 20 bp, Homo sapiens
cctaggcatgctgagtctcc

SEQ ID NO: 7455900 - DNA, 20 bp, Homo sapiens
cctaggcatgctgagtctcc

SEQ ID NO: 7455901 - DNA, 22 bp, Homo sapiens
cctcagaggtgtggcatctctg

SEQ ID NO: 7455902 - DNA, 22 bp, Homo sapiens
cctcagaggttctgtgtgggaa

SEQ ID NO: 7455903 - DNA, 22 bp, Homo sapiens
cctcagaggtgtggcatctctg

SEQ ID NO: 7455904 - DNA, 22 bp, Homo sapiens
cctcagaggtgtggcatctctg

SEQ ID NO: 7455905 - DNA, 22 bp, Homo sapiens
cctcagaggtgtggcatctctg

SEQ ID NO: 7455906 - DNA, 22 bp, Homo sapiens
cctcagaggtgaacatcagtgc

SEQ ID NO: 7455907 - DNA, 22 bp, Homo sapiens
cctcagaggtgaacatcagtgc

SEQ ID NO: 7455908 - DNA, 23 bp, Homo sapiens
cctcagaggcctcatagtctggc

SEQ ID NO: 7455909 - DNA, 22 bp, Homo sapiens
cctcagaggcatggttagaata

SEQ ID NO: 7455910 - DNA, 22 bp, Homo sapiens
cctcagaggcagatggtaagaa

SEQ ID NO: 7455911 - DNA, 22 bp, Homo sapiens
cctcagaggcagatggtaagaa

SEQ ID NO: 7455912 - DNA, 22 bp, Homo sapiens
cctcagaatagtcctcagatca

SEQ ID NO: 7455913 - DNA, 22 bp, Homo sapiens
cctcagaaggacaagagacaaa

SEQ ID NO: 7455914 - DNA, 18 bp, Homo sapiens
cctcagaggcaaattgtt

SEQ ID NO: 7455915 - DNA, 22 bp, Homo sapiens
cctcagaatagtcctcagatca

SEQ ID NO: 7455916 - DNA, 22 bp, Homo sapiens
cctcagaaggacaagagacaaa

SEQ ID NO: 7455917 - DNA, 22 bp, Homo sapiens
cctcagaaggacaagagacaaa

SEQ ID NO: 7455918 - DNA, 22 bp, Homo sapiens
tggcaggtagagttctgagatg

SEQ ID NO: 7455919 - DNA, 22 bp, Homo sapiens
tggcaggtagtcagaggcgaca

SEQ ID NO: 7455920 - DNA, 22 bp, Homo sapiens
tggcaggtagagttctgagatg

SEQ ID NO: 7455921 - DNA, 22 bp, Homo sapiens
tggcaggtacccattggctgta

SEQ ID NO: 7455922 - DNA, 18 bp, Homo sapiens
tggcaggtagactcaggt

SEQ ID NO: 7455923 - DNA, 18 bp, Homo sapiens
tggcaggtagactcaggt

SEQ ID NO: 7455924 - DNA, 22 bp, Homo sapiens
tggcaggtagagttctgagatg

SEQ ID NO: 7455925 - DNA, 18 bp, Homo sapiens
tggcaggtagactcaggt

SEQ ID NO: 7455926 - DNA, 22 bp, Homo sapiens
tggcaggtacccattggctgta

SEQ ID NO: 7455927 - DNA, 18 bp, Homo sapiens
tggcaggtagactcaggt

SEQ ID NO: 7455928 - DNA, 22 bp, Homo sapiens
ccctgcagcttttgcatagtca

SEQ ID NO: 7455929 - DNA, 22 bp, Homo sapiens
ccctgcagcttttgcatagtca

SEQ ID NO: 7455930 - DNA, 22 bp, Homo sapiens
ccctgcagcttttgcatagtca

SEQ ID NO: 7455931 - DNA, 21 bp, Homo sapiens
ccctgcaggccagggctgagc

SEQ ID NO: 7455932 - DNA, 22 bp, Homo sapiens
ccctgcagcttttgcatagtca

SEQ ID NO: 7455933 - DNA, 22 bp, Homo sapiens
ccctgcagcttttgcatagtca

SEQ ID NO: 7455934 - DNA, 22 bp, Homo sapiens
ccctgcagccttgcatgccttc

SEQ ID NO: 7455935 - DNA, 22 bp, Homo sapiens
ccctgcagccttgcatgccttc

SEQ ID NO: 7455936 - DNA, 22 bp, Homo sapiens
ccctgcagccttgcatgccttc

SEQ ID NO: 7455937 - DNA, 21 bp, Homo sapiens
ccctgcaggccagggctgagc

SEQ ID NO: 7455938 - DNA, 21 bp, Homo sapiens
ccctgcaggccagggctgagc

SEQ ID NO: 7455939 - DNA, 21 bp, Homo sapiens
ccctgcaggccagggctgagc

SEQ ID NO: 7455940 - DNA, 21 bp, Homo sapiens
ccctgcaggccagggctgagc

SEQ ID NO: 7455941 - DNA, 21 bp, Homo sapiens
ccctgcaggccagggctgagc

SEQ ID NO: 7455942 - DNA, 21 bp, Homo sapiens
ccctgcaggccagggctgagc

SEQ ID NO: 7455943 - DNA, 22 bp, Homo sapiens
ccctgcaggctcagactggagt

SEQ ID NO: 7455944 - DNA, 22 bp, Homo sapiens
ccctgcaggctcagactggagt

SEQ ID NO: 7455945 - DNA, 22 bp, Homo sapiens
ccctgcaggctcagactggagt

SEQ ID NO: 7455946 - DNA, 22 bp, Homo sapiens
ccctgcaggctcagactggagt

SEQ ID NO: 7455947 - DNA, 22 bp, Homo sapiens
ccctgcaggctcagactggagt

SEQ ID NO: 7455948 - DNA, 22 bp, Homo sapiens
ccctgcaggctcagactggagt

SEQ ID NO: 7455949 - DNA, 22 bp, Homo sapiens
ccctgcaggggacctgcagcct

SEQ ID NO: 7455950 - DNA, 22 bp, Homo sapiens
ccctgcaggggacctgcagcct

SEQ ID NO: 7455951 - DNA, 22 bp, Homo sapiens
ccctgcaggggacctgcagcct

SEQ ID NO: 7455952 - DNA, 22 bp, Homo sapiens
ccctgcagggaggattctgaag

SEQ ID NO: 7455953 - DNA, 22 bp, Homo sapiens
ccctgcaggggacctgcagcct

SEQ ID NO: 7455954 - DNA, 22 bp, Homo sapiens
ccctgcaggctcagactggagt

SEQ ID NO: 7455955 - DNA, 22 bp, Homo sapiens
ccctgcaggggacctgcagcct

SEQ ID NO: 7455956 - DNA, 22 bp, Homo sapiens
ccctgcaggggacctgcagcct

SEQ ID NO: 7455957 - DNA, 23 bp, Homo sapiens
ccctgcagtcagggtgagatggt

SEQ ID NO: 7455958 - DNA, 23 bp, Homo sapiens
ccctgcagtcagggtgagatggt

SEQ ID NO: 7455959 - DNA, 23 bp, Homo sapiens
ccctgcagtcagggtgagatggt

SEQ ID NO: 7455960 - DNA, 22 bp, Homo sapiens
ccctgcaggggacctgcagcct

SEQ ID NO: 7455961 - DNA, 22 bp, Homo sapiens
ccctgcaggggacctgcagcct

SEQ ID NO: 7455962 - DNA, 23 bp, Homo sapiens
ccctgcagtcagggtgagatggt

SEQ ID NO: 7455963 - DNA, 23 bp, Homo sapiens
ccctgcagtcagggtgagatggt

SEQ ID NO: 7455964 - DNA, 22 bp, Homo sapiens
ccctgtgggccatgtgtctaca

SEQ ID NO: 7455965 - DNA, 22 bp, Homo sapiens
ccctgtgggaactcctgagttg

SEQ ID NO: 7455966 - DNA, 22 bp, Homo sapiens
ccctgtgggccatgtgtctaca

SEQ ID NO: 7455967 - DNA, 22 bp, Homo sapiens
tggagcagggcatcactgtgcg

SEQ ID NO: 7455968 - DNA, 22 bp, Homo sapiens
tggagcagggcatcactgtgcg

SEQ ID NO: 7455969 - DNA, 22 bp, Homo sapiens
tggagcagggcatcactgtgcg

SEQ ID NO: 7455970 - DNA, 22 bp, Homo sapiens
tggagcagggcatcactgtgcg

SEQ ID NO: 7455971 - DNA, 22 bp, Homo sapiens
tggagcagggcatcactgtgcg

SEQ ID NO: 7455972 - DNA, 22 bp, Homo sapiens
tggagcagggcatcactgtgcg

SEQ ID NO: 7455973 - DNA, 22 bp, Homo sapiens
tggagcagggcatcactgtgcg

SEQ ID NO: 7455974 - DNA, 22 bp, Homo sapiens
tggagcaggccggaagtggctt

SEQ ID NO: 7455975 - DNA, 22 bp, Homo sapiens
tggagcaggccggaagtggctt

SEQ ID NO: 7455976 - DNA, 22 bp, Homo sapiens
tggagcaggccggaagtggctt

SEQ ID NO: 7455977 - DNA, 22 bp, Homo sapiens
tggagcaggcatctttctctct

SEQ ID NO: 7455978 - DNA, 22 bp, Homo sapiens
tggagcaggcatctttctctct

SEQ ID NO: 7455979 - DNA, 22 bp, Homo sapiens
tggagcaggcatctttctctct

SEQ ID NO: 7455980 - DNA, 22 bp, Homo sapiens
tggagcaggcatctttctctct

SEQ ID NO: 7455981 - DNA, 22 bp, Homo sapiens
tggagcaggccggaagtggctt

SEQ ID NO: 7455982 - DNA, 22 bp, Homo sapiens
tggagcaggcatctttctctct

SEQ ID NO: 7455983 - DNA, 22 bp, Homo sapiens
tggagcaggccggaagtggctt

SEQ ID NO: 7455984 - DNA, 22 bp, Homo sapiens
tggagcaggccggaagtggctt

SEQ ID NO: 7455985 - DNA, 22 bp, Homo sapiens
tggagcaggccggaagtggctt

SEQ ID NO: 7455986 - DNA, 22 bp, Homo sapiens
tggagcaggccggaagtggctt

SEQ ID NO: 7455987 - DNA, 22 bp, Homo sapiens
tggagcaggccggaagtggctt

SEQ ID NO: 7455988 - DNA, 18 bp, Homo sapiens
tggagcaggtaggcatga

SEQ ID NO: 7455989 - DNA, 18 bp, Homo sapiens
tggagcaggtaggcatga

SEQ ID NO: 7455990 - DNA, 22 bp, Homo sapiens
ccctgcagccttgcatgccttc

SEQ ID NO: 7455991 - DNA, 18 bp, Homo sapiens
tggagcaggtaggcatga

SEQ ID NO: 7455992 - DNA, 22 bp, Homo sapiens
ccctgcagccttgcatgccttc

SEQ ID NO: 7455993 - DNA, 22 bp, Homo sapiens
ccctgcagccttgcatgccttc

SEQ ID NO: 7455994 - DNA, 22 bp, Homo sapiens
ccctgcagccttgcatgccttc

SEQ ID NO: 7455995 - DNA, 22 bp, Homo sapiens
ccctgcagccttgcatgccttc

SEQ ID NO: 7455996 - DNA, 22 bp, Homo sapiens
ccctgcagccttgcatgccttc

SEQ ID NO: 7455997 - DNA, 19 bp, Homo sapiens
tggagcagggcccttgttt

SEQ ID NO: 7455998 - DNA, 19 bp, Homo sapiens
tggagcagggcccttgttt

SEQ ID NO: 7455999 - DNA, 19 bp, Homo sapiens
tggagcagggcccttgttt

SEQ ID NO: 7456000 - DNA, 19 bp, Homo sapiens
tggagcagggcccttgttt

SEQ ID NO: 7456001 - DNA, 18 bp, Homo sapiens
tggagcaggtaggcatga

SEQ ID NO: 7456002 - DNA, 18 bp, Homo sapiens
tggagcaggtaggcatga

SEQ ID NO: 7456003 - DNA, 18 bp, Homo sapiens
tggagcaggtaggcatga

SEQ ID NO: 7456004 - DNA, 18 bp, Homo sapiens
tggagcaggtaggcatga

SEQ ID NO: 7456005 - DNA, 18 bp, Homo sapiens
tggagcaggtaggcatga

SEQ ID NO: 7456006 - DNA, 18 bp, Homo sapiens
tggagcaggtaggcatga

SEQ ID NO: 7456007 - DNA, 18 bp, Homo sapiens
tggagcaggtaggcatga

SEQ ID NO: 7456008 - DNA, 21 bp, Homo sapiens
cccttctgctccagctttgcc

SEQ ID NO: 7456009 - DNA, 22 bp, Homo sapiens
cccttctctttcactcactatt

SEQ ID NO: 7456010 - DNA, 22 bp, Homo sapiens
cccttctgtaaatgctgactgg

SEQ ID NO: 7456011 - DNA, 21 bp, Homo sapiens
cccttctgctccagctttgcc

SEQ ID NO: 7456012 - DNA, 21 bp, Homo sapiens
cccttctgctccagctttgcc

SEQ ID NO: 7456013 - DNA, 22 bp, Homo sapiens
cccttctgtaaatgctgactgg

SEQ ID NO: 7456014 - DNA, 22 bp, Homo sapiens
cccttctgtaaatgctgactgg

SEQ ID NO: 7456015 - DNA, 21 bp, Homo sapiens
cccttcttactcaagctcatt

SEQ ID NO: 7456016 - DNA, 21 bp, Homo sapiens
cccttcttactcaagctcatt

SEQ ID NO: 7456017 - DNA, 22 bp, Homo sapiens
cccttccttgtgactggtgggg

SEQ ID NO: 7456018 - DNA, 22 bp, Homo sapiens
cccttccttgtgactggtgggg

SEQ ID NO: 7456019 - DNA, 22 bp, Homo sapiens
cccttccttgtgactggtgggg

SEQ ID NO: 7456020 - DNA, 22 bp, Homo sapiens
cccttccttgtgactggtgggg

SEQ ID NO: 7456021 - DNA, 22 bp, Homo sapiens
cccttccttgtgactggtgggg

SEQ ID NO: 7456022 - DNA, 22 bp, Homo sapiens
cccttccttgtgactggtgggg

SEQ ID NO: 7456023 - DNA, 22 bp, Homo sapiens
cccttctctttcactcactatt

SEQ ID NO: 7456024 - DNA, 22 bp, Homo sapiens
cccttctctttcactcactatt

SEQ ID NO: 7456025 - DNA, 22 bp, Homo sapiens
cccttctctttcactcactatt

SEQ ID NO: 7456026 - DNA, 22 bp, Homo sapiens
cccttctagtccattcttcaca

SEQ ID NO: 7456027 - DNA, 22 bp, Homo sapiens
cccttctctttcactcactatt

SEQ ID NO: 7456028 - DNA, 22 bp, Homo sapiens
tggcagaggagaattaagatta

SEQ ID NO: 7456029 - DNA, 22 bp, Homo sapiens
tggcagaggagaattaagatta

SEQ ID NO: 7456030 - DNA, 19 bp, Homo sapiens
tggcagaggacaaggactt

SEQ ID NO: 7456031 - DNA, 19 bp, Homo sapiens
tggcagaggacaaggactt

SEQ ID NO: 7456032 - DNA, 19 bp, Homo sapiens
tggcagaggacaaggactt

SEQ ID NO: 7456033 - DNA, 19 bp, Homo sapiens
tggcagaggacaaggactt

SEQ ID NO: 7456034 - DNA, 19 bp, Homo sapiens
tggcagaggacaaggactt

SEQ ID NO: 7456035 - DNA, 19 bp, Homo sapiens
tggcagaggacaaggactt

SEQ ID NO: 7456036 - DNA, 19 bp, Homo sapiens
tggcagaggacaaggactt

SEQ ID NO: 7456037 - DNA, 19 bp, Homo sapiens
tggcagaggacaaggactt

SEQ ID NO: 7456038 - DNA, 19 bp, Homo sapiens
tggcagaggacaaggactt

SEQ ID NO: 7456039 - DNA, 19 bp, Homo sapiens
tggcagaggacaaggactt

SEQ ID NO: 7456040 - DNA, 22 bp, Homo sapiens
tggcagaggaaaaagtcactgg

SEQ ID NO: 7456041 - DNA, 21 bp, Homo sapiens
cccttcttgggtcaaagtata

SEQ ID NO: 7456042 - DNA, 22 bp, Homo sapiens
cccttctttgtaataaagatta

SEQ ID NO: 7456043 - DNA, 22 bp, Homo sapiens
cccttctttgtaataaagatta

SEQ ID NO: 7456044 - DNA, 22 bp, Homo sapiens
cccttctttgtaataaagatta

SEQ ID NO: 7456045 - DNA, 21 bp, Homo sapiens
cccttcttgggtcaaagtata

SEQ ID NO: 7456046 - DNA, 21 bp, Homo sapiens
cccttcttgggtcaaagtata

SEQ ID NO: 7456047 - DNA, 22 bp, Homo sapiens
cccttcccttctgggagatcca

SEQ ID NO: 7456048 - DNA, 23 bp, Homo sapiens
ccctgcagtcagggtgagatggt

SEQ ID NO: 7456049 - DNA, 22 bp, Homo sapiens
cccttcctcaaggagctgtgtt

SEQ ID NO: 7456050 - DNA, 22 bp, Homo sapiens
cccttcctcaaggagctgtgtt

SEQ ID NO: 7456051 - DNA, 22 bp, Homo sapiens
cccttcctcaaggagctgtgtt

SEQ ID NO: 7456052 - DNA, 22 bp, Homo sapiens
ccctgtggggtccgcctgtccg

SEQ ID NO: 7456053 - DNA, 22 bp, Homo sapiens
ccctgtggggtccgcctgtccg

SEQ ID NO: 7456054 - DNA, 22 bp, Homo sapiens
ccctgtggggtccgcctgtccg

SEQ ID NO: 7456055 - DNA, 22 bp, Homo sapiens
ccctgtgggccatgtgtctaca

SEQ ID NO: 7456056 - DNA, 22 bp, Homo sapiens
ccctgtgggaactcctgagttg

SEQ ID NO: 7456057 - DNA, 22 bp, Homo sapiens
ccctgtgggccatgtgtctaca

SEQ ID NO: 7456058 - DNA, 22 bp, Homo sapiens
ccctgtggggtccgcctgtccg

SEQ ID NO: 7456059 - DNA, 22 bp, Homo sapiens
ccctgtggtgacaggcctgtct

SEQ ID NO: 7456060 - DNA, 22 bp, Homo sapiens
cccttcctcctcgcctgtcaga

SEQ ID NO: 7456061 - DNA, 22 bp, Homo sapiens
cccttcctcccaggcttctgtg

SEQ ID NO: 7456062 - DNA, 22 bp, Homo sapiens
cccttcctcccaggcttctgtg

SEQ ID NO: 7456063 - DNA, 22 bp, Homo sapiens
cccttcctcccaggcttctgtg

SEQ ID NO: 7456064 - DNA, 22 bp, Homo sapiens
cccttcctcccaggcttctgtg

SEQ ID NO: 7456065 - DNA, 22 bp, Homo sapiens
cccttcctcccaggcttctgtg

SEQ ID NO: 7456066 - DNA, 22 bp, Homo sapiens
cccttcctcaaggagctgtgtt

SEQ ID NO: 7456067 - DNA, 22 bp, Homo sapiens
cccttcctcaaggagctgtgtt

SEQ ID NO: 7456068 - DNA, 22 bp, Homo sapiens
cccttcccttctgggagatcca

SEQ ID NO: 7456069 - DNA, 22 bp, Homo sapiens
cccttcctgggtgtcccggagt

SEQ ID NO: 7456070 - DNA, 22 bp, Homo sapiens
cccttcctggagtaccctctgt

SEQ ID NO: 7456071 - DNA, 22 bp, Homo sapiens
cccttcctgggtgtcccggagt

SEQ ID NO: 7456072 - DNA, 22 bp, Homo sapiens
cccttcctgggtgtcccggagt

SEQ ID NO: 7456073 - DNA, 22 bp, Homo sapiens
cccttcctgggtgtcccggagt

SEQ ID NO: 7456074 - DNA, 22 bp, Homo sapiens
cccttcctgggtgtcccggagt

SEQ ID NO: 7456075 - DNA, 22 bp, Homo sapiens
cccttcctgggtgtcccggagt

SEQ ID NO: 7456076 - DNA, 22 bp, Homo sapiens
cccttccttgattttaactgga

SEQ ID NO: 7456077 - DNA, 22 bp, Homo sapiens
cccttccttgattttaactgga

SEQ ID NO: 7456078 - DNA, 22 bp, Homo sapiens
cccttcctggagtaccctctgt

SEQ ID NO: 7456079 - DNA, 22 bp, Homo sapiens
cccttcctggagtaccctctgt

SEQ ID NO: 7456080 - DNA, 22 bp, Homo sapiens
cccttcctggagtaccctctgt

SEQ ID NO: 7456081 - DNA, 22 bp, Homo sapiens
cccttcctggagtaccctctgt

SEQ ID NO: 7456082 - DNA, 22 bp, Homo sapiens
cccttcctggagtaccctctgt

SEQ ID NO: 7456083 - DNA, 22 bp, Homo sapiens
cccttcctcctcgcctgtcaga

SEQ ID NO: 7456084 - DNA, 22 bp, Homo sapiens
cccttcctcctcgcctgtcaga

SEQ ID NO: 7456085 - DNA, 22 bp, Homo sapiens
cccttcctcctcgcctgtcaga

SEQ ID NO: 7456086 - DNA, 22 bp, Homo sapiens
cccttcctcctcgcctgtcaga

SEQ ID NO: 7456087 - DNA, 22 bp, Homo sapiens
cccttcctcctcgcctgtcaga

SEQ ID NO: 7456088 - DNA, 22 bp, Homo sapiens
cccttcctcctcgcctgtcaga

SEQ ID NO: 7456089 - DNA, 22 bp, Homo sapiens
tgggaaggaatggtgattaata

SEQ ID NO: 7456090 - DNA, 22 bp, Homo sapiens
tgggaaggaatggtgattaata

SEQ ID NO: 7456091 - DNA, 22 bp, Homo sapiens
tgggaaggacagaacataattg

SEQ ID NO: 7456092 - DNA, 22 bp, Homo sapiens
tgggaaggacagaacataattg

SEQ ID NO: 7456093 - DNA, 22 bp, Homo sapiens
tgggaaggacagaacataattg

SEQ ID NO: 7456094 - DNA, 22 bp, Homo sapiens
tgggaaggacagaacataattg

SEQ ID NO: 7456095 - DNA, 22 bp, Homo sapiens
tgggaaggacagaacataattg

SEQ ID NO: 7456096 - DNA, 22 bp, Homo sapiens
tgggaaggacgtgtcagtggca

SEQ ID NO: 7456097 - DNA, 22 bp, Homo sapiens
tgggaaggacgtgtcagtggca

SEQ ID NO: 7456098 - DNA, 22 bp, Homo sapiens
tgggaaggacagaacataattg

SEQ ID NO: 7456099 - DNA, 22 bp, Homo sapiens
tgggaaggaactgcctttagct

SEQ ID NO: 7456100 - DNA, 22 bp, Homo sapiens
tgggaaggaactgcctttagct

SEQ ID NO: 7456101 - DNA, 22 bp, Homo sapiens
tgggaaggaatggtgattaata

SEQ ID NO: 7456102 - DNA, 22 bp, Homo sapiens
tgggaaggaatggtgattaata

SEQ ID NO: 7456103 - DNA, 22 bp, Homo sapiens
tgggaaggaactgcctttagct

SEQ ID NO: 7456104 - DNA, 22 bp, Homo sapiens
tgggaaggaactgcctttagct

SEQ ID NO: 7456105 - DNA, 22 bp, Homo sapiens
tgggaaggaactgcctttagct

SEQ ID NO: 7456106 - DNA, 22 bp, Homo sapiens
tgggaaggaactgcctttagct

SEQ ID NO: 7456107 - DNA, 22 bp, Homo sapiens
tgggaaggaactgcctttagct

SEQ ID NO: 7456108 - DNA, 22 bp, Homo sapiens
cctctggacttgggacagtgag

SEQ ID NO: 7456109 - DNA, 22 bp, Homo sapiens
cctctggacttgggacagtgag

SEQ ID NO: 7456110 - DNA, 22 bp, Homo sapiens
cctctggacttgggacagtgag

SEQ ID NO: 7456111 - DNA, 22 bp, Homo sapiens
cctctggacttgggacagtgag

SEQ ID NO: 7456112 - DNA, 22 bp, Homo sapiens
cctctggagtcagaccagcttg

SEQ ID NO: 7456113 - DNA, 22 bp, Homo sapiens
tgggaagctactcatgcaggca

SEQ ID NO: 7456114 - DNA, 22 bp, Homo sapiens
cctctggacttgggacagtgag

SEQ ID NO: 7456115 - DNA, 22 bp, Homo sapiens
cctctggaggctctaagagaga

SEQ ID NO: 7456116 - DNA, 22 bp, Homo sapiens
cctctggaggctctaagagaga

SEQ ID NO: 7456117 - DNA, 22 bp, Homo sapiens
tgggaagctttaaatgggtgtc

SEQ ID NO: 7456118 - DNA, 22 bp, Homo sapiens
tgggaagctgcattttaacaag

SEQ ID NO: 7456119 - DNA, 22 bp, Homo sapiens
tgggaagctgcattttaacaag

SEQ ID NO: 7456120 - DNA, 22 bp, Homo sapiens
tgggaagctactcatgcaggca

SEQ ID NO: 7456121 - DNA, 22 bp, Homo sapiens
tgggaagctactcatgcaggca

SEQ ID NO: 7456122 - DNA, 22 bp, Homo sapiens
cctctgctgctgttgagcaccg

SEQ ID NO: 7456123 - DNA, 22 bp, Homo sapiens
tgggaagctgcattttaacaag

SEQ ID NO: 7456124 - DNA, 22 bp, Homo sapiens
tgggaagctgcattttaacaag

SEQ ID NO: 7456125 - DNA, 22 bp, Homo sapiens
tgggaaggatacgttacaagat

SEQ ID NO: 7456126 - DNA, 22 bp, Homo sapiens
tgggaaggatacgttacaagat

SEQ ID NO: 7456127 - DNA, 22 bp, Homo sapiens
tgggaaggcagtcactgtccta

SEQ ID NO: 7456128 - DNA, 22 bp, Homo sapiens
tgggaaggataccttggaacat

SEQ ID NO: 7456129 - DNA, 22 bp, Homo sapiens
tgggaaggataccttggaacat

SEQ ID NO: 7456130 - DNA, 22 bp, Homo sapiens
tgggaaggatacgttacaagat

SEQ ID NO: 7456131 - DNA, 22 bp, Homo sapiens
tgggaaggatacgttacaagat

SEQ ID NO: 7456132 - DNA, 22 bp, Homo sapiens
tgggaaggatacgttacaagat

SEQ ID NO: 7456133 - DNA, 22 bp, Homo sapiens
tgggaaggacgtgtcagtggca

SEQ ID NO: 7456134 - DNA, 22 bp, Homo sapiens
tgggaaggacgtgtcagtggca

SEQ ID NO: 7456135 - DNA, 22 bp, Homo sapiens
tgggaaggacgtgtcagtggca

SEQ ID NO: 7456136 - DNA, 22 bp, Homo sapiens
tgggaaggacgtgtcagtggca

SEQ ID NO: 7456137 - DNA, 22 bp, Homo sapiens
tgggaaggacgtgtcagtggca

SEQ ID NO: 7456138 - DNA, 22 bp, Homo sapiens
tgggaaggataccttggaacat

SEQ ID NO: 7456139 - DNA, 22 bp, Homo sapiens
tgggaaggataccttggaacat

SEQ ID NO: 7456140 - DNA, 22 bp, Homo sapiens
tgggaaggacgtgtcagtggca

SEQ ID NO: 7456141 - DNA, 22 bp, Homo sapiens
tgggaaggacgtgtcagtggca

SEQ ID NO: 7456142 - DNA, 19 bp, Homo sapiens
cctctgtgggagtcagtga

SEQ ID NO: 7456143 - DNA, 19 bp, Homo sapiens
cctctgtgggagtcagtga

SEQ ID NO: 7456144 - DNA, 22 bp, Homo sapiens
cctcttccagctgttgcttcca

SEQ ID NO: 7456145 - DNA, 22 bp, Homo sapiens
cctcttccagctgttgcttcca

SEQ ID NO: 7456146 - DNA, 19 bp, Homo sapiens
cctctgtgggagtcagtga

SEQ ID NO: 7456147 - DNA, 22 bp, Homo sapiens
cctcttccagctgttgcttcca

SEQ ID NO: 7456148 - DNA, 22 bp, Homo sapiens
cctctgtggccttggaccagct

SEQ ID NO: 7456149 - DNA, 22 bp, Homo sapiens
cctctgtggccctgactctctt

SEQ ID NO: 7456150 - DNA, 22 bp, Homo sapiens
cctctgtggccttggaccagct

SEQ ID NO: 7456151 - DNA, 22 bp, Homo sapiens
cctctgtggccttggaccagct

SEQ ID NO: 7456152 - DNA, 22 bp, Homo sapiens
tgggaaggcagtcactgtccta

SEQ ID NO: 7456153 - DNA, 22 bp, Homo sapiens
tgggaaggcagtcactgtccta

SEQ ID NO: 7456154 - DNA, 22 bp, Homo sapiens
tgggaaggcagtcactgtccta

SEQ ID NO: 7456155 - DNA, 22 bp, Homo sapiens
tgggaaggatacgttacaagat

SEQ ID NO: 7456156 - DNA, 22 bp, Homo sapiens
tgggaaggcagtcactgtccta

SEQ ID NO: 7456157 - DNA, 22 bp, Homo sapiens
tgggaaggcagtcactgtccta

SEQ ID NO: 7456158 - DNA, 22 bp, Homo sapiens
tgggaaggcagtcactgtccta

SEQ ID NO: 7456159 - DNA, 22 bp, Homo sapiens
tgggaaggcagtcactgtccta

SEQ ID NO: 7456160 - DNA, 22 bp, Homo sapiens
cctctgctctggtccatgtgct

SEQ ID NO: 7456161 - DNA, 22 bp, Homo sapiens
cctctgctctggtccatgtgct

SEQ ID NO: 7456162 - DNA, 22 bp, Homo sapiens
cctctgctctggtccatgtgct

SEQ ID NO: 7456163 - DNA, 22 bp, Homo sapiens
cctctgctctggtccatgtgct

SEQ ID NO: 7456164 - DNA, 22 bp, Homo sapiens
cctctgctctggtccatgtgct

SEQ ID NO: 7456165 - DNA, 22 bp, Homo sapiens
cctctgctctggtccatgtgct

SEQ ID NO: 7456166 - DNA, 22 bp, Homo sapiens
cctctgctctggtccatgtgct

SEQ ID NO: 7456167 - DNA, 22 bp, Homo sapiens
cctctgctctggtccatgtgct

SEQ ID NO: 7456168 - DNA, 22 bp, Homo sapiens
cctctgctgctgttgagcaccg

SEQ ID NO: 7456169 - DNA, 22 bp, Homo sapiens
cctctgctctggtccatgtgct

SEQ ID NO: 7456170 - DNA, 22 bp, Homo sapiens
cctctgcgtctctccacactga

SEQ ID NO: 7456171 - DNA, 19 bp, Homo sapiens
cctctgctccagtttcctt

SEQ ID NO: 7456172 - DNA, 19 bp, Homo sapiens
cctctgctccagtttcctt

SEQ ID NO: 7456173 - DNA, 22 bp, Homo sapiens
cctctgctccctggtgtctgag

SEQ ID NO: 7456174 - DNA, 22 bp, Homo sapiens
cctctgctccctggtgtctgag

SEQ ID NO: 7456175 - DNA, 22 bp, Homo sapiens
cctctgctccctggtgtctgag

SEQ ID NO: 7456176 - DNA, 21 bp, Homo sapiens
cctctgctcgggcatgcgttt

SEQ ID NO: 7456177 - DNA, 21 bp, Homo sapiens
cctctgctcgggcatgcgttt

SEQ ID NO: 7456178 - DNA, 21 bp, Homo sapiens
cctctgctcgggcatgcgttt

SEQ ID NO: 7456179 - DNA, 20 bp, Homo sapiens
cctctgcctttctagtctga

SEQ ID NO: 7456180 - DNA, 20 bp, Homo sapiens
cctctgcctttctagtctga

SEQ ID NO: 7456181 - DNA, 20 bp, Homo sapiens
cctctgcctttctagtctga

SEQ ID NO: 7456182 - DNA, 20 bp, Homo sapiens
cctctgcctttctagtctga

SEQ ID NO: 7456183 - DNA, 22 bp, Homo sapiens
cctctgcctttagtgaaagttg

SEQ ID NO: 7456184 - DNA, 22 bp, Homo sapiens
cctctgcgcccttgatcagcca

SEQ ID NO: 7456185 - DNA, 19 bp, Homo sapiens
cctctgcgctgtcctgctc

SEQ ID NO: 7456186 - DNA, 22 bp, Homo sapiens
cctctgcgcccttgatcagcca

SEQ ID NO: 7456187 - DNA, 22 bp, Homo sapiens
cctctgcgcccttgatcagcca

SEQ ID NO: 7456188 - DNA, 20 bp, Homo sapiens
cctctgcctttctagtctga

SEQ ID NO: 7456189 - DNA, 20 bp, Homo sapiens
cctctgccccggggctgcta

SEQ ID NO: 7456190 - DNA, 20 bp, Homo sapiens
cctctgccccggggctgcta

SEQ ID NO: 7456191 - DNA, 22 bp, Homo sapiens
cctctgagtcctccctggttgc

SEQ ID NO: 7456192 - DNA, 18 bp, Homo sapiens
cctctgccatagccagca

SEQ ID NO: 7456193 - DNA, 22 bp, Homo sapiens
cctctgagtcatgcgcatagga

SEQ ID NO: 7456194 - DNA, 22 bp, Homo sapiens
cctctgcctgcacatcatcctg

SEQ ID NO: 7456195 - DNA, 22 bp, Homo sapiens
cctctgcctgcacatcatcctg

SEQ ID NO: 7456196 - DNA, 22 bp, Homo sapiens
cctctgcccttttcctgtatca

SEQ ID NO: 7456197 - DNA, 22 bp, Homo sapiens
cctctgagtacagtgatggatt

SEQ ID NO: 7456198 - DNA, 22 bp, Homo sapiens
cctctgagtacagtgatggatt

SEQ ID NO: 7456199 - DNA, 22 bp, Homo sapiens
cctctgagtagactggacatga

SEQ ID NO: 7456200 - DNA, 22 bp, Homo sapiens
cctctgagtagactggacatga

SEQ ID NO: 7456201 - DNA, 22 bp, Homo sapiens
cctctgagtcatgcgcatagga

SEQ ID NO: 7456202 - DNA, 22 bp, Homo sapiens
cctctgagtcatgcgcatagga

SEQ ID NO: 7456203 - DNA, 19 bp, Homo sapiens
tggcttccatctctctcat

SEQ ID NO: 7456204 - DNA, 19 bp, Homo sapiens
tggcttccatctctctcat

SEQ ID NO: 7456205 - DNA, 16 bp, Homo sapiens
tggcttcccagagata

SEQ ID NO: 7456206 - DNA, 16 bp, Homo sapiens
tggcttcccagagata

SEQ ID NO: 7456207 - DNA, 22 bp, Homo sapiens
tggcttccagtaatcaggattt

SEQ ID NO: 7456208 - DNA, 22 bp, Homo sapiens
tggcttccagtaatcaggattt

SEQ ID NO: 7456209 - DNA, 19 bp, Homo sapiens
tggcttccatctctctcat

SEQ ID NO: 7456210 - DNA, 22 bp, Homo sapiens
tggcttccagagctgctccacc

SEQ ID NO: 7456211 - DNA, 22 bp, Homo sapiens
tggcttccagtaatcaggattt

SEQ ID NO: 7456212 - DNA, 22 bp, Homo sapiens
tggcttccagtaatcaggattt

SEQ ID NO: 7456213 - DNA, 22 bp, Homo sapiens
tggcttccagagctgctccacc

SEQ ID NO: 7456214 - DNA, 22 bp, Homo sapiens
tggcttccagagctgctccacc

SEQ ID NO: 7456215 - DNA, 22 bp, Homo sapiens
tggcttccagagctgctccacc

SEQ ID NO: 7456216 - DNA, 22 bp, Homo sapiens
tggcttccagaactgagcaaca

SEQ ID NO: 7456217 - DNA, 22 bp, Homo sapiens
tggcttccagaactgagcaaca

SEQ ID NO: 7456218 - DNA, 22 bp, Homo sapiens
tggcttccactgtgtgccccct

SEQ ID NO: 7456219 - DNA, 22 bp, Homo sapiens
tggcttccactgtgtgccccct

SEQ ID NO: 7456220 - DNA, 22 bp, Homo sapiens
tggcttcattcagcatgacagt

SEQ ID NO: 7456221 - DNA, 22 bp, Homo sapiens
tggcttcattcagcatgacagt

SEQ ID NO: 7456222 - DNA, 22 bp, Homo sapiens
tggcttcattcagcatgacagt

SEQ ID NO: 7456223 - DNA, 22 bp, Homo sapiens
tggcttcattattgtttttcct

SEQ ID NO: 7456224 - DNA, 22 bp, Homo sapiens
tggcttcattctgtagttaaaa

SEQ ID NO: 7456225 - DNA, 22 bp, Homo sapiens
tggcttcattcagcatgacagt

SEQ ID NO: 7456226 - DNA, 22 bp, Homo sapiens
tggcttcattcagcatgacagt

SEQ ID NO: 7456227 - DNA, 22 bp, Homo sapiens
tggcttcattctgtagttaaaa

SEQ ID NO: 7456228 - DNA, 22 bp, Homo sapiens
tggcttccaaaggaatgggcct

SEQ ID NO: 7456229 - DNA, 22 bp, Homo sapiens
tggcttccaaattatccctaga

SEQ ID NO: 7456230 - DNA, 22 bp, Homo sapiens
tggcttccaaattatccctaga

SEQ ID NO: 7456231 - DNA, 22 bp, Homo sapiens
tggcttccaaattatccctaga

SEQ ID NO: 7456232 - DNA, 17 bp, Homo sapiens
tggcttcaggctgagca

SEQ ID NO: 7456233 - DNA, 17 bp, Homo sapiens
tggcttcaggctgagca

SEQ ID NO: 7456234 - DNA, 22 bp, Homo sapiens
tggcttcagggttgtcttcagc

SEQ ID NO: 7456235 - DNA, 17 bp, Homo sapiens
tggcttcaggctgagca

SEQ ID NO: 7456236 - DNA, 22 bp, Homo sapiens
tggcttcagtctcatcttggaa

SEQ ID NO: 7456237 - DNA, 22 bp, Homo sapiens
tggcttcagggttgtcttcagc

SEQ ID NO: 7456238 - DNA, 22 bp, Homo sapiens
tggcttcagtctcatcttggaa

SEQ ID NO: 7456239 - DNA, 22 bp, Homo sapiens
tggcttcagttcctgtgttgtt

SEQ ID NO: 7456240 - DNA, 22 bp, Homo sapiens
tggcttcatggcaagtcttagt

SEQ ID NO: 7456241 - DNA, 22 bp, Homo sapiens
tggcttcatctgcagcactgcc

SEQ ID NO: 7456242 - DNA, 22 bp, Homo sapiens
tggcttcatctgcagcactgcc

SEQ ID NO: 7456243 - DNA, 22 bp, Homo sapiens
tggcttcatctgcagcactgcc

SEQ ID NO: 7456244 - DNA, 22 bp, Homo sapiens
tggcttcatctgcagcactgcc

SEQ ID NO: 7456245 - DNA, 22 bp, Homo sapiens
tggcttcatcactcgggctgcc

SEQ ID NO: 7456246 - DNA, 22 bp, Homo sapiens
tggcttcagtttcccagtctgg

SEQ ID NO: 7456247 - DNA, 20 bp, Homo sapiens
tggcttcataatggtttctg

SEQ ID NO: 7456248 - DNA, 22 bp, Homo sapiens
tggctggctgtcaaggaaagcc

SEQ ID NO: 7456249 - DNA, 22 bp, Homo sapiens
tggctggctggaccacacctgc

SEQ ID NO: 7456250 - DNA, 22 bp, Homo sapiens
tggctggctgtcaaggaaagcc

SEQ ID NO: 7456251 - DNA, 22 bp, Homo sapiens
tggctggctgtcagtaggctgt

SEQ ID NO: 7456252 - DNA, 22 bp, Homo sapiens
tggctggctgtcagtaggctgt

SEQ ID NO: 7456253 - DNA, 22 bp, Homo sapiens
tggctggctgtcagtaggctgt

SEQ ID NO: 7456254 - DNA, 22 bp, Homo sapiens
tggctggctgtcaaggaaagcc

SEQ ID NO: 7456255 - DNA, 22 bp, Homo sapiens
tggctggctgtcagtaggctgt

SEQ ID NO: 7456256 - DNA, 22 bp, Homo sapiens
tggctggctgtccagctgggca

SEQ ID NO: 7456257 - DNA, 22 bp, Homo sapiens
tggctggctgtccagctgggca

SEQ ID NO: 7456258 - DNA, 22 bp, Homo sapiens
tggctggctgtccagctgggca

SEQ ID NO: 7456259 - DNA, 22 bp, Homo sapiens
tggctggctgtccagctgggca

SEQ ID NO: 7456260 - DNA, 22 bp, Homo sapiens
tggctggctgtccagctgggca

SEQ ID NO: 7456261 - DNA, 22 bp, Homo sapiens
tggctggctgtcagtaggctgt

SEQ ID NO: 7456262 - DNA, 22 bp, Homo sapiens
tggctggctgtccagctgggca

SEQ ID NO: 7456263 - DNA, 22 bp, Homo sapiens
tggctggctgtccagctgggca

SEQ ID NO: 7456264 - DNA, 22 bp, Homo sapiens
tggctggctgtccagctgggca

SEQ ID NO: 7456265 - DNA, 22 bp, Homo sapiens
tggctggctgtccagctgggca

SEQ ID NO: 7456266 - DNA, 22 bp, Homo sapiens
tggctggcttgttcactgactg

SEQ ID NO: 7456267 - DNA, 22 bp, Homo sapiens
tggctggcttgttcactgactg

SEQ ID NO: 7456268 - DNA, 22 bp, Homo sapiens
tggctggcttgttcactgactg

SEQ ID NO: 7456269 - DNA, 22 bp, Homo sapiens
tggctggcttgttcactgactg

SEQ ID NO: 7456270 - DNA, 20 bp, Homo sapiens
tggctggcttgtatttcctt

SEQ ID NO: 7456271 - DNA, 22 bp, Homo sapiens
tggctggctgtccagctgggca

SEQ ID NO: 7456272 - DNA, 22 bp, Homo sapiens
tggctggcttgttcactgactg

SEQ ID NO: 7456273 - DNA, 22 bp, Homo sapiens
tggctggcttgttcactgactg

SEQ ID NO: 7456274 - DNA, 22 bp, Homo sapiens
tggctgggagctggaactgggc

SEQ ID NO: 7456275 - DNA, 22 bp, Homo sapiens
tggctgggagctggaactgggc

SEQ ID NO: 7456276 - DNA, 22 bp, Homo sapiens
tggctgggagctggaactgggc

SEQ ID NO: 7456277 - DNA, 22 bp, Homo sapiens
tggctgggagctggaactgggc

SEQ ID NO: 7456278 - DNA, 22 bp, Homo sapiens
tggctgggagctggaactgggc

SEQ ID NO: 7456279 - DNA, 22 bp, Homo sapiens
tggctggctttcttgtatttac

SEQ ID NO: 7456280 - DNA, 22 bp, Homo sapiens
tggctgggagctggaactgggc

SEQ ID NO: 7456281 - DNA, 22 bp, Homo sapiens
tggctgggagctggaactgggc

SEQ ID NO: 7456282 - DNA, 22 bp, Homo sapiens
tggctgggagctggaactgggc

SEQ ID NO: 7456283 - DNA, 19 bp, Homo sapiens
tggctctgtcgaaggcaca

SEQ ID NO: 7456284 - DNA, 19 bp, Homo sapiens
tggctctgtcgaaggcaca

SEQ ID NO: 7456285 - DNA, 19 bp, Homo sapiens
tggctctgtcgaaggcaca

SEQ ID NO: 7456286 - DNA, 22 bp, Homo sapiens
tggctgagaagttctggtggga

SEQ ID NO: 7456287 - DNA, 19 bp, Homo sapiens
tggctctgtcgaaggcaca

SEQ ID NO: 7456288 - DNA, 22 bp, Homo sapiens
tggctgagaatgggatgatgcc

SEQ ID NO: 7456289 - DNA, 22 bp, Homo sapiens
tggctgagaatgggatgatgcc

SEQ ID NO: 7456290 - DNA, 22 bp, Homo sapiens
tggctgagaagttctggtggga

SEQ ID NO: 7456291 - DNA, 22 bp, Homo sapiens
tggctgagaatgggatgatgcc

SEQ ID NO: 7456292 - DNA, 22 bp, Homo sapiens
tggctgagaccatcagggtgta

SEQ ID NO: 7456293 - DNA, 22 bp, Homo sapiens
tggctgagaccatcagggtgta

SEQ ID NO: 7456294 - DNA, 22 bp, Homo sapiens
tggctgagaccatcagggtgta

SEQ ID NO: 7456295 - DNA, 22 bp, Homo sapiens
tggctgagaatgggatgatgcc

SEQ ID NO: 7456296 - DNA, 22 bp, Homo sapiens
tggctgagaatgggatgatgcc

SEQ ID NO: 7456297 - DNA, 22 bp, Homo sapiens
tggctgagaccatcagggtgta

SEQ ID NO: 7456298 - DNA, 22 bp, Homo sapiens
tggctgagaccatcagggtgta

SEQ ID NO: 7456299 - DNA, 17 bp, Homo sapiens
tggctctgtcctcagct

SEQ ID NO: 7456300 - DNA, 17 bp, Homo sapiens
tggctctgtcctcagct

SEQ ID NO: 7456301 - DNA, 17 bp, Homo sapiens
tggctctgtcctcagct

SEQ ID NO: 7456302 - DNA, 17 bp, Homo sapiens
tggctctgtcctcagct

SEQ ID NO: 7456303 - DNA, 17 bp, Homo sapiens
tggctctgtcctcagct

SEQ ID NO: 7456304 - DNA, 17 bp, Homo sapiens
tggctctgtcctcagct

SEQ ID NO: 7456305 - DNA, 22 bp, Homo sapiens
tggctctgtcactgtgagctat

SEQ ID NO: 7456306 - DNA, 22 bp, Homo sapiens
tggctctgtcactgtgagctat

SEQ ID NO: 7456307 - DNA, 22 bp, Homo sapiens
tggctctgtcactgtgagctat

SEQ ID NO: 7456308 - DNA, 22 bp, Homo sapiens
tggctctgtcactgtgagctat

SEQ ID NO: 7456309 - DNA, 22 bp, Homo sapiens
tggctctgtcactgtgagctat

SEQ ID NO: 7456310 - DNA, 22 bp, Homo sapiens
tggctctgtcactgtgagctat

SEQ ID NO: 7456311 - DNA, 17 bp, Homo sapiens
tggctctgtcctcagct

SEQ ID NO: 7456312 - DNA, 17 bp, Homo sapiens
tggctctgtcctcagct

SEQ ID NO: 7456313 - DNA, 17 bp, Homo sapiens
tggctctgtcctcagct

SEQ ID NO: 7456314 - DNA, 17 bp, Homo sapiens
tggctctgtcctcagct

SEQ ID NO: 7456315 - DNA, 19 bp, Homo sapiens
tggctctgtcgaaggcaca

SEQ ID NO: 7456316 - DNA, 17 bp, Homo sapiens
tggctctgtcctcagct

SEQ ID NO: 7456317 - DNA, 19 bp, Homo sapiens
tggctctgtcgaaggcaca

SEQ ID NO: 7456318 - DNA, 17 bp, Homo sapiens
tggctctgtcctcagct

SEQ ID NO: 7456319 - DNA, 17 bp, Homo sapiens
tggctctgtcctcagct

SEQ ID NO: 7456320 - DNA, 22 bp, Homo sapiens
tggctgagaccttcccaaattc

SEQ ID NO: 7456321 - DNA, 22 bp, Homo sapiens
tggctgagaccatcagggtgta

SEQ ID NO: 7456322 - DNA, 22 bp, Homo sapiens
tggctgagaccttcccaaattc

SEQ ID NO: 7456323 - DNA, 22 bp, Homo sapiens
tggctgagaccatcagggtgta

SEQ ID NO: 7456324 - DNA, 22 bp, Homo sapiens
tggctgagaccatcagggtgta

SEQ ID NO: 7456325 - DNA, 22 bp, Homo sapiens
tggctgagagaagacggggaag

SEQ ID NO: 7456326 - DNA, 22 bp, Homo sapiens
tggctgagaccttcccaaattc

SEQ ID NO: 7456327 - DNA, 22 bp, Homo sapiens
tggctgagagaagacggggaag

SEQ ID NO: 7456328 - DNA, 16 bp, Homo sapiens
tggctgagagagggtt

SEQ ID NO: 7456329 - DNA, 16 bp, Homo sapiens
tggctgagagagggtt

SEQ ID NO: 7456330 - DNA, 22 bp, Homo sapiens
tggctgctagccagagcttcag

SEQ ID NO: 7456331 - DNA, 22 bp, Homo sapiens
tggctgctagccagagcttcag

SEQ ID NO: 7456332 - DNA, 22 bp, Homo sapiens
tggctgctagccagagcttcag

SEQ ID NO: 7456333 - DNA, 22 bp, Homo sapiens
tggctgctactgagggggtctg

SEQ ID NO: 7456334 - DNA, 22 bp, Homo sapiens
tggctgagagaagacggggaag

SEQ ID NO: 7456335 - DNA, 22 bp, Homo sapiens
tggctgagagaagacggggaag

SEQ ID NO: 7456336 - DNA, 16 bp, Homo sapiens
tggctgagagagggtt

SEQ ID NO: 7456337 - DNA, 22 bp, Homo sapiens
tggctggctggaccacacctgc

SEQ ID NO: 7456338 - DNA, 22 bp, Homo sapiens
tggctggctggaccacacctgc

SEQ ID NO: 7456339 - DNA, 22 bp, Homo sapiens
tggctggctggaccacacctgc

SEQ ID NO: 7456340 - DNA, 18 bp, Homo sapiens
tggctggctctgtcatct

SEQ ID NO: 7456341 - DNA, 18 bp, Homo sapiens
tggctggctctgtcatct

SEQ ID NO: 7456342 - DNA, 18 bp, Homo sapiens
tggctggctctgtcatct

SEQ ID NO: 7456343 - DNA, 22 bp, Homo sapiens
tggctggctagtgggcaggatt

SEQ ID NO: 7456344 - DNA, 22 bp, Homo sapiens
tggctggctagtgggcaggatt

SEQ ID NO: 7456345 - DNA, 22 bp, Homo sapiens
tggctgctagccagagcttcag

SEQ ID NO: 7456346 - DNA, 22 bp, Homo sapiens
tggctgctagccagagcttcag

SEQ ID NO: 7456347 - DNA, 22 bp, Homo sapiens
tggctgctagccagagcttcag

SEQ ID NO: 7456348 - DNA, 22 bp, Homo sapiens
tggctgctcaagggaggaggct

SEQ ID NO: 7456349 - DNA, 22 bp, Homo sapiens
tggctgctcaagggaggaggct

SEQ ID NO: 7456350 - DNA, 22 bp, Homo sapiens
tggctggctagtgggcaggatt

SEQ ID NO: 7456351 - DNA, 22 bp, Homo sapiens
tggctgctcaagggaggaggct

SEQ ID NO: 7456352 - DNA, 22 bp, Homo sapiens
tggctgctcaagggaggaggct

SEQ ID NO: 7456353 - DNA, 22 bp, Homo sapiens
cctgagctggcagtgacctgga

SEQ ID NO: 7456354 - DNA, 22 bp, Homo sapiens
cctgagctggagacattacata

SEQ ID NO: 7456355 - DNA, 22 bp, Homo sapiens
cctgagctggagacattacata

SEQ ID NO: 7456356 - DNA, 22 bp, Homo sapiens
cctgagctggagacattacata

SEQ ID NO: 7456357 - DNA, 22 bp, Homo sapiens
cctgagctggaagagcttgtgc

SEQ ID NO: 7456358 - DNA, 22 bp, Homo sapiens
cctgagctggaagagcttgtgc

SEQ ID NO: 7456359 - DNA, 22 bp, Homo sapiens
cctgagctggaagagcttgtgc

SEQ ID NO: 7456360 - DNA, 22 bp, Homo sapiens
tggggagcccactcacctcccc

SEQ ID NO: 7456361 - DNA, 22 bp, Homo sapiens
tggggagcccactcacctcccc

SEQ ID NO: 7456362 - DNA, 22 bp, Homo sapiens
cctgagctggcagtgacctgga

SEQ ID NO: 7456363 - DNA, 22 bp, Homo sapiens
cctgagctggcagtgacctgga

SEQ ID NO: 7456364 - DNA, 22 bp, Homo sapiens
tggggaggaagtcagatttcag

SEQ ID NO: 7456365 - DNA, 22 bp, Homo sapiens
cctgagctgcggggcagtgctc

SEQ ID NO: 7456366 - DNA, 22 bp, Homo sapiens
cctgagctgcggggcagtgctc

SEQ ID NO: 7456367 - DNA, 22 bp, Homo sapiens
cctgagctgcggggcagtgctc

SEQ ID NO: 7456368 - DNA, 22 bp, Homo sapiens
cctgagctgcggggcagtgctc

SEQ ID NO: 7456369 - DNA, 22 bp, Homo sapiens
cctgagctgcggggcagtgctc

SEQ ID NO: 7456370 - DNA, 22 bp, Homo sapiens
cctgagctgcggggcagtgctc

SEQ ID NO: 7456371 - DNA, 22 bp, Homo sapiens
cctgagctgactctcctttcag

SEQ ID NO: 7456372 - DNA, 22 bp, Homo sapiens
cctgagctgactctcctttcag

SEQ ID NO: 7456373 - DNA, 22 bp, Homo sapiens
cctgagctctgcactttttaga

SEQ ID NO: 7456374 - DNA, 22 bp, Homo sapiens
cctgagctccagtagcagccag

SEQ ID NO: 7456375 - DNA, 22 bp, Homo sapiens
cctgagctccagtagcagccag

SEQ ID NO: 7456376 - DNA, 22 bp, Homo sapiens
cctgagctccagtagcagccag

SEQ ID NO: 7456377 - DNA, 22 bp, Homo sapiens
cctgagctccagtagcagccag

SEQ ID NO: 7456378 - DNA, 22 bp, Homo sapiens
cctgagctgaactaagcagttt

SEQ ID NO: 7456379 - DNA, 22 bp, Homo sapiens
cctgagctcaaagggtgcctgg

SEQ ID NO: 7456380 - DNA, 22 bp, Homo sapiens
cctgagctcaagaaggtgacca

SEQ ID NO: 7456381 - DNA, 22 bp, Homo sapiens
cctgagctcaagaaggtgacca

SEQ ID NO: 7456382 - DNA, 22 bp, Homo sapiens
cctgagctcaagaaggtgacca

SEQ ID NO: 7456383 - DNA, 22 bp, Homo sapiens
cctgagctcaagaaggtgacca

SEQ ID NO: 7456384 - DNA, 22 bp, Homo sapiens
cctgagctcaagaaggtgacca

SEQ ID NO: 7456385 - DNA, 22 bp, Homo sapiens
cctgagctagggaaggaagacc

SEQ ID NO: 7456386 - DNA, 22 bp, Homo sapiens
cctgagctagggaaggaagacc

SEQ ID NO: 7456387 - DNA, 22 bp, Homo sapiens
cctgagctagggaaggaagacc

SEQ ID NO: 7456388 - DNA, 21 bp, Homo sapiens
cctgagcctgtttatccagaa

SEQ ID NO: 7456389 - DNA, 21 bp, Homo sapiens
cctgagcctgtttatccagaa

SEQ ID NO: 7456390 - DNA, 21 bp, Homo sapiens
cctgagcctgtttatccagaa

SEQ ID NO: 7456391 - DNA, 22 bp, Homo sapiens
cctgagcctggctcatgcactc

SEQ ID NO: 7456392 - DNA, 22 bp, Homo sapiens
cctgagcctggctcatgcactc

SEQ ID NO: 7456393 - DNA, 22 bp, Homo sapiens
tgggctggcccaccacacctcg

SEQ ID NO: 7456394 - DNA, 22 bp, Homo sapiens
cctgagcctggctcatgcactc

SEQ ID NO: 7456395 - DNA, 22 bp, Homo sapiens
tgggctggcccaccacacctcg

SEQ ID NO: 7456396 - DNA, 22 bp, Homo sapiens
tgggctggcccaccacacctcg

SEQ ID NO: 7456397 - DNA, 22 bp, Homo sapiens
tgggctggcccaccacacctcg

SEQ ID NO: 7456398 - DNA, 22 bp, Homo sapiens
tgggctggcccaccacacctcg

SEQ ID NO: 7456399 - DNA, 22 bp, Homo sapiens
tgggctggcccaccacacctcg

SEQ ID NO: 7456400 - DNA, 22 bp, Homo sapiens
tgggctggcccaccacacctcg

SEQ ID NO: 7456401 - DNA, 22 bp, Homo sapiens
tgggctggcccaccacacctcg

SEQ ID NO: 7456402 - DNA, 22 bp, Homo sapiens
tgggctggagcttgttgcttcc

SEQ ID NO: 7456403 - DNA, 22 bp, Homo sapiens
tgggctgcttctcaaatgtctc

SEQ ID NO: 7456404 - DNA, 22 bp, Homo sapiens
tgggctgcttctattggtggtc

SEQ ID NO: 7456405 - DNA, 22 bp, Homo sapiens
tgggctgcttcctcagctgaga

SEQ ID NO: 7456406 - DNA, 22 bp, Homo sapiens
tgggctgcttcctcagctgaga

SEQ ID NO: 7456407 - DNA, 22 bp, Homo sapiens
tgggctgcttcctcagctgaga

SEQ ID NO: 7456408 - DNA, 22 bp, Homo sapiens
tgggctgcttcctcagctgaga

SEQ ID NO: 7456409 - DNA, 22 bp, Homo sapiens
tgggctgctgttacaggggctg

SEQ ID NO: 7456410 - DNA, 22 bp, Homo sapiens
tgggctggagcttgttgcttcc

SEQ ID NO: 7456411 - DNA, 22 bp, Homo sapiens
tgggctggagcttgttgcttcc

SEQ ID NO: 7456412 - DNA, 22 bp, Homo sapiens
tgggctggagcttgttgcttcc

SEQ ID NO: 7456413 - DNA, 22 bp, Homo sapiens
tgggctggagcttgttgcttcc

SEQ ID NO: 7456414 - DNA, 22 bp, Homo sapiens
tgggctggagcttgttgcttcc

SEQ ID NO: 7456415 - DNA, 22 bp, Homo sapiens
tgggctggagcttgttgcttcc

SEQ ID NO: 7456416 - DNA, 22 bp, Homo sapiens
tgggctggagcttgttgcttcc

SEQ ID NO: 7456417 - DNA, 22 bp, Homo sapiens
tgggctggagcttgttgcttcc

SEQ ID NO: 7456418 - DNA, 22 bp, Homo sapiens
tgggctggcccaccacacctcg

SEQ ID NO: 7456419 - DNA, 22 bp, Homo sapiens
tgggcccatcattgctgtgggc

SEQ ID NO: 7456420 - DNA, 22 bp, Homo sapiens
tgggccccagcacgtctgggga

SEQ ID NO: 7456421 - DNA, 22 bp, Homo sapiens
tgggccccagcacgtctgggga

SEQ ID NO: 7456422 - DNA, 22 bp, Homo sapiens
tgggccccagcacgtctgggga

SEQ ID NO: 7456423 - DNA, 22 bp, Homo sapiens
tgggccccagcacgtctgggga

SEQ ID NO: 7456424 - DNA, 22 bp, Homo sapiens
tgggccccagcacgtctgggga

SEQ ID NO: 7456425 - DNA, 22 bp, Homo sapiens
tgggccccttggtttcctgagc

SEQ ID NO: 7456426 - DNA, 22 bp, Homo sapiens
tgggccccttggtttcctgagc

SEQ ID NO: 7456427 - DNA, 22 bp, Homo sapiens
tgggccctgacttcaagcatcc

SEQ ID NO: 7456428 - DNA, 22 bp, Homo sapiens
tgggcccgcgcaaaggactcca

SEQ ID NO: 7456429 - DNA, 22 bp, Homo sapiens
tgggccctgacttcaagcatcc

SEQ ID NO: 7456430 - DNA, 22 bp, Homo sapiens
tgggccctgacttcaagcatcc

SEQ ID NO: 7456431 - DNA, 22 bp, Homo sapiens
tgggccctgacttcaagcatcc

SEQ ID NO: 7456432 - DNA, 22 bp, Homo sapiens
tgggccctgacttcaagcatcc

SEQ ID NO: 7456433 - DNA, 23 bp, Homo sapiens
tgggccctggagtcgccagtctg

SEQ ID NO: 7456434 - DNA, 23 bp, Homo sapiens
tgggccctggagtcgccagtctg

SEQ ID NO: 7456435 - DNA, 23 bp, Homo sapiens
tgggccctggagtcgccagtctg

SEQ ID NO: 7456436 - DNA, 22 bp, Homo sapiens
tgggccctggtggccatgcctc

SEQ ID NO: 7456437 - DNA, 22 bp, Homo sapiens
tgggccctggtggccatgcctc

SEQ ID NO: 7456438 - DNA, 22 bp, Homo sapiens
tgggccctggtggccatgcctc

SEQ ID NO: 7456439 - DNA, 22 bp, Homo sapiens
tgggccctggtggccatgcctc

SEQ ID NO: 7456440 - DNA, 22 bp, Homo sapiens
tgggccctggtggccatgcctc

SEQ ID NO: 7456441 - DNA, 22 bp, Homo sapiens
tgggccctgcccttgtctgtcc

SEQ ID NO: 7456442 - DNA, 22 bp, Homo sapiens
tgggccctgcccttgtctgtcc

SEQ ID NO: 7456443 - DNA, 22 bp, Homo sapiens
tgggccctgcccttgtctgtcc

SEQ ID NO: 7456444 - DNA, 23 bp, Homo sapiens
tgggccctggagtcgccagtctg

SEQ ID NO: 7456445 - DNA, 22 bp, Homo sapiens
tgggccctgcccttgtctgtcc

SEQ ID NO: 7456446 - DNA, 22 bp, Homo sapiens
tgggcccatcattgctgtgggc

SEQ ID NO: 7456447 - DNA, 22 bp, Homo sapiens
tgggcccaggtcctgggagaag

SEQ ID NO: 7456448 - DNA, 22 bp, Homo sapiens
tgggcccaggtcctgggagaag

SEQ ID NO: 7456449 - DNA, 21 bp, Homo sapiens
tgggcccagttcccgctgggc

SEQ ID NO: 7456450 - DNA, 21 bp, Homo sapiens
tgggcccagttcccgctgggc

SEQ ID NO: 7456451 - DNA, 22 bp, Homo sapiens
tgggcccaggtcctgggagaag

SEQ ID NO: 7456452 - DNA, 22 bp, Homo sapiens
tgggcccaggtcctgggagaag

SEQ ID NO: 7456453 - DNA, 22 bp, Homo sapiens
tgggcccaagtgcaatgcagtg

SEQ ID NO: 7456454 - DNA, 22 bp, Homo sapiens
tgggcccaagtgcaatgcagtg

SEQ ID NO: 7456455 - DNA, 22 bp, Homo sapiens
tgggcccaagagagtctccaac

SEQ ID NO: 7456456 - DNA, 22 bp, Homo sapiens
tgggcccaagagagtctccaac

SEQ ID NO: 7456457 - DNA, 21 bp, Homo sapiens
tgggcccagctctgtctgttt

SEQ ID NO: 7456458 - DNA, 21 bp, Homo sapiens
tgggcccagctctgtctgttt

SEQ ID NO: 7456459 - DNA, 22 bp, Homo sapiens
tgggcccacatgcctttctgcc

SEQ ID NO: 7456460 - DNA, 22 bp, Homo sapiens
tgggcccacatgcctttctgcc

SEQ ID NO: 7456461 - DNA, 22 bp, Homo sapiens
tgggcccaagtgcaatgcagtg

SEQ ID NO: 7456462 - DNA, 22 bp, Homo sapiens
tgggcccttatgaagctcaaga

SEQ ID NO: 7456463 - DNA, 22 bp, Homo sapiens
tgggcccttatgaagctcaaga

SEQ ID NO: 7456464 - DNA, 23 bp, Homo sapiens
tgggcccttggaatctctatttt

SEQ ID NO: 7456465 - DNA, 22 bp, Homo sapiens
tgggctctagactttagtgtgg

SEQ ID NO: 7456466 - DNA, 22 bp, Homo sapiens
tgggctctagactttagtgtgg

SEQ ID NO: 7456467 - DNA, 22 bp, Homo sapiens
tgggctccttgggagcaagtga

SEQ ID NO: 7456468 - DNA, 22 bp, Homo sapiens
tgggctccttgggagcaagtga

SEQ ID NO: 7456469 - DNA, 22 bp, Homo sapiens
tgggctccttgggagcaagtga

SEQ ID NO: 7456470 - DNA, 22 bp, Homo sapiens
tgggctccttgggagcaagtga

SEQ ID NO: 7456471 - DNA, 22 bp, Homo sapiens
tgggctgcggataggcctcgga

SEQ ID NO: 7456472 - DNA, 22 bp, Homo sapiens
tgggctgcggataggcctcgga

SEQ ID NO: 7456473 - DNA, 22 bp, Homo sapiens
tgggctgcggataggcctcgga

SEQ ID NO: 7456474 - DNA, 22 bp, Homo sapiens
tgggctgcggataggcctcgga

SEQ ID NO: 7456475 - DNA, 22 bp, Homo sapiens
tgggctgcggataggcctcgga

SEQ ID NO: 7456476 - DNA, 22 bp, Homo sapiens
tgggctgcggataggcctcgga

SEQ ID NO: 7456477 - DNA, 18 bp, Homo sapiens
tgggctgcctggcctctg

SEQ ID NO: 7456478 - DNA, 22 bp, Homo sapiens
tgggctgctgttacaggggctg

SEQ ID NO: 7456479 - DNA, 22 bp, Homo sapiens
tgggctgctgttacaggggctg

SEQ ID NO: 7456480 - DNA, 22 bp, Homo sapiens
tgggctgctgtctgcacatgct

SEQ ID NO: 7456481 - DNA, 22 bp, Homo sapiens
tgggctgctgtctgcacatgct

SEQ ID NO: 7456482 - DNA, 22 bp, Homo sapiens
tgggctgctgtctgcacatgct

SEQ ID NO: 7456483 - DNA, 22 bp, Homo sapiens
tgggctgctgtctgcacatgct

SEQ ID NO: 7456484 - DNA, 22 bp, Homo sapiens
tgggctgctgtctgcacatgct

SEQ ID NO: 7456485 - DNA, 22 bp, Homo sapiens
tgggctgctgtctgcacatgct

SEQ ID NO: 7456486 - DNA, 22 bp, Homo sapiens
tgggctgctgcggtgctcttgg

SEQ ID NO: 7456487 - DNA, 22 bp, Homo sapiens
tgggctgctgagaatgagagag

SEQ ID NO: 7456488 - DNA, 22 bp, Homo sapiens
tgggctgctgagaatgagagag

SEQ ID NO: 7456489 - DNA, 22 bp, Homo sapiens
tgggctgctgagaatgagagag

SEQ ID NO: 7456490 - DNA, 22 bp, Homo sapiens
tgggctgctgtctgcacatgct

SEQ ID NO: 7456491 - DNA, 22 bp, Homo sapiens
tgggctgctgtctgcacatgct

SEQ ID NO: 7456492 - DNA, 22 bp, Homo sapiens
tgggctgctgtctgcacatgct

SEQ ID NO: 7456493 - DNA, 22 bp, Homo sapiens
tgggctgctgcggtgctcttgg

SEQ ID NO: 7456494 - DNA, 22 bp, Homo sapiens
tgggctgctgcggtgctcttgg

SEQ ID NO: 7456495 - DNA, 22 bp, Homo sapiens
cctgagcaaaggcccagaggga

SEQ ID NO: 7456496 - DNA, 22 bp, Homo sapiens
cctgagcaaaggaaggatgact

SEQ ID NO: 7456497 - DNA, 22 bp, Homo sapiens
cctgagcaaaggaaggatgact

SEQ ID NO: 7456498 - DNA, 22 bp, Homo sapiens
cctgagatttgtaatttttgta

SEQ ID NO: 7456499 - DNA, 22 bp, Homo sapiens
cctgagatttgtaatttttgta

SEQ ID NO: 7456500 - DNA, 22 bp, Homo sapiens
cctgagcacacatcagaatcac

SEQ ID NO: 7456501 - DNA, 22 bp, Homo sapiens
cctgagcacacatcagaatcac

SEQ ID NO: 7456502 - DNA, 22 bp, Homo sapiens
cctgagcacacatcagaatcac

SEQ ID NO: 7456503 - DNA, 22 bp, Homo sapiens
cctgagcaaaggcccagaggga

SEQ ID NO: 7456504 - DNA, 22 bp, Homo sapiens
cctgagatgtgtaacagatggt

SEQ ID NO: 7456505 - DNA, 22 bp, Homo sapiens
cctgagatgtgtaacagatggt

SEQ ID NO: 7456506 - DNA, 22 bp, Homo sapiens
cctgagattggctagtatgagt

SEQ ID NO: 7456507 - DNA, 22 bp, Homo sapiens
cctgagatggggattattccaa

SEQ ID NO: 7456508 - DNA, 22 bp, Homo sapiens
cctgagatggccagtgctggga

SEQ ID NO: 7456509 - DNA, 22 bp, Homo sapiens
cctgagagagaagcgacctggt

SEQ ID NO: 7456510 - DNA, 21 bp, Homo sapiens
cctgagatctggagtggcttt

SEQ ID NO: 7456511 - DNA, 23 bp, Homo sapiens
cctgagatctgtaagggaccttg

SEQ ID NO: 7456512 - DNA, 23 bp, Homo sapiens
tgggagtgttgggatctctgctc

SEQ ID NO: 7456513 - DNA, 23 bp, Homo sapiens
tgggagtgttgggatctctgctc

SEQ ID NO: 7456514 - DNA, 22 bp, Homo sapiens
tgggagttagttatactgtgac

SEQ ID NO: 7456515 - DNA, 22 bp, Homo sapiens
tgggagttaacattggtctctg

SEQ ID NO: 7456516 - DNA, 23 bp, Homo sapiens
tgggagttgagtgaggttgcttt

SEQ ID NO: 7456517 - DNA, 22 bp, Homo sapiens
tgggagtttgttagaaatgcag

SEQ ID NO: 7456518 - DNA, 22 bp, Homo sapiens
tgggagttgggtgggagacttc

SEQ ID NO: 7456519 - DNA, 22 bp, Homo sapiens
cctgagaccaagttgcagccat

SEQ ID NO: 7456520 - DNA, 22 bp, Homo sapiens
cctgagatcagtgcatttggtg

SEQ ID NO: 7456521 - DNA, 21 bp, Homo sapiens
cctgagatctggagtggcttt

SEQ ID NO: 7456522 - DNA, 22 bp, Homo sapiens
cctgagagagaagcgacctggt

SEQ ID NO: 7456523 - DNA, 22 bp, Homo sapiens
cctgagagagaagcgacctggt

SEQ ID NO: 7456524 - DNA, 22 bp, Homo sapiens
cctgagcctggctcatgcactc

SEQ ID NO: 7456525 - DNA, 22 bp, Homo sapiens
tgggccagtttctcattgaaat

SEQ ID NO: 7456526 - DNA, 22 bp, Homo sapiens
tgggccagtttctcattgaaat

SEQ ID NO: 7456527 - DNA, 22 bp, Homo sapiens
tgggcccaagagagtctccaac

SEQ ID NO: 7456528 - DNA, 22 bp, Homo sapiens
tgggcccaagagagtctccaac

SEQ ID NO: 7456529 - DNA, 22 bp, Homo sapiens
tgggccatttttggaagactgg

SEQ ID NO: 7456530 - DNA, 22 bp, Homo sapiens
cctgagcctgcagccgagcaga

SEQ ID NO: 7456531 - DNA, 22 bp, Homo sapiens
cctgagcctgcagccgagcaga

SEQ ID NO: 7456532 - DNA, 22 bp, Homo sapiens
cctgagcctgagtggtgcaggg

SEQ ID NO: 7456533 - DNA, 22 bp, Homo sapiens
cctgagcctgagtggtgcaggg

SEQ ID NO: 7456534 - DNA, 22 bp, Homo sapiens
cctgagcctgagtggtgcaggg

SEQ ID NO: 7456535 - DNA, 22 bp, Homo sapiens
cctgagcctgagtggtgcaggg

SEQ ID NO: 7456536 - DNA, 22 bp, Homo sapiens
cctgagcctcttgcacgctcag

SEQ ID NO: 7456537 - DNA, 22 bp, Homo sapiens
cctgagcctcttgcacgctcag

SEQ ID NO: 7456538 - DNA, 22 bp, Homo sapiens
cctgagcctcttgcacgctcag

SEQ ID NO: 7456539 - DNA, 22 bp, Homo sapiens
cctgagcagggctctgcagggc

SEQ ID NO: 7456540 - DNA, 22 bp, Homo sapiens
cctgagcagggctctgcagggc

SEQ ID NO: 7456541 - DNA, 22 bp, Homo sapiens
cctgagcagctctgaggggcga

SEQ ID NO: 7456542 - DNA, 22 bp, Homo sapiens
cctgagcagggctctgcagggc

SEQ ID NO: 7456543 - DNA, 22 bp, Homo sapiens
cctgagcagggctctgcagggc

SEQ ID NO: 7456544 - DNA, 22 bp, Homo sapiens
cctgagcagggctctgcagggc

SEQ ID NO: 7456545 - DNA, 22 bp, Homo sapiens
cctgagcattagacatccatca

SEQ ID NO: 7456546 - DNA, 22 bp, Homo sapiens
cctgagcatcagcgcctcctta

SEQ ID NO: 7456547 - DNA, 22 bp, Homo sapiens
cctgagcatcagcgcctcctta

SEQ ID NO: 7456548 - DNA, 22 bp, Homo sapiens
cctgagcagggctctgcagggc

SEQ ID NO: 7456549 - DNA, 22 bp, Homo sapiens
cctgagccaagagtcagaatct

SEQ ID NO: 7456550 - DNA, 22 bp, Homo sapiens
cctgagcatcagcgcctcctta

SEQ ID NO: 7456551 - DNA, 22 bp, Homo sapiens
cctgagccaagagtcagaatct

SEQ ID NO: 7456552 - DNA, 22 bp, Homo sapiens
cctgagcattagacatccatca

SEQ ID NO: 7456553 - DNA, 18 bp, Homo sapiens
cctgagccctgcttactt

SEQ ID NO: 7456554 - DNA, 18 bp, Homo sapiens
cctgagccctgcttactt

SEQ ID NO: 7456555 - DNA, 22 bp, Homo sapiens
cctgagcctcttgcacgctcag

SEQ ID NO: 7456556 - DNA, 22 bp, Homo sapiens
cctgagccgagcgctctttctc

SEQ ID NO: 7456557 - DNA, 22 bp, Homo sapiens
cctgagccgagcgctctttctc

SEQ ID NO: 7456558 - DNA, 22 bp, Homo sapiens
cctgagccgagcgctctttctc

SEQ ID NO: 7456559 - DNA, 22 bp, Homo sapiens
cctgagccgagcgctctttctc

SEQ ID NO: 7456560 - DNA, 22 bp, Homo sapiens
tgggagtggggcatagaaggta

SEQ ID NO: 7456561 - DNA, 22 bp, Homo sapiens
tgggagtggggcatagaaggta

SEQ ID NO: 7456562 - DNA, 22 bp, Homo sapiens
tgggagtggggcatagaaggta

SEQ ID NO: 7456563 - DNA, 22 bp, Homo sapiens
tgggagtggggcatagaaggta

SEQ ID NO: 7456564 - DNA, 19 bp, Homo sapiens
tgggagtggggaaggtcct

SEQ ID NO: 7456565 - DNA, 19 bp, Homo sapiens
tgggagtggggaaggtcct

SEQ ID NO: 7456566 - DNA, 19 bp, Homo sapiens
tgggagtggggaaggtcct

SEQ ID NO: 7456567 - DNA, 19 bp, Homo sapiens
tgggagtggggaaggtcct

SEQ ID NO: 7456568 - DNA, 22 bp, Homo sapiens
tgggagtgttcttggcttgctt

SEQ ID NO: 7456569 - DNA, 22 bp, Homo sapiens
tgggagtgttcttggcttgctt

SEQ ID NO: 7456570 - DNA, 22 bp, Homo sapiens
tgggagtgttcttggcttgctt

SEQ ID NO: 7456571 - DNA, 22 bp, Homo sapiens
tgggagtgttcttggcttgctt

SEQ ID NO: 7456572 - DNA, 22 bp, Homo sapiens
tgggagtgttcttggcttgctt

SEQ ID NO: 7456573 - DNA, 22 bp, Homo sapiens
tgggagtggggcatagaaggta

SEQ ID NO: 7456574 - DNA, 22 bp, Homo sapiens
tgggagtgttcttggcttgctt

SEQ ID NO: 7456575 - DNA, 22 bp, Homo sapiens
tgggagtggggcatagaaggta

SEQ ID NO: 7456576 - DNA, 22 bp, Homo sapiens
tgggagtggggcatagaaggta

SEQ ID NO: 7456577 - DNA, 22 bp, Homo sapiens
cctcttctcaactccagccaga

SEQ ID NO: 7456578 - DNA, 19 bp, Homo sapiens
cctcttctctggcagcaga

SEQ ID NO: 7456579 - DNA, 19 bp, Homo sapiens
cctcttctctggcagcaga

SEQ ID NO: 7456580 - DNA, 22 bp, Homo sapiens
cctcttctcaactccagccaga

SEQ ID NO: 7456581 - DNA, 22 bp, Homo sapiens
cctcttctcaactccagccaga

SEQ ID NO: 7456582 - DNA, 22 bp, Homo sapiens
cctcttctgagtgagactccct

SEQ ID NO: 7456583 - DNA, 19 bp, Homo sapiens
cctcttctctggcagcaga

SEQ ID NO: 7456584 - DNA, 19 bp, Homo sapiens
cctcttctctggcagcaga

SEQ ID NO: 7456585 - DNA, 18 bp, Homo sapiens
tgggagtgggagtggata

SEQ ID NO: 7456586 - DNA, 19 bp, Homo sapiens
tgggagtggggaaggtcct

SEQ ID NO: 7456587 - DNA, 19 bp, Homo sapiens
tgggagtggggaaggtcct

SEQ ID NO: 7456588 - DNA, 19 bp, Homo sapiens
tgggagtggggaaggtcct

SEQ ID NO: 7456589 - DNA, 19 bp, Homo sapiens
tgggagtggggaaggtcct

SEQ ID NO: 7456590 - DNA, 18 bp, Homo sapiens
tgggagtgggagtggata

SEQ ID NO: 7456591 - DNA, 18 bp, Homo sapiens
tgggagtgggagtggata

SEQ ID NO: 7456592 - DNA, 18 bp, Homo sapiens
tgggagtgggagtggata

SEQ ID NO: 7456593 - DNA, 18 bp, Homo sapiens
tgggagtgggagtggata

SEQ ID NO: 7456594 - DNA, 18 bp, Homo sapiens
tgggagtgggagtggata

SEQ ID NO: 7456595 - DNA, 18 bp, Homo sapiens
tgggagtgggagtggata

SEQ ID NO: 7456596 - DNA, 22 bp, Homo sapiens
cctcttctaggacgtccttgtg

SEQ ID NO: 7456597 - DNA, 22 bp, Homo sapiens
cctcttctaggacgtccttgtg

SEQ ID NO: 7456598 - DNA, 22 bp, Homo sapiens
cctcttctaggacgtccttgtg

SEQ ID NO: 7456599 - DNA, 22 bp, Homo sapiens
cctcttctaccatttacatttt

SEQ ID NO: 7456600 - DNA, 22 bp, Homo sapiens
cctcttccttctcactgtggaa

SEQ ID NO: 7456601 - DNA, 22 bp, Homo sapiens
cctcttctaccatttacatttt

SEQ ID NO: 7456602 - DNA, 22 bp, Homo sapiens
cctcttctaggtttcagcctgc

SEQ ID NO: 7456603 - DNA, 22 bp, Homo sapiens
cctcttctaggtttcagcctgc

SEQ ID NO: 7456604 - DNA, 22 bp, Homo sapiens
cctcttctaggacgtccttgtg

SEQ ID NO: 7456605 - DNA, 22 bp, Homo sapiens
cctcttctaggacgtccttgtg

SEQ ID NO: 7456606 - DNA, 22 bp, Homo sapiens
cctcttctaggacgtccttgtg

SEQ ID NO: 7456607 - DNA, 22 bp, Homo sapiens
cctcttctaggtttcagcctgc

SEQ ID NO: 7456608 - DNA, 22 bp, Homo sapiens
cctcttctaggtttcagcctgc

SEQ ID NO: 7456609 - DNA, 22 bp, Homo sapiens
cctcttctcaactccagccaga

SEQ ID NO: 7456610 - DNA, 22 bp, Homo sapiens
cctcttctaggtttcagcctgc

SEQ ID NO: 7456611 - DNA, 17 bp, Homo sapiens
cctcttcctctcagctg

SEQ ID NO: 7456612 - DNA, 17 bp, Homo sapiens
cctcttcctctcagctg

SEQ ID NO: 7456613 - DNA, 17 bp, Homo sapiens
cctcttcctctcagctg

SEQ ID NO: 7456614 - DNA, 17 bp, Homo sapiens
cctcttcctctcagctg

SEQ ID NO: 7456615 - DNA, 17 bp, Homo sapiens
cctcttcctctcagctg

SEQ ID NO: 7456616 - DNA, 17 bp, Homo sapiens
cctcttcctctcagctg

SEQ ID NO: 7456617 - DNA, 22 bp, Homo sapiens
cctcttccttctcactgtggaa

SEQ ID NO: 7456618 - DNA, 22 bp, Homo sapiens
cctcttccttctcactgtggaa

SEQ ID NO: 7456619 - DNA, 19 bp, Homo sapiens
cctcttcctctgacactat

SEQ ID NO: 7456620 - DNA, 19 bp, Homo sapiens
cctcttcctctgacactat

SEQ ID NO: 7456621 - DNA, 19 bp, Homo sapiens
cctcttcctctgacactat

SEQ ID NO: 7456622 - DNA, 19 bp, Homo sapiens
cctcttcctctgacactat

SEQ ID NO: 7456623 - DNA, 19 bp, Homo sapiens
cctcttcctctgacactat

SEQ ID NO: 7456624 - DNA, 22 bp, Homo sapiens
tgcccagctgtcaaagtagata

SEQ ID NO: 7456625 - DNA, 22 bp, Homo sapiens
tgcccagctgtcaaagtagata

SEQ ID NO: 7456626 - DNA, 22 bp, Homo sapiens
tgcccagctgtcaaagtagata

SEQ ID NO: 7456627 - DNA, 22 bp, Homo sapiens
tgcccagcttcttacttttaaa

SEQ ID NO: 7456628 - DNA, 22 bp, Homo sapiens
tgcccagcttcttacttttaaa

SEQ ID NO: 7456629 - DNA, 22 bp, Homo sapiens
cccaggcagtgtgtgcatgcgt

SEQ ID NO: 7456630 - DNA, 22 bp, Homo sapiens
tgcccagcttcttacttttaaa

SEQ ID NO: 7456631 - DNA, 22 bp, Homo sapiens
cccaggcatcccattaaggagc

SEQ ID NO: 7456632 - DNA, 22 bp, Homo sapiens
cccaggcatcccattaaggagc

SEQ ID NO: 7456633 - DNA, 22 bp, Homo sapiens
cccaggcagtgtgtgcatgcgt

SEQ ID NO: 7456634 - DNA, 22 bp, Homo sapiens
cccaggcagtgtgtgcatgcgt

SEQ ID NO: 7456635 - DNA, 22 bp, Homo sapiens
cccaggcatcccattaaggagc

SEQ ID NO: 7456636 - DNA, 19 bp, Homo sapiens
cccaggctacatggagagg

SEQ ID NO: 7456637 - DNA, 23 bp, Homo sapiens
cccaggctacaaattatgctctg

SEQ ID NO: 7456638 - DNA, 23 bp, Homo sapiens
cccaggctacaaattatgctctg

SEQ ID NO: 7456639 - DNA, 19 bp, Homo sapiens
cccaggctacatggagagg

SEQ ID NO: 7456640 - DNA, 19 bp, Homo sapiens
cccaggctacatggagagg

SEQ ID NO: 7456641 - DNA, 19 bp, Homo sapiens
cccaggctacatggagagg

SEQ ID NO: 7456642 - DNA, 19 bp, Homo sapiens
cccaggctacatggagagg

SEQ ID NO: 7456643 - DNA, 22 bp, Homo sapiens
tgcccagcctaaacttggcaag

SEQ ID NO: 7456644 - DNA, 22 bp, Homo sapiens
tgcccagcctaaacttggcaag

SEQ ID NO: 7456645 - DNA, 22 bp, Homo sapiens
tgcccagcctaaacttggcaag

SEQ ID NO: 7456646 - DNA, 22 bp, Homo sapiens
tgcccagcctaaacttggcaag

SEQ ID NO: 7456647 - DNA, 22 bp, Homo sapiens
tgcccagcctaaacttggcaag

SEQ ID NO: 7456648 - DNA, 22 bp, Homo sapiens
tgcccagcctaaacttggcaag

SEQ ID NO: 7456649 - DNA, 22 bp, Homo sapiens
tgcccagcccctatccctggga

SEQ ID NO: 7456650 - DNA, 22 bp, Homo sapiens
tgcccagcccctatccctggga

SEQ ID NO: 7456651 - DNA, 22 bp, Homo sapiens
tgcccagcccctatccctggga

SEQ ID NO: 7456652 - DNA, 22 bp, Homo sapiens
tgcccagcctaaacttggcaag

SEQ ID NO: 7456653 - DNA, 22 bp, Homo sapiens
tgcccagctattcctttcttag

SEQ ID NO: 7456654 - DNA, 22 bp, Homo sapiens
tgcccagcgcccacattctgtc

SEQ ID NO: 7456655 - DNA, 22 bp, Homo sapiens
tgcccagctattcctttcttag

SEQ ID NO: 7456656 - DNA, 22 bp, Homo sapiens
tgcccagcgcccacattctgtc

SEQ ID NO: 7456657 - DNA, 22 bp, Homo sapiens
tgcccagctattcctttcttag

SEQ ID NO: 7456658 - DNA, 22 bp, Homo sapiens
tgcccagcgcccacattctgtc

SEQ ID NO: 7456659 - DNA, 22 bp, Homo sapiens
tgcccagcctaaacttggcaag

SEQ ID NO: 7456660 - DNA, 22 bp, Homo sapiens
tgcccagcgcccacattctgtc

SEQ ID NO: 7456661 - DNA, 22 bp, Homo sapiens
tgcccagcgcccacattctgtc

SEQ ID NO: 7456662 - DNA, 22 bp, Homo sapiens
tgccatattattgagcatatta

SEQ ID NO: 7456663 - DNA, 22 bp, Homo sapiens
tgccatatgcaaatactttctt

SEQ ID NO: 7456664 - DNA, 22 bp, Homo sapiens
tgccatagcaatggtaagctga

SEQ ID NO: 7456665 - DNA, 22 bp, Homo sapiens
tgccatattgatgtgctgtacc

SEQ ID NO: 7456666 - DNA, 22 bp, Homo sapiens
tgcccagccagtttatggtaat

SEQ ID NO: 7456667 - DNA, 22 bp, Homo sapiens
tgcccagccaatttgttatgtt

SEQ ID NO: 7456668 - DNA, 22 bp, Homo sapiens
tgccatattgcaaagtgtctgc

SEQ ID NO: 7456669 - DNA, 22 bp, Homo sapiens
tgcccagccagtttatggtaat

SEQ ID NO: 7456670 - DNA, 22 bp, Homo sapiens
tgcccagccagtttatggtaat

SEQ ID NO: 7456671 - DNA, 22 bp, Homo sapiens
tgcccagcccctatccctggga

SEQ ID NO: 7456672 - DNA, 22 bp, Homo sapiens
tgcccagcccctatccctggga

SEQ ID NO: 7456673 - DNA, 22 bp, Homo sapiens
tgcccagccagtttatggtaat

SEQ ID NO: 7456674 - DNA, 22 bp, Homo sapiens
tgccagttgggaaaacagacat

SEQ ID NO: 7456675 - DNA, 22 bp, Homo sapiens
tgccatagcaatggtaagctga

SEQ ID NO: 7456676 - DNA, 22 bp, Homo sapiens
tgccagttgggaaaacagacat

SEQ ID NO: 7456677 - DNA, 22 bp, Homo sapiens
tgccatagcaatggtaagctga

SEQ ID NO: 7456678 - DNA, 22 bp, Homo sapiens
tgccatagcaatggtaagctga

SEQ ID NO: 7456679 - DNA, 20 bp, Homo sapiens
tgccagtgtgtcaatttata

SEQ ID NO: 7456680 - DNA, 22 bp, Homo sapiens
tgccagtgtgtgccttaagctc

SEQ ID NO: 7456681 - DNA, 22 bp, Homo sapiens
tgccagtgcctgctgcccaata

SEQ ID NO: 7456682 - DNA, 22 bp, Homo sapiens
tgccagtgtagtagctggttta

SEQ ID NO: 7456683 - DNA, 22 bp, Homo sapiens
tgccagtgggtgtgcagagact

SEQ ID NO: 7456684 - DNA, 22 bp, Homo sapiens
tgccagtgtctgctatctgaga

SEQ ID NO: 7456685 - DNA, 22 bp, Homo sapiens
tgccagtgtgagtggagttctt

SEQ ID NO: 7456686 - DNA, 22 bp, Homo sapiens
tgccagtgtggaactaggaaga

SEQ ID NO: 7456687 - DNA, 22 bp, Homo sapiens
tgccagtgtggaactaggaaga

SEQ ID NO: 7456688 - DNA, 22 bp, Homo sapiens
tgccctgggctttgctatgact

SEQ ID NO: 7456689 - DNA, 22 bp, Homo sapiens
tgccctgggctttgctatgact

SEQ ID NO: 7456690 - DNA, 22 bp, Homo sapiens
tgccctggggagcccagccagg

SEQ ID NO: 7456691 - DNA, 22 bp, Homo sapiens
tgccctggggagcccagccagg

SEQ ID NO: 7456692 - DNA, 22 bp, Homo sapiens
tgccctggggagcccagccagg

SEQ ID NO: 7456693 - DNA, 22 bp, Homo sapiens
tgccctgggagttggagctgct

SEQ ID NO: 7456694 - DNA, 22 bp, Homo sapiens
tgccctgggagttggagctgct

SEQ ID NO: 7456695 - DNA, 22 bp, Homo sapiens
cccaggctcccaggtgggacaa

SEQ ID NO: 7456696 - DNA, 22 bp, Homo sapiens
tgccctgggagttggagctgct

SEQ ID NO: 7456697 - DNA, 22 bp, Homo sapiens
tgccctgggctttgctatgact

SEQ ID NO: 7456698 - DNA, 22 bp, Homo sapiens
tgccctgggctttgctatgact

SEQ ID NO: 7456699 - DNA, 22 bp, Homo sapiens
tgccctgggctttgctatgact

SEQ ID NO: 7456700 - DNA, 22 bp, Homo sapiens
cccaggctcctactgtattctg

SEQ ID NO: 7456701 - DNA, 22 bp, Homo sapiens
cccaggctcctactgtattctg

SEQ ID NO: 7456702 - DNA, 22 bp, Homo sapiens
tgccctgggagttggagctgct

SEQ ID NO: 7456703 - DNA, 22 bp, Homo sapiens
cccaggctcccaggtgggacaa

SEQ ID NO: 7456704 - DNA, 22 bp, Homo sapiens
cccaggctcccaggtgggacaa

SEQ ID NO: 7456705 - DNA, 22 bp, Homo sapiens
cccaggctcccaggtgggacaa

SEQ ID NO: 7456706 - DNA, 22 bp, Homo sapiens
tgccctggggagcccagccagg

SEQ ID NO: 7456707 - DNA, 22 bp, Homo sapiens
tgccctggggagcccagccagg

SEQ ID NO: 7456708 - DNA, 21 bp, Homo sapiens
tgccctggggctcttccctca

SEQ ID NO: 7456709 - DNA, 21 bp, Homo sapiens
tgccctggggctcttccctca

SEQ ID NO: 7456710 - DNA, 22 bp, Homo sapiens
tgccctggggagcccagccagg

SEQ ID NO: 7456711 - DNA, 22 bp, Homo sapiens
tgccctggggagcccagccagg

SEQ ID NO: 7456712 - DNA, 22 bp, Homo sapiens
tgccctggggagcccagccagg

SEQ ID NO: 7456713 - DNA, 22 bp, Homo sapiens
tgccctggggagcccagccagg

SEQ ID NO: 7456714 - DNA, 22 bp, Homo sapiens
tgccctggggtctggagcagca

SEQ ID NO: 7456715 - DNA, 22 bp, Homo sapiens
tgccctggggtctggagcagca

SEQ ID NO: 7456716 - DNA, 22 bp, Homo sapiens
tgccctggggtctggagcagca

SEQ ID NO: 7456717 - DNA, 22 bp, Homo sapiens
tgccctggggtctggagcagca

SEQ ID NO: 7456718 - DNA, 21 bp, Homo sapiens
tgccctggggctcttccctca

SEQ ID NO: 7456719 - DNA, 21 bp, Homo sapiens
tgccctggggctcttccctca

SEQ ID NO: 7456720 - DNA, 22 bp, Homo sapiens
tgccctggggtctggagcagca

SEQ ID NO: 7456721 - DNA, 22 bp, Homo sapiens
tgccctggggtctggagcagca

SEQ ID NO: 7456722 - DNA, 22 bp, Homo sapiens
tgccctggggtctggagcagca

SEQ ID NO: 7456723 - DNA, 22 bp, Homo sapiens
tgccctggggtctggagcagca

SEQ ID NO: 7456724 - DNA, 22 bp, Homo sapiens
cccaggctagaaaggccaacaa

SEQ ID NO: 7456725 - DNA, 19 bp, Homo sapiens
cccaggctacatggagagg

SEQ ID NO: 7456726 - DNA, 22 bp, Homo sapiens
cccaggctagaaaggccaacaa

SEQ ID NO: 7456727 - DNA, 22 bp, Homo sapiens
cccaggctagaaaggccaacaa

SEQ ID NO: 7456728 - DNA, 19 bp, Homo sapiens
cccaggctacatggagagg

SEQ ID NO: 7456729 - DNA, 19 bp, Homo sapiens
cccaggctacatggagagg

SEQ ID NO: 7456730 - DNA, 22 bp, Homo sapiens
cccaggctagaaaggccaacaa

SEQ ID NO: 7456731 - DNA, 22 bp, Homo sapiens
cccaggctagaaaggccaacaa

SEQ ID NO: 7456732 - DNA, 22 bp, Homo sapiens
cccaggctagaaaggccaacaa

SEQ ID NO: 7456733 - DNA, 22 bp, Homo sapiens
cccaggctagaaaggccaacaa

SEQ ID NO: 7456734 - DNA, 22 bp, Homo sapiens
cccaggctagaaaggccaacaa

SEQ ID NO: 7456735 - DNA, 22 bp, Homo sapiens
cccaggctagaaaggccaacaa

SEQ ID NO: 7456736 - DNA, 22 bp, Homo sapiens
cccaggctagtatgatatcagt

SEQ ID NO: 7456737 - DNA, 22 bp, Homo sapiens
cccaggctagtatgatatcagt

SEQ ID NO: 7456738 - DNA, 22 bp, Homo sapiens
cccaggctagtatgatatcagt

SEQ ID NO: 7456739 - DNA, 22 bp, Homo sapiens
cccaggctagtatgatatcagt

SEQ ID NO: 7456740 - DNA, 22 bp, Homo sapiens
cccaggctagtatgatatcagt

SEQ ID NO: 7456741 - DNA, 22 bp, Homo sapiens
cccaggctagtatgatatcagt

SEQ ID NO: 7456742 - DNA, 22 bp, Homo sapiens
cccaggctcccaggtgggacaa

SEQ ID NO: 7456743 - DNA, 22 bp, Homo sapiens
cccaggctcccaggtgggacaa

SEQ ID NO: 7456744 - DNA, 22 bp, Homo sapiens
cccaggctcccaggtgggacaa

SEQ ID NO: 7456745 - DNA, 22 bp, Homo sapiens
cccaggctcagactggcttgtt

SEQ ID NO: 7456746 - DNA, 22 bp, Homo sapiens
cccaggctcccaggtgggacaa

SEQ ID NO: 7456747 - DNA, 22 bp, Homo sapiens
cccaggctcccaggtgggacaa

SEQ ID NO: 7456748 - DNA, 22 bp, Homo sapiens
cccaggctcagactggcttgtt

SEQ ID NO: 7456749 - DNA, 22 bp, Homo sapiens
cccaggctcactgtccgcttcc

SEQ ID NO: 7456750 - DNA, 22 bp, Homo sapiens
cccaggctcactgtccgcttcc

SEQ ID NO: 7456751 - DNA, 22 bp, Homo sapiens
cccaggctcagactggcttgtt

SEQ ID NO: 7456752 - DNA, 22 bp, Homo sapiens
cccaggctcagactggcttgtt

SEQ ID NO: 7456753 - DNA, 22 bp, Homo sapiens
cccaggctcagactggcttgtt

SEQ ID NO: 7456754 - DNA, 22 bp, Homo sapiens
cccaggctcagactggcttgtt

SEQ ID NO: 7456755 - DNA, 22 bp, Homo sapiens
cccaggctcagactggcttgtt

SEQ ID NO: 7456756 - DNA, 22 bp, Homo sapiens
cccaggctcagactggcttgtt

SEQ ID NO: 7456757 - DNA, 22 bp, Homo sapiens
cccaggctcactgtccgcttcc

SEQ ID NO: 7456758 - DNA, 22 bp, Homo sapiens
cccaggctcactgtccgcttcc

SEQ ID NO: 7456759 - DNA, 22 bp, Homo sapiens
cccaggagagaggccagttggc

SEQ ID NO: 7456760 - DNA, 22 bp, Homo sapiens
cccaggagagaggggataaagc

SEQ ID NO: 7456761 - DNA, 22 bp, Homo sapiens
cccaggagagaggggataaagc

SEQ ID NO: 7456762 - DNA, 22 bp, Homo sapiens
cccaggagagaggggataaagc

SEQ ID NO: 7456763 - DNA, 22 bp, Homo sapiens
cccaggagagaggggataaagc

SEQ ID NO: 7456764 - DNA, 22 bp, Homo sapiens
cccaggagagaggggataaagc

SEQ ID NO: 7456765 - DNA, 22 bp, Homo sapiens
cccaggagagaggggataaagc

SEQ ID NO: 7456766 - DNA, 22 bp, Homo sapiens
cccaggagagggaaccaaatgt

SEQ ID NO: 7456767 - DNA, 22 bp, Homo sapiens
cccaggagagaggggataaagc

SEQ ID NO: 7456768 - DNA, 22 bp, Homo sapiens
cccaggagagaggggataaagc

SEQ ID NO: 7456769 - DNA, 22 bp, Homo sapiens
cccaggagagggaaccaaatgt

SEQ ID NO: 7456770 - DNA, 22 bp, Homo sapiens
cccaggagagggaaccaaatgt

SEQ ID NO: 7456771 - DNA, 22 bp, Homo sapiens
cccaggagagggaaccaaatgt

SEQ ID NO: 7456772 - DNA, 22 bp, Homo sapiens
cccaggagagaggccagttggc

SEQ ID NO: 7456773 - DNA, 22 bp, Homo sapiens
cccaggagagaggccagttggc

SEQ ID NO: 7456774 - DNA, 22 bp, Homo sapiens
cccaggagagagacttgaatct

SEQ ID NO: 7456775 - DNA, 22 bp, Homo sapiens
cccaggagagagacttgaatct

SEQ ID NO: 7456776 - DNA, 22 bp, Homo sapiens
cccaggagagaggccagttggc

SEQ ID NO: 7456777 - DNA, 22 bp, Homo sapiens
cccaggagagaggccagttggc

SEQ ID NO: 7456778 - DNA, 22 bp, Homo sapiens
cccaggagagaggccagttggc

SEQ ID NO: 7456779 - DNA, 22 bp, Homo sapiens
cccaggagagaggccagttggc

SEQ ID NO: 7456780 - DNA, 22 bp, Homo sapiens
cccaggagagaggccagttggc

SEQ ID NO: 7456781 - DNA, 22 bp, Homo sapiens
cccaggagagaggccagttggc

SEQ ID NO: 7456782 - DNA, 22 bp, Homo sapiens
cccaggagataacgttcccaag

SEQ ID NO: 7456783 - DNA, 22 bp, Homo sapiens
cccaggagataacgttcccaag

SEQ ID NO: 7456784 - DNA, 22 bp, Homo sapiens
cccaggagataacgttcccaag

SEQ ID NO: 7456785 - DNA, 22 bp, Homo sapiens
tgccaggctaagtggaggactt

SEQ ID NO: 7456786 - DNA, 22 bp, Homo sapiens
tgccaggctaagtggaggactt

SEQ ID NO: 7456787 - DNA, 22 bp, Homo sapiens
tgccaggctaagtggaggactt

SEQ ID NO: 7456788 - DNA, 22 bp, Homo sapiens
tgccaggctaagtggaggactt

SEQ ID NO: 7456789 - DNA, 22 bp, Homo sapiens
tgccaggctaagtggaggactt

SEQ ID NO: 7456790 - DNA, 22 bp, Homo sapiens
tgccagtgcttgtgtctgagca

SEQ ID NO: 7456791 - DNA, 22 bp, Homo sapiens
tgccagtgggtgtgcagagact

SEQ ID NO: 7456792 - DNA, 22 bp, Homo sapiens
tgccagtgcttgtgtctgagca

SEQ ID NO: 7456793 - DNA, 22 bp, Homo sapiens
tgccagtgaaacgtggtctcat

SEQ ID NO: 7456794 - DNA, 22 bp, Homo sapiens
cccaggagacctgtgaaaggac

SEQ ID NO: 7456795 - DNA, 22 bp, Homo sapiens
cccaggagacctgtgaaaggac

SEQ ID NO: 7456796 - DNA, 22 bp, Homo sapiens
cccaggagacctgtgaaaggac

SEQ ID NO: 7456797 - DNA, 22 bp, Homo sapiens
cccaggagacctgtgaaaggac

SEQ ID NO: 7456798 - DNA, 22 bp, Homo sapiens
cccaggagacctgtgaaaggac

SEQ ID NO: 7456799 - DNA, 22 bp, Homo sapiens
cccaggagacctgtgaaaggac

SEQ ID NO: 7456800 - DNA, 22 bp, Homo sapiens
cccaggagacctgtgaaaggac

SEQ ID NO: 7456801 - DNA, 22 bp, Homo sapiens
cccaggagacctagatctgttt

SEQ ID NO: 7456802 - DNA, 22 bp, Homo sapiens
cccaggagacctagatctgttt

SEQ ID NO: 7456803 - DNA, 22 bp, Homo sapiens
cccaggagacctagatctgttt

SEQ ID NO: 7456804 - DNA, 22 bp, Homo sapiens
cccaggagagagacttgaatct

SEQ ID NO: 7456805 - DNA, 22 bp, Homo sapiens
cccaggagagagacttgaatct

SEQ ID NO: 7456806 - DNA, 22 bp, Homo sapiens
cccaggagagagacttgaatct

SEQ ID NO: 7456807 - DNA, 22 bp, Homo sapiens
cccaggagactgagctgtaacc

SEQ ID NO: 7456808 - DNA, 22 bp, Homo sapiens
cccaggagagagacttgaatct

SEQ ID NO: 7456809 - DNA, 22 bp, Homo sapiens
cccaggagagagacttgaatct

SEQ ID NO: 7456810 - DNA, 22 bp, Homo sapiens
cccaggagagagacttgaatct

SEQ ID NO: 7456811 - DNA, 22 bp, Homo sapiens
cccaggagagagacttgaatct

SEQ ID NO: 7456812 - DNA, 22 bp, Homo sapiens
cccaggagactgagctgtaacc

SEQ ID NO: 7456813 - DNA, 22 bp, Homo sapiens
cccaggagacctgtgaaaggac

SEQ ID NO: 7456814 - DNA, 22 bp, Homo sapiens
cccaggagactgagctgtaacc

SEQ ID NO: 7456815 - DNA, 22 bp, Homo sapiens
cccaggagactgagctgtaacc

SEQ ID NO: 7456816 - DNA, 22 bp, Homo sapiens
cccaggagactgagctgtaacc

SEQ ID NO: 7456817 - DNA, 22 bp, Homo sapiens
tgccaggatggccagggggcca

SEQ ID NO: 7456818 - DNA, 22 bp, Homo sapiens
cccaggagacatatagaaggac

SEQ ID NO: 7456819 - DNA, 22 bp, Homo sapiens
cccaggagacatatagaaggac

SEQ ID NO: 7456820 - DNA, 22 bp, Homo sapiens
cccaggagacatatagaaggac

SEQ ID NO: 7456821 - DNA, 22 bp, Homo sapiens
cccaggagacatatagaaggac

SEQ ID NO: 7456822 - DNA, 22 bp, Homo sapiens
cccaggagacatatagaaggac

SEQ ID NO: 7456823 - DNA, 22 bp, Homo sapiens
cccaggagacatatagaaggac

SEQ ID NO: 7456824 - DNA, 22 bp, Homo sapiens
cccaggagacctagatctgttt

SEQ ID NO: 7456825 - DNA, 22 bp, Homo sapiens
cccaggagacatatagaaggac

SEQ ID NO: 7456826 - DNA, 22 bp, Homo sapiens
cccaggagacctagatctgttt

SEQ ID NO: 7456827 - DNA, 22 bp, Homo sapiens
cccaggagacctagatctgttt

SEQ ID NO: 7456828 - DNA, 22 bp, Homo sapiens
cccaggagacctagatctgttt

SEQ ID NO: 7456829 - DNA, 22 bp, Homo sapiens
cccaggagacctagatctgttt

SEQ ID NO: 7456830 - DNA, 22 bp, Homo sapiens
tgccaggagtcaggccaggcag

SEQ ID NO: 7456831 - DNA, 22 bp, Homo sapiens
tgccaggaggggacacctcctc

SEQ ID NO: 7456832 - DNA, 22 bp, Homo sapiens
tgccaggaggggacacctcctc

SEQ ID NO: 7456833 - DNA, 22 bp, Homo sapiens
tgccaggaggggacacctcctc

SEQ ID NO: 7456834 - DNA, 22 bp, Homo sapiens
tgccaggaggcggcttgggaaa

SEQ ID NO: 7456835 - DNA, 22 bp, Homo sapiens
tgccaggagtcaggccaggcag

SEQ ID NO: 7456836 - DNA, 22 bp, Homo sapiens
tgccaggagtcaggccaggcag

SEQ ID NO: 7456837 - DNA, 22 bp, Homo sapiens
tgccaggagtcaggccaggcag

SEQ ID NO: 7456838 - DNA, 22 bp, Homo sapiens
tgccaggagtcaggccaggcag

SEQ ID NO: 7456839 - DNA, 22 bp, Homo sapiens
tgccaggatataagagtgcgat

SEQ ID NO: 7456840 - DNA, 22 bp, Homo sapiens
tgccaggatataagagtgcgat

SEQ ID NO: 7456841 - DNA, 22 bp, Homo sapiens
tgccaggatataagagtgcgat

SEQ ID NO: 7456842 - DNA, 22 bp, Homo sapiens
tgccaggagtgtagagtggttt

SEQ ID NO: 7456843 - DNA, 22 bp, Homo sapiens
tgccaggagtgtagagtggttt

SEQ ID NO: 7456844 - DNA, 22 bp, Homo sapiens
tgccaggagtgtagagtggttt

SEQ ID NO: 7456845 - DNA, 22 bp, Homo sapiens
tgccaggagtgtagagtggttt

SEQ ID NO: 7456846 - DNA, 22 bp, Homo sapiens
tgccagctcctgcagctcctgt

SEQ ID NO: 7456847 - DNA, 22 bp, Homo sapiens
tgccagctccgaggagctgcag

SEQ ID NO: 7456848 - DNA, 22 bp, Homo sapiens
tgccagctcctgcagctcctgt

SEQ ID NO: 7456849 - DNA, 22 bp, Homo sapiens
tgccagctcctgcagctcctgt

SEQ ID NO: 7456850 - DNA, 22 bp, Homo sapiens
tgccagctccgaggagctgcag

SEQ ID NO: 7456851 - DNA, 22 bp, Homo sapiens
tgccagctcctgcagctcctgt

SEQ ID NO: 7456852 - DNA, 22 bp, Homo sapiens
tgccagctccgaggagctgcag

SEQ ID NO: 7456853 - DNA, 22 bp, Homo sapiens
tgccagctccgaggagctgcag

SEQ ID NO: 7456854 - DNA, 22 bp, Homo sapiens
tgccagctccgaggagctgcag

SEQ ID NO: 7456855 - DNA, 22 bp, Homo sapiens
tgccagctcccttttctcctcc

SEQ ID NO: 7456856 - DNA, 22 bp, Homo sapiens
tgccagctcccttttctcctcc

SEQ ID NO: 7456857 - DNA, 22 bp, Homo sapiens
tgcacagatctggtggcaagga

SEQ ID NO: 7456858 - DNA, 22 bp, Homo sapiens
tgcacagatctggtggcaagga

SEQ ID NO: 7456859 - DNA, 22 bp, Homo sapiens
tgcacagatagtgatagatagc

SEQ ID NO: 7456860 - DNA, 22 bp, Homo sapiens
tgcacagatctggtggcaagga

SEQ ID NO: 7456861 - DNA, 22 bp, Homo sapiens
tgccacagaggtgaagcccact

SEQ ID NO: 7456862 - DNA, 22 bp, Homo sapiens
tgccacagaggtgaagcccact

SEQ ID NO: 7456863 - DNA, 22 bp, Homo sapiens
tgccacagaggtgaagcccact

SEQ ID NO: 7456864 - DNA, 22 bp, Homo sapiens
tgccacaggcaatccctgcacg

SEQ ID NO: 7456865 - DNA, 22 bp, Homo sapiens
tgccacagcagtgctttgacag

SEQ ID NO: 7456866 - DNA, 19 bp, Homo sapiens
tgccacagataaaaactga

SEQ ID NO: 7456867 - DNA, 22 bp, Homo sapiens
tgccacagaggtgaagcccact

SEQ ID NO: 7456868 - DNA, 20 bp, Homo sapiens
tgcacagacaatgagcccag

SEQ ID NO: 7456869 - DNA, 22 bp, Homo sapiens
tgcacagacatacacatatatg

SEQ ID NO: 7456870 - DNA, 22 bp, Homo sapiens
tgcacagacatacacatatatg

SEQ ID NO: 7456871 - DNA, 22 bp, Homo sapiens
tgcacagagagatgagacacgt

SEQ ID NO: 7456872 - DNA, 22 bp, Homo sapiens
tgcacagagagatgagacacgt

SEQ ID NO: 7456873 - DNA, 22 bp, Homo sapiens
tgcacagagagatgagacacgt

SEQ ID NO: 7456874 - DNA, 22 bp, Homo sapiens
tgcacagagcaggcaccagcgg

SEQ ID NO: 7456875 - DNA, 22 bp, Homo sapiens
tgcacagagcaggcaccagcgg

SEQ ID NO: 7456876 - DNA, 22 bp, Homo sapiens
tgcacagagggaggcataaaat

SEQ ID NO: 7456877 - DNA, 22 bp, Homo sapiens
tgcacagatagtgatagatagc

SEQ ID NO: 7456878 - DNA, 22 bp, Homo sapiens
tgcacagatagtgatagatagc

SEQ ID NO: 7456879 - DNA, 22 bp, Homo sapiens
tgcacagatagtgatagatagc

SEQ ID NO: 7456880 - DNA, 19 bp, Homo sapiens
tgccaggaatactccagaa

SEQ ID NO: 7456881 - DNA, 22 bp, Homo sapiens
tgccaggaagtgtgtgggcctg

SEQ ID NO: 7456882 - DNA, 22 bp, Homo sapiens
tgccaggaacctgttcttgttc

SEQ ID NO: 7456883 - DNA, 22 bp, Homo sapiens
tgccaggaagtgtgtgggcctg

SEQ ID NO: 7456884 - DNA, 22 bp, Homo sapiens
tgccaggaagtgtgtgggcctg

SEQ ID NO: 7456885 - DNA, 22 bp, Homo sapiens
tgccaggaagtgtgtgggcctg

SEQ ID NO: 7456886 - DNA, 22 bp, Homo sapiens
tgccaggaagtgtgtgggcctg

SEQ ID NO: 7456887 - DNA, 22 bp, Homo sapiens
tgccaggaaactgtatatcttg

SEQ ID NO: 7456888 - DNA, 22 bp, Homo sapiens
tgccaggaaactgtatatcttg

SEQ ID NO: 7456889 - DNA, 22 bp, Homo sapiens
tgccaggaacctgttcttgttc

SEQ ID NO: 7456890 - DNA, 22 bp, Homo sapiens
tgccaggaacctgttcttgttc

SEQ ID NO: 7456891 - DNA, 22 bp, Homo sapiens
tgccaggacaaggaccacatgg

SEQ ID NO: 7456892 - DNA, 22 bp, Homo sapiens
tgccaggacaaggaccacatgg

SEQ ID NO: 7456893 - DNA, 22 bp, Homo sapiens
tgccaggacaaggaccacatgg

SEQ ID NO: 7456894 - DNA, 22 bp, Homo sapiens
tgccaggacaaggaccacatgg

SEQ ID NO: 7456895 - DNA, 19 bp, Homo sapiens
tgccaggaatactccagaa

SEQ ID NO: 7456896 - DNA, 19 bp, Homo sapiens
tgccaggaatactccagaa

SEQ ID NO: 7456897 - DNA, 19 bp, Homo sapiens
tgccaggaatactccagaa

SEQ ID NO: 7456898 - DNA, 22 bp, Homo sapiens
tgccaggaggaggtgggacaga

SEQ ID NO: 7456899 - DNA, 22 bp, Homo sapiens
tgccaggaggaggtgggacaga

SEQ ID NO: 7456900 - DNA, 22 bp, Homo sapiens
tgccaggaggaggtgggacaga

SEQ ID NO: 7456901 - DNA, 22 bp, Homo sapiens
tgccaggaggaggtgggacaga

SEQ ID NO: 7456902 - DNA, 22 bp, Homo sapiens
tgccaggaggaggtgggacaga

SEQ ID NO: 7456903 - DNA, 22 bp, Homo sapiens
tgccaggaggcggcttgggaaa

SEQ ID NO: 7456904 - DNA, 22 bp, Homo sapiens
tgccaggaggcggcttgggaaa

SEQ ID NO: 7456905 - DNA, 22 bp, Homo sapiens
tgccaggaggaggtgggacaga

SEQ ID NO: 7456906 - DNA, 22 bp, Homo sapiens
tgccaggagagtgcatgcaggg

SEQ ID NO: 7456907 - DNA, 22 bp, Homo sapiens
tgccaggagagtgcatgcaggg

SEQ ID NO: 7456908 - DNA, 22 bp, Homo sapiens
tgccaggagagtgcatgcaggg

SEQ ID NO: 7456909 - DNA, 22 bp, Homo sapiens
tgccaggagagtgcatgcaggg

SEQ ID NO: 7456910 - DNA, 22 bp, Homo sapiens
tgccaggacaaggaccacatgg

SEQ ID NO: 7456911 - DNA, 22 bp, Homo sapiens
tgccagcttgtggtcagaggct

SEQ ID NO: 7456912 - DNA, 22 bp, Homo sapiens
tgccagcttttgactatcttag

SEQ ID NO: 7456913 - DNA, 22 bp, Homo sapiens
tgccagcttctaaggacccagg

SEQ ID NO: 7456914 - DNA, 22 bp, Homo sapiens
tgccagcttcttacggctgcct

SEQ ID NO: 7456915 - DNA, 22 bp, Homo sapiens
tgccagctgttcccacccaaaa

SEQ ID NO: 7456916 - DNA, 22 bp, Homo sapiens
tgccagcttgtggtcagaggct

SEQ ID NO: 7456917 - DNA, 22 bp, Homo sapiens
tgccagcttgtggtcagaggct

SEQ ID NO: 7456918 - DNA, 22 bp, Homo sapiens
tgccagcttgtggtcagaggct

SEQ ID NO: 7456919 - DNA, 22 bp, Homo sapiens
tgccagcttgtggtcagaggct

SEQ ID NO: 7456920 - DNA, 22 bp, Homo sapiens
tgccagctgacagcagagacaa

SEQ ID NO: 7456921 - DNA, 22 bp, Homo sapiens
tgccagctgacagcagagacaa

SEQ ID NO: 7456922 - DNA, 22 bp, Homo sapiens
tgccagctgacagcagagacaa

SEQ ID NO: 7456923 - DNA, 21 bp, Homo sapiens
tgccagctgctgcatctgtct

SEQ ID NO: 7456924 - DNA, 21 bp, Homo sapiens
tgccagctgctgcatctgtct

SEQ ID NO: 7456925 - DNA, 21 bp, Homo sapiens
tgccagctgctgcatctgtct

SEQ ID NO: 7456926 - DNA, 22 bp, Homo sapiens
tgccagcttctaaggacccagg

SEQ ID NO: 7456927 - DNA, 22 bp, Homo sapiens
tgccagctgttcccacccaaaa

SEQ ID NO: 7456928 - DNA, 22 bp, Homo sapiens
tgccagctgcttgtcccccaca

SEQ ID NO: 7456929 - DNA, 22 bp, Homo sapiens
tgccagctgcttgtcccccaca

SEQ ID NO: 7456930 - DNA, 22 bp, Homo sapiens
tgccagctgcttgtcccccaca

SEQ ID NO: 7456931 - DNA, 22 bp, Homo sapiens
cccagggaaggcagatggagga

SEQ ID NO: 7456932 - DNA, 22 bp, Homo sapiens
cccagggaaggcagatggagga

SEQ ID NO: 7456933 - DNA, 22 bp, Homo sapiens
cccagggaaggcagatggagga

SEQ ID NO: 7456934 - DNA, 21 bp, Homo sapiens
cccagggaagccgcagtcacc

SEQ ID NO: 7456935 - DNA, 21 bp, Homo sapiens
cccagggaagccgcagtcacc

SEQ ID NO: 7456936 - DNA, 22 bp, Homo sapiens
cccaggctggtcctgaactcct

SEQ ID NO: 7456937 - DNA, 22 bp, Homo sapiens
cccaggctggtcctgaactcct

SEQ ID NO: 7456938 - DNA, 21 bp, Homo sapiens
cccagggaagccgcagtcacc

SEQ ID NO: 7456939 - DNA, 21 bp, Homo sapiens
cccagggaagccgcagtcacc

SEQ ID NO: 7456940 - DNA, 21 bp, Homo sapiens
cccagggaagccgcagtcacc

SEQ ID NO: 7456941 - DNA, 22 bp, Homo sapiens
cccaggctggggctcctccagc

SEQ ID NO: 7456942 - DNA, 22 bp, Homo sapiens
cccaggctggggctcctccagc

SEQ ID NO: 7456943 - DNA, 22 bp, Homo sapiens
cccaggctggggctcctccagc

SEQ ID NO: 7456944 - DNA, 22 bp, Homo sapiens
cccaggctggtcctgaactcct

SEQ ID NO: 7456945 - DNA, 22 bp, Homo sapiens
cccaggctggtcctgaactcct

SEQ ID NO: 7456946 - DNA, 22 bp, Homo sapiens
cccaggctggggctcctccagc

SEQ ID NO: 7456947 - DNA, 22 bp, Homo sapiens
cccaggctggtcctgaactcct

SEQ ID NO: 7456948 - DNA, 22 bp, Homo sapiens
cccaggctggtcctgaactcct

SEQ ID NO: 7456949 - DNA, 22 bp, Homo sapiens
cccaggctggtcctgaactcct

SEQ ID NO: 7456950 - DNA, 23 bp, Homo sapiens
cccagggacacgatgacacctcc

SEQ ID NO: 7456951 - DNA, 23 bp, Homo sapiens
cccagggacacgatgacacctcc

SEQ ID NO: 7456952 - DNA, 23 bp, Homo sapiens
cccagggacacgatgacacctcc

SEQ ID NO: 7456953 - DNA, 23 bp, Homo sapiens
cccagggacacgatgacacctcc

SEQ ID NO: 7456954 - DNA, 23 bp, Homo sapiens
cccagggacacgatgacacctcc

SEQ ID NO: 7456955 - DNA, 22 bp, Homo sapiens
cccagggaatgactctggcctt

SEQ ID NO: 7456956 - DNA, 22 bp, Homo sapiens
cccagggaatgactctggcctt

SEQ ID NO: 7456957 - DNA, 23 bp, Homo sapiens
cccagggacacgatgacacctcc

SEQ ID NO: 7456958 - DNA, 22 bp, Homo sapiens
cccagggaagggctacctgagg

SEQ ID NO: 7456959 - DNA, 22 bp, Homo sapiens
cccagggaagggctacctgagg

SEQ ID NO: 7456960 - DNA, 22 bp, Homo sapiens
cccagggaagggctacctgagg

SEQ ID NO: 7456961 - DNA, 22 bp, Homo sapiens
cccagggaaggcagatggagga

SEQ ID NO: 7456962 - DNA, 22 bp, Homo sapiens
cccagggaaggcagatggagga

SEQ ID NO: 7456963 - DNA, 22 bp, Homo sapiens
cccagggaaggcagatggagga

SEQ ID NO: 7456964 - DNA, 22 bp, Homo sapiens
cccagggaaggcagatggagga

SEQ ID NO: 7456965 - DNA, 22 bp, Homo sapiens
cccagggaagggctacctgagg

SEQ ID NO: 7456966 - DNA, 22 bp, Homo sapiens
cccagggaatgactctggcctt

SEQ ID NO: 7456967 - DNA, 22 bp, Homo sapiens
cccagggaatgactctggcctt

SEQ ID NO: 7456968 - DNA, 22 bp, Homo sapiens
cccagggaatgactctggcctt

SEQ ID NO: 7456969 - DNA, 22 bp, Homo sapiens
cccaggctggcctccgcagtgc

SEQ ID NO: 7456970 - DNA, 22 bp, Homo sapiens
cccaggctgggaacgattctag

SEQ ID NO: 7456971 - DNA, 22 bp, Homo sapiens
cccaggctggcctccgcagtgc

SEQ ID NO: 7456972 - DNA, 22 bp, Homo sapiens
cccaggctggcctccgcagtgc

SEQ ID NO: 7456973 - DNA, 22 bp, Homo sapiens
cccaggctggcctccgcagtgc

SEQ ID NO: 7456974 - DNA, 22 bp, Homo sapiens
cccaggctggcactgctgaagt

SEQ ID NO: 7456975 - DNA, 22 bp, Homo sapiens
cccaggctggcctccgcagtgc

SEQ ID NO: 7456976 - DNA, 22 bp, Homo sapiens
cccaggctggcctccgcagtgc

SEQ ID NO: 7456977 - DNA, 22 bp, Homo sapiens
cccaggctggggctcctccagc

SEQ ID NO: 7456978 - DNA, 22 bp, Homo sapiens
cccaggctggggctcctccagc

SEQ ID NO: 7456979 - DNA, 22 bp, Homo sapiens
cccaggctgggaacgattctag

SEQ ID NO: 7456980 - DNA, 22 bp, Homo sapiens
cccaggctgggaacgattctag

SEQ ID NO: 7456981 - DNA, 22 bp, Homo sapiens
cccaggctgggaacgattctag

SEQ ID NO: 7456982 - DNA, 22 bp, Homo sapiens
cccaggctggggctcctccagc

SEQ ID NO: 7456983 - DNA, 22 bp, Homo sapiens
cccaggctggggctcctccagc

SEQ ID NO: 7456984 - DNA, 22 bp, Homo sapiens
cccaggctggggctcctccagc

SEQ ID NO: 7456985 - DNA, 22 bp, Homo sapiens
cccaggctggagtgtaatggtg

SEQ ID NO: 7456986 - DNA, 22 bp, Homo sapiens
cccaggctggagtgcagtggcg

SEQ ID NO: 7456987 - DNA, 22 bp, Homo sapiens
cccaggctggagtgtaatggtg

SEQ ID NO: 7456988 - DNA, 22 bp, Homo sapiens
cccaggctggagtgtaatggtg

SEQ ID NO: 7456989 - DNA, 22 bp, Homo sapiens
cccaggctggagtgtaatggtg

SEQ ID NO: 7456990 - DNA, 22 bp, Homo sapiens
cccaggctggagtgtaatggtg

SEQ ID NO: 7456991 - DNA, 22 bp, Homo sapiens
cccaggctggatttcggtggca

SEQ ID NO: 7456992 - DNA, 22 bp, Homo sapiens
cccaggctggatttcggtggca

SEQ ID NO: 7456993 - DNA, 22 bp, Homo sapiens
cccaggctggatttcggtggca

SEQ ID NO: 7456994 - DNA, 22 bp, Homo sapiens
cccaggctggcactgctgaagt

SEQ ID NO: 7456995 - DNA, 22 bp, Homo sapiens
cccaggctggatttcggtggca

SEQ ID NO: 7456996 - DNA, 22 bp, Homo sapiens
cccaggctggcactgctgaagt

SEQ ID NO: 7456997 - DNA, 22 bp, Homo sapiens
cccaggctggcactgctgaagt

SEQ ID NO: 7456998 - DNA, 22 bp, Homo sapiens
tgccctggttacactggagtcc

SEQ ID NO: 7456999 - DNA, 22 bp, Homo sapiens
tgccctggttacactggagtcc

SEQ ID NO: 7457000 - DNA, 22 bp, Homo sapiens
tgccctggttacactggagtcc

SEQ ID NO: 7457001 - DNA, 22 bp, Homo sapiens
tgccctggttacactggagtcc

SEQ ID NO: 7457002 - DNA, 22 bp, Homo sapiens
tgccctggttacactggagtcc

SEQ ID NO: 7457003 - DNA, 22 bp, Homo sapiens
tgccctggttacactggagtcc

SEQ ID NO: 7457004 - DNA, 22 bp, Homo sapiens
tgccctggtgaagtgctctcct

SEQ ID NO: 7457005 - DNA, 22 bp, Homo sapiens
tgccctggtgaagtgctctcct

SEQ ID NO: 7457006 - DNA, 22 bp, Homo sapiens
tgccctggtgaagtgctctcct

SEQ ID NO: 7457007 - DNA, 22 bp, Homo sapiens
tgccctggtatcatgtggaatt

SEQ ID NO: 7457008 - DNA, 22 bp, Homo sapiens
tgccctggtatcatgtggaatt

SEQ ID NO: 7457009 - DNA, 22 bp, Homo sapiens
tgccctggtatcatgtggaatt

SEQ ID NO: 7457010 - DNA, 22 bp, Homo sapiens
tgccctggtatcatgtggaatt

SEQ ID NO: 7457011 - DNA, 22 bp, Homo sapiens
tgccctggtgaagtgctctcct

SEQ ID NO: 7457012 - DNA, 22 bp, Homo sapiens
tgccctggtgaagtgctctcct

SEQ ID NO: 7457013 - DNA, 22 bp, Homo sapiens
tgccctggtatcatgtggaatt

SEQ ID NO: 7457014 - DNA, 22 bp, Homo sapiens
tgccctggtagacacagactgt

SEQ ID NO: 7457015 - DNA, 22 bp, Homo sapiens
tgccctggtagacacagactgt

SEQ ID NO: 7457016 - DNA, 22 bp, Homo sapiens
tgccctggtagacacagactgt

SEQ ID NO: 7457017 - DNA, 22 bp, Homo sapiens
tgccctggtagacacagactgt

SEQ ID NO: 7457018 - DNA, 22 bp, Homo sapiens
tgccctggtagacacagactgt

SEQ ID NO: 7457019 - DNA, 22 bp, Homo sapiens
tgccctggtagacacagactgt

SEQ ID NO: 7457020 - DNA, 22 bp, Homo sapiens
cccaggctggaattccaggcct

SEQ ID NO: 7457021 - DNA, 22 bp, Homo sapiens
cccaggctggaattccaggcct

SEQ ID NO: 7457022 - DNA, 22 bp, Homo sapiens
cccaggctggagggcagtgtca

SEQ ID NO: 7457023 - DNA, 22 bp, Homo sapiens
cccaggctggagggcagtgtca

SEQ ID NO: 7457024 - DNA, 22 bp, Homo sapiens
cccaggctggagggcagtgtca

SEQ ID NO: 7457025 - DNA, 22 bp, Homo sapiens
cccaggctggagggcagtgtca

SEQ ID NO: 7457026 - DNA, 22 bp, Homo sapiens
cccaggctggagggcagtgtca

SEQ ID NO: 7457027 - DNA, 22 bp, Homo sapiens
cccaggctggagggcagtgtca

SEQ ID NO: 7457028 - DNA, 22 bp, Homo sapiens
cccaggctggagggcagtgtca

SEQ ID NO: 7457029 - DNA, 22 bp, Homo sapiens
cccaggctggaattccaggcct

SEQ ID NO: 7457030 - DNA, 22 bp, Homo sapiens
cccaggctgagttagaggtgtc

SEQ ID NO: 7457031 - DNA, 22 bp, Homo sapiens
cccaggctgagttagaggtgtc

SEQ ID NO: 7457032 - DNA, 22 bp, Homo sapiens
cccaggctgagttagaggtgtc

SEQ ID NO: 7457033 - DNA, 22 bp, Homo sapiens
cccaggctggagtgcagtggcg

SEQ ID NO: 7457034 - DNA, 22 bp, Homo sapiens
cccaggctggagtgcagtggcg

SEQ ID NO: 7457035 - DNA, 22 bp, Homo sapiens
cccaggctggagtgcagtggcg

SEQ ID NO: 7457036 - DNA, 22 bp, Homo sapiens
cccaggctggagtgcaatggtg

SEQ ID NO: 7457037 - DNA, 22 bp, Homo sapiens
cccaggctggagtgcaatggtg

SEQ ID NO: 7457038 - DNA, 22 bp, Homo sapiens
cccaggctggagtgcagtggcg

SEQ ID NO: 7457039 - DNA, 22 bp, Homo sapiens
cccaggctggagtgcagtggcg

SEQ ID NO: 7457040 - DNA, 22 bp, Homo sapiens
cccaggctggagtgcagtggcg

SEQ ID NO: 7457041 - DNA, 22 bp, Homo sapiens
cccaggctggagtgcagtggcg

SEQ ID NO: 7457042 - DNA, 22 bp, Homo sapiens
cccaggctggagtgcagtggcg

SEQ ID NO: 7457043 - DNA, 22 bp, Homo sapiens
cccaggctggagtgcagtggcg

SEQ ID NO: 7457044 - DNA, 22 bp, Homo sapiens
cccaggctggagtgcagtggcg

SEQ ID NO: 7457045 - DNA, 22 bp, Homo sapiens
cccaggctggagggcagtgtca

SEQ ID NO: 7457046 - DNA, 22 bp, Homo sapiens
cccaggctggagggcagtgtca

SEQ ID NO: 7457047 - DNA, 22 bp, Homo sapiens
cccaggctggagggcagtgtca

SEQ ID NO: 7457048 - DNA, 22 bp, Homo sapiens
cccaggctggagtgcaatggca

SEQ ID NO: 7457049 - DNA, 22 bp, Homo sapiens
cccaggctggagtgcaatggca

SEQ ID NO: 7457050 - DNA, 22 bp, Homo sapiens
cccaggctggagtgcaatggca

SEQ ID NO: 7457051 - DNA, 22 bp, Homo sapiens
cccaggctggagtgcaatggtg

SEQ ID NO: 7457052 - DNA, 22 bp, Homo sapiens
cccaggctggagtgcaatggtg

SEQ ID NO: 7457053 - DNA, 22 bp, Homo sapiens
cccaggctggagtgcaatggtg

SEQ ID NO: 7457054 - DNA, 22 bp, Homo sapiens
cccaggctggagtgcaatggca

SEQ ID NO: 7457055 - DNA, 22 bp, Homo sapiens
cccaggctggagtgcaatggca

SEQ ID NO: 7457056 - DNA, 22 bp, Homo sapiens
cccagggacagatgggcagcta

SEQ ID NO: 7457057 - DNA, 22 bp, Homo sapiens
cccagggacagatgggcagcta

SEQ ID NO: 7457058 - DNA, 22 bp, Homo sapiens
cccagggacagatgggcagcta

SEQ ID NO: 7457059 - DNA, 22 bp, Homo sapiens
cccagggacagatgggcagcta

SEQ ID NO: 7457060 - DNA, 22 bp, Homo sapiens
cccagggacagatgggcagcta

SEQ ID NO: 7457061 - DNA, 22 bp, Homo sapiens
cccagggacagatgggcagcta

SEQ ID NO: 7457062 - DNA, 22 bp, Homo sapiens
cccagggacagatgggcagcta

SEQ ID NO: 7457063 - DNA, 22 bp, Homo sapiens
cccagggacagatgggcagcta

SEQ ID NO: 7457064 - DNA, 22 bp, Homo sapiens
cccagggacagatgggcagcta

SEQ ID NO: 7457065 - DNA, 22 bp, Homo sapiens
cccagggacagctaggtggggc

SEQ ID NO: 7457066 - DNA, 22 bp, Homo sapiens
cccagggacagctaggtggggc

SEQ ID NO: 7457067 - DNA, 22 bp, Homo sapiens
cccagggacagctaggtggggc

SEQ ID NO: 7457068 - DNA, 22 bp, Homo sapiens
cccagggacagatgggcagcta

SEQ ID NO: 7457069 - DNA, 22 bp, Homo sapiens
cccagggacagatgggcagcta

SEQ ID NO: 7457070 - DNA, 22 bp, Homo sapiens
cccagggacagatgggcagcta

SEQ ID NO: 7457071 - DNA, 22 bp, Homo sapiens
cccagggacagctaggtggggc

SEQ ID NO: 7457072 - DNA, 17 bp, Homo sapiens
cccagggaccactgctt

SEQ ID NO: 7457073 - DNA, 17 bp, Homo sapiens
cccagggaccactgctt

SEQ ID NO: 7457074 - DNA, 17 bp, Homo sapiens
cccagggaccactgctt

SEQ ID NO: 7457075 - DNA, 22 bp, Homo sapiens
cccagggacagctaggtggggc

SEQ ID NO: 7457076 - DNA, 17 bp, Homo sapiens
cccagggaccactgctt

SEQ ID NO: 7457077 - DNA, 17 bp, Homo sapiens
cccagggaccactgctt

SEQ ID NO: 7457078 - DNA, 22 bp, Homo sapiens
tgcctgtgtggggtctgccgcc

SEQ ID NO: 7457079 - DNA, 22 bp, Homo sapiens
tgcctgtgtgaccacgggcaag

SEQ ID NO: 7457080 - DNA, 22 bp, Homo sapiens
tgcctgtgtggtctgcgcatta

SEQ ID NO: 7457081 - DNA, 22 bp, Homo sapiens
tgcctgtgttgattactttgtc

SEQ ID NO: 7457082 - DNA, 22 bp, Homo sapiens
tgcctgtgttgattactttgtc

SEQ ID NO: 7457083 - DNA, 22 bp, Homo sapiens
tgcctgtgtggtctgcgcatta

SEQ ID NO: 7457084 - DNA, 17 bp, Homo sapiens
cccagggaccactgctt

SEQ ID NO: 7457085 - DNA, 22 bp, Homo sapiens
tgcctgtgtggtctgcgcatta

SEQ ID NO: 7457086 - DNA, 22 bp, Homo sapiens
tgccttcactgagcttatggga

SEQ ID NO: 7457087 - DNA, 22 bp, Homo sapiens
tgccttcatccatgttatagtg

SEQ ID NO: 7457088 - DNA, 22 bp, Homo sapiens
tgccttcatccatgttatagtg

SEQ ID NO: 7457089 - DNA, 22 bp, Homo sapiens
tgccttcactgagcttatggga

SEQ ID NO: 7457090 - DNA, 22 bp, Homo sapiens
tgccttcaccaggccttcagcc

SEQ ID NO: 7457091 - DNA, 22 bp, Homo sapiens
tgccttcctaatggtggggttt

SEQ ID NO: 7457092 - DNA, 22 bp, Homo sapiens
tgccttcatccatgttatagtg

SEQ ID NO: 7457093 - DNA, 22 bp, Homo sapiens
tgccttcctgctttgagttctg

SEQ ID NO: 7457094 - DNA, 22 bp, Homo sapiens
cccagggccctggacagctaca

SEQ ID NO: 7457095 - DNA, 22 bp, Homo sapiens
cccagggattataaaggtgaaa

SEQ ID NO: 7457096 - DNA, 22 bp, Homo sapiens
tgccttcctggagctgaaggct

SEQ ID NO: 7457097 - DNA, 22 bp, Homo sapiens
cccagggattataaaggtgaaa

SEQ ID NO: 7457098 - DNA, 22 bp, Homo sapiens
cccagggattataaaggtgaaa

SEQ ID NO: 7457099 - DNA, 22 bp, Homo sapiens
tgccttcaatcaggatggtctc

SEQ ID NO: 7457100 - DNA, 22 bp, Homo sapiens
tgccttcaccaggccttcagcc

SEQ ID NO: 7457101 - DNA, 22 bp, Homo sapiens
tgccttcaccaggccttcagcc

SEQ ID NO: 7457102 - DNA, 22 bp, Homo sapiens
tgccttcaatcaggatggtctc

SEQ ID NO: 7457103 - DNA, 22 bp, Homo sapiens
tgccttcaagacccatcctcca

SEQ ID NO: 7457104 - DNA, 22 bp, Homo sapiens
tgccttcaagacccatcctcca

SEQ ID NO: 7457105 - DNA, 22 bp, Homo sapiens
tgccttagggtacctggtgctt

SEQ ID NO: 7457106 - DNA, 22 bp, Homo sapiens
tgccttagaggatagtgaagcc

SEQ ID NO: 7457107 - DNA, 22 bp, Homo sapiens
tgcctgttgcccacctgataaa

SEQ ID NO: 7457108 - DNA, 22 bp, Homo sapiens
tgcctgttgcccacctgataaa

SEQ ID NO: 7457109 - DNA, 22 bp, Homo sapiens
tgcctgttaagggtgtagatat

SEQ ID NO: 7457110 - DNA, 22 bp, Homo sapiens
cccagggtagctgagctggcag

SEQ ID NO: 7457111 - DNA, 22 bp, Homo sapiens
cccagggtagctgagctggcag

SEQ ID NO: 7457112 - DNA, 20 bp, Homo sapiens
cccaggggttgtggtgagga

SEQ ID NO: 7457113 - DNA, 22 bp, Homo sapiens
cccagggtaatcatgtgaagcc

SEQ ID NO: 7457114 - DNA, 20 bp, Homo sapiens
cccaggggttgtggtgagga

SEQ ID NO: 7457115 - DNA, 20 bp, Homo sapiens
cccaggggttgtggtgagga

SEQ ID NO: 7457116 - DNA, 20 bp, Homo sapiens
cccaggggttgtggtgagga

SEQ ID NO: 7457117 - DNA, 20 bp, Homo sapiens
cccaggggttgtggtgagga

SEQ ID NO: 7457118 - DNA, 20 bp, Homo sapiens
cccaggggttgtggtgagga

SEQ ID NO: 7457119 - DNA, 20 bp, Homo sapiens
cccaggggttgtggtgagga

SEQ ID NO: 7457120 - DNA, 22 bp, Homo sapiens
cccaggggttctgagcagcagc

SEQ ID NO: 7457121 - DNA, 22 bp, Homo sapiens
cccaggggttctgagcagcagc

SEQ ID NO: 7457122 - DNA, 22 bp, Homo sapiens
cccaggggttctgagcagcagc

SEQ ID NO: 7457123 - DNA, 22 bp, Homo sapiens
cccaggggttctgagcagcagc

SEQ ID NO: 7457124 - DNA, 22 bp, Homo sapiens
cccaggggttctgagcagcagc

SEQ ID NO: 7457125 - DNA, 22 bp, Homo sapiens
cccaggggttctgagcagcagc

SEQ ID NO: 7457126 - DNA, 22 bp, Homo sapiens
cccaggggttctgagcagcagc

SEQ ID NO: 7457127 - DNA, 20 bp, Homo sapiens
cccaggggttgtggtgagga

SEQ ID NO: 7457128 - DNA, 20 bp, Homo sapiens
cccaggggttgtggtgagga

SEQ ID NO: 7457129 - DNA, 20 bp, Homo sapiens
cccaggggttgtggtgagga

SEQ ID NO: 7457130 - DNA, 22 bp, Homo sapiens
cccaggggttctgagcagcagc

SEQ ID NO: 7457131 - DNA, 20 bp, Homo sapiens
cccaggggttgtggtgagga

SEQ ID NO: 7457132 - DNA, 20 bp, Homo sapiens
cccaggggttgtggtgagga

SEQ ID NO: 7457133 - DNA, 20 bp, Homo sapiens
cccaggggttgtggtgagga

SEQ ID NO: 7457134 - DNA, 20 bp, Homo sapiens
cccaggggttgtggtgagga

SEQ ID NO: 7457135 - DNA, 22 bp, Homo sapiens
cccaggggttctagaccagctt

SEQ ID NO: 7457136 - DNA, 22 bp, Homo sapiens
cccaggggttctagaccagctt

SEQ ID NO: 7457137 - DNA, 22 bp, Homo sapiens
cccaggggttcaaggctgcagt

SEQ ID NO: 7457138 - DNA, 22 bp, Homo sapiens
cccaggggttcaaggctgcagt

SEQ ID NO: 7457139 - DNA, 22 bp, Homo sapiens
cccaggggttctagaccagctt

SEQ ID NO: 7457140 - DNA, 22 bp, Homo sapiens
cccaggggttctagaccagctt

SEQ ID NO: 7457141 - DNA, 22 bp, Homo sapiens
cccaggggttctagaccagctt

SEQ ID NO: 7457142 - DNA, 22 bp, Homo sapiens
cccaggggttctagaccagctt

SEQ ID NO: 7457143 - DNA, 22 bp, Homo sapiens
cccaggggttctagaccagctt

SEQ ID NO: 7457144 - DNA, 22 bp, Homo sapiens
cccaggggttctagaccagctt

SEQ ID NO: 7457145 - DNA, 22 bp, Homo sapiens
cccaggggttctagaccagctt

SEQ ID NO: 7457146 - DNA, 22 bp, Homo sapiens
cccaggggttctagaccagctt

SEQ ID NO: 7457147 - DNA, 22 bp, Homo sapiens
cccaggggttcaaggctgcagt

SEQ ID NO: 7457148 - DNA, 22 bp, Homo sapiens
cccaggggttcaaggctgcagt

SEQ ID NO: 7457149 - DNA, 22 bp, Homo sapiens
cccaggggttcaaggctgcagt

SEQ ID NO: 7457150 - DNA, 22 bp, Homo sapiens
cccagggattataaaggtgaaa

SEQ ID NO: 7457151 - DNA, 22 bp, Homo sapiens
cccaggggttcaaggctgcagt

SEQ ID NO: 7457152 - DNA, 22 bp, Homo sapiens
cccaggggttcaaggctgcagt

SEQ ID NO: 7457153 - DNA, 22 bp, Homo sapiens
cccaggggttcaaggctgcagt

SEQ ID NO: 7457154 - DNA, 22 bp, Homo sapiens
cccaggggttcaaggctgcagt

SEQ ID NO: 7457155 - DNA, 22 bp, Homo sapiens
cccaggggttcaaggctgcagt

SEQ ID NO: 7457156 - DNA, 22 bp, Homo sapiens
cccaggggttcaaggctgcagt

SEQ ID NO: 7457157 - DNA, 22 bp, Homo sapiens
cccaggggttcaaggctgcagt

SEQ ID NO: 7457158 - DNA, 22 bp, Homo sapiens
cccagggtccctgctctctgtg

SEQ ID NO: 7457159 - DNA, 22 bp, Homo sapiens
cccagggtccctgctctctgtg

SEQ ID NO: 7457160 - DNA, 22 bp, Homo sapiens
cccagggtccctgctctctgtg

SEQ ID NO: 7457161 - DNA, 22 bp, Homo sapiens
cccagggtccctgctctctgtg

SEQ ID NO: 7457162 - DNA, 22 bp, Homo sapiens
cccagggtagctgagctggcag

SEQ ID NO: 7457163 - DNA, 22 bp, Homo sapiens
cccagggtagctgagctggcag

SEQ ID NO: 7457164 - DNA, 22 bp, Homo sapiens
cccagggtagctgagctggcag

SEQ ID NO: 7457165 - DNA, 22 bp, Homo sapiens
cccagggtagctgagctggcag

SEQ ID NO: 7457166 - DNA, 22 bp, Homo sapiens
cccagggtagctgagctggcag

SEQ ID NO: 7457167 - DNA, 22 bp, Homo sapiens
cccagggtgctaattaaatatg

SEQ ID NO: 7457168 - DNA, 22 bp, Homo sapiens
cccagggtgcggccctggctgg

SEQ ID NO: 7457169 - DNA, 22 bp, Homo sapiens
cccagggtgcggccctggctgg

SEQ ID NO: 7457170 - DNA, 22 bp, Homo sapiens
cccagggtgcggccctggctgg

SEQ ID NO: 7457171 - DNA, 22 bp, Homo sapiens
cccagggtgcggccctggctgg

SEQ ID NO: 7457172 - DNA, 22 bp, Homo sapiens
cccagggtccggataaccctgg

SEQ ID NO: 7457173 - DNA, 22 bp, Homo sapiens
cccagggtccctgctctctgtg

SEQ ID NO: 7457174 - DNA, 22 bp, Homo sapiens
cccaggtaaggatgctcctcat

SEQ ID NO: 7457175 - DNA, 19 bp, Homo sapiens
cccagggtttcctctctcc

SEQ ID NO: 7457176 - DNA, 23 bp, Homo sapiens
cccaggtagccctctagagcctg

SEQ ID NO: 7457177 - DNA, 22 bp, Homo sapiens
cccaggtaaggatgctcctcat

SEQ ID NO: 7457178 - DNA, 22 bp, Homo sapiens
cccaggtagttggaagagacaa

SEQ ID NO: 7457179 - DNA, 22 bp, Homo sapiens
cccaggtagttggaagagacaa

SEQ ID NO: 7457180 - DNA, 22 bp, Homo sapiens
cccaggtagttggaagagacaa

SEQ ID NO: 7457181 - DNA, 22 bp, Homo sapiens
cccaggtagtgagaaatggagg

SEQ ID NO: 7457182 - DNA, 20 bp, Homo sapiens
cccaggtaggtgccatgagt

SEQ ID NO: 7457183 - DNA, 22 bp, Homo sapiens
cccagggttgcctgcctctgct

SEQ ID NO: 7457184 - DNA, 22 bp, Homo sapiens
cccagggtggatgcaagcagca

SEQ ID NO: 7457185 - DNA, 22 bp, Homo sapiens
cccagggtggatgcaagcagca

SEQ ID NO: 7457186 - DNA, 22 bp, Homo sapiens
cccagggtggatgcaagcagca

SEQ ID NO: 7457187 - DNA, 19 bp, Homo sapiens
cccagggtttcctctctcc

SEQ ID NO: 7457188 - DNA, 22 bp, Homo sapiens
cccagggttgcctgcctctgct

SEQ ID NO: 7457189 - DNA, 22 bp, Homo sapiens
cccagggttgcctgcctctgct

SEQ ID NO: 7457190 - DNA, 22 bp, Homo sapiens
cccagggtggatgcaagcagca

SEQ ID NO: 7457191 - DNA, 22 bp, Homo sapiens
cccagtttcaactttccagtgg

SEQ ID NO: 7457192 - DNA, 22 bp, Homo sapiens
cccagtttcaactttccagtgg

SEQ ID NO: 7457193 - DNA, 22 bp, Homo sapiens
cccagttgttgccggctctgga

SEQ ID NO: 7457194 - DNA, 22 bp, Homo sapiens
cccattcatcctcgcttccttc

SEQ ID NO: 7457195 - DNA, 22 bp, Homo sapiens
cccaggtctatgccagctctga

SEQ ID NO: 7457196 - DNA, 22 bp, Homo sapiens
cccaggtctccctgcagccctg

SEQ ID NO: 7457197 - DNA, 22 bp, Homo sapiens
cccagttgttgccggctctgga

SEQ ID NO: 7457198 - DNA, 22 bp, Homo sapiens
cccaggtctatgccagctctga

SEQ ID NO: 7457199 - DNA, 22 bp, Homo sapiens
cccaggtctatgccagctctga

SEQ ID NO: 7457200 - DNA, 22 bp, Homo sapiens
cccaggtctatgccagctctga

SEQ ID NO: 7457201 - DNA, 22 bp, Homo sapiens
cccaggtctatgccagctctga

SEQ ID NO: 7457202 - DNA, 22 bp, Homo sapiens
cccaggtctatgccagctctga

SEQ ID NO: 7457203 - DNA, 22 bp, Homo sapiens
cccaggtcgtcagcagtgtggt

SEQ ID NO: 7457204 - DNA, 22 bp, Homo sapiens
cccaggtcgtcagcagtgtggt

SEQ ID NO: 7457205 - DNA, 21 bp, Homo sapiens
cccaggtcgtggtcttcccag

SEQ ID NO: 7457206 - DNA, 21 bp, Homo sapiens
cccaggtcgtggtcttcccag

SEQ ID NO: 7457207 - DNA, 22 bp, Homo sapiens
cccaggtcccggggccagctgc

SEQ ID NO: 7457208 - DNA, 22 bp, Homo sapiens
cccaggtcgtcagcagtgtggt

SEQ ID NO: 7457209 - DNA, 22 bp, Homo sapiens
cccaggtcgtcagcagtgtggt

SEQ ID NO: 7457210 - DNA, 22 bp, Homo sapiens
cccaggtcccgccccagctcta

SEQ ID NO: 7457211 - DNA, 22 bp, Homo sapiens
cccaggtcccggggccagctgc

SEQ ID NO: 7457212 - DNA, 22 bp, Homo sapiens
cccaggtcccggggccagctgc

SEQ ID NO: 7457213 - DNA, 22 bp, Homo sapiens
cccaggtcccgccccagctcta

SEQ ID NO: 7457214 - DNA, 22 bp, Homo sapiens
cccaggtccccacctgtctgct

SEQ ID NO: 7457215 - DNA, 22 bp, Homo sapiens
cccaggtccccacctgtctgct

SEQ ID NO: 7457216 - DNA, 22 bp, Homo sapiens
cccaggtcccgccccagctcta

SEQ ID NO: 7457217 - DNA, 22 bp, Homo sapiens
cccaggtcccgccccagctcta

SEQ ID NO: 7457218 - DNA, 16 bp, Homo sapiens
cccaggtatccaaggg

SEQ ID NO: 7457219 - DNA, 23 bp, Homo sapiens
cccaggtcaaaattcacaggcct

SEQ ID NO: 7457220 - DNA, 23 bp, Homo sapiens
cccaggtcaaaattcacaggcct

SEQ ID NO: 7457221 - DNA, 23 bp, Homo sapiens
cccaggtcaaaattcacaggcct

SEQ ID NO: 7457222 - DNA, 23 bp, Homo sapiens
cccaggtcaaaattcacaggcct

SEQ ID NO: 7457223 - DNA, 22 bp, Homo sapiens
cccaggtccccacctgtctgct

SEQ ID NO: 7457224 - DNA, 22 bp, Homo sapiens
cccattccctttactgttgcat

SEQ ID NO: 7457225 - DNA, 22 bp, Homo sapiens
cccattctaggctttgctcttc

SEQ ID NO: 7457226 - DNA, 22 bp, Homo sapiens
cccattctaagctttgctcttc

SEQ ID NO: 7457227 - DNA, 22 bp, Homo sapiens
cccattcttcatacaagtctaa

SEQ ID NO: 7457228 - DNA, 22 bp, Homo sapiens
cccatttagataacagttcaaa

SEQ ID NO: 7457229 - DNA, 22 bp, Homo sapiens
cccattgtggttgttgaggata

SEQ ID NO: 7457230 - DNA, 22 bp, Homo sapiens
cccattgtggttgttgaggata

SEQ ID NO: 7457231 - DNA, 22 bp, Homo sapiens
cccatttaaacacaagctttca

SEQ ID NO: 7457232 - DNA, 22 bp, Homo sapiens
cccattttagcaaggggtggcg

SEQ ID NO: 7457233 - DNA, 23 bp, Homo sapiens
cccattttcatgttaactcctgg

SEQ ID NO: 7457234 - DNA, 22 bp, Homo sapiens
cccatttgtatagagccttata

SEQ ID NO: 7457235 - DNA, 22 bp, Homo sapiens
cccatttgtccaaagtataaaa

SEQ ID NO: 7457236 - DNA, 22 bp, Homo sapiens
cccatttgtccaaagtataaaa

SEQ ID NO: 7457237 - DNA, 22 bp, Homo sapiens
cccatttcttgagttcagctct

SEQ ID NO: 7457238 - DNA, 22 bp, Homo sapiens
cccatttatcccaaggttactc

SEQ ID NO: 7457239 - DNA, 22 bp, Homo sapiens
cccatttttgtgtgagtaatga

SEQ ID NO: 7457240 - DNA, 22 bp, Homo sapiens
cccattttgcttatgctgctgt

SEQ ID NO: 7457241 - DNA, 22 bp, Homo sapiens
ccccaaaacttagtgacttaaa

SEQ ID NO: 7457242 - DNA, 22 bp, Homo sapiens
ccccaaaacttggtgacttcca

SEQ ID NO: 7457243 - DNA, 18 bp, Homo sapiens
ccccaaaagtcaccctgg

SEQ ID NO: 7457244 - DNA, 22 bp, Homo sapiens
ccccaaaattcttaagttgaat

SEQ ID NO: 7457245 - DNA, 23 bp, Homo sapiens
cccatttgctcacaggacagcag

SEQ ID NO: 7457246 - DNA, 22 bp, Homo sapiens
ccccaaccctggttccgtggcg

SEQ ID NO: 7457247 - DNA, 19 bp, Homo sapiens
ccccaaagtttagatgttg

SEQ ID NO: 7457248 - DNA, 19 bp, Homo sapiens
ccccaaagtttagatgttg

SEQ ID NO: 7457249 - DNA, 19 bp, Homo sapiens
ccccaaagtttagatgttg

SEQ ID NO: 7457250 - DNA, 22 bp, Homo sapiens
ccccaaagtgttggataattga

SEQ ID NO: 7457251 - DNA, 22 bp, Homo sapiens
ccccaaagtgttggataattga

SEQ ID NO: 7457252 - DNA, 22 bp, Homo sapiens
ccccaaagctgagttcccgcct

SEQ ID NO: 7457253 - DNA, 22 bp, Homo sapiens
ccccaaagctgagttcccgcct

SEQ ID NO: 7457254 - DNA, 22 bp, Homo sapiens
ccccaaagcctcagcctgcctg

SEQ ID NO: 7457255 - DNA, 22 bp, Homo sapiens
ccccaaagcctcagcctgcctg

SEQ ID NO: 7457256 - DNA, 22 bp, Homo sapiens
ccccaaagcctcagcctgcctg

SEQ ID NO: 7457257 - DNA, 22 bp, Homo sapiens
ccccacactctttacattcata

SEQ ID NO: 7457258 - DNA, 22 bp, Homo sapiens
ccccacactctttacattcata

SEQ ID NO: 7457259 - DNA, 22 bp, Homo sapiens
ccccacactctttacattcata

SEQ ID NO: 7457260 - DNA, 22 bp, Homo sapiens
ccccacagccgccagcagggag

SEQ ID NO: 7457261 - DNA, 22 bp, Homo sapiens
ccccacagccgccagcagggag

SEQ ID NO: 7457262 - DNA, 20 bp, Homo sapiens
ccccacactattgagcactt

SEQ ID NO: 7457263 - DNA, 20 bp, Homo sapiens
ccccacactattgagcactt

SEQ ID NO: 7457264 - DNA, 20 bp, Homo sapiens
ccccacactattgagcactt

SEQ ID NO: 7457265 - DNA, 20 bp, Homo sapiens
ccccacactattgagcactt

SEQ ID NO: 7457266 - DNA, 22 bp, Homo sapiens
ccccacaactcatgttgaaact

SEQ ID NO: 7457267 - DNA, 22 bp, Homo sapiens
ccccacaactcatgttgaaact

SEQ ID NO: 7457268 - DNA, 22 bp, Homo sapiens
ccccacaactcatgttgaaact

SEQ ID NO: 7457269 - DNA, 22 bp, Homo sapiens
ccccacaactcatgttgaaact

SEQ ID NO: 7457270 - DNA, 22 bp, Homo sapiens
ccccacaactcatgttgaaact

SEQ ID NO: 7457271 - DNA, 22 bp, Homo sapiens
ccccacaactcatgttgaaact

SEQ ID NO: 7457272 - DNA, 22 bp, Homo sapiens
ccccaaggtgctcactgtctgg

SEQ ID NO: 7457273 - DNA, 22 bp, Homo sapiens
ccccaaggtgctcactgtctgg

SEQ ID NO: 7457274 - DNA, 22 bp, Homo sapiens
ccccacacctgccgggcagcag

SEQ ID NO: 7457275 - DNA, 22 bp, Homo sapiens
ccccacacctgccgggcagcag

SEQ ID NO: 7457276 - DNA, 22 bp, Homo sapiens
ccccacacctgccgggcagcag

SEQ ID NO: 7457277 - DNA, 22 bp, Homo sapiens
ccccacagtccgtgaggagcca

SEQ ID NO: 7457278 - DNA, 22 bp, Homo sapiens
ccccacagtccgtgaggagcca

SEQ ID NO: 7457279 - DNA, 22 bp, Homo sapiens
ccccacagtccgtgaggagcca

SEQ ID NO: 7457280 - DNA, 22 bp, Homo sapiens
ccccacagtccgtgaggagcca

SEQ ID NO: 7457281 - DNA, 22 bp, Homo sapiens
ccccaccaccaaggctcagttt

SEQ ID NO: 7457282 - DNA, 22 bp, Homo sapiens
ccccacagtccgtgaggagcca

SEQ ID NO: 7457283 - DNA, 22 bp, Homo sapiens
ccccacagccgccagcagggag

SEQ ID NO: 7457284 - DNA, 22 bp, Homo sapiens
ccccacactctttacattcata

SEQ ID NO: 7457285 - DNA, 22 bp, Homo sapiens
ccccacagccgccagcagggag

SEQ ID NO: 7457286 - DNA, 22 bp, Homo sapiens
ccccacaggtgtctgaggcagg

SEQ ID NO: 7457287 - DNA, 22 bp, Homo sapiens
ccccacaggtgtctgaggcagg

SEQ ID NO: 7457288 - DNA, 22 bp, Homo sapiens
ccccacagcttgtggagagaat

SEQ ID NO: 7457289 - DNA, 22 bp, Homo sapiens
ccccacagcttgtggagagaat

SEQ ID NO: 7457290 - DNA, 22 bp, Homo sapiens
ccccacagcttgtggagagaat

SEQ ID NO: 7457291 - DNA, 22 bp, Homo sapiens
ccccacagcttgtggagagaat

SEQ ID NO: 7457292 - DNA, 21 bp, Homo sapiens
tgctggccatgtgctgggcat

SEQ ID NO: 7457293 - DNA, 21 bp, Homo sapiens
tgctggccatgtgctgggcat

SEQ ID NO: 7457294 - DNA, 21 bp, Homo sapiens
tgctggccatgtgctgggcat

SEQ ID NO: 7457295 - DNA, 21 bp, Homo sapiens
tgctggccatgtgctgggcat

SEQ ID NO: 7457296 - DNA, 22 bp, Homo sapiens
tgctggccaatggcagaggcgg

SEQ ID NO: 7457297 - DNA, 22 bp, Homo sapiens
tgctggccaatggcagaggcgg

SEQ ID NO: 7457298 - DNA, 22 bp, Homo sapiens
tgctggccaatggcagaggcgg

SEQ ID NO: 7457299 - DNA, 22 bp, Homo sapiens
tgctggccaatggcagaggcgg

SEQ ID NO: 7457300 - DNA, 22 bp, Homo sapiens
tgctggccaatggcagaggcgg

SEQ ID NO: 7457301 - DNA, 22 bp, Homo sapiens
tgctggccaatggcagaggcgg

SEQ ID NO: 7457302 - DNA, 22 bp, Homo sapiens
tgctggagcccaggcggccttt

SEQ ID NO: 7457303 - DNA, 22 bp, Homo sapiens
tgctggccaagcagaggtcaat

SEQ ID NO: 7457304 - DNA, 22 bp, Homo sapiens
ccccacctgtgcgtctgccgca

SEQ ID NO: 7457305 - DNA, 22 bp, Homo sapiens
tgctggagcccaggcggccttt

SEQ ID NO: 7457306 - DNA, 22 bp, Homo sapiens
tgctggagcccaggcggccttt

SEQ ID NO: 7457307 - DNA, 22 bp, Homo sapiens
ccccacctgtgcgtctgccgca

SEQ ID NO: 7457308 - DNA, 22 bp, Homo sapiens
ccccaccctcgctccatttcgg

SEQ ID NO: 7457309 - DNA, 22 bp, Homo sapiens
ccccaccctcgctccatttcgg

SEQ ID NO: 7457310 - DNA, 22 bp, Homo sapiens
ccccaccctcgctccatttcgg

SEQ ID NO: 7457311 - DNA, 22 bp, Homo sapiens
ccccaccctcgctccatttcgg

SEQ ID NO: 7457312 - DNA, 22 bp, Homo sapiens
ccccaccctcgctccatttcgg

SEQ ID NO: 7457313 - DNA, 22 bp, Homo sapiens
ccccaccctcgctccatttcgg

SEQ ID NO: 7457314 - DNA, 22 bp, Homo sapiens
ccccaccctcgctccatttcgg

SEQ ID NO: 7457315 - DNA, 22 bp, Homo sapiens
ccccaccctcgctccatttcgg

SEQ ID NO: 7457316 - DNA, 22 bp, Homo sapiens
ccccaccctcgctccatttcgg

SEQ ID NO: 7457317 - DNA, 22 bp, Homo sapiens
ccccacccacctaagagaaact

SEQ ID NO: 7457318 - DNA, 22 bp, Homo sapiens
ccccacccacctaagagaaact

SEQ ID NO: 7457319 - DNA, 22 bp, Homo sapiens
ccccacccacctaagagaaact

SEQ ID NO: 7457320 - DNA, 22 bp, Homo sapiens
ccccaccagcaccctctctatc

SEQ ID NO: 7457321 - DNA, 22 bp, Homo sapiens
ccccaccatgtagaaactgaga

SEQ ID NO: 7457322 - DNA, 22 bp, Homo sapiens
ccccacccacctaagagaaact

SEQ ID NO: 7457323 - DNA, 22 bp, Homo sapiens
ccccacccacctaagagaaact

SEQ ID NO: 7457324 - DNA, 22 bp, Homo sapiens
ccccacccacctaagagaaact

SEQ ID NO: 7457325 - DNA, 22 bp, Homo sapiens
ccccaccaccaaggctcagttt

SEQ ID NO: 7457326 - DNA, 22 bp, Homo sapiens
ccccaccaccaaggctcagttt

SEQ ID NO: 7457327 - DNA, 22 bp, Homo sapiens
ccccaccagcaccctctctatc

SEQ ID NO: 7457328 - DNA, 22 bp, Homo sapiens
ccccaccagcaccctctctatc

SEQ ID NO: 7457329 - DNA, 22 bp, Homo sapiens
ccccaccagcaccctctctatc

SEQ ID NO: 7457330 - DNA, 22 bp, Homo sapiens
ccccaccagcaccctctctatc

SEQ ID NO: 7457331 - DNA, 22 bp, Homo sapiens
tgctgggatatagcttctaggg

SEQ ID NO: 7457332 - DNA, 22 bp, Homo sapiens
tgctgggatatagcttctaggg

SEQ ID NO: 7457333 - DNA, 22 bp, Homo sapiens
tgctgggatatagcttctaggg

SEQ ID NO: 7457334 - DNA, 22 bp, Homo sapiens
tgctgggcacacagtaggtgct

SEQ ID NO: 7457335 - DNA, 22 bp, Homo sapiens
tgctgggcacacagtaggtgct

SEQ ID NO: 7457336 - DNA, 22 bp, Homo sapiens
tgctgggcacacagtaggtgct

SEQ ID NO: 7457337 - DNA, 22 bp, Homo sapiens
tgctgggatatagcttctaggg

SEQ ID NO: 7457338 - DNA, 22 bp, Homo sapiens
tgctgggatatagcttctaggg

SEQ ID NO: 7457339 - DNA, 22 bp, Homo sapiens
tgctgggatatagcttctaggg

SEQ ID NO: 7457340 - DNA, 22 bp, Homo sapiens
tgctggctttttggtccttgct

SEQ ID NO: 7457341 - DNA, 22 bp, Homo sapiens
tgctggctttttggtccttgct

SEQ ID NO: 7457342 - DNA, 22 bp, Homo sapiens
tgctggctttttgtgtcaaaga

SEQ ID NO: 7457343 - DNA, 22 bp, Homo sapiens
tgctggctttttgtgtcaaaga

SEQ ID NO: 7457344 - DNA, 22 bp, Homo sapiens
tgctggctttttggtccttgct

SEQ ID NO: 7457345 - DNA, 22 bp, Homo sapiens
tgctggctttttggtccttgct

SEQ ID NO: 7457346 - DNA, 22 bp, Homo sapiens
tgctggctttttggtccttgct

SEQ ID NO: 7457347 - DNA, 22 bp, Homo sapiens
tgctggcttttccttcaggcag

SEQ ID NO: 7457348 - DNA, 22 bp, Homo sapiens
tgctggctttttggtccttgct

SEQ ID NO: 7457349 - DNA, 23 bp, Homo sapiens
cccctctggtggctcagctcctg

SEQ ID NO: 7457350 - DNA, 23 bp, Homo sapiens
cccctctggtggctcagctcctg

SEQ ID NO: 7457351 - DNA, 23 bp, Homo sapiens
cccctctggtggctcagctcctg

SEQ ID NO: 7457352 - DNA, 22 bp, Homo sapiens
cccctcttggcattgagtgcca

SEQ ID NO: 7457353 - DNA, 23 bp, Homo sapiens
cccctctggtggctcagctcctg

SEQ ID NO: 7457354 - DNA, 22 bp, Homo sapiens
cccctcttgtactagacagttt

SEQ ID NO: 7457355 - DNA, 22 bp, Homo sapiens
cccctcttgtactagacagttt

SEQ ID NO: 7457356 - DNA, 22 bp, Homo sapiens
cccctcttggcattgagtgcca

SEQ ID NO: 7457357 - DNA, 22 bp, Homo sapiens
cccctcttggcattgagtgcca

SEQ ID NO: 7457358 - DNA, 22 bp, Homo sapiens
ccccttccaggaagcagaatcg

SEQ ID NO: 7457359 - DNA, 22 bp, Homo sapiens
cccctcttgtgggctcaggtca

SEQ ID NO: 7457360 - DNA, 22 bp, Homo sapiens
ccccttccaggaagcagaatcg

SEQ ID NO: 7457361 - DNA, 22 bp, Homo sapiens
ccccttctctgcaagcctgctc

SEQ ID NO: 7457362 - DNA, 22 bp, Homo sapiens
ccccttccttcctcagacagcc

SEQ ID NO: 7457363 - DNA, 22 bp, Homo sapiens
ccccttccttcctcagacagcc

SEQ ID NO: 7457364 - DNA, 22 bp, Homo sapiens
ccccttccttcctcagacagcc

SEQ ID NO: 7457365 - DNA, 22 bp, Homo sapiens
ccccttccttcctcagacagcc

SEQ ID NO: 7457366 - DNA, 22 bp, Homo sapiens
ccccttccttcctcagacagcc

SEQ ID NO: 7457367 - DNA, 22 bp, Homo sapiens
ccccttccgtctcttgagtgtc

SEQ ID NO: 7457368 - DNA, 22 bp, Homo sapiens
ccccttccgtctcttgagtgtc

SEQ ID NO: 7457369 - DNA, 22 bp, Homo sapiens
cccctcttgtgggctcaggtca

SEQ ID NO: 7457370 - DNA, 22 bp, Homo sapiens
ccccttccttcctcagacagcc

SEQ ID NO: 7457371 - DNA, 22 bp, Homo sapiens
ccccttccttcctcagacagcc

SEQ ID NO: 7457372 - DNA, 22 bp, Homo sapiens
ccccttccttcctcagacagcc

SEQ ID NO: 7457373 - DNA, 22 bp, Homo sapiens
ccccttccttcctcagacagcc

SEQ ID NO: 7457374 - DNA, 18 bp, Homo sapiens
cccggctaatttttggta

SEQ ID NO: 7457375 - DNA, 22 bp, Homo sapiens
cccggccccgtggcaggtaacg

SEQ ID NO: 7457376 - DNA, 22 bp, Homo sapiens
cccggacagaggggcagagtgt

SEQ ID NO: 7457377 - DNA, 22 bp, Homo sapiens
cccggacagaggggcagagtgt

SEQ ID NO: 7457378 - DNA, 22 bp, Homo sapiens
cccgcagtcggaatttctcagt

SEQ ID NO: 7457379 - DNA, 22 bp, Homo sapiens
cccgcagtcggaatttctcagt

SEQ ID NO: 7457380 - DNA, 22 bp, Homo sapiens
cccgctccttacctgtccaacc

SEQ ID NO: 7457381 - DNA, 22 bp, Homo sapiens
cccgctccttacctgtccaacc

SEQ ID NO: 7457382 - DNA, 22 bp, Homo sapiens
cccgcaggggcagccctcatcc

SEQ ID NO: 7457383 - DNA, 22 bp, Homo sapiens
cccgcaggggcagccctcatcc

SEQ ID NO: 7457384 - DNA, 21 bp, Homo sapiens
cccgcacagcggtaggccgcc

SEQ ID NO: 7457385 - DNA, 21 bp, Homo sapiens
cccgcacagcggtaggccgcc

SEQ ID NO: 7457386 - DNA, 21 bp, Homo sapiens
cccgcacagcggtaggccgcc

SEQ ID NO: 7457387 - DNA, 22 bp, Homo sapiens
cccgactagctgggattacagg

SEQ ID NO: 7457388 - DNA, 22 bp, Homo sapiens
ccccttttcgcttggcctcatc

SEQ ID NO: 7457389 - DNA, 22 bp, Homo sapiens
cccgaatagctggaattacagg

SEQ ID NO: 7457390 - DNA, 22 bp, Homo sapiens
cccgacatgagacatggcacag

SEQ ID NO: 7457391 - DNA, 22 bp, Homo sapiens
cccgagtgtctactcactccca

SEQ ID NO: 7457392 - DNA, 22 bp, Homo sapiens
cccgagggtagatggcattgaa

SEQ ID NO: 7457393 - DNA, 22 bp, Homo sapiens
cccgaggaaccagaggtagctc

SEQ ID NO: 7457394 - DNA, 22 bp, Homo sapiens
cccgagggccgaaagctgcttt

SEQ ID NO: 7457395 - DNA, 22 bp, Homo sapiens
cccgagggccgaaagctgcttt

SEQ ID NO: 7457396 - DNA, 22 bp, Homo sapiens
cccgaggaaccagaggtagctc

SEQ ID NO: 7457397 - DNA, 22 bp, Homo sapiens
ccccttctgtgtcctgtcagcc

SEQ ID NO: 7457398 - DNA, 22 bp, Homo sapiens
ccccttctgtgtcctgtcagcc

SEQ ID NO: 7457399 - DNA, 22 bp, Homo sapiens
ccccttctgtgtcctgtcagcc

SEQ ID NO: 7457400 - DNA, 22 bp, Homo sapiens
ccccttctgtgtcctgtcagcc

SEQ ID NO: 7457401 - DNA, 22 bp, Homo sapiens
ccccttctggtcttcaatggtg

SEQ ID NO: 7457402 - DNA, 22 bp, Homo sapiens
ccccttctctgcaagcctgctc

SEQ ID NO: 7457403 - DNA, 22 bp, Homo sapiens
ccccttctctgcaagcctgctc

SEQ ID NO: 7457404 - DNA, 22 bp, Homo sapiens
ccccttctctgcaagcctgctc

SEQ ID NO: 7457405 - DNA, 22 bp, Homo sapiens
tgctggcctcggcgctgggcct

SEQ ID NO: 7457406 - DNA, 22 bp, Homo sapiens
tgctggcctcggcgctgggcct

SEQ ID NO: 7457407 - DNA, 21 bp, Homo sapiens
tgctggcctcaagggtgactt

SEQ ID NO: 7457408 - DNA, 21 bp, Homo sapiens
tgctggcctcaagggtgactt

SEQ ID NO: 7457409 - DNA, 21 bp, Homo sapiens
tgctggcctcaagggtgactt

SEQ ID NO: 7457410 - DNA, 22 bp, Homo sapiens
tgctggccgtgagctctcggga

SEQ ID NO: 7457411 - DNA, 22 bp, Homo sapiens
tgctggccgtgagctctcggga

SEQ ID NO: 7457412 - DNA, 22 bp, Homo sapiens
tgctggcctcggcgctgggcct

SEQ ID NO: 7457413 - DNA, 22 bp, Homo sapiens
tgctggcctcggcgctgggcct

SEQ ID NO: 7457414 - DNA, 22 bp, Homo sapiens
tgctggcctcggcgctgggcct

SEQ ID NO: 7457415 - DNA, 22 bp, Homo sapiens
tgctggcctgggctgcaccttg

SEQ ID NO: 7457416 - DNA, 22 bp, Homo sapiens
tgctggcctgggctgcaccttg

SEQ ID NO: 7457417 - DNA, 22 bp, Homo sapiens
tgctggcctgggctgcaccttg

SEQ ID NO: 7457418 - DNA, 22 bp, Homo sapiens
tgctggcctggttagaaagggg

SEQ ID NO: 7457419 - DNA, 22 bp, Homo sapiens
tgctggcctggttagaaagggg

SEQ ID NO: 7457420 - DNA, 22 bp, Homo sapiens
tgctggcctgtccacgggctgt

SEQ ID NO: 7457421 - DNA, 22 bp, Homo sapiens
tgctggcctgtccacgggctgt

SEQ ID NO: 7457422 - DNA, 22 bp, Homo sapiens
tgctggcctgggctgcaccttg

SEQ ID NO: 7457423 - DNA, 22 bp, Homo sapiens
tgctggcctggttagaaagggg

SEQ ID NO: 7457424 - DNA, 22 bp, Homo sapiens
tgctggcctggttagaaagggg

SEQ ID NO: 7457425 - DNA, 22 bp, Homo sapiens
tgctggcccagtactaatgtct

SEQ ID NO: 7457426 - DNA, 21 bp, Homo sapiens
tgctggccatgtgctgggcat

SEQ ID NO: 7457427 - DNA, 22 bp, Homo sapiens
tgctggcccagtatggactgca

SEQ ID NO: 7457428 - DNA, 22 bp, Homo sapiens
tgctggcccagtatggactgca

SEQ ID NO: 7457429 - DNA, 22 bp, Homo sapiens
tgctggcccagtatggactgca

SEQ ID NO: 7457430 - DNA, 22 bp, Homo sapiens
tgctggcccagtatggactgca

SEQ ID NO: 7457431 - DNA, 22 bp, Homo sapiens
tgctggcccatgaagacgcagt

SEQ ID NO: 7457432 - DNA, 22 bp, Homo sapiens
tgctggcccatgaagacgcagt

SEQ ID NO: 7457433 - DNA, 22 bp, Homo sapiens
tgctggcccatgaagacgcagt

SEQ ID NO: 7457434 - DNA, 22 bp, Homo sapiens
tgctggcccagtatggactgca

SEQ ID NO: 7457435 - DNA, 22 bp, Homo sapiens
tgctggccggccaggtgctgag

SEQ ID NO: 7457436 - DNA, 22 bp, Homo sapiens
tgctggccggccaggtgctgag

SEQ ID NO: 7457437 - DNA, 22 bp, Homo sapiens
tgctggccggccaggtgctgag

SEQ ID NO: 7457438 - DNA, 22 bp, Homo sapiens
tgctggccggccaggtgctgag

SEQ ID NO: 7457439 - DNA, 22 bp, Homo sapiens
tgctggccggccaggtgctgag

SEQ ID NO: 7457440 - DNA, 22 bp, Homo sapiens
tgctggcccatgaagacgcagt

SEQ ID NO: 7457441 - DNA, 22 bp, Homo sapiens
tgctggccctggctcagggaac

SEQ ID NO: 7457442 - DNA, 22 bp, Homo sapiens
tgctggccctggctcagggaac

SEQ ID NO: 7457443 - DNA, 22 bp, Homo sapiens
tgctggccctggctcagggaac

SEQ ID NO: 7457444 - DNA, 22 bp, Homo sapiens
tgctggctttctgtccctggca

SEQ ID NO: 7457445 - DNA, 22 bp, Homo sapiens
tgctggctttctgtccctggca

SEQ ID NO: 7457446 - DNA, 22 bp, Homo sapiens
tgctggctttctgtccctggca

SEQ ID NO: 7457447 - DNA, 22 bp, Homo sapiens
tgctggctttctgtccctggca

SEQ ID NO: 7457448 - DNA, 22 bp, Homo sapiens
tgctggctttctgtccctggca

SEQ ID NO: 7457449 - DNA, 22 bp, Homo sapiens
tgctggctttgcgagatgcatt

SEQ ID NO: 7457450 - DNA, 22 bp, Homo sapiens
tgctggctttgcgagatgcatt

SEQ ID NO: 7457451 - DNA, 22 bp, Homo sapiens
tgctggctttgcgagatgcatt

SEQ ID NO: 7457452 - DNA, 22 bp, Homo sapiens
tgctggctttgcgagatgcatt

SEQ ID NO: 7457453 - DNA, 22 bp, Homo sapiens
tgctggctttgcgagatgcatt

SEQ ID NO: 7457454 - DNA, 22 bp, Homo sapiens
tgctggcttttccttcaggcag

SEQ ID NO: 7457455 - DNA, 22 bp, Homo sapiens
tgctggcttttccttcaggcag

SEQ ID NO: 7457456 - DNA, 23 bp, Homo sapiens
tgctggcttttatctggtcccta

SEQ ID NO: 7457457 - DNA, 23 bp, Homo sapiens
tgctggcttttatctggtcccta

SEQ ID NO: 7457458 - DNA, 22 bp, Homo sapiens
tgctggcttttccttcaggcag

SEQ ID NO: 7457459 - DNA, 23 bp, Homo sapiens
tgctggcttttatctggtcccta

SEQ ID NO: 7457460 - DNA, 23 bp, Homo sapiens
tgctggcttttatctggtcccta

SEQ ID NO: 7457461 - DNA, 22 bp, Homo sapiens
tgctggctttgcgagatgcatt

SEQ ID NO: 7457462 - DNA, 22 bp, Homo sapiens
tgctggctacattattgctgtc

SEQ ID NO: 7457463 - DNA, 22 bp, Homo sapiens
tgctggctacattattgctgtc

SEQ ID NO: 7457464 - DNA, 22 bp, Homo sapiens
tgctggctacattattgctgtc

SEQ ID NO: 7457465 - DNA, 22 bp, Homo sapiens
tgctggctactgatggcaggcc

SEQ ID NO: 7457466 - DNA, 22 bp, Homo sapiens
tgctggctactgatggcaggcc

SEQ ID NO: 7457467 - DNA, 22 bp, Homo sapiens
tgctggctttaaggttaaagtg

SEQ ID NO: 7457468 - DNA, 22 bp, Homo sapiens
tgctggctttaaggttaaagtg

SEQ ID NO: 7457469 - DNA, 22 bp, Homo sapiens
tgctggctttagtgattggggt

SEQ ID NO: 7457470 - DNA, 22 bp, Homo sapiens
tgctggctttagtgattggggt

SEQ ID NO: 7457471 - DNA, 22 bp, Homo sapiens
tgctggctttagtgattggggt

SEQ ID NO: 7457472 - DNA, 22 bp, Homo sapiens
tgctggctttagtgattggggt

SEQ ID NO: 7457473 - DNA, 22 bp, Homo sapiens
tgctggctttagtgattggggt

SEQ ID NO: 7457474 - DNA, 23 bp, Homo sapiens
tgctggctaagaatctgcatttt

SEQ ID NO: 7457475 - DNA, 22 bp, Homo sapiens
tgctggcctgtccacgggctgt

SEQ ID NO: 7457476 - DNA, 22 bp, Homo sapiens
tgctggcctgtccacgggctgt

SEQ ID NO: 7457477 - DNA, 23 bp, Homo sapiens
tgctggctaagaatctgcatttt

SEQ ID NO: 7457478 - DNA, 23 bp, Homo sapiens
tgctggctaagaatctgcatttt

SEQ ID NO: 7457479 - DNA, 23 bp, Homo sapiens
tgctggctaagaatctgcatttt

SEQ ID NO: 7457480 - DNA, 22 bp, Homo sapiens
tgctggctaatggaaaccagat

SEQ ID NO: 7457481 - DNA, 22 bp, Homo sapiens
tgctggctaatggaaaccagat

SEQ ID NO: 7457482 - DNA, 22 bp, Homo sapiens
tgctggctaatggaaaccagat

SEQ ID NO: 7457483 - DNA, 22 bp, Homo sapiens
tgctggctaatggaaaccagat

SEQ ID NO: 7457484 - DNA, 22 bp, Homo sapiens
tgctggctacattattgctgtc

SEQ ID NO: 7457485 - DNA, 22 bp, Homo sapiens
tgctgtgttaaatacaagcatg

SEQ ID NO: 7457486 - DNA, 22 bp, Homo sapiens
tgctgtgttctcctgactcacc

SEQ ID NO: 7457487 - DNA, 22 bp, Homo sapiens
tgctgtgttcctcagtttcatg

SEQ ID NO: 7457488 - DNA, 22 bp, Homo sapiens
tgctgtgtctttctgtgaaaag

SEQ ID NO: 7457489 - DNA, 22 bp, Homo sapiens
tgctgtgtggatgtgaagaatc

SEQ ID NO: 7457490 - DNA, 22 bp, Homo sapiens
tgctgtgttaaatacaagcatg

SEQ ID NO: 7457491 - DNA, 20 bp, Homo sapiens
tgctgtgtggcccagcatga

SEQ ID NO: 7457492 - DNA, 20 bp, Homo sapiens
tgctgtgtggcccagcatga

SEQ ID NO: 7457493 - DNA, 22 bp, Homo sapiens
tgctgtgtggatgtgaagaatc

SEQ ID NO: 7457494 - DNA, 22 bp, Homo sapiens
tggaatggaaacaaactgagga

SEQ ID NO: 7457495 - DNA, 22 bp, Homo sapiens
tggaatggaaacaaactgagga

SEQ ID NO: 7457496 - DNA, 22 bp, Homo sapiens
tggaatggaaacaaactgagga

SEQ ID NO: 7457497 - DNA, 22 bp, Homo sapiens
tggaatggaaacaaactgagga

SEQ ID NO: 7457498 - DNA, 22 bp, Homo sapiens
tgctgttagtaaggaacatgac

SEQ ID NO: 7457499 - DNA, 22 bp, Homo sapiens
tgctgttatacttagctggtta

SEQ ID NO: 7457500 - DNA, 22 bp, Homo sapiens
tgctgttatacttagctggtta

SEQ ID NO: 7457501 - DNA, 22 bp, Homo sapiens
tgctgtgttctcctgactcacc

SEQ ID NO: 7457502 - DNA, 22 bp, Homo sapiens
tggaagggagctggaatttgga

SEQ ID NO: 7457503 - DNA, 22 bp, Homo sapiens
tggaagggagctggaatttgga

SEQ ID NO: 7457504 - DNA, 22 bp, Homo sapiens
tggaagggagctggaatttgga

SEQ ID NO: 7457505 - DNA, 22 bp, Homo sapiens
tggaagggagctggaatttgga

SEQ ID NO: 7457506 - DNA, 22 bp, Homo sapiens
tggaagggagctggaatttgga

SEQ ID NO: 7457507 - DNA, 22 bp, Homo sapiens
tggaagggagctggaatttgga

SEQ ID NO: 7457508 - DNA, 22 bp, Homo sapiens
tggaagggagctggaatttgga

SEQ ID NO: 7457509 - DNA, 22 bp, Homo sapiens
tggaagggagctggaatttgga

SEQ ID NO: 7457510 - DNA, 22 bp, Homo sapiens
tgctgtgctggcggcagaggcc

SEQ ID NO: 7457511 - DNA, 22 bp, Homo sapiens
tgctgtgctggcggcagaggcc

SEQ ID NO: 7457512 - DNA, 22 bp, Homo sapiens
tgctgtgctggcggcagaggcc

SEQ ID NO: 7457513 - DNA, 23 bp, Homo sapiens
tgctgtggatggcaggtccttgc

SEQ ID NO: 7457514 - DNA, 22 bp, Homo sapiens
tgctgtggattcagagatgaaa

SEQ ID NO: 7457515 - DNA, 22 bp, Homo sapiens
tgctgtggattcagagatgaaa

SEQ ID NO: 7457516 - DNA, 22 bp, Homo sapiens
tgctgtgctccattgtcttcac

SEQ ID NO: 7457517 - DNA, 22 bp, Homo sapiens
tgctgtgctctttaaggtgctg

SEQ ID NO: 7457518 - DNA, 22 bp, Homo sapiens
tgctgtgctctttaaggtgctg

SEQ ID NO: 7457519 - DNA, 18 bp, Homo sapiens
cccggctaatttttggta

SEQ ID NO: 7457520 - DNA, 18 bp, Homo sapiens
cccggctaatttttggta

SEQ ID NO: 7457521 - DNA, 18 bp, Homo sapiens
cccggctaatttttggta

SEQ ID NO: 7457522 - DNA, 18 bp, Homo sapiens
cccggctaatttttggta

SEQ ID NO: 7457523 - DNA, 18 bp, Homo sapiens
cccggctaatttttggta

SEQ ID NO: 7457524 - DNA, 18 bp, Homo sapiens
cccggctaatttttggta

SEQ ID NO: 7457525 - DNA, 22 bp, Homo sapiens
tgctgtgtctttctgtgaaaag

SEQ ID NO: 7457526 - DNA, 22 bp, Homo sapiens
tgctgtgtaaaaggtgattgaa

SEQ ID NO: 7457527 - DNA, 22 bp, Homo sapiens
tgctgtggttcccagagtggat

SEQ ID NO: 7457528 - DNA, 22 bp, Homo sapiens
tgctgtgtaaaaggtgattgaa

SEQ ID NO: 7457529 - DNA, 22 bp, Homo sapiens
tgctgtgtaaaaggtgattgaa

SEQ ID NO: 7457530 - DNA, 22 bp, Homo sapiens
tgctgtgtaaaaggtgattgaa

SEQ ID NO: 7457531 - DNA, 22 bp, Homo sapiens
tgctgtgggatatatgttcaaa

SEQ ID NO: 7457532 - DNA, 22 bp, Homo sapiens
tgctgtggcagtttatgtatag

SEQ ID NO: 7457533 - DNA, 22 bp, Homo sapiens
tgctgtggcagtttatgtatag

SEQ ID NO: 7457534 - DNA, 22 bp, Homo sapiens
tgctgtgggcagtacataagct

SEQ ID NO: 7457535 - DNA, 22 bp, Homo sapiens
tgctgtgggcagtacataagct

SEQ ID NO: 7457536 - DNA, 22 bp, Homo sapiens
tgctgtggttcccagagtggat

SEQ ID NO: 7457537 - DNA, 22 bp, Homo sapiens
ccctcctggaggcggatgccca

SEQ ID NO: 7457538 - DNA, 22 bp, Homo sapiens
ccctcctggaggcggatgccca

SEQ ID NO: 7457539 - DNA, 22 bp, Homo sapiens
ccctcctggaggcggatgccca

SEQ ID NO: 7457540 - DNA, 22 bp, Homo sapiens
ccctcctggaggcggatgccca

SEQ ID NO: 7457541 - DNA, 22 bp, Homo sapiens
ccctcctgtgcctgaggccagc

SEQ ID NO: 7457542 - DNA, 22 bp, Homo sapiens
ccctcctgtgcctgaggccagc

SEQ ID NO: 7457543 - DNA, 22 bp, Homo sapiens
ccctcctctccctaagagtcac

SEQ ID NO: 7457544 - DNA, 22 bp, Homo sapiens
ccctcctctccctaagagtcac

SEQ ID NO: 7457545 - DNA, 22 bp, Homo sapiens
ccctcctctccctaagagtcac

SEQ ID NO: 7457546 - DNA, 22 bp, Homo sapiens
ccctcctctccctaagagtcac

SEQ ID NO: 7457547 - DNA, 22 bp, Homo sapiens
tggaatgtgttctattttacag

SEQ ID NO: 7457548 - DNA, 22 bp, Homo sapiens
tggaatgttaaacctcaatgat

SEQ ID NO: 7457549 - DNA, 22 bp, Homo sapiens
ccctcgctctaggcagccctgt

SEQ ID NO: 7457550 - DNA, 22 bp, Homo sapiens
ccctcgctctaggcagccctgt

SEQ ID NO: 7457551 - DNA, 22 bp, Homo sapiens
ccctcgccgcagctgcttcccg

SEQ ID NO: 7457552 - DNA, 22 bp, Homo sapiens
ccctcgctctaggcagccctgt

SEQ ID NO: 7457553 - DNA, 22 bp, Homo sapiens
ccctcgctctaggcagccctgt

SEQ ID NO: 7457554 - DNA, 22 bp, Homo sapiens
ccctctacagggaagcgctttc

SEQ ID NO: 7457555 - DNA, 22 bp, Homo sapiens
ccctcggggcctcagtttccct

SEQ ID NO: 7457556 - DNA, 22 bp, Homo sapiens
ccctcgtgcatccatcatttag

SEQ ID NO: 7457557 - DNA, 22 bp, Homo sapiens
ccctcctttctaggcttccagc

SEQ ID NO: 7457558 - DNA, 22 bp, Homo sapiens
ccctcgaggttttctgaggtac

SEQ ID NO: 7457559 - DNA, 22 bp, Homo sapiens
ccctccttaccaccacagctcc

SEQ ID NO: 7457560 - DNA, 22 bp, Homo sapiens
ccctcgccgcagctgcttcccg

SEQ ID NO: 7457561 - DNA, 22 bp, Homo sapiens
ccctcctttctaggcttccagc

SEQ ID NO: 7457562 - DNA, 22 bp, Homo sapiens
ccctccttaccaccacagctcc

SEQ ID NO: 7457563 - DNA, 22 bp, Homo sapiens
ccctcctgtgcctgaggccagc

SEQ ID NO: 7457564 - DNA, 22 bp, Homo sapiens
ccctccttaccaccacagctcc

SEQ ID NO: 7457565 - DNA, 22 bp, Homo sapiens
ccctcctgtgcctgaggccagc

SEQ ID NO: 7457566 - DNA, 22 bp, Homo sapiens
tggaatgtgaacatacaaggta

SEQ ID NO: 7457567 - DNA, 22 bp, Homo sapiens
tggaatgtcttgatatagaggt

SEQ ID NO: 7457568 - DNA, 22 bp, Homo sapiens
tggaatgtgctactgttgattt

SEQ ID NO: 7457569 - DNA, 22 bp, Homo sapiens
tggaatgtgagaataccgtttt

SEQ ID NO: 7457570 - DNA, 22 bp, Homo sapiens
tggaatgtggtatcagtagaaa

SEQ ID NO: 7457571 - DNA, 22 bp, Homo sapiens
tggaatgtggtatcagtagaaa

SEQ ID NO: 7457572 - DNA, 22 bp, Homo sapiens
tggaatgtggataagggtgtct

SEQ ID NO: 7457573 - DNA, 22 bp, Homo sapiens
tggaatgtgctagggctgtggc

SEQ ID NO: 7457574 - DNA, 22 bp, Homo sapiens
tggaatgtcagctacaagaggg

SEQ ID NO: 7457575 - DNA, 22 bp, Homo sapiens
tggaatgtcataccataaaaga

SEQ ID NO: 7457576 - DNA, 23 bp, Homo sapiens
tggaatgtctgattctgctctag

SEQ ID NO: 7457577 - DNA, 22 bp, Homo sapiens
tggaatgtcaagaagcagtaag

SEQ ID NO: 7457578 - DNA, 22 bp, Homo sapiens
tggaatgtcaaaagtctgctat

SEQ ID NO: 7457579 - DNA, 22 bp, Homo sapiens
tggaatgtattaagtattgagt

SEQ ID NO: 7457580 - DNA, 22 bp, Homo sapiens
tggaatgtagtgtccatggaat

SEQ ID NO: 7457581 - DNA, 22 bp, Homo sapiens
tggaatgtatagatgttatgta

SEQ ID NO: 7457582 - DNA, 22 bp, Homo sapiens
tggaatggaaacaaactgagga

SEQ ID NO: 7457583 - DNA, 22 bp, Homo sapiens
tggaatggaaacaaactgagga

SEQ ID NO: 7457584 - DNA, 22 bp, Homo sapiens
tggaatggggactttgggacat

SEQ ID NO: 7457585 - DNA, 22 bp, Homo sapiens
tggaatgtaaactctgtgaggg

SEQ ID NO: 7457586 - DNA, 22 bp, Homo sapiens
tggaatgtaaacctcaggtggg

SEQ ID NO: 7457587 - DNA, 20 bp, Homo sapiens
tggaatgggtccttgaaaaa

SEQ ID NO: 7457588 - DNA, 20 bp, Homo sapiens
tggaatgggtccttgaaaaa

SEQ ID NO: 7457589 - DNA, 22 bp, Homo sapiens
tggaatgtaaagcgtgtgataa

SEQ ID NO: 7457590 - DNA, 22 bp, Homo sapiens
tggaatgtaatcatgtggtggt

SEQ ID NO: 7457591 - DNA, 22 bp, Homo sapiens
tggaatgtaatcagaatatgaa

SEQ ID NO: 7457592 - DNA, 22 bp, Homo sapiens
tggaatgtaaagggtatgggat

SEQ ID NO: 7457593 - DNA, 22 bp, Homo sapiens
tggaatgtagtgtccatggaat

SEQ ID NO: 7457594 - DNA, 20 bp, Homo sapiens
tggaatgtagtcggtgagag

SEQ ID NO: 7457595 - DNA, 22 bp, Homo sapiens
tggaatgtagcaagtgttgtca

SEQ ID NO: 7457596 - DNA, 21 bp, Homo sapiens
tggaatgtacctccctctctt

SEQ ID NO: 7457597 - DNA, 19 bp, Homo sapiens
ccctcttgcacaaagcaaa

SEQ ID NO: 7457598 - DNA, 19 bp, Homo sapiens
ccctcttgcacaaagcaaa

SEQ ID NO: 7457599 - DNA, 19 bp, Homo sapiens
ccctcttgcacaaagcaaa

SEQ ID NO: 7457600 - DNA, 22 bp, Homo sapiens
ccctgaaatcctgtgctctgtg

SEQ ID NO: 7457601 - DNA, 22 bp, Homo sapiens
ccctgaaatcctgtgctctgtg

SEQ ID NO: 7457602 - DNA, 22 bp, Homo sapiens
ccctgaaagtacactgggacgg

SEQ ID NO: 7457603 - DNA, 22 bp, Homo sapiens
ccctgaaagtacactgggacgg

SEQ ID NO: 7457604 - DNA, 22 bp, Homo sapiens
ccctctcgcggggcagcggagg

SEQ ID NO: 7457605 - DNA, 22 bp, Homo sapiens
ccctctctcaggctgacagcct

SEQ ID NO: 7457606 - DNA, 22 bp, Homo sapiens
ccctctctcaggctgacagcct

SEQ ID NO: 7457607 - DNA, 22 bp, Homo sapiens
ccctctctcaggctgacagcct

SEQ ID NO: 7457608 - DNA, 22 bp, Homo sapiens
ccctctctcaggctgacagcct

SEQ ID NO: 7457609 - DNA, 22 bp, Homo sapiens
ccctctctcaggctgacagcct

SEQ ID NO: 7457610 - DNA, 19 bp, Homo sapiens
ccctcttgcacaaagcaaa

SEQ ID NO: 7457611 - DNA, 19 bp, Homo sapiens
ccctcttgcacaaagcaaa

SEQ ID NO: 7457612 - DNA, 22 bp, Homo sapiens
ccctctctcaggctgacagcct

SEQ ID NO: 7457613 - DNA, 22 bp, Homo sapiens
ccctctctcaggctgacagcct

SEQ ID NO: 7457614 - DNA, 22 bp, Homo sapiens
ccctctccctgcagaatgtggc

SEQ ID NO: 7457615 - DNA, 18 bp, Homo sapiens
ccctctcctgctagtggg

SEQ ID NO: 7457616 - DNA, 18 bp, Homo sapiens
ccctctcctgctagtggg

SEQ ID NO: 7457617 - DNA, 22 bp, Homo sapiens
ccctctccctgcagaatgtggc

SEQ ID NO: 7457618 - DNA, 22 bp, Homo sapiens
ccctctcagtcagagccagata

SEQ ID NO: 7457619 - DNA, 22 bp, Homo sapiens
ccctctacagggaagcgctttc

SEQ ID NO: 7457620 - DNA, 22 bp, Homo sapiens
ccctctcagtcagagccagata

SEQ ID NO: 7457621 - DNA, 18 bp, Homo sapiens
ccctctcctgctagtggg

SEQ ID NO: 7457622 - DNA, 18 bp, Homo sapiens
ccctctcctgctagtggg

SEQ ID NO: 7457623 - DNA, 18 bp, Homo sapiens
ccctctcctgctagtggg

SEQ ID NO: 7457624 - DNA, 22 bp, Homo sapiens
ccctctcctggctgcatggagc

SEQ ID NO: 7457625 - DNA, 22 bp, Homo sapiens
ccctctcctggctgcatggagc

SEQ ID NO: 7457626 - DNA, 22 bp, Homo sapiens
ccctctcctggctgcatggagc

SEQ ID NO: 7457627 - DNA, 22 bp, Homo sapiens
ccctctcctggctgcatggagc

SEQ ID NO: 7457628 - DNA, 22 bp, Homo sapiens
ccctctcctggctgcatggagc

SEQ ID NO: 7457629 - DNA, 20 bp, Homo sapiens
ccctgagaccagagagcagc

SEQ ID NO: 7457630 - DNA, 20 bp, Homo sapiens
ccctgagaccagagagcagc

SEQ ID NO: 7457631 - DNA, 20 bp, Homo sapiens
ccctgagaccagagagcagc

SEQ ID NO: 7457632 - DNA, 20 bp, Homo sapiens
ccctgagaccagagagcagc

SEQ ID NO: 7457633 - DNA, 20 bp, Homo sapiens
ccctgagaccagagagcagc

SEQ ID NO: 7457634 - DNA, 20 bp, Homo sapiens
ccctgagaccagagagcagc

SEQ ID NO: 7457635 - DNA, 20 bp, Homo sapiens
ccctgagacaaaggaggggc

SEQ ID NO: 7457636 - DNA, 20 bp, Homo sapiens
ccctgagacaaaggaggggc

SEQ ID NO: 7457637 - DNA, 20 bp, Homo sapiens
ccctgagacaaaggaggggc

SEQ ID NO: 7457638 - DNA, 20 bp, Homo sapiens
ccctgagacgactgagctcc

SEQ ID NO: 7457639 - DNA, 20 bp, Homo sapiens
ccctgagacgactgagctcc

SEQ ID NO: 7457640 - DNA, 20 bp, Homo sapiens
ccctgagacgactgagctcc

SEQ ID NO: 7457641 - DNA, 20 bp, Homo sapiens
ccctgagacgactgagctcc

SEQ ID NO: 7457642 - DNA, 22 bp, Homo sapiens
ccctgagagcagggtctttctc

SEQ ID NO: 7457643 - DNA, 22 bp, Homo sapiens
ccctgagaggttgagtgtctgc

SEQ ID NO: 7457644 - DNA, 22 bp, Homo sapiens
ccctgagaggttgagtgtctgc

SEQ ID NO: 7457645 - DNA, 22 bp, Homo sapiens
ccctgagagcagggtctttctc

SEQ ID NO: 7457646 - DNA, 20 bp, Homo sapiens
ccctgagacgactgagctcc

SEQ ID NO: 7457647 - DNA, 22 bp, Homo sapiens
ccctgagaggttgagtgtctgc

SEQ ID NO: 7457648 - DNA, 22 bp, Homo sapiens
ccctgagaagatcattgccacg

SEQ ID NO: 7457649 - DNA, 22 bp, Homo sapiens
ccctgacttgatctttgacttg

SEQ ID NO: 7457650 - DNA, 20 bp, Homo sapiens
ccctgagacaaaggaggggc

SEQ ID NO: 7457651 - DNA, 20 bp, Homo sapiens
ccctgagacaaaggaggggc

SEQ ID NO: 7457652 - DNA, 20 bp, Homo sapiens
ccctgagacaaaggaggggc

SEQ ID NO: 7457653 - DNA, 22 bp, Homo sapiens
ccctgagaagatcattgccacg

SEQ ID NO: 7457654 - DNA, 20 bp, Homo sapiens
ccctgagacaaaggaggggc

SEQ ID NO: 7457655 - DNA, 22 bp, Homo sapiens
ccctgacttgatctttgacttg

SEQ ID NO: 7457656 - DNA, 22 bp, Homo sapiens
ccctgaccctatcagagggcca

SEQ ID NO: 7457657 - DNA, 22 bp, Homo sapiens
ccctgaccctatcagagggcca

SEQ ID NO: 7457658 - DNA, 22 bp, Homo sapiens
ccctgactcggcgcgctcccgt

SEQ ID NO: 7457659 - DNA, 22 bp, Homo sapiens
ccctgaccccacggctggagaa

SEQ ID NO: 7457660 - DNA, 22 bp, Homo sapiens
ccctgaccccacggctggagaa

SEQ ID NO: 7457661 - DNA, 22 bp, Homo sapiens
ccctgaccctatcagagggcca

SEQ ID NO: 7457662 - DNA, 18 bp, Homo sapiens
ccctgaagggcaagataa

SEQ ID NO: 7457663 - DNA, 18 bp, Homo sapiens
ccctgaagggcaagataa

SEQ ID NO: 7457664 - DNA, 18 bp, Homo sapiens
ccctgaagggcaagataa

SEQ ID NO: 7457665 - DNA, 22 bp, Homo sapiens
ccctgacagatggcaggggagc

SEQ ID NO: 7457666 - DNA, 22 bp, Homo sapiens
ccctgaaatcctgtgctctgtg

SEQ ID NO: 7457667 - DNA, 22 bp, Homo sapiens
ccctgaacaaagcccaggctct

SEQ ID NO: 7457668 - DNA, 22 bp, Homo sapiens
ccctgaacagtgagagataggg

SEQ ID NO: 7457669 - DNA, 18 bp, Homo sapiens
ccctgaagggcaagataa

SEQ ID NO: 7457670 - DNA, 18 bp, Homo sapiens
ccctgaagggcaagataa

SEQ ID NO: 7457671 - DNA, 22 bp, Homo sapiens
ccctgacccaaaactgtcagaa

SEQ ID NO: 7457672 - DNA, 22 bp, Homo sapiens
ccctgacccaaaactgtcagaa

SEQ ID NO: 7457673 - DNA, 22 bp, Homo sapiens
ccctgacccaaaactgtcagaa

SEQ ID NO: 7457674 - DNA, 22 bp, Homo sapiens
ccctgacccaaaactgtcagaa

SEQ ID NO: 7457675 - DNA, 22 bp, Homo sapiens
ccctgaccatcccgcactgact

SEQ ID NO: 7457676 - DNA, 22 bp, Homo sapiens
ccctgaccagcagtacttggta

SEQ ID NO: 7457677 - DNA, 22 bp, Homo sapiens
ccctgaccaccagctccatttg

SEQ ID NO: 7457678 - DNA, 22 bp, Homo sapiens
ccctgaccatcccgcactgact

SEQ ID NO: 7457679 - DNA, 22 bp, Homo sapiens
ccctgaggaccaggaaggaggg

SEQ ID NO: 7457680 - DNA, 22 bp, Homo sapiens
ccctgaggaaagggtggagggc

SEQ ID NO: 7457681 - DNA, 22 bp, Homo sapiens
ccctgaggaccaggaaggaggg

SEQ ID NO: 7457682 - DNA, 22 bp, Homo sapiens
ccctgaggaccaggaaggaggg

SEQ ID NO: 7457683 - DNA, 22 bp, Homo sapiens
ccctgaggaccaggaaggaggg

SEQ ID NO: 7457684 - DNA, 22 bp, Homo sapiens
tggagcagaaatggcctcttgt

SEQ ID NO: 7457685 - DNA, 22 bp, Homo sapiens
tggagcagaaatggcctcttgt

SEQ ID NO: 7457686 - DNA, 22 bp, Homo sapiens
tggagcagaaatggcctcttgt

SEQ ID NO: 7457687 - DNA, 22 bp, Homo sapiens
tggagcaaattcaagctcatct

SEQ ID NO: 7457688 - DNA, 22 bp, Homo sapiens
tggagcaagctggagagaacat

SEQ ID NO: 7457689 - DNA, 22 bp, Homo sapiens
ccctgaggaaagggtggagggc

SEQ ID NO: 7457690 - DNA, 22 bp, Homo sapiens
ccctgaggaaagggtggagggc

SEQ ID NO: 7457691 - DNA, 22 bp, Homo sapiens
ccctgaggaaagggtggagggc

SEQ ID NO: 7457692 - DNA, 22 bp, Homo sapiens
ccctgaggaaagggtggagggc

SEQ ID NO: 7457693 - DNA, 23 bp, Homo sapiens
ccctgagctggtccaggctcaac

SEQ ID NO: 7457694 - DNA, 23 bp, Homo sapiens
ccctgagctggtccaggctcaac

SEQ ID NO: 7457695 - DNA, 23 bp, Homo sapiens
ccctgagctggtccaggctcaac

SEQ ID NO: 7457696 - DNA, 22 bp, Homo sapiens
ccctgagctcaggcccttgggg

SEQ ID NO: 7457697 - DNA, 23 bp, Homo sapiens
ccctgagctggtccaggctcaac

SEQ ID NO: 7457698 - DNA, 16 bp, Homo sapiens
tggagcaggcaggatg

SEQ ID NO: 7457699 - DNA, 16 bp, Homo sapiens
tggagcaggcaggatg

SEQ ID NO: 7457700 - DNA, 16 bp, Homo sapiens
tggagcaggcaggatg

SEQ ID NO: 7457701 - DNA, 16 bp, Homo sapiens
tggagcaggcaggatg

SEQ ID NO: 7457702 - DNA, 22 bp, Homo sapiens
tggagcaggcatctttctctct

SEQ ID NO: 7457703 - DNA, 22 bp, Homo sapiens
tggagcaggactgctgccctca

SEQ ID NO: 7457704 - DNA, 22 bp, Homo sapiens
tggagcaggactgctgccctca

SEQ ID NO: 7457705 - DNA, 22 bp, Homo sapiens
tggagcaggactgctgccctca

SEQ ID NO: 7457706 - DNA, 22 bp, Homo sapiens
tggagcaggactgctgccctca

SEQ ID NO: 7457707 - DNA, 16 bp, Homo sapiens
tggagcaggcaggatg

SEQ ID NO: 7457708 - DNA, 16 bp, Homo sapiens
tggagcaggcaggatg

SEQ ID NO: 7457709 - DNA, 22 bp, Homo sapiens
tggagcaaattcaagctcatct

SEQ ID NO: 7457710 - DNA, 22 bp, Homo sapiens
tggagcaggactgctgccctca

SEQ ID NO: 7457711 - DNA, 22 bp, Homo sapiens
tggagcagaaatggcctcttgt

SEQ ID NO: 7457712 - DNA, 22 bp, Homo sapiens
tggagcagaaatggcctcttgt

SEQ ID NO: 7457713 - DNA, 22 bp, Homo sapiens
tggagcagaaatggcctcttgt

SEQ ID NO: 7457714 - DNA, 22 bp, Homo sapiens
tggagcaggacggggagtggta

SEQ ID NO: 7457715 - DNA, 22 bp, Homo sapiens
tggagcaggacggggagtggta

SEQ ID NO: 7457716 - DNA, 22 bp, Homo sapiens
tggagcaggacggggagtggta

SEQ ID NO: 7457717 - DNA, 22 bp, Homo sapiens
tggagcaggacggggagtggta

SEQ ID NO: 7457718 - DNA, 22 bp, Homo sapiens
tggagcaggacggggagtggta

SEQ ID NO: 7457719 - DNA, 22 bp, Homo sapiens
tggagcaggacggggagtggta

SEQ ID NO: 7457720 - DNA, 22 bp, Homo sapiens
tggagcaggactgctgccctca

SEQ ID NO: 7457721 - DNA, 22 bp, Homo sapiens
tggagcaggactgctgccctca

SEQ ID NO: 7457722 - DNA, 22 bp, Homo sapiens
ccctgagatgcctcaccctagt

SEQ ID NO: 7457723 - DNA, 22 bp, Homo sapiens
ccctgagatgcctcaccctagt

SEQ ID NO: 7457724 - DNA, 22 bp, Homo sapiens
ccctgagatgtgaatttcagag

SEQ ID NO: 7457725 - DNA, 22 bp, Homo sapiens
ccctgagcaacaaactgaatac

SEQ ID NO: 7457726 - DNA, 22 bp, Homo sapiens
ccctgagcacacctggcagaca

SEQ ID NO: 7457727 - DNA, 22 bp, Homo sapiens
ccctgagcaacaaactgaatac

SEQ ID NO: 7457728 - DNA, 22 bp, Homo sapiens
ccctgagcacacctggcagaca

SEQ ID NO: 7457729 - DNA, 22 bp, Homo sapiens
ccctgagcacacctggcagaca

SEQ ID NO: 7457730 - DNA, 22 bp, Homo sapiens
ccctgagcacacctggcagaca

SEQ ID NO: 7457731 - DNA, 22 bp, Homo sapiens
ccctgagcacacctggcagaca

SEQ ID NO: 7457732 - DNA, 18 bp, Homo sapiens
ccctgagatgatgctgtg

SEQ ID NO: 7457733 - DNA, 22 bp, Homo sapiens
ccctgagagtgagtgccacctt

SEQ ID NO: 7457734 - DNA, 22 bp, Homo sapiens
ccctgagagtgagtgccacctt

SEQ ID NO: 7457735 - DNA, 18 bp, Homo sapiens
ccctgagatgatgctgtg

SEQ ID NO: 7457736 - DNA, 22 bp, Homo sapiens
ccctgagatgcctcaccctagt

SEQ ID NO: 7457737 - DNA, 22 bp, Homo sapiens
ccctgagatgcctcaccctagt

SEQ ID NO: 7457738 - DNA, 22 bp, Homo sapiens
ccctgagagtgagtgccacctt

SEQ ID NO: 7457739 - DNA, 22 bp, Homo sapiens
ccctgagcattcatgtgagctt

SEQ ID NO: 7457740 - DNA, 22 bp, Homo sapiens
ccctgagcattcatgtgagctt

SEQ ID NO: 7457741 - DNA, 22 bp, Homo sapiens
ccctgagcattcatgtgagctt

SEQ ID NO: 7457742 - DNA, 22 bp, Homo sapiens
ccctgagcattcatgtgagctt

SEQ ID NO: 7457743 - DNA, 22 bp, Homo sapiens
ccctgagccacacagagcaggt

SEQ ID NO: 7457744 - DNA, 22 bp, Homo sapiens
ccctgagccacacagagcaggt

SEQ ID NO: 7457745 - DNA, 22 bp, Homo sapiens
ccctgagccacacagagcaggt

SEQ ID NO: 7457746 - DNA, 22 bp, Homo sapiens
ccctgagcccatagttgacatt

SEQ ID NO: 7457747 - DNA, 22 bp, Homo sapiens
ccctgagccacacagagcaggt

SEQ ID NO: 7457748 - DNA, 22 bp, Homo sapiens
ccctgagcccatagttgacatt

SEQ ID NO: 7457749 - DNA, 22 bp, Homo sapiens
ccctgagccgctgctccaacct

SEQ ID NO: 7457750 - DNA, 22 bp, Homo sapiens
ccctgagccgcctgccgtgtcc

SEQ ID NO: 7457751 - DNA, 22 bp, Homo sapiens
ccctgagccgctgctccaacct

SEQ ID NO: 7457752 - DNA, 22 bp, Homo sapiens
ccctgagccgctgctccaacct

SEQ ID NO: 7457753 - DNA, 22 bp, Homo sapiens
ccctgagcgtgaggaggaagta

SEQ ID NO: 7457754 - DNA, 22 bp, Homo sapiens
ccctgagccgctgctccaacct

SEQ ID NO: 7457755 - DNA, 22 bp, Homo sapiens
cccagacataacagcagagagg

SEQ ID NO: 7457756 - DNA, 22 bp, Homo sapiens
cccagacataacagcagagagg

SEQ ID NO: 7457757 - DNA, 22 bp, Homo sapiens
cccagacataacagcagagagg

SEQ ID NO: 7457758 - DNA, 22 bp, Homo sapiens
cccagacataacagcagagagg

SEQ ID NO: 7457759 - DNA, 22 bp, Homo sapiens
cccagacataacagcagagagg

SEQ ID NO: 7457760 - DNA, 22 bp, Homo sapiens
cccagacattgcagggactggt

SEQ ID NO: 7457761 - DNA, 22 bp, Homo sapiens
cccagacattgcagggactggt

SEQ ID NO: 7457762 - DNA, 22 bp, Homo sapiens
cccagacattgcagggactggt

SEQ ID NO: 7457763 - DNA, 22 bp, Homo sapiens
cccagacccagagggaggcagg

SEQ ID NO: 7457764 - DNA, 22 bp, Homo sapiens
cccagacattgcagggactggt

SEQ ID NO: 7457765 - DNA, 22 bp, Homo sapiens
cccagacataacagcagagagg

SEQ ID NO: 7457766 - DNA, 22 bp, Homo sapiens
cccagacagtcaagaggcctgc

SEQ ID NO: 7457767 - DNA, 22 bp, Homo sapiens
cccagacagtgatttacttaat

SEQ ID NO: 7457768 - DNA, 20 bp, Homo sapiens
cccagaagtcacctccactc

SEQ ID NO: 7457769 - DNA, 22 bp, Homo sapiens
cccagacagtcaagaggcctgc

SEQ ID NO: 7457770 - DNA, 22 bp, Homo sapiens
cccagacagtcaagaggcctgc

SEQ ID NO: 7457771 - DNA, 22 bp, Homo sapiens
cccagacagtcaagaggcctgc

SEQ ID NO: 7457772 - DNA, 22 bp, Homo sapiens
cccagacagtcaagaggcctgc

SEQ ID NO: 7457773 - DNA, 22 bp, Homo sapiens
cccagacagtcaagaggcctgc

SEQ ID NO: 7457774 - DNA, 22 bp, Homo sapiens
cccagacagtcaagaggcctgc

SEQ ID NO: 7457775 - DNA, 22 bp, Homo sapiens
cccagaatgttatagtgcccct

SEQ ID NO: 7457776 - DNA, 20 bp, Homo sapiens
cccagaagcttaacagagca

SEQ ID NO: 7457777 - DNA, 22 bp, Homo sapiens
cccagaaggctaagcgtggatt

SEQ ID NO: 7457778 - DNA, 20 bp, Homo sapiens
cccagaagcttaacagagca

SEQ ID NO: 7457779 - DNA, 22 bp, Homo sapiens
cccagaaggctaagcgtggatt

SEQ ID NO: 7457780 - DNA, 22 bp, Homo sapiens
cccagaaggcttgccaggaagc

SEQ ID NO: 7457781 - DNA, 22 bp, Homo sapiens
cccagaaggctaagcgtggatt

SEQ ID NO: 7457782 - DNA, 22 bp, Homo sapiens
cccagaaggctaagcgtggatt

SEQ ID NO: 7457783 - DNA, 22 bp, Homo sapiens
cccagaaggctaagcgtggatt

SEQ ID NO: 7457784 - DNA, 22 bp, Homo sapiens
cccagaaggtcgaggctgcagt

SEQ ID NO: 7457785 - DNA, 22 bp, Homo sapiens
cccagaaggtcgaggctgcagt

SEQ ID NO: 7457786 - DNA, 22 bp, Homo sapiens
cccagaaggcttgccaggaagc

SEQ ID NO: 7457787 - DNA, 22 bp, Homo sapiens
cccagaaggcttgccaggaagc

SEQ ID NO: 7457788 - DNA, 22 bp, Homo sapiens
cccagaaggcttgccaggaagc

SEQ ID NO: 7457789 - DNA, 22 bp, Homo sapiens
cccagaaggcttgccaggaagc

SEQ ID NO: 7457790 - DNA, 21 bp, Homo sapiens
cccagaagttccatggggggc

SEQ ID NO: 7457791 - DNA, 21 bp, Homo sapiens
cccagaagttccatggggggc

SEQ ID NO: 7457792 - DNA, 22 bp, Homo sapiens
cccagaatgattcagcgacagt

SEQ ID NO: 7457793 - DNA, 22 bp, Homo sapiens
cccagaataggtaagcccaggg

SEQ ID NO: 7457794 - DNA, 22 bp, Homo sapiens
cccagaatgattcagcgacagt

SEQ ID NO: 7457795 - DNA, 21 bp, Homo sapiens
cccagaagttccatggggggc

SEQ ID NO: 7457796 - DNA, 22 bp, Homo sapiens
cccagaataggtaagcccaggg

SEQ ID NO: 7457797 - DNA, 20 bp, Homo sapiens
cccagaagtcacctccactc

SEQ ID NO: 7457798 - DNA, 22 bp, Homo sapiens
cccagaaggtcgaggctgcagt

SEQ ID NO: 7457799 - DNA, 22 bp, Homo sapiens
cccagaaggtcgaggctgcagt

SEQ ID NO: 7457800 - DNA, 22 bp, Homo sapiens
cccagaaggtcgaggctgcagt

SEQ ID NO: 7457801 - DNA, 22 bp, Homo sapiens
cccagaaggcttgccaggaagc

SEQ ID NO: 7457802 - DNA, 22 bp, Homo sapiens
cccagaaggtcgaggctgcagt

SEQ ID NO: 7457803 - DNA, 22 bp, Homo sapiens
tgcacacatatgagcatgtgtg

SEQ ID NO: 7457804 - DNA, 22 bp, Homo sapiens
tgcacacatatgagcatgtgtg

SEQ ID NO: 7457805 - DNA, 22 bp, Homo sapiens
tgcacacatgtatgtatatgtg

SEQ ID NO: 7457806 - DNA, 22 bp, Homo sapiens
tgcacacatgtatgtatatgtg

SEQ ID NO: 7457807 - DNA, 22 bp, Homo sapiens
tgcacacatgtatgtatatgtg

SEQ ID NO: 7457808 - DNA, 22 bp, Homo sapiens
cccagacccagagggaggcagg

SEQ ID NO: 7457809 - DNA, 22 bp, Homo sapiens
cccagactcctctggctggtgg

SEQ ID NO: 7457810 - DNA, 22 bp, Homo sapiens
cccagactcctctggctggtgg

SEQ ID NO: 7457811 - DNA, 22 bp, Homo sapiens
cccagactcatccctgggagct

SEQ ID NO: 7457812 - DNA, 22 bp, Homo sapiens
cccagactcatccctgggagct

SEQ ID NO: 7457813 - DNA, 22 bp, Homo sapiens
tgcacacatgtttacaagcatc

SEQ ID NO: 7457814 - DNA, 22 bp, Homo sapiens
tgcacacatgtttacaagcatc

SEQ ID NO: 7457815 - DNA, 22 bp, Homo sapiens
tgcacacatgtatgtatatgtg

SEQ ID NO: 7457816 - DNA, 22 bp, Homo sapiens
tgcacacatgtttacaagcatc

SEQ ID NO: 7457817 - DNA, 22 bp, Homo sapiens
tgcacacatgtttacaagcatc

SEQ ID NO: 7457818 - DNA, 22 bp, Homo sapiens
tgcacacatgtttacaagcatc

SEQ ID NO: 7457819 - DNA, 22 bp, Homo sapiens
tgcacacatgtttacaagcatc

SEQ ID NO: 7457820 - DNA, 22 bp, Homo sapiens
tgcacacatgtttacaagcatc

SEQ ID NO: 7457821 - DNA, 22 bp, Homo sapiens
tgcacacatgtttacaagcatc

SEQ ID NO: 7457822 - DNA, 22 bp, Homo sapiens
tgcacacctctccaccactctc

SEQ ID NO: 7457823 - DNA, 22 bp, Homo sapiens
tgcacactgctgctccaggagg

SEQ ID NO: 7457824 - DNA, 22 bp, Homo sapiens
tgcacacttagtatgactacat

SEQ ID NO: 7457825 - DNA, 22 bp, Homo sapiens
tgcacacttagtatgactacat

SEQ ID NO: 7457826 - DNA, 22 bp, Homo sapiens
tgcacacattctatggggctga

SEQ ID NO: 7457827 - DNA, 22 bp, Homo sapiens
tgcacacctctccaccactctc

SEQ ID NO: 7457828 - DNA, 22 bp, Homo sapiens
tgcacagaataatatatgttct

SEQ ID NO: 7457829 - DNA, 22 bp, Homo sapiens
tgcacagacaactctttctaga

SEQ ID NO: 7457830 - DNA, 22 bp, Homo sapiens
tgcacacatgtttacaagcatc

SEQ ID NO: 7457831 - DNA, 22 bp, Homo sapiens
tgcacacattaaggatacacag

SEQ ID NO: 7457832 - DNA, 22 bp, Homo sapiens
tgcacacattaaggatacacag

SEQ ID NO: 7457833 - DNA, 22 bp, Homo sapiens
tgcacacattaaggatacacag

SEQ ID NO: 7457834 - DNA, 22 bp, Homo sapiens
tgcacacattaaggatacacag

SEQ ID NO: 7457835 - DNA, 22 bp, Homo sapiens
tgcacacattctatggggctga

SEQ ID NO: 7457836 - DNA, 22 bp, Homo sapiens
tgcacacattctatggggctga

SEQ ID NO: 7457837 - DNA, 22 bp, Homo sapiens
tgcacacattctatggggctga

SEQ ID NO: 7457838 - DNA, 22 bp, Homo sapiens
tgcacacattaaggatacacag

SEQ ID NO: 7457839 - DNA, 23 bp, Homo sapiens
tgcaaataacaaggagtttaagg

SEQ ID NO: 7457840 - DNA, 23 bp, Homo sapiens
tgcaaataacaaggagtttaagg

SEQ ID NO: 7457841 - DNA, 22 bp, Homo sapiens
tgcaaataaatttctgttcatt

SEQ ID NO: 7457842 - DNA, 23 bp, Homo sapiens
tgcaaataacaaggagtttaagg

SEQ ID NO: 7457843 - DNA, 23 bp, Homo sapiens
tgcaaataacaaggagtttaagg

SEQ ID NO: 7457844 - DNA, 23 bp, Homo sapiens
tgcaaataacaaggagtttaagg

SEQ ID NO: 7457845 - DNA, 22 bp, Homo sapiens
tgcaaataaatttctgttcatt

SEQ ID NO: 7457846 - DNA, 22 bp, Homo sapiens
tgcaaataaatttctgttcatt

SEQ ID NO: 7457847 - DNA, 22 bp, Homo sapiens
tgcaaataaatttctgttcatt

SEQ ID NO: 7457848 - DNA, 22 bp, Homo sapiens
tgcaaatacaaaatggtacagc

SEQ ID NO: 7457849 - DNA, 22 bp, Homo sapiens
tgcaaatacaaaatggtacagc

SEQ ID NO: 7457850 - DNA, 22 bp, Homo sapiens
tgcaaataagctattatggaat

SEQ ID NO: 7457851 - DNA, 22 bp, Homo sapiens
tgcaaatacaaaatggtacagc

SEQ ID NO: 7457852 - DNA, 22 bp, Homo sapiens
tgcaaatacaaaatggtacagc

SEQ ID NO: 7457853 - DNA, 23 bp, Homo sapiens
tgcaaataccatgctgtcctgtc

SEQ ID NO: 7457854 - DNA, 22 bp, Homo sapiens
tgcaaatagcctatatttatag

SEQ ID NO: 7457855 - DNA, 22 bp, Homo sapiens
tgcaaatagcctatatttatag

SEQ ID NO: 7457856 - DNA, 22 bp, Homo sapiens
tgcaaatagcctatatttatag

SEQ ID NO: 7457857 - DNA, 22 bp, Homo sapiens
tgcaaatagcctatatttatag

SEQ ID NO: 7457858 - DNA, 22 bp, Homo sapiens
tgcaaatagcctatatttatag

SEQ ID NO: 7457859 - DNA, 18 bp, Homo sapiens
tgcaaaggacactgagat

SEQ ID NO: 7457860 - DNA, 22 bp, Homo sapiens
tgcaaagccaccctggcggtgg

SEQ ID NO: 7457861 - DNA, 18 bp, Homo sapiens
tgcaaaggacactgagat

SEQ ID NO: 7457862 - DNA, 21 bp, Homo sapiens
tgcaaaggacctgaggtagga

SEQ ID NO: 7457863 - DNA, 22 bp, Homo sapiens
tgcaaaggaggatgggaaagaa

SEQ ID NO: 7457864 - DNA, 22 bp, Homo sapiens
tgcaaagcaatgtaggtcagct

SEQ ID NO: 7457865 - DNA, 23 bp, Homo sapiens
tgcaaagcacttaagaggccctg

SEQ ID NO: 7457866 - DNA, 21 bp, Homo sapiens
tgcaaagctgctgaagtggta

SEQ ID NO: 7457867 - DNA, 22 bp, Homo sapiens
tgcaaagccacaatgaaatcag

SEQ ID NO: 7457868 - DNA, 22 bp, Homo sapiens
tgcaaagccacaatgaaatcag

SEQ ID NO: 7457869 - DNA, 22 bp, Homo sapiens
tgcaaaggcatctgggaaggtt

SEQ ID NO: 7457870 - DNA, 22 bp, Homo sapiens
tgcaaaggcatctgggaaggtt

SEQ ID NO: 7457871 - DNA, 22 bp, Homo sapiens
tgcaaagggctttgcatacaga

SEQ ID NO: 7457872 - DNA, 22 bp, Homo sapiens
tgcaaaggcctttaggttgaaa

SEQ ID NO: 7457873 - DNA, 22 bp, Homo sapiens
tgcaaagggctttgcatacaga

SEQ ID NO: 7457874 - DNA, 21 bp, Homo sapiens
tgcaaaggtatttagggggta

SEQ ID NO: 7457875 - DNA, 22 bp, Homo sapiens
tgcaaagtcgcaaaattcttct

SEQ ID NO: 7457876 - DNA, 22 bp, Homo sapiens
tgcaaagttgaggaaggcatgg

SEQ ID NO: 7457877 - DNA, 22 bp, Homo sapiens
tgcaaatattccatgctgttca

SEQ ID NO: 7457878 - DNA, 22 bp, Homo sapiens
tgcaaatattagcattcgatat

SEQ ID NO: 7457879 - DNA, 22 bp, Homo sapiens
tgcaaatattccatgctgttca

SEQ ID NO: 7457880 - DNA, 22 bp, Homo sapiens
cccacccctggacaggtgagtg

SEQ ID NO: 7457881 - DNA, 22 bp, Homo sapiens
tgcaaatagcctgatgaaagaa

SEQ ID NO: 7457882 - DNA, 22 bp, Homo sapiens
tgcaaatagcctgatgaaagaa

SEQ ID NO: 7457883 - DNA, 22 bp, Homo sapiens
tgcaaatagcctgatgaaagaa

SEQ ID NO: 7457884 - DNA, 22 bp, Homo sapiens
tgcaaatagcctatatttatag

SEQ ID NO: 7457885 - DNA, 22 bp, Homo sapiens
tgcaaataggggacaactcttt

SEQ ID NO: 7457886 - DNA, 22 bp, Homo sapiens
tgcaaataggggacaactcttt

SEQ ID NO: 7457887 - DNA, 22 bp, Homo sapiens
tgcaaataggggacaactcttt

SEQ ID NO: 7457888 - DNA, 22 bp, Homo sapiens
tgcaaataggggacaactcttt

SEQ ID NO: 7457889 - DNA, 22 bp, Homo sapiens
tgcaaatagcctgatgaaagaa

SEQ ID NO: 7457890 - DNA, 22 bp, Homo sapiens
tgcaaatagcctgatgaaagaa

SEQ ID NO: 7457891 - DNA, 22 bp, Homo sapiens
cccacttcatgggcaggaagga

SEQ ID NO: 7457892 - DNA, 22 bp, Homo sapiens
cccacttcatgggcaggaagga

SEQ ID NO: 7457893 - DNA, 22 bp, Homo sapiens
cccacttcatgggcaggaagga

SEQ ID NO: 7457894 - DNA, 22 bp, Homo sapiens
cccactgtttccctgaggctct

SEQ ID NO: 7457895 - DNA, 20 bp, Homo sapiens
cccagaagcttaacagagca

SEQ ID NO: 7457896 - DNA, 20 bp, Homo sapiens
cccagaagcttaacagagca

SEQ ID NO: 7457897 - DNA, 20 bp, Homo sapiens
cccagaagcttaacagagca

SEQ ID NO: 7457898 - DNA, 20 bp, Homo sapiens
cccagaagcttaacagagca

SEQ ID NO: 7457899 - DNA, 22 bp, Homo sapiens
cccactgtgttgcagtctagtg

SEQ ID NO: 7457900 - DNA, 22 bp, Homo sapiens
cccactgtgttgcagtctagtg

SEQ ID NO: 7457901 - DNA, 18 bp, Homo sapiens
cccaccctggctcttagt

SEQ ID NO: 7457902 - DNA, 18 bp, Homo sapiens
cccaccctggctcttagt

SEQ ID NO: 7457903 - DNA, 22 bp, Homo sapiens
cccaccctcaagggtgtctata

SEQ ID NO: 7457904 - DNA, 23 bp, Homo sapiens
tgattttaaaaagtaagttatca

SEQ ID NO: 7457905 - DNA, 23 bp, Homo sapiens
tgattttaaaaagtaagttatca

SEQ ID NO: 7457906 - DNA, 23 bp, Homo sapiens
tgattttaaaaagtaagttatca

SEQ ID NO: 7457907 - DNA, 22 bp, Homo sapiens
tgatttgcgtctcatttgaaat

SEQ ID NO: 7457908 - DNA, 23 bp, Homo sapiens
tgattttaaaaagtaagttatca

SEQ ID NO: 7457909 - DNA, 23 bp, Homo sapiens
tgattttaaaaagtaagttatca

SEQ ID NO: 7457910 - DNA, 23 bp, Homo sapiens
tgattttaaaaagtaagttatca

SEQ ID NO: 7457911 - DNA, 23 bp, Homo sapiens
tgattttaaaaagtaagttatca

SEQ ID NO: 7457912 - DNA, 22 bp, Homo sapiens
tgatttgttacacaggtgtgtg

SEQ ID NO: 7457913 - DNA, 22 bp, Homo sapiens
tgatttgttacacaggtgtgtg

SEQ ID NO: 7457914 - DNA, 22 bp, Homo sapiens
tgatttgtttagtgccaagttt

SEQ ID NO: 7457915 - DNA, 22 bp, Homo sapiens
tgatttgtttagtgccaagttt

SEQ ID NO: 7457916 - DNA, 22 bp, Homo sapiens
tgatttgcgtctcatttgaaat

SEQ ID NO: 7457917 - DNA, 22 bp, Homo sapiens
tgatttgcgtctcatttgaaat

SEQ ID NO: 7457918 - DNA, 22 bp, Homo sapiens
tgatttcttctaatttccatca

SEQ ID NO: 7457919 - DNA, 22 bp, Homo sapiens
tgatttcttctaatttccatca

SEQ ID NO: 7457920 - DNA, 22 bp, Homo sapiens
tgatttgaaacctttggcaaga

SEQ ID NO: 7457921 - DNA, 22 bp, Homo sapiens
tgatttgaaacctttggcaaga

SEQ ID NO: 7457922 - DNA, 22 bp, Homo sapiens
tgatttgaattttaaaacactg

SEQ ID NO: 7457923 - DNA, 22 bp, Homo sapiens
tgatttgaactctgggacttgt

SEQ ID NO: 7457924 - DNA, 22 bp, Homo sapiens
tgatttgaggtacataaatcca

SEQ ID NO: 7457925 - DNA, 22 bp, Homo sapiens
tgatttgaggtacataaatcca

SEQ ID NO: 7457926 - DNA, 20 bp, Homo sapiens
tgatttgagaagctgctggt

SEQ ID NO: 7457927 - DNA, 20 bp, Homo sapiens
tgatttgatcatggctgcat

SEQ ID NO: 7457928 - DNA, 22 bp, Homo sapiens
tgatttgattcttcttggagta

SEQ ID NO: 7457929 - DNA, 22 bp, Homo sapiens
tgatttgcatggagaataacag

SEQ ID NO: 7457930 - DNA, 22 bp, Homo sapiens
tgattttacttagcatgatgtt

SEQ ID NO: 7457931 - DNA, 22 bp, Homo sapiens
tgattttacttagcatgatgtt

SEQ ID NO: 7457932 - DNA, 23 bp, Homo sapiens
tgattttaaaaagtaagttatca

SEQ ID NO: 7457933 - DNA, 22 bp, Homo sapiens
tgattttacttagcatgatgtt

SEQ ID NO: 7457934 - DNA, 23 bp, Homo sapiens
tgattttaaaaagtaagttatca

SEQ ID NO: 7457935 - DNA, 23 bp, Homo sapiens
tgattttaaaaagtaagttatca

SEQ ID NO: 7457936 - DNA, 23 bp, Homo sapiens
tgattttaaaaagtaagttatca

SEQ ID NO: 7457937 - DNA, 22 bp, Homo sapiens
tgattttattgaaacttcactt

SEQ ID NO: 7457938 - DNA, 22 bp, Homo sapiens
tgattttattgaaacttcactt

SEQ ID NO: 7457939 - DNA, 22 bp, Homo sapiens
tgattttacttagcatgatgtt

SEQ ID NO: 7457940 - DNA, 22 bp, Homo sapiens
tgattttacttagcatgatgtt

SEQ ID NO: 7457941 - DNA, 22 bp, Homo sapiens
tgattttattggtgaggaaatt

SEQ ID NO: 7457942 - DNA, 22 bp, Homo sapiens
tgattttattggtgaggaaatt

SEQ ID NO: 7457943 - DNA, 22 bp, Homo sapiens
tgattttattgaaacttcactt

SEQ ID NO: 7457944 - DNA, 22 bp, Homo sapiens
tgattttattgaaacttcactt

SEQ ID NO: 7457945 - DNA, 22 bp, Homo sapiens
tgattttattggtgaggaaatt

SEQ ID NO: 7457946 - DNA, 22 bp, Homo sapiens
tgatttctcatattgttcaaaa

SEQ ID NO: 7457947 - DNA, 22 bp, Homo sapiens
tgatttctagtgaggttgaaca

SEQ ID NO: 7457948 - DNA, 22 bp, Homo sapiens
tgatttctagtgaggttgaaca

SEQ ID NO: 7457949 - DNA, 22 bp, Homo sapiens
tgatttctcatattgttcaaaa

SEQ ID NO: 7457950 - DNA, 21 bp, Homo sapiens
tgatttctagatattggccca

SEQ ID NO: 7457951 - DNA, 22 bp, Homo sapiens
tgattcaagctactgttactgg

SEQ ID NO: 7457952 - DNA, 22 bp, Homo sapiens
tgatttcctgtgcgcccttagg

SEQ ID NO: 7457953 - DNA, 22 bp, Homo sapiens
tgattcaagctactgttactgg

SEQ ID NO: 7457954 - DNA, 22 bp, Homo sapiens
tgattcaagattggttagctgt

SEQ ID NO: 7457955 - DNA, 22 bp, Homo sapiens
tgattcaagccaccacatactg

SEQ ID NO: 7457956 - DNA, 22 bp, Homo sapiens
ccattgtaaagagtatactttg

SEQ ID NO: 7457957 - DNA, 22 bp, Homo sapiens
ccattgtaaagagtatactttg

SEQ ID NO: 7457958 - DNA, 22 bp, Homo sapiens
ccattgtaaagagtatactttg

SEQ ID NO: 7457959 - DNA, 22 bp, Homo sapiens
ccattgtaaattctgtggaagt

SEQ ID NO: 7457960 - DNA, 22 bp, Homo sapiens
ccattgtaaattctgtggaagt

SEQ ID NO: 7457961 - DNA, 22 bp, Homo sapiens
ccattgtaaattctgtggaagt

SEQ ID NO: 7457962 - DNA, 22 bp, Homo sapiens
ccattgtaaattctgtggaagt

SEQ ID NO: 7457963 - DNA, 22 bp, Homo sapiens
tgattcaagattggttagctgt

SEQ ID NO: 7457964 - DNA, 22 bp, Homo sapiens
tgattcaagccaccacatactg

SEQ ID NO: 7457965 - DNA, 22 bp, Homo sapiens
tgatttctctccgttatttcag

SEQ ID NO: 7457966 - DNA, 22 bp, Homo sapiens
tgatttctctccgttatttcag

SEQ ID NO: 7457967 - DNA, 22 bp, Homo sapiens
tgatttctctccgttatttcag

SEQ ID NO: 7457968 - DNA, 22 bp, Homo sapiens
tgatttctcatattgttcaaaa

SEQ ID NO: 7457969 - DNA, 20 bp, Homo sapiens
tgatttctcttctattcctt

SEQ ID NO: 7457970 - DNA, 22 bp, Homo sapiens
tgatttctcttggcaatatgtt

SEQ ID NO: 7457971 - DNA, 20 bp, Homo sapiens
tgatttctcttctattcctt

SEQ ID NO: 7457972 - DNA, 22 bp, Homo sapiens
tgatttcttccttgtcattaga

SEQ ID NO: 7457973 - DNA, 22 bp, Homo sapiens
tgatttcttccttgtcattaga

SEQ ID NO: 7457974 - DNA, 21 bp, Homo sapiens
tgatttctgccaagttcacta

SEQ ID NO: 7457975 - DNA, 21 bp, Homo sapiens
tgatttctgccaagttcacta

SEQ ID NO: 7457976 - DNA, 21 bp, Homo sapiens
tgatttctgccaagttcacta

SEQ ID NO: 7457977 - DNA, 21 bp, Homo sapiens
tgatttctgccaagttcacta

SEQ ID NO: 7457978 - DNA, 22 bp, Homo sapiens
tgatttcttccttgtcattaga

SEQ ID NO: 7457979 - DNA, 22 bp, Homo sapiens
ccattaaaatggaatgtagtga

SEQ ID NO: 7457980 - DNA, 22 bp, Homo sapiens
ccattaaaatggaatgtagtga

SEQ ID NO: 7457981 - DNA, 22 bp, Homo sapiens
ccattaaaatggaatgtagtga

SEQ ID NO: 7457982 - DNA, 22 bp, Homo sapiens
ccattaaaatggaatgtagtga

SEQ ID NO: 7457983 - DNA, 22 bp, Homo sapiens
ccattaaaatggaatgtagtga

SEQ ID NO: 7457984 - DNA, 22 bp, Homo sapiens
ccatgttgtcaaacttagagta

SEQ ID NO: 7457985 - DNA, 22 bp, Homo sapiens
ccattaaaatggaatgtagtga

SEQ ID NO: 7457986 - DNA, 22 bp, Homo sapiens
ccattaaaatggaatgtagtga

SEQ ID NO: 7457987 - DNA, 22 bp, Homo sapiens
ccattaaaattgtgacatagga

SEQ ID NO: 7457988 - DNA, 22 bp, Homo sapiens
ccattaaaattgtgacatagga

SEQ ID NO: 7457989 - DNA, 22 bp, Homo sapiens
ccattaaaattgtgacatagga

SEQ ID NO: 7457990 - DNA, 22 bp, Homo sapiens
ccattaaaattgtgacatagga

SEQ ID NO: 7457991 - DNA, 22 bp, Homo sapiens
ccattaaacttgtggacccagt

SEQ ID NO: 7457992 - DNA, 22 bp, Homo sapiens
ccattaaacttgtggacccagt

SEQ ID NO: 7457993 - DNA, 22 bp, Homo sapiens
ccattaaacttgtggacccagt

SEQ ID NO: 7457994 - DNA, 22 bp, Homo sapiens
ccatgttggaacttcacattct

SEQ ID NO: 7457995 - DNA, 22 bp, Homo sapiens
ccatgttgtatctcttatcggc

SEQ ID NO: 7457996 - DNA, 22 bp, Homo sapiens
ccatgttgtcaaacttagagta

SEQ ID NO: 7457997 - DNA, 22 bp, Homo sapiens
ccatgttgtatctcttatcggc

SEQ ID NO: 7457998 - DNA, 22 bp, Homo sapiens
ccatgttggaacttcacattct

SEQ ID NO: 7457999 - DNA, 22 bp, Homo sapiens
ccatgtgttgattctctgcaga

SEQ ID NO: 7458000 - DNA, 22 bp, Homo sapiens
ccattaaagcaccactgtaata

SEQ ID NO: 7458001 - DNA, 22 bp, Homo sapiens
ccattaaagcaccactgtaata

SEQ ID NO: 7458002 - DNA, 22 bp, Homo sapiens
ccattaaagcaccactgtaata

SEQ ID NO: 7458003 - DNA, 22 bp, Homo sapiens
ccattaaagcaccactgtaata

SEQ ID NO: 7458004 - DNA, 22 bp, Homo sapiens
ccattaaagcaccactgtaata

SEQ ID NO: 7458005 - DNA, 22 bp, Homo sapiens
ccattaaagcaccactgtaata

SEQ ID NO: 7458006 - DNA, 22 bp, Homo sapiens
ccattaagtattattaatgatt

SEQ ID NO: 7458007 - DNA, 22 bp, Homo sapiens
ccattactttccaatatatcag

SEQ ID NO: 7458008 - DNA, 22 bp, Homo sapiens
ccattagtacctctggaaaatt

SEQ ID NO: 7458009 - DNA, 22 bp, Homo sapiens
ccattagaagatgtaatagaga

SEQ ID NO: 7458010 - DNA, 22 bp, Homo sapiens
ccattatccacgggcttcctga

SEQ ID NO: 7458011 - DNA, 22 bp, Homo sapiens
ccattcatacaattttgttcta

SEQ ID NO: 7458012 - DNA, 22 bp, Homo sapiens
ccattcacttttgccctgtcct

SEQ ID NO: 7458013 - DNA, 22 bp, Homo sapiens
ccattcatagcaagctacatct

SEQ ID NO: 7458014 - DNA, 23 bp, Homo sapiens
ccattcatctcagtcattgcttt

SEQ ID NO: 7458015 - DNA, 22 bp, Homo sapiens
ccattattataggaggctcatt

SEQ ID NO: 7458016 - DNA, 22 bp, Homo sapiens
ccattattataggaggctcatt

SEQ ID NO: 7458017 - DNA, 22 bp, Homo sapiens
ccattcacctcttcacgtgctc

SEQ ID NO: 7458018 - DNA, 22 bp, Homo sapiens
ccattcaataccttagagaaaa

SEQ ID NO: 7458019 - DNA, 22 bp, Homo sapiens
ccattagataatgcacaccctc

SEQ ID NO: 7458020 - DNA, 22 bp, Homo sapiens
ccattctgaagtgcaggctaag

SEQ ID NO: 7458021 - DNA, 22 bp, Homo sapiens
ccattctgaagtgcaggctaag

SEQ ID NO: 7458022 - DNA, 22 bp, Homo sapiens
ccattctgaacaattcttgtct

SEQ ID NO: 7458023 - DNA, 22 bp, Homo sapiens
ccattctgaacaattcttgtct

SEQ ID NO: 7458024 - DNA, 22 bp, Homo sapiens
ccattctgaacaattcttgtct

SEQ ID NO: 7458025 - DNA, 22 bp, Homo sapiens
ccattccttcatcaaaaggcct

SEQ ID NO: 7458026 - DNA, 22 bp, Homo sapiens
ccattccttcatcaaaaggcct

SEQ ID NO: 7458027 - DNA, 19 bp, Homo sapiens
ccattcctctagaatttgg

SEQ ID NO: 7458028 - DNA, 19 bp, Homo sapiens
ccattcctctagaatttgg

SEQ ID NO: 7458029 - DNA, 23 bp, Homo sapiens
ccattcccactgtgccttccctg

SEQ ID NO: 7458030 - DNA, 22 bp, Homo sapiens
ccattccatgtgctacacataa

SEQ ID NO: 7458031 - DNA, 22 bp, Homo sapiens
ccattctgacacctaattctgt

SEQ ID NO: 7458032 - DNA, 22 bp, Homo sapiens
ccattctgacacctaattctgt

SEQ ID NO: 7458033 - DNA, 22 bp, Homo sapiens
ccattctgacttcattgcctca

SEQ ID NO: 7458034 - DNA, 22 bp, Homo sapiens
ccattctgacttcattgcctca

SEQ ID NO: 7458035 - DNA, 22 bp, Homo sapiens
ccattctgagtcttatgtcttt

SEQ ID NO: 7458036 - DNA, 22 bp, Homo sapiens
ccattctgacttcattgcctca

SEQ ID NO: 7458037 - DNA, 22 bp, Homo sapiens
ccattctgagtcttatgtcttt

SEQ ID NO: 7458038 - DNA, 22 bp, Homo sapiens
ccattctgccatgcttcatcta

SEQ ID NO: 7458039 - DNA, 20 bp, Homo sapiens
ccattctgggtgcagtctgg

SEQ ID NO: 7458040 - DNA, 20 bp, Homo sapiens
ccattctgggtgcagtctgg

SEQ ID NO: 7458041 - DNA, 22 bp, Homo sapiens
ccattctgccatgcttcatcta

SEQ ID NO: 7458042 - DNA, 22 bp, Homo sapiens
ccattctgccatgcttcatcta

SEQ ID NO: 7458043 - DNA, 20 bp, Homo sapiens
ccattctgggtgcagtctgg

SEQ ID NO: 7458044 - DNA, 20 bp, Homo sapiens
ccattctgggtgcagtctgg

SEQ ID NO: 7458045 - DNA, 22 bp, Homo sapiens
ccattctgagtcttatgtcttt

SEQ ID NO: 7458046 - DNA, 22 bp, Homo sapiens
ccattctgccatgcttcatcta

SEQ ID NO: 7458047 - DNA, 22 bp, Homo sapiens
ccattctgtataaatgctagaa

SEQ ID NO: 7458048 - DNA, 19 bp, Homo sapiens
ccattctgtctctgccaca

SEQ ID NO: 7458049 - DNA, 22 bp, Homo sapiens
ccattctgtccagaggaggaag

SEQ ID NO: 7458050 - DNA, 19 bp, Homo sapiens
ccattctgtctctgccaca

SEQ ID NO: 7458051 - DNA, 19 bp, Homo sapiens
ccattctgtctctgccaca

SEQ ID NO: 7458052 - DNA, 22 bp, Homo sapiens
ccattctgtgtctctccacagc

SEQ ID NO: 7458053 - DNA, 19 bp, Homo sapiens
ccattctgtctctgccaca

SEQ ID NO: 7458054 - DNA, 22 bp, Homo sapiens
ccattctgtgtctctccacagc

SEQ ID NO: 7458055 - DNA, 22 bp, Homo sapiens
ccattctgtgtctctccacagc

SEQ ID NO: 7458056 - DNA, 22 bp, Homo sapiens
ccattctgtttaatgaatgaaa

SEQ ID NO: 7458057 - DNA, 22 bp, Homo sapiens
ccattctttcagtgtctcatgt

SEQ ID NO: 7458058 - DNA, 22 bp, Homo sapiens
ccattctttcagtgtctcatgt

SEQ ID NO: 7458059 - DNA, 21 bp, Homo sapiens
ccattcttagtcaagtgtctc

SEQ ID NO: 7458060 - DNA, 22 bp, Homo sapiens
ccattctttcagtgtctcatgt

SEQ ID NO: 7458061 - DNA, 22 bp, Homo sapiens
ccattgaattagaaggggaagg

SEQ ID NO: 7458062 - DNA, 22 bp, Homo sapiens
ccattgaatcctcagctgctag

SEQ ID NO: 7458063 - DNA, 22 bp, Homo sapiens
ccattgaacccctctaggccac

SEQ ID NO: 7458064 - DNA, 22 bp, Homo sapiens
ccattgaaggcacttgagcaga

SEQ ID NO: 7458065 - DNA, 19 bp, Homo sapiens
ccattgtaaagaaaaatgt

SEQ ID NO: 7458066 - DNA, 22 bp, Homo sapiens
ccattggagccaagagttttac

SEQ ID NO: 7458067 - DNA, 21 bp, Homo sapiens
ccattgagaccatggaggagt

SEQ ID NO: 7458068 - DNA, 22 bp, Homo sapiens
ccattgattaccagcagcagtt

SEQ ID NO: 7458069 - DNA, 22 bp, Homo sapiens
ccattgcactccatcctgggca

SEQ ID NO: 7458070 - DNA, 22 bp, Homo sapiens
ccattggagagttttaagaagg

SEQ ID NO: 7458071 - DNA, 22 bp, Homo sapiens
tgaggcagcccactttccttag

SEQ ID NO: 7458072 - DNA, 22 bp, Homo sapiens
tgaggcagcccactttccttag

SEQ ID NO: 7458073 - DNA, 22 bp, Homo sapiens
tgaggcagcccactttccttag

SEQ ID NO: 7458074 - DNA, 22 bp, Homo sapiens
tgaggcagcccactttccttag

SEQ ID NO: 7458075 - DNA, 22 bp, Homo sapiens
tgaggcagcccactttccttag

SEQ ID NO: 7458076 - DNA, 22 bp, Homo sapiens
tgaggcagcccactttccttag

SEQ ID NO: 7458077 - DNA, 22 bp, Homo sapiens
tgaggcagcattcttcaagaca

SEQ ID NO: 7458078 - DNA, 22 bp, Homo sapiens
tgaggcagcccactttccttag

SEQ ID NO: 7458079 - DNA, 22 bp, Homo sapiens
tgaggcagcccactttccttag

SEQ ID NO: 7458080 - DNA, 22 bp, Homo sapiens
tgaggcagcccactttccttag

SEQ ID NO: 7458081 - DNA, 22 bp, Homo sapiens
tgaggcagcctgcattaaagag

SEQ ID NO: 7458082 - DNA, 22 bp, Homo sapiens
tgaggcagcctgcattaaagag

SEQ ID NO: 7458083 - DNA, 22 bp, Homo sapiens
tgaggcagcaattgtattgtat

SEQ ID NO: 7458084 - DNA, 22 bp, Homo sapiens
tgaggcagcaattgtattgtat

SEQ ID NO: 7458085 - DNA, 22 bp, Homo sapiens
tgaggcagcattcttcaagaca

SEQ ID NO: 7458086 - DNA, 22 bp, Homo sapiens
tgaggcagcattcttcaagaca

SEQ ID NO: 7458087 - DNA, 22 bp, Homo sapiens
tgaggcagcattcttcaagaca

SEQ ID NO: 7458088 - DNA, 22 bp, Homo sapiens
tgaggcagcattcttcaagaca

SEQ ID NO: 7458089 - DNA, 22 bp, Homo sapiens
tgaggcagcattcttcaagaca

SEQ ID NO: 7458090 - DNA, 22 bp, Homo sapiens
tgaggcagcattcttcaagaca

SEQ ID NO: 7458091 - DNA, 22 bp, Homo sapiens
tgaggcagcattcttcaagaca

SEQ ID NO: 7458092 - DNA, 22 bp, Homo sapiens
tgaggcagcctgcattaaagag

SEQ ID NO: 7458093 - DNA, 22 bp, Homo sapiens
tgaggcagcctgcattaaagag

SEQ ID NO: 7458094 - DNA, 22 bp, Homo sapiens
ccagtcccgcatggtccagaat

SEQ ID NO: 7458095 - DNA, 22 bp, Homo sapiens
ccagtcccgcatggtccagaat

SEQ ID NO: 7458096 - DNA, 22 bp, Homo sapiens
ccagtcccgcatggtccagaat

SEQ ID NO: 7458097 - DNA, 22 bp, Homo sapiens
ccagtcccgcatggtccagaat

SEQ ID NO: 7458098 - DNA, 20 bp, Homo sapiens
ccagtccctgagcaccaggg

SEQ ID NO: 7458099 - DNA, 20 bp, Homo sapiens
ccagtccctgagcaccaggg

SEQ ID NO: 7458100 - DNA, 22 bp, Homo sapiens
ccagtcccgcatggtccagaat

SEQ ID NO: 7458101 - DNA, 22 bp, Homo sapiens
ccagtcccgcatggtccagaat

SEQ ID NO: 7458102 - DNA, 22 bp, Homo sapiens
ccagtcctcagatggtctgtgc

SEQ ID NO: 7458103 - DNA, 22 bp, Homo sapiens
ccagtcctagaagaggagtcga

SEQ ID NO: 7458104 - DNA, 22 bp, Homo sapiens
ccagtcctagaagaggagtcga

SEQ ID NO: 7458105 - DNA, 22 bp, Homo sapiens
ccagtcctagaagaggagtcga

SEQ ID NO: 7458106 - DNA, 20 bp, Homo sapiens
ccagtccctgagcaccaggg

SEQ ID NO: 7458107 - DNA, 20 bp, Homo sapiens
ccagtccctgagcaccaggg

SEQ ID NO: 7458108 - DNA, 20 bp, Homo sapiens
ccagtccctgagcaccaggg

SEQ ID NO: 7458109 - DNA, 20 bp, Homo sapiens
ccagtccctgagcaccaggg

SEQ ID NO: 7458110 - DNA, 20 bp, Homo sapiens
ccagtctctggccagcatca

SEQ ID NO: 7458111 - DNA, 20 bp, Homo sapiens
ccagtctctggccagcatca

SEQ ID NO: 7458112 - DNA, 20 bp, Homo sapiens
ccagtctctggccagcatca

SEQ ID NO: 7458113 - DNA, 20 bp, Homo sapiens
ccagtctctatcagaaataa

SEQ ID NO: 7458114 - DNA, 20 bp, Homo sapiens
ccagtctctatcagaaataa

SEQ ID NO: 7458115 - DNA, 22 bp, Homo sapiens
ccagtctcttccctcctgccag

SEQ ID NO: 7458116 - DNA, 22 bp, Homo sapiens
ccagtctcttccctcctgccag

SEQ ID NO: 7458117 - DNA, 22 bp, Homo sapiens
ccagtctcttccctcctgccag

SEQ ID NO: 7458118 - DNA, 23 bp, Homo sapiens
ccagtctctttccaaaatcacat

SEQ ID NO: 7458119 - DNA, 23 bp, Homo sapiens
ccagtctctttccaaaatcacat

SEQ ID NO: 7458120 - DNA, 22 bp, Homo sapiens
ccagtctcctaagagcccctga

SEQ ID NO: 7458121 - DNA, 22 bp, Homo sapiens
ccagtctcgttgaggcgcttgt

SEQ ID NO: 7458122 - DNA, 19 bp, Homo sapiens
ccagtctccttgcagcatc

SEQ ID NO: 7458123 - DNA, 19 bp, Homo sapiens
ccagtctccttgcagcatc

SEQ ID NO: 7458124 - DNA, 22 bp, Homo sapiens
ccagtctcagttcacgttggta

SEQ ID NO: 7458125 - DNA, 22 bp, Homo sapiens
ccagtcctttgagccagttctg

SEQ ID NO: 7458126 - DNA, 21 bp, Homo sapiens
ccagtcgccaggttgtgtgct

SEQ ID NO: 7458127 - DNA, 23 bp, Homo sapiens
ccagtctcacgtatacaggattt

SEQ ID NO: 7458128 - DNA, 23 bp, Homo sapiens
ccagtctcacgtatacaggattt

SEQ ID NO: 7458129 - DNA, 22 bp, Homo sapiens
ccagtcctcagatggtctgtgc

SEQ ID NO: 7458130 - DNA, 22 bp, Homo sapiens
ccagtcctcagatggtctgtgc

SEQ ID NO: 7458131 - DNA, 19 bp, Homo sapiens
ccagtcctctttgggcctg

SEQ ID NO: 7458132 - DNA, 22 bp, Homo sapiens
ccagtcctgccaccctgtctat

SEQ ID NO: 7458133 - DNA, 22 bp, Homo sapiens
ccagtcctgctccctgaccacc

SEQ ID NO: 7458134 - DNA, 22 bp, Homo sapiens
ccagtcctgctccctgaccacc

SEQ ID NO: 7458135 - DNA, 22 bp, Homo sapiens
ccagtcctgctccctgaccacc

SEQ ID NO: 7458136 - DNA, 22 bp, Homo sapiens
ccagtcctgccaccctgtctat

SEQ ID NO: 7458137 - DNA, 22 bp, Homo sapiens
ccagtcctttgagccagttctg

SEQ ID NO: 7458138 - DNA, 22 bp, Homo sapiens
ccagtcctgtgtgaccctgcac

SEQ ID NO: 7458139 - DNA, 22 bp, Homo sapiens
ccagtcctgtgtgaccctgcac

SEQ ID NO: 7458140 - DNA, 22 bp, Homo sapiens
ccagtcctgggagcttgcactg

SEQ ID NO: 7458141 - DNA, 22 bp, Homo sapiens
ccagtcctgtgtgaccctgcac

SEQ ID NO: 7458142 - DNA, 22 bp, Homo sapiens
ccagtcctgggagcttgcactg

SEQ ID NO: 7458143 - DNA, 22 bp, Homo sapiens
ccagtcctgggagcttgcactg

SEQ ID NO: 7458144 - DNA, 22 bp, Homo sapiens
ccagtcctggccagtaacatga

SEQ ID NO: 7458145 - DNA, 22 bp, Homo sapiens
tgagggctgcttccagagctag

SEQ ID NO: 7458146 - DNA, 22 bp, Homo sapiens
tgagggctgcttccagagctag

SEQ ID NO: 7458147 - DNA, 22 bp, Homo sapiens
tgagggctgcttccagagctag

SEQ ID NO: 7458148 - DNA, 22 bp, Homo sapiens
tgagggctgcttccagagctag

SEQ ID NO: 7458149 - DNA, 22 bp, Homo sapiens
tgagggctgtctgaagcttggg

SEQ ID NO: 7458150 - DNA, 22 bp, Homo sapiens
tgagggctgcttccagagctag

SEQ ID NO: 7458151 - DNA, 22 bp, Homo sapiens
tgagggctgcttccagagctag

SEQ ID NO: 7458152 - DNA, 22 bp, Homo sapiens
tgagggctgtggaaggctaacc

SEQ ID NO: 7458153 - DNA, 22 bp, Homo sapiens
tgagggctgacaggaggacagc

SEQ ID NO: 7458154 - DNA, 20 bp, Homo sapiens
tgagggctaaccagactctg

SEQ ID NO: 7458155 - DNA, 22 bp, Homo sapiens
tgagggctgacaggaggacagc

SEQ ID NO: 7458156 - DNA, 22 bp, Homo sapiens
tgagggctgacaggaggacagc

SEQ ID NO: 7458157 - DNA, 22 bp, Homo sapiens
tgagggctgacaggaggacagc

SEQ ID NO: 7458158 - DNA, 22 bp, Homo sapiens
tgagggctgcttccagagctag

SEQ ID NO: 7458159 - DNA, 22 bp, Homo sapiens
tgagggctgcttccagagctag

SEQ ID NO: 7458160 - DNA, 22 bp, Homo sapiens
ccagtgttgaacagtatttgga

SEQ ID NO: 7458161 - DNA, 22 bp, Homo sapiens
ccagtgttgcataggatgggga

SEQ ID NO: 7458162 - DNA, 22 bp, Homo sapiens
ccagtgtttaggaataaaatgt

SEQ ID NO: 7458163 - DNA, 22 bp, Homo sapiens
ccagtgtttacagttgaacaaa

SEQ ID NO: 7458164 - DNA, 22 bp, Homo sapiens
ccagtgtttacagttgaacaaa

SEQ ID NO: 7458165 - DNA, 22 bp, Homo sapiens
ccagtgtttacagttgaacaaa

SEQ ID NO: 7458166 - DNA, 22 bp, Homo sapiens
ccagtgttccctcgggttcatg

SEQ ID NO: 7458167 - DNA, 22 bp, Homo sapiens
ccagtgttctggtgttcatttc

SEQ ID NO: 7458168 - DNA, 22 bp, Homo sapiens
ccagtgttccagagagctgatg

SEQ ID NO: 7458169 - DNA, 22 bp, Homo sapiens
ccagtgttccctcgggttcatg

SEQ ID NO: 7458170 - DNA, 22 bp, Homo sapiens
tgaggggaactgatgcccattg

SEQ ID NO: 7458171 - DNA, 22 bp, Homo sapiens
tgaggctgccttgggaagaggg

SEQ ID NO: 7458172 - DNA, 22 bp, Homo sapiens
tgagggatccagaggcagtggt

SEQ ID NO: 7458173 - DNA, 23 bp, Homo sapiens
tgaggctgattgatttttgctca

SEQ ID NO: 7458174 - DNA, 23 bp, Homo sapiens
tgaggctgattgatttttgctca

SEQ ID NO: 7458175 - DNA, 23 bp, Homo sapiens
tgaggctgattgatttttgctca

SEQ ID NO: 7458176 - DNA, 23 bp, Homo sapiens
ccagtctctttccaaaatcacat

SEQ ID NO: 7458177 - DNA, 23 bp, Homo sapiens
tgaggctgattgatttttgctca

SEQ ID NO: 7458178 - DNA, 22 bp, Homo sapiens
ccagtctgaggcctggtgaggg

SEQ ID NO: 7458179 - DNA, 22 bp, Homo sapiens
tgagggcaaagtggtgctgagg

SEQ ID NO: 7458180 - DNA, 22 bp, Homo sapiens
tgagggcaaagtggtgctgagg

SEQ ID NO: 7458181 - DNA, 22 bp, Homo sapiens
tgagggcaaagtggtgctgagg

SEQ ID NO: 7458182 - DNA, 22 bp, Homo sapiens
tgagggcaaagtggtgctgagg

SEQ ID NO: 7458183 - DNA, 22 bp, Homo sapiens
tgagggattgatgtttgacatg

SEQ ID NO: 7458184 - DNA, 22 bp, Homo sapiens
tgagggatccagaggcagtggt

SEQ ID NO: 7458185 - DNA, 22 bp, Homo sapiens
tgagggatggtgagagtctgat

SEQ ID NO: 7458186 - DNA, 22 bp, Homo sapiens
tgagggcagagcactggggagc

SEQ ID NO: 7458187 - DNA, 22 bp, Homo sapiens
tgagggcagagcactggggagc

SEQ ID NO: 7458188 - DNA, 22 bp, Homo sapiens
tgagggcaaagtggtgctgagg

SEQ ID NO: 7458189 - DNA, 22 bp, Homo sapiens
tgagggcaaagtggtgctgagg

SEQ ID NO: 7458190 - DNA, 22 bp, Homo sapiens
tgagggccgaggagctgtgggt

SEQ ID NO: 7458191 - DNA, 22 bp, Homo sapiens
tgagggccgaggagctgtgggt

SEQ ID NO: 7458192 - DNA, 22 bp, Homo sapiens
tgagggccgaggagctgtgggt

SEQ ID NO: 7458193 - DNA, 22 bp, Homo sapiens
tgagggccgaggagctgtgggt

SEQ ID NO: 7458194 - DNA, 22 bp, Homo sapiens
tgagggcagagcactggggagc

SEQ ID NO: 7458195 - DNA, 22 bp, Homo sapiens
tgagggccgaggagctgtgggt

SEQ ID NO: 7458196 - DNA, 22 bp, Homo sapiens
tgagggctaaattgtggcaggt

SEQ ID NO: 7458197 - DNA, 22 bp, Homo sapiens
tgagggcagagcactggggagc

SEQ ID NO: 7458198 - DNA, 22 bp, Homo sapiens
tgagggcagagcactggggagc

SEQ ID NO: 7458199 - DNA, 22 bp, Homo sapiens
tgagggcagagcactggggagc

SEQ ID NO: 7458200 - DNA, 22 bp, Homo sapiens
tgagggctaaattgtggcaggt

SEQ ID NO: 7458201 - DNA, 22 bp, Homo sapiens
tgagggctaaattgtggcaggt

SEQ ID NO: 7458202 - DNA, 22 bp, Homo sapiens
tgagggctaaattgtggcaggt

SEQ ID NO: 7458203 - DNA, 22 bp, Homo sapiens
tgagggctaaattgtggcaggt

SEQ ID NO: 7458204 - DNA, 22 bp, Homo sapiens
tgagggctaaattgtggcaggt

SEQ ID NO: 7458205 - DNA, 22 bp, Homo sapiens
tgagggctaaattgtggcaggt

SEQ ID NO: 7458206 - DNA, 22 bp, Homo sapiens
tgagggctaaattgtggcaggt

SEQ ID NO: 7458207 - DNA, 20 bp, Homo sapiens
tgagggctaaccagactctg

SEQ ID NO: 7458208 - DNA, 20 bp, Homo sapiens
tgagggctaaccagactctg

SEQ ID NO: 7458209 - DNA, 22 bp, Homo sapiens
tgaggtaggcttgagatgggag

SEQ ID NO: 7458210 - DNA, 22 bp, Homo sapiens
ccatggaactcagtaaattata

SEQ ID NO: 7458211 - DNA, 22 bp, Homo sapiens
tgaggtagggaaggctggtatt

SEQ ID NO: 7458212 - DNA, 22 bp, Homo sapiens
tgaggtaggcttgagatgggag

SEQ ID NO: 7458213 - DNA, 22 bp, Homo sapiens
tgaggtagggaaggctggtatt

SEQ ID NO: 7458214 - DNA, 22 bp, Homo sapiens
tgaggtaggtgtcgagagaggt

SEQ ID NO: 7458215 - DNA, 22 bp, Homo sapiens
tgaggtaggtgtcgagagaggt

SEQ ID NO: 7458216 - DNA, 22 bp, Homo sapiens
tgaggtaggttgaaagatagat

SEQ ID NO: 7458217 - DNA, 22 bp, Homo sapiens
tgaggtaggtgtcgagagaggt

SEQ ID NO: 7458218 - DNA, 22 bp, Homo sapiens
tgaggtaggtggtaagagatac

SEQ ID NO: 7458219 - DNA, 21 bp, Homo sapiens
tgaggtagtgtttgtcaagtt

SEQ ID NO: 7458220 - DNA, 22 bp, Homo sapiens
tgaggtagtttgttgtacagta

SEQ ID NO: 7458221 - DNA, 22 bp, Homo sapiens
tgaggtatccagtgaagcagcc

SEQ ID NO: 7458222 - DNA, 20 bp, Homo sapiens
tgaggtatcaattcaaggca

SEQ ID NO: 7458223 - DNA, 22 bp, Homo sapiens
tgaggtatacgttggttcagtc

SEQ ID NO: 7458224 - DNA, 22 bp, Homo sapiens
tgaggtagtttttcaagtattt

SEQ ID NO: 7458225 - DNA, 22 bp, Homo sapiens
tgaggtagtgcttgtcatgttt

SEQ ID NO: 7458226 - DNA, 22 bp, Homo sapiens
tgaggtagtgtttagtccagtc

SEQ ID NO: 7458227 - DNA, 22 bp, Homo sapiens
tgaggtagtgcttgtcatgttt

SEQ ID NO: 7458228 - DNA, 22 bp, Homo sapiens
tgaggtagtgcttgtcatgttt

SEQ ID NO: 7458229 - DNA, 22 bp, Homo sapiens
tgaggtagtaaaggtgttagtt

SEQ ID NO: 7458230 - DNA, 22 bp, Homo sapiens
tgaggtaggttgaaagatagat

SEQ ID NO: 7458231 - DNA, 22 bp, Homo sapiens
tgaggtagtgattgtagaagtg

SEQ ID NO: 7458232 - DNA, 22 bp, Homo sapiens
tgaggtagtaaaggtgttagtt

SEQ ID NO: 7458233 - DNA, 22 bp, Homo sapiens
tgaggtaggtgtcgagagaggt

SEQ ID NO: 7458234 - DNA, 22 bp, Homo sapiens
tgaggtcagcccttcctatgat

SEQ ID NO: 7458235 - DNA, 22 bp, Homo sapiens
tgaggtcacctggaggcagcct

SEQ ID NO: 7458236 - DNA, 22 bp, Homo sapiens
tgaggtcagcccttcctatgat

SEQ ID NO: 7458237 - DNA, 22 bp, Homo sapiens
ccatggcctgaaggagtgcatc

SEQ ID NO: 7458238 - DNA, 22 bp, Homo sapiens
ccatggcctgaaggagtgcatc

SEQ ID NO: 7458239 - DNA, 22 bp, Homo sapiens
ccatggcctgaaggagtgcatc

SEQ ID NO: 7458240 - DNA, 22 bp, Homo sapiens
tgaggtcacctggaggcagcct

SEQ ID NO: 7458241 - DNA, 22 bp, Homo sapiens
tgaggtcacctggaggcagcct

SEQ ID NO: 7458242 - DNA, 22 bp, Homo sapiens
tgaggtcacctggaggcagcct

SEQ ID NO: 7458243 - DNA, 22 bp, Homo sapiens
tgaggtattttttaaagcacaa

SEQ ID NO: 7458244 - DNA, 22 bp, Homo sapiens
tgaggtattttttaaagcacaa

SEQ ID NO: 7458245 - DNA, 22 bp, Homo sapiens
tgaggtcaagcccagagcagca

SEQ ID NO: 7458246 - DNA, 22 bp, Homo sapiens
tgaggtatggtaaggtaaaatc

SEQ ID NO: 7458247 - DNA, 22 bp, Homo sapiens
tgaggtatgaggttctatgatc

SEQ ID NO: 7458248 - DNA, 22 bp, Homo sapiens
tgaggtatccagtgaagcagcc

SEQ ID NO: 7458249 - DNA, 22 bp, Homo sapiens
tgaggtatgagtgtgccaggtg

SEQ ID NO: 7458250 - DNA, 22 bp, Homo sapiens
tgaggtatgagtgtgccaggtg

SEQ ID NO: 7458251 - DNA, 22 bp, Homo sapiens
tgaggtatgatttacatgcagt

SEQ ID NO: 7458252 - DNA, 22 bp, Homo sapiens
tgaggtatgatttacatgcagt

SEQ ID NO: 7458253 - DNA, 22 bp, Homo sapiens
tgaggtatgctgaactctgttt

SEQ ID NO: 7458254 - DNA, 22 bp, Homo sapiens
tgaggtatgatttacatgcagt

SEQ ID NO: 7458255 - DNA, 22 bp, Homo sapiens
ccatgtggtagtgcttaacctt

SEQ ID NO: 7458256 - DNA, 22 bp, Homo sapiens
ccatgtgggattttggtgtctg

SEQ ID NO: 7458257 - DNA, 22 bp, Homo sapiens
ccatgtggggtcagtgtttggg

SEQ ID NO: 7458258 - DNA, 22 bp, Homo sapiens
ccatgtgggattttggtgtctg

SEQ ID NO: 7458259 - DNA, 22 bp, Homo sapiens
ccatgtggctgctgacaacaga

SEQ ID NO: 7458260 - DNA, 22 bp, Homo sapiens
ccatgtggctgctgacaacaga

SEQ ID NO: 7458261 - DNA, 22 bp, Homo sapiens
ccatgtggctgtgtggtttatt

SEQ ID NO: 7458262 - DNA, 22 bp, Homo sapiens
ccatggctaagtatctgtagaa

SEQ ID NO: 7458263 - DNA, 22 bp, Homo sapiens
ccatggctaagtatctgtagaa

SEQ ID NO: 7458264 - DNA, 22 bp, Homo sapiens
ccatggctaagtatctgtagaa

SEQ ID NO: 7458265 - DNA, 22 bp, Homo sapiens
ccatgtggctgctgacaacaga

SEQ ID NO: 7458266 - DNA, 22 bp, Homo sapiens
ccatggcctgaaggagtgcatc

SEQ ID NO: 7458267 - DNA, 22 bp, Homo sapiens
ccatgtggtgggaaggagaatg

SEQ ID NO: 7458268 - DNA, 22 bp, Homo sapiens
ccatgtggtgggaaggagaatg

SEQ ID NO: 7458269 - DNA, 22 bp, Homo sapiens
ccatgtggtgggaaggagaatg

SEQ ID NO: 7458270 - DNA, 22 bp, Homo sapiens
ccatgtggtctgtgtagcaact

SEQ ID NO: 7458271 - DNA, 22 bp, Homo sapiens
ccatgtgtctcccctggaagta

SEQ ID NO: 7458272 - DNA, 22 bp, Homo sapiens
ccatgtgttcaataagggagtt

SEQ ID NO: 7458273 - DNA, 22 bp, Homo sapiens
ccatgctgaccctgtgcaggca

SEQ ID NO: 7458274 - DNA, 22 bp, Homo sapiens
ccatgctgaccctgtgcaggca

SEQ ID NO: 7458275 - DNA, 22 bp, Homo sapiens
ccatgctgaccctgtgcaggca

SEQ ID NO: 7458276 - DNA, 22 bp, Homo sapiens
ccatgctgaccctgtgcaggca

SEQ ID NO: 7458277 - DNA, 22 bp, Homo sapiens
ccatgccttcctttccctggaa

SEQ ID NO: 7458278 - DNA, 22 bp, Homo sapiens
ccatgctgaccctgtgcaggca

SEQ ID NO: 7458279 - DNA, 22 bp, Homo sapiens
ccatgctggagtccctagctgt

SEQ ID NO: 7458280 - DNA, 22 bp, Homo sapiens
ccatgctccttaccactcactt

SEQ ID NO: 7458281 - DNA, 22 bp, Homo sapiens
ccatgctctggggaggtcaagc

SEQ ID NO: 7458282 - DNA, 22 bp, Homo sapiens
ccatgctccttaccactcactt

SEQ ID NO: 7458283 - DNA, 22 bp, Homo sapiens
ccatgccttcctttccctggaa

SEQ ID NO: 7458284 - DNA, 22 bp, Homo sapiens
ccatgctaggaactctcaggga

SEQ ID NO: 7458285 - DNA, 22 bp, Homo sapiens
ccatgctccttaccactcactt

SEQ ID NO: 7458286 - DNA, 22 bp, Homo sapiens
ccatgctggagtccctagctgt

SEQ ID NO: 7458287 - DNA, 22 bp, Homo sapiens
ccatgctgggatgctccaagtg

SEQ ID NO: 7458288 - DNA, 22 bp, Homo sapiens
ccatgctgggatgctccaagtg

SEQ ID NO: 7458289 - DNA, 22 bp, Homo sapiens
ccatgctgggatgctccaagtg

SEQ ID NO: 7458290 - DNA, 22 bp, Homo sapiens
ccatgctggagtccctagctgt

SEQ ID NO: 7458291 - DNA, 22 bp, Homo sapiens
ccatgctggagtccctagctgt

SEQ ID NO: 7458292 - DNA, 22 bp, Homo sapiens
ccatgctgtgacacagtagtta

SEQ ID NO: 7458293 - DNA, 22 bp, Homo sapiens
ccatgctgtgccattagcagtt

SEQ ID NO: 7458294 - DNA, 22 bp, Homo sapiens
ccatgcttaaataagaggcagc

SEQ ID NO: 7458295 - DNA, 22 bp, Homo sapiens
ccatgctgtgacacagtagtta

SEQ ID NO: 7458296 - DNA, 22 bp, Homo sapiens
ccatgcccttgtcatctccagg

SEQ ID NO: 7458297 - DNA, 22 bp, Homo sapiens
ccatgcctcgggaagagtctgt

SEQ ID NO: 7458298 - DNA, 22 bp, Homo sapiens
ccatgccctaaaggactggcag

SEQ ID NO: 7458299 - DNA, 22 bp, Homo sapiens
ccatgccctaaaggactggcag

SEQ ID NO: 7458300 - DNA, 22 bp, Homo sapiens
ccatgccctaaaggactggcag

SEQ ID NO: 7458301 - DNA, 22 bp, Homo sapiens
ccatgccctaaaggactggcag

SEQ ID NO: 7458302 - DNA, 22 bp, Homo sapiens
ccatgccttcctttccctggaa

SEQ ID NO: 7458303 - DNA, 22 bp, Homo sapiens
ccatgccttcctttccctggaa

SEQ ID NO: 7458304 - DNA, 22 bp, Homo sapiens
ccatgcgcacccaggggaagct

SEQ ID NO: 7458305 - DNA, 22 bp, Homo sapiens
ccatgcctcgggaagagtctgt

SEQ ID NO: 7458306 - DNA, 22 bp, Homo sapiens
ccatgcctggactccactctca

SEQ ID NO: 7458307 - DNA, 22 bp, Homo sapiens
ccatgcccttgtcatctccagg

SEQ ID NO: 7458308 - DNA, 22 bp, Homo sapiens
ccatgcccacgttgtggctcag

SEQ ID NO: 7458309 - DNA, 22 bp, Homo sapiens
ccatgccccaatacaggacacc

SEQ ID NO: 7458310 - DNA, 22 bp, Homo sapiens
ccatgccccaccaggacgctgc

SEQ ID NO: 7458311 - DNA, 22 bp, Homo sapiens
ccatgccccaccaggacgctgc

SEQ ID NO: 7458312 - DNA, 22 bp, Homo sapiens
ccatgccccaccaggacgctgc

SEQ ID NO: 7458313 - DNA, 22 bp, Homo sapiens
ccatgcccacgttgtggctcag

SEQ ID NO: 7458314 - DNA, 22 bp, Homo sapiens
ccatgcccacgttgtggctcag

SEQ ID NO: 7458315 - DNA, 19 bp, Homo sapiens
ccatgccatcattttaaag

SEQ ID NO: 7458316 - DNA, 22 bp, Homo sapiens
ccatgccatactggccacccgg

SEQ ID NO: 7458317 - DNA, 19 bp, Homo sapiens
ccatgccatcattttaaag

SEQ ID NO: 7458318 - DNA, 22 bp, Homo sapiens
ccatgcagtgctggagctgatt

SEQ ID NO: 7458319 - DNA, 22 bp, Homo sapiens
ccatgcagtgctggagctgatt

SEQ ID NO: 7458320 - DNA, 22 bp, Homo sapiens
ccatgcagtgctggagctgatt

SEQ ID NO: 7458321 - DNA, 22 bp, Homo sapiens
ccatcctgtctgtggcctcagg

SEQ ID NO: 7458322 - DNA, 22 bp, Homo sapiens
ccatgcatgcctgaaattgctg

SEQ ID NO: 7458323 - DNA, 22 bp, Homo sapiens
ccatgcatataatagtgcctgg

SEQ ID NO: 7458324 - DNA, 22 bp, Homo sapiens
ccatgcatctaccagccccaga

SEQ ID NO: 7458325 - DNA, 22 bp, Homo sapiens
ccatgcatggcactggactggg

SEQ ID NO: 7458326 - DNA, 22 bp, Homo sapiens
ccatgcatggcactggactggg

SEQ ID NO: 7458327 - DNA, 22 bp, Homo sapiens
ccatgcatggcactggactggg

SEQ ID NO: 7458328 - DNA, 22 bp, Homo sapiens
ccatgccatactggccacccgg

SEQ ID NO: 7458329 - DNA, 22 bp, Homo sapiens
ccatgcattcctgctctgcgca

SEQ ID NO: 7458330 - DNA, 22 bp, Homo sapiens
ccatgccagctgctaggtcaca

SEQ ID NO: 7458331 - DNA, 22 bp, Homo sapiens
ccatcctgtctgtggcctcagg

SEQ ID NO: 7458332 - DNA, 22 bp, Homo sapiens
ccatcctgtctgtggcctcagg

SEQ ID NO: 7458333 - DNA, 22 bp, Homo sapiens
ccatgcagtgctggagctgatt

SEQ ID NO: 7458334 - DNA, 22 bp, Homo sapiens
ccatcctggccttgctgtccac

SEQ ID NO: 7458335 - DNA, 22 bp, Homo sapiens
ccatcctggccttgctgtccac

SEQ ID NO: 7458336 - DNA, 22 bp, Homo sapiens
ccatcctggccttgctgtccac

SEQ ID NO: 7458337 - DNA, 22 bp, Homo sapiens
ccatcctggcctcgctgtccac

SEQ ID NO: 7458338 - DNA, 22 bp, Homo sapiens
ccatcctggccttgctgtccac

SEQ ID NO: 7458339 - DNA, 22 bp, Homo sapiens
ccatcctggccttgctgtccac

SEQ ID NO: 7458340 - DNA, 22 bp, Homo sapiens
ccatcctggcctcgctgtccac

SEQ ID NO: 7458341 - DNA, 22 bp, Homo sapiens
ccatcctggcctcgctgtccac

SEQ ID NO: 7458342 - DNA, 22 bp, Homo sapiens
ccatcctggcctcgctgtccac

SEQ ID NO: 7458343 - DNA, 22 bp, Homo sapiens
ccatcctggcctcgctgtccac

SEQ ID NO: 7458344 - DNA, 22 bp, Homo sapiens
ccatcctgcattgctattcaga

SEQ ID NO: 7458345 - DNA, 22 bp, Homo sapiens
ccatcctgcattgctattcaga

SEQ ID NO: 7458346 - DNA, 22 bp, Homo sapiens
ccagtgtttgatgggattttca

SEQ ID NO: 7458347 - DNA, 22 bp, Homo sapiens
ccagtgttttcatcctcccttg

SEQ ID NO: 7458348 - DNA, 22 bp, Homo sapiens
ccagtgtttccgtcagtacacg

SEQ ID NO: 7458349 - DNA, 22 bp, Homo sapiens
ccagtgtttccgtcagtacacg

SEQ ID NO: 7458350 - DNA, 22 bp, Homo sapiens
ccagtgtttccccagaagagag

SEQ ID NO: 7458351 - DNA, 21 bp, Homo sapiens
ccagggtccagctgccatggt

SEQ ID NO: 7458352 - DNA, 21 bp, Homo sapiens
ccagggtccagctgccatggt

SEQ ID NO: 7458353 - DNA, 22 bp, Homo sapiens
ccagggtcacaaataactgcag

SEQ ID NO: 7458354 - DNA, 22 bp, Homo sapiens
ccagggtaccccaagggcaggt

SEQ ID NO: 7458355 - DNA, 22 bp, Homo sapiens
ccagggtaccccaagggcaggt

SEQ ID NO: 7458356 - DNA, 22 bp, Homo sapiens
ccaggggttggaggttgcagtg

SEQ ID NO: 7458357 - DNA, 17 bp, Homo sapiens
ccaggtctccttgcttt

SEQ ID NO: 7458358 - DNA, 22 bp, Homo sapiens
ccaggtctcgggtctgctcgtg

SEQ ID NO: 7458359 - DNA, 22 bp, Homo sapiens
ccaggtctcgggtctgctcgtg

SEQ ID NO: 7458360 - DNA, 22 bp, Homo sapiens
ccaggtctcgggtctgctcgtg

SEQ ID NO: 7458361 - DNA, 22 bp, Homo sapiens
ccaggtgctagcaatcactgtc

SEQ ID NO: 7458362 - DNA, 22 bp, Homo sapiens
ccagggtaccccaagggcaggt

SEQ ID NO: 7458363 - DNA, 22 bp, Homo sapiens
ccaggggttggaggttgcagtg

SEQ ID NO: 7458364 - DNA, 22 bp, Homo sapiens
ccaggggttggaggttgcagtg

SEQ ID NO: 7458365 - DNA, 22 bp, Homo sapiens
ccaggggttggaggttgcagtg

SEQ ID NO: 7458366 - DNA, 22 bp, Homo sapiens
ccaggggggcgtagatgctggg

SEQ ID NO: 7458367 - DNA, 22 bp, Homo sapiens
ccaggggggcgtagatgctggg

SEQ ID NO: 7458368 - DNA, 22 bp, Homo sapiens
ccaggggggcgtagatgctggg

SEQ ID NO: 7458369 - DNA, 22 bp, Homo sapiens
ccaggggggcgtagatgctggg

SEQ ID NO: 7458370 - DNA, 22 bp, Homo sapiens
ccaggggggcgtagatgctggg

SEQ ID NO: 7458371 - DNA, 22 bp, Homo sapiens
ccaggggggcgtagatgctggg

SEQ ID NO: 7458372 - DNA, 22 bp, Homo sapiens
ccaggggggcgtagatgctggg

SEQ ID NO: 7458373 - DNA, 22 bp, Homo sapiens
ccaggggggcgtagatgctggg

SEQ ID NO: 7458374 - DNA, 22 bp, Homo sapiens
ccagggggcttggtgaggccat

SEQ ID NO: 7458375 - DNA, 22 bp, Homo sapiens
ccagggggcttggtgaggccat

SEQ ID NO: 7458376 - DNA, 22 bp, Homo sapiens
ccagggggcttggtgaggccat

SEQ ID NO: 7458377 - DNA, 22 bp, Homo sapiens
ccagggggcttggtgaggccat

SEQ ID NO: 7458378 - DNA, 22 bp, Homo sapiens
ccagggggcttggtgaggccat

SEQ ID NO: 7458379 - DNA, 22 bp, Homo sapiens
ccagggggcttggtgaggccat

SEQ ID NO: 7458380 - DNA, 22 bp, Homo sapiens
ccaggggctggtgctgagctgg

SEQ ID NO: 7458381 - DNA, 22 bp, Homo sapiens
ccaggggctggtgctgagctgg

SEQ ID NO: 7458382 - DNA, 22 bp, Homo sapiens
ccaggtggaaggtctgtgctct

SEQ ID NO: 7458383 - DNA, 22 bp, Homo sapiens
ccaggtggaaggtctgtgctct

SEQ ID NO: 7458384 - DNA, 19 bp, Homo sapiens
ccaggtggaactgaggtag

SEQ ID NO: 7458385 - DNA, 22 bp, Homo sapiens
ccaggtggaaggtctgtgctct

SEQ ID NO: 7458386 - DNA, 22 bp, Homo sapiens
ccaggtggaaggtctgtgctct

SEQ ID NO: 7458387 - DNA, 22 bp, Homo sapiens
ccaggtggaaggtctgtgctct

SEQ ID NO: 7458388 - DNA, 22 bp, Homo sapiens
ccaggtggaaggtctgtgctct

SEQ ID NO: 7458389 - DNA, 22 bp, Homo sapiens
ccaggtggaaggtctgtgctct

SEQ ID NO: 7458390 - DNA, 17 bp, Homo sapiens
ccaggtggaatcgtgga

SEQ ID NO: 7458391 - DNA, 22 bp, Homo sapiens
ccaggtggacaaggctttcaca

SEQ ID NO: 7458392 - DNA, 22 bp, Homo sapiens
ccaggtggacggcgagtacagg

SEQ ID NO: 7458393 - DNA, 22 bp, Homo sapiens
ccaggtggacaaggctttcaca

SEQ ID NO: 7458394 - DNA, 22 bp, Homo sapiens
ccaggtggacaaggctttcaca

SEQ ID NO: 7458395 - DNA, 17 bp, Homo sapiens
ccaggtggaatcgtgga

SEQ ID NO: 7458396 - DNA, 19 bp, Homo sapiens
ccaggtggaactgaggtag

SEQ ID NO: 7458397 - DNA, 22 bp, Homo sapiens
ccaggtggaaggtctgtgctct

SEQ ID NO: 7458398 - DNA, 19 bp, Homo sapiens
ccaggtggaactgaggtag

SEQ ID NO: 7458399 - DNA, 19 bp, Homo sapiens
ccaggtggaactgaggtag

SEQ ID NO: 7458400 - DNA, 19 bp, Homo sapiens
ccaggtggaactgaggtag

SEQ ID NO: 7458401 - DNA, 19 bp, Homo sapiens
ccaggtggaactgaggtag

SEQ ID NO: 7458402 - DNA, 19 bp, Homo sapiens
ccaggtggaactgaggtag

SEQ ID NO: 7458403 - DNA, 19 bp, Homo sapiens
ccaggtggaactgaggtag

SEQ ID NO: 7458404 - DNA, 22 bp, Homo sapiens
ccaggtgctgaccggtcagatt

SEQ ID NO: 7458405 - DNA, 22 bp, Homo sapiens
ccaggtgctcttgccagggctg

SEQ ID NO: 7458406 - DNA, 22 bp, Homo sapiens
ccaggtgctcttgccagggctg

SEQ ID NO: 7458407 - DNA, 22 bp, Homo sapiens
ccaggtgctcttgccagggctg

SEQ ID NO: 7458408 - DNA, 22 bp, Homo sapiens
ccaggtgctcttgccagggctg

SEQ ID NO: 7458409 - DNA, 22 bp, Homo sapiens
ccaggtgctcttgccagggctg

SEQ ID NO: 7458410 - DNA, 22 bp, Homo sapiens
ccaggtgctcttgccagggctg

SEQ ID NO: 7458411 - DNA, 22 bp, Homo sapiens
ccaggggctctcagggtgtgtg

SEQ ID NO: 7458412 - DNA, 22 bp, Homo sapiens
ccaggggcctgtgaaggtgccc

SEQ ID NO: 7458413 - DNA, 22 bp, Homo sapiens
ccaggggctctcagggtgtgtg

SEQ ID NO: 7458414 - DNA, 22 bp, Homo sapiens
ccaggggctctcagggtgtgtg

SEQ ID NO: 7458415 - DNA, 22 bp, Homo sapiens
ccaggggctctcagggtgtgtg

SEQ ID NO: 7458416 - DNA, 22 bp, Homo sapiens
ccaggggctgcagatccatggt

SEQ ID NO: 7458417 - DNA, 22 bp, Homo sapiens
ccaggggctgcagatccatggt

SEQ ID NO: 7458418 - DNA, 22 bp, Homo sapiens
ccaggggctgcagatccatggt

SEQ ID NO: 7458419 - DNA, 22 bp, Homo sapiens
ccaggggctctcagggtgtgtg

SEQ ID NO: 7458420 - DNA, 22 bp, Homo sapiens
ccaggggctctcagggtgtgtg

SEQ ID NO: 7458421 - DNA, 22 bp, Homo sapiens
ccaggggctggtgctgagctgg

SEQ ID NO: 7458422 - DNA, 22 bp, Homo sapiens
ccaggggctggtgctgagctgg

SEQ ID NO: 7458423 - DNA, 22 bp, Homo sapiens
ccaggggctgcagatccatggt

SEQ ID NO: 7458424 - DNA, 22 bp, Homo sapiens
ccaggggctggtgctgagctgg

SEQ ID NO: 7458425 - DNA, 22 bp, Homo sapiens
ccaggggctggtgctgagctgg

SEQ ID NO: 7458426 - DNA, 22 bp, Homo sapiens
ccaggggctggtgctgagctgg

SEQ ID NO: 7458427 - DNA, 22 bp, Homo sapiens
ccaggggctggtgctgagctgg

SEQ ID NO: 7458428 - DNA, 22 bp, Homo sapiens
ccaggggctggtgctgagctgg

SEQ ID NO: 7458429 - DNA, 22 bp, Homo sapiens
ccaggggctggtgctgagctgg

SEQ ID NO: 7458430 - DNA, 22 bp, Homo sapiens
tgagaatgagggggtagaaggt

SEQ ID NO: 7458431 - DNA, 22 bp, Homo sapiens
tgagaatatttgaagatgttag

SEQ ID NO: 7458432 - DNA, 22 bp, Homo sapiens
tgagaatattgttttagtgagg

SEQ ID NO: 7458433 - DNA, 22 bp, Homo sapiens
tgagaatatttgaagatgttag

SEQ ID NO: 7458434 - DNA, 22 bp, Homo sapiens
tgagaatattgttttagtgagg

SEQ ID NO: 7458435 - DNA, 22 bp, Homo sapiens
tgagaatagtaataatttctgg

SEQ ID NO: 7458436 - DNA, 22 bp, Homo sapiens
tgagaataggcatagaacctgg

SEQ ID NO: 7458437 - DNA, 22 bp, Homo sapiens
tgagaataggcatagaacctgg

SEQ ID NO: 7458438 - DNA, 22 bp, Homo sapiens
tgagaatagcaaaagctgtcag

SEQ ID NO: 7458439 - DNA, 22 bp, Homo sapiens
tgagaatactgcattgttagga

SEQ ID NO: 7458440 - DNA, 22 bp, Homo sapiens
tgagaatactgcattgttagga

SEQ ID NO: 7458441 - DNA, 22 bp, Homo sapiens
tgagaatagaaagagctgtcat

SEQ ID NO: 7458442 - DNA, 22 bp, Homo sapiens
tgagaatagaaagagctgtcat

SEQ ID NO: 7458443 - DNA, 22 bp, Homo sapiens
tgagaatagaaagagctgtcat

SEQ ID NO: 7458444 - DNA, 22 bp, Homo sapiens
tgagaatagcaaaagctgtcag

SEQ ID NO: 7458445 - DNA, 22 bp, Homo sapiens
tgagaatagcaaaagctgtcag

SEQ ID NO: 7458446 - DNA, 22 bp, Homo sapiens
tgagaagggttggagaaataat

SEQ ID NO: 7458447 - DNA, 22 bp, Homo sapiens
tgagaagggttggagaaataat

SEQ ID NO: 7458448 - DNA, 20 bp, Homo sapiens
tgagaaggggtcagctgtac

SEQ ID NO: 7458449 - DNA, 22 bp, Homo sapiens
tgagaaggcctgtgtgacaggg

SEQ ID NO: 7458450 - DNA, 20 bp, Homo sapiens
tgagaaggggtcagctgtac

SEQ ID NO: 7458451 - DNA, 20 bp, Homo sapiens
tgagaaggggtcagctgtac

SEQ ID NO: 7458452 - DNA, 20 bp, Homo sapiens
tgagaaggggtcagctgtac

SEQ ID NO: 7458453 - DNA, 20 bp, Homo sapiens
tgagaaggggtcagctgtac

SEQ ID NO: 7458454 - DNA, 22 bp, Homo sapiens
tgagaaggctcaggcttagaga

SEQ ID NO: 7458455 - DNA, 22 bp, Homo sapiens
tgagaaggctcaggcttagaga

SEQ ID NO: 7458456 - DNA, 22 bp, Homo sapiens
tgagaaggctcaggcttagaga

SEQ ID NO: 7458457 - DNA, 22 bp, Homo sapiens
tgagaaggcctgtgtgacaggg

SEQ ID NO: 7458458 - DNA, 22 bp, Homo sapiens
tgagaaggcctgtgtgacaggg

SEQ ID NO: 7458459 - DNA, 19 bp, Homo sapiens
tgagaaggcagtggggagc

SEQ ID NO: 7458460 - DNA, 19 bp, Homo sapiens
tgagaaggcagtggggagc

SEQ ID NO: 7458461 - DNA, 19 bp, Homo sapiens
tgagaaggcagtggggagc

SEQ ID NO: 7458462 - DNA, 22 bp, Homo sapiens
tgagaagtgacattattgaatg

SEQ ID NO: 7458463 - DNA, 22 bp, Homo sapiens
tgagaagtgacattattgaatg

SEQ ID NO: 7458464 - DNA, 22 bp, Homo sapiens
tgagaataacagcctgtgttcc

SEQ ID NO: 7458465 - DNA, 22 bp, Homo sapiens
tgagaataacagcctgtgttcc

SEQ ID NO: 7458466 - DNA, 22 bp, Homo sapiens
tgagaagtgacattattgaatg

SEQ ID NO: 7458467 - DNA, 22 bp, Homo sapiens
tgagaataactgatttaaatgc

SEQ ID NO: 7458468 - DNA, 22 bp, Homo sapiens
tgagaataagagatagtttatt

SEQ ID NO: 7458469 - DNA, 22 bp, Homo sapiens
tgagaataagagatagtttatt

SEQ ID NO: 7458470 - DNA, 22 bp, Homo sapiens
tgagaataagagatagtttatt

SEQ ID NO: 7458471 - DNA, 22 bp, Homo sapiens
tgagaataagagatagtttatt

SEQ ID NO: 7458472 - DNA, 19 bp, Homo sapiens
tgagaaggtttccgtgggt

SEQ ID NO: 7458473 - DNA, 22 bp, Homo sapiens
tgagaaggtgaaagtgtggaga

SEQ ID NO: 7458474 - DNA, 22 bp, Homo sapiens
tgagaaggtgaaagtgtggaga

SEQ ID NO: 7458475 - DNA, 22 bp, Homo sapiens
tgagaaggtgaaagtgtggaga

SEQ ID NO: 7458476 - DNA, 22 bp, Homo sapiens
tgagaaggtgaaagtgtggaga

SEQ ID NO: 7458477 - DNA, 17 bp, Homo sapiens
tgagaagtaggcatcat

SEQ ID NO: 7458478 - DNA, 21 bp, Homo sapiens
tgagaagtatgtcttcagcca

SEQ ID NO: 7458479 - DNA, 22 bp, Homo sapiens
tgagaagtactacaagagaggg

SEQ ID NO: 7458480 - DNA, 19 bp, Homo sapiens
tgagaaggtttccgtgggt

SEQ ID NO: 7458481 - DNA, 22 bp, Homo sapiens
tgagaagtactacaagagaggg

SEQ ID NO: 7458482 - DNA, 22 bp, Homo sapiens
tgaggcagatatttattgggtt

SEQ ID NO: 7458483 - DNA, 22 bp, Homo sapiens
tgaggcagatatttattgggtt

SEQ ID NO: 7458484 - DNA, 22 bp, Homo sapiens
tgaggcagatatttattgggtt

SEQ ID NO: 7458485 - DNA, 22 bp, Homo sapiens
tgaggcagatatttattgggtt

SEQ ID NO: 7458486 - DNA, 22 bp, Homo sapiens
tgaggcagagtaagatacatga

SEQ ID NO: 7458487 - DNA, 22 bp, Homo sapiens
tgaggcagatatttattgggtt

SEQ ID NO: 7458488 - DNA, 22 bp, Homo sapiens
tgaggcagatatttattgggtt

SEQ ID NO: 7458489 - DNA, 22 bp, Homo sapiens
tgaggcagagtaagatacatga

SEQ ID NO: 7458490 - DNA, 22 bp, Homo sapiens
tgaggcagagtaagatacatga

SEQ ID NO: 7458491 - DNA, 22 bp, Homo sapiens
tgaggcagcaattgtattgtat

SEQ ID NO: 7458492 - DNA, 22 bp, Homo sapiens
tgaggcagcaattgtattgtat

SEQ ID NO: 7458493 - DNA, 22 bp, Homo sapiens
tgaggcagcaattgtattgtat

SEQ ID NO: 7458494 - DNA, 22 bp, Homo sapiens
tgaggcagcaattgattattca

SEQ ID NO: 7458495 - DNA, 22 bp, Homo sapiens
tgaggcagcaattgattattca

SEQ ID NO: 7458496 - DNA, 22 bp, Homo sapiens
tgaggcagcaattgattattca

SEQ ID NO: 7458497 - DNA, 22 bp, Homo sapiens
tgaggcagcaattgattattca

SEQ ID NO: 7458498 - DNA, 22 bp, Homo sapiens
tgaggcagcaattgattattca

SEQ ID NO: 7458499 - DNA, 22 bp, Homo sapiens
tgaggcagcaattgattattca

SEQ ID NO: 7458500 - DNA, 22 bp, Homo sapiens
tgaggcagaaattcctgttttc

SEQ ID NO: 7458501 - DNA, 22 bp, Homo sapiens
tgaggcagagtaagatacatga

SEQ ID NO: 7458502 - DNA, 22 bp, Homo sapiens
tgaggcagagtaagatacatga

SEQ ID NO: 7458503 - DNA, 22 bp, Homo sapiens
tgaggcagagtaagatacatga

SEQ ID NO: 7458504 - DNA, 22 bp, Homo sapiens
tgaggcagagtaagatacatga

SEQ ID NO: 7458505 - DNA, 22 bp, Homo sapiens
tgaggcagaaattcctgttttc

SEQ ID NO: 7458506 - DNA, 22 bp, Homo sapiens
tgaggcagaaattcctgttttc

SEQ ID NO: 7458507 - DNA, 22 bp, Homo sapiens
tgaggcagaaattcctgttttc

SEQ ID NO: 7458508 - DNA, 22 bp, Homo sapiens
tgaggcagaaattcctgttttc

SEQ ID NO: 7458509 - DNA, 22 bp, Homo sapiens
tgaggcagaaaatagcagttca

SEQ ID NO: 7458510 - DNA, 22 bp, Homo sapiens
tgaggagaaatgctcagagcca

SEQ ID NO: 7458511 - DNA, 22 bp, Homo sapiens
tgaggcagaaaatagcagttca

SEQ ID NO: 7458512 - DNA, 22 bp, Homo sapiens
tgaggcagaaaatagcagttca

SEQ ID NO: 7458513 - DNA, 22 bp, Homo sapiens
tgaggactttccatgttaatgt

SEQ ID NO: 7458514 - DNA, 22 bp, Homo sapiens
tgaggactacctggggtgggag

SEQ ID NO: 7458515 - DNA, 22 bp, Homo sapiens
tgaggagaaatgctcagagcca

SEQ ID NO: 7458516 - DNA, 22 bp, Homo sapiens
tgaggactttccatgttaatgt

SEQ ID NO: 7458517 - DNA, 22 bp, Homo sapiens
tgaggactttccatgttaatgt

SEQ ID NO: 7458518 - DNA, 22 bp, Homo sapiens
tgaggcagaaaatagcagttca

SEQ ID NO: 7458519 - DNA, 22 bp, Homo sapiens
ccaggtgtgtacagaacagcac

SEQ ID NO: 7458520 - DNA, 22 bp, Homo sapiens
ccaggtgtggtggcatacacct

SEQ ID NO: 7458521 - DNA, 22 bp, Homo sapiens
ccaggtgtgtacagaacagcac

SEQ ID NO: 7458522 - DNA, 22 bp, Homo sapiens
tgaggactacctggggtgggag

SEQ ID NO: 7458523 - DNA, 23 bp, Homo sapiens
tgaggacctctcaggggccaggc

SEQ ID NO: 7458524 - DNA, 22 bp, Homo sapiens
ccaggtgtggtggcatacacct

SEQ ID NO: 7458525 - DNA, 22 bp, Homo sapiens
ccaggtgtggtggcatacacct

SEQ ID NO: 7458526 - DNA, 22 bp, Homo sapiens
ccaggtgtgctctgcagtggat

SEQ ID NO: 7458527 - DNA, 22 bp, Homo sapiens
ccaggtgtgctctgcagtggat

SEQ ID NO: 7458528 - DNA, 22 bp, Homo sapiens
ccaggtgtggggaggactcaca

SEQ ID NO: 7458529 - DNA, 22 bp, Homo sapiens
ccaggtgtggccacatggctgg

SEQ ID NO: 7458530 - DNA, 22 bp, Homo sapiens
ccaggtgtggggaggactcaca

SEQ ID NO: 7458531 - DNA, 22 bp, Homo sapiens
ccaggtgtgccagcagggactg

SEQ ID NO: 7458532 - DNA, 22 bp, Homo sapiens
ccaggtgtgctctgcagtggat

SEQ ID NO: 7458533 - DNA, 22 bp, Homo sapiens
ccaggtgtgctctgcagtggat

SEQ ID NO: 7458534 - DNA, 22 bp, Homo sapiens
ccaggtgtgctctgcagtggat

SEQ ID NO: 7458535 - DNA, 22 bp, Homo sapiens
ccaggtgtgccagcagggactg

SEQ ID NO: 7458536 - DNA, 22 bp, Homo sapiens
ccaggtgtgccagcagggactg

SEQ ID NO: 7458537 - DNA, 22 bp, Homo sapiens
ccaggtgtgccagcagggactg

SEQ ID NO: 7458538 - DNA, 22 bp, Homo sapiens
ccaggtgtgatttggcagtgtc

SEQ ID NO: 7458539 - DNA, 22 bp, Homo sapiens
ccaggtgtgagcattctgtctt

SEQ ID NO: 7458540 - DNA, 22 bp, Homo sapiens
ccaggtgtctgtggccagccct

SEQ ID NO: 7458541 - DNA, 22 bp, Homo sapiens
ccaggtgtgatttcatctgagg

SEQ ID NO: 7458542 - DNA, 22 bp, Homo sapiens
ccaggtgtgatttggcagtgtc

SEQ ID NO: 7458543 - DNA, 22 bp, Homo sapiens
ccaggtgtgatttggcagtgtc

SEQ ID NO: 7458544 - DNA, 22 bp, Homo sapiens
ccaggtgtgatttggcagtgtc

SEQ ID NO: 7458545 - DNA, 22 bp, Homo sapiens
ccaggtgtgatttggcagtgtc

SEQ ID NO: 7458546 - DNA, 22 bp, Homo sapiens
ccaggtgtaggacaccaaggga

SEQ ID NO: 7458547 - DNA, 22 bp, Homo sapiens
ccaggtgtcatgcgtgtgaccc

SEQ ID NO: 7458548 - DNA, 22 bp, Homo sapiens
ccaggtgtaggacaccaaggga

SEQ ID NO: 7458549 - DNA, 22 bp, Homo sapiens
ccaggtgtcatgcgtgtgaccc

SEQ ID NO: 7458550 - DNA, 22 bp, Homo sapiens
ccaggtgtcatgcgtgtgaccc

SEQ ID NO: 7458551 - DNA, 22 bp, Homo sapiens
ccaggtgtcatggataatgggt

SEQ ID NO: 7458552 - DNA, 22 bp, Homo sapiens
ccaggtgtccccgtcactgcag

SEQ ID NO: 7458553 - DNA, 22 bp, Homo sapiens
ccaggtgtctgtggccagccct

SEQ ID NO: 7458554 - DNA, 22 bp, Homo sapiens
ccaggtgtctgtctctttttca

SEQ ID NO: 7458555 - DNA, 22 bp, Homo sapiens
ccaggtgtaagacatggtccta

SEQ ID NO: 7458556 - DNA, 22 bp, Homo sapiens
ccaggtgtagcactgctcacag

SEQ ID NO: 7458557 - DNA, 22 bp, Homo sapiens
ccaggtgtagcactgctcacag

SEQ ID NO: 7458558 - DNA, 17 bp, Homo sapiens
ccaggtgggaggtgggg

SEQ ID NO: 7458559 - DNA, 17 bp, Homo sapiens
ccaggtgggaggtgggg

SEQ ID NO: 7458560 - DNA, 22 bp, Homo sapiens
tgagacgaagtcttgctctgtt

SEQ ID NO: 7458561 - DNA, 22 bp, Homo sapiens
tgagacgaagtcttgctctgtt

SEQ ID NO: 7458562 - DNA, 22 bp, Homo sapiens
tgagacgaagtcttgctctgtt

SEQ ID NO: 7458563 - DNA, 22 bp, Homo sapiens
tgagacgaagtcttgctctgtt

SEQ ID NO: 7458564 - DNA, 17 bp, Homo sapiens
ccaggtgggaggtgggg

SEQ ID NO: 7458565 - DNA, 22 bp, Homo sapiens
tgagacctgtaatgagaaattg

SEQ ID NO: 7458566 - DNA, 22 bp, Homo sapiens
tgagacctgtagcttcacagag

SEQ ID NO: 7458567 - DNA, 22 bp, Homo sapiens
tgagacctgtagcttcacagag

SEQ ID NO: 7458568 - DNA, 22 bp, Homo sapiens
tgagaccttaaaaggtatgtca

SEQ ID NO: 7458569 - DNA, 22 bp, Homo sapiens
tgagacgaagtcttgctctgtt

SEQ ID NO: 7458570 - DNA, 23 bp, Homo sapiens
tgagaccctaatttagcaagtgt

SEQ ID NO: 7458571 - DNA, 23 bp, Homo sapiens
tgagaccctaatttagcaagtgt

SEQ ID NO: 7458572 - DNA, 20 bp, Homo sapiens
tgagacccgctgacaagttc

SEQ ID NO: 7458573 - DNA, 22 bp, Homo sapiens
tgagacctgcccaacgcagacc

SEQ ID NO: 7458574 - DNA, 23 bp, Homo sapiens
tgagaccctaatttagcaagtgt

SEQ ID NO: 7458575 - DNA, 22 bp, Homo sapiens
tgagacctctgggttctgagct

SEQ ID NO: 7458576 - DNA, 22 bp, Homo sapiens
tgagacatcatggctgaaagta

SEQ ID NO: 7458577 - DNA, 22 bp, Homo sapiens
tgagacatcacaaaatcctcaa

SEQ ID NO: 7458578 - DNA, 22 bp, Homo sapiens
tgagacagtttttctatttcca

SEQ ID NO: 7458579 - DNA, 22 bp, Homo sapiens
tgagacatgctgtccaagaagt

SEQ ID NO: 7458580 - DNA, 22 bp, Homo sapiens
tgagacatcatggctgaaagta

SEQ ID NO: 7458581 - DNA, 22 bp, Homo sapiens
tgagacatcatggctgaaagta

SEQ ID NO: 7458582 - DNA, 22 bp, Homo sapiens
tgagaccatttgacatacagtg

SEQ ID NO: 7458583 - DNA, 20 bp, Homo sapiens
tgagacccgctgacaagttc

SEQ ID NO: 7458584 - DNA, 22 bp, Homo sapiens
tgagacatgtgaatatttgtac

SEQ ID NO: 7458585 - DNA, 22 bp, Homo sapiens
ccaggtggacggcgagtacagg

SEQ ID NO: 7458586 - DNA, 22 bp, Homo sapiens
ccaggtggacggcgagtacagg

SEQ ID NO: 7458587 - DNA, 22 bp, Homo sapiens
tgagacagttctgcagctgggt

SEQ ID NO: 7458588 - DNA, 22 bp, Homo sapiens
tgagacagttctgcagctgggt

SEQ ID NO: 7458589 - DNA, 22 bp, Homo sapiens
tgagacagttctgcagctgggt

SEQ ID NO: 7458590 - DNA, 22 bp, Homo sapiens
tgagacagttctgcagctgggt

SEQ ID NO: 7458591 - DNA, 22 bp, Homo sapiens
tgagacagttctgcagctgggt

SEQ ID NO: 7458592 - DNA, 22 bp, Homo sapiens
tgagacagttctgcagctgggt

SEQ ID NO: 7458593 - DNA, 22 bp, Homo sapiens
tgagacagttctgcagctgggt

SEQ ID NO: 7458594 - DNA, 22 bp, Homo sapiens
tgagacagttggtgaaatctaa

SEQ ID NO: 7458595 - DNA, 22 bp, Homo sapiens
tgagacagttggtgaaatctaa

SEQ ID NO: 7458596 - DNA, 22 bp, Homo sapiens
tgagacagttggtgaaatctaa

SEQ ID NO: 7458597 - DNA, 22 bp, Homo sapiens
tgagacagtttttctatttcca

SEQ ID NO: 7458598 - DNA, 22 bp, Homo sapiens
tgagacagttggtgaaatctaa

SEQ ID NO: 7458599 - DNA, 22 bp, Homo sapiens
tgagacagtttttctatttcca

SEQ ID NO: 7458600 - DNA, 22 bp, Homo sapiens
tgaatgatacagaattatgtag

SEQ ID NO: 7458601 - DNA, 22 bp, Homo sapiens
tgaatgatacagaattatgtag

SEQ ID NO: 7458602 - DNA, 22 bp, Homo sapiens
tgaatgatatgtgaaaaggaac

SEQ ID NO: 7458603 - DNA, 22 bp, Homo sapiens
tgaatgatatattgggaataat

SEQ ID NO: 7458604 - DNA, 22 bp, Homo sapiens
tgaatgatctccgattagtcct

SEQ ID NO: 7458605 - DNA, 22 bp, Homo sapiens
tgaatgatacagaattatgtag

SEQ ID NO: 7458606 - DNA, 22 bp, Homo sapiens
tgaatgatctagttttgtagac

SEQ ID NO: 7458607 - DNA, 22 bp, Homo sapiens
tgaagttgttaaggttgccatt

SEQ ID NO: 7458608 - DNA, 21 bp, Homo sapiens
tgaagttcgcgggcaagatta

SEQ ID NO: 7458609 - DNA, 22 bp, Homo sapiens
tgaagttgttaaggttgccatt

SEQ ID NO: 7458610 - DNA, 22 bp, Homo sapiens
tgaagttgttaaggttgccatt

SEQ ID NO: 7458611 - DNA, 22 bp, Homo sapiens
tgaagttgttaaggttgccatt

SEQ ID NO: 7458612 - DNA, 22 bp, Homo sapiens
tgaagttgttaaggttgccatt

SEQ ID NO: 7458613 - DNA, 22 bp, Homo sapiens
tgaatgagtgagttcagacctc

SEQ ID NO: 7458614 - DNA, 22 bp, Homo sapiens
tgaatgagtggattctgagtag

SEQ ID NO: 7458615 - DNA, 22 bp, Homo sapiens
tgaatgagtggattctgagtag

SEQ ID NO: 7458616 - DNA, 22 bp, Homo sapiens
tgaatgatttgggtgcattcag

SEQ ID NO: 7458617 - DNA, 22 bp, Homo sapiens
tgaatgatttcttaggcaattg

SEQ ID NO: 7458618 - DNA, 23 bp, Homo sapiens
tgaatgattgtactgagctttta

SEQ ID NO: 7458619 - DNA, 22 bp, Homo sapiens
tgaatgattaaaacccggacta

SEQ ID NO: 7458620 - DNA, 22 bp, Homo sapiens
tgaatgatgtataatattgaga

SEQ ID NO: 7458621 - DNA, 22 bp, Homo sapiens
tgaatgatggtgtgttcttgcc

SEQ ID NO: 7458622 - DNA, 22 bp, Homo sapiens
tgaatgatggtgtgttcttgcc

SEQ ID NO: 7458623 - DNA, 23 bp, Homo sapiens
tgaatgatggtgctcctcatctt

SEQ ID NO: 7458624 - DNA, 21 bp, Homo sapiens
tgaatgatgccccagagttgt

SEQ ID NO: 7458625 - DNA, 21 bp, Homo sapiens
tgaatgatgccccagagttgt

SEQ ID NO: 7458626 - DNA, 22 bp, Homo sapiens
tgaatgatgcatttgtttccca

SEQ ID NO: 7458627 - DNA, 22 bp, Homo sapiens
tgaatgatgcagtataatgata

SEQ ID NO: 7458628 - DNA, 22 bp, Homo sapiens
tgaatgatgcagtataatgata

SEQ ID NO: 7458629 - DNA, 22 bp, Homo sapiens
tgaatgatgaggggagaataat

SEQ ID NO: 7458630 - DNA, 22 bp, Homo sapiens
tgaatgatgaggggagaataat

SEQ ID NO: 7458631 - DNA, 22 bp, Homo sapiens
tgaatgatgaggggagaataat

SEQ ID NO: 7458632 - DNA, 22 bp, Homo sapiens
tgaatgatctccgattagtcct

SEQ ID NO: 7458633 - DNA, 21 bp, Homo sapiens
tgaatgatctggttgcctttt

SEQ ID NO: 7458634 - DNA, 22 bp, Homo sapiens
tgacaactttacaaaattcttc

SEQ ID NO: 7458635 - DNA, 22 bp, Homo sapiens
tgacaactgcatcttggacttc

SEQ ID NO: 7458636 - DNA, 20 bp, Homo sapiens
tgacaactctgagaacgttc

SEQ ID NO: 7458637 - DNA, 20 bp, Homo sapiens
tgacaactctgagaacgttc

SEQ ID NO: 7458638 - DNA, 22 bp, Homo sapiens
tgacaactctagttaatgaatt

SEQ ID NO: 7458639 - DNA, 22 bp, Homo sapiens
tgacaactctagttaatgaatt

SEQ ID NO: 7458640 - DNA, 22 bp, Homo sapiens
tgacaactttacaaaattcttc

SEQ ID NO: 7458641 - DNA, 22 bp, Homo sapiens
tgacaagaagacctggtaatga

SEQ ID NO: 7458642 - DNA, 22 bp, Homo sapiens
tgacaagaagacctggtaatga

SEQ ID NO: 7458643 - DNA, 22 bp, Homo sapiens
tgacaagaatttgggactgtta

SEQ ID NO: 7458644 - DNA, 23 bp, Homo sapiens
tgacaacagctctcagccatgtc

SEQ ID NO: 7458645 - DNA, 22 bp, Homo sapiens
tgacaacaaggatcctgcctgg

SEQ ID NO: 7458646 - DNA, 21 bp, Homo sapiens
tgacaacagaactgggcaagc

SEQ ID NO: 7458647 - DNA, 22 bp, Homo sapiens
tgacaacagccatcacttttag

SEQ ID NO: 7458648 - DNA, 23 bp, Homo sapiens
tgacaacagctctcagccatgtc

SEQ ID NO: 7458649 - DNA, 23 bp, Homo sapiens
tgacaacagctctcagccatgtc

SEQ ID NO: 7458650 - DNA, 23 bp, Homo sapiens
tgacaacagctctcagccatgtc

SEQ ID NO: 7458651 - DNA, 23 bp, Homo sapiens
tgacaacagctctcagccatgtc

SEQ ID NO: 7458652 - DNA, 23 bp, Homo sapiens
tgacaacagctctcagccatgtc

SEQ ID NO: 7458653 - DNA, 22 bp, Homo sapiens
tgacaacatcatttttgtgtgg

SEQ ID NO: 7458654 - DNA, 20 bp, Homo sapiens
tgacaacatgccttttgctt

SEQ ID NO: 7458655 - DNA, 22 bp, Homo sapiens
tgacaacattgagttatgtgca

SEQ ID NO: 7458656 - DNA, 22 bp, Homo sapiens
tgaatgcaagaaggaacatgaa

SEQ ID NO: 7458657 - DNA, 22 bp, Homo sapiens
tgaatgcaaatcatgattgtaa

SEQ ID NO: 7458658 - DNA, 22 bp, Homo sapiens
tgaatgcaagaaggaacatgaa

SEQ ID NO: 7458659 - DNA, 22 bp, Homo sapiens
tgaatgcaagtcacacatttct

SEQ ID NO: 7458660 - DNA, 22 bp, Homo sapiens
tgaatgcaagtcacacatttct

SEQ ID NO: 7458661 - DNA, 22 bp, Homo sapiens
tgaatgcactgctctcctagga

SEQ ID NO: 7458662 - DNA, 22 bp, Homo sapiens
tgacaaattcatatttcagagg

SEQ ID NO: 7458663 - DNA, 20 bp, Homo sapiens
tgacaacaaaatggtaattt

SEQ ID NO: 7458664 - DNA, 20 bp, Homo sapiens
tgacaacaaaatggtaattt

SEQ ID NO: 7458665 - DNA, 22 bp, Homo sapiens
tgacaacaaggatcctgcctgg

SEQ ID NO: 7458666 - DNA, 22 bp, Homo sapiens
tgaatgcagagactgtgggaaa

SEQ ID NO: 7458667 - DNA, 22 bp, Homo sapiens
tgaatgcacattagtaagtgca

SEQ ID NO: 7458668 - DNA, 22 bp, Homo sapiens
tgaatgcactgctctcctagga

SEQ ID NO: 7458669 - DNA, 22 bp, Homo sapiens
tgaatgcatggcttagatctac

SEQ ID NO: 7458670 - DNA, 22 bp, Homo sapiens
tgaatgcatggcttagatctac

SEQ ID NO: 7458671 - DNA, 22 bp, Homo sapiens
tgaatgctcacatgcctaggtc

SEQ ID NO: 7458672 - DNA, 22 bp, Homo sapiens
tgaatgctcacatgcctaggtc

SEQ ID NO: 7458673 - DNA, 22 bp, Homo sapiens
ccaggctggagtgcagtagtgt

SEQ ID NO: 7458674 - DNA, 22 bp, Homo sapiens
ccaggctggagtgcagtagtgt

SEQ ID NO: 7458675 - DNA, 22 bp, Homo sapiens
ccaggctggagtgcaatggtgc

SEQ ID NO: 7458676 - DNA, 22 bp, Homo sapiens
ccaggctggagtgcaatggtgc

SEQ ID NO: 7458677 - DNA, 22 bp, Homo sapiens
ccaggctggagtgcaatggtgc

SEQ ID NO: 7458678 - DNA, 22 bp, Homo sapiens
ccaggctggagtgcaatggtgc

SEQ ID NO: 7458679 - DNA, 22 bp, Homo sapiens
ccaggctggagtgcagtagtgt

SEQ ID NO: 7458680 - DNA, 22 bp, Homo sapiens
ccaggctggagtgcagtagtgt

SEQ ID NO: 7458681 - DNA, 22 bp, Homo sapiens
ccaggctggagtgcagtagtgt

SEQ ID NO: 7458682 - DNA, 22 bp, Homo sapiens
ccaggctggagtgcagtagtgt

SEQ ID NO: 7458683 - DNA, 22 bp, Homo sapiens
ccaggctggagtgcagtagtgt

SEQ ID NO: 7458684 - DNA, 22 bp, Homo sapiens
ccaggctggagtgcagtagtgt

SEQ ID NO: 7458685 - DNA, 22 bp, Homo sapiens
ccaggctggagtgcagtagtgt

SEQ ID NO: 7458686 - DNA, 22 bp, Homo sapiens
ccaggctggagtgcagtagtgt

SEQ ID NO: 7458687 - DNA, 22 bp, Homo sapiens
ccaggctggagtgcagtagtgt

SEQ ID NO: 7458688 - DNA, 22 bp, Homo sapiens
ccaggctggagtgcagtagtgt

SEQ ID NO: 7458689 - DNA, 22 bp, Homo sapiens
ccaggctggagtgcagtggcac

SEQ ID NO: 7458690 - DNA, 22 bp, Homo sapiens
ccaggctggagtgcagtggcac

SEQ ID NO: 7458691 - DNA, 22 bp, Homo sapiens
ccaggctggagtgcagtggcac

SEQ ID NO: 7458692 - DNA, 22 bp, Homo sapiens
ccaggctggagtgcagtggcac

SEQ ID NO: 7458693 - DNA, 22 bp, Homo sapiens
ccaggctggagtgcagtggcac

SEQ ID NO: 7458694 - DNA, 22 bp, Homo sapiens
ccaggctggagtgcagtggcac

SEQ ID NO: 7458695 - DNA, 22 bp, Homo sapiens
ccaggctggagtgcagtggcac

SEQ ID NO: 7458696 - DNA, 22 bp, Homo sapiens
ccaggctggagtgcagtggcac

SEQ ID NO: 7458697 - DNA, 22 bp, Homo sapiens
ccaggctggagtgcagtggcac

SEQ ID NO: 7458698 - DNA, 22 bp, Homo sapiens
ccaggctggagtgcagtggcac

SEQ ID NO: 7458699 - DNA, 22 bp, Homo sapiens
ccaggctggagtgcagtggcac

SEQ ID NO: 7458700 - DNA, 22 bp, Homo sapiens
ccaggctggagtgcagtggcac

SEQ ID NO: 7458701 - DNA, 22 bp, Homo sapiens
ccaggctggagtgcagtggcac

SEQ ID NO: 7458702 - DNA, 22 bp, Homo sapiens
ccaggctggagtgcagtggcac

SEQ ID NO: 7458703 - DNA, 22 bp, Homo sapiens
ccaggctggagtgcagtggcac

SEQ ID NO: 7458704 - DNA, 22 bp, Homo sapiens
ccaggctggagtgcagtggcac

SEQ ID NO: 7458705 - DNA, 22 bp, Homo sapiens
ccaggctggagtgcagtggcac

SEQ ID NO: 7458706 - DNA, 22 bp, Homo sapiens
ccaggctggattttgcagttca

SEQ ID NO: 7458707 - DNA, 22 bp, Homo sapiens
ccaggctggattttgcagttca

SEQ ID NO: 7458708 - DNA, 22 bp, Homo sapiens
ccaggctggattttgcagttca

SEQ ID NO: 7458709 - DNA, 22 bp, Homo sapiens
ccaggctggagtgtagtcgcat

SEQ ID NO: 7458710 - DNA, 22 bp, Homo sapiens
ccaggctggattttgcagttca

SEQ ID NO: 7458711 - DNA, 22 bp, Homo sapiens
ccaggctggattttgcagttca

SEQ ID NO: 7458712 - DNA, 22 bp, Homo sapiens
ccaggctggattttgcagttca

SEQ ID NO: 7458713 - DNA, 22 bp, Homo sapiens
ccaggctggagtgtagtcgcat

SEQ ID NO: 7458714 - DNA, 22 bp, Homo sapiens
ccaggctggagtgcagtggcac

SEQ ID NO: 7458715 - DNA, 22 bp, Homo sapiens
ccaggctggagtgtagtcgcat

SEQ ID NO: 7458716 - DNA, 22 bp, Homo sapiens
ccaggctggagtgtagtcgcat

SEQ ID NO: 7458717 - DNA, 22 bp, Homo sapiens
ccaggctggagtgcagtggcac

SEQ ID NO: 7458718 - DNA, 22 bp, Homo sapiens
ccaggctggagtgtagtcgcat

SEQ ID NO: 7458719 - DNA, 22 bp, Homo sapiens
ccaggctggagtgtagtcgcat

SEQ ID NO: 7458720 - DNA, 22 bp, Homo sapiens
ccaggctggagtgtagtcgcat

SEQ ID NO: 7458721 - DNA, 21 bp, Homo sapiens
ccaggctggccatggtattga

SEQ ID NO: 7458722 - DNA, 21 bp, Homo sapiens
ccaggctggccatggtattga

SEQ ID NO: 7458723 - DNA, 21 bp, Homo sapiens
ccaggctggccatggtattga

SEQ ID NO: 7458724 - DNA, 20 bp, Homo sapiens
ccaggctggcaaatgggggc

SEQ ID NO: 7458725 - DNA, 20 bp, Homo sapiens
ccaggctggcaaatgggggc

SEQ ID NO: 7458726 - DNA, 20 bp, Homo sapiens
ccaggctggcaaatgggggc

SEQ ID NO: 7458727 - DNA, 21 bp, Homo sapiens
ccaggctggccatggtattga

SEQ ID NO: 7458728 - DNA, 22 bp, Homo sapiens
tgaagttcaagggctacatttg

SEQ ID NO: 7458729 - DNA, 22 bp, Homo sapiens
tgaagttcaagggctacatttg

SEQ ID NO: 7458730 - DNA, 22 bp, Homo sapiens
tgaagttcactgagagttcacc

SEQ ID NO: 7458731 - DNA, 23 bp, Homo sapiens
tgaagttcattctcactgatgta

SEQ ID NO: 7458732 - DNA, 23 bp, Homo sapiens
tgaagttcattctcactgatgta

SEQ ID NO: 7458733 - DNA, 20 bp, Homo sapiens
ccaggctggcaaatgggggc

SEQ ID NO: 7458734 - DNA, 20 bp, Homo sapiens
ccaggctggcaaatgggggc

SEQ ID NO: 7458735 - DNA, 20 bp, Homo sapiens
ccaggctggcaaatgggggc

SEQ ID NO: 7458736 - DNA, 20 bp, Homo sapiens
ccaggctggcaaatgggggc

SEQ ID NO: 7458737 - DNA, 20 bp, Homo sapiens
ccaggctggcaaatgggggc

SEQ ID NO: 7458738 - DNA, 20 bp, Homo sapiens
ccaggctggcaaatgggggc

SEQ ID NO: 7458739 - DNA, 22 bp, Homo sapiens
ccaggctggattttgcagttca

SEQ ID NO: 7458740 - DNA, 22 bp, Homo sapiens
ccaggctggattttgcagttca

SEQ ID NO: 7458741 - DNA, 22 bp, Homo sapiens
tgacaagtacataatttcatgt

SEQ ID NO: 7458742 - DNA, 22 bp, Homo sapiens
tgacaagtacataatttcatgt

SEQ ID NO: 7458743 - DNA, 22 bp, Homo sapiens
tgacaagtacataatttcatgt

SEQ ID NO: 7458744 - DNA, 22 bp, Homo sapiens
tgacaagaggcagaatcagctg

SEQ ID NO: 7458745 - DNA, 22 bp, Homo sapiens
tgacaagaggcagaatcagctg

SEQ ID NO: 7458746 - DNA, 19 bp, Homo sapiens
tgacaagataatagccttg

SEQ ID NO: 7458747 - DNA, 22 bp, Homo sapiens
tgacaagtttcctggtgatttt

SEQ ID NO: 7458748 - DNA, 22 bp, Homo sapiens
tgacaagtttcctggtgatttt

SEQ ID NO: 7458749 - DNA, 22 bp, Homo sapiens
tgacaatacagagagagcaaaa

SEQ ID NO: 7458750 - DNA, 22 bp, Homo sapiens
tgacaatacagagagagcaaaa

SEQ ID NO: 7458751 - DNA, 22 bp, Homo sapiens
tgacaagttctaataagaaatg

SEQ ID NO: 7458752 - DNA, 22 bp, Homo sapiens
tgacaagttctaataagaaatg

SEQ ID NO: 7458753 - DNA, 22 bp, Homo sapiens
tgacaagttctaataagaaatg

SEQ ID NO: 7458754 - DNA, 22 bp, Homo sapiens
tgacaagttggaaagcagtgca

SEQ ID NO: 7458755 - DNA, 22 bp, Homo sapiens
tgacaagttggaaagcagtgca

SEQ ID NO: 7458756 - DNA, 22 bp, Homo sapiens
tgacaagtcactgttcttcaat

SEQ ID NO: 7458757 - DNA, 22 bp, Homo sapiens
tgacaagtcactgttcttcaat

SEQ ID NO: 7458758 - DNA, 22 bp, Homo sapiens
tgacaagtcactgttcttcaat

SEQ ID NO: 7458759 - DNA, 23 bp, Homo sapiens
tgacaagtctcagccaatgcaga

SEQ ID NO: 7458760 - DNA, 23 bp, Homo sapiens
tgacaagtctcagccaatgcaga

SEQ ID NO: 7458761 - DNA, 23 bp, Homo sapiens
tgacaagtctcagccaatgcaga

SEQ ID NO: 7458762 - DNA, 23 bp, Homo sapiens
tgacaagtctcagccaatgcaga

SEQ ID NO: 7458763 - DNA, 22 bp, Homo sapiens
tgacaatagcgatttatcttgc

SEQ ID NO: 7458764 - DNA, 22 bp, Homo sapiens
tgacaatagcgatttatcttgc

SEQ ID NO: 7458765 - DNA, 22 bp, Homo sapiens
tgacaatattgagtcttaggtt

SEQ ID NO: 7458766 - DNA, 22 bp, Homo sapiens
tgacaatagcgatttatcttgc

SEQ ID NO: 7458767 - DNA, 22 bp, Homo sapiens
tgacaatagcgatttatcttgc

SEQ ID NO: 7458768 - DNA, 22 bp, Homo sapiens
tgacaatggatattagttgtgg

SEQ ID NO: 7458769 - DNA, 22 bp, Homo sapiens
tgacaatggatattagttgtgg

SEQ ID NO: 7458770 - DNA, 22 bp, Homo sapiens
tgacaatgaggccctccacaaa

SEQ ID NO: 7458771 - DNA, 22 bp, Homo sapiens
tgacaatgacatggacagtgat

SEQ ID NO: 7458772 - DNA, 22 bp, Homo sapiens
tgacaatgacatggacagtgat

SEQ ID NO: 7458773 - DNA, 17 bp, Homo sapiens
tgacaatgacaagcact

SEQ ID NO: 7458774 - DNA, 17 bp, Homo sapiens
tgacaatgacaagcact

SEQ ID NO: 7458775 - DNA, 22 bp, Homo sapiens
ccagggcttcagaggttttggc

SEQ ID NO: 7458776 - DNA, 22 bp, Homo sapiens
ccagggctggaccagtgcttgg

SEQ ID NO: 7458777 - DNA, 22 bp, Homo sapiens
ccagggcttcagttagtggtga

SEQ ID NO: 7458778 - DNA, 22 bp, Homo sapiens
ccagggctgctgtgggactcca

SEQ ID NO: 7458779 - DNA, 19 bp, Homo sapiens
tgacaatgggcacctgtgt

SEQ ID NO: 7458780 - DNA, 22 bp, Homo sapiens
tgacaatggggcacatggaaag

SEQ ID NO: 7458781 - DNA, 22 bp, Homo sapiens
ccagggctgctgtgggactcca

SEQ ID NO: 7458782 - DNA, 22 bp, Homo sapiens
ccagggctgctgtgggactcca

SEQ ID NO: 7458783 - DNA, 22 bp, Homo sapiens
ccaggggaaacagggagcactc

SEQ ID NO: 7458784 - DNA, 22 bp, Homo sapiens
ccaggggaaacagggagcactc

SEQ ID NO: 7458785 - DNA, 22 bp, Homo sapiens
ccaggggaaacagggagcactc

SEQ ID NO: 7458786 - DNA, 22 bp, Homo sapiens
ccaggggaaacagggagcactc

SEQ ID NO: 7458787 - DNA, 22 bp, Homo sapiens
ccaggggaaacagggagcactc

SEQ ID NO: 7458788 - DNA, 22 bp, Homo sapiens
ccaggggaaacagggagcactc

SEQ ID NO: 7458789 - DNA, 22 bp, Homo sapiens
ccaggggaaacagggagcactc

SEQ ID NO: 7458790 - DNA, 22 bp, Homo sapiens
ccaggggaaacagggagcactc

SEQ ID NO: 7458791 - DNA, 21 bp, Homo sapiens
ccaggggcaaattgtcgtttc

SEQ ID NO: 7458792 - DNA, 21 bp, Homo sapiens
ccaggggcaaattgtcgtttc

SEQ ID NO: 7458793 - DNA, 22 bp, Homo sapiens
ccagggctttgccaaagtccag

SEQ ID NO: 7458794 - DNA, 22 bp, Homo sapiens
ccagggctttgccaaagtccag

SEQ ID NO: 7458795 - DNA, 22 bp, Homo sapiens
ccagggctttgccaaagtccag

SEQ ID NO: 7458796 - DNA, 22 bp, Homo sapiens
ccagggctttgccaaagtccag

SEQ ID NO: 7458797 - DNA, 22 bp, Homo sapiens
ccagggctttatctgcctttga

SEQ ID NO: 7458798 - DNA, 22 bp, Homo sapiens
ccagggctttatctgcctttga

SEQ ID NO: 7458799 - DNA, 22 bp, Homo sapiens
ccagggctttatctgcctttga

SEQ ID NO: 7458800 - DNA, 22 bp, Homo sapiens
ccagggcttggtggcttgtatc

SEQ ID NO: 7458801 - DNA, 22 bp, Homo sapiens
ccagggcttggtggcttgtatc

SEQ ID NO: 7458802 - DNA, 19 bp, Homo sapiens
ccagggctttaagttgagg

SEQ ID NO: 7458803 - DNA, 19 bp, Homo sapiens
ccagggctttaagttgagg

SEQ ID NO: 7458804 - DNA, 19 bp, Homo sapiens
ccagggctttaagttgagg

SEQ ID NO: 7458805 - DNA, 19 bp, Homo sapiens
ccagggctttaagttgagg

SEQ ID NO: 7458806 - DNA, 19 bp, Homo sapiens
ccagggctttaagttgagg

SEQ ID NO: 7458807 - DNA, 22 bp, Homo sapiens
ccagggcttggtggcttgtatc

SEQ ID NO: 7458808 - DNA, 22 bp, Homo sapiens
ccagggcttcagttagtggtga

SEQ ID NO: 7458809 - DNA, 22 bp, Homo sapiens
ccagggcttcagttagtggtga

SEQ ID NO: 7458810 - DNA, 22 bp, Homo sapiens
ccagggcttcagttagtggtga

SEQ ID NO: 7458811 - DNA, 22 bp, Homo sapiens
ccagggcttcccacgtgccctg

SEQ ID NO: 7458812 - DNA, 22 bp, Homo sapiens
ccagggcttcccacgtgccctg

SEQ ID NO: 7458813 - DNA, 22 bp, Homo sapiens
ccagggcttcccacgtgccctg

SEQ ID NO: 7458814 - DNA, 22 bp, Homo sapiens
ccagggcttcccacgtgccctg

SEQ ID NO: 7458815 - DNA, 22 bp, Homo sapiens
ccagggcttcccacgtgccctg

SEQ ID NO: 7458816 - DNA, 22 bp, Homo sapiens
ccaggggcctgtgaaggtgccc

SEQ ID NO: 7458817 - DNA, 22 bp, Homo sapiens
ccaggggcctgtgaaggtgccc

SEQ ID NO: 7458818 - DNA, 22 bp, Homo sapiens
ccaggggcctgtgaaggtgccc

SEQ ID NO: 7458819 - DNA, 21 bp, Homo sapiens
ccaggggcaaattgtcgtttc

SEQ ID NO: 7458820 - DNA, 22 bp, Homo sapiens
tgacagtgcgggtacatcatag

SEQ ID NO: 7458821 - DNA, 22 bp, Homo sapiens
tgacagtgcgggtacatcatag

SEQ ID NO: 7458822 - DNA, 22 bp, Homo sapiens
tgacagtggtgacaggatgggg

SEQ ID NO: 7458823 - DNA, 22 bp, Homo sapiens
tgacagtgcgggtacatcatag

SEQ ID NO: 7458824 - DNA, 22 bp, Homo sapiens
ccaggggcctgtgaaggtgccc

SEQ ID NO: 7458825 - DNA, 22 bp, Homo sapiens
ccagggctttatctgcctttga

SEQ ID NO: 7458826 - DNA, 23 bp, Homo sapiens
tgacagtgtatttgactatatgg

SEQ ID NO: 7458827 - DNA, 22 bp, Homo sapiens
tgacagtgtgcccggaggttag

SEQ ID NO: 7458828 - DNA, 22 bp, Homo sapiens
tgacagtgtttgcacttcaggt

SEQ ID NO: 7458829 - DNA, 22 bp, Homo sapiens
tgacagttaaggtatacattca

SEQ ID NO: 7458830 - DNA, 21 bp, Homo sapiens
tgacagtgtggcatggaaggt

SEQ ID NO: 7458831 - DNA, 22 bp, Homo sapiens
tgacagtgttgggggtaaattt

SEQ ID NO: 7458832 - DNA, 22 bp, Homo sapiens
tgacagtgtttgcacttcaggt

SEQ ID NO: 7458833 - DNA, 22 bp, Homo sapiens
tgacagttaaggtatacattca

SEQ ID NO: 7458834 - DNA, 22 bp, Homo sapiens
tgacagttaaggtatacattca

SEQ ID NO: 7458835 - DNA, 22 bp, Homo sapiens
tgacagttcaggtcagatttat

SEQ ID NO: 7458836 - DNA, 22 bp, Homo sapiens
tgacagttaaggtatacattca

SEQ ID NO: 7458837 - DNA, 22 bp, Homo sapiens
tgacagttcaggtcagatttat

SEQ ID NO: 7458838 - DNA, 22 bp, Homo sapiens
tgacagttcaggtcagatttat

SEQ ID NO: 7458839 - DNA, 22 bp, Homo sapiens
tgacagttgtattacatgggaa

SEQ ID NO: 7458840 - DNA, 22 bp, Homo sapiens
tgacagtttagtgtaatagtta

SEQ ID NO: 7458841 - DNA, 22 bp, Homo sapiens
tgacagtttattttgcagaatg

SEQ ID NO: 7458842 - DNA, 22 bp, Homo sapiens
tgacagtttattttgcagaatg

SEQ ID NO: 7458843 - DNA, 22 bp, Homo sapiens
tgacagtttattttgcagaatg

SEQ ID NO: 7458844 - DNA, 22 bp, Homo sapiens
tgacagttgagcatgtaagaga

SEQ ID NO: 7458845 - DNA, 22 bp, Homo sapiens
tgacagttgagcatgtaagaga

SEQ ID NO: 7458846 - DNA, 22 bp, Homo sapiens
tgacagttgagcatgtaagaga

SEQ ID NO: 7458847 - DNA, 22 bp, Homo sapiens
tgacagttgtattacatgggaa

SEQ ID NO: 7458848 - DNA, 20 bp, Homo sapiens
tgacagtttcatatggttca

SEQ ID NO: 7458849 - DNA, 22 bp, Homo sapiens
tgacataaaccagtgagcaaaa

SEQ ID NO: 7458850 - DNA, 22 bp, Homo sapiens
tgacataaaccagtgagcaaaa

SEQ ID NO: 7458851 - DNA, 22 bp, Homo sapiens
tgagaaaaggttgagatgataa

SEQ ID NO: 7458852 - DNA, 22 bp, Homo sapiens
tgagaaaagtacatggagaagc

SEQ ID NO: 7458853 - DNA, 22 bp, Homo sapiens
tgagaaaaggttgagatgataa

SEQ ID NO: 7458854 - DNA, 22 bp, Homo sapiens
tgagaaaagtacatggagaagc

SEQ ID NO: 7458855 - DNA, 22 bp, Homo sapiens
tgagaaaaggttgagatgataa

SEQ ID NO: 7458856 - DNA, 22 bp, Homo sapiens
tgagaaaagtacatggagaagc

SEQ ID NO: 7458857 - DNA, 22 bp, Homo sapiens
tgagaaaagtacatggagaagc

SEQ ID NO: 7458858 - DNA, 22 bp, Homo sapiens
tgagaaaagtacatggagaagc

SEQ ID NO: 7458859 - DNA, 22 bp, Homo sapiens
tgagaaaagtacatggagaagc

SEQ ID NO: 7458860 - DNA, 22 bp, Homo sapiens
tgagaaaagtacatggagaagc

SEQ ID NO: 7458861 - DNA, 22 bp, Homo sapiens
tgagaaggaaacaatggctttt

SEQ ID NO: 7458862 - DNA, 22 bp, Homo sapiens
tgacatctagtaggtagagacc

SEQ ID NO: 7458863 - DNA, 22 bp, Homo sapiens
tgacatccggccactagactcc

SEQ ID NO: 7458864 - DNA, 22 bp, Homo sapiens
tgacatcctgagtacataagag

SEQ ID NO: 7458865 - DNA, 22 bp, Homo sapiens
tgagaaaaggttgagatgataa

SEQ ID NO: 7458866 - DNA, 22 bp, Homo sapiens
tgacatcattagtaacatagct

SEQ ID NO: 7458867 - DNA, 22 bp, Homo sapiens
tgacatccggccactagactcc

SEQ ID NO: 7458868 - DNA, 22 bp, Homo sapiens
tgacatcagaatggcatagaaa

SEQ ID NO: 7458869 - DNA, 22 bp, Homo sapiens
tgacatcacaagccatctgcag

SEQ ID NO: 7458870 - DNA, 22 bp, Homo sapiens
tgacatagggcaaaagagtagg

SEQ ID NO: 7458871 - DNA, 20 bp, Homo sapiens
tgacatagctttgcagagtt

SEQ ID NO: 7458872 - DNA, 22 bp, Homo sapiens
tgacatagctattaagtgatgc

SEQ ID NO: 7458873 - DNA, 20 bp, Homo sapiens
tgacatagctcttggggtgc

SEQ ID NO: 7458874 - DNA, 22 bp, Homo sapiens
tgacatacttttagatagatgg

SEQ ID NO: 7458875 - DNA, 22 bp, Homo sapiens
tgacataatgctttgaagttgc

SEQ ID NO: 7458876 - DNA, 22 bp, Homo sapiens
tgacataatgctttgaagttgc

SEQ ID NO: 7458877 - DNA, 22 bp, Homo sapiens
tgacatacttttagatagatgg

SEQ ID NO: 7458878 - DNA, 19 bp, Homo sapiens
tgacatagcaagacaaaac

SEQ ID NO: 7458879 - DNA, 19 bp, Homo sapiens
tgacatagcaagacaaaac

SEQ ID NO: 7458880 - DNA, 21 bp, Homo sapiens
tgacataatccatagtacaaa

SEQ ID NO: 7458881 - DNA, 21 bp, Homo sapiens
tgacataatccatagtacaaa

SEQ ID NO: 7458882 - DNA, 21 bp, Homo sapiens
tgacataatccatagtacaaa

SEQ ID NO: 7458883 - DNA, 22 bp, Homo sapiens
tgacataatgctttgaagttgc

SEQ ID NO: 7458884 - DNA, 22 bp, Homo sapiens
tgacataatgctttgaagttgc

SEQ ID NO: 7458885 - DNA, 22 bp, Homo sapiens
tgacataatgctttgaagttgc

SEQ ID NO: 7458886 - DNA, 22 bp, Homo sapiens
tgacataataatccaaacatac

SEQ ID NO: 7458887 - DNA, 22 bp, Homo sapiens
tctgctttcttgcgcagatgtg

SEQ ID NO: 7458888 - DNA, 22 bp, Homo sapiens
tctgctttcttgcgcagatgtg

SEQ ID NO: 7458889 - DNA, 22 bp, Homo sapiens
tctgctttcttgcgcagatgtg

SEQ ID NO: 7458890 - DNA, 22 bp, Homo sapiens
tctgctttgaccttcttgatgc

SEQ ID NO: 7458891 - DNA, 22 bp, Homo sapiens
tctgctttgctgcctcctgatc

SEQ ID NO: 7458892 - DNA, 22 bp, Homo sapiens
tctgctttgaccttcttgatgc

SEQ ID NO: 7458893 - DNA, 22 bp, Homo sapiens
tctgctttgctgcctcctgatc

SEQ ID NO: 7458894 - DNA, 22 bp, Homo sapiens
tctgctttgctgcctcctgatc

SEQ ID NO: 7458895 - DNA, 22 bp, Homo sapiens
tctgctttgctgcctcctgatc

SEQ ID NO: 7458896 - DNA, 22 bp, Homo sapiens
tctggaaagatcattaaatcca

SEQ ID NO: 7458897 - DNA, 22 bp, Homo sapiens
tctggaaagatcattaaatcca

SEQ ID NO: 7458898 - DNA, 22 bp, Homo sapiens
tctgctttttcattgactgaaa

SEQ ID NO: 7458899 - DNA, 22 bp, Homo sapiens
tctgctttttcattgactgaaa

SEQ ID NO: 7458900 - DNA, 22 bp, Homo sapiens
tctggaaaagcgataaaccatt

SEQ ID NO: 7458901 - DNA, 22 bp, Homo sapiens
tctggaaaagcgataaaccatt

SEQ ID NO: 7458902 - DNA, 18 bp, Homo sapiens
tctggaacaacttcatgt

SEQ ID NO: 7458903 - DNA, 18 bp, Homo sapiens
tctggaacaacttcatgt

SEQ ID NO: 7458904 - DNA, 22 bp, Homo sapiens
tctggaaatttcagttttagag

SEQ ID NO: 7458905 - DNA, 22 bp, Homo sapiens
tctggaaatttcagttttagag

SEQ ID NO: 7458906 - DNA, 22 bp, Homo sapiens
tctggaaatttcagttttagag

SEQ ID NO: 7458907 - DNA, 18 bp, Homo sapiens
tctggaacaacttcatgt

SEQ ID NO: 7458908 - DNA, 21 bp, Homo sapiens
tctggaagaaaaaagtattat

SEQ ID NO: 7458909 - DNA, 22 bp, Homo sapiens
tctggaacagttacttgctgat

SEQ ID NO: 7458910 - DNA, 22 bp, Homo sapiens
ccagctctctgcagaaaggact

SEQ ID NO: 7458911 - DNA, 22 bp, Homo sapiens
ccagctctctgcagaaaggact

SEQ ID NO: 7458912 - DNA, 22 bp, Homo sapiens
ccagctctcagcgggagactca

SEQ ID NO: 7458913 - DNA, 22 bp, Homo sapiens
ccagctctcagcgggagactca

SEQ ID NO: 7458914 - DNA, 22 bp, Homo sapiens
tctggaacagttacttgctgat

SEQ ID NO: 7458915 - DNA, 22 bp, Homo sapiens
tctgctttcaaattcacttagt

SEQ ID NO: 7458916 - DNA, 22 bp, Homo sapiens
tctgctttcaaattcacttagt

SEQ ID NO: 7458917 - DNA, 22 bp, Homo sapiens
tctgctttcaaattcacttagt

SEQ ID NO: 7458918 - DNA, 22 bp, Homo sapiens
tctgctttcttactaaaaatga

SEQ ID NO: 7458919 - DNA, 22 bp, Homo sapiens
tctgctttcttactaaaaatga

SEQ ID NO: 7458920 - DNA, 22 bp, Homo sapiens
tctgctttcttactaaaaatga

SEQ ID NO: 7458921 - DNA, 22 bp, Homo sapiens
tctgctttcttactaaaaatga

SEQ ID NO: 7458922 - DNA, 22 bp, Homo sapiens
tctgctttcttactaaaaatga

SEQ ID NO: 7458923 - DNA, 22 bp, Homo sapiens
tctgctttcttactaaaaatga

SEQ ID NO: 7458924 - DNA, 22 bp, Homo sapiens
tctgctttagtgcaaagtctta

SEQ ID NO: 7458925 - DNA, 22 bp, Homo sapiens
tctgctttagtgcaaagtctta

SEQ ID NO: 7458926 - DNA, 22 bp, Homo sapiens
tctgctttattacactagccaa

SEQ ID NO: 7458927 - DNA, 22 bp, Homo sapiens
tctgctttatggctcagagact

SEQ ID NO: 7458928 - DNA, 22 bp, Homo sapiens
tctgctttagtgcaaagtctta

SEQ ID NO: 7458929 - DNA, 22 bp, Homo sapiens
tctgctttagacataaaaggta

SEQ ID NO: 7458930 - DNA, 22 bp, Homo sapiens
tctgctttagacataaaaggta

SEQ ID NO: 7458931 - DNA, 22 bp, Homo sapiens
tctgctttagacataaaaggta

SEQ ID NO: 7458932 - DNA, 22 bp, Homo sapiens
tctgctttagaatccagtagct

SEQ ID NO: 7458933 - DNA, 23 bp, Homo sapiens
tctgcttctgtattttttcccat

SEQ ID NO: 7458934 - DNA, 22 bp, Homo sapiens
tctgcttctgtgaaggcagtct

SEQ ID NO: 7458935 - DNA, 22 bp, Homo sapiens
tctgcttctgtgaaggcagtct

SEQ ID NO: 7458936 - DNA, 22 bp, Homo sapiens
tctgctttagaatccagtagct

SEQ ID NO: 7458937 - DNA, 22 bp, Homo sapiens
tctgctttagaatccagtagct

SEQ ID NO: 7458938 - DNA, 22 bp, Homo sapiens
tctgctttagaatccagtagct

SEQ ID NO: 7458939 - DNA, 22 bp, Homo sapiens
tctgcttgtgtctgtccagcct

SEQ ID NO: 7458940 - DNA, 22 bp, Homo sapiens
tctgcttatcactagagacaga

SEQ ID NO: 7458941 - DNA, 22 bp, Homo sapiens
tctgcttctcctacttcatggg

SEQ ID NO: 7458942 - DNA, 22 bp, Homo sapiens
tctgcttctcctacttcatggg

SEQ ID NO: 7458943 - DNA, 22 bp, Homo sapiens
tctgcttctcctacttcatggg

SEQ ID NO: 7458944 - DNA, 18 bp, Homo sapiens
tctgctattagaattgcc

SEQ ID NO: 7458945 - DNA, 22 bp, Homo sapiens
tctgctcaatactgctcatgaa

SEQ ID NO: 7458946 - DNA, 22 bp, Homo sapiens
tctgctcacatggctccatgca

SEQ ID NO: 7458947 - DNA, 22 bp, Homo sapiens
tctgctgtttactgtgtgatat

SEQ ID NO: 7458948 - DNA, 22 bp, Homo sapiens
ccagagagaaaatggagggcca

SEQ ID NO: 7458949 - DNA, 22 bp, Homo sapiens
ccagagagaaaatggagggcca

SEQ ID NO: 7458950 - DNA, 22 bp, Homo sapiens
ccagagagaaaatggagggcca

SEQ ID NO: 7458951 - DNA, 22 bp, Homo sapiens
ccagagagaaaatggagggcca

SEQ ID NO: 7458952 - DNA, 22 bp, Homo sapiens
ccagagagaaaatggagggcca

SEQ ID NO: 7458953 - DNA, 22 bp, Homo sapiens
ccagagagaaaatggagggcca

SEQ ID NO: 7458954 - DNA, 22 bp, Homo sapiens
ccagagagaaaatggagggcca

SEQ ID NO: 7458955 - DNA, 22 bp, Homo sapiens
ccagagagaaaatggagggcca

SEQ ID NO: 7458956 - DNA, 22 bp, Homo sapiens
ccagagagaaaatggagggcca

SEQ ID NO: 7458957 - DNA, 22 bp, Homo sapiens
ccagagagaaaatggagggcca

SEQ ID NO: 7458958 - DNA, 22 bp, Homo sapiens
ccagagagaaaatggagggcca

SEQ ID NO: 7458959 - DNA, 22 bp, Homo sapiens
ccagagagaaaatggagggcca

SEQ ID NO: 7458960 - DNA, 22 bp, Homo sapiens
ccagagagaaaatggagggcca

SEQ ID NO: 7458961 - DNA, 22 bp, Homo sapiens
ccagagactggctgagagatct

SEQ ID NO: 7458962 - DNA, 22 bp, Homo sapiens
ccagagactggctgagagatct

SEQ ID NO: 7458963 - DNA, 22 bp, Homo sapiens
ccagagacgtcggtcagggcgc

SEQ ID NO: 7458964 - DNA, 22 bp, Homo sapiens
ccagagacgtcggtcagggcgc

SEQ ID NO: 7458965 - DNA, 22 bp, Homo sapiens
ccagagacgtcggtcagggcgc

SEQ ID NO: 7458966 - DNA, 22 bp, Homo sapiens
tctcagaaggcaagggctgggg

SEQ ID NO: 7458967 - DNA, 22 bp, Homo sapiens
tctcagaagggtggtgctggag

SEQ ID NO: 7458968 - DNA, 22 bp, Homo sapiens
tctcagaagggtggtgctggag

SEQ ID NO: 7458969 - DNA, 22 bp, Homo sapiens
tctcagaagtgatcaggatgtt

SEQ ID NO: 7458970 - DNA, 22 bp, Homo sapiens
tctcagaataaattcctaactt

SEQ ID NO: 7458971 - DNA, 22 bp, Homo sapiens
tctcagaataaattcctaactt

SEQ ID NO: 7458972 - DNA, 22 bp, Homo sapiens
tctcagaagtgatcaggatgtt

SEQ ID NO: 7458973 - DNA, 22 bp, Homo sapiens
tctcagaagtgatcaggatgtt

SEQ ID NO: 7458974 - DNA, 22 bp, Homo sapiens
ccagagagaaatggatttgagt

SEQ ID NO: 7458975 - DNA, 22 bp, Homo sapiens
ccagagagaaatggatttgagt

SEQ ID NO: 7458976 - DNA, 22 bp, Homo sapiens
ccagagagaaatggatttgagt

SEQ ID NO: 7458977 - DNA, 22 bp, Homo sapiens
ccagagagagaggtcaatggca

SEQ ID NO: 7458978 - DNA, 22 bp, Homo sapiens
ccagagagagaggtcaatggca

SEQ ID NO: 7458979 - DNA, 22 bp, Homo sapiens
ccagagagagaggtcaatggca

SEQ ID NO: 7458980 - DNA, 22 bp, Homo sapiens
ccagagagagaggtcaatggca

SEQ ID NO: 7458981 - DNA, 22 bp, Homo sapiens
tctcagaagggtggtgctggag

SEQ ID NO: 7458982 - DNA, 22 bp, Homo sapiens
tctcagactatagtagagattc

SEQ ID NO: 7458983 - DNA, 23 bp, Homo sapiens
tctcagacccgaagccagaggaa

SEQ ID NO: 7458984 - DNA, 22 bp, Homo sapiens
tctcagactctttagtgaaggt

SEQ ID NO: 7458985 - DNA, 22 bp, Homo sapiens
tctcagagaaatgtgtcaccat

SEQ ID NO: 7458986 - DNA, 19 bp, Homo sapiens
tctcagactgtgcttctgt

SEQ ID NO: 7458987 - DNA, 22 bp, Homo sapiens
tctcagagaacagttggtgctt

SEQ ID NO: 7458988 - DNA, 22 bp, Homo sapiens
tctcagagaaatgtgtcaccat

SEQ ID NO: 7458989 - DNA, 22 bp, Homo sapiens
tctcagagaaatgtgtcaccat

SEQ ID NO: 7458990 - DNA, 22 bp, Homo sapiens
tctcagagaacagttggtgctt

SEQ ID NO: 7458991 - DNA, 22 bp, Homo sapiens
tctcagagaacagttggtgctt

SEQ ID NO: 7458992 - DNA, 22 bp, Homo sapiens
tctgctaatgtggttatttcta

SEQ ID NO: 7458993 - DNA, 22 bp, Homo sapiens
tctgctacagggaaggacccct

SEQ ID NO: 7458994 - DNA, 22 bp, Homo sapiens
tctcagagaagtgatgagcaat

SEQ ID NO: 7458995 - DNA, 22 bp, Homo sapiens
tctgctattttctatctgtgtg

SEQ ID NO: 7458996 - DNA, 22 bp, Homo sapiens
tctgctcaatactgctcatgaa

SEQ ID NO: 7458997 - DNA, 22 bp, Homo sapiens
tctcagaattgtgtccactggg

SEQ ID NO: 7458998 - DNA, 22 bp, Homo sapiens
tctcagaattgtgtccactggg

SEQ ID NO: 7458999 - DNA, 22 bp, Homo sapiens
tctcagacatgtaatctctacc

SEQ ID NO: 7459000 - DNA, 22 bp, Homo sapiens
tctcagacatgtaatctctacc

SEQ ID NO: 7459001 - DNA, 22 bp, Homo sapiens
tctcagaattgtgtccactggg

SEQ ID NO: 7459002 - DNA, 19 bp, Homo sapiens
tctcagaattggcaatcat

SEQ ID NO: 7459003 - DNA, 22 bp, Homo sapiens
tctcagaattgtgtccactggg

SEQ ID NO: 7459004 - DNA, 19 bp, Homo sapiens
tctcagaattaagagtgct

SEQ ID NO: 7459005 - DNA, 19 bp, Homo sapiens
tctcagaattggcaatcat

SEQ ID NO: 7459006 - DNA, 19 bp, Homo sapiens
tctcagaattaagagtgct

SEQ ID NO: 7459007 - DNA, 19 bp, Homo sapiens
tctcagaattaagagtgct

SEQ ID NO: 7459008 - DNA, 22 bp, Homo sapiens
tctcagaatccttgcccaggtg

SEQ ID NO: 7459009 - DNA, 22 bp, Homo sapiens
tctcagaatccttgcccaggtg

SEQ ID NO: 7459010 - DNA, 22 bp, Homo sapiens
tctcagaatccttgcccaggtg

SEQ ID NO: 7459011 - DNA, 22 bp, Homo sapiens
tctcagaatcaggacctacttc

SEQ ID NO: 7459012 - DNA, 22 bp, Homo sapiens
tctcagaatcaggacctacttc

SEQ ID NO: 7459013 - DNA, 22 bp, Homo sapiens
tctcagaataaattcctaactt

SEQ ID NO: 7459014 - DNA, 22 bp, Homo sapiens
ccagctgcaggtgttccagatg

SEQ ID NO: 7459015 - DNA, 22 bp, Homo sapiens
ccagctgcaggtgttccagatg

SEQ ID NO: 7459016 - DNA, 22 bp, Homo sapiens
ccagctgcaggtgttccagatg

SEQ ID NO: 7459017 - DNA, 22 bp, Homo sapiens
ccagctgcaggtgttccagatg

SEQ ID NO: 7459018 - DNA, 22 bp, Homo sapiens
ccagctgcaggggagcagtgga

SEQ ID NO: 7459019 - DNA, 22 bp, Homo sapiens
ccagctgcaggtgttccagatg

SEQ ID NO: 7459020 - DNA, 22 bp, Homo sapiens
ccagctgcaggggagcagtgga

SEQ ID NO: 7459021 - DNA, 22 bp, Homo sapiens
ccagctgcaggtgttccagatg

SEQ ID NO: 7459022 - DNA, 22 bp, Homo sapiens
ccagctgcaggggagcagtgga

SEQ ID NO: 7459023 - DNA, 20 bp, Homo sapiens
ccagctgcagttcttaatga

SEQ ID NO: 7459024 - DNA, 20 bp, Homo sapiens
ccagctgcagttcttaatga

SEQ ID NO: 7459025 - DNA, 22 bp, Homo sapiens
ccagctgcatcctattcactgc

SEQ ID NO: 7459026 - DNA, 22 bp, Homo sapiens
ccagctgcatcctattcactgc

SEQ ID NO: 7459027 - DNA, 22 bp, Homo sapiens
ccagctgcatcctattcactgc

SEQ ID NO: 7459028 - DNA, 22 bp, Homo sapiens
ccagctgcatgacattaggtga

SEQ ID NO: 7459029 - DNA, 22 bp, Homo sapiens
ccagctgcatcctattcactgc

SEQ ID NO: 7459030 - DNA, 22 bp, Homo sapiens
ccagctgcccaagaggcatcct

SEQ ID NO: 7459031 - DNA, 22 bp, Homo sapiens
ccagctgcatgacattaggtga

SEQ ID NO: 7459032 - DNA, 22 bp, Homo sapiens
ccagctgcagaatgttggggaa

SEQ ID NO: 7459033 - DNA, 22 bp, Homo sapiens
ccagctgcagaatgttggggaa

SEQ ID NO: 7459034 - DNA, 22 bp, Homo sapiens
ccagctgcaggggagcagtgga

SEQ ID NO: 7459035 - DNA, 22 bp, Homo sapiens
ccagctgcaggggagcagtgga

SEQ ID NO: 7459036 - DNA, 22 bp, Homo sapiens
ccagctgcaggggagcagtgga

SEQ ID NO: 7459037 - DNA, 22 bp, Homo sapiens
ccagctgcaggggagcagtgga

SEQ ID NO: 7459038 - DNA, 22 bp, Homo sapiens
ccagctgaggttgaagaaagag

SEQ ID NO: 7459039 - DNA, 22 bp, Homo sapiens
ccagctgattcggtggtggttg

SEQ ID NO: 7459040 - DNA, 22 bp, Homo sapiens
ccagctctgccaagcgtcagct

SEQ ID NO: 7459041 - DNA, 20 bp, Homo sapiens
ccagctgagccaaggggaga

SEQ ID NO: 7459042 - DNA, 22 bp, Homo sapiens
ccagctgaggcagccacacagg

SEQ ID NO: 7459043 - DNA, 22 bp, Homo sapiens
ccagctgaggcagccacacagg

SEQ ID NO: 7459044 - DNA, 22 bp, Homo sapiens
ccagctctgattttgacctcca

SEQ ID NO: 7459045 - DNA, 22 bp, Homo sapiens
ccagctctctttgaagcataaa

SEQ ID NO: 7459046 - DNA, 22 bp, Homo sapiens
ccagctctgattttgacctcca

SEQ ID NO: 7459047 - DNA, 22 bp, Homo sapiens
ccagctctgattttgacctcca

SEQ ID NO: 7459048 - DNA, 22 bp, Homo sapiens
ccagctctcttcaagcccactc

SEQ ID NO: 7459049 - DNA, 22 bp, Homo sapiens
ccagctctcttcaagcccactc

SEQ ID NO: 7459050 - DNA, 22 bp, Homo sapiens
ccagctctcttcaagcccactc

SEQ ID NO: 7459051 - DNA, 22 bp, Homo sapiens
ccagctctctttgaagcataaa

SEQ ID NO: 7459052 - DNA, 22 bp, Homo sapiens
ccagctctctgtcctccccaca

SEQ ID NO: 7459053 - DNA, 22 bp, Homo sapiens
ccagctctctgtcctccccaca

SEQ ID NO: 7459054 - DNA, 22 bp, Homo sapiens
ccagctctctgtcctccccaca

SEQ ID NO: 7459055 - DNA, 22 bp, Homo sapiens
ccagctctctgtcctccccaca

SEQ ID NO: 7459056 - DNA, 22 bp, Homo sapiens
ccagctctctgtcctccccaca

SEQ ID NO: 7459057 - DNA, 22 bp, Homo sapiens
ccagctctctgcagaaaggact

SEQ ID NO: 7459058 - DNA, 22 bp, Homo sapiens
ccagctctctgcagaaaggact

SEQ ID NO: 7459059 - DNA, 22 bp, Homo sapiens
ccagctctctgcagaaaggact

SEQ ID NO: 7459060 - DNA, 22 bp, Homo sapiens
ccagctctgccaagcgtcagct

SEQ ID NO: 7459061 - DNA, 22 bp, Homo sapiens
ccagctctgccaagcgtcagct

SEQ ID NO: 7459062 - DNA, 22 bp, Homo sapiens
ccagctctgccaagcgtcagct

SEQ ID NO: 7459063 - DNA, 22 bp, Homo sapiens
ccagctctgccaagcgtcagct

SEQ ID NO: 7459064 - DNA, 22 bp, Homo sapiens
ccagctctgccaagcgtcagct

SEQ ID NO: 7459065 - DNA, 22 bp, Homo sapiens
ccagctctgccaagcgtcagct

SEQ ID NO: 7459066 - DNA, 22 bp, Homo sapiens
ccagctctgcatgtttcccttg

SEQ ID NO: 7459067 - DNA, 22 bp, Homo sapiens
ccagctctgcatgtttcccttg

SEQ ID NO: 7459068 - DNA, 22 bp, Homo sapiens
ccagctctgcagggcctggggt

SEQ ID NO: 7459069 - DNA, 22 bp, Homo sapiens
ccagctctgattttgacctcca

SEQ ID NO: 7459070 - DNA, 22 bp, Homo sapiens
ccagctctgcagggcctggggt

SEQ ID NO: 7459071 - DNA, 22 bp, Homo sapiens
ccagctctgcagggcctggggt

SEQ ID NO: 7459072 - DNA, 22 bp, Homo sapiens
ccagctctgcagggcctggggt

SEQ ID NO: 7459073 - DNA, 22 bp, Homo sapiens
ccagctctgattttgacctcca

SEQ ID NO: 7459074 - DNA, 22 bp, Homo sapiens
ccagctctgattttgacctcca

SEQ ID NO: 7459075 - DNA, 22 bp, Homo sapiens
ccagctctgattttgacctcca

SEQ ID NO: 7459076 - DNA, 22 bp, Homo sapiens
ccagctgcccaagaggcatcct

SEQ ID NO: 7459077 - DNA, 22 bp, Homo sapiens
ccagctgcccaagaggcatcct

SEQ ID NO: 7459078 - DNA, 22 bp, Homo sapiens
ccagctgcccaagaggcatcct

SEQ ID NO: 7459079 - DNA, 22 bp, Homo sapiens
ccagctgcatcctattcactgc

SEQ ID NO: 7459080 - DNA, 22 bp, Homo sapiens
ccagctgcccaagaggcatcct

SEQ ID NO: 7459081 - DNA, 22 bp, Homo sapiens
ccagctgcccaagaggcatcct

SEQ ID NO: 7459082 - DNA, 22 bp, Homo sapiens
ccagctgcccaagaggcatcct

SEQ ID NO: 7459083 - DNA, 22 bp, Homo sapiens
ccagctgcctaagcaatccata

SEQ ID NO: 7459084 - DNA, 22 bp, Homo sapiens
ccagctgcccactatgtgttct

SEQ ID NO: 7459085 - DNA, 22 bp, Homo sapiens
ccagctgcctaagcaatccata

SEQ ID NO: 7459086 - DNA, 22 bp, Homo sapiens
ccagctgcccactatgtgttct

SEQ ID NO: 7459087 - DNA, 22 bp, Homo sapiens
ccagctgcccactatgtgttct

SEQ ID NO: 7459088 - DNA, 22 bp, Homo sapiens
ccagctgcccactatgtgttct

SEQ ID NO: 7459089 - DNA, 22 bp, Homo sapiens
ccagctgcccaagaggcatcct

SEQ ID NO: 7459090 - DNA, 21 bp, Homo sapiens
ccagctgcctgcactttggac

SEQ ID NO: 7459091 - DNA, 21 bp, Homo sapiens
ccagctgcctgcactttggac

SEQ ID NO: 7459092 - DNA, 18 bp, Homo sapiens
ccagctgcgctgaaccga

SEQ ID NO: 7459093 - DNA, 21 bp, Homo sapiens
ccagctgcctgcactttggac

SEQ ID NO: 7459094 - DNA, 18 bp, Homo sapiens
ccagctgcgctgaaccga

SEQ ID NO: 7459095 - DNA, 18 bp, Homo sapiens
ccagctgcgctgaaccga

SEQ ID NO: 7459096 - DNA, 21 bp, Homo sapiens
ccagctgcctgcactttggac

SEQ ID NO: 7459097 - DNA, 22 bp, Homo sapiens
ccagctgcctaagcaatccata

SEQ ID NO: 7459098 - DNA, 18 bp, Homo sapiens
ccagctgcgctgaaccga

SEQ ID NO: 7459099 - DNA, 18 bp, Homo sapiens
ccagctgcgctgaaccga

SEQ ID NO: 7459100 - DNA, 18 bp, Homo sapiens
ccagctgcgctgaaccga

SEQ ID NO: 7459101 - DNA, 22 bp, Homo sapiens
ccagctgcgggcatcgagagtt

SEQ ID NO: 7459102 - DNA, 22 bp, Homo sapiens
ccagctgcgggcatcgagagtt

SEQ ID NO: 7459103 - DNA, 22 bp, Homo sapiens
ccagctgcgggcatcgagagtt

SEQ ID NO: 7459104 - DNA, 22 bp, Homo sapiens
ccagctgcgggcatcgagagtt

SEQ ID NO: 7459105 - DNA, 22 bp, Homo sapiens
ccagctgcgggcatcgagagtt

SEQ ID NO: 7459106 - DNA, 22 bp, Homo sapiens
ccagctgcgggcatcgagagtt

SEQ ID NO: 7459107 - DNA, 22 bp, Homo sapiens
ccagctgcggtctcccaaagtt

SEQ ID NO: 7459108 - DNA, 22 bp, Homo sapiens
ccagctgcggtctcccaaagtt

SEQ ID NO: 7459109 - DNA, 22 bp, Homo sapiens
ccagctgcgggcatcgagagtt

SEQ ID NO: 7459110 - DNA, 22 bp, Homo sapiens
ccagctgctaacacaaaggagt

SEQ ID NO: 7459111 - DNA, 22 bp, Homo sapiens
ccagctgcggtctcccaaagtt

SEQ ID NO: 7459112 - DNA, 22 bp, Homo sapiens
ccagctgcggtctcccaaagtt

SEQ ID NO: 7459113 - DNA, 22 bp, Homo sapiens
ccagctgctatcatgccatttc

SEQ ID NO: 7459114 - DNA, 22 bp, Homo sapiens
ccagctgctaacacaaaggagt

SEQ ID NO: 7459115 - DNA, 21 bp, Homo sapiens
ccagctgctccttgaggttcc

SEQ ID NO: 7459116 - DNA, 17 bp, Homo sapiens
ccagctgctccctcaga

SEQ ID NO: 7459117 - DNA, 21 bp, Homo sapiens
ccagctgctccttgaggttcc

SEQ ID NO: 7459118 - DNA, 21 bp, Homo sapiens
ccagctgctccttgaggttcc

SEQ ID NO: 7459119 - DNA, 21 bp, Homo sapiens
ccagctgctccttgaggttcc

SEQ ID NO: 7459120 - DNA, 17 bp, Homo sapiens
ccagctgctccctcaga

SEQ ID NO: 7459121 - DNA, 17 bp, Homo sapiens
ccagctgctccctcaga

SEQ ID NO: 7459122 - DNA, 17 bp, Homo sapiens
ccagctgctccctcaga

SEQ ID NO: 7459123 - DNA, 17 bp, Homo sapiens
ccagctgctccctcaga

SEQ ID NO: 7459124 - DNA, 22 bp, Homo sapiens
ccagctgctatcatgccatttc

SEQ ID NO: 7459125 - DNA, 22 bp, Homo sapiens
ccagctgctatcatgccatttc

SEQ ID NO: 7459126 - DNA, 22 bp, Homo sapiens
ccagctgctatcatgccatttc

SEQ ID NO: 7459127 - DNA, 22 bp, Homo sapiens
ccagctgctatcatgccatttc

SEQ ID NO: 7459128 - DNA, 22 bp, Homo sapiens
ccagctgctgacatgggcaggt

SEQ ID NO: 7459129 - DNA, 22 bp, Homo sapiens
ccagctgctgacatgggcaggt

SEQ ID NO: 7459130 - DNA, 22 bp, Homo sapiens
ccagctgctgacatgggcaggt

SEQ ID NO: 7459131 - DNA, 22 bp, Homo sapiens
ccagctgctgacatgggcaggt

SEQ ID NO: 7459132 - DNA, 22 bp, Homo sapiens
ccagctgctgcaccgtgcatgg

SEQ ID NO: 7459133 - DNA, 22 bp, Homo sapiens
ccagctgctgacatgggcaggt

SEQ ID NO: 7459134 - DNA, 22 bp, Homo sapiens
ccagctgctgacatgggcaggt

SEQ ID NO: 7459135 - DNA, 22 bp, Homo sapiens
ccagctgctgacatgggcaggt

SEQ ID NO: 7459136 - DNA, 22 bp, Homo sapiens
ccagctgctctcttctccgcca

SEQ ID NO: 7459137 - DNA, 22 bp, Homo sapiens
ccagctgctctcttctccgcca

SEQ ID NO: 7459138 - DNA, 22 bp, Homo sapiens
ccagctgctctcttctccgcca

SEQ ID NO: 7459139 - DNA, 22 bp, Homo sapiens
ccagctgctctcttctccgcca

SEQ ID NO: 7459140 - DNA, 22 bp, Homo sapiens
ccagctgctgacatgggcaggt

SEQ ID NO: 7459141 - DNA, 22 bp, Homo sapiens
ccagctgctctcttctccgcca

SEQ ID NO: 7459142 - DNA, 22 bp, Homo sapiens
ccagctgctgtgaggaccacag

SEQ ID NO: 7459143 - DNA, 22 bp, Homo sapiens
ccagctgctgtgaggaccacag

SEQ ID NO: 7459144 - DNA, 22 bp, Homo sapiens
ccagctgctgtgaggaccacag

SEQ ID NO: 7459145 - DNA, 22 bp, Homo sapiens
ccagctgctgcaccgtgcatgg

SEQ ID NO: 7459146 - DNA, 22 bp, Homo sapiens
ccagctgctgcaccgtgcatgg

SEQ ID NO: 7459147 - DNA, 22 bp, Homo sapiens
ccagctgctgtgaggaccacag

SEQ ID NO: 7459148 - DNA, 22 bp, Homo sapiens
ccagctgctgcaccgtgcatgg

SEQ ID NO: 7459149 - DNA, 22 bp, Homo sapiens
ccagctgctgtgaggaccacag

SEQ ID NO: 7459150 - DNA, 22 bp, Homo sapiens
ccagctgctgtgcagggaggct

SEQ ID NO: 7459151 - DNA, 22 bp, Homo sapiens
ccagctgctgtgcagggaggct

SEQ ID NO: 7459152 - DNA, 22 bp, Homo sapiens
ccagctgctgtgcagggaggct

SEQ ID NO: 7459153 - DNA, 22 bp, Homo sapiens
ccagctgctgtgcagggaggct

SEQ ID NO: 7459154 - DNA, 22 bp, Homo sapiens
ccagctgctgtgcagggaggct

SEQ ID NO: 7459155 - DNA, 22 bp, Homo sapiens
ccagctgcttgggaaaatgtct

SEQ ID NO: 7459156 - DNA, 22 bp, Homo sapiens
ccagctgcttgggaaaatgtct

SEQ ID NO: 7459157 - DNA, 22 bp, Homo sapiens
tctggaggccatagggaaggat

SEQ ID NO: 7459158 - DNA, 22 bp, Homo sapiens
tctggaggccatagggaaggat

SEQ ID NO: 7459159 - DNA, 22 bp, Homo sapiens
tctggaggcaggctgccaggat

SEQ ID NO: 7459160 - DNA, 22 bp, Homo sapiens
tctggaggccatagggaaggat

SEQ ID NO: 7459161 - DNA, 22 bp, Homo sapiens
tctggaggccatagggaaggat

SEQ ID NO: 7459162 - DNA, 22 bp, Homo sapiens
tctggaggccatagggaaggat

SEQ ID NO: 7459163 - DNA, 22 bp, Homo sapiens
tctggaggccatagggaaggat

SEQ ID NO: 7459164 - DNA, 22 bp, Homo sapiens
tctggcagcagcatcagtggct

SEQ ID NO: 7459165 - DNA, 22 bp, Homo sapiens
tctggcagcagcatcagtggct

SEQ ID NO: 7459166 - DNA, 22 bp, Homo sapiens
tctggcagcagcatcagtggct

SEQ ID NO: 7459167 - DNA, 22 bp, Homo sapiens
tctggcagcagcatcagtggct

SEQ ID NO: 7459168 - DNA, 22 bp, Homo sapiens
tctggccctgctgctgtgagca

SEQ ID NO: 7459169 - DNA, 22 bp, Homo sapiens
tctggcagggtcagggcccagg

SEQ ID NO: 7459170 - DNA, 22 bp, Homo sapiens
tctggcaggggttctgcacttg

SEQ ID NO: 7459171 - DNA, 22 bp, Homo sapiens
tctggcaggggttctgcacttg

SEQ ID NO: 7459172 - DNA, 22 bp, Homo sapiens
tctggcaggggttctgcacttg

SEQ ID NO: 7459173 - DNA, 22 bp, Homo sapiens
tctggcctatttctgtcagatc

SEQ ID NO: 7459174 - DNA, 22 bp, Homo sapiens
tctggcctactggagtccatga

SEQ ID NO: 7459175 - DNA, 22 bp, Homo sapiens
tctggcctatttctgtcagatc

SEQ ID NO: 7459176 - DNA, 22 bp, Homo sapiens
tctggcctatttctgtcagatc

SEQ ID NO: 7459177 - DNA, 22 bp, Homo sapiens
tctggcctactggagtccatga

SEQ ID NO: 7459178 - DNA, 22 bp, Homo sapiens
tctggcctactggagtccatga

SEQ ID NO: 7459179 - DNA, 22 bp, Homo sapiens
tctggcctactggagtccatga

SEQ ID NO: 7459180 - DNA, 22 bp, Homo sapiens
tctggcctgggcctgccggtgc

SEQ ID NO: 7459181 - DNA, 22 bp, Homo sapiens
tctggcctgaaagtccatgctt

SEQ ID NO: 7459182 - DNA, 22 bp, Homo sapiens
tctggcctgaaagtccatgctt

SEQ ID NO: 7459183 - DNA, 22 bp, Homo sapiens
tctggcctgggcctgccggtgc

SEQ ID NO: 7459184 - DNA, 22 bp, Homo sapiens
tctggcctgggcctgccggtgc

SEQ ID NO: 7459185 - DNA, 22 bp, Homo sapiens
tctggcctgtgttggtggcccc

SEQ ID NO: 7459186 - DNA, 22 bp, Homo sapiens
tctggcctgtgttggtggcccc

SEQ ID NO: 7459187 - DNA, 22 bp, Homo sapiens
tctggccttatctgtccaagcc

SEQ ID NO: 7459188 - DNA, 22 bp, Homo sapiens
tctggccttatctgtccaagcc

SEQ ID NO: 7459189 - DNA, 22 bp, Homo sapiens
tctggcctcctccaccagggaa

SEQ ID NO: 7459190 - DNA, 22 bp, Homo sapiens
tctggcctcctccaccagggaa

SEQ ID NO: 7459191 - DNA, 22 bp, Homo sapiens
tctggcctcctccaccagggaa

SEQ ID NO: 7459192 - DNA, 22 bp, Homo sapiens
tctggcctcttgggatgctccc

SEQ ID NO: 7459193 - DNA, 22 bp, Homo sapiens
tctggcctcttgggatgctccc

SEQ ID NO: 7459194 - DNA, 22 bp, Homo sapiens
tctggcctcttgggatgctccc

SEQ ID NO: 7459195 - DNA, 22 bp, Homo sapiens
tctggcctgaaagtccatgctt

SEQ ID NO: 7459196 - DNA, 22 bp, Homo sapiens
tctggcctgaaagtccatgctt

SEQ ID NO: 7459197 - DNA, 22 bp, Homo sapiens
tctggcctgaaagtccatgctt

SEQ ID NO: 7459198 - DNA, 22 bp, Homo sapiens
tctggcaggcaatcggctctgg

SEQ ID NO: 7459199 - DNA, 21 bp, Homo sapiens
tctggcaggcacgggcccagc

SEQ ID NO: 7459200 - DNA, 22 bp, Homo sapiens
tctggcaggccttgtcaatctg

SEQ ID NO: 7459201 - DNA, 22 bp, Homo sapiens
tctggcaggccttgtcaatctg

SEQ ID NO: 7459202 - DNA, 22 bp, Homo sapiens
tctggcaggacatgctgaccat

SEQ ID NO: 7459203 - DNA, 22 bp, Homo sapiens
tctggcaggaccatgaagcgta

SEQ ID NO: 7459204 - DNA, 22 bp, Homo sapiens
tctggcaggaccatgaagcgta

SEQ ID NO: 7459205 - DNA, 22 bp, Homo sapiens
tctggcaggatatcgaagtgaa

SEQ ID NO: 7459206 - DNA, 22 bp, Homo sapiens
tctggcaggatatcgaagtgaa

SEQ ID NO: 7459207 - DNA, 22 bp, Homo sapiens
tctggcaggatatcgaagtgaa

SEQ ID NO: 7459208 - DNA, 21 bp, Homo sapiens
tctggcagcagtttgttgagt

SEQ ID NO: 7459209 - DNA, 22 bp, Homo sapiens
tctggcagcgaagcgtgtactt

SEQ ID NO: 7459210 - DNA, 22 bp, Homo sapiens
tctggcagctatcctctggcca

SEQ ID NO: 7459211 - DNA, 22 bp, Homo sapiens
tctggcagctatcctctggcca

SEQ ID NO: 7459212 - DNA, 21 bp, Homo sapiens
tctggcaggaagacggatggg

SEQ ID NO: 7459213 - DNA, 21 bp, Homo sapiens
tctggcaggaagacggatggg

SEQ ID NO: 7459214 - DNA, 22 bp, Homo sapiens
tctggcaggacatgctgaccat

SEQ ID NO: 7459215 - DNA, 22 bp, Homo sapiens
tctggcagctcagttcaggtct

SEQ ID NO: 7459216 - DNA, 22 bp, Homo sapiens
tctggcagctctcctcggcgga

SEQ ID NO: 7459217 - DNA, 22 bp, Homo sapiens
ccaggaccctgcaaaccctgtt

SEQ ID NO: 7459218 - DNA, 22 bp, Homo sapiens
ccaggaccctgcaaaccctgtt

SEQ ID NO: 7459219 - DNA, 22 bp, Homo sapiens
ccaggacctggagctctatgaa

SEQ ID NO: 7459220 - DNA, 22 bp, Homo sapiens
ccaggacctggagctctatgaa

SEQ ID NO: 7459221 - DNA, 22 bp, Homo sapiens
ccaggacctggagctctatgaa

SEQ ID NO: 7459222 - DNA, 22 bp, Homo sapiens
ccaggacctggagctctatgaa

SEQ ID NO: 7459223 - DNA, 22 bp, Homo sapiens
ccaggactcaatgaccacaggg

SEQ ID NO: 7459224 - DNA, 19 bp, Homo sapiens
ccaggacctttccagggtc

SEQ ID NO: 7459225 - DNA, 19 bp, Homo sapiens
ccaggacctttccagggtc

SEQ ID NO: 7459226 - DNA, 19 bp, Homo sapiens
ccaggacctttccagggtc

SEQ ID NO: 7459227 - DNA, 22 bp, Homo sapiens
ccaggacatgttgcaagtttat

SEQ ID NO: 7459228 - DNA, 22 bp, Homo sapiens
ccaggaccctgcaaaccctgtt

SEQ ID NO: 7459229 - DNA, 22 bp, Homo sapiens
ccaggaccacacgacaggagag

SEQ ID NO: 7459230 - DNA, 22 bp, Homo sapiens
ccaggacatgttgcaagtttat

SEQ ID NO: 7459231 - DNA, 22 bp, Homo sapiens
ccaggaccacacgacaggagag

SEQ ID NO: 7459232 - DNA, 22 bp, Homo sapiens
ccaggacatgttgcaagtttat

SEQ ID NO: 7459233 - DNA, 22 bp, Homo sapiens
ccaggacagtgaacatgtaaga

SEQ ID NO: 7459234 - DNA, 22 bp, Homo sapiens
ccaggacagtgaacatgtaaga

SEQ ID NO: 7459235 - DNA, 22 bp, Homo sapiens
ccaggacagtgaacatgtaaga

SEQ ID NO: 7459236 - DNA, 22 bp, Homo sapiens
ccaggacagtgaacatgtaaga

SEQ ID NO: 7459237 - DNA, 22 bp, Homo sapiens
ccaggacagtgaacatgtaaga

SEQ ID NO: 7459238 - DNA, 22 bp, Homo sapiens
ccaggacagggagacgggagcc

SEQ ID NO: 7459239 - DNA, 22 bp, Homo sapiens
ccaggacagggagacgggagcc

SEQ ID NO: 7459240 - DNA, 22 bp, Homo sapiens
ccaggacagggagacgggagcc

SEQ ID NO: 7459241 - DNA, 22 bp, Homo sapiens
ccaggacagggagacgggagcc

SEQ ID NO: 7459242 - DNA, 22 bp, Homo sapiens
ccaggacagggagacgggagcc

SEQ ID NO: 7459243 - DNA, 18 bp, Homo sapiens
ccaggacaggcaaaaggt

SEQ ID NO: 7459244 - DNA, 18 bp, Homo sapiens
ccaggacaggcaaaaggt

SEQ ID NO: 7459245 - DNA, 22 bp, Homo sapiens
ccaggacactgcttcacagcag

SEQ ID NO: 7459246 - DNA, 22 bp, Homo sapiens
ccaggacaggagttggcttcgc

SEQ ID NO: 7459247 - DNA, 22 bp, Homo sapiens
ccaggacaggagttggcttcgc

SEQ ID NO: 7459248 - DNA, 22 bp, Homo sapiens
ccaggacaggagttggcttcgc

SEQ ID NO: 7459249 - DNA, 22 bp, Homo sapiens
ccaggacactgcttcacagcag

SEQ ID NO: 7459250 - DNA, 22 bp, Homo sapiens
ccaggacactgcttcacagcag

SEQ ID NO: 7459251 - DNA, 18 bp, Homo sapiens
ccaggacaggcaaaaggt

SEQ ID NO: 7459252 - DNA, 18 bp, Homo sapiens
ccaggacaggcaaaaggt

SEQ ID NO: 7459253 - DNA, 18 bp, Homo sapiens
ccaggacaggcaaaaggt

SEQ ID NO: 7459254 - DNA, 22 bp, Homo sapiens
ccaggacaggagttggcttcgc

SEQ ID NO: 7459255 - DNA, 22 bp, Homo sapiens
ccaggacaggagttggcttcgc

SEQ ID NO: 7459256 - DNA, 22 bp, Homo sapiens
tctggctcaaaatacgtactct

SEQ ID NO: 7459257 - DNA, 22 bp, Homo sapiens
tctggctcacttcaggcttcac

SEQ ID NO: 7459258 - DNA, 22 bp, Homo sapiens
tctggctcacttcaggcttcac

SEQ ID NO: 7459259 - DNA, 22 bp, Homo sapiens
tctggctcacttcaggcttcac

SEQ ID NO: 7459260 - DNA, 22 bp, Homo sapiens
tctggctcacttcaggcttcac

SEQ ID NO: 7459261 - DNA, 22 bp, Homo sapiens
tctggctatatgctggcttcca

SEQ ID NO: 7459262 - DNA, 22 bp, Homo sapiens
tctggctaacattttgtggaga

SEQ ID NO: 7459263 - DNA, 17 bp, Homo sapiens
tctggccttcctgaact

SEQ ID NO: 7459264 - DNA, 22 bp, Homo sapiens
tctggctcacttcaggcttcac

SEQ ID NO: 7459265 - DNA, 22 bp, Homo sapiens
tctggctcagggctctgaggga

SEQ ID NO: 7459266 - DNA, 22 bp, Homo sapiens
tctggctcagggctctgaggga

SEQ ID NO: 7459267 - DNA, 22 bp, Homo sapiens
tctggctcaggtcagacaggga

SEQ ID NO: 7459268 - DNA, 22 bp, Homo sapiens
tctggctcaggtcagacaggga

SEQ ID NO: 7459269 - DNA, 22 bp, Homo sapiens
tctggctcaggtcagacaggga

SEQ ID NO: 7459270 - DNA, 22 bp, Homo sapiens
tctggctcaggtcagacaggga

SEQ ID NO: 7459271 - DNA, 22 bp, Homo sapiens
tctggctcaggtcagacaggga

SEQ ID NO: 7459272 - DNA, 21 bp, Homo sapiens
ccaggaaggactgagctccct

SEQ ID NO: 7459273 - DNA, 21 bp, Homo sapiens
ccaggaaggactgagctccct

SEQ ID NO: 7459274 - DNA, 21 bp, Homo sapiens
ccaggaaggactgagctccct

SEQ ID NO: 7459275 - DNA, 22 bp, Homo sapiens
ccaggaaggatcgtttgggagt

SEQ ID NO: 7459276 - DNA, 22 bp, Homo sapiens
ccaggaaggatcgtttgggagt

SEQ ID NO: 7459277 - DNA, 22 bp, Homo sapiens
ccaggaaggatcgtttgggagt

SEQ ID NO: 7459278 - DNA, 21 bp, Homo sapiens
ccaggaaggactgagctccct

SEQ ID NO: 7459279 - DNA, 22 bp, Homo sapiens
ccaggaaggatcgtttgggagt

SEQ ID NO: 7459280 - DNA, 22 bp, Homo sapiens
ccaggacacgatttttagtctg

SEQ ID NO: 7459281 - DNA, 22 bp, Homo sapiens
ccaggacacgatttttagtctg

SEQ ID NO: 7459282 - DNA, 22 bp, Homo sapiens
ccaggacacgatttttagtctg

SEQ ID NO: 7459283 - DNA, 22 bp, Homo sapiens
ccaggacacgatttttagtctg

SEQ ID NO: 7459284 - DNA, 22 bp, Homo sapiens
ccaggacactgcttcacagcag

SEQ ID NO: 7459285 - DNA, 22 bp, Homo sapiens
ccaggacactgcttcacagcag

SEQ ID NO: 7459286 - DNA, 22 bp, Homo sapiens
ccaggacactgcttcacagcag

SEQ ID NO: 7459287 - DNA, 22 bp, Homo sapiens
ccaggacactgcttcacagcag

SEQ ID NO: 7459288 - DNA, 22 bp, Homo sapiens
ccaggacactgcttcacagcag

SEQ ID NO: 7459289 - DNA, 22 bp, Homo sapiens
ccaggacttattacagtataac

SEQ ID NO: 7459290 - DNA, 22 bp, Homo sapiens
ccaggacttattacagtataac

SEQ ID NO: 7459291 - DNA, 20 bp, Homo sapiens
ccaggactgctggggactct

SEQ ID NO: 7459292 - DNA, 20 bp, Homo sapiens
ccaggactgctggggactct

SEQ ID NO: 7459293 - DNA, 22 bp, Homo sapiens
ccaggactgcagggggcgagga

SEQ ID NO: 7459294 - DNA, 20 bp, Homo sapiens
ccaggactgctggggactct

SEQ ID NO: 7459295 - DNA, 20 bp, Homo sapiens
ccaggactgctggggactct

SEQ ID NO: 7459296 - DNA, 22 bp, Homo sapiens
tctggttagccaataatgccaa

SEQ ID NO: 7459297 - DNA, 19 bp, Homo sapiens
tctggttcatttctgctgt

SEQ ID NO: 7459298 - DNA, 22 bp, Homo sapiens
tctggtttcaatgggtacgatt

SEQ ID NO: 7459299 - DNA, 22 bp, Homo sapiens
ccaggacttcgaggctacagtg

SEQ ID NO: 7459300 - DNA, 22 bp, Homo sapiens
ccaggacttcgaggctacagtg

SEQ ID NO: 7459301 - DNA, 22 bp, Homo sapiens
ccaggacttcgaggctacagtg

SEQ ID NO: 7459302 - DNA, 19 bp, Homo sapiens
ccaggactttgcagacact

SEQ ID NO: 7459303 - DNA, 19 bp, Homo sapiens
ccaggactttgcagacact

SEQ ID NO: 7459304 - DNA, 22 bp, Homo sapiens
ccaggactttaagtccagcact

SEQ ID NO: 7459305 - DNA, 22 bp, Homo sapiens
ccaggactttaagtccagcact

SEQ ID NO: 7459306 - DNA, 22 bp, Homo sapiens
ccaggagaagcatctgagtgta

SEQ ID NO: 7459307 - DNA, 22 bp, Homo sapiens
ccaggagaagcatctgagtgta

SEQ ID NO: 7459308 - DNA, 22 bp, Homo sapiens
ccaggagaagcatctgagtgta

SEQ ID NO: 7459309 - DNA, 22 bp, Homo sapiens
ccaggagaagcatctgagtgta

SEQ ID NO: 7459310 - DNA, 22 bp, Homo sapiens
ccaggagaagcatctgagtgta

SEQ ID NO: 7459311 - DNA, 22 bp, Homo sapiens
ccaggagaagcatctgagtgta

SEQ ID NO: 7459312 - DNA, 22 bp, Homo sapiens
ccaggagaagcatctgagtgta

SEQ ID NO: 7459313 - DNA, 22 bp, Homo sapiens
ccaggagaagcatctgagtgta

SEQ ID NO: 7459314 - DNA, 22 bp, Homo sapiens
ccaggagaagcatctgagtgta

SEQ ID NO: 7459315 - DNA, 22 bp, Homo sapiens
ccaggagaagcatctgagtgta

SEQ ID NO: 7459316 - DNA, 22 bp, Homo sapiens
ccaggagaagcatctgagtgta

SEQ ID NO: 7459317 - DNA, 22 bp, Homo sapiens
ccaggagaagcatctgagtgta

SEQ ID NO: 7459318 - DNA, 22 bp, Homo sapiens
ccaggagaataatggcagatta

SEQ ID NO: 7459319 - DNA, 22 bp, Homo sapiens
ccaggagaataatggcagatta

SEQ ID NO: 7459320 - DNA, 22 bp, Homo sapiens
ccaggagaataatggcagatta

SEQ ID NO: 7459321 - DNA, 22 bp, Homo sapiens
ccaggagaataatggcagatta

SEQ ID NO: 7459322 - DNA, 22 bp, Homo sapiens
ccaggagaataatggcagatta

SEQ ID NO: 7459323 - DNA, 22 bp, Homo sapiens
ccaggagaataatggcagatta

SEQ ID NO: 7459324 - DNA, 22 bp, Homo sapiens
ccaggagaataatggcagatta

SEQ ID NO: 7459325 - DNA, 22 bp, Homo sapiens
ccaggagaataatggcagatta

SEQ ID NO: 7459326 - DNA, 22 bp, Homo sapiens
ccaggagaataatggcagatta

SEQ ID NO: 7459327 - DNA, 22 bp, Homo sapiens
ccaggagaataatggcagatta

SEQ ID NO: 7459328 - DNA, 19 bp, Homo sapiens
tctggttcatttctgctgt

SEQ ID NO: 7459329 - DNA, 22 bp, Homo sapiens
tctggtgtcagtattctttgaa

SEQ ID NO: 7459330 - DNA, 22 bp, Homo sapiens
tctggtgtcagtattctttgaa

SEQ ID NO: 7459331 - DNA, 22 bp, Homo sapiens
tctggtgtcagtattctttgaa

SEQ ID NO: 7459332 - DNA, 22 bp, Homo sapiens
tctggtgtcagtattctttgaa

SEQ ID NO: 7459333 - DNA, 22 bp, Homo sapiens
tctggtggtgggccacaagcat

SEQ ID NO: 7459334 - DNA, 22 bp, Homo sapiens
tctggtggtgggccacaagcat

SEQ ID NO: 7459335 - DNA, 22 bp, Homo sapiens
tctggtgtcaggctgtcctcgg

SEQ ID NO: 7459336 - DNA, 22 bp, Homo sapiens
tctggtcctgaagtcaacttca

SEQ ID NO: 7459337 - DNA, 22 bp, Homo sapiens
tctggtctccaggagtggtggt

SEQ ID NO: 7459338 - DNA, 21 bp, Homo sapiens
tctggtctgctgtggacctgg

SEQ ID NO: 7459339 - DNA, 21 bp, Homo sapiens
tctggtctgctgtggacctgg

SEQ ID NO: 7459340 - DNA, 22 bp, Homo sapiens
tctggtggtatacatctaggag

SEQ ID NO: 7459341 - DNA, 22 bp, Homo sapiens
tctggtggcacgtgtcttgcat

SEQ ID NO: 7459342 - DNA, 21 bp, Homo sapiens
tctggtctgctgtggacctgg

SEQ ID NO: 7459343 - DNA, 22 bp, Homo sapiens
tctggtcccttttcctgcagtc

SEQ ID NO: 7459344 - DNA, 22 bp, Homo sapiens
tctggtcccttttcctgcagtc

SEQ ID NO: 7459345 - DNA, 22 bp, Homo sapiens
tctggtccctgctcacttcttg

SEQ ID NO: 7459346 - DNA, 22 bp, Homo sapiens
tctggtccctgtgtcacctctc

SEQ ID NO: 7459347 - DNA, 22 bp, Homo sapiens
tctggtccctgtgtcacctctc

SEQ ID NO: 7459348 - DNA, 22 bp, Homo sapiens
tctggtcccttttcctgcagtc

SEQ ID NO: 7459349 - DNA, 22 bp, Homo sapiens
tctggtccccattccaggtggg

SEQ ID NO: 7459350 - DNA, 22 bp, Homo sapiens
tctggtccccattccaggtggg

SEQ ID NO: 7459351 - DNA, 22 bp, Homo sapiens
tctggtcatcggaaagatcaaa

SEQ ID NO: 7459352 - DNA, 22 bp, Homo sapiens
ccaggactgcagggggcgagga

SEQ ID NO: 7459353 - DNA, 22 bp, Homo sapiens
ccaggactgcagggggcgagga

SEQ ID NO: 7459354 - DNA, 22 bp, Homo sapiens
ccaggactgcagggggcgagga

SEQ ID NO: 7459355 - DNA, 21 bp, Homo sapiens
ccaggactccatggggtctct

SEQ ID NO: 7459356 - DNA, 22 bp, Homo sapiens
tctgggagagtcacaggcattg

SEQ ID NO: 7459357 - DNA, 22 bp, Homo sapiens
tctgggagatccaagcagaact

SEQ ID NO: 7459358 - DNA, 19 bp, Homo sapiens
tctgggagagtgaatctga

SEQ ID NO: 7459359 - DNA, 19 bp, Homo sapiens
tctgggagagtgaatctga

SEQ ID NO: 7459360 - DNA, 19 bp, Homo sapiens
tctgggagagtgaatctga

SEQ ID NO: 7459361 - DNA, 21 bp, Homo sapiens
ccaggactccatggggtctct

SEQ ID NO: 7459362 - DNA, 22 bp, Homo sapiens
ccaggactcagtggggaaaggg

SEQ ID NO: 7459363 - DNA, 22 bp, Homo sapiens
ccaggactcagtggggaaaggg

SEQ ID NO: 7459364 - DNA, 22 bp, Homo sapiens
ccaggactcaattaacctcact

SEQ ID NO: 7459365 - DNA, 19 bp, Homo sapiens
ccaggacctttccagggtc

SEQ ID NO: 7459366 - DNA, 22 bp, Homo sapiens
ccaggactcaatgaccacaggg

SEQ ID NO: 7459367 - DNA, 22 bp, Homo sapiens
ccaggactcaatgaccacaggg

SEQ ID NO: 7459368 - DNA, 22 bp, Homo sapiens
tctgggagcagatgatggtata

SEQ ID NO: 7459369 - DNA, 22 bp, Homo sapiens
tctgggagcagatgatggtata

SEQ ID NO: 7459370 - DNA, 22 bp, Homo sapiens
tctgggagcagatgatggtata

SEQ ID NO: 7459371 - DNA, 22 bp, Homo sapiens
tctgggagcagatgatggtata

SEQ ID NO: 7459372 - DNA, 22 bp, Homo sapiens
tctgggagcacacgcagtgatc

SEQ ID NO: 7459373 - DNA, 22 bp, Homo sapiens
tctgggagcacacgcagtgatc

SEQ ID NO: 7459374 - DNA, 22 bp, Homo sapiens
tctgggagcacacgcagtgatc

SEQ ID NO: 7459375 - DNA, 22 bp, Homo sapiens
tctgggagcacacgcagtgatc

SEQ ID NO: 7459376 - DNA, 22 bp, Homo sapiens
tctgggagatccaagcagaact

SEQ ID NO: 7459377 - DNA, 22 bp, Homo sapiens
tctgggagatccaagcagaact

SEQ ID NO: 7459378 - DNA, 19 bp, Homo sapiens
tctgggagagtgaatctga

SEQ ID NO: 7459379 - DNA, 22 bp, Homo sapiens
tctgggagatccaagcagaact

SEQ ID NO: 7459380 - DNA, 22 bp, Homo sapiens
tctgggagcacacgcagtgatc

SEQ ID NO: 7459381 - DNA, 22 bp, Homo sapiens
tctgggagatccaagcagaact

SEQ ID NO: 7459382 - DNA, 22 bp, Homo sapiens
tctgggagcacacgcagtgatc

SEQ ID NO: 7459383 - DNA, 22 bp, Homo sapiens
tctgggagcacacgcagtgatc

SEQ ID NO: 7459384 - DNA, 20 bp, Homo sapiens
tctggggatgaggtctagga

SEQ ID NO: 7459385 - DNA, 20 bp, Homo sapiens
tctggggatgaggtctagga

SEQ ID NO: 7459386 - DNA, 22 bp, Homo sapiens
tctggggatgaggtccagtgat

SEQ ID NO: 7459387 - DNA, 22 bp, Homo sapiens
tctggggatgaggtccagtgat

SEQ ID NO: 7459388 - DNA, 20 bp, Homo sapiens
tctggggatgaggtctagga

SEQ ID NO: 7459389 - DNA, 20 bp, Homo sapiens
tctggggatgaggtctagga

SEQ ID NO: 7459390 - DNA, 22 bp, Homo sapiens
tctggggatgaggtccagtgat

SEQ ID NO: 7459391 - DNA, 22 bp, Homo sapiens
tctggggatgaggtccagtgat

SEQ ID NO: 7459392 - DNA, 22 bp, Homo sapiens
tctgggagctggctttgcctca

SEQ ID NO: 7459393 - DNA, 22 bp, Homo sapiens
tctgggagctggctttgcctca

SEQ ID NO: 7459394 - DNA, 22 bp, Homo sapiens
tctgggtttgaagtagagccca

SEQ ID NO: 7459395 - DNA, 22 bp, Homo sapiens
tctggtaacctttatccctcct

SEQ ID NO: 7459396 - DNA, 22 bp, Homo sapiens
tctggtaataggcaatagcttg

SEQ ID NO: 7459397 - DNA, 22 bp, Homo sapiens
tctggtagaagaagtgaagctg

SEQ ID NO: 7459398 - DNA, 22 bp, Homo sapiens
tctggtagaagaagtgaagctg

SEQ ID NO: 7459399 - DNA, 22 bp, Homo sapiens
tctgggagccatgccttggagt

SEQ ID NO: 7459400 - DNA, 22 bp, Homo sapiens
tctgggagccatgccttggagt

SEQ ID NO: 7459401 - DNA, 22 bp, Homo sapiens
tctgggagcagctcagcagatt

SEQ ID NO: 7459402 - DNA, 22 bp, Homo sapiens
tctgggagcagctcagcagatt

SEQ ID NO: 7459403 - DNA, 22 bp, Homo sapiens
tctgggagcagctcagcagatt

SEQ ID NO: 7459404 - DNA, 22 bp, Homo sapiens
tctgggagcagctcagcagatt

SEQ ID NO: 7459405 - DNA, 22 bp, Homo sapiens
tctgggagcagctcagcagatt

SEQ ID NO: 7459406 - DNA, 22 bp, Homo sapiens
tctgggagcagctcagcagatt

SEQ ID NO: 7459407 - DNA, 22 bp, Homo sapiens
tctgggagcagctcagcagatt

SEQ ID NO: 7459408 - DNA, 22 bp, Homo sapiens
tctgggagcctgaaagtgaatg

SEQ ID NO: 7459409 - DNA, 22 bp, Homo sapiens
tctgggagcctgaaagtgaatg

SEQ ID NO: 7459410 - DNA, 22 bp, Homo sapiens
tctgggagcctgaaagtgaatg

SEQ ID NO: 7459411 - DNA, 22 bp, Homo sapiens
tctgggagccatgccttggagt

SEQ ID NO: 7459412 - DNA, 22 bp, Homo sapiens
tctgggagccatgccttggagt

SEQ ID NO: 7459413 - DNA, 22 bp, Homo sapiens
tctgggagcgctgtttttccca

SEQ ID NO: 7459414 - DNA, 22 bp, Homo sapiens
tctgggagcctgaaagtgaatg

SEQ ID NO: 7459415 - DNA, 22 bp, Homo sapiens
tctttggtcagaaagattacac

SEQ ID NO: 7459416 - DNA, 22 bp, Homo sapiens
tctttggtcagaaagattacac

SEQ ID NO: 7459417 - DNA, 22 bp, Homo sapiens
tctttggtcagaaagattacac

SEQ ID NO: 7459418 - DNA, 22 bp, Homo sapiens
tctttggtcatcatgggaagca

SEQ ID NO: 7459419 - DNA, 22 bp, Homo sapiens
tctttggtcatcatgggaagca

SEQ ID NO: 7459420 - DNA, 22 bp, Homo sapiens
tctttggtcatcatgggaagca

SEQ ID NO: 7459421 - DNA, 22 bp, Homo sapiens
tctttggtattcacttgtgaag

SEQ ID NO: 7459422 - DNA, 22 bp, Homo sapiens
tctttggtattcacttgtgaag

SEQ ID NO: 7459423 - DNA, 23 bp, Homo sapiens
tctttggtaaataaagtggggat

SEQ ID NO: 7459424 - DNA, 23 bp, Homo sapiens
tctttggtaaataaagtggggat

SEQ ID NO: 7459425 - DNA, 22 bp, Homo sapiens
tctttggtattcacttgtgaag

SEQ ID NO: 7459426 - DNA, 22 bp, Homo sapiens
tctttgggagaaggggtcccag

SEQ ID NO: 7459427 - DNA, 22 bp, Homo sapiens
tctttgggagatgttatttata

SEQ ID NO: 7459428 - DNA, 22 bp, Homo sapiens
tctttgggagaaggggtcccag

SEQ ID NO: 7459429 - DNA, 22 bp, Homo sapiens
tctttgggctaggagtttggat

SEQ ID NO: 7459430 - DNA, 22 bp, Homo sapiens
tctttgggctaggagtttggat

SEQ ID NO: 7459431 - DNA, 22 bp, Homo sapiens
tctttgggctaggagtttggat

SEQ ID NO: 7459432 - DNA, 22 bp, Homo sapiens
tctttgggccgacactcgtcaa

SEQ ID NO: 7459433 - DNA, 22 bp, Homo sapiens
tctttggggcatctgggagatt

SEQ ID NO: 7459434 - DNA, 22 bp, Homo sapiens
tctttggggcatctgggagatt

SEQ ID NO: 7459435 - DNA, 23 bp, Homo sapiens
tctttggtaaataaagtggggat

SEQ ID NO: 7459436 - DNA, 22 bp, Homo sapiens
tctttggccttaggagcccttg

SEQ ID NO: 7459437 - DNA, 22 bp, Homo sapiens
tctttggcatttaggagcagga

SEQ ID NO: 7459438 - DNA, 22 bp, Homo sapiens
tctttggctatgatttactgtt

SEQ ID NO: 7459439 - DNA, 22 bp, Homo sapiens
ccaggctgaatatgttccaggg

SEQ ID NO: 7459440 - DNA, 22 bp, Homo sapiens
ccaggctgagcatgattggagc

SEQ ID NO: 7459441 - DNA, 22 bp, Homo sapiens
ccaggctgagcatgattggagc

SEQ ID NO: 7459442 - DNA, 22 bp, Homo sapiens
ccaggctgagcatgattggagc

SEQ ID NO: 7459443 - DNA, 22 bp, Homo sapiens
ccaggctgagcatgattggagc

SEQ ID NO: 7459444 - DNA, 22 bp, Homo sapiens
ccaggctgagcatgattggagc

SEQ ID NO: 7459445 - DNA, 22 bp, Homo sapiens
tctttggcttgtctcctcagtt

SEQ ID NO: 7459446 - DNA, 22 bp, Homo sapiens
tctttggcttgtctcctcagtt

SEQ ID NO: 7459447 - DNA, 22 bp, Homo sapiens
tctttggcttgtctcctcagtt

SEQ ID NO: 7459448 - DNA, 22 bp, Homo sapiens
tctttggctttgccacacccaa

SEQ ID NO: 7459449 - DNA, 22 bp, Homo sapiens
tctttggctttgccacacccaa

SEQ ID NO: 7459450 - DNA, 22 bp, Homo sapiens
tctttggctgcctgaagcccaa

SEQ ID NO: 7459451 - DNA, 19 bp, Homo sapiens
tctttggcttctggatcag

SEQ ID NO: 7459452 - DNA, 19 bp, Homo sapiens
tctttggcttctggatcag

SEQ ID NO: 7459453 - DNA, 22 bp, Homo sapiens
ccaggctggagtgcaatggcgt

SEQ ID NO: 7459454 - DNA, 22 bp, Homo sapiens
ccaggctggagtgcaatggcgt

SEQ ID NO: 7459455 - DNA, 22 bp, Homo sapiens
ccaggctggagtgcaatggcgt

SEQ ID NO: 7459456 - DNA, 22 bp, Homo sapiens
ccaggctggagtgcaatggcat

SEQ ID NO: 7459457 - DNA, 22 bp, Homo sapiens
ccaggctggagtgcaatggcgt

SEQ ID NO: 7459458 - DNA, 22 bp, Homo sapiens
ccaggctggagtgcaatggcgt

SEQ ID NO: 7459459 - DNA, 22 bp, Homo sapiens
ccaggctggagtgcaatggcgt

SEQ ID NO: 7459460 - DNA, 22 bp, Homo sapiens
ccaggctggagtgcaatggcgt

SEQ ID NO: 7459461 - DNA, 22 bp, Homo sapiens
ccaggctggagtgcaatggcgt

SEQ ID NO: 7459462 - DNA, 22 bp, Homo sapiens
ccaggctggagtgcaatggcgt

SEQ ID NO: 7459463 - DNA, 22 bp, Homo sapiens
ccaggctggagtgcaatggtgc

SEQ ID NO: 7459464 - DNA, 22 bp, Homo sapiens
ccaggctggagtgcaatggtgc

SEQ ID NO: 7459465 - DNA, 22 bp, Homo sapiens
ccaggctggagtgcaatggtgc

SEQ ID NO: 7459466 - DNA, 22 bp, Homo sapiens
ccaggctggagtgcaatggtgc

SEQ ID NO: 7459467 - DNA, 22 bp, Homo sapiens
ccaggctggagtgcaatggtgc

SEQ ID NO: 7459468 - DNA, 22 bp, Homo sapiens
ccaggctggagtgcaatggcgt

SEQ ID NO: 7459469 - DNA, 22 bp, Homo sapiens
ccaggctggagtgcaatggcgt

SEQ ID NO: 7459470 - DNA, 22 bp, Homo sapiens
ccaggctggagtgcaatggcgt

SEQ ID NO: 7459471 - DNA, 22 bp, Homo sapiens
ccaggctgctgttggtgtccgc

SEQ ID NO: 7459472 - DNA, 22 bp, Homo sapiens
tctttggtgatatctctttggt

SEQ ID NO: 7459473 - DNA, 22 bp, Homo sapiens
ccaggctgctgttggtgtccgc

SEQ ID NO: 7459474 - DNA, 22 bp, Homo sapiens
ccaggctgctgttggtgtccgc

SEQ ID NO: 7459475 - DNA, 22 bp, Homo sapiens
ccaggctgctgttggtgtccgc

SEQ ID NO: 7459476 - DNA, 22 bp, Homo sapiens
tctttggtgaatggtcatccag

SEQ ID NO: 7459477 - DNA, 22 bp, Homo sapiens
tctttggtcatcatgggaagca

SEQ ID NO: 7459478 - DNA, 22 bp, Homo sapiens
tctttggtcatcatgggaagca

SEQ ID NO: 7459479 - DNA, 22 bp, Homo sapiens
tctttggtgaatggtcatccag

SEQ ID NO: 7459480 - DNA, 22 bp, Homo sapiens
tctttggtgatatctctttggt

SEQ ID NO: 7459481 - DNA, 22 bp, Homo sapiens
ccaggctggagtgcaatggcat

SEQ ID NO: 7459482 - DNA, 22 bp, Homo sapiens
ccaggctggagtgcaatggcat

SEQ ID NO: 7459483 - DNA, 22 bp, Homo sapiens
ccaggctgctgttggtgtccgc

SEQ ID NO: 7459484 - DNA, 22 bp, Homo sapiens
ccaggctgctgttggtgtccgc

SEQ ID NO: 7459485 - DNA, 22 bp, Homo sapiens
ccaggctgctgttggtgtccgc

SEQ ID NO: 7459486 - DNA, 22 bp, Homo sapiens
ccaggctgctgttggtgtccgc

SEQ ID NO: 7459487 - DNA, 22 bp, Homo sapiens
ccaggctggagtgcaatggcat

SEQ ID NO: 7459488 - DNA, 22 bp, Homo sapiens
ccaggctggagtgcaatggcat

SEQ ID NO: 7459489 - DNA, 22 bp, Homo sapiens
ccaggctctgtctggtcagaag

SEQ ID NO: 7459490 - DNA, 22 bp, Homo sapiens
ccaggctctgtctggtcagaag

SEQ ID NO: 7459491 - DNA, 22 bp, Homo sapiens
ccaggctctgtctggtcagaag

SEQ ID NO: 7459492 - DNA, 22 bp, Homo sapiens
ccaggctctgtgtgggctagag

SEQ ID NO: 7459493 - DNA, 22 bp, Homo sapiens
ccaggctctgtctggtcagaag

SEQ ID NO: 7459494 - DNA, 21 bp, Homo sapiens
ccaggctcctgaggctggtca

SEQ ID NO: 7459495 - DNA, 21 bp, Homo sapiens
ccaggctcctgaggctggtca

SEQ ID NO: 7459496 - DNA, 21 bp, Homo sapiens
ccaggctcctgaggctggtca

SEQ ID NO: 7459497 - DNA, 21 bp, Homo sapiens
ccaggctcctgaggctggtca

SEQ ID NO: 7459498 - DNA, 21 bp, Homo sapiens
ccaggctcctgaggctggtca

SEQ ID NO: 7459499 - DNA, 22 bp, Homo sapiens
ccaggcctggccaggggatgcc

SEQ ID NO: 7459500 - DNA, 22 bp, Homo sapiens
ccaggcctggccaggggatgcc

SEQ ID NO: 7459501 - DNA, 22 bp, Homo sapiens
ccaggcctggccaggggatgcc

SEQ ID NO: 7459502 - DNA, 22 bp, Homo sapiens
ccaggcctggaccatgccaggg

SEQ ID NO: 7459503 - DNA, 22 bp, Homo sapiens
ccaggcctggaccatgccaggg

SEQ ID NO: 7459504 - DNA, 22 bp, Homo sapiens
ccaggcctggacgggtggcctg

SEQ ID NO: 7459505 - DNA, 22 bp, Homo sapiens
ccaggcctggacgggtggcctg

SEQ ID NO: 7459506 - DNA, 22 bp, Homo sapiens
ccaggcctggacgggtggcctg

SEQ ID NO: 7459507 - DNA, 22 bp, Homo sapiens
ccaggcctggacgggtggcctg

SEQ ID NO: 7459508 - DNA, 22 bp, Homo sapiens
ccaggcctggccaggggatgcc

SEQ ID NO: 7459509 - DNA, 22 bp, Homo sapiens
ccaggcctggacgggtggcctg

SEQ ID NO: 7459510 - DNA, 22 bp, Homo sapiens
ccaggcctggccaggggatgcc

SEQ ID NO: 7459511 - DNA, 22 bp, Homo sapiens
ccaggcctggccaggggatgcc

SEQ ID NO: 7459512 - DNA, 22 bp, Homo sapiens
ccaggcctggacgggtggcctg

SEQ ID NO: 7459513 - DNA, 22 bp, Homo sapiens
ccaggcctggacgggtggcctg

SEQ ID NO: 7459514 - DNA, 22 bp, Homo sapiens
ccaggcctggacgggtggcctg

SEQ ID NO: 7459515 - DNA, 22 bp, Homo sapiens
ccaggcctggacgggtggcctg

SEQ ID NO: 7459516 - DNA, 22 bp, Homo sapiens
ccaggcctggacgggtggcctg

SEQ ID NO: 7459517 - DNA, 22 bp, Homo sapiens
ccaggctgaatatgttccaggg

SEQ ID NO: 7459518 - DNA, 22 bp, Homo sapiens
ccaggctgaatatgttccaggg

SEQ ID NO: 7459519 - DNA, 22 bp, Homo sapiens
ccaggctgaatatgttccaggg

SEQ ID NO: 7459520 - DNA, 22 bp, Homo sapiens
ccaggctgaatatgttccaggg

SEQ ID NO: 7459521 - DNA, 22 bp, Homo sapiens
ccaggctgaatatgttccaggg

SEQ ID NO: 7459522 - DNA, 22 bp, Homo sapiens
ccaggctgaatatgttccaggg

SEQ ID NO: 7459523 - DNA, 22 bp, Homo sapiens
ccaggctgaatatgttccaggg

SEQ ID NO: 7459524 - DNA, 23 bp, Homo sapiens
ccaggctctttcacctgctattc

SEQ ID NO: 7459525 - DNA, 23 bp, Homo sapiens
ccaggctctttcacctgctattc

SEQ ID NO: 7459526 - DNA, 23 bp, Homo sapiens
ccaggctctttcacctgctattc

SEQ ID NO: 7459527 - DNA, 22 bp, Homo sapiens
ccaggctgaatatgttccaggg

SEQ ID NO: 7459528 - DNA, 22 bp, Homo sapiens
ccaggctctgttccccgaggag

SEQ ID NO: 7459529 - DNA, 23 bp, Homo sapiens
ccaggctctttcacctgctattc

SEQ ID NO: 7459530 - DNA, 23 bp, Homo sapiens
ccaggctctttcacctgctattc

SEQ ID NO: 7459531 - DNA, 23 bp, Homo sapiens
ccaggctctttcacctgctattc

SEQ ID NO: 7459532 - DNA, 23 bp, Homo sapiens
ccaggctctttcacctgctattc

SEQ ID NO: 7459533 - DNA, 22 bp, Homo sapiens
ccaggctctgtgtgggctagag

SEQ ID NO: 7459534 - DNA, 22 bp, Homo sapiens
ccaggctctgtgtgggctagag

SEQ ID NO: 7459535 - DNA, 22 bp, Homo sapiens
ccaggctctgtgtgggctagag

SEQ ID NO: 7459536 - DNA, 22 bp, Homo sapiens
ccaggctctgtgtgggctagag

SEQ ID NO: 7459537 - DNA, 22 bp, Homo sapiens
ccaggctctgtctggtcagaag

SEQ ID NO: 7459538 - DNA, 22 bp, Homo sapiens
ccaggctctgtgtgggctagag

SEQ ID NO: 7459539 - DNA, 22 bp, Homo sapiens
ccaggctctgtgtgggctagag

SEQ ID NO: 7459540 - DNA, 22 bp, Homo sapiens
ccaggctctgtgtgggctagag

SEQ ID NO: 7459541 - DNA, 22 bp, Homo sapiens
ccaggctctgtgtgggctagag

SEQ ID NO: 7459542 - DNA, 22 bp, Homo sapiens
ccaggctctgtgtgggctagag

SEQ ID NO: 7459543 - DNA, 22 bp, Homo sapiens
ccaggctctgtgtgggctagag

SEQ ID NO: 7459544 - DNA, 22 bp, Homo sapiens
ccaggctctgttccccgaggag

SEQ ID NO: 7459545 - DNA, 22 bp, Homo sapiens
ccaggctctgttccccgaggag

SEQ ID NO: 7459546 - DNA, 22 bp, Homo sapiens
ccaggctctgttccccgaggag

SEQ ID NO: 7459547 - DNA, 22 bp, Homo sapiens
ccaggctctgttccccgaggag

SEQ ID NO: 7459548 - DNA, 22 bp, Homo sapiens
ccaggctctgttccccgaggag

SEQ ID NO: 7459549 - DNA, 22 bp, Homo sapiens
ccaggctctgttccccgaggag

SEQ ID NO: 7459550 - DNA, 22 bp, Homo sapiens
ccaggctctgttccccgaggag

SEQ ID NO: 7459551 - DNA, 22 bp, Homo sapiens
ccaggctctgttccccgaggag

SEQ ID NO: 7459552 - DNA, 22 bp, Homo sapiens
ccaggctctgtgtgggctagag

SEQ ID NO: 7459553 - DNA, 22 bp, Homo sapiens
ccaggctctgttccccgaggag

SEQ ID NO: 7459554 - DNA, 22 bp, Homo sapiens
tctttcttggtattctgagcta

SEQ ID NO: 7459555 - DNA, 22 bp, Homo sapiens
tctttcttgtgggtgccctttt

SEQ ID NO: 7459556 - DNA, 22 bp, Homo sapiens
tctttcttgtgggtgccctttt

SEQ ID NO: 7459557 - DNA, 22 bp, Homo sapiens
tctttcttggtattctgagcta

SEQ ID NO: 7459558 - DNA, 22 bp, Homo sapiens
tctttctttatcacctgatatg

SEQ ID NO: 7459559 - DNA, 22 bp, Homo sapiens
tctttctttatcacctgatatg

SEQ ID NO: 7459560 - DNA, 22 bp, Homo sapiens
tctttcttgtgggtgccctttt

SEQ ID NO: 7459561 - DNA, 22 bp, Homo sapiens
tctttctttatcacctgatatg

SEQ ID NO: 7459562 - DNA, 22 bp, Homo sapiens
tctttcttgtgggtgccctttt

SEQ ID NO: 7459563 - DNA, 22 bp, Homo sapiens
tctttcttgtgggtgccctttt

SEQ ID NO: 7459564 - DNA, 22 bp, Homo sapiens
tctttcttggtataaagcaggg

SEQ ID NO: 7459565 - DNA, 22 bp, Homo sapiens
tctttcttggtataaagcaggg

SEQ ID NO: 7459566 - DNA, 22 bp, Homo sapiens
tctttcttggtattctgagcta

SEQ ID NO: 7459567 - DNA, 22 bp, Homo sapiens
tctttcttggtattctgagcta

SEQ ID NO: 7459568 - DNA, 22 bp, Homo sapiens
tctttcttggtataaagcaggg

SEQ ID NO: 7459569 - DNA, 22 bp, Homo sapiens
tctttcttggtataaagcaggg

SEQ ID NO: 7459570 - DNA, 22 bp, Homo sapiens
tctttcttcagccctgtaagat

SEQ ID NO: 7459571 - DNA, 22 bp, Homo sapiens
tctttcttattatgctcaatgt

SEQ ID NO: 7459572 - DNA, 22 bp, Homo sapiens
tctttcttcagccctgtaagat

SEQ ID NO: 7459573 - DNA, 22 bp, Homo sapiens
tctttcttcagccctgtaagat

SEQ ID NO: 7459574 - DNA, 22 bp, Homo sapiens
tctttcttcagccctgtaagat

SEQ ID NO: 7459575 - DNA, 22 bp, Homo sapiens
tctttcttcagccctgtaagat

SEQ ID NO: 7459576 - DNA, 22 bp, Homo sapiens
tctttcttcctggagcccaaca

SEQ ID NO: 7459577 - DNA, 22 bp, Homo sapiens
tctttcttcctggagcccaaca

SEQ ID NO: 7459578 - DNA, 22 bp, Homo sapiens
tctttcttcagccctgtaagat

SEQ ID NO: 7459579 - DNA, 22 bp, Homo sapiens
tctttcttctttcatagtgtga

SEQ ID NO: 7459580 - DNA, 22 bp, Homo sapiens
tctttcttctttcatagtgtga

SEQ ID NO: 7459581 - DNA, 22 bp, Homo sapiens
ccaggcctggaccatgccaggg

SEQ ID NO: 7459582 - DNA, 22 bp, Homo sapiens
ccaggcctggaccatgccaggg

SEQ ID NO: 7459583 - DNA, 22 bp, Homo sapiens
ccaggcctggaccatgccaggg

SEQ ID NO: 7459584 - DNA, 22 bp, Homo sapiens
ccaggcctggaccatgccaggg

SEQ ID NO: 7459585 - DNA, 22 bp, Homo sapiens
ccaggcctggaccatgccaggg

SEQ ID NO: 7459586 - DNA, 19 bp, Homo sapiens
ccaggcctgcgggcgttgg

SEQ ID NO: 7459587 - DNA, 19 bp, Homo sapiens
ccaggcctgcgggcgttgg

SEQ ID NO: 7459588 - DNA, 19 bp, Homo sapiens
ccaggcctgcgggcgttgg

SEQ ID NO: 7459589 - DNA, 19 bp, Homo sapiens
ccaggcctgcgggcgttgg

SEQ ID NO: 7459590 - DNA, 22 bp, Homo sapiens
ccaggcctgcattccctctcag

SEQ ID NO: 7459591 - DNA, 22 bp, Homo sapiens
ccaggcctgcattccctctcag

SEQ ID NO: 7459592 - DNA, 22 bp, Homo sapiens
ccaggcctgcattccctctcag

SEQ ID NO: 7459593 - DNA, 22 bp, Homo sapiens
ccaggcctgcatctgctgcgca

SEQ ID NO: 7459594 - DNA, 22 bp, Homo sapiens
ccaggcctgcattccctctcag

SEQ ID NO: 7459595 - DNA, 22 bp, Homo sapiens
ccaggcctgcattccctctcag

SEQ ID NO: 7459596 - DNA, 22 bp, Homo sapiens
ccaggcctgcattccctctcag

SEQ ID NO: 7459597 - DNA, 22 bp, Homo sapiens
tctttgaaaagatattcctcct

SEQ ID NO: 7459598 - DNA, 22 bp, Homo sapiens
tctttgaaaagatattcctcct

SEQ ID NO: 7459599 - DNA, 22 bp, Homo sapiens
tctttctttatcacctgatatg

SEQ ID NO: 7459600 - DNA, 22 bp, Homo sapiens
tctttctttatcacctgatatg

SEQ ID NO: 7459601 - DNA, 22 bp, Homo sapiens
tctttgaaaagggagatagaaa

SEQ ID NO: 7459602 - DNA, 22 bp, Homo sapiens
tctttgaaaagatattcctcct

SEQ ID NO: 7459603 - DNA, 22 bp, Homo sapiens
tctttgaaaagggagatagaaa

SEQ ID NO: 7459604 - DNA, 22 bp, Homo sapiens
tctttgaaagctgttctagagt

SEQ ID NO: 7459605 - DNA, 22 bp, Homo sapiens
tctttgaaagctgttctagagt

SEQ ID NO: 7459606 - DNA, 22 bp, Homo sapiens
tctttgaaacaccctaaccttt

SEQ ID NO: 7459607 - DNA, 22 bp, Homo sapiens
tctttgaaagctgttctagagt

SEQ ID NO: 7459608 - DNA, 22 bp, Homo sapiens
tctttgaaagctgttctagagt

SEQ ID NO: 7459609 - DNA, 22 bp, Homo sapiens
tctttgaaagctgttctagagt

SEQ ID NO: 7459610 - DNA, 22 bp, Homo sapiens
ccaggcctgcatctgctgcgca

SEQ ID NO: 7459611 - DNA, 22 bp, Homo sapiens
ccaggcctgcatctgctgcgca

SEQ ID NO: 7459612 - DNA, 22 bp, Homo sapiens
ccaggccccagggctggctttc

SEQ ID NO: 7459613 - DNA, 22 bp, Homo sapiens
ccaggccccagggctggctttc

SEQ ID NO: 7459614 - DNA, 22 bp, Homo sapiens
ccaggccccagggctggctttc

SEQ ID NO: 7459615 - DNA, 22 bp, Homo sapiens
ccaggccccagggctggctttc

SEQ ID NO: 7459616 - DNA, 22 bp, Homo sapiens
ccaggccccagggctggctttc

SEQ ID NO: 7459617 - DNA, 22 bp, Homo sapiens
ccaggccccagggctggctttc

SEQ ID NO: 7459618 - DNA, 22 bp, Homo sapiens
tctttcaagggccctagtttgg

SEQ ID NO: 7459619 - DNA, 22 bp, Homo sapiens
tctttcaagggccctagtttgg

SEQ ID NO: 7459620 - DNA, 22 bp, Homo sapiens
ccaggcccccgagcagaagaca

SEQ ID NO: 7459621 - DNA, 22 bp, Homo sapiens
tctttcaaatgcttgaattgga

SEQ ID NO: 7459622 - DNA, 22 bp, Homo sapiens
tctttcaatccattcatatgtc

SEQ ID NO: 7459623 - DNA, 22 bp, Homo sapiens
tctttcaatccattcatatgtc

SEQ ID NO: 7459624 - DNA, 22 bp, Homo sapiens
tctttcaagggccctagtttgg

SEQ ID NO: 7459625 - DNA, 22 bp, Homo sapiens
tctttcaatccattcatatgtc

SEQ ID NO: 7459626 - DNA, 22 bp, Homo sapiens
tctttcaatccattcatatgtc

SEQ ID NO: 7459627 - DNA, 22 bp, Homo sapiens
tctttcttattagccattgttc

SEQ ID NO: 7459628 - DNA, 22 bp, Homo sapiens
tctttcttattagccattgttc

SEQ ID NO: 7459629 - DNA, 22 bp, Homo sapiens
ccaggcccagggtactgaccaa

SEQ ID NO: 7459630 - DNA, 22 bp, Homo sapiens
ccaggcccagggtactgaccaa

SEQ ID NO: 7459631 - DNA, 22 bp, Homo sapiens
ccaggcccagggtactgaccaa

SEQ ID NO: 7459632 - DNA, 22 bp, Homo sapiens
ccaggcccagggtactgaccaa

SEQ ID NO: 7459633 - DNA, 22 bp, Homo sapiens
ccaggcccagggtactgaccaa

SEQ ID NO: 7459634 - DNA, 22 bp, Homo sapiens
ccaggcccagggtactgaccaa

SEQ ID NO: 7459635 - DNA, 22 bp, Homo sapiens
ccaggcccaccttggccactta

SEQ ID NO: 7459636 - DNA, 22 bp, Homo sapiens
ccaggccccagggctggctttc

SEQ ID NO: 7459637 - DNA, 22 bp, Homo sapiens
ccaggccccagggctggctttc

SEQ ID NO: 7459638 - DNA, 22 bp, Homo sapiens
ccaggcccaccttggccactta

SEQ ID NO: 7459639 - DNA, 22 bp, Homo sapiens
ccaggcccaccttggccactta

SEQ ID NO: 7459640 - DNA, 22 bp, Homo sapiens
ccaggcccaccttggccactta

SEQ ID NO: 7459641 - DNA, 22 bp, Homo sapiens
ccaggcccaccttggccactta

SEQ ID NO: 7459642 - DNA, 22 bp, Homo sapiens
ccaggcccaccttggccactta

SEQ ID NO: 7459643 - DNA, 22 bp, Homo sapiens
ccaggcccaccttggccactta

SEQ ID NO: 7459644 - DNA, 22 bp, Homo sapiens
ccaggcccaccttggccactta

SEQ ID NO: 7459645 - DNA, 22 bp, Homo sapiens
ccaggcccaccttggccactta

SEQ ID NO: 7459646 - DNA, 22 bp, Homo sapiens
ccaggcccaccttggccactta

SEQ ID NO: 7459647 - DNA, 22 bp, Homo sapiens
ccaggcccaccttggccactta

SEQ ID NO: 7459648 - DNA, 22 bp, Homo sapiens
ccaggcccaccttggccactta

SEQ ID NO: 7459649 - DNA, 22 bp, Homo sapiens
ccaggccattcccagagttgct

SEQ ID NO: 7459650 - DNA, 22 bp, Homo sapiens
ccaggccattcccagagttgct

SEQ ID NO: 7459651 - DNA, 22 bp, Homo sapiens
ccaggccattcccagagttgct

SEQ ID NO: 7459652 - DNA, 22 bp, Homo sapiens
ccaggccattcccagagttgct

SEQ ID NO: 7459653 - DNA, 18 bp, Homo sapiens
ccaggccatgaacctctg

SEQ ID NO: 7459654 - DNA, 18 bp, Homo sapiens
ccaggccatgaacctctg

SEQ ID NO: 7459655 - DNA, 19 bp, Homo sapiens
ccaggccatcccagttccc

SEQ ID NO: 7459656 - DNA, 19 bp, Homo sapiens
ccaggccatcccagttccc

SEQ ID NO: 7459657 - DNA, 19 bp, Homo sapiens
ccaggccatcccagttccc

SEQ ID NO: 7459658 - DNA, 19 bp, Homo sapiens
ccaggccatcccagttccc

SEQ ID NO: 7459659 - DNA, 22 bp, Homo sapiens
ccaggccagtgtttggtccagg

SEQ ID NO: 7459660 - DNA, 22 bp, Homo sapiens
ccaggccagtgtttggtccagg

SEQ ID NO: 7459661 - DNA, 22 bp, Homo sapiens
ccaggccagtgtttggtccagg

SEQ ID NO: 7459662 - DNA, 22 bp, Homo sapiens
ccaggccagtgtttggtccagg

SEQ ID NO: 7459663 - DNA, 21 bp, Homo sapiens
ccaggccaggcctacggggat

SEQ ID NO: 7459664 - DNA, 21 bp, Homo sapiens
ccaggccaggcctacggggat

SEQ ID NO: 7459665 - DNA, 21 bp, Homo sapiens
ccaggccaggcctacggggat

SEQ ID NO: 7459666 - DNA, 22 bp, Homo sapiens
ccaggccagggctgcagcgagc

SEQ ID NO: 7459667 - DNA, 22 bp, Homo sapiens
ccaggccagggctgcagcgagc

SEQ ID NO: 7459668 - DNA, 22 bp, Homo sapiens
ccaggccagggctgcagcgagc

SEQ ID NO: 7459669 - DNA, 22 bp, Homo sapiens
ccaggccagggctgcagcgagc

SEQ ID NO: 7459670 - DNA, 22 bp, Homo sapiens
ccaggccagggctgcagcgagc

SEQ ID NO: 7459671 - DNA, 21 bp, Homo sapiens
ccaggccaggcctacggggat

SEQ ID NO: 7459672 - DNA, 22 bp, Homo sapiens
ccaggccaggagagcgaggttt

SEQ ID NO: 7459673 - DNA, 22 bp, Homo sapiens
ccaggccaggagagcgaggttt

SEQ ID NO: 7459674 - DNA, 22 bp, Homo sapiens
ccaggccaggagagcgaggttt

SEQ ID NO: 7459675 - DNA, 22 bp, Homo sapiens
ccaggccagggctgcagcgagc

SEQ ID NO: 7459676 - DNA, 22 bp, Homo sapiens
ccaggccagggctgcagcgagc

SEQ ID NO: 7459677 - DNA, 22 bp, Homo sapiens
ccaggccagggctgcagcgagc

SEQ ID NO: 7459678 - DNA, 22 bp, Homo sapiens
ccaggccagggctgcagcgagc

SEQ ID NO: 7459679 - DNA, 22 bp, Homo sapiens
ccaggccagtgtttggtccagg

SEQ ID NO: 7459680 - DNA, 22 bp, Homo sapiens
ccaggccagtgtttggtccagg

SEQ ID NO: 7459681 - DNA, 22 bp, Homo sapiens
ccaggccagtgtttggtccagg

SEQ ID NO: 7459682 - DNA, 22 bp, Homo sapiens
ccaggccagtgtttggtccagg

SEQ ID NO: 7459683 - DNA, 22 bp, Homo sapiens
ccaggccagtgtttggtccagg

SEQ ID NO: 7459684 - DNA, 22 bp, Homo sapiens
ccaggaggttgaggctgcagtg

SEQ ID NO: 7459685 - DNA, 22 bp, Homo sapiens
ccaggaggttgaggctgcagtg

SEQ ID NO: 7459686 - DNA, 22 bp, Homo sapiens
ccaggaggttgaggctgcagtg

SEQ ID NO: 7459687 - DNA, 22 bp, Homo sapiens
ccaggaggttgaggctgcagtg

SEQ ID NO: 7459688 - DNA, 22 bp, Homo sapiens
ccaggaggttgaggctgcagtg

SEQ ID NO: 7459689 - DNA, 22 bp, Homo sapiens
ccaggaggttgaggctgcagtg

SEQ ID NO: 7459690 - DNA, 22 bp, Homo sapiens
ccaggaggttgaggctgcagtg

SEQ ID NO: 7459691 - DNA, 22 bp, Homo sapiens
ccaggagggaggagttcctgag

SEQ ID NO: 7459692 - DNA, 22 bp, Homo sapiens
ccaggaggttgaggctgcagtg

SEQ ID NO: 7459693 - DNA, 22 bp, Homo sapiens
ccaggaggttgaggctgcagtg

SEQ ID NO: 7459694 - DNA, 22 bp, Homo sapiens
ccaggagggaccgcggcatccc

SEQ ID NO: 7459695 - DNA, 22 bp, Homo sapiens
ccaggagggaccgcggcatccc

SEQ ID NO: 7459696 - DNA, 17 bp, Homo sapiens
ccaggagagatgcttgt

SEQ ID NO: 7459697 - DNA, 17 bp, Homo sapiens
ccaggagagatgcttgt

SEQ ID NO: 7459698 - DNA, 17 bp, Homo sapiens
ccaggagagatgcttgt

SEQ ID NO: 7459699 - DNA, 22 bp, Homo sapiens
ccaggagggaccgcggcatccc

SEQ ID NO: 7459700 - DNA, 22 bp, Homo sapiens
ccaggagggaccgcggcatccc

SEQ ID NO: 7459701 - DNA, 22 bp, Homo sapiens
ccaggagggaccgcggcatccc

SEQ ID NO: 7459702 - DNA, 22 bp, Homo sapiens
ccaggagacccagggaaggagc

SEQ ID NO: 7459703 - DNA, 22 bp, Homo sapiens
ccaggagacccagggaaggagc

SEQ ID NO: 7459704 - DNA, 22 bp, Homo sapiens
ccaggagacaaagatgactgct

SEQ ID NO: 7459705 - DNA, 22 bp, Homo sapiens
ccaggagacaaagatgactgct

SEQ ID NO: 7459706 - DNA, 22 bp, Homo sapiens
ccaggagacccagggaaggagc

SEQ ID NO: 7459707 - DNA, 22 bp, Homo sapiens
ccaggagacaaagatgactgct

SEQ ID NO: 7459708 - DNA, 22 bp, Homo sapiens
ccaggagacaaagatgactgct

SEQ ID NO: 7459709 - DNA, 22 bp, Homo sapiens
ccaggagaatgggattacccta

SEQ ID NO: 7459710 - DNA, 22 bp, Homo sapiens
ccaggagaatgggattacccta

SEQ ID NO: 7459711 - DNA, 22 bp, Homo sapiens
ccaggagacaaagatgactgct

SEQ ID NO: 7459712 - DNA, 22 bp, Homo sapiens
ccaggagacaaagatgactgct

SEQ ID NO: 7459713 - DNA, 22 bp, Homo sapiens
ccaggagacaaagatgactgct

SEQ ID NO: 7459714 - DNA, 22 bp, Homo sapiens
ccaggagactgtactgatattt

SEQ ID NO: 7459715 - DNA, 22 bp, Homo sapiens
ccaggagactgtactgatattt

SEQ ID NO: 7459716 - DNA, 22 bp, Homo sapiens
ccaggagactgtactgatattt

SEQ ID NO: 7459717 - DNA, 22 bp, Homo sapiens
ccaggagactgtactgatattt

SEQ ID NO: 7459718 - DNA, 22 bp, Homo sapiens
ccaggagacccagggaaggagc

SEQ ID NO: 7459719 - DNA, 22 bp, Homo sapiens
ccaggagacccagggaaggagc

SEQ ID NO: 7459720 - DNA, 22 bp, Homo sapiens
ccaggagacccagggaaggagc

SEQ ID NO: 7459721 - DNA, 22 bp, Homo sapiens
ccaggagacccagggaaggagc

SEQ ID NO: 7459722 - DNA, 22 bp, Homo sapiens
ccaggaggttgaggctgcagtg

SEQ ID NO: 7459723 - DNA, 22 bp, Homo sapiens
ccaggaggttgaggctgcagtg

SEQ ID NO: 7459724 - DNA, 22 bp, Homo sapiens
ccaggaggttgaggctgcagtg

SEQ ID NO: 7459725 - DNA, 22 bp, Homo sapiens
ccaggaggttgaggctgcagtg

SEQ ID NO: 7459726 - DNA, 22 bp, Homo sapiens
ccaggaggttgaggctgcagtg

SEQ ID NO: 7459727 - DNA, 22 bp, Homo sapiens
ccaggaggttgaggctgcagtg

SEQ ID NO: 7459728 - DNA, 22 bp, Homo sapiens
ccaggaggttgaggctgcagtg

SEQ ID NO: 7459729 - DNA, 22 bp, Homo sapiens
ccaggaggttgaggctgcagtg

SEQ ID NO: 7459730 - DNA, 22 bp, Homo sapiens
ccaggaggttgaggctgcagtg

SEQ ID NO: 7459731 - DNA, 22 bp, Homo sapiens
ccaggaggttgaggctgcagtg

SEQ ID NO: 7459732 - DNA, 22 bp, Homo sapiens
ccaggaggttgaggctgcagtg

SEQ ID NO: 7459733 - DNA, 22 bp, Homo sapiens
ccaggagtcaataaaggaagct

SEQ ID NO: 7459734 - DNA, 22 bp, Homo sapiens
ccaggagtctggatgaggtgtc

SEQ ID NO: 7459735 - DNA, 22 bp, Homo sapiens
ccaggagtcaataaaggaagct

SEQ ID NO: 7459736 - DNA, 22 bp, Homo sapiens
ccaggagtcaataaaggaagct

SEQ ID NO: 7459737 - DNA, 22 bp, Homo sapiens
ccaggagtcaataaaggaagct

SEQ ID NO: 7459738 - DNA, 22 bp, Homo sapiens
ccaggagtcaataaaggaagct

SEQ ID NO: 7459739 - DNA, 22 bp, Homo sapiens
ccaggagtgcagggatggtatc

SEQ ID NO: 7459740 - DNA, 22 bp, Homo sapiens
ccaggagtctggatgaggtgtc

SEQ ID NO: 7459741 - DNA, 22 bp, Homo sapiens
ccaggagtctggatgaggtgtc

SEQ ID NO: 7459742 - DNA, 22 bp, Homo sapiens
ccaggagtggctggtgaccttc

SEQ ID NO: 7459743 - DNA, 19 bp, Homo sapiens
ccaggagtggtggggtgag

SEQ ID NO: 7459744 - DNA, 22 bp, Homo sapiens
ccaggagttggaagctgccatg

SEQ ID NO: 7459745 - DNA, 19 bp, Homo sapiens
ccaggagtggtggggtgag

SEQ ID NO: 7459746 - DNA, 19 bp, Homo sapiens
ccaggagtggtggggtgag

SEQ ID NO: 7459747 - DNA, 22 bp, Homo sapiens
tcttagaatgtcaactgatgtt

SEQ ID NO: 7459748 - DNA, 22 bp, Homo sapiens
tcttagaatgtcaactgatgtt

SEQ ID NO: 7459749 - DNA, 22 bp, Homo sapiens
ccaggcaaggtctcctagagag

SEQ ID NO: 7459750 - DNA, 22 bp, Homo sapiens
ccaggcaaggtctcctagagag

SEQ ID NO: 7459751 - DNA, 22 bp, Homo sapiens
tcttagaatgtcaactgatgtt

SEQ ID NO: 7459752 - DNA, 22 bp, Homo sapiens
ccaggcaacggagcccactgcc

SEQ ID NO: 7459753 - DNA, 22 bp, Homo sapiens
ccaggcaagagaggctctggca

SEQ ID NO: 7459754 - DNA, 22 bp, Homo sapiens
ccaggcaagagaggctctggca

SEQ ID NO: 7459755 - DNA, 22 bp, Homo sapiens
ccaggcaagctctgctgtgccc

SEQ ID NO: 7459756 - DNA, 22 bp, Homo sapiens
ccaggcaagctctgctgtgccc

SEQ ID NO: 7459757 - DNA, 22 bp, Homo sapiens
ccaggcaaggacatgaaactga

SEQ ID NO: 7459758 - DNA, 22 bp, Homo sapiens
ccaggcaaggacatgaaactga

SEQ ID NO: 7459759 - DNA, 22 bp, Homo sapiens
ccaggcaaggtctcctagagag

SEQ ID NO: 7459760 - DNA, 22 bp, Homo sapiens
ccaggcaaggtctcctagagag

SEQ ID NO: 7459761 - DNA, 22 bp, Homo sapiens
ccaggcaaggtctcctagagag

SEQ ID NO: 7459762 - DNA, 22 bp, Homo sapiens
tcttcacattttaagaagttct

SEQ ID NO: 7459763 - DNA, 22 bp, Homo sapiens
tcttcacattcacgtaacatag

SEQ ID NO: 7459764 - DNA, 22 bp, Homo sapiens
tcttcacatggagaagcaactc

SEQ ID NO: 7459765 - DNA, 22 bp, Homo sapiens
tcttcacattcacgtaacatag

SEQ ID NO: 7459766 - DNA, 22 bp, Homo sapiens
tcttcacatggagaagcaactc

SEQ ID NO: 7459767 - DNA, 22 bp, Homo sapiens
tcttcacattttaagaagttct

SEQ ID NO: 7459768 - DNA, 22 bp, Homo sapiens
tcttcacattttaagaagttct

SEQ ID NO: 7459769 - DNA, 22 bp, Homo sapiens
tcttcacattttaagaagttct

SEQ ID NO: 7459770 - DNA, 22 bp, Homo sapiens
tcttcacattttagtggtttgt

SEQ ID NO: 7459771 - DNA, 22 bp, Homo sapiens
tcttcactgatgtctctcaaat

SEQ ID NO: 7459772 - DNA, 22 bp, Homo sapiens
tcttcacgccaagtgcccctca

SEQ ID NO: 7459773 - DNA, 22 bp, Homo sapiens
tcttcactgatgtctctcaaat

SEQ ID NO: 7459774 - DNA, 22 bp, Homo sapiens
tcttcaccatcaacagaatgaa

SEQ ID NO: 7459775 - DNA, 22 bp, Homo sapiens
tcttcacgccaagtgcccctca

SEQ ID NO: 7459776 - DNA, 22 bp, Homo sapiens
ccaggatgacccccactttcct

SEQ ID NO: 7459777 - DNA, 22 bp, Homo sapiens
ccaggatctgggtccatgggac

SEQ ID NO: 7459778 - DNA, 22 bp, Homo sapiens
ccaggatctgggtccatgggac

SEQ ID NO: 7459779 - DNA, 22 bp, Homo sapiens
ccaggatgacccccactttcct

SEQ ID NO: 7459780 - DNA, 22 bp, Homo sapiens
ccaggatctgtacacctctgag

SEQ ID NO: 7459781 - DNA, 22 bp, Homo sapiens
ccaggagtttgaggctgcagtg

SEQ ID NO: 7459782 - DNA, 22 bp, Homo sapiens
ccaggatactgctctctgctgc

SEQ ID NO: 7459783 - DNA, 22 bp, Homo sapiens
ccaggagtttgaggctgcagtg

SEQ ID NO: 7459784 - DNA, 22 bp, Homo sapiens
ccaggatagtatgagtagggat

SEQ ID NO: 7459785 - DNA, 22 bp, Homo sapiens
ccaggatggggagcagatagaa

SEQ ID NO: 7459786 - DNA, 22 bp, Homo sapiens
ccaggatggggagcagatagaa

SEQ ID NO: 7459787 - DNA, 22 bp, Homo sapiens
ccaggatggggagcagatagaa

SEQ ID NO: 7459788 - DNA, 22 bp, Homo sapiens
ccaggcaaatccctctggcaga

SEQ ID NO: 7459789 - DNA, 22 bp, Homo sapiens
ccaggcaaagcccatgcaagag

SEQ ID NO: 7459790 - DNA, 22 bp, Homo sapiens
ccaggcaaagcccatgcaagag

SEQ ID NO: 7459791 - DNA, 22 bp, Homo sapiens
ccaggagttggaggttgcagtg

SEQ ID NO: 7459792 - DNA, 22 bp, Homo sapiens
ccaggagttggaggctgcagtg

SEQ ID NO: 7459793 - DNA, 22 bp, Homo sapiens
ccaggagttggaggctgcagtg

SEQ ID NO: 7459794 - DNA, 22 bp, Homo sapiens
ccaggagttggaggttgcagtg

SEQ ID NO: 7459795 - DNA, 22 bp, Homo sapiens
ccaggagtttgaggctgcagtg

SEQ ID NO: 7459796 - DNA, 22 bp, Homo sapiens
ccaggagtttgaggctgcagtg

SEQ ID NO: 7459797 - DNA, 22 bp, Homo sapiens
ccaggagtttgaggctgcagtg

SEQ ID NO: 7459798 - DNA, 22 bp, Homo sapiens
ccaggagttggaagctgccatg

SEQ ID NO: 7459799 - DNA, 22 bp, Homo sapiens
ccaggagttggaggctgcagtg

SEQ ID NO: 7459800 - DNA, 22 bp, Homo sapiens
ccaggagttggaagctgccatg

SEQ ID NO: 7459801 - DNA, 22 bp, Homo sapiens
ccaggagttggaagctgccatg

SEQ ID NO: 7459802 - DNA, 22 bp, Homo sapiens
ccaggagttggaagctgccatg

SEQ ID NO: 7459803 - DNA, 22 bp, Homo sapiens
ccaggagttggaggctgcagtg

SEQ ID NO: 7459804 - DNA, 22 bp, Homo sapiens
ccaggagttggaggctgcagtg

SEQ ID NO: 7459805 - DNA, 22 bp, Homo sapiens
ccaggagttggaagctgccatg

SEQ ID NO: 7459806 - DNA, 22 bp, Homo sapiens
tcttcccagaggaggtgccagc

SEQ ID NO: 7459807 - DNA, 22 bp, Homo sapiens
tcttcccagaggaggtgccagc

SEQ ID NO: 7459808 - DNA, 22 bp, Homo sapiens
tcttcccagaggaggtgccagc

SEQ ID NO: 7459809 - DNA, 22 bp, Homo sapiens
tcttcccagaccttacatgtga

SEQ ID NO: 7459810 - DNA, 22 bp, Homo sapiens
tcttcccactgcccatgggcag

SEQ ID NO: 7459811 - DNA, 22 bp, Homo sapiens
tcttcccagaccttacatgtga

SEQ ID NO: 7459812 - DNA, 22 bp, Homo sapiens
tcttcccagctgctgcgatgcc

SEQ ID NO: 7459813 - DNA, 22 bp, Homo sapiens
tcttcccagctgctgcgatgcc

SEQ ID NO: 7459814 - DNA, 22 bp, Homo sapiens
tcttcccagtgagacttatggg

SEQ ID NO: 7459815 - DNA, 22 bp, Homo sapiens
tcttcccagtgagacttatggg

SEQ ID NO: 7459816 - DNA, 22 bp, Homo sapiens
tcttcccagaggaggtgccagc

SEQ ID NO: 7459817 - DNA, 22 bp, Homo sapiens
tcttcccagctgctgcgatgcc

SEQ ID NO: 7459818 - DNA, 22 bp, Homo sapiens
tcttcccagaccttacatgtga

SEQ ID NO: 7459819 - DNA, 22 bp, Homo sapiens
tcttcccactgcccatgggcag

SEQ ID NO: 7459820 - DNA, 22 bp, Homo sapiens
tcttcccaatgcaaagtaggac

SEQ ID NO: 7459821 - DNA, 22 bp, Homo sapiens
tcttcccaatgcaaagtaggac

SEQ ID NO: 7459822 - DNA, 22 bp, Homo sapiens
tcttcccaatgcaaagtaggac

SEQ ID NO: 7459823 - DNA, 22 bp, Homo sapiens
tcttccagtgtagacatctgcc

SEQ ID NO: 7459824 - DNA, 22 bp, Homo sapiens
tcttccagtgtagacatctgcc

SEQ ID NO: 7459825 - DNA, 22 bp, Homo sapiens
tcttccagtgtagacatctgcc

SEQ ID NO: 7459826 - DNA, 22 bp, Homo sapiens
tcttccagtgtagacatctgcc

SEQ ID NO: 7459827 - DNA, 22 bp, Homo sapiens
tcttccagtgtagacatctgcc

SEQ ID NO: 7459828 - DNA, 22 bp, Homo sapiens
tcttcagagtgaaagtctgtga

SEQ ID NO: 7459829 - DNA, 22 bp, Homo sapiens
tcttcagagtgaaagtctgtga

SEQ ID NO: 7459830 - DNA, 22 bp, Homo sapiens
tcttcagagtgagcagtgtcat

SEQ ID NO: 7459831 - DNA, 20 bp, Homo sapiens
tcttcagatgcttttggagt

SEQ ID NO: 7459832 - DNA, 20 bp, Homo sapiens
tcttcagatgcttttggagt

SEQ ID NO: 7459833 - DNA, 22 bp, Homo sapiens
tcttcagataaagggagagtat

SEQ ID NO: 7459834 - DNA, 22 bp, Homo sapiens
tcttccaggtatgtttctagtt

SEQ ID NO: 7459835 - DNA, 20 bp, Homo sapiens
tcttccaggtacagtctgca

SEQ ID NO: 7459836 - DNA, 22 bp, Homo sapiens
tcttccaggtatgtttctagtt

SEQ ID NO: 7459837 - DNA, 22 bp, Homo sapiens
tcttccaggtatgtttctagtt

SEQ ID NO: 7459838 - DNA, 22 bp, Homo sapiens
tcttccaggtatgtttctagtt

SEQ ID NO: 7459839 - DNA, 19 bp, Homo sapiens
tcttccagtcacataacaa

SEQ ID NO: 7459840 - DNA, 19 bp, Homo sapiens
tcttccagtcacataacaa

SEQ ID NO: 7459841 - DNA, 22 bp, Homo sapiens
tcttccagtctgtaggactagg

SEQ ID NO: 7459842 - DNA, 22 bp, Homo sapiens
tcttccagtctgtaggactagg

SEQ ID NO: 7459843 - DNA, 22 bp, Homo sapiens
tcttccagtctgtaggactagg

SEQ ID NO: 7459844 - DNA, 22 bp, Homo sapiens
tcttccagtctgtaggactagg

SEQ ID NO: 7459845 - DNA, 22 bp, Homo sapiens
tcttccagtgctgtgtagagct

SEQ ID NO: 7459846 - DNA, 22 bp, Homo sapiens
tcttccagtgctgtgtagagct

SEQ ID NO: 7459847 - DNA, 22 bp, Homo sapiens
tcttccagtgctgtgtagagct

SEQ ID NO: 7459848 - DNA, 22 bp, Homo sapiens
tcttccagtgctgtgtagagct

SEQ ID NO: 7459849 - DNA, 22 bp, Homo sapiens
tcttccagtgctgtgtagagct

SEQ ID NO: 7459850 - DNA, 22 bp, Homo sapiens
tcttcagaagatcacatcagtg

SEQ ID NO: 7459851 - DNA, 22 bp, Homo sapiens
tcttcagacccttagctgtgat

SEQ ID NO: 7459852 - DNA, 22 bp, Homo sapiens
tcttcagaagatcacatcagtg

SEQ ID NO: 7459853 - DNA, 22 bp, Homo sapiens
tcttcagaaaattatcacttgt

SEQ ID NO: 7459854 - DNA, 22 bp, Homo sapiens
tcttcagaaaattatcacttgt

SEQ ID NO: 7459855 - DNA, 22 bp, Homo sapiens
tcttcagaaaattatcacttgt

SEQ ID NO: 7459856 - DNA, 22 bp, Homo sapiens
tcttcactgtgaatttgttctt

SEQ ID NO: 7459857 - DNA, 22 bp, Homo sapiens
tcttcactgtgaatttgttctt

SEQ ID NO: 7459858 - DNA, 22 bp, Homo sapiens
tcttcactgatgtctctcaaat

SEQ ID NO: 7459859 - DNA, 22 bp, Homo sapiens
tcttcagactccaaatgtttta

SEQ ID NO: 7459860 - DNA, 22 bp, Homo sapiens
tcttcagactgttgttcttttg

SEQ ID NO: 7459861 - DNA, 22 bp, Homo sapiens
tcttcagactccaaatgtttta

SEQ ID NO: 7459862 - DNA, 22 bp, Homo sapiens
tcttcagacccttagctgtgat

SEQ ID NO: 7459863 - DNA, 22 bp, Homo sapiens
tcttcagacccttagctgtgat

SEQ ID NO: 7459864 - DNA, 22 bp, Homo sapiens
tcttcagacccttagctgtgat

SEQ ID NO: 7459865 - DNA, 22 bp, Homo sapiens
tcttcagaggagctgaatatat

SEQ ID NO: 7459866 - DNA, 22 bp, Homo sapiens
tcttcagaggagctgaatatat

SEQ ID NO: 7459867 - DNA, 22 bp, Homo sapiens
tcttcagaggaagtcagtcttt

SEQ ID NO: 7459868 - DNA, 22 bp, Homo sapiens
tcttcagagcatttctgaggta

SEQ ID NO: 7459869 - DNA, 22 bp, Homo sapiens
tcttcagaggaagtcagtcttt

SEQ ID NO: 7459870 - DNA, 22 bp, Homo sapiens
tcttcagaggaagtcagtcttt

SEQ ID NO: 7459871 - DNA, 22 bp, Homo sapiens
tcttcagagcatttctgaggta

SEQ ID NO: 7459872 - DNA, 22 bp, Homo sapiens
tcttcagagactctgagcccct

SEQ ID NO: 7459873 - DNA, 22 bp, Homo sapiens
tcttcagagatgtaacatatgg

SEQ ID NO: 7459874 - DNA, 22 bp, Homo sapiens
tcttcagagatgtaacatatgg

SEQ ID NO: 7459875 - DNA, 22 bp, Homo sapiens
tcttcagagactctgagcccct

SEQ ID NO: 7459876 - DNA, 22 bp, Homo sapiens
tcttcagagcatttctgaggta

SEQ ID NO: 7459877 - DNA, 22 bp, Homo sapiens
tcttcagagatgtaacatatgg

SEQ ID NO: 7459878 - DNA, 22 bp, Homo sapiens
tcttcagagatgtaacatatgg

SEQ ID NO: 7459879 - DNA, 22 bp, Homo sapiens
ccaggccagcaggcacacctgc

SEQ ID NO: 7459880 - DNA, 22 bp, Homo sapiens
ccaggccagcaggcacacctgc

SEQ ID NO: 7459881 - DNA, 22 bp, Homo sapiens
ccaggccagcctggagcatggc

SEQ ID NO: 7459882 - DNA, 22 bp, Homo sapiens
ccaggccagcaggcacacctgc

SEQ ID NO: 7459883 - DNA, 22 bp, Homo sapiens
ccaggccagcaggcacacctgc

SEQ ID NO: 7459884 - DNA, 22 bp, Homo sapiens
ccaggccagcaggcacacctgc

SEQ ID NO: 7459885 - DNA, 22 bp, Homo sapiens
ccaggccagcaggcacacctgc

SEQ ID NO: 7459886 - DNA, 22 bp, Homo sapiens
ccaggccagcaggcacacctgc

SEQ ID NO: 7459887 - DNA, 22 bp, Homo sapiens
ccaggccagagtgcagtggcac

SEQ ID NO: 7459888 - DNA, 22 bp, Homo sapiens
ccaggccagagtgcagtggcac

SEQ ID NO: 7459889 - DNA, 22 bp, Homo sapiens
ccaggccagagtgcagtggcac

SEQ ID NO: 7459890 - DNA, 22 bp, Homo sapiens
ccaggccagagtgcagtggcac

SEQ ID NO: 7459891 - DNA, 22 bp, Homo sapiens
ccaggccagagtgcagtggcac

SEQ ID NO: 7459892 - DNA, 22 bp, Homo sapiens
ccaggccagagtgcagtggcac

SEQ ID NO: 7459893 - DNA, 22 bp, Homo sapiens
ccaggccagcctggagcatggc

SEQ ID NO: 7459894 - DNA, 22 bp, Homo sapiens
ccaggccagcctggagcatggc

SEQ ID NO: 7459895 - DNA, 22 bp, Homo sapiens
ccaggccagcgctggctggagg

SEQ ID NO: 7459896 - DNA, 22 bp, Homo sapiens
ccaggccagcgctggctggagg

SEQ ID NO: 7459897 - DNA, 22 bp, Homo sapiens
ccaggccagcgctggctggagg

SEQ ID NO: 7459898 - DNA, 22 bp, Homo sapiens
ccaggccagcctggagcatggc

SEQ ID NO: 7459899 - DNA, 22 bp, Homo sapiens
ccaggccagcctggagcatggc

SEQ ID NO: 7459900 - DNA, 22 bp, Homo sapiens
ccaggccagcctggagcatggc

SEQ ID NO: 7459901 - DNA, 22 bp, Homo sapiens
ccaggccagcctggagcatggc

SEQ ID NO: 7459902 - DNA, 22 bp, Homo sapiens
ccaggccaggagagcgaggttt

SEQ ID NO: 7459903 - DNA, 22 bp, Homo sapiens
ccaggccagcgctggctggagg

SEQ ID NO: 7459904 - DNA, 22 bp, Homo sapiens
ccaggccagcgctggctggagg

SEQ ID NO: 7459905 - DNA, 22 bp, Homo sapiens
ccaggccagcgctggctggagg

SEQ ID NO: 7459906 - DNA, 22 bp, Homo sapiens
ccaggccagcgctggctggagg

SEQ ID NO: 7459907 - DNA, 22 bp, Homo sapiens
ccaggccagcgctggctggagg

SEQ ID NO: 7459908 - DNA, 22 bp, Homo sapiens
ccaggccagcgctggctggagg

SEQ ID NO: 7459909 - DNA, 22 bp, Homo sapiens
ccaggccagcgctggctggagg

SEQ ID NO: 7459910 - DNA, 22 bp, Homo sapiens
ccaggccagcgctggctggagg

SEQ ID NO: 7459911 - DNA, 22 bp, Homo sapiens
ccaggccagcgctggctggagg

SEQ ID NO: 7459912 - DNA, 22 bp, Homo sapiens
ccaggcagggagctgtttggcc

SEQ ID NO: 7459913 - DNA, 22 bp, Homo sapiens
ccaggcagggagctgtttggcc

SEQ ID NO: 7459914 - DNA, 22 bp, Homo sapiens
ccaggcagggagctgtttggcc

SEQ ID NO: 7459915 - DNA, 22 bp, Homo sapiens
ccaggccagagtgcagtggcac

SEQ ID NO: 7459916 - DNA, 22 bp, Homo sapiens
ccaggccagagtgcagtggcac

SEQ ID NO: 7459917 - DNA, 22 bp, Homo sapiens
ccaggcagggagctgtttggcc

SEQ ID NO: 7459918 - DNA, 22 bp, Homo sapiens
ccaggcagggagctgtttggcc

SEQ ID NO: 7459919 - DNA, 22 bp, Homo sapiens
ccaggcaggctagaatgtaaat

SEQ ID NO: 7459920 - DNA, 22 bp, Homo sapiens
ccaggcaggctagaatgtaaat

SEQ ID NO: 7459921 - DNA, 22 bp, Homo sapiens
ccaggcaggctagaatgtaaat

SEQ ID NO: 7459922 - DNA, 22 bp, Homo sapiens
ccaggcaggctagaatgtaaat

SEQ ID NO: 7459923 - DNA, 22 bp, Homo sapiens
ccaggcaggctagaatgtaaat

SEQ ID NO: 7459924 - DNA, 19 bp, Homo sapiens
tcttccctggctgtcagtc

SEQ ID NO: 7459925 - DNA, 19 bp, Homo sapiens
tcttccctggctgtcagtc

SEQ ID NO: 7459926 - DNA, 22 bp, Homo sapiens
tcttcctagaaggaagaaatct

SEQ ID NO: 7459927 - DNA, 19 bp, Homo sapiens
tcttccctggctgtcagtc

SEQ ID NO: 7459928 - DNA, 22 bp, Homo sapiens
tcttcctatgccaacattctgt

SEQ ID NO: 7459929 - DNA, 22 bp, Homo sapiens
tcttcctagaaggaagaaatct

SEQ ID NO: 7459930 - DNA, 22 bp, Homo sapiens
tcttcctatgccaacattctgt

SEQ ID NO: 7459931 - DNA, 22 bp, Homo sapiens
tcttcctatggggctgcaggaa

SEQ ID NO: 7459932 - DNA, 22 bp, Homo sapiens
tcttcccccgtgctccagtgca

SEQ ID NO: 7459933 - DNA, 22 bp, Homo sapiens
tcttcccccgtgctccagtgca

SEQ ID NO: 7459934 - DNA, 22 bp, Homo sapiens
tcttcccccgtgctccagtgca

SEQ ID NO: 7459935 - DNA, 22 bp, Homo sapiens
tcttcccccgtgctccagtgca

SEQ ID NO: 7459936 - DNA, 22 bp, Homo sapiens
tcttcccccgtgctccagtgca

SEQ ID NO: 7459937 - DNA, 22 bp, Homo sapiens
tcttcccccgtgctccagtgca

SEQ ID NO: 7459938 - DNA, 22 bp, Homo sapiens
tcttcccattagtaatgaagtg

SEQ ID NO: 7459939 - DNA, 22 bp, Homo sapiens
tcttcccattagtaatgaagtg

SEQ ID NO: 7459940 - DNA, 21 bp, Homo sapiens
tcttcccattatgttccaatt

SEQ ID NO: 7459941 - DNA, 22 bp, Homo sapiens
tcttcccattagtaatgaagtg

SEQ ID NO: 7459942 - DNA, 21 bp, Homo sapiens
tcttcccattatgttccaatt

SEQ ID NO: 7459943 - DNA, 21 bp, Homo sapiens
tcttcccattatgttccaatt

SEQ ID NO: 7459944 - DNA, 22 bp, Homo sapiens
tcttccctaatcaccatcttca

SEQ ID NO: 7459945 - DNA, 21 bp, Homo sapiens
tcttccctcaggatgtcctgc

SEQ ID NO: 7459946 - DNA, 21 bp, Homo sapiens
tcttccctcaggatgtcctgc

SEQ ID NO: 7459947 - DNA, 22 bp, Homo sapiens
tcttccctcttctgccaaatac

SEQ ID NO: 7459948 - DNA, 21 bp, Homo sapiens
tcttccctcaggatgtcctgc

SEQ ID NO: 7459949 - DNA, 22 bp, Homo sapiens
tcttccctcttctgccaaatac

SEQ ID NO: 7459950 - DNA, 22 bp, Homo sapiens
tcttccctcttctgccaaatac

SEQ ID NO: 7459951 - DNA, 21 bp, Homo sapiens
tcttccctcaggatgtcctgc

SEQ ID NO: 7459952 - DNA, 18 bp, Homo sapiens
ttggggtgaggccaggaa

SEQ ID NO: 7459953 - DNA, 18 bp, Homo sapiens
ttggggtgaggccaggaa

SEQ ID NO: 7459954 - DNA, 18 bp, Homo sapiens
ttggggtgaggccaggaa

SEQ ID NO: 7459955 - DNA, 22 bp, Homo sapiens
ttgcaattaacatatgtcaact

SEQ ID NO: 7459956 - DNA, 22 bp, Homo sapiens
ttgcaattaacatatgtcaact

SEQ ID NO: 7459957 - DNA, 22 bp, Homo sapiens
ttgcaattaacatatgtcaact

SEQ ID NO: 7459958 - DNA, 22 bp, Homo sapiens
ttgcaattaacatatgtcaact

SEQ ID NO: 7459959 - DNA, 22 bp, Homo sapiens
ttgcaatgcctcaattaaagcc

SEQ ID NO: 7459960 - DNA, 21 bp, Homo sapiens
ttgcaatgggcattttggagg

SEQ ID NO: 7459961 - DNA, 22 bp, Homo sapiens
ttgcaatcaaaaagaagtacag

SEQ ID NO: 7459962 - DNA, 22 bp, Homo sapiens
ttgcaaggtttctctctgccta

SEQ ID NO: 7459963 - DNA, 22 bp, Homo sapiens
ttgcaagttccttatgagaatc

SEQ ID NO: 7459964 - DNA, 22 bp, Homo sapiens
ttgcaaggtttctctctgccta

SEQ ID NO: 7459965 - DNA, 20 bp, Homo sapiens
ttgcaataaatgaaagacca

SEQ ID NO: 7459966 - DNA, 22 bp, Homo sapiens
ttgcaagttttacttacctgga

SEQ ID NO: 7459967 - DNA, 22 bp, Homo sapiens
ttgcaagaaattaggaagtgaa

SEQ ID NO: 7459968 - DNA, 20 bp, Homo sapiens
ttgcaactgtaagaagcagg

SEQ ID NO: 7459969 - DNA, 22 bp, Homo sapiens
ttgcaagacacttggaagcaca

SEQ ID NO: 7459970 - DNA, 22 bp, Homo sapiens
ttgcaagacacttggaagcaca

SEQ ID NO: 7459971 - DNA, 22 bp, Homo sapiens
ttgcaagggtgttttgaggtgt

SEQ ID NO: 7459972 - DNA, 22 bp, Homo sapiens
ttgcaagggataccatactaag

SEQ ID NO: 7459973 - DNA, 22 bp, Homo sapiens
ttgcaagggcatgtgtgcgtgt

SEQ ID NO: 7459974 - DNA, 22 bp, Homo sapiens
ttgcaagggcatgtgtgcgtgt

SEQ ID NO: 7459975 - DNA, 22 bp, Homo sapiens
ttgcaaggctaggttcacccac

SEQ ID NO: 7459976 - DNA, 22 bp, Homo sapiens
ttgcaaggagccactctgcctg

SEQ ID NO: 7459977 - DNA, 22 bp, Homo sapiens
ttgcaaggagccactctgcctg

SEQ ID NO: 7459978 - DNA, 22 bp, Homo sapiens
ttgcaagatgttaccattgtta

SEQ ID NO: 7459979 - DNA, 20 bp, Homo sapiens
ttgcaagctttcaagatagc

SEQ ID NO: 7459980 - DNA, 22 bp, Homo sapiens
ttgcaaattcgtcactgttaaa

SEQ ID NO: 7459981 - DNA, 22 bp, Homo sapiens
ttgcaaattcgtcactgttaaa

SEQ ID NO: 7459982 - DNA, 22 bp, Homo sapiens
ttgcaaattcgtcactgttaaa

SEQ ID NO: 7459983 - DNA, 22 bp, Homo sapiens
ttgcaaattccaatccaatatt

SEQ ID NO: 7459984 - DNA, 18 bp, Homo sapiens
ttgcaaattcttccctgt

SEQ ID NO: 7459985 - DNA, 18 bp, Homo sapiens
ttgcaaattcttccctgt

SEQ ID NO: 7459986 - DNA, 18 bp, Homo sapiens
ttgcaaattcttccctgt

SEQ ID NO: 7459987 - DNA, 18 bp, Homo sapiens
ttgcaaattcttccctgt

SEQ ID NO: 7459988 - DNA, 22 bp, Homo sapiens
ttgcaaattgcaagagttggat

SEQ ID NO: 7459989 - DNA, 18 bp, Homo sapiens
ttgcaaattcttccctgt

SEQ ID NO: 7459990 - DNA, 22 bp, Homo sapiens
ttgcaaattgcaagagttggat

SEQ ID NO: 7459991 - DNA, 22 bp, Homo sapiens
ttgcaaattccaatccaatatt

SEQ ID NO: 7459992 - DNA, 22 bp, Homo sapiens
ttgcaaattccaatccaatatt

SEQ ID NO: 7459993 - DNA, 22 bp, Homo sapiens
ttgcaaattccaatccaatatt

SEQ ID NO: 7459994 - DNA, 22 bp, Homo sapiens
ttgcaaattccaatccaatatt

SEQ ID NO: 7459995 - DNA, 22 bp, Homo sapiens
ttgcaaattccaatccaatatt

SEQ ID NO: 7459996 - DNA, 22 bp, Homo sapiens
ttgcaaattcatggatctgaat

SEQ ID NO: 7459997 - DNA, 22 bp, Homo sapiens
ttgcaaattcatggatctgaat

SEQ ID NO: 7459998 - DNA, 22 bp, Homo sapiens
ttgcaaattattttagtccctt

SEQ ID NO: 7459999 - DNA, 22 bp, Homo sapiens
ttgcaaattattttagtccctt

SEQ ID NO: 7460000 - DNA, 22 bp, Homo sapiens
ttgcaaattatataagggatgc

SEQ ID NO: 7460001 - DNA, 22 bp, Homo sapiens
ttgcaaattattttagtccctt

SEQ ID NO: 7460002 - DNA, 22 bp, Homo sapiens
ttgcaaattattttagtccctt

SEQ ID NO: 7460003 - DNA, 22 bp, Homo sapiens
ttgcaaattcatggatctgaat

SEQ ID NO: 7460004 - DNA, 23 bp, Homo sapiens
ttgcaaatttcagttagttcatg

SEQ ID NO: 7460005 - DNA, 23 bp, Homo sapiens
ttgcaaatttcagttagttcatg

SEQ ID NO: 7460006 - DNA, 23 bp, Homo sapiens
ttgcaaatttcagttagttcatg

SEQ ID NO: 7460007 - DNA, 22 bp, Homo sapiens
ttgcaaattgcaagagttggat

SEQ ID NO: 7460008 - DNA, 23 bp, Homo sapiens
ttgcaaatttcagttagttcatg

SEQ ID NO: 7460009 - DNA, 23 bp, Homo sapiens
ttgcaaatttcagttagttcatg

SEQ ID NO: 7460010 - DNA, 23 bp, Homo sapiens
ttgcaaatttcagttagttcatg

SEQ ID NO: 7460011 - DNA, 21 bp, Homo sapiens
ttgcaacaacctatatatttt

SEQ ID NO: 7460012 - DNA, 23 bp, Homo sapiens
ttgcaaatttcagttagttcatg

SEQ ID NO: 7460013 - DNA, 23 bp, Homo sapiens
ttgcaaatttcagttagttcatg

SEQ ID NO: 7460014 - DNA, 22 bp, Homo sapiens
ttgcaactaaaagaacttgaca

SEQ ID NO: 7460015 - DNA, 22 bp, Homo sapiens
ttgcaactcttgaaaagcattg

SEQ ID NO: 7460016 - DNA, 22 bp, Homo sapiens
ttgcaacattgtaagtttatat

SEQ ID NO: 7460017 - DNA, 22 bp, Homo sapiens
ttgcaacattgtaagtttatat

SEQ ID NO: 7460018 - DNA, 22 bp, Homo sapiens
ttgcaacacaaagtttgattcc

SEQ ID NO: 7460019 - DNA, 22 bp, Homo sapiens
ttgcaacacaaagtttgattcc

SEQ ID NO: 7460020 - DNA, 22 bp, Homo sapiens
ttggtgggagagatgagggttg

SEQ ID NO: 7460021 - DNA, 22 bp, Homo sapiens
ttggtgggagaagactctggtt

SEQ ID NO: 7460022 - DNA, 22 bp, Homo sapiens
ttggtgggagagatgagggttg

SEQ ID NO: 7460023 - DNA, 22 bp, Homo sapiens
ttggtgggcacaggggagaagt

SEQ ID NO: 7460024 - DNA, 22 bp, Homo sapiens
ttggtgggcacaggggagaagt

SEQ ID NO: 7460025 - DNA, 22 bp, Homo sapiens
ttggtgggcacaggggagaagt

SEQ ID NO: 7460026 - DNA, 22 bp, Homo sapiens
ttggtgggagagatgagggttg

SEQ ID NO: 7460027 - DNA, 22 bp, Homo sapiens
ttggtgtacatctccccttcat

SEQ ID NO: 7460028 - DNA, 22 bp, Homo sapiens
ttggtgggttaatgagtgactg

SEQ ID NO: 7460029 - DNA, 22 bp, Homo sapiens
ttggtgggttaatgagtgactg

SEQ ID NO: 7460030 - DNA, 22 bp, Homo sapiens
ttggtgggttaatgagtgactg

SEQ ID NO: 7460031 - DNA, 22 bp, Homo sapiens
ttggtgggttaatgagtgactg

SEQ ID NO: 7460032 - DNA, 22 bp, Homo sapiens
ttggttaaaatcaaattaatca

SEQ ID NO: 7460033 - DNA, 22 bp, Homo sapiens
ttggtgtgccagagctgacatg

SEQ ID NO: 7460034 - DNA, 22 bp, Homo sapiens
ttggtgtcttttttatacatgt

SEQ ID NO: 7460035 - DNA, 22 bp, Homo sapiens
ttggttacaagtttgctctgcc

SEQ ID NO: 7460036 - DNA, 22 bp, Homo sapiens
ttggtgtgactaaggcagtgtg

SEQ ID NO: 7460037 - DNA, 22 bp, Homo sapiens
ttggtgtgactaaggcagtgtg

SEQ ID NO: 7460038 - DNA, 22 bp, Homo sapiens
ttggtgtgactaaggcagtgtg

SEQ ID NO: 7460039 - DNA, 23 bp, Homo sapiens
ttggtgtcagggaactttggaat

SEQ ID NO: 7460040 - DNA, 19 bp, Homo sapiens
ttggtggtggttttggttc

SEQ ID NO: 7460041 - DNA, 19 bp, Homo sapiens
ttggtggtggttttggttc

SEQ ID NO: 7460042 - DNA, 22 bp, Homo sapiens
ttggtgtcttttttatacatgt

SEQ ID NO: 7460043 - DNA, 22 bp, Homo sapiens
ttggtgccgaggatctgcaggt

SEQ ID NO: 7460044 - DNA, 22 bp, Homo sapiens
ttggtgccgaggatctgcaggt

SEQ ID NO: 7460045 - DNA, 19 bp, Homo sapiens
ttggtgcacacatgggccc

SEQ ID NO: 7460046 - DNA, 19 bp, Homo sapiens
ttggtgcacacatgggccc

SEQ ID NO: 7460047 - DNA, 22 bp, Homo sapiens
ttggtgcaaaattagagaacca

SEQ ID NO: 7460048 - DNA, 22 bp, Homo sapiens
ttggtgcaaaattagagaacca

SEQ ID NO: 7460049 - DNA, 22 bp, Homo sapiens
ttggtgggagagatgagggttg

SEQ ID NO: 7460050 - DNA, 22 bp, Homo sapiens
ttggtgggagaagactctggtt

SEQ ID NO: 7460051 - DNA, 22 bp, Homo sapiens
ttggtgggagaagactctggtt

SEQ ID NO: 7460052 - DNA, 22 bp, Homo sapiens
ttggtgggagaagactctggtt

SEQ ID NO: 7460053 - DNA, 22 bp, Homo sapiens
ttggtgacttgcagaaacagct

SEQ ID NO: 7460054 - DNA, 22 bp, Homo sapiens
ttggtgacttgcagaaacagct

SEQ ID NO: 7460055 - DNA, 22 bp, Homo sapiens
ttggtgagtatggacacagaga

SEQ ID NO: 7460056 - DNA, 22 bp, Homo sapiens
ttggtgagtgctatgtaccaca

SEQ ID NO: 7460057 - DNA, 22 bp, Homo sapiens
ttggtgaacacatacacatttt

SEQ ID NO: 7460058 - DNA, 22 bp, Homo sapiens
ttggtcttttctattaaatata

SEQ ID NO: 7460059 - DNA, 22 bp, Homo sapiens
ttggtgaattgagaccatttgt

SEQ ID NO: 7460060 - DNA, 22 bp, Homo sapiens
ttggtgaacacatacacatttt

SEQ ID NO: 7460061 - DNA, 22 bp, Homo sapiens
ttggggtgttggatggagcaag

SEQ ID NO: 7460062 - DNA, 22 bp, Homo sapiens
ttggggtgttggatggagcaag

SEQ ID NO: 7460063 - DNA, 22 bp, Homo sapiens
ttggtcagctcaatggagaggg

SEQ ID NO: 7460064 - DNA, 22 bp, Homo sapiens
ttggtcagtcagagaatggagt

SEQ ID NO: 7460065 - DNA, 22 bp, Homo sapiens
ttggtcatcttccgtttcctca

SEQ ID NO: 7460066 - DNA, 22 bp, Homo sapiens
ttggggtgttcagggtacttct

SEQ ID NO: 7460067 - DNA, 22 bp, Homo sapiens
ttggggtgttggatggagcaag

SEQ ID NO: 7460068 - DNA, 22 bp, Homo sapiens
ttggggtgttggatggagcaag

SEQ ID NO: 7460069 - DNA, 22 bp, Homo sapiens
ttggggtggaagtgaggatcat

SEQ ID NO: 7460070 - DNA, 18 bp, Homo sapiens
ttggggtgaggccaggaa

SEQ ID NO: 7460071 - DNA, 22 bp, Homo sapiens
ttggggtggaagtgaggatcat

SEQ ID NO: 7460072 - DNA, 22 bp, Homo sapiens
ttggggtgttcagggtacttct

SEQ ID NO: 7460073 - DNA, 22 bp, Homo sapiens
ttggggtgtgtgaaattatgtc

SEQ ID NO: 7460074 - DNA, 22 bp, Homo sapiens
ttggggtggaagtgaggatcat

SEQ ID NO: 7460075 - DNA, 22 bp, Homo sapiens
ttggtccattctggaagaaggg

SEQ ID NO: 7460076 - DNA, 22 bp, Homo sapiens
ttggtccaaagtcctctgagta

SEQ ID NO: 7460077 - DNA, 22 bp, Homo sapiens
ttggtcctcagtttccctatct

SEQ ID NO: 7460078 - DNA, 22 bp, Homo sapiens
ttggtccctcatggacacatga

SEQ ID NO: 7460079 - DNA, 22 bp, Homo sapiens
ttggtcctgcagaggggtctgg

SEQ ID NO: 7460080 - DNA, 22 bp, Homo sapiens
ttggtcctcagtttccctatct

SEQ ID NO: 7460081 - DNA, 22 bp, Homo sapiens
ttggtcctttatcctttaggca

SEQ ID NO: 7460082 - DNA, 22 bp, Homo sapiens
ttggtcctggtctaggcagagt

SEQ ID NO: 7460083 - DNA, 22 bp, Homo sapiens
ttggtctgcagggagggctgga

SEQ ID NO: 7460084 - DNA, 22 bp, Homo sapiens
ttggtctgcagggagggctgga

SEQ ID NO: 7460085 - DNA, 22 bp, Homo sapiens
ttggtctggagtatgatgataa

SEQ ID NO: 7460086 - DNA, 22 bp, Homo sapiens
ttggtcttgtggcatctttcca

SEQ ID NO: 7460087 - DNA, 22 bp, Homo sapiens
ttggtcttgagtggcttgttaa

SEQ ID NO: 7460088 - DNA, 22 bp, Homo sapiens
ttggtcttgagtggcttgttaa

SEQ ID NO: 7460089 - DNA, 20 bp, Homo sapiens
ttggttgagccagggcctgg

SEQ ID NO: 7460090 - DNA, 22 bp, Homo sapiens
ttggttcattttctcatctaga

SEQ ID NO: 7460091 - DNA, 22 bp, Homo sapiens
ttggttcaaagggattcaattt

SEQ ID NO: 7460092 - DNA, 22 bp, Homo sapiens
ttggtttccttaacagcctaaa

SEQ ID NO: 7460093 - DNA, 22 bp, Homo sapiens
ttggtttaggaactggcttgga

SEQ ID NO: 7460094 - DNA, 22 bp, Homo sapiens
ttggtttagagagtgtggttac

SEQ ID NO: 7460095 - DNA, 22 bp, Homo sapiens
ttggttttagttcttgctcatg

SEQ ID NO: 7460096 - DNA, 22 bp, Homo sapiens
ttggtttgttcaccatcaagca

SEQ ID NO: 7460097 - DNA, 22 bp, Homo sapiens
ttggtttgttcaccatcaagca

SEQ ID NO: 7460098 - DNA, 22 bp, Homo sapiens
ttggttttcaggggcaggataa

SEQ ID NO: 7460099 - DNA, 22 bp, Homo sapiens
ttggttttcaggggcaggataa

SEQ ID NO: 7460100 - DNA, 22 bp, Homo sapiens
ttggttttctaatgtattaagg

SEQ ID NO: 7460101 - DNA, 22 bp, Homo sapiens
ttggttttctaatgtattaagg

SEQ ID NO: 7460102 - DNA, 22 bp, Homo sapiens
ttgtctaaggaggtagaggact

SEQ ID NO: 7460103 - DNA, 22 bp, Homo sapiens
ttgtctaatgagctccacttca

SEQ ID NO: 7460104 - DNA, 22 bp, Homo sapiens
ttgtcgggcttacgcagggcca

SEQ ID NO: 7460105 - DNA, 22 bp, Homo sapiens
ttgtctaatgagctccacttca

SEQ ID NO: 7460106 - DNA, 22 bp, Homo sapiens
ttgtctaatgagctccacttca

SEQ ID NO: 7460107 - DNA, 22 bp, Homo sapiens
ttgtctatacatcaataatgat

SEQ ID NO: 7460108 - DNA, 22 bp, Homo sapiens
ttgtctactaagaaagacaatt

SEQ ID NO: 7460109 - DNA, 22 bp, Homo sapiens
ttgtctactaagaaagacaatt

SEQ ID NO: 7460110 - DNA, 17 bp, Homo sapiens
ttgtctacctagcagaa

SEQ ID NO: 7460111 - DNA, 22 bp, Homo sapiens
ttgtcgggcttacgcagggcca

SEQ ID NO: 7460112 - DNA, 22 bp, Homo sapiens
ttgtcgggcttacgcagggcca

SEQ ID NO: 7460113 - DNA, 21 bp, Homo sapiens
ttgtcctttagggcttgtctg

SEQ ID NO: 7460114 - DNA, 22 bp, Homo sapiens
ttgtcctttaatgtttagtatt

SEQ ID NO: 7460115 - DNA, 22 bp, Homo sapiens
ttgtcctttaatgtttagtatt

SEQ ID NO: 7460116 - DNA, 22 bp, Homo sapiens
ttgtccttgttcctaacccctc

SEQ ID NO: 7460117 - DNA, 22 bp, Homo sapiens
ttgtcctttaatgtttagtatt

SEQ ID NO: 7460118 - DNA, 22 bp, Homo sapiens
ttgtcctttaatgtttagtatt

SEQ ID NO: 7460119 - DNA, 22 bp, Homo sapiens
ttgtccttgtgatagtttgctg

SEQ ID NO: 7460120 - DNA, 22 bp, Homo sapiens
ttgtccttgtgcaagacccagc

SEQ ID NO: 7460121 - DNA, 22 bp, Homo sapiens
ttgtccttgtgcaagacccagc

SEQ ID NO: 7460122 - DNA, 22 bp, Homo sapiens
ttgtccttggatgaagctggga

SEQ ID NO: 7460123 - DNA, 22 bp, Homo sapiens
ttgtccttggctctagaggtga

SEQ ID NO: 7460124 - DNA, 22 bp, Homo sapiens
ttgtccttggctctagaggtga

SEQ ID NO: 7460125 - DNA, 22 bp, Homo sapiens
ttggttttgggatgtacaaagg

SEQ ID NO: 7460126 - DNA, 22 bp, Homo sapiens
ttggttttgaaatagcttattg

SEQ ID NO: 7460127 - DNA, 22 bp, Homo sapiens
ttggttttgggatgtacaaagg

SEQ ID NO: 7460128 - DNA, 22 bp, Homo sapiens
ttggttttgggatgtacaaagg

SEQ ID NO: 7460129 - DNA, 22 bp, Homo sapiens
ttggttttgggatgtacaaagg

SEQ ID NO: 7460130 - DNA, 22 bp, Homo sapiens
ttggttttgggatgtacaaagg

SEQ ID NO: 7460131 - DNA, 22 bp, Homo sapiens
ttggttttctcagctggaccat

SEQ ID NO: 7460132 - DNA, 21 bp, Homo sapiens
ttggttttctgagtctgtaca

SEQ ID NO: 7460133 - DNA, 21 bp, Homo sapiens
ttggttttctgagtctgtaca

SEQ ID NO: 7460134 - DNA, 22 bp, Homo sapiens
ttggttttcatagctccactct

SEQ ID NO: 7460135 - DNA, 22 bp, Homo sapiens
ttggttttcaggggcaggataa

SEQ ID NO: 7460136 - DNA, 22 bp, Homo sapiens
ttggttttctatcctctgcaat

SEQ ID NO: 7460137 - DNA, 22 bp, Homo sapiens
ttggttttctcagctggaccat

SEQ ID NO: 7460138 - DNA, 23 bp, Homo sapiens
ttgtaaaacagtgtgacggttcc

SEQ ID NO: 7460139 - DNA, 23 bp, Homo sapiens
ttgtaaaacagtgtgacggttcc

SEQ ID NO: 7460140 - DNA, 23 bp, Homo sapiens
ttgtaaaacagtgtgacggttcc

SEQ ID NO: 7460141 - DNA, 22 bp, Homo sapiens
ttgtccttcatgttggatttat

SEQ ID NO: 7460142 - DNA, 22 bp, Homo sapiens
ttgtccttcatgttggatttat

SEQ ID NO: 7460143 - DNA, 22 bp, Homo sapiens
ttgtccttcatgttggatttat

SEQ ID NO: 7460144 - DNA, 22 bp, Homo sapiens
ttgtccttagatgtggcctcca

SEQ ID NO: 7460145 - DNA, 22 bp, Homo sapiens
ttgtccttccagactcttccac

SEQ ID NO: 7460146 - DNA, 23 bp, Homo sapiens
ttgtccttctgaaatatatctgg

SEQ ID NO: 7460147 - DNA, 22 bp, Homo sapiens
ttgtccttcttcattcagtccc

SEQ ID NO: 7460148 - DNA, 23 bp, Homo sapiens
ttgtccttctgaaatatatctgg

SEQ ID NO: 7460149 - DNA, 23 bp, Homo sapiens
ttgtccttctgaaatatatctgg

SEQ ID NO: 7460150 - DNA, 23 bp, Homo sapiens
ttgtccttctgaaatatatctgg

SEQ ID NO: 7460151 - DNA, 22 bp, Homo sapiens
ttgtgaatagtgccgctataaa

SEQ ID NO: 7460152 - DNA, 22 bp, Homo sapiens
ttgtgaatagtgccgctataaa

SEQ ID NO: 7460153 - DNA, 22 bp, Homo sapiens
ttgtgaatagtgccgctataaa

SEQ ID NO: 7460154 - DNA, 22 bp, Homo sapiens
ttgtgaatagtgccgctataaa

SEQ ID NO: 7460155 - DNA, 22 bp, Homo sapiens
ttgtgaatagtgccgcaataaa

SEQ ID NO: 7460156 - DNA, 22 bp, Homo sapiens
ttgtgaatagtgccgcaataaa

SEQ ID NO: 7460157 - DNA, 22 bp, Homo sapiens
ttgtgaatagtgccgcaataaa

SEQ ID NO: 7460158 - DNA, 22 bp, Homo sapiens
ttgtgaatagtgctgcaataaa

SEQ ID NO: 7460159 - DNA, 22 bp, Homo sapiens
ttgtgaatagtgctgcagtaaa

SEQ ID NO: 7460160 - DNA, 22 bp, Homo sapiens
ttgtgaatggtgccgcaataaa

SEQ ID NO: 7460161 - DNA, 22 bp, Homo sapiens
ttgtgaatggtgccgcaataaa

SEQ ID NO: 7460162 - DNA, 22 bp, Homo sapiens
ttgtgaatgcttaatatgtttc

SEQ ID NO: 7460163 - DNA, 22 bp, Homo sapiens
ttgtgaatagtgccgctataaa

SEQ ID NO: 7460164 - DNA, 22 bp, Homo sapiens
ttgtgaatagtgctgcaataaa

SEQ ID NO: 7460165 - DNA, 22 bp, Homo sapiens
ttgtgaatagtgccgctataaa

SEQ ID NO: 7460166 - DNA, 22 bp, Homo sapiens
ttgtgaatagtgccgctataaa

SEQ ID NO: 7460167 - DNA, 22 bp, Homo sapiens
ttgtctgctcctcccagcctca

SEQ ID NO: 7460168 - DNA, 22 bp, Homo sapiens
ttgtctgcattgtttctatggg

SEQ ID NO: 7460169 - DNA, 22 bp, Homo sapiens
ttgtctgcattgtttctatggg

SEQ ID NO: 7460170 - DNA, 22 bp, Homo sapiens
ttgtctggtcaaatcacttgta

SEQ ID NO: 7460171 - DNA, 22 bp, Homo sapiens
ttgtctgcttgttcagatggaa

SEQ ID NO: 7460172 - DNA, 22 bp, Homo sapiens
ttgtctggtcaaatcacttgta

SEQ ID NO: 7460173 - DNA, 22 bp, Homo sapiens
ttgtctgcttgatgccaagcat

SEQ ID NO: 7460174 - DNA, 22 bp, Homo sapiens
ttgtctgtaaagacggccacca

SEQ ID NO: 7460175 - DNA, 22 bp, Homo sapiens
ttgtctgtaaagacggccacca

SEQ ID NO: 7460176 - DNA, 22 bp, Homo sapiens
ttgtctgtaaagacggccacca

SEQ ID NO: 7460177 - DNA, 22 bp, Homo sapiens
ttgtgaaatcgtgtttggaagc

SEQ ID NO: 7460178 - DNA, 22 bp, Homo sapiens
ttgtgaatagtgccacaataaa

SEQ ID NO: 7460179 - DNA, 22 bp, Homo sapiens
ttgtgaatagtgccacaataaa

SEQ ID NO: 7460180 - DNA, 22 bp, Homo sapiens
ttgtgaatagtgccgcaataaa

SEQ ID NO: 7460181 - DNA, 22 bp, Homo sapiens
ttgtgaatagtgccgcaataaa

SEQ ID NO: 7460182 - DNA, 22 bp, Homo sapiens
ttgtgaaatgtttcaaaatagt

SEQ ID NO: 7460183 - DNA, 22 bp, Homo sapiens
ttgtgaagtgttctgagacagg

SEQ ID NO: 7460184 - DNA, 22 bp, Homo sapiens
ttgtgaagtgttctgagacagg

SEQ ID NO: 7460185 - DNA, 22 bp, Homo sapiens
ttgtgaagtgttctgagacagg

SEQ ID NO: 7460186 - DNA, 22 bp, Homo sapiens
ttgtgaaatgtttcaaaatagt

SEQ ID NO: 7460187 - DNA, 22 bp, Homo sapiens
ttgtgaaatgtttcaaaatagt

SEQ ID NO: 7460188 - DNA, 22 bp, Homo sapiens
ttgtgaaatgtttcaaaatagt

SEQ ID NO: 7460189 - DNA, 22 bp, Homo sapiens
ttgtctgagagatggcagaggt

SEQ ID NO: 7460190 - DNA, 22 bp, Homo sapiens
ttgtctgagggtttgagagaat

SEQ ID NO: 7460191 - DNA, 22 bp, Homo sapiens
ttgtctgatgttccctcatgat

SEQ ID NO: 7460192 - DNA, 22 bp, Homo sapiens
ttgtctgcatgattctaggcag

SEQ ID NO: 7460193 - DNA, 22 bp, Homo sapiens
ttgtctgcatgattctaggcag

SEQ ID NO: 7460194 - DNA, 22 bp, Homo sapiens
ttgtctgattgctggattagca

SEQ ID NO: 7460195 - DNA, 22 bp, Homo sapiens
ttgtctgatgttccctcatgat

SEQ ID NO: 7460196 - DNA, 22 bp, Homo sapiens
ttgtctgagaaagtgagttgct

SEQ ID NO: 7460197 - DNA, 22 bp, Homo sapiens
ttgtctgagaaagtgagttgct

SEQ ID NO: 7460198 - DNA, 22 bp, Homo sapiens
ttgtctgagagatggcagaggt

SEQ ID NO: 7460199 - DNA, 22 bp, Homo sapiens
ttgtctgagggtttgagagaat

SEQ ID NO: 7460200 - DNA, 22 bp, Homo sapiens
ttgtctgaatatgtatgtatcc

SEQ ID NO: 7460201 - DNA, 22 bp, Homo sapiens
ttgtctgaatctggagctctct

SEQ ID NO: 7460202 - DNA, 22 bp, Homo sapiens
ttgtctgacttctttagttact

SEQ ID NO: 7460203 - DNA, 22 bp, Homo sapiens
ttgtctgaattcttctaggcag

SEQ ID NO: 7460204 - DNA, 22 bp, Homo sapiens
ttgtctgaattcttctaggcag

SEQ ID NO: 7460205 - DNA, 22 bp, Homo sapiens
ttgtctctaagtgtgatcttca

SEQ ID NO: 7460206 - DNA, 22 bp, Homo sapiens
ttgtctctaagtgtgatcttca

SEQ ID NO: 7460207 - DNA, 22 bp, Homo sapiens
ttgtctctaagtgtgatcttca

SEQ ID NO: 7460208 - DNA, 22 bp, Homo sapiens
ttgtctctcattcctgcaactc

SEQ ID NO: 7460209 - DNA, 22 bp, Homo sapiens
ttgtctctacagagagtagtag

SEQ ID NO: 7460210 - DNA, 22 bp, Homo sapiens
ttgtctctcattcctgcaactc

SEQ ID NO: 7460211 - DNA, 22 bp, Homo sapiens
ttgtctctcattcctgcaactc

SEQ ID NO: 7460212 - DNA, 22 bp, Homo sapiens
ttgtctctgccatgcttgaggg

SEQ ID NO: 7460213 - DNA, 22 bp, Homo sapiens
ttgtctctcattcctgcaactc

SEQ ID NO: 7460214 - DNA, 22 bp, Homo sapiens
ttgtctgaaaaggtaaatattt

SEQ ID NO: 7460215 - DNA, 22 bp, Homo sapiens
ttgtctgaaagatcattacatt

SEQ ID NO: 7460216 - DNA, 22 bp, Homo sapiens
ttgtctgaaccatctccctggc

SEQ ID NO: 7460217 - DNA, 22 bp, Homo sapiens
ttgtctgaagtcacacagatgc

SEQ ID NO: 7460218 - DNA, 22 bp, Homo sapiens
ttgtctctgccatgcttgaggg

SEQ ID NO: 7460219 - DNA, 22 bp, Homo sapiens
ttgtctctggaaggaaaaagca

SEQ ID NO: 7460220 - DNA, 22 bp, Homo sapiens
ttgtctctgtgtggcttcccta

SEQ ID NO: 7460221 - DNA, 22 bp, Homo sapiens
ttgtctctgtgtggcttcccta

SEQ ID NO: 7460222 - DNA, 22 bp, Homo sapiens
ttgtctctggaaggaaaaagca

SEQ ID NO: 7460223 - DNA, 22 bp, Homo sapiens
ttgtctctgggacatggtatta

SEQ ID NO: 7460224 - DNA, 22 bp, Homo sapiens
ttgtttaaagaacttctgactt

SEQ ID NO: 7460225 - DNA, 22 bp, Homo sapiens
ttgtttaaaatgtagcaagaaa

SEQ ID NO: 7460226 - DNA, 22 bp, Homo sapiens
ttgttattattactaagtcttc

SEQ ID NO: 7460227 - DNA, 22 bp, Homo sapiens
ttgttattattactaagtcttc

SEQ ID NO: 7460228 - DNA, 22 bp, Homo sapiens
ttgttattattactaagtcttc

SEQ ID NO: 7460229 - DNA, 22 bp, Homo sapiens
ttgttataaagactaaatatgt

SEQ ID NO: 7460230 - DNA, 22 bp, Homo sapiens
ttgttatcaatgaatcaaaact

SEQ ID NO: 7460231 - DNA, 22 bp, Homo sapiens
ttgttatctgcgtgaagaaaat

SEQ ID NO: 7460232 - DNA, 22 bp, Homo sapiens
ttgttagtttatataatgtagt

SEQ ID NO: 7460233 - DNA, 22 bp, Homo sapiens
ttgttagtgcaatgtttggtga

SEQ ID NO: 7460234 - DNA, 22 bp, Homo sapiens
ttgttagctgatcttgagtgca

SEQ ID NO: 7460235 - DNA, 22 bp, Homo sapiens
ttgttagtaagtgacaaaaatc

SEQ ID NO: 7460236 - DNA, 22 bp, Homo sapiens
ttgttagtaagtgacaaaaatc

SEQ ID NO: 7460237 - DNA, 22 bp, Homo sapiens
ttgtttcatggggatgtttatt

SEQ ID NO: 7460238 - DNA, 22 bp, Homo sapiens
ttgtttaagccacccaatctgt

SEQ ID NO: 7460239 - DNA, 22 bp, Homo sapiens
ttgtttaagccacccaatctgt

SEQ ID NO: 7460240 - DNA, 22 bp, Homo sapiens
ttgtttaagccacccaatctgt

SEQ ID NO: 7460241 - DNA, 22 bp, Homo sapiens
ttgtttaagccacccaatctgt

SEQ ID NO: 7460242 - DNA, 22 bp, Homo sapiens
ttgtttaagccacccaatctgt

SEQ ID NO: 7460243 - DNA, 22 bp, Homo sapiens
ttgtttaagccacccaatctgt

SEQ ID NO: 7460244 - DNA, 20 bp, Homo sapiens
ttgtttaaaggtgaagaggc

SEQ ID NO: 7460245 - DNA, 22 bp, Homo sapiens
ttgtttaaagaacttctgactt

SEQ ID NO: 7460246 - DNA, 22 bp, Homo sapiens
ttgtttcattttggctaaactg

SEQ ID NO: 7460247 - DNA, 22 bp, Homo sapiens
ttgtttccagcaaatagtccat

SEQ ID NO: 7460248 - DNA, 22 bp, Homo sapiens
ttgtttccagcaaatagtccat

SEQ ID NO: 7460249 - DNA, 22 bp, Homo sapiens
ttgtttcattttggctaaactg

SEQ ID NO: 7460250 - DNA, 22 bp, Homo sapiens
ttgtttccataattaagtgtga

SEQ ID NO: 7460251 - DNA, 22 bp, Homo sapiens
ttgtttccataattaagtgtga

SEQ ID NO: 7460252 - DNA, 22 bp, Homo sapiens
ttgtttccatgcatgcatttat

SEQ ID NO: 7460253 - DNA, 22 bp, Homo sapiens
ttgtttccatgcatgcatttat

SEQ ID NO: 7460254 - DNA, 22 bp, Homo sapiens
ttgtttccattgcagactgtgt

SEQ ID NO: 7460255 - DNA, 21 bp, Homo sapiens
ttgtttcccagagctcgctcc

SEQ ID NO: 7460256 - DNA, 21 bp, Homo sapiens
ttgtttcccagagctcgctcc

SEQ ID NO: 7460257 - DNA, 21 bp, Homo sapiens
ttgtttcccagagctcgctcc

SEQ ID NO: 7460258 - DNA, 22 bp, Homo sapiens
ttgtttccattgcagactgtgt

SEQ ID NO: 7460259 - DNA, 22 bp, Homo sapiens
ttgtttccattgcagactgtgt

SEQ ID NO: 7460260 - DNA, 22 bp, Homo sapiens
ttgtttccattgcagactgtgt

SEQ ID NO: 7460261 - DNA, 22 bp, Homo sapiens
ttgttaaaaatagatttccagg

SEQ ID NO: 7460262 - DNA, 22 bp, Homo sapiens
ttgtgttttcttatggcataaa

SEQ ID NO: 7460263 - DNA, 22 bp, Homo sapiens
ttgttaaaaatagatttccagg

SEQ ID NO: 7460264 - DNA, 22 bp, Homo sapiens
ttgttaaaaatagatttccagg

SEQ ID NO: 7460265 - DNA, 22 bp, Homo sapiens
ttgttaaaaatagatttccagg

SEQ ID NO: 7460266 - DNA, 22 bp, Homo sapiens
ttgtgttttcttatggcataaa

SEQ ID NO: 7460267 - DNA, 22 bp, Homo sapiens
ttgtgttttcttatggcataaa

SEQ ID NO: 7460268 - DNA, 22 bp, Homo sapiens
ttgttacagcagcaatagaaaa

SEQ ID NO: 7460269 - DNA, 22 bp, Homo sapiens
ttgttaaaaatagatttccagg

SEQ ID NO: 7460270 - DNA, 22 bp, Homo sapiens
ttgttaaaaatagatttccagg

SEQ ID NO: 7460271 - DNA, 22 bp, Homo sapiens
ttgttaaaaatagatttccagg

SEQ ID NO: 7460272 - DNA, 22 bp, Homo sapiens
ttgttaaaaatagatttccagg

SEQ ID NO: 7460273 - DNA, 22 bp, Homo sapiens
ttgttacagcagtgatttcaga

SEQ ID NO: 7460274 - DNA, 22 bp, Homo sapiens
ttgttacagcagtgatttcaga

SEQ ID NO: 7460275 - DNA, 22 bp, Homo sapiens
ttgttacagcagcaatagaaaa

SEQ ID NO: 7460276 - DNA, 22 bp, Homo sapiens
ttgttacagcagtgatttcaga

SEQ ID NO: 7460277 - DNA, 22 bp, Homo sapiens
ttgttacagcagtgatttcaga

SEQ ID NO: 7460278 - DNA, 22 bp, Homo sapiens
ttgttacaggtcctagtggctg

SEQ ID NO: 7460279 - DNA, 22 bp, Homo sapiens
ttgttacaggtcctagtggctg

SEQ ID NO: 7460280 - DNA, 22 bp, Homo sapiens
ttgttacatacagcagaacata

SEQ ID NO: 7460281 - DNA, 22 bp, Homo sapiens
ttgttacatacagcagaacata

SEQ ID NO: 7460282 - DNA, 22 bp, Homo sapiens
ttgttacatacagcagaacata

SEQ ID NO: 7460283 - DNA, 22 bp, Homo sapiens
ttgttacatcttatgtaagtgg

SEQ ID NO: 7460284 - DNA, 22 bp, Homo sapiens
ttgttacatcttatgtaagtgg

SEQ ID NO: 7460285 - DNA, 22 bp, Homo sapiens
ttgttacatcttatgtaagtgg

SEQ ID NO: 7460286 - DNA, 20 bp, Homo sapiens
ttgttagaggaatgccatag

SEQ ID NO: 7460287 - DNA, 20 bp, Homo sapiens
ttgttagaggaatgccatag

SEQ ID NO: 7460288 - DNA, 20 bp, Homo sapiens
ttgttagaggaatgccatag

SEQ ID NO: 7460289 - DNA, 22 bp, Homo sapiens
ttgttagatatttcttagaaga

SEQ ID NO: 7460290 - DNA, 22 bp, Homo sapiens
ttgttagatatttcttagaaga

SEQ ID NO: 7460291 - DNA, 22 bp, Homo sapiens
ttgttagcatgcttaatggata

SEQ ID NO: 7460292 - DNA, 20 bp, Homo sapiens
ttgttagaggaatgccatag

SEQ ID NO: 7460293 - DNA, 20 bp, Homo sapiens
ttgttagaggaatgccatag

SEQ ID NO: 7460294 - DNA, 21 bp, Homo sapiens
ttgttacattcttatggcata

SEQ ID NO: 7460295 - DNA, 22 bp, Homo sapiens
ttgttactaagcctttaaatag

SEQ ID NO: 7460296 - DNA, 22 bp, Homo sapiens
ttgttactaagcctttaaatag

SEQ ID NO: 7460297 - DNA, 22 bp, Homo sapiens
ttgttactgttctacatacagt

SEQ ID NO: 7460298 - DNA, 22 bp, Homo sapiens
ttgttactgttctacatacagt

SEQ ID NO: 7460299 - DNA, 22 bp, Homo sapiens
ttgttacttgcatgtagactaa

SEQ ID NO: 7460300 - DNA, 22 bp, Homo sapiens
ttgttacatcttatgtaagtgg

SEQ ID NO: 7460301 - DNA, 22 bp, Homo sapiens
ttgttacatcttatgtaagtgg

SEQ ID NO: 7460302 - DNA, 22 bp, Homo sapiens
ttgttacatggacaactgtatg

SEQ ID NO: 7460303 - DNA, 22 bp, Homo sapiens
ttgttacatggacaactgtatg

SEQ ID NO: 7460304 - DNA, 22 bp, Homo sapiens
ttgttacatggacaactgtatg

SEQ ID NO: 7460305 - DNA, 22 bp, Homo sapiens
ttgttacatggacaactgtatg

SEQ ID NO: 7460306 - DNA, 22 bp, Homo sapiens
ttgttacatggacaactgtatg

SEQ ID NO: 7460307 - DNA, 21 bp, Homo sapiens
ttgttacattcttatggcata

SEQ ID NO: 7460308 - DNA, 22 bp, Homo sapiens
ttgtgtgtgagccttcaccaca

SEQ ID NO: 7460309 - DNA, 22 bp, Homo sapiens
ttgtgtgtgagccttcaccaca

SEQ ID NO: 7460310 - DNA, 22 bp, Homo sapiens
ttgtgtgtgagccttcaccaca

SEQ ID NO: 7460311 - DNA, 22 bp, Homo sapiens
ttgtgtgtgagccttcaccaca

SEQ ID NO: 7460312 - DNA, 22 bp, Homo sapiens
ttgtgtgtgagccttcaccaca

SEQ ID NO: 7460313 - DNA, 22 bp, Homo sapiens
ttgtgtgtcttcttcactgccc

SEQ ID NO: 7460314 - DNA, 22 bp, Homo sapiens
ttgtgtgtcttcttcactgccc

SEQ ID NO: 7460315 - DNA, 22 bp, Homo sapiens
ttgtgtgtcttcttcactgccc

SEQ ID NO: 7460316 - DNA, 19 bp, Homo sapiens
ttgtgtgtcagtcagagtt

SEQ ID NO: 7460317 - DNA, 22 bp, Homo sapiens
ttgtgtgtcttcttcactgccc

SEQ ID NO: 7460318 - DNA, 19 bp, Homo sapiens
ttgtgtgtcagtcagagtt

SEQ ID NO: 7460319 - DNA, 19 bp, Homo sapiens
ttgtgtgtcagtcagagtt

SEQ ID NO: 7460320 - DNA, 19 bp, Homo sapiens
ttgtgactggctctgcata

SEQ ID NO: 7460321 - DNA, 22 bp, Homo sapiens
ttgtgacattgattaaactatg

SEQ ID NO: 7460322 - DNA, 22 bp, Homo sapiens
ttgtgacattgattaaactatg

SEQ ID NO: 7460323 - DNA, 22 bp, Homo sapiens
ttgtgacattgattaaactatg

SEQ ID NO: 7460324 - DNA, 19 bp, Homo sapiens
ttgtgtgtcagtcagagtt

SEQ ID NO: 7460325 - DNA, 22 bp, Homo sapiens
ttgtgagaaatcttaatcccaa

SEQ ID NO: 7460326 - DNA, 22 bp, Homo sapiens
ttgtgagaaatcttaatcccaa

SEQ ID NO: 7460327 - DNA, 22 bp, Homo sapiens
ttgtgaatggtgccgcaataaa

SEQ ID NO: 7460328 - DNA, 22 bp, Homo sapiens
ttgtgaatggtgccgcaataaa

SEQ ID NO: 7460329 - DNA, 22 bp, Homo sapiens
ttgtgaatggtgccgcaataaa

SEQ ID NO: 7460330 - DNA, 22 bp, Homo sapiens
ttgtgacaatacagcatggaga

SEQ ID NO: 7460331 - DNA, 22 bp, Homo sapiens
ttgtgacagagatcacgtggcc

SEQ ID NO: 7460332 - DNA, 22 bp, Homo sapiens
ttgtgacacatgccgtcctgag

SEQ ID NO: 7460333 - DNA, 22 bp, Homo sapiens
ttgtgacacatgccgtcctgag

SEQ ID NO: 7460334 - DNA, 22 bp, Homo sapiens
ttgtgtgtgtaactttatgaga

SEQ ID NO: 7460335 - DNA, 22 bp, Homo sapiens
ttgtgtgtttgtagaaaatcca

SEQ ID NO: 7460336 - DNA, 22 bp, Homo sapiens
ttgtgtgtgtaactttatgaga

SEQ ID NO: 7460337 - DNA, 22 bp, Homo sapiens
ttgtgtgtgtaactttatgaga

SEQ ID NO: 7460338 - DNA, 22 bp, Homo sapiens
ttgtgtgtgtaactttatgaga

SEQ ID NO: 7460339 - DNA, 22 bp, Homo sapiens
ttgtgtgtgtaactttatgaga

SEQ ID NO: 7460340 - DNA, 22 bp, Homo sapiens
ttgtgttaaggtgcatctagtg

SEQ ID NO: 7460341 - DNA, 22 bp, Homo sapiens
ttgtgtgtttgtagaaaatcca

SEQ ID NO: 7460342 - DNA, 22 bp, Homo sapiens
ttgtgttaaggtgcatctagtg

SEQ ID NO: 7460343 - DNA, 22 bp, Homo sapiens
ttgtgttaaggtgcatctagtg

SEQ ID NO: 7460344 - DNA, 22 bp, Homo sapiens
ttgtgttaaggtgcatctagtg

SEQ ID NO: 7460345 - DNA, 22 bp, Homo sapiens
ttgtgttaaggtgcatctagtg

SEQ ID NO: 7460346 - DNA, 22 bp, Homo sapiens
ttgtgtgtgtaactttatgaga

SEQ ID NO: 7460347 - DNA, 22 bp, Homo sapiens
ttgtgtgtttgtagaaaatcca

SEQ ID NO: 7460348 - DNA, 22 bp, Homo sapiens
ttgtgtttctggccaagatgga

SEQ ID NO: 7460349 - DNA, 22 bp, Homo sapiens
ttgtgtttctggccaagatgga

SEQ ID NO: 7460350 - DNA, 22 bp, Homo sapiens
ttgtgtttctggccaagatgga

SEQ ID NO: 7460351 - DNA, 22 bp, Homo sapiens
ttgtgtttctggccaagatgga

SEQ ID NO: 7460352 - DNA, 22 bp, Homo sapiens
ttgtgtttctggccaagatgga

SEQ ID NO: 7460353 - DNA, 22 bp, Homo sapiens
ttgtgttttcttatggcataaa

SEQ ID NO: 7460354 - DNA, 22 bp, Homo sapiens
ttgtgtttctggccaagatgga

SEQ ID NO: 7460355 - DNA, 22 bp, Homo sapiens
ttgtgtttctgtgatatgtaaa

SEQ ID NO: 7460356 - DNA, 22 bp, Homo sapiens
ttgtgtttctgtgatatgtaaa

SEQ ID NO: 7460357 - DNA, 22 bp, Homo sapiens
ttgtgtttctgtgatatgtaaa

SEQ ID NO: 7460358 - DNA, 22 bp, Homo sapiens
ttgtgtttctgtgatatgtaaa

SEQ ID NO: 7460359 - DNA, 22 bp, Homo sapiens
ttgtgtttctggccaagatgga

SEQ ID NO: 7460360 - DNA, 22 bp, Homo sapiens
ttgtgtttctggccaagatgga

SEQ ID NO: 7460361 - DNA, 22 bp, Homo sapiens
ttgtgtttctggccaagatgga

SEQ ID NO: 7460362 - DNA, 22 bp, Homo sapiens
ttgtgtttcccttgcatattcc

SEQ ID NO: 7460363 - DNA, 22 bp, Homo sapiens
ttgtgtttcccttgcatattcc

SEQ ID NO: 7460364 - DNA, 21 bp, Homo sapiens
ttgtgtttccccagtcacttt

SEQ ID NO: 7460365 - DNA, 22 bp, Homo sapiens
ttgtgttaaggtgcatctagtg

SEQ ID NO: 7460366 - DNA, 22 bp, Homo sapiens
ttgtgttgcatcttattcttct

SEQ ID NO: 7460367 - DNA, 22 bp, Homo sapiens
ttgttttattctgcaatttccc

SEQ ID NO: 7460368 - DNA, 22 bp, Homo sapiens
ttgttttatctttctacagact

SEQ ID NO: 7460369 - DNA, 22 bp, Homo sapiens
ttgttttattctgcaatttccc

SEQ ID NO: 7460370 - DNA, 22 bp, Homo sapiens
ttgttttctccactgcatctta

SEQ ID NO: 7460371 - DNA, 22 bp, Homo sapiens
ttgttttctccactgcatctta

SEQ ID NO: 7460372 - DNA, 22 bp, Homo sapiens
ttgttttcctgggataccaacc

SEQ ID NO: 7460373 - DNA, 22 bp, Homo sapiens
ttgttttcctgggataccaacc

SEQ ID NO: 7460374 - DNA, 22 bp, Homo sapiens
ttgttttcctgggataccaacc

SEQ ID NO: 7460375 - DNA, 22 bp, Homo sapiens
ttgttttcagggtgtcattcac

SEQ ID NO: 7460376 - DNA, 22 bp, Homo sapiens
ttgttttcagggtgtcattcac

SEQ ID NO: 7460377 - DNA, 22 bp, Homo sapiens
ttgttttcacagctttgcccgg

SEQ ID NO: 7460378 - DNA, 22 bp, Homo sapiens
ttgttttcacagctttgcccgg

SEQ ID NO: 7460379 - DNA, 22 bp, Homo sapiens
ttgtttttaaacatgtgactga

SEQ ID NO: 7460380 - DNA, 22 bp, Homo sapiens
ttgtttttaaacatgtgactga

SEQ ID NO: 7460381 - DNA, 22 bp, Homo sapiens
ttgtttttaaacatgtgactga

SEQ ID NO: 7460382 - DNA, 22 bp, Homo sapiens
ttgtttttaaacatgtgactga

SEQ ID NO: 7460383 - DNA, 22 bp, Homo sapiens
ttgtttttaaacatgtgactga

SEQ ID NO: 7460384 - DNA, 22 bp, Homo sapiens
ttgttttggagatgagctaaaa

SEQ ID NO: 7460385 - DNA, 22 bp, Homo sapiens
ttgttttggagatgagctaaaa

SEQ ID NO: 7460386 - DNA, 22 bp, Homo sapiens
ttgttttggagatgagctaaaa

SEQ ID NO: 7460387 - DNA, 22 bp, Homo sapiens
ttgttttggagatgagctaaaa

SEQ ID NO: 7460388 - DNA, 22 bp, Homo sapiens
ttgttttgagccctggacttgc

SEQ ID NO: 7460389 - DNA, 22 bp, Homo sapiens
ttgttttggaagaacttactct

SEQ ID NO: 7460390 - DNA, 22 bp, Homo sapiens
ttgttttggaagaacttactct

SEQ ID NO: 7460391 - DNA, 22 bp, Homo sapiens
ttgttttggaagaacttactct

SEQ ID NO: 7460392 - DNA, 22 bp, Homo sapiens
ttgttttggaagaacttactct

SEQ ID NO: 7460393 - DNA, 22 bp, Homo sapiens
ttgttttggaagaacttactct

SEQ ID NO: 7460394 - DNA, 22 bp, Homo sapiens
ttgttttgctaaagggtcatca

SEQ ID NO: 7460395 - DNA, 22 bp, Homo sapiens
ttgttttgctaaagggtcatca

SEQ ID NO: 7460396 - DNA, 22 bp, Homo sapiens
ttgttttgagccctggacttgc

SEQ ID NO: 7460397 - DNA, 22 bp, Homo sapiens
ttgttttcttgtatatagcctc

SEQ ID NO: 7460398 - DNA, 22 bp, Homo sapiens
ttgttttctccactgcatctta

SEQ ID NO: 7460399 - DNA, 22 bp, Homo sapiens
ttgttttctccactgcatctta

SEQ ID NO: 7460400 - DNA, 22 bp, Homo sapiens
ttgttttagtaggtacactgag

SEQ ID NO: 7460401 - DNA, 22 bp, Homo sapiens
ttgttttagtaggtacactgag

SEQ ID NO: 7460402 - DNA, 22 bp, Homo sapiens
ttgttttagtaggtacactgag

SEQ ID NO: 7460403 - DNA, 22 bp, Homo sapiens
ttgttttagtaggtacactgag

SEQ ID NO: 7460404 - DNA, 22 bp, Homo sapiens
ttgttttagtaggtacactgag

SEQ ID NO: 7460405 - DNA, 22 bp, Homo sapiens
ttgttttagtaggtacactgag

SEQ ID NO: 7460406 - DNA, 22 bp, Homo sapiens
ttgttttatctttctacagact

SEQ ID NO: 7460407 - DNA, 22 bp, Homo sapiens
ttgttttatctttctacagact

SEQ ID NO: 7460408 - DNA, 22 bp, Homo sapiens
ttgttttaagccagtctgccta

SEQ ID NO: 7460409 - DNA, 22 bp, Homo sapiens
ttgttttaatgagggaggttga

SEQ ID NO: 7460410 - DNA, 22 bp, Homo sapiens
ttgttttaatgagggaggttga

SEQ ID NO: 7460411 - DNA, 18 bp, Homo sapiens
ttgttttaagactctgtc

SEQ ID NO: 7460412 - DNA, 18 bp, Homo sapiens
ttgttttaagactctgtc

SEQ ID NO: 7460413 - DNA, 18 bp, Homo sapiens
ttgttttaagactctgtc

SEQ ID NO: 7460414 - DNA, 22 bp, Homo sapiens
ttgttttaacgactcagcttgt

SEQ ID NO: 7460415 - DNA, 22 bp, Homo sapiens
ttgttttaacgactcagcttgt

SEQ ID NO: 7460416 - DNA, 22 bp, Homo sapiens
ttgttttaacctagtgtttatg

SEQ ID NO: 7460417 - DNA, 22 bp, Homo sapiens
ttgttttaacctagtgtttatg

SEQ ID NO: 7460418 - DNA, 22 bp, Homo sapiens
ttgttttaacctagtgtttatg

SEQ ID NO: 7460419 - DNA, 22 bp, Homo sapiens
ttgttttaacctagtgtttatg

SEQ ID NO: 7460420 - DNA, 22 bp, Homo sapiens
ttgtttgtgctatttaatgtag

SEQ ID NO: 7460421 - DNA, 17 bp, Homo sapiens
ttgtttgttcttgcccc

SEQ ID NO: 7460422 - DNA, 20 bp, Homo sapiens
ttgttttaaatcctggatga

SEQ ID NO: 7460423 - DNA, 17 bp, Homo sapiens
ttgtttgttcttgcccc

SEQ ID NO: 7460424 - DNA, 20 bp, Homo sapiens
ttgttttaaatcctggatga

SEQ ID NO: 7460425 - DNA, 20 bp, Homo sapiens
ttgttttaaatcctggatga

SEQ ID NO: 7460426 - DNA, 22 bp, Homo sapiens
ttgtttgtgctatttaatgtag

SEQ ID NO: 7460427 - DNA, 22 bp, Homo sapiens
ttgtttgtgctatttaatgtag

SEQ ID NO: 7460428 - DNA, 22 bp, Homo sapiens
ttgtttgtcataatatcattac

SEQ ID NO: 7460429 - DNA, 22 bp, Homo sapiens
ttgtttgtgctatttaatgtag

SEQ ID NO: 7460430 - DNA, 22 bp, Homo sapiens
ttgtttcttcatttagaagctt

SEQ ID NO: 7460431 - DNA, 22 bp, Homo sapiens
ttgtttcttcatttagaagctt

SEQ ID NO: 7460432 - DNA, 22 bp, Homo sapiens
ttgtttcttcatttagaagctt

SEQ ID NO: 7460433 - DNA, 17 bp, Homo sapiens
ttgtttcttctctgtgg

SEQ ID NO: 7460434 - DNA, 17 bp, Homo sapiens
ttgtttcttctctgtgg

SEQ ID NO: 7460435 - DNA, 17 bp, Homo sapiens
ttgtttcttctctgtgg

SEQ ID NO: 7460436 - DNA, 17 bp, Homo sapiens
ttgtttcttctctgtgg

SEQ ID NO: 7460437 - DNA, 22 bp, Homo sapiens
ttgtttcttcaggcttttagga

SEQ ID NO: 7460438 - DNA, 22 bp, Homo sapiens
ttgtttcttcatttagaagctt

SEQ ID NO: 7460439 - DNA, 22 bp, Homo sapiens
ttgtttcttcatttagaagctt

SEQ ID NO: 7460440 - DNA, 22 bp, Homo sapiens
ttgtttcttcatttagaagctt

SEQ ID NO: 7460441 - DNA, 22 bp, Homo sapiens
ttgtttcttcaggcttttagga

SEQ ID NO: 7460442 - DNA, 23 bp, Homo sapiens
ttgtttctttgtattgtctctat

SEQ ID NO: 7460443 - DNA, 23 bp, Homo sapiens
ttgtttctttgtattgtctctat

SEQ ID NO: 7460444 - DNA, 23 bp, Homo sapiens
ttgtttctttgtattgtctctat

SEQ ID NO: 7460445 - DNA, 23 bp, Homo sapiens
ttgtttctttgtattgtctctat

SEQ ID NO: 7460446 - DNA, 22 bp, Homo sapiens
ttgtttctttgaagtttctaga

SEQ ID NO: 7460447 - DNA, 22 bp, Homo sapiens
ttgtttctttgaagtttctaga

SEQ ID NO: 7460448 - DNA, 22 bp, Homo sapiens
ttgtttctttgaagtttctaga

SEQ ID NO: 7460449 - DNA, 17 bp, Homo sapiens
ttgtttcttctctgtgg

SEQ ID NO: 7460450 - DNA, 17 bp, Homo sapiens
ttgtttcttctctgtgg

SEQ ID NO: 7460451 - DNA, 22 bp, Homo sapiens
ttgtttctttgaagtttctaga

SEQ ID NO: 7460452 - DNA, 22 bp, Homo sapiens
ttgtttctttgaagtttctaga

SEQ ID NO: 7460453 - DNA, 22 bp, Homo sapiens
ttgtttctttgaagtttctaga

SEQ ID NO: 7460454 - DNA, 22 bp, Homo sapiens
ttgtttctttgaagtttctaga

SEQ ID NO: 7460455 - DNA, 22 bp, Homo sapiens
ttgtttgtaaggctcttagaat

SEQ ID NO: 7460456 - DNA, 22 bp, Homo sapiens
ttgtttgtaaggctcttagaat

SEQ ID NO: 7460457 - DNA, 22 bp, Homo sapiens
ttgtttgtaaggctcttagaat

SEQ ID NO: 7460458 - DNA, 22 bp, Homo sapiens
ttgtttgtcataatatcattac

SEQ ID NO: 7460459 - DNA, 22 bp, Homo sapiens
ttgtttgtatgctgagaagaat

SEQ ID NO: 7460460 - DNA, 22 bp, Homo sapiens
ttgtttgtcataatatcattac

SEQ ID NO: 7460461 - DNA, 22 bp, Homo sapiens
ttgtttgtcataatatcattac

SEQ ID NO: 7460462 - DNA, 22 bp, Homo sapiens
ttgtttgtcataatatcattac

SEQ ID NO: 7460463 - DNA, 22 bp, Homo sapiens
ttgtttgcccacaactattaag

SEQ ID NO: 7460464 - DNA, 22 bp, Homo sapiens
ttgtttgactaaattggtatca

SEQ ID NO: 7460465 - DNA, 22 bp, Homo sapiens
ttgtttgaggtcactgatattt

SEQ ID NO: 7460466 - DNA, 23 bp, Homo sapiens
ttgtttctttgtattgtctctat

SEQ ID NO: 7460467 - DNA, 22 bp, Homo sapiens
ttgtttgactaaattggtatca

SEQ ID NO: 7460468 - DNA, 23 bp, Homo sapiens
ttgtttctttgtattgtctctat

SEQ ID NO: 7460469 - DNA, 20 bp, Homo sapiens
ttgtttctgctattttctaa

SEQ ID NO: 7460470 - DNA, 20 bp, Homo sapiens
ttgtttctgctattttctaa

SEQ ID NO: 7460471 - DNA, 20 bp, Homo sapiens
ttgtttctgctattttctaa

SEQ ID NO: 7460472 - DNA, 22 bp, Homo sapiens
ttgtttctgagttttcatgtat

SEQ ID NO: 7460473 - DNA, 22 bp, Homo sapiens
ttgtttctgagttttcatgtat

SEQ ID NO: 7460474 - DNA, 22 bp, Homo sapiens
ttgtttctctggtcttgagtga

SEQ ID NO: 7460475 - DNA, 22 bp, Homo sapiens
ttgtttctctggtcttgagtga

SEQ ID NO: 7460476 - DNA, 22 bp, Homo sapiens
ttgtttctctggtcttgagtga

SEQ ID NO: 7460477 - DNA, 22 bp, Homo sapiens
ttgtttctgagttttcatgtat

SEQ ID NO: 7460478 - DNA, 22 bp, Homo sapiens
ttgtttctgagttttcatgtat

SEQ ID NO: 7460479 - DNA, 22 bp, Homo sapiens
ttgtttctgagttttcatgtat

SEQ ID NO: 7460480 - DNA, 22 bp, Homo sapiens
ttgtttctgagttttcatgtat

SEQ ID NO: 7460481 - DNA, 22 bp, Homo sapiens
ttgtttctggaaaaggcgagaa

SEQ ID NO: 7460482 - DNA, 22 bp, Homo sapiens
ttgtttcttcaggcttttagga

SEQ ID NO: 7460483 - DNA, 22 bp, Homo sapiens
ttgtttcttcaggcttttagga

SEQ ID NO: 7460484 - DNA, 22 bp, Homo sapiens
ttgtttcttcaggcttttagga

SEQ ID NO: 7460485 - DNA, 22 bp, Homo sapiens
ttgtttcttcaggcttttagga

SEQ ID NO: 7460486 - DNA, 22 bp, Homo sapiens
ttgtttctggaaaaggcgagaa

SEQ ID NO: 7460487 - DNA, 22 bp, Homo sapiens
ttgtttctggaaaaggcgagaa

SEQ ID NO: 7460488 - DNA, 20 bp, Homo sapiens
ttgtttctgctattttctaa

SEQ ID NO: 7460489 - DNA, 20 bp, Homo sapiens
ttgtttctgctattttctaa

SEQ ID NO: 7460490 - DNA, 20 bp, Homo sapiens
ttgtttctgctattttctaa

SEQ ID NO: 7460491 - DNA, 20 bp, Homo sapiens
ttgtttctgctattttctaa

SEQ ID NO: 7460492 - DNA, 20 bp, Homo sapiens
ttgtttctgctattttctaa

SEQ ID NO: 7460493 - DNA, 20 bp, Homo sapiens
ttgtttctgctattttctaa

SEQ ID NO: 7460494 - DNA, 20 bp, Homo sapiens
ttgtttctgctattttctaa

SEQ ID NO: 7460495 - DNA, 22 bp, Homo sapiens
ttgtttctcctggtgcctgata

SEQ ID NO: 7460496 - DNA, 22 bp, Homo sapiens
ttgtttctcctggtgcctgata

SEQ ID NO: 7460497 - DNA, 22 bp, Homo sapiens
ttgtttctcctggtgcctgata

SEQ ID NO: 7460498 - DNA, 22 bp, Homo sapiens
ttgtttctctggtcttgagtga

SEQ ID NO: 7460499 - DNA, 22 bp, Homo sapiens
ttgtttctctggtcttgagtga

SEQ ID NO: 7460500 - DNA, 22 bp, Homo sapiens
ttgtttctcctggtgcctgata

SEQ ID NO: 7460501 - DNA, 22 bp, Homo sapiens
ttgtttctccagtctaggaaaa

SEQ ID NO: 7460502 - DNA, 22 bp, Homo sapiens
ttgtttcctttctatacaggat

SEQ ID NO: 7460503 - DNA, 22 bp, Homo sapiens
ttgtttctccagtctaggaaaa

SEQ ID NO: 7460504 - DNA, 22 bp, Homo sapiens
ttgtttctccagtctaggaaaa

SEQ ID NO: 7460505 - DNA, 22 bp, Homo sapiens
ttgtttctcctggtgcctgata

SEQ ID NO: 7460506 - DNA, 22 bp, Homo sapiens
ttgtttctccagtctaggaaaa

SEQ ID NO: 7460507 - DNA, 22 bp, Homo sapiens
ttgtttccctggatctagagct

SEQ ID NO: 7460508 - DNA, 22 bp, Homo sapiens
ttgtttccctggatctagagct

SEQ ID NO: 7460509 - DNA, 21 bp, Homo sapiens
ttgtttcccagagctcgctcc

SEQ ID NO: 7460510 - DNA, 21 bp, Homo sapiens
ttgtttcccagagctcgctcc

SEQ ID NO: 7460511 - DNA, 21 bp, Homo sapiens
ttgtttcctcccaaaatgcca

SEQ ID NO: 7460512 - DNA, 21 bp, Homo sapiens
ttgtttcctcccaaaatgcca

SEQ ID NO: 7460513 - DNA, 22 bp, Homo sapiens
ttgtttccctggatctagagct

SEQ ID NO: 7460514 - DNA, 21 bp, Homo sapiens
ttgtttcctcccaaaatgcca

SEQ ID NO: 7460515 - DNA, 21 bp, Homo sapiens
ttgtttcctcccaaaatgcca

SEQ ID NO: 7460516 - DNA, 20 bp, Homo sapiens
ttgtttcctggctgttctgc

SEQ ID NO: 7460517 - DNA, 20 bp, Homo sapiens
ttgtttcctggctgttctgc

SEQ ID NO: 7460518 - DNA, 22 bp, Homo sapiens
ttgtttcctttctatacaggat

SEQ ID NO: 7460519 - DNA, 22 bp, Homo sapiens
ttgtttcctttctatacaggat

SEQ ID NO: 7460520 - DNA, 22 bp, Homo sapiens
ttgtttcctttctatacaggat

SEQ ID NO: 7460521 - DNA, 22 bp, Homo sapiens
ttgtttcctttctatacaggat

SEQ ID NO: 7460522 - DNA, 22 bp, Homo sapiens
tttaatttgaaatgagtaaccc

SEQ ID NO: 7460523 - DNA, 22 bp, Homo sapiens
tttaattgttgtgggtacatag

SEQ ID NO: 7460524 - DNA, 22 bp, Homo sapiens
tttaatttgaaatgagtaaccc

SEQ ID NO: 7460525 - DNA, 22 bp, Homo sapiens
tttaatttgaaatgagtaaccc

SEQ ID NO: 7460526 - DNA, 22 bp, Homo sapiens
tttaatttgaaatgagtaaccc

SEQ ID NO: 7460527 - DNA, 22 bp, Homo sapiens
tttaattgttgtgggtacatag

SEQ ID NO: 7460528 - DNA, 22 bp, Homo sapiens
tttaattgttgtgggtacatag

SEQ ID NO: 7460529 - DNA, 22 bp, Homo sapiens
tttaatttgaaatgagtaaccc

SEQ ID NO: 7460530 - DNA, 22 bp, Homo sapiens
tttaatttgaaatgagtaaccc

SEQ ID NO: 7460531 - DNA, 22 bp, Homo sapiens
tttaatttgaaatgagtaaccc

SEQ ID NO: 7460532 - DNA, 22 bp, Homo sapiens
tttaattgcatttaaagatgga

SEQ ID NO: 7460533 - DNA, 22 bp, Homo sapiens
tttaattgcatttaaagatgga

SEQ ID NO: 7460534 - DNA, 22 bp, Homo sapiens
tttaattgattcacagtctgta

SEQ ID NO: 7460535 - DNA, 22 bp, Homo sapiens
tttaattgcatttaaagatgga

SEQ ID NO: 7460536 - DNA, 22 bp, Homo sapiens
tttaattgttgtgggtacatag

SEQ ID NO: 7460537 - DNA, 22 bp, Homo sapiens
tttaattgcatttaaagatgga

SEQ ID NO: 7460538 - DNA, 22 bp, Homo sapiens
tttaattgcatttaaagatgga

SEQ ID NO: 7460539 - DNA, 22 bp, Homo sapiens
tttaattctggcataatagctc

SEQ ID NO: 7460540 - DNA, 22 bp, Homo sapiens
tttaattctggcataatagctc

SEQ ID NO: 7460541 - DNA, 22 bp, Homo sapiens
tttaattgattcacagtctgta

SEQ ID NO: 7460542 - DNA, 22 bp, Homo sapiens
tttaattatatctgggcagtta

SEQ ID NO: 7460543 - DNA, 22 bp, Homo sapiens
tttaattatatctgggcagtta

SEQ ID NO: 7460544 - DNA, 22 bp, Homo sapiens
tttaattatgttaagccactga

SEQ ID NO: 7460545 - DNA, 22 bp, Homo sapiens
tttaattatgttaagccactga

SEQ ID NO: 7460546 - DNA, 22 bp, Homo sapiens
tttaattctggcataatagctc

SEQ ID NO: 7460547 - DNA, 22 bp, Homo sapiens
tttaattagcaagccagagagc

SEQ ID NO: 7460548 - DNA, 22 bp, Homo sapiens
tttaattagcaagccagagagc

SEQ ID NO: 7460549 - DNA, 22 bp, Homo sapiens
tttaattagcaagccagagagc

SEQ ID NO: 7460550 - DNA, 22 bp, Homo sapiens
tttaattatatctgggcagtta

SEQ ID NO: 7460551 - DNA, 22 bp, Homo sapiens
tttaattaggaaatgggcaggg

SEQ ID NO: 7460552 - DNA, 22 bp, Homo sapiens
tttaattagcaagccagagagc

SEQ ID NO: 7460553 - DNA, 22 bp, Homo sapiens
tttaattagcaagccagagagc

SEQ ID NO: 7460554 - DNA, 22 bp, Homo sapiens
tttaatgtttgagtcagtatat

SEQ ID NO: 7460555 - DNA, 22 bp, Homo sapiens
tttaatgtttgagtcagtatat

SEQ ID NO: 7460556 - DNA, 21 bp, Homo sapiens
tttaatttgcatgtatgacgc

SEQ ID NO: 7460557 - DNA, 21 bp, Homo sapiens
tttaatttgcatgtatgacgc

SEQ ID NO: 7460558 - DNA, 21 bp, Homo sapiens
tttaatttgcatgtatgacgc

SEQ ID NO: 7460559 - DNA, 21 bp, Homo sapiens
tttaatttgcatgtatgacgc

SEQ ID NO: 7460560 - DNA, 21 bp, Homo sapiens
tttaatttgcatgtatgacgc

SEQ ID NO: 7460561 - DNA, 22 bp, Homo sapiens
tttaatttgtatttctagaggg

SEQ ID NO: 7460562 - DNA, 22 bp, Homo sapiens
tttaatttgtatttctagaggg

SEQ ID NO: 7460563 - DNA, 22 bp, Homo sapiens
tttaatttgtatttctagaggg

SEQ ID NO: 7460564 - DNA, 22 bp, Homo sapiens
tttaatttgtatttctagaggg

SEQ ID NO: 7460565 - DNA, 21 bp, Homo sapiens
tttaatttgcatgtatgacgc

SEQ ID NO: 7460566 - DNA, 21 bp, Homo sapiens
tttaatttgcatgtatgacgc

SEQ ID NO: 7460567 - DNA, 22 bp, Homo sapiens
tttaattttcctcttcctggag

SEQ ID NO: 7460568 - DNA, 22 bp, Homo sapiens
tttaattttcctcttcctggag

SEQ ID NO: 7460569 - DNA, 22 bp, Homo sapiens
tttaattttcctcttcctggag

SEQ ID NO: 7460570 - DNA, 22 bp, Homo sapiens
tttaatttgtatttctagaggg

SEQ ID NO: 7460571 - DNA, 22 bp, Homo sapiens
tttaatttgtatttctagaggg

SEQ ID NO: 7460572 - DNA, 22 bp, Homo sapiens
tttaattttctgggcccagcag

SEQ ID NO: 7460573 - DNA, 22 bp, Homo sapiens
tttaattttcctggtaggcctg

SEQ ID NO: 7460574 - DNA, 22 bp, Homo sapiens
tttaattttcctggtaggcctg

SEQ ID NO: 7460575 - DNA, 22 bp, Homo sapiens
tttaattttctgggcccagcag

SEQ ID NO: 7460576 - DNA, 22 bp, Homo sapiens
tttaattttctgggcccagcag

SEQ ID NO: 7460577 - DNA, 22 bp, Homo sapiens
tttaattttctgggcccagcag

SEQ ID NO: 7460578 - DNA, 22 bp, Homo sapiens
tttacaacctcatattctgatg

SEQ ID NO: 7460579 - DNA, 22 bp, Homo sapiens
tttacaacccaagtccagagag

SEQ ID NO: 7460580 - DNA, 22 bp, Homo sapiens
tttacaacataggccccaagaa

SEQ ID NO: 7460581 - DNA, 22 bp, Homo sapiens
tttaattttcctggtaggcctg

SEQ ID NO: 7460582 - DNA, 22 bp, Homo sapiens
tttaattttcctggtaggcctg

SEQ ID NO: 7460583 - DNA, 22 bp, Homo sapiens
tttaattttcctcttcctggag

SEQ ID NO: 7460584 - DNA, 22 bp, Homo sapiens
tttaattttcctcttcctggag

SEQ ID NO: 7460585 - DNA, 22 bp, Homo sapiens
tttaattttcctcttcctggag

SEQ ID NO: 7460586 - DNA, 22 bp, Homo sapiens
tttaattttcctcttcctggag

SEQ ID NO: 7460587 - DNA, 22 bp, Homo sapiens
tttaaaatttagacctctccac

SEQ ID NO: 7460588 - DNA, 22 bp, Homo sapiens
tttaaaatttagacctctccac

SEQ ID NO: 7460589 - DNA, 22 bp, Homo sapiens
tttaaaatttagacctctccac

SEQ ID NO: 7460590 - DNA, 22 bp, Homo sapiens
tttaaaatttagacctctccac

SEQ ID NO: 7460591 - DNA, 22 bp, Homo sapiens
tttaaaatcagatgggagttgg

SEQ ID NO: 7460592 - DNA, 22 bp, Homo sapiens
tttaaaatttagacctctccac

SEQ ID NO: 7460593 - DNA, 22 bp, Homo sapiens
tttaaaatttagacctctccac

SEQ ID NO: 7460594 - DNA, 22 bp, Homo sapiens
tttaaaatttagacctctccac

SEQ ID NO: 7460595 - DNA, 22 bp, Homo sapiens
tttaaaatttagacctctccac

SEQ ID NO: 7460596 - DNA, 22 bp, Homo sapiens
tttaaaatttagacctctccac

SEQ ID NO: 7460597 - DNA, 22 bp, Homo sapiens
tttaaaatttagacctctccac

SEQ ID NO: 7460598 - DNA, 22 bp, Homo sapiens
tttaaaatttagacctctccac

SEQ ID NO: 7460599 - DNA, 22 bp, Homo sapiens
tttaaaatttagacctctccac

SEQ ID NO: 7460600 - DNA, 22 bp, Homo sapiens
tttaaacatatctgttgaggga

SEQ ID NO: 7460601 - DNA, 22 bp, Homo sapiens
tttaaacatatctgttgaggga

SEQ ID NO: 7460602 - DNA, 22 bp, Homo sapiens
tttaaacatatctgttgaggga

SEQ ID NO: 7460603 - DNA, 22 bp, Homo sapiens
tttaatgtgagtccctttcaag

SEQ ID NO: 7460604 - DNA, 22 bp, Homo sapiens
tttaaacatatctgttgaggga

SEQ ID NO: 7460605 - DNA, 22 bp, Homo sapiens
tttaaacaaataggattgccta

SEQ ID NO: 7460606 - DNA, 22 bp, Homo sapiens
tttaaacaaataggattgccta

SEQ ID NO: 7460607 - DNA, 22 bp, Homo sapiens
tttaaacaaataggattgccta

SEQ ID NO: 7460608 - DNA, 22 bp, Homo sapiens
tttaaacaaataggattgccta

SEQ ID NO: 7460609 - DNA, 22 bp, Homo sapiens
tttaaacaaataggattgccta

SEQ ID NO: 7460610 - DNA, 22 bp, Homo sapiens
tttaaacaaataggattgccta

SEQ ID NO: 7460611 - DNA, 22 bp, Homo sapiens
tttaatgttaaatttgtagatg

SEQ ID NO: 7460612 - DNA, 22 bp, Homo sapiens
tttaatgttaaatttgtagatg

SEQ ID NO: 7460613 - DNA, 22 bp, Homo sapiens
tttaatgttaaatttgtagatg

SEQ ID NO: 7460614 - DNA, 19 bp, Homo sapiens
tttaatgtgtgctgcaatc

SEQ ID NO: 7460615 - DNA, 19 bp, Homo sapiens
tttaatgtgtgctgcaatc

SEQ ID NO: 7460616 - DNA, 22 bp, Homo sapiens
tttaatgttaaatttgtagatg

SEQ ID NO: 7460617 - DNA, 22 bp, Homo sapiens
tttaatgttaaatttgtagatg

SEQ ID NO: 7460618 - DNA, 22 bp, Homo sapiens
tttaatgtttgagtcagtatat

SEQ ID NO: 7460619 - DNA, 22 bp, Homo sapiens
tttaatgtttgagtcagtatat

SEQ ID NO: 7460620 - DNA, 22 bp, Homo sapiens
tttaatgtttgagtcagtatat

SEQ ID NO: 7460621 - DNA, 22 bp, Homo sapiens
tttaatgtttgagtcagtatat

SEQ ID NO: 7460622 - DNA, 22 bp, Homo sapiens
ttgtttttaaacatgtgactga

SEQ ID NO: 7460623 - DNA, 22 bp, Homo sapiens
ttgtttttagagaagccctgaa

SEQ ID NO: 7460624 - DNA, 22 bp, Homo sapiens
ttgtttttagagaagccctgaa

SEQ ID NO: 7460625 - DNA, 22 bp, Homo sapiens
ttgtttttagagaagccctgaa

SEQ ID NO: 7460626 - DNA, 22 bp, Homo sapiens
ttgtttttagagaagccctgaa

SEQ ID NO: 7460627 - DNA, 22 bp, Homo sapiens
ttgtttttagagaagccctgaa

SEQ ID NO: 7460628 - DNA, 23 bp, Homo sapiens
ttgtttttagaggtggcatgaga

SEQ ID NO: 7460629 - DNA, 23 bp, Homo sapiens
ttgtttttagaggtggcatgaga

SEQ ID NO: 7460630 - DNA, 22 bp, Homo sapiens
ttgtttttagagaagccctgaa

SEQ ID NO: 7460631 - DNA, 22 bp, Homo sapiens
ttgtttttgtgaggcagcccat

SEQ ID NO: 7460632 - DNA, 22 bp, Homo sapiens
ttgtttttgtgaggcagcccat

SEQ ID NO: 7460633 - DNA, 22 bp, Homo sapiens
ttgtttttatgaacatccagga

SEQ ID NO: 7460634 - DNA, 22 bp, Homo sapiens
ttgtttttatgaacatccagga

SEQ ID NO: 7460635 - DNA, 22 bp, Homo sapiens
ttgtttttatgaacatccagga

SEQ ID NO: 7460636 - DNA, 23 bp, Homo sapiens
ttgtttttagaggtggcatgaga

SEQ ID NO: 7460637 - DNA, 23 bp, Homo sapiens
ttgtttttagaggtggcatgaga

SEQ ID NO: 7460638 - DNA, 22 bp, Homo sapiens
tttaaaagttatcatctgtcca

SEQ ID NO: 7460639 - DNA, 22 bp, Homo sapiens
tttaaaagttatcatctgtcca

SEQ ID NO: 7460640 - DNA, 23 bp, Homo sapiens
tttaaaagttgtaatgtaggctt

SEQ ID NO: 7460641 - DNA, 22 bp, Homo sapiens
tttaaaagttatcatctgtcca

SEQ ID NO: 7460642 - DNA, 22 bp, Homo sapiens
tttaaaagttatcatctgtcca

SEQ ID NO: 7460643 - DNA, 22 bp, Homo sapiens
tttaaaagttatcatctgtcca

SEQ ID NO: 7460644 - DNA, 22 bp, Homo sapiens
tttaaaaaactagtctgagtct

SEQ ID NO: 7460645 - DNA, 23 bp, Homo sapiens
tttaaaagttgtaatgtaggctt

SEQ ID NO: 7460646 - DNA, 23 bp, Homo sapiens
tttaaaagttgtaatgtaggctt

SEQ ID NO: 7460647 - DNA, 23 bp, Homo sapiens
tttaaaagttgtaatgtaggctt

SEQ ID NO: 7460648 - DNA, 23 bp, Homo sapiens
tttaaaagttgtaatgtaggctt

SEQ ID NO: 7460649 - DNA, 22 bp, Homo sapiens
tttaaaatcagatgggagttgg

SEQ ID NO: 7460650 - DNA, 22 bp, Homo sapiens
tttaaaatcagatgggagttgg

SEQ ID NO: 7460651 - DNA, 22 bp, Homo sapiens
tttaaaatcagatgggagttgg

SEQ ID NO: 7460652 - DNA, 22 bp, Homo sapiens
tttaaaatcagatgggagttgg

SEQ ID NO: 7460653 - DNA, 22 bp, Homo sapiens
tttagaaattcatctatggcct

SEQ ID NO: 7460654 - DNA, 22 bp, Homo sapiens
tttagaaattcatctatggcct

SEQ ID NO: 7460655 - DNA, 22 bp, Homo sapiens
tttagaaattcatctatggcct

SEQ ID NO: 7460656 - DNA, 22 bp, Homo sapiens
tttagaaattgcagagtgggtg

SEQ ID NO: 7460657 - DNA, 22 bp, Homo sapiens
tttagaaattgcagagtgggtg

SEQ ID NO: 7460658 - DNA, 22 bp, Homo sapiens
tttagaaattcatctatggcct

SEQ ID NO: 7460659 - DNA, 22 bp, Homo sapiens
tttagaaattcatctatggcct

SEQ ID NO: 7460660 - DNA, 22 bp, Homo sapiens
tttagaaattgcagagtgggtg

SEQ ID NO: 7460661 - DNA, 22 bp, Homo sapiens
tttagaaattgcagagtgggtg

SEQ ID NO: 7460662 - DNA, 22 bp, Homo sapiens
tttagaaattgcagagtgggtg

SEQ ID NO: 7460663 - DNA, 22 bp, Homo sapiens
tttagaacaatgtgtagaaaaa

SEQ ID NO: 7460664 - DNA, 20 bp, Homo sapiens
tttagaagaatgagcacttt

SEQ ID NO: 7460665 - DNA, 22 bp, Homo sapiens
tttagaacagatattgtaactt

SEQ ID NO: 7460666 - DNA, 20 bp, Homo sapiens
tttagaagaatgagcacttt

SEQ ID NO: 7460667 - DNA, 22 bp, Homo sapiens
tttagttattgttacagtatga

SEQ ID NO: 7460668 - DNA, 22 bp, Homo sapiens
tttagttattgttacagtatga

SEQ ID NO: 7460669 - DNA, 22 bp, Homo sapiens
tttagttattgttacagtatga

SEQ ID NO: 7460670 - DNA, 22 bp, Homo sapiens
tttagttattgttacagtatga

SEQ ID NO: 7460671 - DNA, 22 bp, Homo sapiens
tttagttattgttacagtatga

SEQ ID NO: 7460672 - DNA, 22 bp, Homo sapiens
tttactttctcaagtatatagg

SEQ ID NO: 7460673 - DNA, 22 bp, Homo sapiens
tttactttctcaagtatatagg

SEQ ID NO: 7460674 - DNA, 22 bp, Homo sapiens
tttactttctcaagtatatagg

SEQ ID NO: 7460675 - DNA, 22 bp, Homo sapiens
tttactttctcaagtatatagg

SEQ ID NO: 7460676 - DNA, 22 bp, Homo sapiens
tttactttctcaagtatatagg

SEQ ID NO: 7460677 - DNA, 22 bp, Homo sapiens
tttactttctcaagtatatagg

SEQ ID NO: 7460678 - DNA, 22 bp, Homo sapiens
tttacttttggtaaggtcattt

SEQ ID NO: 7460679 - DNA, 22 bp, Homo sapiens
tttactttgtgtcaagtcaaga

SEQ ID NO: 7460680 - DNA, 22 bp, Homo sapiens
tttactttgtgtcaagtcaaga

SEQ ID NO: 7460681 - DNA, 22 bp, Homo sapiens
tttactttgtgtcaagtcaaga

SEQ ID NO: 7460682 - DNA, 22 bp, Homo sapiens
tttactttgtgtcaagtcaaga

SEQ ID NO: 7460683 - DNA, 22 bp, Homo sapiens
tttactttgtgtcaagtcaaga

SEQ ID NO: 7460684 - DNA, 22 bp, Homo sapiens
tttactttgtgtcaagtcaaga

SEQ ID NO: 7460685 - DNA, 22 bp, Homo sapiens
tttactttgtgtcaagtcaaga

SEQ ID NO: 7460686 - DNA, 22 bp, Homo sapiens
tttactttgtgtcaagtcaaga

SEQ ID NO: 7460687 - DNA, 18 bp, Homo sapiens
tttactcataggcctgac

SEQ ID NO: 7460688 - DNA, 22 bp, Homo sapiens
tttactgaatttggtatattcc

SEQ ID NO: 7460689 - DNA, 22 bp, Homo sapiens
tttactgaatttggtatattcc

SEQ ID NO: 7460690 - DNA, 22 bp, Homo sapiens
tttactgaactgctagtacagg

SEQ ID NO: 7460691 - DNA, 22 bp, Homo sapiens
tttactgaactgctagtacagg

SEQ ID NO: 7460692 - DNA, 22 bp, Homo sapiens
tttactgaactgctagtacagg

SEQ ID NO: 7460693 - DNA, 21 bp, Homo sapiens
tttactgagcacttactatgt

SEQ ID NO: 7460694 - DNA, 21 bp, Homo sapiens
tttactgagcacttactatgt

SEQ ID NO: 7460695 - DNA, 22 bp, Homo sapiens
tttactgaatttggtatattcc

SEQ ID NO: 7460696 - DNA, 22 bp, Homo sapiens
tttactgacctccaatcccact

SEQ ID NO: 7460697 - DNA, 21 bp, Homo sapiens
tttactgagcacttactatgt

SEQ ID NO: 7460698 - DNA, 21 bp, Homo sapiens
tttactgagcacttactatgt

SEQ ID NO: 7460699 - DNA, 21 bp, Homo sapiens
tttactgagcacttactatgt

SEQ ID NO: 7460700 - DNA, 22 bp, Homo sapiens
tttactgagtgacctagaataa

SEQ ID NO: 7460701 - DNA, 22 bp, Homo sapiens
tttactgagtgacctagaataa

SEQ ID NO: 7460702 - DNA, 22 bp, Homo sapiens
tttacttgatatggagctgagg

SEQ ID NO: 7460703 - DNA, 22 bp, Homo sapiens
tttacttctgcatttcccctag

SEQ ID NO: 7460704 - DNA, 22 bp, Homo sapiens
tttactgttcaacttgcaagta

SEQ ID NO: 7460705 - DNA, 22 bp, Homo sapiens
tttactgttcaacttgcaagta

SEQ ID NO: 7460706 - DNA, 22 bp, Homo sapiens
tttactgttttatattgtccag

SEQ ID NO: 7460707 - DNA, 22 bp, Homo sapiens
tttactgtgcattagaatcacc

SEQ ID NO: 7460708 - DNA, 22 bp, Homo sapiens
tttactgtgtaaggggaatgtt

SEQ ID NO: 7460709 - DNA, 22 bp, Homo sapiens
tttactgtgtccatctgtgact

SEQ ID NO: 7460710 - DNA, 22 bp, Homo sapiens
tttactgttacacctaccttct

SEQ ID NO: 7460711 - DNA, 22 bp, Homo sapiens
tttactgttacacctaccttct

SEQ ID NO: 7460712 - DNA, 22 bp, Homo sapiens
tttactgttacacctaccttct

SEQ ID NO: 7460713 - DNA, 22 bp, Homo sapiens
tttactgtctcagagagacaaa

SEQ ID NO: 7460714 - DNA, 22 bp, Homo sapiens
tttactgagtgacctagaataa

SEQ ID NO: 7460715 - DNA, 22 bp, Homo sapiens
tttactgtgcattagaatcacc

SEQ ID NO: 7460716 - DNA, 22 bp, Homo sapiens
tttactgtctcagagagacaaa

SEQ ID NO: 7460717 - DNA, 22 bp, Homo sapiens
tttacaacctcatattctgatg

SEQ ID NO: 7460718 - DNA, 22 bp, Homo sapiens
tttacaacctcatattctgatg

SEQ ID NO: 7460719 - DNA, 22 bp, Homo sapiens
tttacaacctcatattctgatg

SEQ ID NO: 7460720 - DNA, 22 bp, Homo sapiens
tttacaacctcatattctgatg

SEQ ID NO: 7460721 - DNA, 22 bp, Homo sapiens
tttacaacgttcctggtgctaa

SEQ ID NO: 7460722 - DNA, 22 bp, Homo sapiens
tttacaactttctgttctgtat

SEQ ID NO: 7460723 - DNA, 22 bp, Homo sapiens
tttacaactttctgttctgtat

SEQ ID NO: 7460724 - DNA, 22 bp, Homo sapiens
tttacaacgttcctggtgctaa

SEQ ID NO: 7460725 - DNA, 22 bp, Homo sapiens
tttacaaggcagaactgattaa

SEQ ID NO: 7460726 - DNA, 22 bp, Homo sapiens
tttacaaggcagaactgattaa

SEQ ID NO: 7460727 - DNA, 22 bp, Homo sapiens
tttacaaggcagaactgattaa

SEQ ID NO: 7460728 - DNA, 22 bp, Homo sapiens
tttacaaggatcaagggatctc

SEQ ID NO: 7460729 - DNA, 22 bp, Homo sapiens
tttacaaggatcaagggatctc

SEQ ID NO: 7460730 - DNA, 22 bp, Homo sapiens
tttacaaggatcaagggatctc

SEQ ID NO: 7460731 - DNA, 22 bp, Homo sapiens
tttacaagaaatcatgatgcta

SEQ ID NO: 7460732 - DNA, 22 bp, Homo sapiens
tttacaagaaatcatgatgcta

SEQ ID NO: 7460733 - DNA, 22 bp, Homo sapiens
tttacaactttctgttctgtat

SEQ ID NO: 7460734 - DNA, 22 bp, Homo sapiens
tttacaagaaatcatgatgcta

SEQ ID NO: 7460735 - DNA, 22 bp, Homo sapiens
tttacaagaaatcatgatgcta

SEQ ID NO: 7460736 - DNA, 22 bp, Homo sapiens
tttacaagaaatcatgatgcta

SEQ ID NO: 7460737 - DNA, 22 bp, Homo sapiens
tttacaaggcagaactgattaa

SEQ ID NO: 7460738 - DNA, 22 bp, Homo sapiens
tttacaaggcagaactgattaa

SEQ ID NO: 7460739 - DNA, 22 bp, Homo sapiens
tttacaaggcagaactgattaa

SEQ ID NO: 7460740 - DNA, 22 bp, Homo sapiens
tttacaaggcagttattttcct

SEQ ID NO: 7460741 - DNA, 22 bp, Homo sapiens
tttacaaggcagttattttcct

SEQ ID NO: 7460742 - DNA, 22 bp, Homo sapiens
tttacaaggcagttattttcct

SEQ ID NO: 7460743 - DNA, 22 bp, Homo sapiens
tttacaaggcagttattttcct

SEQ ID NO: 7460744 - DNA, 22 bp, Homo sapiens
tttacaaggcagttattttcct

SEQ ID NO: 7460745 - DNA, 22 bp, Homo sapiens
tttacaagtacacctaacagct

SEQ ID NO: 7460746 - DNA, 22 bp, Homo sapiens
tttacaaggcagttattttcct

SEQ ID NO: 7460747 - DNA, 22 bp, Homo sapiens
tttacaagtacacctaacagct

SEQ ID NO: 7460748 - DNA, 22 bp, Homo sapiens
tttacaagtacacctaacagct

SEQ ID NO: 7460749 - DNA, 22 bp, Homo sapiens
tttaccaggagtcagaaggact

SEQ ID NO: 7460750 - DNA, 22 bp, Homo sapiens
tttaccaggagtcagaaggact

SEQ ID NO: 7460751 - DNA, 22 bp, Homo sapiens
tttacaagtacacctaacagct

SEQ ID NO: 7460752 - DNA, 22 bp, Homo sapiens
tttaccatacatcaaaatattt

SEQ ID NO: 7460753 - DNA, 22 bp, Homo sapiens
tttaccatacatcaaaatattt

SEQ ID NO: 7460754 - DNA, 22 bp, Homo sapiens
tttaccatacatcaaaatattt

SEQ ID NO: 7460755 - DNA, 22 bp, Homo sapiens
tttaccagtgaggaaaatgagg

SEQ ID NO: 7460756 - DNA, 22 bp, Homo sapiens
tttaccagtgaggaaaatgagg

SEQ ID NO: 7460757 - DNA, 22 bp, Homo sapiens
tttaccagtgaggaaaatgagg

SEQ ID NO: 7460758 - DNA, 22 bp, Homo sapiens
tttaccagtgttaaacaccagc

SEQ ID NO: 7460759 - DNA, 22 bp, Homo sapiens
tttacccattcagactcacttg

SEQ ID NO: 7460760 - DNA, 22 bp, Homo sapiens
tttacctggattcttacttcct

SEQ ID NO: 7460761 - DNA, 19 bp, Homo sapiens
tttaccttcttgagagcag

SEQ ID NO: 7460762 - DNA, 19 bp, Homo sapiens
tttaccttcttgagagcag

SEQ ID NO: 7460763 - DNA, 22 bp, Homo sapiens
tttacctggattcttacttcct

SEQ ID NO: 7460764 - DNA, 22 bp, Homo sapiens
tttaccttcttttaactacagt

SEQ ID NO: 7460765 - DNA, 22 bp, Homo sapiens
tttacgaaaagtgactaatagg

SEQ ID NO: 7460766 - DNA, 22 bp, Homo sapiens
tttacgactgctaaatgcctgc

SEQ ID NO: 7460767 - DNA, 22 bp, Homo sapiens
tttacgactgctaaatgcctgc

SEQ ID NO: 7460768 - DNA, 22 bp, Homo sapiens
tttaccttcttttaactacagt

SEQ ID NO: 7460769 - DNA, 22 bp, Homo sapiens
tttaccatcctcttttagaatt

SEQ ID NO: 7460770 - DNA, 22 bp, Homo sapiens
tttaccatcctcttttagaatt

SEQ ID NO: 7460771 - DNA, 22 bp, Homo sapiens
tttaccatctgccacagatatg

SEQ ID NO: 7460772 - DNA, 22 bp, Homo sapiens
tttaccatcctcttttagaatt

SEQ ID NO: 7460773 - DNA, 22 bp, Homo sapiens
tttaccattattaaaattaagt

SEQ ID NO: 7460774 - DNA, 22 bp, Homo sapiens
tttaccattattaaaattaagt

SEQ ID NO: 7460775 - DNA, 22 bp, Homo sapiens
tttaccattattaaaattaagt

SEQ ID NO: 7460776 - DNA, 22 bp, Homo sapiens
tttaccatctgccacagatatg

SEQ ID NO: 7460777 - DNA, 22 bp, Homo sapiens
tttaccatctgccacagatatg

SEQ ID NO: 7460778 - DNA, 22 bp, Homo sapiens
tttacccattcagactcacttg

SEQ ID NO: 7460779 - DNA, 22 bp, Homo sapiens
tttactaccattctgatcagtg

SEQ ID NO: 7460780 - DNA, 22 bp, Homo sapiens
tttactacttcattgacttacg

SEQ ID NO: 7460781 - DNA, 22 bp, Homo sapiens
tttactaagtacttgtatccct

SEQ ID NO: 7460782 - DNA, 22 bp, Homo sapiens
tttactaagtacttgtatccct

SEQ ID NO: 7460783 - DNA, 22 bp, Homo sapiens
tttactcaagtatgcatttatg

SEQ ID NO: 7460784 - DNA, 22 bp, Homo sapiens
tttactcaagtatgcatttatg

SEQ ID NO: 7460785 - DNA, 22 bp, Homo sapiens
tttactaagcccagttatatgc

SEQ ID NO: 7460786 - DNA, 22 bp, Homo sapiens
tttactaagtacttgtatccct

SEQ ID NO: 7460787 - DNA, 22 bp, Homo sapiens
tttactaagtacttgtatccct

SEQ ID NO: 7460788 - DNA, 22 bp, Homo sapiens
tttactaagtacttgtatccct

SEQ ID NO: 7460789 - DNA, 22 bp, Homo sapiens
tttactaagcccagttatatgc

SEQ ID NO: 7460790 - DNA, 22 bp, Homo sapiens
tttactaacaccatacatgctg

SEQ ID NO: 7460791 - DNA, 22 bp, Homo sapiens
tttactaagcccagttatatgc

SEQ ID NO: 7460792 - DNA, 22 bp, Homo sapiens
tttactaagcccagttatatgc

SEQ ID NO: 7460793 - DNA, 22 bp, Homo sapiens
tttactaagcccagttatatgc

SEQ ID NO: 7460794 - DNA, 22 bp, Homo sapiens
tttactaacaccatacatgctg

SEQ ID NO: 7460795 - DNA, 22 bp, Homo sapiens
tttactaacaccatacatgctg

SEQ ID NO: 7460796 - DNA, 22 bp, Homo sapiens
tttactaacaccatacatgctg

SEQ ID NO: 7460797 - DNA, 22 bp, Homo sapiens
tttacgctcttcaggtaaaacc

SEQ ID NO: 7460798 - DNA, 22 bp, Homo sapiens
tttactaacaccatacatgctg

SEQ ID NO: 7460799 - DNA, 22 bp, Homo sapiens
tttattatgatggacaccttcg

SEQ ID NO: 7460800 - DNA, 22 bp, Homo sapiens
tttattatgatggacaccttcg

SEQ ID NO: 7460801 - DNA, 22 bp, Homo sapiens
tttattatgatggacaccttcg

SEQ ID NO: 7460802 - DNA, 22 bp, Homo sapiens
tttattatgatggacaccttcg

SEQ ID NO: 7460803 - DNA, 22 bp, Homo sapiens
tttattatccagtgttgtcatg

SEQ ID NO: 7460804 - DNA, 22 bp, Homo sapiens
tttattatccagtgttgtcatg

SEQ ID NO: 7460805 - DNA, 22 bp, Homo sapiens
tttattatgatggacaccttcg

SEQ ID NO: 7460806 - DNA, 22 bp, Homo sapiens
tttattatgatggacaccttcg

SEQ ID NO: 7460807 - DNA, 22 bp, Homo sapiens
tttattatgatggacaccttcg

SEQ ID NO: 7460808 - DNA, 22 bp, Homo sapiens
tttattatgatggacaccttcg

SEQ ID NO: 7460809 - DNA, 22 bp, Homo sapiens
tttattatgtacaggcactata

SEQ ID NO: 7460810 - DNA, 22 bp, Homo sapiens
tttattatgtacaggcactata

SEQ ID NO: 7460811 - DNA, 22 bp, Homo sapiens
tttattatgtacaggcactata

SEQ ID NO: 7460812 - DNA, 22 bp, Homo sapiens
tttattatgatggacaccttcg

SEQ ID NO: 7460813 - DNA, 22 bp, Homo sapiens
tttattattctctggagaatgt

SEQ ID NO: 7460814 - DNA, 22 bp, Homo sapiens
tttattattctctggagaatgt

SEQ ID NO: 7460815 - DNA, 22 bp, Homo sapiens
tttattattctctggagaatgt

SEQ ID NO: 7460816 - DNA, 22 bp, Homo sapiens
tttattatgtacaggcactata

SEQ ID NO: 7460817 - DNA, 22 bp, Homo sapiens
tttattatgtacaggcactata

SEQ ID NO: 7460818 - DNA, 22 bp, Homo sapiens
tttattattctctggagaatgt

SEQ ID NO: 7460819 - DNA, 22 bp, Homo sapiens
tttattattctctggagaatgt

SEQ ID NO: 7460820 - DNA, 22 bp, Homo sapiens
tttattattctctggagaatgt

SEQ ID NO: 7460821 - DNA, 22 bp, Homo sapiens
tttattattctctggagaatgt

SEQ ID NO: 7460822 - DNA, 22 bp, Homo sapiens
tttattattctctggagaatgt

SEQ ID NO: 7460823 - DNA, 22 bp, Homo sapiens
tttattattctgttctctctac

SEQ ID NO: 7460824 - DNA, 22 bp, Homo sapiens
tttattattctgttctctctac

SEQ ID NO: 7460825 - DNA, 22 bp, Homo sapiens
tttattattctgttctctctac

SEQ ID NO: 7460826 - DNA, 22 bp, Homo sapiens
tttattattctgttctctctac

SEQ ID NO: 7460827 - DNA, 22 bp, Homo sapiens
tttattattctgttctctctac

SEQ ID NO: 7460828 - DNA, 22 bp, Homo sapiens
tttattattctgttctctctac

SEQ ID NO: 7460829 - DNA, 22 bp, Homo sapiens
tttattagattatcaaagaggt

SEQ ID NO: 7460830 - DNA, 22 bp, Homo sapiens
tttattacaccaggttaactca

SEQ ID NO: 7460831 - DNA, 22 bp, Homo sapiens
tttattagattatcaaagaggt

SEQ ID NO: 7460832 - DNA, 22 bp, Homo sapiens
tttattacaccaggttaactca

SEQ ID NO: 7460833 - DNA, 22 bp, Homo sapiens
tttattagattatcaaagaggt

SEQ ID NO: 7460834 - DNA, 22 bp, Homo sapiens
tttattaattagtgacccaatg

SEQ ID NO: 7460835 - DNA, 22 bp, Homo sapiens
tttattaattagtgacccaatg

SEQ ID NO: 7460836 - DNA, 22 bp, Homo sapiens
tttattaattagtgacccaatg

SEQ ID NO: 7460837 - DNA, 22 bp, Homo sapiens
tttattacaccaggttaactca

SEQ ID NO: 7460838 - DNA, 22 bp, Homo sapiens
tttattacaccaggttaactca

SEQ ID NO: 7460839 - DNA, 22 bp, Homo sapiens
tttattaattagtgacccaatg

SEQ ID NO: 7460840 - DNA, 22 bp, Homo sapiens
tttattaattagtgacccaatg

SEQ ID NO: 7460841 - DNA, 22 bp, Homo sapiens
tttattaattagtgacccaatg

SEQ ID NO: 7460842 - DNA, 22 bp, Homo sapiens
tttattaattagtgacccaatg

SEQ ID NO: 7460843 - DNA, 22 bp, Homo sapiens
tttattaatgtagcatccatgg

SEQ ID NO: 7460844 - DNA, 22 bp, Homo sapiens
tttattagtgcttgtatcactg

SEQ ID NO: 7460845 - DNA, 22 bp, Homo sapiens
tttattatagtggtggggactg

SEQ ID NO: 7460846 - DNA, 22 bp, Homo sapiens
tttattatagtggtggggactg

SEQ ID NO: 7460847 - DNA, 22 bp, Homo sapiens
tttattatagtggtggggactg

SEQ ID NO: 7460848 - DNA, 22 bp, Homo sapiens
tttattatagtggtggggactg

SEQ ID NO: 7460849 - DNA, 22 bp, Homo sapiens
tttattagtgcttgtatcactg

SEQ ID NO: 7460850 - DNA, 22 bp, Homo sapiens
tttattagtgcttgtatcactg

SEQ ID NO: 7460851 - DNA, 22 bp, Homo sapiens
tttattatccagtgttgtcatg

SEQ ID NO: 7460852 - DNA, 22 bp, Homo sapiens
tttattatagtggtggggactg

SEQ ID NO: 7460853 - DNA, 22 bp, Homo sapiens
tttattatagtggtggggactg

SEQ ID NO: 7460854 - DNA, 22 bp, Homo sapiens
tttattatccagtgttgtcatg

SEQ ID NO: 7460855 - DNA, 22 bp, Homo sapiens
tttattatccagtgttgtcatg

SEQ ID NO: 7460856 - DNA, 22 bp, Homo sapiens
tttattatccagtgttgtcatg

SEQ ID NO: 7460857 - DNA, 22 bp, Homo sapiens
tttattatccagtgttgtcatg

SEQ ID NO: 7460858 - DNA, 22 bp, Homo sapiens
tttcaaacatatcttcattact

SEQ ID NO: 7460859 - DNA, 22 bp, Homo sapiens
tttcaaacatatcttcattact

SEQ ID NO: 7460860 - DNA, 22 bp, Homo sapiens
tttcaaacatatcttcattact

SEQ ID NO: 7460861 - DNA, 22 bp, Homo sapiens
tttcaaacatagatctgaatat

SEQ ID NO: 7460862 - DNA, 22 bp, Homo sapiens
tttcaaacatagatctgaatat

SEQ ID NO: 7460863 - DNA, 22 bp, Homo sapiens
tttcaaacatatcttcattact

SEQ ID NO: 7460864 - DNA, 22 bp, Homo sapiens
tttcaaaattttgcagtggtaa

SEQ ID NO: 7460865 - DNA, 22 bp, Homo sapiens
tttcaaaattttgcagtggtaa

SEQ ID NO: 7460866 - DNA, 22 bp, Homo sapiens
tttcaaaattttgcagtggtaa

SEQ ID NO: 7460867 - DNA, 15 bp, Homo sapiens
tttcaaaatgaggcc

SEQ ID NO: 7460868 - DNA, 15 bp, Homo sapiens
tttcaaaatgaggcc

SEQ ID NO: 7460869 - DNA, 22 bp, Homo sapiens
tttcaaaattttgcagtggtaa

SEQ ID NO: 7460870 - DNA, 22 bp, Homo sapiens
tttcaaaattttgcagtggtaa

SEQ ID NO: 7460871 - DNA, 22 bp, Homo sapiens
tttcaaaattttgcagtggtaa

SEQ ID NO: 7460872 - DNA, 22 bp, Homo sapiens
tttcaaaattttgcagtggtaa

SEQ ID NO: 7460873 - DNA, 22 bp, Homo sapiens
tttcaaaagcgtacgtagtgaa

SEQ ID NO: 7460874 - DNA, 22 bp, Homo sapiens
tttcaaaagcgtacgtagtgaa

SEQ ID NO: 7460875 - DNA, 22 bp, Homo sapiens
tttcaaaagcgtacgtagtgaa

SEQ ID NO: 7460876 - DNA, 22 bp, Homo sapiens
tttcaaaagcgtacgtagtgaa

SEQ ID NO: 7460877 - DNA, 22 bp, Homo sapiens
tttcaaaagcgtacgtagtgaa

SEQ ID NO: 7460878 - DNA, 22 bp, Homo sapiens
tttcaaacttaaatacctttcc

SEQ ID NO: 7460879 - DNA, 22 bp, Homo sapiens
tttcaaacttaaatacctttcc

SEQ ID NO: 7460880 - DNA, 22 bp, Homo sapiens
tttcaaactgtactttccccta

SEQ ID NO: 7460881 - DNA, 22 bp, Homo sapiens
tttcaaacttaaatacctttcc

SEQ ID NO: 7460882 - DNA, 22 bp, Homo sapiens
tttcaaacttaaatacctttcc

SEQ ID NO: 7460883 - DNA, 22 bp, Homo sapiens
tttcaaactgcccagcacacct

SEQ ID NO: 7460884 - DNA, 22 bp, Homo sapiens
tttcaaactgcccagcacacct

SEQ ID NO: 7460885 - DNA, 22 bp, Homo sapiens
tttcaaactgggagtgagggga

SEQ ID NO: 7460886 - DNA, 22 bp, Homo sapiens
tttcaaactgggagtgagggga

SEQ ID NO: 7460887 - DNA, 22 bp, Homo sapiens
tttcaaactccagctcaccaat

SEQ ID NO: 7460888 - DNA, 20 bp, Homo sapiens
tttcaaactgcacctttgct

SEQ ID NO: 7460889 - DNA, 22 bp, Homo sapiens
tttcaaactgcccagcacacct

SEQ ID NO: 7460890 - DNA, 22 bp, Homo sapiens
tttcaaactgcccagcacacct

SEQ ID NO: 7460891 - DNA, 22 bp, Homo sapiens
tttcaaacctacttgtatgttt

SEQ ID NO: 7460892 - DNA, 22 bp, Homo sapiens
tttcaaactatgtgtcaggcag

SEQ ID NO: 7460893 - DNA, 20 bp, Homo sapiens
tttcaaactgcacctttgct

SEQ ID NO: 7460894 - DNA, 20 bp, Homo sapiens
tttcaaactgcacctttgct

SEQ ID NO: 7460895 - DNA, 22 bp, Homo sapiens
tttcaaacatatcttcattact

SEQ ID NO: 7460896 - DNA, 22 bp, Homo sapiens
tttcaaacattcctgggagact

SEQ ID NO: 7460897 - DNA, 22 bp, Homo sapiens
tttcaaaccactgaggttctga

SEQ ID NO: 7460898 - DNA, 22 bp, Homo sapiens
tttcaaaccactgaggttctga

SEQ ID NO: 7460899 - DNA, 22 bp, Homo sapiens
tttcaaacctacttgtatgttt

SEQ ID NO: 7460900 - DNA, 22 bp, Homo sapiens
tttatttggcatccagggagaa

SEQ ID NO: 7460901 - DNA, 22 bp, Homo sapiens
tttatttggcatctctgccaag

SEQ ID NO: 7460902 - DNA, 22 bp, Homo sapiens
tttatttggcatctctgccaag

SEQ ID NO: 7460903 - DNA, 22 bp, Homo sapiens
tttatttggcatctctgccaag

SEQ ID NO: 7460904 - DNA, 22 bp, Homo sapiens
tttatttggcatctctgccaag

SEQ ID NO: 7460905 - DNA, 22 bp, Homo sapiens
tttatttggcatctctgccaag

SEQ ID NO: 7460906 - DNA, 22 bp, Homo sapiens
tttatttggcatccagggagaa

SEQ ID NO: 7460907 - DNA, 19 bp, Homo sapiens
tttatttgagacatgcctt

SEQ ID NO: 7460908 - DNA, 22 bp, Homo sapiens
tttatttggcatccagggagaa

SEQ ID NO: 7460909 - DNA, 22 bp, Homo sapiens
tttatttggcatccagggagaa

SEQ ID NO: 7460910 - DNA, 22 bp, Homo sapiens
tttatttgtcttgccatttagt

SEQ ID NO: 7460911 - DNA, 22 bp, Homo sapiens
tttatttgtcttgccatttagt

SEQ ID NO: 7460912 - DNA, 22 bp, Homo sapiens
tttatttgtcttgccatttagt

SEQ ID NO: 7460913 - DNA, 22 bp, Homo sapiens
tttatttgtcttgccatttagt

SEQ ID NO: 7460914 - DNA, 22 bp, Homo sapiens
tttatttgtcttgccatttagt

SEQ ID NO: 7460915 - DNA, 22 bp, Homo sapiens
tttatttgtcttgccatttagt

SEQ ID NO: 7460916 - DNA, 22 bp, Homo sapiens
tttatttgtcttgccatttagt

SEQ ID NO: 7460917 - DNA, 22 bp, Homo sapiens
tttatttgtcttgccatttagt

SEQ ID NO: 7460918 - DNA, 22 bp, Homo sapiens
tttatttggcatctctgccaag

SEQ ID NO: 7460919 - DNA, 19 bp, Homo sapiens
tttatttgagacatgcctt

SEQ ID NO: 7460920 - DNA, 19 bp, Homo sapiens
tttatttgagacatgcctt

SEQ ID NO: 7460921 - DNA, 19 bp, Homo sapiens
tttatttgagacatgcctt

SEQ ID NO: 7460922 - DNA, 22 bp, Homo sapiens
tttatttggcatccagggagaa

SEQ ID NO: 7460923 - DNA, 19 bp, Homo sapiens
tttatttgagacatgcctt

SEQ ID NO: 7460924 - DNA, 22 bp, Homo sapiens
tttatttgaatcaggggagaat

SEQ ID NO: 7460925 - DNA, 22 bp, Homo sapiens
tttatttgaatcaggggagaat

SEQ ID NO: 7460926 - DNA, 22 bp, Homo sapiens
tttatttcttagtttgccacag

SEQ ID NO: 7460927 - DNA, 22 bp, Homo sapiens
tttatttcttagtttgccacag

SEQ ID NO: 7460928 - DNA, 22 bp, Homo sapiens
tttatttcttagtttgccacag

SEQ ID NO: 7460929 - DNA, 22 bp, Homo sapiens
tttatttcactctccggatact

SEQ ID NO: 7460930 - DNA, 23 bp, Homo sapiens
tttatttatttaggctgagggat

SEQ ID NO: 7460931 - DNA, 22 bp, Homo sapiens
tttattattctgttctctctac

SEQ ID NO: 7460932 - DNA, 22 bp, Homo sapiens
tttattattctgttctctctac

SEQ ID NO: 7460933 - DNA, 22 bp, Homo sapiens
tttattaaaactgttggctctg

SEQ ID NO: 7460934 - DNA, 22 bp, Homo sapiens
tttatgtttgcattttcaaaga

SEQ ID NO: 7460935 - DNA, 22 bp, Homo sapiens
tttatgtttgcattttcaaaga

SEQ ID NO: 7460936 - DNA, 22 bp, Homo sapiens
tttatgtttgcattttcaaaga

SEQ ID NO: 7460937 - DNA, 22 bp, Homo sapiens
tttattaaaactgttggctctg

SEQ ID NO: 7460938 - DNA, 22 bp, Homo sapiens
tttattaaaactgttggctctg

SEQ ID NO: 7460939 - DNA, 22 bp, Homo sapiens
tttattaaaactgttggctctg

SEQ ID NO: 7460940 - DNA, 22 bp, Homo sapiens
tttattaaaactgttggctctg

SEQ ID NO: 7460941 - DNA, 22 bp, Homo sapiens
tttattaaaactgttggctctg

SEQ ID NO: 7460942 - DNA, 21 bp, Homo sapiens
tttattaacaactgtggacgt

SEQ ID NO: 7460943 - DNA, 21 bp, Homo sapiens
tttattaacaactgtggacgt

SEQ ID NO: 7460944 - DNA, 21 bp, Homo sapiens
tttattaacaactgtggacgt

SEQ ID NO: 7460945 - DNA, 21 bp, Homo sapiens
tttattaacaactgtggacgt

SEQ ID NO: 7460946 - DNA, 21 bp, Homo sapiens
tttattaacaactgtggacgt

SEQ ID NO: 7460947 - DNA, 21 bp, Homo sapiens
tttattaacaactgtggacgt

SEQ ID NO: 7460948 - DNA, 22 bp, Homo sapiens
tttattaatgtagcatccatgg

SEQ ID NO: 7460949 - DNA, 22 bp, Homo sapiens
tttattaatgtagcatccatgg

SEQ ID NO: 7460950 - DNA, 22 bp, Homo sapiens
tttattaatgtagcatccatgg

SEQ ID NO: 7460951 - DNA, 22 bp, Homo sapiens
tttattaatgtagcatccatgg

SEQ ID NO: 7460952 - DNA, 22 bp, Homo sapiens
tttattaagatgcgaatgctga

SEQ ID NO: 7460953 - DNA, 22 bp, Homo sapiens
tttattaatgtagcatccatgg

SEQ ID NO: 7460954 - DNA, 22 bp, Homo sapiens
tttattaatgtagcatccatgg

SEQ ID NO: 7460955 - DNA, 22 bp, Homo sapiens
tttattaatgtagcatccatgg

SEQ ID NO: 7460956 - DNA, 22 bp, Homo sapiens
tttattaatgtagcatccatgg

SEQ ID NO: 7460957 - DNA, 22 bp, Homo sapiens
tttattaatgtagcatccatgg

SEQ ID NO: 7460958 - DNA, 22 bp, Homo sapiens
tttattaagatgcgaatgctga

SEQ ID NO: 7460959 - DNA, 22 bp, Homo sapiens
tttattaagatgcgaatgctga

SEQ ID NO: 7460960 - DNA, 22 bp, Homo sapiens
tttattaagatgcgaatgctga

SEQ ID NO: 7460961 - DNA, 22 bp, Homo sapiens
tttattaagatgcgaatgctga

SEQ ID NO: 7460962 - DNA, 22 bp, Homo sapiens
tttattaagatgcgaatgctga

SEQ ID NO: 7460963 - DNA, 22 bp, Homo sapiens
tttattaagatgcgaatgctga

SEQ ID NO: 7460964 - DNA, 22 bp, Homo sapiens
tttattaagatgcgaatgctga

SEQ ID NO: 7460965 - DNA, 22 bp, Homo sapiens
tttattaagatgcgaatgctga

SEQ ID NO: 7460966 - DNA, 22 bp, Homo sapiens
tttattaagatgcgaatgctga

SEQ ID NO: 7460967 - DNA, 22 bp, Homo sapiens
tttattaagatgcgaatgctga

SEQ ID NO: 7460968 - DNA, 22 bp, Homo sapiens
tttattaagatgcgaatgctga

SEQ ID NO: 7460969 - DNA, 22 bp, Homo sapiens
tttattaagatgcgaatgctga

SEQ ID NO: 7460970 - DNA, 22 bp, Homo sapiens
tttatagtagcatgatttataa

SEQ ID NO: 7460971 - DNA, 22 bp, Homo sapiens
tttatagggtagctaggattga

SEQ ID NO: 7460972 - DNA, 22 bp, Homo sapiens
tttatagtagcatgatttataa

SEQ ID NO: 7460973 - DNA, 22 bp, Homo sapiens
tttatagggtagctaggattga

SEQ ID NO: 7460974 - DNA, 22 bp, Homo sapiens
tttatagggacagttcttggag

SEQ ID NO: 7460975 - DNA, 22 bp, Homo sapiens
tttataggatatgggggaagga

SEQ ID NO: 7460976 - DNA, 22 bp, Homo sapiens
tttatagtagcatgatttatag

SEQ ID NO: 7460977 - DNA, 22 bp, Homo sapiens
tttatagtagcatgatttataa

SEQ ID NO: 7460978 - DNA, 22 bp, Homo sapiens
tttatagtagcatgatttatag

SEQ ID NO: 7460979 - DNA, 22 bp, Homo sapiens
tttatagtagcatgatttatag

SEQ ID NO: 7460980 - DNA, 22 bp, Homo sapiens
tttatagtcgtctcagtaataa

SEQ ID NO: 7460981 - DNA, 22 bp, Homo sapiens
tttatagtcgtctcagtaataa

SEQ ID NO: 7460982 - DNA, 23 bp, Homo sapiens
tttatagcagcatgatttataat

SEQ ID NO: 7460983 - DNA, 23 bp, Homo sapiens
tttatagcagcatgatttataat

SEQ ID NO: 7460984 - DNA, 22 bp, Homo sapiens
tttatagcagcatgatttataa

SEQ ID NO: 7460985 - DNA, 23 bp, Homo sapiens
tttatagcagcatgatttataat

SEQ ID NO: 7460986 - DNA, 23 bp, Homo sapiens
tttatagcagcatgatttataat

SEQ ID NO: 7460987 - DNA, 23 bp, Homo sapiens
tttatagcagcatgatttataat

SEQ ID NO: 7460988 - DNA, 23 bp, Homo sapiens
tttatagcagcatgatttatagt

SEQ ID NO: 7460989 - DNA, 23 bp, Homo sapiens
tttatagcagcatgatttatagt

SEQ ID NO: 7460990 - DNA, 23 bp, Homo sapiens
tttatagcagcatgatttatagt

SEQ ID NO: 7460991 - DNA, 22 bp, Homo sapiens
tttatagcagcatgatttatag

SEQ ID NO: 7460992 - DNA, 23 bp, Homo sapiens
tttatagcagcatgatttatagt

SEQ ID NO: 7460993 - DNA, 23 bp, Homo sapiens
tttatagcagcatgatttatagt

SEQ ID NO: 7460994 - DNA, 22 bp, Homo sapiens
tttatagttatatacagatgtt

SEQ ID NO: 7460995 - DNA, 22 bp, Homo sapiens
tttatagttatatacagatgtt

SEQ ID NO: 7460996 - DNA, 20 bp, Homo sapiens
tttatagtgatcaatttata

SEQ ID NO: 7460997 - DNA, 22 bp, Homo sapiens
tttatagttatatacagatgtt

SEQ ID NO: 7460998 - DNA, 22 bp, Homo sapiens
tttatagttatatacagatgtt

SEQ ID NO: 7460999 - DNA, 22 bp, Homo sapiens
tttatagttatatacagatgtt

SEQ ID NO: 7461000 - DNA, 22 bp, Homo sapiens
tttatagttatatacagatgtt

SEQ ID NO: 7461001 - DNA, 20 bp, Homo sapiens
tttatagtgatcaatttata

SEQ ID NO: 7461002 - DNA, 22 bp, Homo sapiens
tttatagtcgtctcagtaataa

SEQ ID NO: 7461003 - DNA, 22 bp, Homo sapiens
tttatagtcgtctcagtaataa

SEQ ID NO: 7461004 - DNA, 22 bp, Homo sapiens
tttatataacagagactgctat

SEQ ID NO: 7461005 - DNA, 22 bp, Homo sapiens
tttatataacagagactgctat

SEQ ID NO: 7461006 - DNA, 22 bp, Homo sapiens
tttatataacagagactgctat

SEQ ID NO: 7461007 - DNA, 22 bp, Homo sapiens
tttatataacagagactgctat

SEQ ID NO: 7461008 - DNA, 22 bp, Homo sapiens
tttatataacagagactgctat

SEQ ID NO: 7461009 - DNA, 22 bp, Homo sapiens
tttatataacagagactgctat

SEQ ID NO: 7461010 - DNA, 22 bp, Homo sapiens
tttatataacagagactgctat

SEQ ID NO: 7461011 - DNA, 22 bp, Homo sapiens
tttataattatctctactctta

SEQ ID NO: 7461012 - DNA, 22 bp, Homo sapiens
tttataattatctctactctta

SEQ ID NO: 7461013 - DNA, 17 bp, Homo sapiens
tttataattggcctctt

SEQ ID NO: 7461014 - DNA, 22 bp, Homo sapiens
tttataattatctctactctta

SEQ ID NO: 7461015 - DNA, 22 bp, Homo sapiens
tttatacatggagaatttttgc

SEQ ID NO: 7461016 - DNA, 22 bp, Homo sapiens
tttatacatggagaatttttgc

SEQ ID NO: 7461017 - DNA, 22 bp, Homo sapiens
tttatacatggagaatttttgc

SEQ ID NO: 7461018 - DNA, 22 bp, Homo sapiens
tttatacatggagaatttttgc

SEQ ID NO: 7461019 - DNA, 23 bp, Homo sapiens
tttatacaagaaaccgctggcct

SEQ ID NO: 7461020 - DNA, 23 bp, Homo sapiens
tttatacaagaaaccgctggcct

SEQ ID NO: 7461021 - DNA, 23 bp, Homo sapiens
tttatacaagaaaccgctggcct

SEQ ID NO: 7461022 - DNA, 22 bp, Homo sapiens
tttataattatctctactctta

SEQ ID NO: 7461023 - DNA, 22 bp, Homo sapiens
tttatagatgtctgtattataa

SEQ ID NO: 7461024 - DNA, 22 bp, Homo sapiens
tttatagatgtctgtattataa

SEQ ID NO: 7461025 - DNA, 22 bp, Homo sapiens
tttatagatgtctgtattataa

SEQ ID NO: 7461026 - DNA, 22 bp, Homo sapiens
tttatacttcataatgtctatt

SEQ ID NO: 7461027 - DNA, 22 bp, Homo sapiens
tttatacttcataatgtctatt

SEQ ID NO: 7461028 - DNA, 22 bp, Homo sapiens
tttatagacaaactcagaggct

SEQ ID NO: 7461029 - DNA, 22 bp, Homo sapiens
tttatagacaaactcagaggct

SEQ ID NO: 7461030 - DNA, 22 bp, Homo sapiens
tttatagatgtctgtattataa

SEQ ID NO: 7461031 - DNA, 22 bp, Homo sapiens
tttatagatgtctgtattataa

SEQ ID NO: 7461032 - DNA, 22 bp, Homo sapiens
tttatacttcataatgtctatt

SEQ ID NO: 7461033 - DNA, 22 bp, Homo sapiens
tttatacttcataatgtctatt

SEQ ID NO: 7461034 - DNA, 22 bp, Homo sapiens
tttatacttcataatgtctatt

SEQ ID NO: 7461035 - DNA, 22 bp, Homo sapiens
tttatactccactctgcaagcg

SEQ ID NO: 7461036 - DNA, 22 bp, Homo sapiens
tttatacatggagaatttttgc

SEQ ID NO: 7461037 - DNA, 22 bp, Homo sapiens
tttatacatggagaatttttgc

SEQ ID NO: 7461038 - DNA, 22 bp, Homo sapiens
tttagttttgatgaaaatgcca

SEQ ID NO: 7461039 - DNA, 22 bp, Homo sapiens
tttagttttgatgaaaatgcca

SEQ ID NO: 7461040 - DNA, 22 bp, Homo sapiens
tttagttttgatgaaaatgcca

SEQ ID NO: 7461041 - DNA, 22 bp, Homo sapiens
tttagttttgatgaaaatgcca

SEQ ID NO: 7461042 - DNA, 22 bp, Homo sapiens
tttagttttgatgaaaatgcca

SEQ ID NO: 7461043 - DNA, 22 bp, Homo sapiens
tttagtttgatgttctactcct

SEQ ID NO: 7461044 - DNA, 22 bp, Homo sapiens
tttagttttaactgaaagctat

SEQ ID NO: 7461045 - DNA, 22 bp, Homo sapiens
tttagttttaactgaaagctat

SEQ ID NO: 7461046 - DNA, 22 bp, Homo sapiens
tttagttcacaccagggtagca

SEQ ID NO: 7461047 - DNA, 22 bp, Homo sapiens
tttagttattgttacagtatga

SEQ ID NO: 7461048 - DNA, 22 bp, Homo sapiens
tttagttctcccagtcttgatt

SEQ ID NO: 7461049 - DNA, 22 bp, Homo sapiens
tttagttctcccagtcttgatt

SEQ ID NO: 7461050 - DNA, 22 bp, Homo sapiens
tttagttctcccagtcttgatt

SEQ ID NO: 7461051 - DNA, 22 bp, Homo sapiens
tttagttgaaggcagtcctcaa

SEQ ID NO: 7461052 - DNA, 20 bp, Homo sapiens
tttagtttcttctgaggtgt

SEQ ID NO: 7461053 - DNA, 22 bp, Homo sapiens
tttataacatttcttacctgtg

SEQ ID NO: 7461054 - DNA, 22 bp, Homo sapiens
tttataaacagtaccacggtgc

SEQ ID NO: 7461055 - DNA, 22 bp, Homo sapiens
tttataagaagcaatgtctgag

SEQ ID NO: 7461056 - DNA, 22 bp, Homo sapiens
tttataagaagcaatgtctgag

SEQ ID NO: 7461057 - DNA, 22 bp, Homo sapiens
tttataaacagtaccacggtgc

SEQ ID NO: 7461058 - DNA, 22 bp, Homo sapiens
tttataaacagtaccacggtgc

SEQ ID NO: 7461059 - DNA, 22 bp, Homo sapiens
tttataaacagtaccacggtgc

SEQ ID NO: 7461060 - DNA, 22 bp, Homo sapiens
tttataaacagtaccacggtgc

SEQ ID NO: 7461061 - DNA, 22 bp, Homo sapiens
tttataaacagtaccacggtgc

SEQ ID NO: 7461062 - DNA, 22 bp, Homo sapiens
tttataaacagtaccacggtgc

SEQ ID NO: 7461063 - DNA, 22 bp, Homo sapiens
tttataaacagtaccacggtgc

SEQ ID NO: 7461064 - DNA, 22 bp, Homo sapiens
tttataaaatagactgggtcta

SEQ ID NO: 7461065 - DNA, 22 bp, Homo sapiens
tttataaaatagactgggtcta

SEQ ID NO: 7461066 - DNA, 22 bp, Homo sapiens
tttataaaatagactgggtcta

SEQ ID NO: 7461067 - DNA, 22 bp, Homo sapiens
tttataaaatagactgggtcta

SEQ ID NO: 7461068 - DNA, 22 bp, Homo sapiens
tttataaaatagactgggtcta

SEQ ID NO: 7461069 - DNA, 22 bp, Homo sapiens
tttataaaatagactgggtcta

SEQ ID NO: 7461070 - DNA, 22 bp, Homo sapiens
tttataaaatagactgggtcta

SEQ ID NO: 7461071 - DNA, 22 bp, Homo sapiens
tttataaaatagactgggtcta

SEQ ID NO: 7461072 - DNA, 22 bp, Homo sapiens
tttataaaatagactgggtcta

SEQ ID NO: 7461073 - DNA, 22 bp, Homo sapiens
tttataaaatagactgggtcta

SEQ ID NO: 7461074 - DNA, 22 bp, Homo sapiens
tttataaacagtaccacggtgc

SEQ ID NO: 7461075 - DNA, 22 bp, Homo sapiens
tttataaaatagactgggtcta

SEQ ID NO: 7461076 - DNA, 22 bp, Homo sapiens
tttataaaatagactgggtcta

SEQ ID NO: 7461077 - DNA, 22 bp, Homo sapiens
tttctttaaaggaactctgttt

SEQ ID NO: 7461078 - DNA, 22 bp, Homo sapiens
tttctttaaaggaactctgttt

SEQ ID NO: 7461079 - DNA, 22 bp, Homo sapiens
tttctttaaaggaactctgttt

SEQ ID NO: 7461080 - DNA, 22 bp, Homo sapiens
tttctttaaaggaactctgttt

SEQ ID NO: 7461081 - DNA, 22 bp, Homo sapiens
tttctttaaaggaactctgttt

SEQ ID NO: 7461082 - DNA, 22 bp, Homo sapiens
tttctttaattctcacagcaat

SEQ ID NO: 7461083 - DNA, 22 bp, Homo sapiens
tttctttaattctcacagcaat

SEQ ID NO: 7461084 - DNA, 22 bp, Homo sapiens
tttctttaattctcacagcaat

SEQ ID NO: 7461085 - DNA, 22 bp, Homo sapiens
tttctttaattctcacagcaat

SEQ ID NO: 7461086 - DNA, 22 bp, Homo sapiens
tttctttaattctcacagcaat

SEQ ID NO: 7461087 - DNA, 22 bp, Homo sapiens
tttctttaattctcacagcaat

SEQ ID NO: 7461088 - DNA, 22 bp, Homo sapiens
tttcttgtgcctaattttgggc

SEQ ID NO: 7461089 - DNA, 22 bp, Homo sapiens
tttcttgtttcatggtgtctca

SEQ ID NO: 7461090 - DNA, 22 bp, Homo sapiens
tttcttgtttcatggtgtctca

SEQ ID NO: 7461091 - DNA, 22 bp, Homo sapiens
tttcttgtttcatggtgtctca

SEQ ID NO: 7461092 - DNA, 22 bp, Homo sapiens
tttcttgtttcatggtgtctca

SEQ ID NO: 7461093 - DNA, 22 bp, Homo sapiens
tttcttgtctttagtatctggc

SEQ ID NO: 7461094 - DNA, 22 bp, Homo sapiens
tttcttgtctttagtatctggc

SEQ ID NO: 7461095 - DNA, 22 bp, Homo sapiens
tttcttgtctttagtatctggc

SEQ ID NO: 7461096 - DNA, 22 bp, Homo sapiens
tttcttgtgcctaattttgggc

SEQ ID NO: 7461097 - DNA, 22 bp, Homo sapiens
tttcttgtgcctaattttgggc

SEQ ID NO: 7461098 - DNA, 22 bp, Homo sapiens
tttcttgtctttagtatctggc

SEQ ID NO: 7461099 - DNA, 22 bp, Homo sapiens
tttcttgtgcctaattttgggc

SEQ ID NO: 7461100 - DNA, 22 bp, Homo sapiens
tttctttatcatagcatctttg

SEQ ID NO: 7461101 - DNA, 22 bp, Homo sapiens
tttctttatcatagcatctttg

SEQ ID NO: 7461102 - DNA, 22 bp, Homo sapiens
tttctttatcatagcatctttg

SEQ ID NO: 7461103 - DNA, 22 bp, Homo sapiens
tttctttatcatagcatctttg

SEQ ID NO: 7461104 - DNA, 22 bp, Homo sapiens
tttctttaggctgtgttgccaa

SEQ ID NO: 7461105 - DNA, 22 bp, Homo sapiens
tttctttaattctcacagcaat

SEQ ID NO: 7461106 - DNA, 22 bp, Homo sapiens
tttctttaattctcacagcaat

SEQ ID NO: 7461107 - DNA, 22 bp, Homo sapiens
tttctttaggctgtgttgccaa

SEQ ID NO: 7461108 - DNA, 22 bp, Homo sapiens
tttctttaattctcacagcaat

SEQ ID NO: 7461109 - DNA, 22 bp, Homo sapiens
tttctttatcctcctttgcaca

SEQ ID NO: 7461110 - DNA, 22 bp, Homo sapiens
tttctttatcctcctttgcaca

SEQ ID NO: 7461111 - DNA, 22 bp, Homo sapiens
tttctttatcctcctttgcaca

SEQ ID NO: 7461112 - DNA, 22 bp, Homo sapiens
tttctttatcctcctttgcaca

SEQ ID NO: 7461113 - DNA, 22 bp, Homo sapiens
tttctttatcatagcatctttg

SEQ ID NO: 7461114 - DNA, 22 bp, Homo sapiens
tttctttatcatagcatctttg

SEQ ID NO: 7461115 - DNA, 22 bp, Homo sapiens
tttctttatcatagcatctttg

SEQ ID NO: 7461116 - DNA, 22 bp, Homo sapiens
tttctttatcatagcatctttg

SEQ ID NO: 7461117 - DNA, 22 bp, Homo sapiens
tttctttatcatagcatctttg

SEQ ID NO: 7461118 - DNA, 22 bp, Homo sapiens
tttctttatcatagcatctttg

SEQ ID NO: 7461119 - DNA, 22 bp, Homo sapiens
tttctttatcatagcatctttg

SEQ ID NO: 7461120 - DNA, 22 bp, Homo sapiens
tttctttatcatagcatctttg

SEQ ID NO: 7461121 - DNA, 22 bp, Homo sapiens
tttcttctgagatcagggagaa

SEQ ID NO: 7461122 - DNA, 22 bp, Homo sapiens
tttcttctgagatcagggagaa

SEQ ID NO: 7461123 - DNA, 22 bp, Homo sapiens
tttcttctgagatcagggagaa

SEQ ID NO: 7461124 - DNA, 22 bp, Homo sapiens
tttcttctctgattaaggctca

SEQ ID NO: 7461125 - DNA, 22 bp, Homo sapiens
tttcttctgagatcagggagaa

SEQ ID NO: 7461126 - DNA, 22 bp, Homo sapiens
tttcttctctgattaaggctca

SEQ ID NO: 7461127 - DNA, 22 bp, Homo sapiens
tttcttctctgattaaggctca

SEQ ID NO: 7461128 - DNA, 22 bp, Homo sapiens
tttcttctctgattaaggctca

SEQ ID NO: 7461129 - DNA, 22 bp, Homo sapiens
tttcttctctgattaaggctca

SEQ ID NO: 7461130 - DNA, 22 bp, Homo sapiens
tttcttctctgattaaggctca

SEQ ID NO: 7461131 - DNA, 22 bp, Homo sapiens
tttcttctctaatctcaatgat

SEQ ID NO: 7461132 - DNA, 22 bp, Homo sapiens
tttcttctctaatctcaatgat

SEQ ID NO: 7461133 - DNA, 22 bp, Homo sapiens
tttcttctctaatctcaatgat

SEQ ID NO: 7461134 - DNA, 22 bp, Homo sapiens
tttcttctctaatctcaatgat

SEQ ID NO: 7461135 - DNA, 22 bp, Homo sapiens
tttcttctctaatctcaatgat

SEQ ID NO: 7461136 - DNA, 22 bp, Homo sapiens
tttcttctctaatctcaatgat

SEQ ID NO: 7461137 - DNA, 22 bp, Homo sapiens
tttcttctctaatctcaatgat

SEQ ID NO: 7461138 - DNA, 22 bp, Homo sapiens
tttcttctctgattaaggctca

SEQ ID NO: 7461139 - DNA, 22 bp, Homo sapiens
tttcttctctaatctcaatgat

SEQ ID NO: 7461140 - DNA, 20 bp, Homo sapiens
tttcttgtcggctgttgctg

SEQ ID NO: 7461141 - DNA, 20 bp, Homo sapiens
tttcttgtcggctgttgctg

SEQ ID NO: 7461142 - DNA, 20 bp, Homo sapiens
tttcttgtcggctgttgctg

SEQ ID NO: 7461143 - DNA, 20 bp, Homo sapiens
tttcttgtcggctgttgctg

SEQ ID NO: 7461144 - DNA, 20 bp, Homo sapiens
tttcttgtcggctgttgctg

SEQ ID NO: 7461145 - DNA, 20 bp, Homo sapiens
tttcttgtcggctgttgctg

SEQ ID NO: 7461146 - DNA, 20 bp, Homo sapiens
tttcttgtacttggagaagg

SEQ ID NO: 7461147 - DNA, 20 bp, Homo sapiens
tttcttgtacttggagaagg

SEQ ID NO: 7461148 - DNA, 20 bp, Homo sapiens
tttcttgtacttggagaagg

SEQ ID NO: 7461149 - DNA, 20 bp, Homo sapiens
tttcttgtacttggagaagg

SEQ ID NO: 7461150 - DNA, 20 bp, Homo sapiens
tttcttgtacttggagaagg

SEQ ID NO: 7461151 - DNA, 22 bp, Homo sapiens
tttcttgtacactggaatttat

SEQ ID NO: 7461152 - DNA, 20 bp, Homo sapiens
tttcttgtacttggagaagg

SEQ ID NO: 7461153 - DNA, 22 bp, Homo sapiens
tttcttgtaagatgtttattaa

SEQ ID NO: 7461154 - DNA, 22 bp, Homo sapiens
tttcttgtaagatgtttattaa

SEQ ID NO: 7461155 - DNA, 22 bp, Homo sapiens
tttcttgtaagatgtttattaa

SEQ ID NO: 7461156 - DNA, 22 bp, Homo sapiens
tttcttctgagatcagggagaa

SEQ ID NO: 7461157 - DNA, 22 bp, Homo sapiens
tttcttgtaagatgtttattaa

SEQ ID NO: 7461158 - DNA, 22 bp, Homo sapiens
tttcttctaggactaataagag

SEQ ID NO: 7461159 - DNA, 22 bp, Homo sapiens
tttcttctaggactaataagag

SEQ ID NO: 7461160 - DNA, 22 bp, Homo sapiens
tttcttctaggactaataagag

SEQ ID NO: 7461161 - DNA, 22 bp, Homo sapiens
tttcttctaggactaataagag

SEQ ID NO: 7461162 - DNA, 22 bp, Homo sapiens
tttcttctaggactaataagag

SEQ ID NO: 7461163 - DNA, 22 bp, Homo sapiens
tttcttctaggactaataagag

SEQ ID NO: 7461164 - DNA, 22 bp, Homo sapiens
tttcttctaggactaataagag

SEQ ID NO: 7461165 - DNA, 22 bp, Homo sapiens
tttcttctaggactaataagag

SEQ ID NO: 7461166 - DNA, 22 bp, Homo sapiens
tttcttctaggactaataagag

SEQ ID NO: 7461167 - DNA, 22 bp, Homo sapiens
tttcttctaagatttcaaacta

SEQ ID NO: 7461168 - DNA, 22 bp, Homo sapiens
tttcttctaagatttcaaacta

SEQ ID NO: 7461169 - DNA, 22 bp, Homo sapiens
tttcttctaagatttcaaacta

SEQ ID NO: 7461170 - DNA, 22 bp, Homo sapiens
tttcttctaagatttcaaacta

SEQ ID NO: 7461171 - DNA, 22 bp, Homo sapiens
tttcttctaagatttcaaacta

SEQ ID NO: 7461172 - DNA, 22 bp, Homo sapiens
tttcttctaagatttcaaacta

SEQ ID NO: 7461173 - DNA, 22 bp, Homo sapiens
tttcttctaagatttcaaacta

SEQ ID NO: 7461174 - DNA, 22 bp, Homo sapiens
tttcttctaagatttcaaacta

SEQ ID NO: 7461175 - DNA, 22 bp, Homo sapiens
tttcttccttaccttactagag

SEQ ID NO: 7461176 - DNA, 22 bp, Homo sapiens
tttcttctaagatttcaaacta

SEQ ID NO: 7461177 - DNA, 22 bp, Homo sapiens
tttcttctaagatttcaaacta

SEQ ID NO: 7461178 - DNA, 22 bp, Homo sapiens
tttcttctaagatttcaaacta

SEQ ID NO: 7461179 - DNA, 22 bp, Homo sapiens
tttcttcctatgtatcttgctg

SEQ ID NO: 7461180 - DNA, 22 bp, Homo sapiens
tttcttcctatgtatcttgctg

SEQ ID NO: 7461181 - DNA, 22 bp, Homo sapiens
tttcttcctaaatatgatttcc

SEQ ID NO: 7461182 - DNA, 22 bp, Homo sapiens
tttcttcctaaatatgatttcc

SEQ ID NO: 7461183 - DNA, 22 bp, Homo sapiens
tttcttcctaaatatgatttcc

SEQ ID NO: 7461184 - DNA, 22 bp, Homo sapiens
tttcttcctaaatatgatttcc

SEQ ID NO: 7461185 - DNA, 22 bp, Homo sapiens
tttcttcctaaatatgatttcc

SEQ ID NO: 7461186 - DNA, 22 bp, Homo sapiens
tttcttcctaaatatgatttcc

SEQ ID NO: 7461187 - DNA, 22 bp, Homo sapiens
tttcttcctatgtatcttgctg

SEQ ID NO: 7461188 - DNA, 22 bp, Homo sapiens
tttcttcctatgtatcttgctg

SEQ ID NO: 7461189 - DNA, 22 bp, Homo sapiens
tttcttcctatgtatcttgctg

SEQ ID NO: 7461190 - DNA, 22 bp, Homo sapiens
tttcttcctatgtatcttgctg

SEQ ID NO: 7461191 - DNA, 22 bp, Homo sapiens
tttcttcctatgtatcttgctg

SEQ ID NO: 7461192 - DNA, 22 bp, Homo sapiens
tttcttcctgctttgtcccatg

SEQ ID NO: 7461193 - DNA, 22 bp, Homo sapiens
tttcttcctgctttgtcccatg

SEQ ID NO: 7461194 - DNA, 22 bp, Homo sapiens
tttcttcctgctttgtcccatg

SEQ ID NO: 7461195 - DNA, 22 bp, Homo sapiens
tttcttcctgctttgtcccatg

SEQ ID NO: 7461196 - DNA, 22 bp, Homo sapiens
tttcttcctgctttgtcccatg

SEQ ID NO: 7461197 - DNA, 22 bp, Homo sapiens
tttcttcctgctttgtcccatg

SEQ ID NO: 7461198 - DNA, 22 bp, Homo sapiens
tttcttcctggattcctacttc

SEQ ID NO: 7461199 - DNA, 22 bp, Homo sapiens
tttcttcctggattcctacttc

SEQ ID NO: 7461200 - DNA, 22 bp, Homo sapiens
tttcttcctgctttgtcccatg

SEQ ID NO: 7461201 - DNA, 22 bp, Homo sapiens
tttcttcctggattcctacttc

SEQ ID NO: 7461202 - DNA, 22 bp, Homo sapiens
tttcttcctggattcctacttc

SEQ ID NO: 7461203 - DNA, 22 bp, Homo sapiens
tttcttcctggattcctacttc

SEQ ID NO: 7461204 - DNA, 22 bp, Homo sapiens
tttcttccttaccttactagag

SEQ ID NO: 7461205 - DNA, 22 bp, Homo sapiens
tttcttcctggattcctacttc

SEQ ID NO: 7461206 - DNA, 22 bp, Homo sapiens
tttcttcctggattcctacttc

SEQ ID NO: 7461207 - DNA, 22 bp, Homo sapiens
tttcttccttaccttactagag

SEQ ID NO: 7461208 - DNA, 22 bp, Homo sapiens
tttcttcctggattcctacttc

SEQ ID NO: 7461209 - DNA, 22 bp, Homo sapiens
tttcttccttaccttactagag

SEQ ID NO: 7461210 - DNA, 22 bp, Homo sapiens
tttcttctcacccaggacagag

SEQ ID NO: 7461211 - DNA, 22 bp, Homo sapiens
tttcttctcacccaggacagag

SEQ ID NO: 7461212 - DNA, 22 bp, Homo sapiens
tttcttctcacccaggacagag

SEQ ID NO: 7461213 - DNA, 22 bp, Homo sapiens
tttcttctcacccaggacagag

SEQ ID NO: 7461214 - DNA, 22 bp, Homo sapiens
tttcttctcacccaggacagag

SEQ ID NO: 7461215 - DNA, 22 bp, Homo sapiens
tttcttctcatccctgaaatca

SEQ ID NO: 7461216 - DNA, 22 bp, Homo sapiens
tttcttctcatccctgaaatca

SEQ ID NO: 7461217 - DNA, 22 bp, Homo sapiens
tttcttctcatccctgaaatca

SEQ ID NO: 7461218 - DNA, 22 bp, Homo sapiens
tttcttctcatccctgaaatca

SEQ ID NO: 7461219 - DNA, 22 bp, Homo sapiens
tttcttctcatccctgaaatca

SEQ ID NO: 7461220 - DNA, 22 bp, Homo sapiens
tttcttctcacccaggacagag

SEQ ID NO: 7461221 - DNA, 22 bp, Homo sapiens
tttcttctcacccaggacagag

SEQ ID NO: 7461222 - DNA, 22 bp, Homo sapiens
tttcttctcacccaggacagag

SEQ ID NO: 7461223 - DNA, 22 bp, Homo sapiens
tttcttctcacccaggacagag

SEQ ID NO: 7461224 - DNA, 22 bp, Homo sapiens
tttcttctatgtgtgatatttt

SEQ ID NO: 7461225 - DNA, 22 bp, Homo sapiens
tttcttctatgtgtgatatttt

SEQ ID NO: 7461226 - DNA, 22 bp, Homo sapiens
tttcttctatgtgtgatatttt

SEQ ID NO: 7461227 - DNA, 22 bp, Homo sapiens
tttcttctatgtgtgatatttt

SEQ ID NO: 7461228 - DNA, 22 bp, Homo sapiens
tttcttctatgtgtgatatttt

SEQ ID NO: 7461229 - DNA, 22 bp, Homo sapiens
tttcttctaggactaataagag

SEQ ID NO: 7461230 - DNA, 22 bp, Homo sapiens
tttcttctaggactaataagag

SEQ ID NO: 7461231 - DNA, 22 bp, Homo sapiens
tttcttctaggactaataagag

SEQ ID NO: 7461232 - DNA, 22 bp, Homo sapiens
tttcttctatgtgtgatatttt

SEQ ID NO: 7461233 - DNA, 22 bp, Homo sapiens
tttcttctatgtgtgatatttt

SEQ ID NO: 7461234 - DNA, 22 bp, Homo sapiens
tttcttctatgtgtgatatttt

SEQ ID NO: 7461235 - DNA, 22 bp, Homo sapiens
tttcttctcatccctgaaatca

SEQ ID NO: 7461236 - DNA, 22 bp, Homo sapiens
tttcttctcatccctgaaatca

SEQ ID NO: 7461237 - DNA, 22 bp, Homo sapiens
tttcttctcatccctgaaatca

SEQ ID NO: 7461238 - DNA, 22 bp, Homo sapiens
tttcttctcatccctgaaatca

SEQ ID NO: 7461239 - DNA, 22 bp, Homo sapiens
tttcttctcatccctgaaatca

SEQ ID NO: 7461240 - DNA, 22 bp, Homo sapiens
tttcttctccatggcaggtcct

SEQ ID NO: 7461241 - DNA, 22 bp, Homo sapiens
tttcttctcatccctgaaatca

SEQ ID NO: 7461242 - DNA, 22 bp, Homo sapiens
tttcttctccatggcaggtcct

SEQ ID NO: 7461243 - DNA, 22 bp, Homo sapiens
tttcttctcatccctgaaatca

SEQ ID NO: 7461244 - DNA, 22 bp, Homo sapiens
tttcttctcatccctgaaatca

SEQ ID NO: 7461245 - DNA, 22 bp, Homo sapiens
tttcttctcatccctgaaatca

SEQ ID NO: 7461246 - DNA, 22 bp, Homo sapiens
tttcttctcgacaccttatccc

SEQ ID NO: 7461247 - DNA, 22 bp, Homo sapiens
tttcttctcgacaccttatccc

SEQ ID NO: 7461248 - DNA, 22 bp, Homo sapiens
tttcttctcgacaccttatccc

SEQ ID NO: 7461249 - DNA, 22 bp, Homo sapiens
tttcttctcgacaccttatccc

SEQ ID NO: 7461250 - DNA, 23 bp, Homo sapiens
tttcttctcgaagagggagctta

SEQ ID NO: 7461251 - DNA, 22 bp, Homo sapiens
tttcttctccatggcaggtcct

SEQ ID NO: 7461252 - DNA, 23 bp, Homo sapiens
tttcttctcgaagagggagctta

SEQ ID NO: 7461253 - DNA, 22 bp, Homo sapiens
tttcttctcgacaccttatccc

SEQ ID NO: 7461254 - DNA, 22 bp, Homo sapiens
tttcttctcgacaccttatccc

SEQ ID NO: 7461255 - DNA, 22 bp, Homo sapiens
tttcttctcgacaccttatccc

SEQ ID NO: 7461256 - DNA, 23 bp, Homo sapiens
tttcttctcgaagagggagctta

SEQ ID NO: 7461257 - DNA, 22 bp, Homo sapiens
tttcttcaattgctaacaagga

SEQ ID NO: 7461258 - DNA, 22 bp, Homo sapiens
tttcttcaattgctaacaagga

SEQ ID NO: 7461259 - DNA, 22 bp, Homo sapiens
tttcttcaattgctaacaagga

SEQ ID NO: 7461260 - DNA, 22 bp, Homo sapiens
tttcttcaattgctaacaagga

SEQ ID NO: 7461261 - DNA, 22 bp, Homo sapiens
tttcttcaattgctaacaagga

SEQ ID NO: 7461262 - DNA, 22 bp, Homo sapiens
tttcttatgtgcagagtgagta

SEQ ID NO: 7461263 - DNA, 22 bp, Homo sapiens
tttcttatgtgcagagtgagta

SEQ ID NO: 7461264 - DNA, 22 bp, Homo sapiens
tttcttatgtgcagagtgagta

SEQ ID NO: 7461265 - DNA, 22 bp, Homo sapiens
tttcttatgtgcagagtgagta

SEQ ID NO: 7461266 - DNA, 22 bp, Homo sapiens
tttcttatgtgcagagtgagta

SEQ ID NO: 7461267 - DNA, 22 bp, Homo sapiens
tttcttatgagcaagactctat

SEQ ID NO: 7461268 - DNA, 22 bp, Homo sapiens
tttcttatgagcaagactctat

SEQ ID NO: 7461269 - DNA, 22 bp, Homo sapiens
tttcttatgagcaagactctat

SEQ ID NO: 7461270 - DNA, 22 bp, Homo sapiens
tttcttatgagcaagactctat

SEQ ID NO: 7461271 - DNA, 22 bp, Homo sapiens
tttcttatgagcaagactctat

SEQ ID NO: 7461272 - DNA, 22 bp, Homo sapiens
tttcttatggggtagtccttta

SEQ ID NO: 7461273 - DNA, 22 bp, Homo sapiens
tttcttatggggtagtccttta

SEQ ID NO: 7461274 - DNA, 22 bp, Homo sapiens
tttcttatggggtagtccttta

SEQ ID NO: 7461275 - DNA, 22 bp, Homo sapiens
tttcttatggggtagtccttta

SEQ ID NO: 7461276 - DNA, 22 bp, Homo sapiens
tttcttatggggtagtccttta

SEQ ID NO: 7461277 - DNA, 22 bp, Homo sapiens
tttcttcagcaggtttgtgaga

SEQ ID NO: 7461278 - DNA, 22 bp, Homo sapiens
tttcttcagcaggtttgtgaga

SEQ ID NO: 7461279 - DNA, 22 bp, Homo sapiens
tttcttcagccactccaaactg

SEQ ID NO: 7461280 - DNA, 22 bp, Homo sapiens
tttcttcagccactccaaactg

SEQ ID NO: 7461281 - DNA, 22 bp, Homo sapiens
tttcttcagcaggtttgtgaga

SEQ ID NO: 7461282 - DNA, 22 bp, Homo sapiens
tttcttcagagagagctttccc

SEQ ID NO: 7461283 - DNA, 22 bp, Homo sapiens
tttcttcagagagagctttccc

SEQ ID NO: 7461284 - DNA, 22 bp, Homo sapiens
tttcttcagagagagctttccc

SEQ ID NO: 7461285 - DNA, 22 bp, Homo sapiens
tttcttcagagagagctttccc

SEQ ID NO: 7461286 - DNA, 22 bp, Homo sapiens
tttcttcagagagagctttccc

SEQ ID NO: 7461287 - DNA, 23 bp, Homo sapiens
tttcttcagaagccttgcgaggc

SEQ ID NO: 7461288 - DNA, 23 bp, Homo sapiens
tttcttcagaagccttgcgaggc

SEQ ID NO: 7461289 - DNA, 23 bp, Homo sapiens
tttcttcagaagccttgcgaggc

SEQ ID NO: 7461290 - DNA, 21 bp, Homo sapiens
tttcttcactttgccccatgt

SEQ ID NO: 7461291 - DNA, 21 bp, Homo sapiens
tttcttcactttgccccatgt

SEQ ID NO: 7461292 - DNA, 22 bp, Homo sapiens
tttcttcacagggtattgggtg

SEQ ID NO: 7461293 - DNA, 21 bp, Homo sapiens
tttcttcactttgccccatgt

SEQ ID NO: 7461294 - DNA, 22 bp, Homo sapiens
tttcttcacagggtattgggtg

SEQ ID NO: 7461295 - DNA, 22 bp, Homo sapiens
tttcttcaattgctaacaagga

SEQ ID NO: 7461296 - DNA, 22 bp, Homo sapiens
tttcttcaattgctaacaagga

SEQ ID NO: 7461297 - DNA, 22 bp, Homo sapiens
tttcttcaattgctaacaagga

SEQ ID NO: 7461298 - DNA, 22 bp, Homo sapiens
tttcttcacagggtattgggtg

SEQ ID NO: 7461299 - DNA, 22 bp, Homo sapiens
tttcttcacagggtattgggtg

SEQ ID NO: 7461300 - DNA, 22 bp, Homo sapiens
tttcttcattgatgtcaggtgg

SEQ ID NO: 7461301 - DNA, 22 bp, Homo sapiens
tttcttcattgatgtcaggtgg

SEQ ID NO: 7461302 - DNA, 22 bp, Homo sapiens
tttcttcattgatgtcaggtgg

SEQ ID NO: 7461303 - DNA, 22 bp, Homo sapiens
tttcttcattgatgtcaggtgg

SEQ ID NO: 7461304 - DNA, 22 bp, Homo sapiens
tttcttcattgacaaggaaaaa

SEQ ID NO: 7461305 - DNA, 19 bp, Homo sapiens
tttcttccaaagactatgg

SEQ ID NO: 7461306 - DNA, 19 bp, Homo sapiens
tttcttccaaagactatgg

SEQ ID NO: 7461307 - DNA, 22 bp, Homo sapiens
tttcttccaaaggcacgttctc

SEQ ID NO: 7461308 - DNA, 19 bp, Homo sapiens
tttcttccaaagactatgg

SEQ ID NO: 7461309 - DNA, 19 bp, Homo sapiens
tttcttccaaagactatgg

SEQ ID NO: 7461310 - DNA, 19 bp, Homo sapiens
tttcttccaaagactatgg

SEQ ID NO: 7461311 - DNA, 22 bp, Homo sapiens
tttcttccaaaggcacgttctc

SEQ ID NO: 7461312 - DNA, 22 bp, Homo sapiens
tttcttccaaaggcacgttctc

SEQ ID NO: 7461313 - DNA, 22 bp, Homo sapiens
tttcttccaaaggcacgttctc

SEQ ID NO: 7461314 - DNA, 22 bp, Homo sapiens
tttcttcccaagcagtttcaga

SEQ ID NO: 7461315 - DNA, 22 bp, Homo sapiens
tttcttcccaagcagtttcaga

SEQ ID NO: 7461316 - DNA, 22 bp, Homo sapiens
tttcttcccaagcagtttcaga

SEQ ID NO: 7461317 - DNA, 22 bp, Homo sapiens
tttcttcccaagcagtttcaga

SEQ ID NO: 7461318 - DNA, 22 bp, Homo sapiens
tttcttccccaagtgaatttta

SEQ ID NO: 7461319 - DNA, 22 bp, Homo sapiens
tttcttccccaagtgaatttta

SEQ ID NO: 7461320 - DNA, 22 bp, Homo sapiens
tttcttcctaaatatgatttcc

SEQ ID NO: 7461321 - DNA, 21 bp, Homo sapiens
tttcttcccttggcttctgag

SEQ ID NO: 7461322 - DNA, 21 bp, Homo sapiens
tttcttcccttggcttctgag

SEQ ID NO: 7461323 - DNA, 22 bp, Homo sapiens
tttcttccccactgcaggctct

SEQ ID NO: 7461324 - DNA, 22 bp, Homo sapiens
tttcttccccaagtgaatttta

SEQ ID NO: 7461325 - DNA, 22 bp, Homo sapiens
tttcttccccactgcaggctct

SEQ ID NO: 7461326 - DNA, 22 bp, Homo sapiens
tttcttcatagaccttgtcttg

SEQ ID NO: 7461327 - DNA, 22 bp, Homo sapiens
tttcttcatagaccttgtcttg

SEQ ID NO: 7461328 - DNA, 22 bp, Homo sapiens
tttcttcatagaccttgtcttg

SEQ ID NO: 7461329 - DNA, 22 bp, Homo sapiens
tttcttcagtaacacaaaccat

SEQ ID NO: 7461330 - DNA, 22 bp, Homo sapiens
tttcttcagtaacacaaaccat

SEQ ID NO: 7461331 - DNA, 22 bp, Homo sapiens
tttcttcagtaacacaaaccat

SEQ ID NO: 7461332 - DNA, 22 bp, Homo sapiens
tttcttcagccttcacaacctg

SEQ ID NO: 7461333 - DNA, 22 bp, Homo sapiens
tttcttcagccttcacaacctg

SEQ ID NO: 7461334 - DNA, 22 bp, Homo sapiens
tttcttcagcaggtttgtgaga

SEQ ID NO: 7461335 - DNA, 22 bp, Homo sapiens
tttcttcattcaccttcacccc

SEQ ID NO: 7461336 - DNA, 22 bp, Homo sapiens
tttcttcattcaccttcacccc

SEQ ID NO: 7461337 - DNA, 22 bp, Homo sapiens
tttcttcattcaccttcacccc

SEQ ID NO: 7461338 - DNA, 22 bp, Homo sapiens
tttcttcatagaccttgtcttg

SEQ ID NO: 7461339 - DNA, 22 bp, Homo sapiens
tttcttcattcaccttcacccc

SEQ ID NO: 7461340 - DNA, 22 bp, Homo sapiens
tttcttcattgacaaggaaaaa

SEQ ID NO: 7461341 - DNA, 22 bp, Homo sapiens
tttcttcattgacaaggaaaaa

SEQ ID NO: 7461342 - DNA, 22 bp, Homo sapiens
tttcttcattgacaaggaaaaa

SEQ ID NO: 7461343 - DNA, 22 bp, Homo sapiens
tttcttcattgacaaggaaaaa

SEQ ID NO: 7461344 - DNA, 22 bp, Homo sapiens
tttcttcattgacaaggaaaaa

SEQ ID NO: 7461345 - DNA, 19 bp, Homo sapiens
tttctgttagaaggataca

SEQ ID NO: 7461346 - DNA, 19 bp, Homo sapiens
tttctgttagaaggataca

SEQ ID NO: 7461347 - DNA, 19 bp, Homo sapiens
tttctgttagaaggataca

SEQ ID NO: 7461348 - DNA, 22 bp, Homo sapiens
tttctgtggtgggtagttcaga

SEQ ID NO: 7461349 - DNA, 22 bp, Homo sapiens
tttctgtggattttccattcaa

SEQ ID NO: 7461350 - DNA, 22 bp, Homo sapiens
tttctgtggattttccattcaa

SEQ ID NO: 7461351 - DNA, 22 bp, Homo sapiens
tttctgtggtgggtagttcaga

SEQ ID NO: 7461352 - DNA, 23 bp, Homo sapiens
tttctgttcctctagctttgcat

SEQ ID NO: 7461353 - DNA, 23 bp, Homo sapiens
tttctgttcctctagctttgcat

SEQ ID NO: 7461354 - DNA, 23 bp, Homo sapiens
tttctgttcctctagctttgcat

SEQ ID NO: 7461355 - DNA, 23 bp, Homo sapiens
tttctgttcctctagctttgcat

SEQ ID NO: 7461356 - DNA, 22 bp, Homo sapiens
tttctgttaggcatcattttaa

SEQ ID NO: 7461357 - DNA, 22 bp, Homo sapiens
tttctgttaggcatcattttaa

SEQ ID NO: 7461358 - DNA, 22 bp, Homo sapiens
tttctgttaggcatcattttaa

SEQ ID NO: 7461359 - DNA, 22 bp, Homo sapiens
tttctgttaggcatcattttaa

SEQ ID NO: 7461360 - DNA, 22 bp, Homo sapiens
tttctgttaggcatcattttaa

SEQ ID NO: 7461361 - DNA, 22 bp, Homo sapiens
tttctgttaggcatcattttaa

SEQ ID NO: 7461362 - DNA, 22 bp, Homo sapiens
tttctgttaggcatcattttaa

SEQ ID NO: 7461363 - DNA, 22 bp, Homo sapiens
tttctgttgtacttaaactagg

SEQ ID NO: 7461364 - DNA, 22 bp, Homo sapiens
tttctgttgtacttaaactagg

SEQ ID NO: 7461365 - DNA, 22 bp, Homo sapiens
tttctgttgtacttaaactagg

SEQ ID NO: 7461366 - DNA, 23 bp, Homo sapiens
tttctgttgggtatatatccaag

SEQ ID NO: 7461367 - DNA, 23 bp, Homo sapiens
tttctgttgggtatatatccaag

SEQ ID NO: 7461368 - DNA, 23 bp, Homo sapiens
tttctgttgggtatatatccaag

SEQ ID NO: 7461369 - DNA, 23 bp, Homo sapiens
tttctgttgggtatatatccaag

SEQ ID NO: 7461370 - DNA, 23 bp, Homo sapiens
tttctgttgggtatatatccaag

SEQ ID NO: 7461371 - DNA, 22 bp, Homo sapiens
tttcttatattctgtcattgtt

SEQ ID NO: 7461372 - DNA, 22 bp, Homo sapiens
tttctgttgtacttaaactagg

SEQ ID NO: 7461373 - DNA, 22 bp, Homo sapiens
tttctgttgtacttaaactagg

SEQ ID NO: 7461374 - DNA, 22 bp, Homo sapiens
tttctgttgtacttaaactagg

SEQ ID NO: 7461375 - DNA, 21 bp, Homo sapiens
tttcttatctgtaaagtggga

SEQ ID NO: 7461376 - DNA, 22 bp, Homo sapiens
tttctgttgtacttaaactagg

SEQ ID NO: 7461377 - DNA, 22 bp, Homo sapiens
tttcttatattctgtcattgtt

SEQ ID NO: 7461378 - DNA, 21 bp, Homo sapiens
tttcttatctgtaaagtggga

SEQ ID NO: 7461379 - DNA, 21 bp, Homo sapiens
tttcttatctgtaaagtggga

SEQ ID NO: 7461380 - DNA, 21 bp, Homo sapiens
tttcttatctgtaaagtggga

SEQ ID NO: 7461381 - DNA, 22 bp, Homo sapiens
tttctgtaagttcaggctttcc

SEQ ID NO: 7461382 - DNA, 22 bp, Homo sapiens
tttctgtatttaaaagatctgg

SEQ ID NO: 7461383 - DNA, 22 bp, Homo sapiens
tttctgtatttaaaagatctgg

SEQ ID NO: 7461384 - DNA, 22 bp, Homo sapiens
tttctgtatttaaaagatctgg

SEQ ID NO: 7461385 - DNA, 22 bp, Homo sapiens
tttctgtatttaggacaggtgg

SEQ ID NO: 7461386 - DNA, 22 bp, Homo sapiens
tttctgtatttaggacaggtgg

SEQ ID NO: 7461387 - DNA, 22 bp, Homo sapiens
tttctgtaggggatatctttga

SEQ ID NO: 7461388 - DNA, 22 bp, Homo sapiens
tttctgtagggatttcacagtt

SEQ ID NO: 7461389 - DNA, 22 bp, Homo sapiens
tttctgtagtgtggtatgtagg

SEQ ID NO: 7461390 - DNA, 22 bp, Homo sapiens
tttctgtagtgtggtatgtagg

SEQ ID NO: 7461391 - DNA, 22 bp, Homo sapiens
tttctgtattttgtcataacct

SEQ ID NO: 7461392 - DNA, 22 bp, Homo sapiens
tttctgtattttgtcataacct

SEQ ID NO: 7461393 - DNA, 22 bp, Homo sapiens
tttctgtcattactttcctccc

SEQ ID NO: 7461394 - DNA, 21 bp, Homo sapiens
tttctgtcctttccatcagct

SEQ ID NO: 7461395 - DNA, 21 bp, Homo sapiens
tttctgtcctttccatcagct

SEQ ID NO: 7461396 - DNA, 21 bp, Homo sapiens
tttctgtcctttccatcagct

SEQ ID NO: 7461397 - DNA, 20 bp, Homo sapiens
tttctgtgcccaggtctgtt

SEQ ID NO: 7461398 - DNA, 20 bp, Homo sapiens
tttctgtgcccaggtctgtt

SEQ ID NO: 7461399 - DNA, 20 bp, Homo sapiens
tttctgtgcccaggtctgtt

SEQ ID NO: 7461400 - DNA, 22 bp, Homo sapiens
tttctgtggattttccattcaa

SEQ ID NO: 7461401 - DNA, 20 bp, Homo sapiens
tttctgtgaggactgtactg

SEQ ID NO: 7461402 - DNA, 20 bp, Homo sapiens
tttctgtgatagagaggtgt

SEQ ID NO: 7461403 - DNA, 20 bp, Homo sapiens
tttctgtgatagagaggtgt

SEQ ID NO: 7461404 - DNA, 20 bp, Homo sapiens
tttctgtgatagagaggtgt

SEQ ID NO: 7461405 - DNA, 22 bp, Homo sapiens
tttctgtgataggctgcgacgc

SEQ ID NO: 7461406 - DNA, 19 bp, Homo sapiens
tttctgtctgtgttttgcc

SEQ ID NO: 7461407 - DNA, 19 bp, Homo sapiens
tttctgtctgtgttttgcc

SEQ ID NO: 7461408 - DNA, 22 bp, Homo sapiens
tttctgtgaattataaaatttg

SEQ ID NO: 7461409 - DNA, 20 bp, Homo sapiens
tttctgtgagaaacactgtt

SEQ ID NO: 7461410 - DNA, 20 bp, Homo sapiens
tttctgtgagaaacactgtt

SEQ ID NO: 7461411 - DNA, 21 bp, Homo sapiens
tttctgtctctgccactagtt

SEQ ID NO: 7461412 - DNA, 21 bp, Homo sapiens
tttctgtctctgccactagtt

SEQ ID NO: 7461413 - DNA, 22 bp, Homo sapiens
tttctgtctgacatccctgcct

SEQ ID NO: 7461414 - DNA, 22 bp, Homo sapiens
tttctcctgagttccacgctac

SEQ ID NO: 7461415 - DNA, 22 bp, Homo sapiens
tttctcctctccagagtgcagt

SEQ ID NO: 7461416 - DNA, 22 bp, Homo sapiens
tttctcctctccagagtgcagt

SEQ ID NO: 7461417 - DNA, 22 bp, Homo sapiens
tttctcctctccagagtgcagt

SEQ ID NO: 7461418 - DNA, 22 bp, Homo sapiens
tttctcctgagttccacgctac

SEQ ID NO: 7461419 - DNA, 22 bp, Homo sapiens
tttctcctgagttccacgctac

SEQ ID NO: 7461420 - DNA, 22 bp, Homo sapiens
tttctcctgagttccacgctac

SEQ ID NO: 7461421 - DNA, 22 bp, Homo sapiens
tttctcctgagttccacgctac

SEQ ID NO: 7461422 - DNA, 22 bp, Homo sapiens
tttctcctgagttccacgctac

SEQ ID NO: 7461423 - DNA, 22 bp, Homo sapiens
tttctcctgcccagatgcctgg

SEQ ID NO: 7461424 - DNA, 22 bp, Homo sapiens
tttctcctgcccagatgcctgg

SEQ ID NO: 7461425 - DNA, 22 bp, Homo sapiens
tttctcctgcccagatgcctgg

SEQ ID NO: 7461426 - DNA, 22 bp, Homo sapiens
tttctcctgctagaacaaggag

SEQ ID NO: 7461427 - DNA, 22 bp, Homo sapiens
tttctcctgctagaacaaggag

SEQ ID NO: 7461428 - DNA, 22 bp, Homo sapiens
tttctcctgtgaggtcagaagt

SEQ ID NO: 7461429 - DNA, 22 bp, Homo sapiens
tttctccttgtgtctcctttga

SEQ ID NO: 7461430 - DNA, 22 bp, Homo sapiens
tttctccttgtgtctcctttga

SEQ ID NO: 7461431 - DNA, 22 bp, Homo sapiens
tttctccttgtgtctcctttga

SEQ ID NO: 7461432 - DNA, 22 bp, Homo sapiens
tttctccttgtgtctcctttga

SEQ ID NO: 7461433 - DNA, 17 bp, Homo sapiens
tttctccttccatctca

SEQ ID NO: 7461434 - DNA, 17 bp, Homo sapiens
tttctccttccatctca

SEQ ID NO: 7461435 - DNA, 17 bp, Homo sapiens
tttctccttccatctca

SEQ ID NO: 7461436 - DNA, 17 bp, Homo sapiens
tttctccttccatctca

SEQ ID NO: 7461437 - DNA, 17 bp, Homo sapiens
tttctccttccatctca

SEQ ID NO: 7461438 - DNA, 22 bp, Homo sapiens
tttctcctgtgaggtcagaagt

SEQ ID NO: 7461439 - DNA, 22 bp, Homo sapiens
tttctcctgtgaggtcagaagt

SEQ ID NO: 7461440 - DNA, 22 bp, Homo sapiens
tttctcctgtgaggtcagaagt

SEQ ID NO: 7461441 - DNA, 22 bp, Homo sapiens
tttctcctgtgaggtcagaagt

SEQ ID NO: 7461442 - DNA, 22 bp, Homo sapiens
tttctcctgtgaggtcagaagt

SEQ ID NO: 7461443 - DNA, 22 bp, Homo sapiens
tttctcctgtgaggtcagaagt

SEQ ID NO: 7461444 - DNA, 22 bp, Homo sapiens
tttctcctgtgtaagccgccca

SEQ ID NO: 7461445 - DNA, 22 bp, Homo sapiens
tttctcctgtgtaagccgccca

SEQ ID NO: 7461446 - DNA, 17 bp, Homo sapiens
tttctccttccatctca

SEQ ID NO: 7461447 - DNA, 17 bp, Homo sapiens
tttctccttccatctca

SEQ ID NO: 7461448 - DNA, 17 bp, Homo sapiens
tttctccttccatctca

SEQ ID NO: 7461449 - DNA, 22 bp, Homo sapiens
tttctctagctattcattaaat

SEQ ID NO: 7461450 - DNA, 22 bp, Homo sapiens
tttctctagctattcattaaat

SEQ ID NO: 7461451 - DNA, 22 bp, Homo sapiens
tttctctagctattcattaaat

SEQ ID NO: 7461452 - DNA, 22 bp, Homo sapiens
tttctctaaatagggaggctta

SEQ ID NO: 7461453 - DNA, 22 bp, Homo sapiens
tttctctagctattcattaaat

SEQ ID NO: 7461454 - DNA, 22 bp, Homo sapiens
tttctccttgtgtctcctttga

SEQ ID NO: 7461455 - DNA, 22 bp, Homo sapiens
tttctcggcagagatgatgggc

SEQ ID NO: 7461456 - DNA, 22 bp, Homo sapiens
tttctcggcagagatgatgggc

SEQ ID NO: 7461457 - DNA, 22 bp, Homo sapiens
tttctctaaatagggaggctta

SEQ ID NO: 7461458 - DNA, 18 bp, Homo sapiens
tttctctgtcgtcttctg

SEQ ID NO: 7461459 - DNA, 22 bp, Homo sapiens
tttctctagctattcattaaat

SEQ ID NO: 7461460 - DNA, 19 bp, Homo sapiens
tttctctgtgcaccttttc

SEQ ID NO: 7461461 - DNA, 22 bp, Homo sapiens
tttctctgtgccatttccataa

SEQ ID NO: 7461462 - DNA, 22 bp, Homo sapiens
tttctctgtgccatttccataa

SEQ ID NO: 7461463 - DNA, 22 bp, Homo sapiens
tttctctgtgccatttccataa

SEQ ID NO: 7461464 - DNA, 22 bp, Homo sapiens
tttctctgtgccatttccataa

SEQ ID NO: 7461465 - DNA, 22 bp, Homo sapiens
tttctcttaatgtctctgtgct

SEQ ID NO: 7461466 - DNA, 22 bp, Homo sapiens
tttctcttcactgtgtgcctca

SEQ ID NO: 7461467 - DNA, 22 bp, Homo sapiens
tttctcttcactgtgtgcctca

SEQ ID NO: 7461468 - DNA, 22 bp, Homo sapiens
tttctcttaatgtctctgtgct

SEQ ID NO: 7461469 - DNA, 22 bp, Homo sapiens
tttctcttaatgtctctgtgct

SEQ ID NO: 7461470 - DNA, 22 bp, Homo sapiens
tttctcttaatgtctctgtgct

SEQ ID NO: 7461471 - DNA, 22 bp, Homo sapiens
tttctcttaatgtctctgtgct

SEQ ID NO: 7461472 - DNA, 22 bp, Homo sapiens
tttctctgttctctaactgtaa

SEQ ID NO: 7461473 - DNA, 22 bp, Homo sapiens
tttctctgtgccatttccataa

SEQ ID NO: 7461474 - DNA, 22 bp, Homo sapiens
tttctctgtgggctttatgcat

SEQ ID NO: 7461475 - DNA, 22 bp, Homo sapiens
tttctctgtgggctttatgcat

SEQ ID NO: 7461476 - DNA, 22 bp, Homo sapiens
tttctctgttctctaactgtaa

SEQ ID NO: 7461477 - DNA, 22 bp, Homo sapiens
tttctctgttctctaactgtaa

SEQ ID NO: 7461478 - DNA, 22 bp, Homo sapiens
tttctctgttctctaactgtaa

SEQ ID NO: 7461479 - DNA, 22 bp, Homo sapiens
tttctctttgacaggaatcaga

SEQ ID NO: 7461480 - DNA, 22 bp, Homo sapiens
tttctctttgacaggaatcaga

SEQ ID NO: 7461481 - DNA, 22 bp, Homo sapiens
tttctctttgacaggaatcaga

SEQ ID NO: 7461482 - DNA, 22 bp, Homo sapiens
tttctctttgacaggaatcaga

SEQ ID NO: 7461483 - DNA, 22 bp, Homo sapiens
tttctctttgacaggaatcaga

SEQ ID NO: 7461484 - DNA, 22 bp, Homo sapiens
tttctctttcaatctgcagtac

SEQ ID NO: 7461485 - DNA, 22 bp, Homo sapiens
tttctctttcaatctgcagtac

SEQ ID NO: 7461486 - DNA, 22 bp, Homo sapiens
tttctctttcaatctgcagtac

SEQ ID NO: 7461487 - DNA, 22 bp, Homo sapiens
tttctctttcaatctgcagtac

SEQ ID NO: 7461488 - DNA, 22 bp, Homo sapiens
tttctgaaaactgaagtagtgc

SEQ ID NO: 7461489 - DNA, 22 bp, Homo sapiens
tttctgaaaactgaagtagtgc

SEQ ID NO: 7461490 - DNA, 22 bp, Homo sapiens
tttctgaaaactgaagtagtgc

SEQ ID NO: 7461491 - DNA, 22 bp, Homo sapiens
tttctgaaaactgaagtagtgc

SEQ ID NO: 7461492 - DNA, 22 bp, Homo sapiens
tttctgaaaactgaagtagtgc

SEQ ID NO: 7461493 - DNA, 22 bp, Homo sapiens
tttctgaaaactgaagtagtgc

SEQ ID NO: 7461494 - DNA, 22 bp, Homo sapiens
tttctctttgacaggaatcaga

SEQ ID NO: 7461495 - DNA, 22 bp, Homo sapiens
tttctctttgacaggaatcaga

SEQ ID NO: 7461496 - DNA, 22 bp, Homo sapiens
tttctcttcactgtgtgcctca

SEQ ID NO: 7461497 - DNA, 22 bp, Homo sapiens
tttctcttcactgtgtgcctca

SEQ ID NO: 7461498 - DNA, 22 bp, Homo sapiens
tttctcttcactgtgtgcctca

SEQ ID NO: 7461499 - DNA, 22 bp, Homo sapiens
tttctcttgcgatatgctacac

SEQ ID NO: 7461500 - DNA, 22 bp, Homo sapiens
tttctcttgcgatatgctacac

SEQ ID NO: 7461501 - DNA, 22 bp, Homo sapiens
tttctcttcactgtgtgcctca

SEQ ID NO: 7461502 - DNA, 22 bp, Homo sapiens
tttctcttgcgatatgctacac

SEQ ID NO: 7461503 - DNA, 22 bp, Homo sapiens
tttctctttcaatctgcagtac

SEQ ID NO: 7461504 - DNA, 22 bp, Homo sapiens
tttctctttcaatctgcagtac

SEQ ID NO: 7461505 - DNA, 22 bp, Homo sapiens
tttctctttcaatctgcagtac

SEQ ID NO: 7461506 - DNA, 22 bp, Homo sapiens
tttctctttcaatctgcagtac

SEQ ID NO: 7461507 - DNA, 22 bp, Homo sapiens
tttctctttcaatctgcagtac

SEQ ID NO: 7461508 - DNA, 22 bp, Homo sapiens
tttctctttcaatctgcagtac

SEQ ID NO: 7461509 - DNA, 22 bp, Homo sapiens
tttctgaagatacagctttgct

SEQ ID NO: 7461510 - DNA, 22 bp, Homo sapiens
tttctgaagatacagctttgct

SEQ ID NO: 7461511 - DNA, 22 bp, Homo sapiens
tttctgaagatacagctttgct

SEQ ID NO: 7461512 - DNA, 22 bp, Homo sapiens
tttctgaacttggtactggagc

SEQ ID NO: 7461513 - DNA, 22 bp, Homo sapiens
tttctgaagatacagctttgct

SEQ ID NO: 7461514 - DNA, 22 bp, Homo sapiens
tttctgaagatacagctttgct

SEQ ID NO: 7461515 - DNA, 22 bp, Homo sapiens
tttctgaagatacagctttgct

SEQ ID NO: 7461516 - DNA, 22 bp, Homo sapiens
tttctgaacttggtactggagc

SEQ ID NO: 7461517 - DNA, 22 bp, Homo sapiens
tttctgaacttggtactggagc

SEQ ID NO: 7461518 - DNA, 21 bp, Homo sapiens
tttctgaaggcaacatctatc

SEQ ID NO: 7461519 - DNA, 22 bp, Homo sapiens
tttctgaagggcagcagactct

SEQ ID NO: 7461520 - DNA, 22 bp, Homo sapiens
tttctgaagggcagcagactct

SEQ ID NO: 7461521 - DNA, 21 bp, Homo sapiens
tttctgaaggcaacatctatc

SEQ ID NO: 7461522 - DNA, 21 bp, Homo sapiens
tttctgaaggcaacatctatc

SEQ ID NO: 7461523 - DNA, 21 bp, Homo sapiens
tttctgaaggcaacatctatc

SEQ ID NO: 7461524 - DNA, 21 bp, Homo sapiens
tttctgaaggcaacatctatc

SEQ ID NO: 7461525 - DNA, 21 bp, Homo sapiens
tttctgaaggcaacatctatc

SEQ ID NO: 7461526 - DNA, 21 bp, Homo sapiens
tttctgaaggcaacatctatc

SEQ ID NO: 7461527 - DNA, 21 bp, Homo sapiens
tttctgaaggcaacatctatc

SEQ ID NO: 7461528 - DNA, 21 bp, Homo sapiens
tttctgaaggcaacatctatc

SEQ ID NO: 7461529 - DNA, 22 bp, Homo sapiens
tttctgaaatgctggctttgga

SEQ ID NO: 7461530 - DNA, 22 bp, Homo sapiens
tttctgaaatgctggctttgga

SEQ ID NO: 7461531 - DNA, 22 bp, Homo sapiens
tttctgaaatgctggctttgga

SEQ ID NO: 7461532 - DNA, 22 bp, Homo sapiens
tttctgaaatctcttttgagga

SEQ ID NO: 7461533 - DNA, 22 bp, Homo sapiens
tttctgaaatctcttttgagga

SEQ ID NO: 7461534 - DNA, 22 bp, Homo sapiens
tttctgaaatgctggctttgga

SEQ ID NO: 7461535 - DNA, 22 bp, Homo sapiens
tttctgaaatgctggctttgga

SEQ ID NO: 7461536 - DNA, 22 bp, Homo sapiens
tttctgaacaaagccattatca

SEQ ID NO: 7461537 - DNA, 22 bp, Homo sapiens
tttctgaacaaagccattatca

SEQ ID NO: 7461538 - DNA, 22 bp, Homo sapiens
tttctgaacaaagccattatca

SEQ ID NO: 7461539 - DNA, 22 bp, Homo sapiens
tttctgaacaaagccattatca

SEQ ID NO: 7461540 - DNA, 22 bp, Homo sapiens
tttctgaaacatggtctttgta

SEQ ID NO: 7461541 - DNA, 22 bp, Homo sapiens
tttctgaaatctcttttgagga

SEQ ID NO: 7461542 - DNA, 22 bp, Homo sapiens
tttctgaaatctcttttgagga

SEQ ID NO: 7461543 - DNA, 22 bp, Homo sapiens
tttctgaaatctcttttgagga

SEQ ID NO: 7461544 - DNA, 22 bp, Homo sapiens
tttctgaaatctcttttgagga

SEQ ID NO: 7461545 - DNA, 22 bp, Homo sapiens
tttctgaaatctcttttgagga

SEQ ID NO: 7461546 - DNA, 22 bp, Homo sapiens
tttctgaaacatggtctttgta

SEQ ID NO: 7461547 - DNA, 22 bp, Homo sapiens
tttctgaaacatggtctttgta

SEQ ID NO: 7461548 - DNA, 22 bp, Homo sapiens
tttctgaaaactgaagtagtgc

SEQ ID NO: 7461549 - DNA, 22 bp, Homo sapiens
tttctgaaacatggtctttgta

SEQ ID NO: 7461550 - DNA, 22 bp, Homo sapiens
tttctgaaacatggtctttgta

SEQ ID NO: 7461551 - DNA, 22 bp, Homo sapiens
tttctggaacagtaattgaaga

SEQ ID NO: 7461552 - DNA, 22 bp, Homo sapiens
tttctggaaagcaagatacatt

SEQ ID NO: 7461553 - DNA, 22 bp, Homo sapiens
tttctggaaactgtaaagagga

SEQ ID NO: 7461554 - DNA, 22 bp, Homo sapiens
tttctggaaactgtaaagagga

SEQ ID NO: 7461555 - DNA, 22 bp, Homo sapiens
tttctggaaagcaagatacatt

SEQ ID NO: 7461556 - DNA, 22 bp, Homo sapiens
tttctggaaagcaagatacatt

SEQ ID NO: 7461557 - DNA, 22 bp, Homo sapiens
tttctggattcatacagatgta

SEQ ID NO: 7461558 - DNA, 22 bp, Homo sapiens
tttctggacccttctgtgagtg

SEQ ID NO: 7461559 - DNA, 22 bp, Homo sapiens
tttctggacccttctgtgagtg

SEQ ID NO: 7461560 - DNA, 22 bp, Homo sapiens
tttctggacccttctgtgagtg

SEQ ID NO: 7461561 - DNA, 22 bp, Homo sapiens
tttctggaggcccaagggcaga

SEQ ID NO: 7461562 - DNA, 22 bp, Homo sapiens
tttctggaaccacaaaagtatg

SEQ ID NO: 7461563 - DNA, 17 bp, Homo sapiens
tttctggaatgggcaaa

SEQ ID NO: 7461564 - DNA, 22 bp, Homo sapiens
tttctggacagcaagatcagtt

SEQ ID NO: 7461565 - DNA, 22 bp, Homo sapiens
tttctggacagcaagatcagtt

SEQ ID NO: 7461566 - DNA, 17 bp, Homo sapiens
tttctggaatgggcaaa

SEQ ID NO: 7461567 - DNA, 22 bp, Homo sapiens
tttctgcttgagagaattgctg

SEQ ID NO: 7461568 - DNA, 22 bp, Homo sapiens
tttctgcttgagagaattgctg

SEQ ID NO: 7461569 - DNA, 22 bp, Homo sapiens
tttctgcttccttgagaaggag

SEQ ID NO: 7461570 - DNA, 22 bp, Homo sapiens
tttctgctttcagagtgagaca

SEQ ID NO: 7461571 - DNA, 22 bp, Homo sapiens
tttctggaaacgggttcaagct

SEQ ID NO: 7461572 - DNA, 22 bp, Homo sapiens
tttctggaaacgggttcaagct

SEQ ID NO: 7461573 - DNA, 22 bp, Homo sapiens
tttctgctgtgtaaaatgaggg

SEQ ID NO: 7461574 - DNA, 22 bp, Homo sapiens
tttctgctgtgtaaaatgaggg

SEQ ID NO: 7461575 - DNA, 22 bp, Homo sapiens
tttctgcttaggactctgtgga

SEQ ID NO: 7461576 - DNA, 22 bp, Homo sapiens
tttctgcttaggactctgtgga

SEQ ID NO: 7461577 - DNA, 22 bp, Homo sapiens
tttctgctgtgctttcttgcgt

SEQ ID NO: 7461578 - DNA, 22 bp, Homo sapiens
tttctgctgtgctttcttgcgt

SEQ ID NO: 7461579 - DNA, 20 bp, Homo sapiens
tttctgtagctcagtattca

SEQ ID NO: 7461580 - DNA, 20 bp, Homo sapiens
tttctgtagctcagtattca

SEQ ID NO: 7461581 - DNA, 22 bp, Homo sapiens
tttctgtagggatttcacagtt

SEQ ID NO: 7461582 - DNA, 22 bp, Homo sapiens
tttctgtagggatttcacagtt

SEQ ID NO: 7461583 - DNA, 22 bp, Homo sapiens
tttctgtagggatttcacagtt

SEQ ID NO: 7461584 - DNA, 22 bp, Homo sapiens
tttctgtacctcctcttgcccc

SEQ ID NO: 7461585 - DNA, 20 bp, Homo sapiens
tttctgtagctcagtattca

SEQ ID NO: 7461586 - DNA, 22 bp, Homo sapiens
tttctgtacacccactattcat

SEQ ID NO: 7461587 - DNA, 22 bp, Homo sapiens
tttctgtaagtggcaaataatg

SEQ ID NO: 7461588 - DNA, 20 bp, Homo sapiens
tttctgtaaggcattaatct

SEQ ID NO: 7461589 - DNA, 20 bp, Homo sapiens
tttctgtaaggcattaatct

SEQ ID NO: 7461590 - DNA, 22 bp, Homo sapiens
tttctgtaagtggcaaataatg

SEQ ID NO: 7461591 - DNA, 22 bp, Homo sapiens
tttctgtacacccactattcat

SEQ ID NO: 7461592 - DNA, 22 bp, Homo sapiens
tttctgtaattggccaagtcac

SEQ ID NO: 7461593 - DNA, 22 bp, Homo sapiens
tttctgtaagttcaggctttcc

SEQ ID NO: 7461594 - DNA, 22 bp, Homo sapiens
tttctgtaattaaaagggcagg

SEQ ID NO: 7461595 - DNA, 22 bp, Homo sapiens
tttctggcagcgggacaggggt

SEQ ID NO: 7461596 - DNA, 22 bp, Homo sapiens
tttctggcagcgggacaggggt

SEQ ID NO: 7461597 - DNA, 22 bp, Homo sapiens
tttctggcagcgggacaggggt

SEQ ID NO: 7461598 - DNA, 22 bp, Homo sapiens
tttctggcagcgggacaggggt

SEQ ID NO: 7461599 - DNA, 22 bp, Homo sapiens
tttctggcagcgggacaggggt

SEQ ID NO: 7461600 - DNA, 22 bp, Homo sapiens
tttctggcagcgggacaggggt

SEQ ID NO: 7461601 - DNA, 22 bp, Homo sapiens
tttctgggactggggagattct

SEQ ID NO: 7461602 - DNA, 20 bp, Homo sapiens
tttctgggtactctccctct

SEQ ID NO: 7461603 - DNA, 22 bp, Homo sapiens
tttctgggtttatgtcacagct

SEQ ID NO: 7461604 - DNA, 21 bp, Homo sapiens
tttctgggtggctgcatagtg

SEQ ID NO: 7461605 - DNA, 21 bp, Homo sapiens
tttctgggtggctgcatagtg

SEQ ID NO: 7461606 - DNA, 21 bp, Homo sapiens
tttctgggtggctgcatagtg

SEQ ID NO: 7461607 - DNA, 22 bp, Homo sapiens
tttctgtaaagaccaagccagc

SEQ ID NO: 7461608 - DNA, 22 bp, Homo sapiens
tttctgtaaggacttaatgcaa

SEQ ID NO: 7461609 - DNA, 22 bp, Homo sapiens
tttctgtaaggacttaatgcaa

SEQ ID NO: 7461610 - DNA, 22 bp, Homo sapiens
tttctgtaaggacttaatgcaa

SEQ ID NO: 7461611 - DNA, 22 bp, Homo sapiens
tttctgtaaggacttaatgcaa

SEQ ID NO: 7461612 - DNA, 22 bp, Homo sapiens
tttctgagaaattaaacacttt

SEQ ID NO: 7461613 - DNA, 22 bp, Homo sapiens
tttctgagaaattaaacacttt

SEQ ID NO: 7461614 - DNA, 22 bp, Homo sapiens
tttctgacttttatatgcatat

SEQ ID NO: 7461615 - DNA, 22 bp, Homo sapiens
tttctgacctgcaacagtttac

SEQ ID NO: 7461616 - DNA, 22 bp, Homo sapiens
tttctgactccagagaggaata

SEQ ID NO: 7461617 - DNA, 22 bp, Homo sapiens
tttctgactggtgtataatagg

SEQ ID NO: 7461618 - DNA, 22 bp, Homo sapiens
tttctgataattttgtgaaatc

SEQ ID NO: 7461619 - DNA, 22 bp, Homo sapiens
tttctgaggaattaatacagaa

SEQ ID NO: 7461620 - DNA, 22 bp, Homo sapiens
tttctgaggaattaatacagaa

SEQ ID NO: 7461621 - DNA, 22 bp, Homo sapiens
tttctgaggaattaatacagaa

SEQ ID NO: 7461622 - DNA, 22 bp, Homo sapiens
tttctgaggaattaatacagaa

SEQ ID NO: 7461623 - DNA, 22 bp, Homo sapiens
tttctgagaaattaaacacttt

SEQ ID NO: 7461624 - DNA, 22 bp, Homo sapiens
tttctgcatgcatttaattaaa

SEQ ID NO: 7461625 - DNA, 17 bp, Homo sapiens
tttctgcatgattggac

SEQ ID NO: 7461626 - DNA, 22 bp, Homo sapiens
tttctgcatcttgaaacagagc

SEQ ID NO: 7461627 - DNA, 22 bp, Homo sapiens
tttctgcatcttgaaacagagc

SEQ ID NO: 7461628 - DNA, 17 bp, Homo sapiens
tttctgcatgattggac

SEQ ID NO: 7461629 - DNA, 22 bp, Homo sapiens
tttctgcatctctacagttgtt

SEQ ID NO: 7461630 - DNA, 22 bp, Homo sapiens
tttctgataattttgtgaaatc

SEQ ID NO: 7461631 - DNA, 22 bp, Homo sapiens
tttctgctcgctctcaatcagg

SEQ ID NO: 7461632 - DNA, 22 bp, Homo sapiens
tttctgctcgctctcaatcagg

SEQ ID NO: 7461633 - DNA, 22 bp, Homo sapiens
tttctgctcatcctagtggagc

SEQ ID NO: 7461634 - DNA, 22 bp, Homo sapiens
tttctgctaatcttttactgag

SEQ ID NO: 7461635 - DNA, 22 bp, Homo sapiens
tttctgccttgtagactagaat

SEQ ID NO: 7461636 - DNA, 22 bp, Homo sapiens
tttctgctaatcttttactgag

SEQ ID NO: 7461637 - DNA, 22 bp, Homo sapiens
tttctgccgttccctgctctgt

SEQ ID NO: 7461638 - DNA, 22 bp, Homo sapiens
tttctgccttatctttgctgag

SEQ ID NO: 7461639 - DNA, 22 bp, Homo sapiens
tttctgcatttacaaaatgagg

SEQ ID NO: 7461640 - DNA, 22 bp, Homo sapiens
tttctgcattgtcctcttggtt

SEQ ID NO: 7461641 - DNA, 22 bp, Homo sapiens
tttctgccaaccatttaaactc

SEQ ID NO: 7461642 - DNA, 22 bp, Homo sapiens
tttctgcatttacaaaatgagg

SEQ ID NO: 7461643 - DNA, 22 bp, Homo sapiens
tttctgcatttacaaaatgagg

SEQ ID NO: 7461644 - DNA, 22 bp, Homo sapiens
tttctgccaggtttctggatga

SEQ ID NO: 7461645 - DNA, 22 bp, Homo sapiens
tttctgccagtcactgctctag

SEQ ID NO: 7461646 - DNA, 22 bp, Homo sapiens
tttctgcccccgagggcggtgc

SEQ ID NO: 7461647 - DNA, 22 bp, Homo sapiens
tttctgccaaccatttaaactc

SEQ ID NO: 7461648 - DNA, 22 bp, Homo sapiens
tttctgccaggtttctggatga

SEQ ID NO: 7461649 - DNA, 22 bp, Homo sapiens
tttctgaatttactcaaggtca

SEQ ID NO: 7461650 - DNA, 22 bp, Homo sapiens
tttctgaatttactcaaggtca

SEQ ID NO: 7461651 - DNA, 22 bp, Homo sapiens
tttctgaattcctaggatgttg

SEQ ID NO: 7461652 - DNA, 22 bp, Homo sapiens
tttctgacacatcagttgtaaa

SEQ ID NO: 7461653 - DNA, 22 bp, Homo sapiens
tttctgacacatcagttgtaaa

SEQ ID NO: 7461654 - DNA, 22 bp, Homo sapiens
tttctgaatttactcaaggtca

SEQ ID NO: 7461655 - DNA, 22 bp, Homo sapiens
tttctgacctgcaacagtttac

SEQ ID NO: 7461656 - DNA, 22 bp, Homo sapiens
tttctgacctgcaacagtttac

SEQ ID NO: 7461657 - DNA, 22 bp, Homo sapiens
tttctgactccagagaggaata

SEQ ID NO: 7461658 - DNA, 22 bp, Homo sapiens
tttctgactccagagaggaata

SEQ ID NO: 7461659 - DNA, 22 bp, Homo sapiens
tttctgacacatcagttgtaaa

SEQ ID NO: 7461660 - DNA, 22 bp, Homo sapiens
tttctgacagagtgctcagagt

SEQ ID NO: 7461661 - DNA, 18 bp, Homo sapiens
tttctgaatgtctatttc

SEQ ID NO: 7461662 - DNA, 22 bp, Homo sapiens
tttctgaattcctaggatgttg

SEQ ID NO: 7461663 - DNA, 22 bp, Homo sapiens
tttctgaattcctaggatgttg

SEQ ID NO: 7461664 - DNA, 22 bp, Homo sapiens
tttctgaattcctaggatgttg

SEQ ID NO: 7461665 - DNA, 18 bp, Homo sapiens
tttctgaatgtctatttc

SEQ ID NO: 7461666 - DNA, 18 bp, Homo sapiens
tttctgaatgtctatttc

SEQ ID NO: 7461667 - DNA, 22 bp, Homo sapiens
tttctgaataactctatgatat

SEQ ID NO: 7461668 - DNA, 18 bp, Homo sapiens
tttctgaatgtctatttc

SEQ ID NO: 7461669 - DNA, 18 bp, Homo sapiens
tttctgaatgtctatttc

SEQ ID NO: 7461670 - DNA, 18 bp, Homo sapiens
tttctgaatgtctatttc

SEQ ID NO: 7461671 - DNA, 22 bp, Homo sapiens
tttctgaataactctatgatat

SEQ ID NO: 7461672 - DNA, 22 bp, Homo sapiens
tttctgaataactctatgatat

SEQ ID NO: 7461673 - DNA, 22 bp, Homo sapiens
tttctgaaggttaaggaattag

SEQ ID NO: 7461674 - DNA, 22 bp, Homo sapiens
tttctgaaggttaaggaattag

SEQ ID NO: 7461675 - DNA, 22 bp, Homo sapiens
tttctgaaggttaaggaattag

SEQ ID NO: 7461676 - DNA, 22 bp, Homo sapiens
tttctgaaggttaaggaattag

SEQ ID NO: 7461677 - DNA, 22 bp, Homo sapiens
tttctgaaggttaaggaattag

SEQ ID NO: 7461678 - DNA, 22 bp, Homo sapiens
tttctgaagtcttctaacagat

SEQ ID NO: 7461679 - DNA, 22 bp, Homo sapiens
tttctgaagtcttctaacagat

SEQ ID NO: 7461680 - DNA, 22 bp, Homo sapiens
tttctgaagtcttctaacagat

SEQ ID NO: 7461681 - DNA, 23 bp, Homo sapiens
tttctgaagttgagatggacttt

SEQ ID NO: 7461682 - DNA, 23 bp, Homo sapiens
tttctgaagttgagatggacttt

SEQ ID NO: 7461683 - DNA, 22 bp, Homo sapiens
tttctgaataactctatgatat

SEQ ID NO: 7461684 - DNA, 22 bp, Homo sapiens
tttctgaataactctatgatat

SEQ ID NO: 7461685 - DNA, 22 bp, Homo sapiens
tttctgaataactctatgatat

SEQ ID NO: 7461686 - DNA, 22 bp, Homo sapiens
tttctgaataactctatgatat

SEQ ID NO: 7461687 - DNA, 22 bp, Homo sapiens
tttctgaagtcttctaacagat

SEQ ID NO: 7461688 - DNA, 22 bp, Homo sapiens
tttctgaagtcttctaacagat

SEQ ID NO: 7461689 - DNA, 22 bp, Homo sapiens
tttcattgtcagagctttgaat

SEQ ID NO: 7461690 - DNA, 22 bp, Homo sapiens
tttcattgtcagagctttgaat

SEQ ID NO: 7461691 - DNA, 22 bp, Homo sapiens
tttcattgtcatctatcttaga

SEQ ID NO: 7461692 - DNA, 20 bp, Homo sapiens
tttcattgtcagaatcttat

SEQ ID NO: 7461693 - DNA, 22 bp, Homo sapiens
tttcattgtcaataaactgtat

SEQ ID NO: 7461694 - DNA, 22 bp, Homo sapiens
tttcattgtcaataaactgtat

SEQ ID NO: 7461695 - DNA, 20 bp, Homo sapiens
tttcattgtcagaatcttat

SEQ ID NO: 7461696 - DNA, 20 bp, Homo sapiens
tttcattgtcagaatcttat

SEQ ID NO: 7461697 - DNA, 20 bp, Homo sapiens
tttcattgtcagaatcttat

SEQ ID NO: 7461698 - DNA, 22 bp, Homo sapiens
tttcatttcatagaattgtgtt

SEQ ID NO: 7461699 - DNA, 22 bp, Homo sapiens
tttcatttcatagaattgtgtt

SEQ ID NO: 7461700 - DNA, 22 bp, Homo sapiens
tttcatttcatagaattgtgtt

SEQ ID NO: 7461701 - DNA, 22 bp, Homo sapiens
tttcattgtgatgcttttatca

SEQ ID NO: 7461702 - DNA, 22 bp, Homo sapiens
tttcattgtgatgcttttatca

SEQ ID NO: 7461703 - DNA, 22 bp, Homo sapiens
tttcattgtctacatatgacat

SEQ ID NO: 7461704 - DNA, 22 bp, Homo sapiens
tttcattgtctacatatgacat

SEQ ID NO: 7461705 - DNA, 22 bp, Homo sapiens
tttcattgtctacatatgacat

SEQ ID NO: 7461706 - DNA, 22 bp, Homo sapiens
tttcattgtccccaggcaagac

SEQ ID NO: 7461707 - DNA, 22 bp, Homo sapiens
tttcagtggcatcgattaccct

SEQ ID NO: 7461708 - DNA, 22 bp, Homo sapiens
tttcattgccataaggtgggat

SEQ ID NO: 7461709 - DNA, 22 bp, Homo sapiens
tttcattgcagagtctgtgtgc

SEQ ID NO: 7461710 - DNA, 22 bp, Homo sapiens
tttcattgcagagtctgtgtgc

SEQ ID NO: 7461711 - DNA, 22 bp, Homo sapiens
tttcagtggaccacagtttgat

SEQ ID NO: 7461712 - DNA, 22 bp, Homo sapiens
tttcagtgcttctgtttaccgg

SEQ ID NO: 7461713 - DNA, 22 bp, Homo sapiens
tttcagtgcttctgtttaccgg

SEQ ID NO: 7461714 - DNA, 22 bp, Homo sapiens
tttcagtggagtgacatgatct

SEQ ID NO: 7461715 - DNA, 22 bp, Homo sapiens
tttcagtggagtgacatgatct

SEQ ID NO: 7461716 - DNA, 22 bp, Homo sapiens
tttcattggctccctgatgaat

SEQ ID NO: 7461717 - DNA, 22 bp, Homo sapiens
tttcattggcagagcctgtttt

SEQ ID NO: 7461718 - DNA, 22 bp, Homo sapiens
tttcattgccataaggtgggat

SEQ ID NO: 7461719 - DNA, 22 bp, Homo sapiens
tttcattgcctttggaaggtct

SEQ ID NO: 7461720 - DNA, 22 bp, Homo sapiens
tttcattgtcaataaactgtat

SEQ ID NO: 7461721 - DNA, 22 bp, Homo sapiens
tttcattggctccctgatgaat

SEQ ID NO: 7461722 - DNA, 22 bp, Homo sapiens
tttcattggctccctgatgaat

SEQ ID NO: 7461723 - DNA, 22 bp, Homo sapiens
tttcattgtcaataaactgtat

SEQ ID NO: 7461724 - DNA, 22 bp, Homo sapiens
tttcatttcatagaattgtgtt

SEQ ID NO: 7461725 - DNA, 22 bp, Homo sapiens
tttcatttcatagaattgtgtt

SEQ ID NO: 7461726 - DNA, 22 bp, Homo sapiens
tttcatttcatagaattgtgtt

SEQ ID NO: 7461727 - DNA, 22 bp, Homo sapiens
tttcatttcatagaattgtgtt

SEQ ID NO: 7461728 - DNA, 22 bp, Homo sapiens
tttcatttcatagaattgtgtt

SEQ ID NO: 7461729 - DNA, 22 bp, Homo sapiens
tttcatttcatagaattgtgtt

SEQ ID NO: 7461730 - DNA, 22 bp, Homo sapiens
tttcatttcatagaattgtgtt

SEQ ID NO: 7461731 - DNA, 22 bp, Homo sapiens
tttcatttcatagaattgtgtt

SEQ ID NO: 7461732 - DNA, 22 bp, Homo sapiens
tttcatttcatagaattgtgtt

SEQ ID NO: 7461733 - DNA, 22 bp, Homo sapiens
tttcatttcatagaattgtgtt

SEQ ID NO: 7461734 - DNA, 22 bp, Homo sapiens
tttcattttggttatgccataa

SEQ ID NO: 7461735 - DNA, 22 bp, Homo sapiens
tttcattttggttatgccataa

SEQ ID NO: 7461736 - DNA, 22 bp, Homo sapiens
tttcattttggttatgccataa

SEQ ID NO: 7461737 - DNA, 22 bp, Homo sapiens
tttcattttggttatgccataa

SEQ ID NO: 7461738 - DNA, 22 bp, Homo sapiens
tttcattttggttatgccataa

SEQ ID NO: 7461739 - DNA, 22 bp, Homo sapiens
tttcattttggttatgccataa

SEQ ID NO: 7461740 - DNA, 22 bp, Homo sapiens
tttcattttggttatgccataa

SEQ ID NO: 7461741 - DNA, 22 bp, Homo sapiens
tttcattttggttatgccataa

SEQ ID NO: 7461742 - DNA, 22 bp, Homo sapiens
tttcattttggttatgccataa

SEQ ID NO: 7461743 - DNA, 22 bp, Homo sapiens
tttcattttggttatgccataa

SEQ ID NO: 7461744 - DNA, 22 bp, Homo sapiens
tttcattttggttatgccataa

SEQ ID NO: 7461745 - DNA, 22 bp, Homo sapiens
tttcattttggttatgccataa

SEQ ID NO: 7461746 - DNA, 22 bp, Homo sapiens
tttccaaacccagcgagctaca

SEQ ID NO: 7461747 - DNA, 22 bp, Homo sapiens
tttccaaaatgaatctaatgca

SEQ ID NO: 7461748 - DNA, 22 bp, Homo sapiens
tttccaaagctgagttgagcaa

SEQ ID NO: 7461749 - DNA, 22 bp, Homo sapiens
tttccaaacccagcgagctaca

SEQ ID NO: 7461750 - DNA, 22 bp, Homo sapiens
tttccaaagctgagttgagcaa

SEQ ID NO: 7461751 - DNA, 22 bp, Homo sapiens
tttccaaaatgaatctaatgca

SEQ ID NO: 7461752 - DNA, 22 bp, Homo sapiens
tttccaaaatgaatctaatgca

SEQ ID NO: 7461753 - DNA, 22 bp, Homo sapiens
tttccaaaagtttgttctgtgc

SEQ ID NO: 7461754 - DNA, 22 bp, Homo sapiens
tttccaaaagtttgttctgtgc

SEQ ID NO: 7461755 - DNA, 22 bp, Homo sapiens
tttccaaaagtttgttctgtgc

SEQ ID NO: 7461756 - DNA, 22 bp, Homo sapiens
tttccaaaagtttgttctgtgc

SEQ ID NO: 7461757 - DNA, 22 bp, Homo sapiens
tttccaaaagtttgttctgtgc

SEQ ID NO: 7461758 - DNA, 22 bp, Homo sapiens
tttcattttggttatgccataa

SEQ ID NO: 7461759 - DNA, 22 bp, Homo sapiens
tttccaaagttgccataagctt

SEQ ID NO: 7461760 - DNA, 22 bp, Homo sapiens
tttccaaataaggtcacactca

SEQ ID NO: 7461761 - DNA, 22 bp, Homo sapiens
tttccaaataaggtcacactca

SEQ ID NO: 7461762 - DNA, 22 bp, Homo sapiens
tttccaaataaggtcacactca

SEQ ID NO: 7461763 - DNA, 22 bp, Homo sapiens
tttccaaataaggtcacactca

SEQ ID NO: 7461764 - DNA, 22 bp, Homo sapiens
tttccaaataaggtcacactca

SEQ ID NO: 7461765 - DNA, 22 bp, Homo sapiens
tttccaaaggtggcaggaacaa

SEQ ID NO: 7461766 - DNA, 22 bp, Homo sapiens
tttccaaaggtggcaggaacaa

SEQ ID NO: 7461767 - DNA, 22 bp, Homo sapiens
tttccaaaggtggcaggaacaa

SEQ ID NO: 7461768 - DNA, 16 bp, Homo sapiens
tttccaaagggcagct

SEQ ID NO: 7461769 - DNA, 22 bp, Homo sapiens
tttccaaaggtggcaggaacaa

SEQ ID NO: 7461770 - DNA, 22 bp, Homo sapiens
tttccaaaggtggcaggaacaa

SEQ ID NO: 7461771 - DNA, 22 bp, Homo sapiens
tttccaaagttgccataagctt

SEQ ID NO: 7461772 - DNA, 22 bp, Homo sapiens
tttccaaagttgccataagctt

SEQ ID NO: 7461773 - DNA, 22 bp, Homo sapiens
tttccaaagttgccataagctt

SEQ ID NO: 7461774 - DNA, 22 bp, Homo sapiens
tttccaaaggtggcaggaacaa

SEQ ID NO: 7461775 - DNA, 22 bp, Homo sapiens
tttccaaaggaggaaccagttt

SEQ ID NO: 7461776 - DNA, 22 bp, Homo sapiens
tttccaaaggaggaaccagttt

SEQ ID NO: 7461777 - DNA, 22 bp, Homo sapiens
tttccaaaggaggaaccagttt

SEQ ID NO: 7461778 - DNA, 22 bp, Homo sapiens
tttccaaaggaggaaccagttt

SEQ ID NO: 7461779 - DNA, 22 bp, Homo sapiens
tttccaaaggaggaaccagttt

SEQ ID NO: 7461780 - DNA, 22 bp, Homo sapiens
tttccaaaggaggaaccagttt

SEQ ID NO: 7461781 - DNA, 22 bp, Homo sapiens
tttccaaagctgagttgagcaa

SEQ ID NO: 7461782 - DNA, 22 bp, Homo sapiens
tttccaaaggaggaaccagttt

SEQ ID NO: 7461783 - DNA, 22 bp, Homo sapiens
tttccaaaggagtaccacgcat

SEQ ID NO: 7461784 - DNA, 22 bp, Homo sapiens
tttccaaaggagtaccacgcat

SEQ ID NO: 7461785 - DNA, 22 bp, Homo sapiens
tttccaaaggaggaaccagttt

SEQ ID NO: 7461786 - DNA, 22 bp, Homo sapiens
tttccaaaggctaaactcagtt

SEQ ID NO: 7461787 - DNA, 22 bp, Homo sapiens
tttccaaaggctaaactcagtt

SEQ ID NO: 7461788 - DNA, 16 bp, Homo sapiens
tttccaaagggcagct

SEQ ID NO: 7461789 - DNA, 22 bp, Homo sapiens
tttccaaaggctaaactcagtt

SEQ ID NO: 7461790 - DNA, 22 bp, Homo sapiens
tttccaaaggctaaactcagtt

SEQ ID NO: 7461791 - DNA, 22 bp, Homo sapiens
tttccaaaggagtaccacgcat

SEQ ID NO: 7461792 - DNA, 22 bp, Homo sapiens
tttccaaaggctaaactcagtt

SEQ ID NO: 7461793 - DNA, 22 bp, Homo sapiens
tttcctctgctgccattgcccc

SEQ ID NO: 7461794 - DNA, 22 bp, Homo sapiens
tttcctctgctgccattgcccc

SEQ ID NO: 7461795 - DNA, 22 bp, Homo sapiens
tttcctctgctgccattgcccc

SEQ ID NO: 7461796 - DNA, 22 bp, Homo sapiens
tttcctctgatgctgacttgga

SEQ ID NO: 7461797 - DNA, 22 bp, Homo sapiens
tttcctctgggccctgccaccc

SEQ ID NO: 7461798 - DNA, 22 bp, Homo sapiens
tttcctctgggccctgccaccc

SEQ ID NO: 7461799 - DNA, 22 bp, Homo sapiens
tttcctctgtcatgacagctga

SEQ ID NO: 7461800 - DNA, 22 bp, Homo sapiens
tttcctctgtcatgacagctga

SEQ ID NO: 7461801 - DNA, 22 bp, Homo sapiens
tttcctcttatacagtgtttat

SEQ ID NO: 7461802 - DNA, 22 bp, Homo sapiens
tttcctcttatacagtgtttat

SEQ ID NO: 7461803 - DNA, 22 bp, Homo sapiens
tttcctcttcttcccatgtcat

SEQ ID NO: 7461804 - DNA, 22 bp, Homo sapiens
tttcctcttcttcccatgtcat

SEQ ID NO: 7461805 - DNA, 22 bp, Homo sapiens
tttcctcttcttcccatgtcat

SEQ ID NO: 7461806 - DNA, 22 bp, Homo sapiens
tttcctcttcttcccatgtcat

SEQ ID NO: 7461807 - DNA, 22 bp, Homo sapiens
tttcctcttcttcccatgtcat

SEQ ID NO: 7461808 - DNA, 22 bp, Homo sapiens
tttcctcttctggcaggcaggg

SEQ ID NO: 7461809 - DNA, 22 bp, Homo sapiens
tttcctcttcttcccatgtcat

SEQ ID NO: 7461810 - DNA, 22 bp, Homo sapiens
tttcctcttcttcccatgtcat

SEQ ID NO: 7461811 - DNA, 22 bp, Homo sapiens
tttcctcttcttcccatgtcat

SEQ ID NO: 7461812 - DNA, 22 bp, Homo sapiens
tttcctcttctggcaggcaggg

SEQ ID NO: 7461813 - DNA, 22 bp, Homo sapiens
tttcctcttcgattaagtttgg

SEQ ID NO: 7461814 - DNA, 22 bp, Homo sapiens
tttcctcttcgattaagtttgg

SEQ ID NO: 7461815 - DNA, 22 bp, Homo sapiens
tttcctcttcgattaagtttgg

SEQ ID NO: 7461816 - DNA, 22 bp, Homo sapiens
tttcctcttccgagggggaggc

SEQ ID NO: 7461817 - DNA, 22 bp, Homo sapiens
tttcctcttatacagtgtttat

SEQ ID NO: 7461818 - DNA, 22 bp, Homo sapiens
tttcctcttccgagggggaggc

SEQ ID NO: 7461819 - DNA, 22 bp, Homo sapiens
tttcagataaatatgggactaa

SEQ ID NO: 7461820 - DNA, 22 bp, Homo sapiens
tttcagatcactttcaggaaag

SEQ ID NO: 7461821 - DNA, 22 bp, Homo sapiens
tttcagataaatatgggactaa

SEQ ID NO: 7461822 - DNA, 22 bp, Homo sapiens
tttcagagttatgtaagaaaat

SEQ ID NO: 7461823 - DNA, 22 bp, Homo sapiens
tttcagagttggggaaaagcag

SEQ ID NO: 7461824 - DNA, 22 bp, Homo sapiens
tttcagagttgtcttcttgacc

SEQ ID NO: 7461825 - DNA, 22 bp, Homo sapiens
tttcagagttgtcttcttgacc

SEQ ID NO: 7461826 - DNA, 22 bp, Homo sapiens
tttcagatcattttttaagtac

SEQ ID NO: 7461827 - DNA, 22 bp, Homo sapiens
tttcagatcattttttaagtac

SEQ ID NO: 7461828 - DNA, 22 bp, Homo sapiens
tttcagatcttctttgggttaa

SEQ ID NO: 7461829 - DNA, 22 bp, Homo sapiens
tttcagatgaaatgtgtatatt

SEQ ID NO: 7461830 - DNA, 22 bp, Homo sapiens
tttcagatgcaattaattttca

SEQ ID NO: 7461831 - DNA, 22 bp, Homo sapiens
tttcagatgcaattaattttca

SEQ ID NO: 7461832 - DNA, 22 bp, Homo sapiens
tttcagatgatgcatgcgctca

SEQ ID NO: 7461833 - DNA, 22 bp, Homo sapiens
tttcagatgcaattaattttca

SEQ ID NO: 7461834 - DNA, 22 bp, Homo sapiens
tttcagatgcaattaattttca

SEQ ID NO: 7461835 - DNA, 17 bp, Homo sapiens
tttcagattcactttct

SEQ ID NO: 7461836 - DNA, 20 bp, Homo sapiens
tttcagatttacagaaatgt

SEQ ID NO: 7461837 - DNA, 20 bp, Homo sapiens
tttcagatttacagaaatgt

SEQ ID NO: 7461838 - DNA, 20 bp, Homo sapiens
tttcagatttacagaaatgt

SEQ ID NO: 7461839 - DNA, 22 bp, Homo sapiens
tttcagcactttaggcagcagg

SEQ ID NO: 7461840 - DNA, 22 bp, Homo sapiens
tttcagcactttaggcagcagg

SEQ ID NO: 7461841 - DNA, 23 bp, Homo sapiens
tttcagcattctagttcaggttc

SEQ ID NO: 7461842 - DNA, 23 bp, Homo sapiens
tttcagcattctagttcaggttc

SEQ ID NO: 7461843 - DNA, 22 bp, Homo sapiens
tttcagctgctgactagttgta

SEQ ID NO: 7461844 - DNA, 22 bp, Homo sapiens
tttcagatggaggtttaggaca

SEQ ID NO: 7461845 - DNA, 22 bp, Homo sapiens
tttcagatggtatatacagtag

SEQ ID NO: 7461846 - DNA, 22 bp, Homo sapiens
tttcagatggtatatacagtag

SEQ ID NO: 7461847 - DNA, 22 bp, Homo sapiens
tttcagatggtatatacagtag

SEQ ID NO: 7461848 - DNA, 22 bp, Homo sapiens
tttcagatggtatatacagtag

SEQ ID NO: 7461849 - DNA, 22 bp, Homo sapiens
tttcagatggtatatacagtag

SEQ ID NO: 7461850 - DNA, 22 bp, Homo sapiens
tttcagatggtatatacagtag

SEQ ID NO: 7461851 - DNA, 22 bp, Homo sapiens
tttcagattatctcaactttgg

SEQ ID NO: 7461852 - DNA, 22 bp, Homo sapiens
tttcagattatctcaactttgg

SEQ ID NO: 7461853 - DNA, 22 bp, Homo sapiens
tttcaggaaggtgaggcacatg

SEQ ID NO: 7461854 - DNA, 22 bp, Homo sapiens
tttcaggaatacacacacatct

SEQ ID NO: 7461855 - DNA, 22 bp, Homo sapiens
tttcaggacacctttaaaaacg

SEQ ID NO: 7461856 - DNA, 22 bp, Homo sapiens
tttcaggacacctttaaaaacg

SEQ ID NO: 7461857 - DNA, 22 bp, Homo sapiens
tttcaggactcaaaacgataat

SEQ ID NO: 7461858 - DNA, 22 bp, Homo sapiens
tttcagctggtaaaggagtagc

SEQ ID NO: 7461859 - DNA, 22 bp, Homo sapiens
tttcagctttaccattccatga

SEQ ID NO: 7461860 - DNA, 22 bp, Homo sapiens
tttcagctttaccattccatga

SEQ ID NO: 7461861 - DNA, 22 bp, Homo sapiens
tttcaggaaacatttaatggca

SEQ ID NO: 7461862 - DNA, 22 bp, Homo sapiens
tttcaggaaggtgaggcacatg

SEQ ID NO: 7461863 - DNA, 22 bp, Homo sapiens
tttcaggattagtttaagcagg

SEQ ID NO: 7461864 - DNA, 22 bp, Homo sapiens
tttcaggattttatgagatagt

SEQ ID NO: 7461865 - DNA, 22 bp, Homo sapiens
tttcaggattttatgagatagt

SEQ ID NO: 7461866 - DNA, 22 bp, Homo sapiens
tttcaggattttatgagatagt

SEQ ID NO: 7461867 - DNA, 22 bp, Homo sapiens
tttcaggagagaccagaaatga

SEQ ID NO: 7461868 - DNA, 22 bp, Homo sapiens
tttcaggagagaccagaaatga

SEQ ID NO: 7461869 - DNA, 19 bp, Homo sapiens
tttcaggagctatgcaggg

SEQ ID NO: 7461870 - DNA, 22 bp, Homo sapiens
tttcaggatcaaatgaaatcgt

SEQ ID NO: 7461871 - DNA, 22 bp, Homo sapiens
tttcagtgcacgtagtttattt

SEQ ID NO: 7461872 - DNA, 22 bp, Homo sapiens
tttcagtgcacgtagtttattt

SEQ ID NO: 7461873 - DNA, 22 bp, Homo sapiens
tttcagtgaaagctactgttag

SEQ ID NO: 7461874 - DNA, 22 bp, Homo sapiens
tttcagtgcccagagctttgca

SEQ ID NO: 7461875 - DNA, 22 bp, Homo sapiens
tttcagtctgtaaaggtgagga

SEQ ID NO: 7461876 - DNA, 22 bp, Homo sapiens
tttcagtgaaagctactgttag

SEQ ID NO: 7461877 - DNA, 22 bp, Homo sapiens
tttcagtctgtaaaggtgagga

SEQ ID NO: 7461878 - DNA, 22 bp, Homo sapiens
tttcagtcatgagttgttttca

SEQ ID NO: 7461879 - DNA, 22 bp, Homo sapiens
tttcagtcaggaggatctctca

SEQ ID NO: 7461880 - DNA, 22 bp, Homo sapiens
tttcagtcagttaagtcatgaa

SEQ ID NO: 7461881 - DNA, 22 bp, Homo sapiens
tttcaggccatagcacagggaa

SEQ ID NO: 7461882 - DNA, 20 bp, Homo sapiens
tttcaggctggctatctttg

SEQ ID NO: 7461883 - DNA, 22 bp, Homo sapiens
tttcagggaagtgttgaaaagg

SEQ ID NO: 7461884 - DNA, 22 bp, Homo sapiens
tttcagaggtgcttggaatgct

SEQ ID NO: 7461885 - DNA, 22 bp, Homo sapiens
tttcagaggtgcttggaatgct

SEQ ID NO: 7461886 - DNA, 22 bp, Homo sapiens
tttcagaggtgcttggaatgct

SEQ ID NO: 7461887 - DNA, 22 bp, Homo sapiens
tttcagagtctggctgcagcct

SEQ ID NO: 7461888 - DNA, 22 bp, Homo sapiens
tttcagagtctggctgcagcct

SEQ ID NO: 7461889 - DNA, 22 bp, Homo sapiens
tttcagagtcagctcctctcta

SEQ ID NO: 7461890 - DNA, 22 bp, Homo sapiens
tttcagagtcagctcctctcta

SEQ ID NO: 7461891 - DNA, 22 bp, Homo sapiens
tttcagagtcagctcctctcta

SEQ ID NO: 7461892 - DNA, 22 bp, Homo sapiens
tttcagagtctggctgcagcct

SEQ ID NO: 7461893 - DNA, 20 bp, Homo sapiens
tttcagagtgtctttccatt

SEQ ID NO: 7461894 - DNA, 20 bp, Homo sapiens
tttcagagtgtctttccatt

SEQ ID NO: 7461895 - DNA, 22 bp, Homo sapiens
tttcagagttatgtaagaaaat

SEQ ID NO: 7461896 - DNA, 22 bp, Homo sapiens
tttcagagttatgtaagaaaat

SEQ ID NO: 7461897 - DNA, 22 bp, Homo sapiens
tttcagagttatgtaagaaaat

SEQ ID NO: 7461898 - DNA, 22 bp, Homo sapiens
tttcagagttagtagagcatgt

SEQ ID NO: 7461899 - DNA, 22 bp, Homo sapiens
tttcagagttagtagagcatgt

SEQ ID NO: 7461900 - DNA, 22 bp, Homo sapiens
tttcagagttagtagagcatgt

SEQ ID NO: 7461901 - DNA, 22 bp, Homo sapiens
tttcagagttagtagagcatgt

SEQ ID NO: 7461902 - DNA, 22 bp, Homo sapiens
tttcaaagggaagttatgaagt

SEQ ID NO: 7461903 - DNA, 22 bp, Homo sapiens
tttcagaggaaatctcattgag

SEQ ID NO: 7461904 - DNA, 22 bp, Homo sapiens
tttcaaaggaggctgagaggat

SEQ ID NO: 7461905 - DNA, 22 bp, Homo sapiens
tttcaaagggaagttatgaagt

SEQ ID NO: 7461906 - DNA, 22 bp, Homo sapiens
tttcaaagggaagttatgaagt

SEQ ID NO: 7461907 - DNA, 22 bp, Homo sapiens
tttcaaagggaagttatgaagt

SEQ ID NO: 7461908 - DNA, 22 bp, Homo sapiens
tttcaaagggaagttatgaagt

SEQ ID NO: 7461909 - DNA, 20 bp, Homo sapiens
tttcaaaggcacctatgaag

SEQ ID NO: 7461910 - DNA, 20 bp, Homo sapiens
tttcaaaggcacctatgaag

SEQ ID NO: 7461911 - DNA, 20 bp, Homo sapiens
tttcaaaggcacctatgaag

SEQ ID NO: 7461912 - DNA, 20 bp, Homo sapiens
tttcaaaggcacctatgaag

SEQ ID NO: 7461913 - DNA, 22 bp, Homo sapiens
tttcagaggaaatctcattgag

SEQ ID NO: 7461914 - DNA, 22 bp, Homo sapiens
tttcagaggagagctggaccaa

SEQ ID NO: 7461915 - DNA, 22 bp, Homo sapiens
tttcagaggagagctggaccaa

SEQ ID NO: 7461916 - DNA, 22 bp, Homo sapiens
tttcagaggaggaaggcagtta

SEQ ID NO: 7461917 - DNA, 22 bp, Homo sapiens
tttcagaggaggaaggcagtta

SEQ ID NO: 7461918 - DNA, 22 bp, Homo sapiens
tttcagaggaggaaggcagtta

SEQ ID NO: 7461919 - DNA, 22 bp, Homo sapiens
tttcagaggaggaaggcagtta

SEQ ID NO: 7461920 - DNA, 22 bp, Homo sapiens
tttcagagggcagatctggggc

SEQ ID NO: 7461921 - DNA, 22 bp, Homo sapiens
tttcagaggtatgctgcttatc

SEQ ID NO: 7461922 - DNA, 22 bp, Homo sapiens
tttcagaggtatgctgcttatc

SEQ ID NO: 7461923 - DNA, 22 bp, Homo sapiens
tttcagaggtatgctgcttatc

SEQ ID NO: 7461924 - DNA, 22 bp, Homo sapiens
tttcaaagcaactgaaaaggaa

SEQ ID NO: 7461925 - DNA, 22 bp, Homo sapiens
tttcaaagcaactgaaaaggaa

SEQ ID NO: 7461926 - DNA, 22 bp, Homo sapiens
tttcaaagagttgtaaattact

SEQ ID NO: 7461927 - DNA, 22 bp, Homo sapiens
tttcaaagagttgtaaattact

SEQ ID NO: 7461928 - DNA, 22 bp, Homo sapiens
tttcaaagagttgtaaattact

SEQ ID NO: 7461929 - DNA, 22 bp, Homo sapiens
tttcaaagagttgtaaattact

SEQ ID NO: 7461930 - DNA, 22 bp, Homo sapiens
tttcaaagagaggcagaaggaa

SEQ ID NO: 7461931 - DNA, 17 bp, Homo sapiens
tttcaaagcagtcagga

SEQ ID NO: 7461932 - DNA, 22 bp, Homo sapiens
tttcaaaggaggctgagaggat

SEQ ID NO: 7461933 - DNA, 22 bp, Homo sapiens
tttcaaaggaggctgagaggat

SEQ ID NO: 7461934 - DNA, 20 bp, Homo sapiens
tttcaaaggcacctatgaag

SEQ ID NO: 7461935 - DNA, 20 bp, Homo sapiens
tttcaaaggcacctatgaag

SEQ ID NO: 7461936 - DNA, 22 bp, Homo sapiens
tttcaaagcaactgaaaaggaa

SEQ ID NO: 7461937 - DNA, 17 bp, Homo sapiens
tttcaaagcagtcagga

SEQ ID NO: 7461938 - DNA, 17 bp, Homo sapiens
tttcaaagcagtcagga

SEQ ID NO: 7461939 - DNA, 17 bp, Homo sapiens
tttcaaagcagtcagga

SEQ ID NO: 7461940 - DNA, 17 bp, Homo sapiens
tttcaaagcagtcagga

SEQ ID NO: 7461941 - DNA, 22 bp, Homo sapiens
tttcaaagacagccatatttgt

SEQ ID NO: 7461942 - DNA, 22 bp, Homo sapiens
tttcaaagacagccatatttgt

SEQ ID NO: 7461943 - DNA, 22 bp, Homo sapiens
tttcaaagaccattaactatca

SEQ ID NO: 7461944 - DNA, 22 bp, Homo sapiens
tttcaaagaccattaactatca

SEQ ID NO: 7461945 - DNA, 22 bp, Homo sapiens
tttcaaagacagccatatttgt

SEQ ID NO: 7461946 - DNA, 22 bp, Homo sapiens
tttcaaagacagccatatttgt

SEQ ID NO: 7461947 - DNA, 22 bp, Homo sapiens
tttcaaagacagccatatttgt

SEQ ID NO: 7461948 - DNA, 22 bp, Homo sapiens
tttcaaactttactcttgaatc

SEQ ID NO: 7461949 - DNA, 22 bp, Homo sapiens
tttcaaactttactcttgaatc

SEQ ID NO: 7461950 - DNA, 22 bp, Homo sapiens
tttcaaactttactcttgaatc

SEQ ID NO: 7461951 - DNA, 22 bp, Homo sapiens
tttcaaagaccattaactatca

SEQ ID NO: 7461952 - DNA, 23 bp, Homo sapiens
tttcaaagactttcccttagagt

SEQ ID NO: 7461953 - DNA, 22 bp, Homo sapiens
tttcaaagaccattaactatca

SEQ ID NO: 7461954 - DNA, 22 bp, Homo sapiens
tttcaaagaccattaactatca

SEQ ID NO: 7461955 - DNA, 22 bp, Homo sapiens
tttcaaagaccattaactatca

SEQ ID NO: 7461956 - DNA, 22 bp, Homo sapiens
tttcaaagaccattaactatca

SEQ ID NO: 7461957 - DNA, 22 bp, Homo sapiens
tttctcagcgttcttagggctc

SEQ ID NO: 7461958 - DNA, 22 bp, Homo sapiens
tttctcagcgttcttagggctc

SEQ ID NO: 7461959 - DNA, 22 bp, Homo sapiens
tttctcagcctccttgctggag

SEQ ID NO: 7461960 - DNA, 22 bp, Homo sapiens
tttctcagctcagcatctgggt

SEQ ID NO: 7461961 - DNA, 22 bp, Homo sapiens
tttctcagctcagcatctgggt

SEQ ID NO: 7461962 - DNA, 22 bp, Homo sapiens
tttctcagctcagcatctgggt

SEQ ID NO: 7461963 - DNA, 22 bp, Homo sapiens
tttctcagctcagcatctgggt

SEQ ID NO: 7461964 - DNA, 22 bp, Homo sapiens
tttctcagctcagcatctgggt

SEQ ID NO: 7461965 - DNA, 22 bp, Homo sapiens
tttctcagctcagcatctgggt

SEQ ID NO: 7461966 - DNA, 22 bp, Homo sapiens
tttctcagctgtggagcctatc

SEQ ID NO: 7461967 - DNA, 22 bp, Homo sapiens
tttctcagtaatgtcctggaat

SEQ ID NO: 7461968 - DNA, 22 bp, Homo sapiens
tttctcagtaatgtcctggaat

SEQ ID NO: 7461969 - DNA, 22 bp, Homo sapiens
tttctcagggaggagtcaagcc

SEQ ID NO: 7461970 - DNA, 22 bp, Homo sapiens
tttctcagtaatgtcctggaat

SEQ ID NO: 7461971 - DNA, 22 bp, Homo sapiens
tttctcagtaatgtcctggaat

SEQ ID NO: 7461972 - DNA, 22 bp, Homo sapiens
tttctcagtagtaatggcagtc

SEQ ID NO: 7461973 - DNA, 22 bp, Homo sapiens
tttctcagtagtaatggcagtc

SEQ ID NO: 7461974 - DNA, 22 bp, Homo sapiens
tttctcagtcacatgaaccaat

SEQ ID NO: 7461975 - DNA, 22 bp, Homo sapiens
tttctcagtcacatgaaccaat

SEQ ID NO: 7461976 - DNA, 22 bp, Homo sapiens
tttctcagtcacatgaaccaat

SEQ ID NO: 7461977 - DNA, 21 bp, Homo sapiens
tttctcataaaatactcatta

SEQ ID NO: 7461978 - DNA, 21 bp, Homo sapiens
tttctcataaaatactcatta

SEQ ID NO: 7461979 - DNA, 21 bp, Homo sapiens
tttctcataaaatactcatta

SEQ ID NO: 7461980 - DNA, 21 bp, Homo sapiens
tttctcataaaatactcatta

SEQ ID NO: 7461981 - DNA, 22 bp, Homo sapiens
tttctcagttctctgcaaggag

SEQ ID NO: 7461982 - DNA, 22 bp, Homo sapiens
tttctcagttgtgcgagcagca

SEQ ID NO: 7461983 - DNA, 21 bp, Homo sapiens
tttctcagttgtgtgagcagc

SEQ ID NO: 7461984 - DNA, 21 bp, Homo sapiens
tttctcagttgtgtgagcagc

SEQ ID NO: 7461985 - DNA, 22 bp, Homo sapiens
tttctcagtgcagtttctacgt

SEQ ID NO: 7461986 - DNA, 22 bp, Homo sapiens
tttctcagtgcagtttctacgt

SEQ ID NO: 7461987 - DNA, 22 bp, Homo sapiens
tttctcagtgtagcttttcaag

SEQ ID NO: 7461988 - DNA, 22 bp, Homo sapiens
tttctcagtgtagcttttcaag

SEQ ID NO: 7461989 - DNA, 22 bp, Homo sapiens
tttctcagttactagctgtggt

SEQ ID NO: 7461990 - DNA, 22 bp, Homo sapiens
tttctcagttactagctgtggt

SEQ ID NO: 7461991 - DNA, 22 bp, Homo sapiens
tttctcagttactagctgtggt

SEQ ID NO: 7461992 - DNA, 22 bp, Homo sapiens
tttctcagttactagctgtggt

SEQ ID NO: 7461993 - DNA, 22 bp, Homo sapiens
tttctcagttctctgcaaggag

SEQ ID NO: 7461994 - DNA, 22 bp, Homo sapiens
tttctcagttactagctgtggt

SEQ ID NO: 7461995 - DNA, 22 bp, Homo sapiens
tttctatttacagtgctaggta

SEQ ID NO: 7461996 - DNA, 22 bp, Homo sapiens
tttctattttaaaggcatatgg

SEQ ID NO: 7461997 - DNA, 22 bp, Homo sapiens
tttctattttaaaggcatatgg

SEQ ID NO: 7461998 - DNA, 22 bp, Homo sapiens
tttctattttaaaggcatatgg

SEQ ID NO: 7461999 - DNA, 22 bp, Homo sapiens
tttctattggcgtcactgttgt

SEQ ID NO: 7462000 - DNA, 22 bp, Homo sapiens
tttctattgtaagtctcctata

SEQ ID NO: 7462001 - DNA, 22 bp, Homo sapiens
tttctattgtaagtctcctata

SEQ ID NO: 7462002 - DNA, 21 bp, Homo sapiens
tttctagaatgactggttctt

SEQ ID NO: 7462003 - DNA, 22 bp, Homo sapiens
tttctagacatttctatgtaca

SEQ ID NO: 7462004 - DNA, 22 bp, Homo sapiens
tttctagacatttctatgtaca

SEQ ID NO: 7462005 - DNA, 22 bp, Homo sapiens
tttctattgtaagtctcctata

SEQ ID NO: 7462006 - DNA, 22 bp, Homo sapiens
tttctattgtaagtctcctata

SEQ ID NO: 7462007 - DNA, 22 bp, Homo sapiens
tttctagaaatagagatagagt

SEQ ID NO: 7462008 - DNA, 22 bp, Homo sapiens
tttctagaaatagagatagagt

SEQ ID NO: 7462009 - DNA, 22 bp, Homo sapiens
tttctagaaatagagatagagt

SEQ ID NO: 7462010 - DNA, 22 bp, Homo sapiens
tttctagaatgactcatctgag

SEQ ID NO: 7462011 - DNA, 22 bp, Homo sapiens
tttctagaatgactcatctgag

SEQ ID NO: 7462012 - DNA, 22 bp, Homo sapiens
tttctagaaagttcatgtgttt

SEQ ID NO: 7462013 - DNA, 22 bp, Homo sapiens
tttctagaaagttcatgtgttt

SEQ ID NO: 7462014 - DNA, 22 bp, Homo sapiens
tttctagaaaccaagatattgt

SEQ ID NO: 7462015 - DNA, 22 bp, Homo sapiens
tttctagaaaccaagatattgt

SEQ ID NO: 7462016 - DNA, 22 bp, Homo sapiens
tttctactttggaatgcactga

SEQ ID NO: 7462017 - DNA, 22 bp, Homo sapiens
tttctactttggaatgcactga

SEQ ID NO: 7462018 - DNA, 22 bp, Homo sapiens
tttctacttctcctgaatgtct

SEQ ID NO: 7462019 - DNA, 22 bp, Homo sapiens
tttctacttctcctgaatgtct

SEQ ID NO: 7462020 - DNA, 22 bp, Homo sapiens
tttctacttctcctgaatgtct

SEQ ID NO: 7462021 - DNA, 22 bp, Homo sapiens
tttctacttctcctgaatgtct

SEQ ID NO: 7462022 - DNA, 22 bp, Homo sapiens
tttctcctaactcaaatttaag

SEQ ID NO: 7462023 - DNA, 22 bp, Homo sapiens
tttctccctttataagactgta

SEQ ID NO: 7462024 - DNA, 22 bp, Homo sapiens
tttctccctttataagactgta

SEQ ID NO: 7462025 - DNA, 20 bp, Homo sapiens
tttctccggtcttgagatcc

SEQ ID NO: 7462026 - DNA, 22 bp, Homo sapiens
tttctcctaactcaaatttaag

SEQ ID NO: 7462027 - DNA, 22 bp, Homo sapiens
tttctcctaactcaaatttaag

SEQ ID NO: 7462028 - DNA, 22 bp, Homo sapiens
tttctcctaactcaaatttaag

SEQ ID NO: 7462029 - DNA, 22 bp, Homo sapiens
tttctcctaactcaaatttaag

SEQ ID NO: 7462030 - DNA, 22 bp, Homo sapiens
tttctcctcatgactggttgtg

SEQ ID NO: 7462031 - DNA, 22 bp, Homo sapiens
tttctcctcatgactggttgtg

SEQ ID NO: 7462032 - DNA, 22 bp, Homo sapiens
tttctcctccagagagacacag

SEQ ID NO: 7462033 - DNA, 22 bp, Homo sapiens
tttctcctcatgactggttgtg

SEQ ID NO: 7462034 - DNA, 22 bp, Homo sapiens
tttctcctccagagagacacag

SEQ ID NO: 7462035 - DNA, 22 bp, Homo sapiens
tttctcctctccagagtgcagt

SEQ ID NO: 7462036 - DNA, 22 bp, Homo sapiens
tttctcctctccagagtgcagt

SEQ ID NO: 7462037 - DNA, 22 bp, Homo sapiens
tttctcctctccagagtgcagt

SEQ ID NO: 7462038 - DNA, 22 bp, Homo sapiens
tttctcctctccagagtgcagt

SEQ ID NO: 7462039 - DNA, 22 bp, Homo sapiens
tttctcctccagagagacacag

SEQ ID NO: 7462040 - DNA, 22 bp, Homo sapiens
tttctccccagtctaatctgga

SEQ ID NO: 7462041 - DNA, 22 bp, Homo sapiens
tttctccccagtctaatctgga

SEQ ID NO: 7462042 - DNA, 22 bp, Homo sapiens
tttctccccagtctaatctgga

SEQ ID NO: 7462043 - DNA, 20 bp, Homo sapiens
tttctcccaagtgcaagggt

SEQ ID NO: 7462044 - DNA, 22 bp, Homo sapiens
tttctccccagtctaatctgga

SEQ ID NO: 7462045 - DNA, 22 bp, Homo sapiens
tttctcccccatgataatttct

SEQ ID NO: 7462046 - DNA, 22 bp, Homo sapiens
tttctcccccatgataatttct

SEQ ID NO: 7462047 - DNA, 22 bp, Homo sapiens
tttctccctccactacaggctc

SEQ ID NO: 7462048 - DNA, 22 bp, Homo sapiens
tttctccctccactacaggctc

SEQ ID NO: 7462049 - DNA, 22 bp, Homo sapiens
tttctccctccactacaggctc

SEQ ID NO: 7462050 - DNA, 22 bp, Homo sapiens
tttctccctttataagactgta

SEQ ID NO: 7462051 - DNA, 22 bp, Homo sapiens
tttctccctttataagactgta

SEQ ID NO: 7462052 - DNA, 22 bp, Homo sapiens
tttctccctttataagactgta

SEQ ID NO: 7462053 - DNA, 22 bp, Homo sapiens
tttctccctttataagactgta

SEQ ID NO: 7462054 - DNA, 22 bp, Homo sapiens
tttctccagaagaggaagcgga

SEQ ID NO: 7462055 - DNA, 22 bp, Homo sapiens
tttctccatcaccccctcggtg

SEQ ID NO: 7462056 - DNA, 22 bp, Homo sapiens
tttctccatcaccccctcggtg

SEQ ID NO: 7462057 - DNA, 22 bp, Homo sapiens
tttctccatcaccccctcggtg

SEQ ID NO: 7462058 - DNA, 22 bp, Homo sapiens
tttctcccaaagtgcaaccaca

SEQ ID NO: 7462059 - DNA, 22 bp, Homo sapiens
tttctcccaaagtgcaaccaca

SEQ ID NO: 7462060 - DNA, 22 bp, Homo sapiens
tttctcccaactctggaagcca

SEQ ID NO: 7462061 - DNA, 22 bp, Homo sapiens
tttctcccaactctggaagcca

SEQ ID NO: 7462062 - DNA, 22 bp, Homo sapiens
tttctcccaaagtgcaaccaca

SEQ ID NO: 7462063 - DNA, 20 bp, Homo sapiens
tttctcccaagtgcaagggt

SEQ ID NO: 7462064 - DNA, 20 bp, Homo sapiens
tttctcccaagtgcaagggt

SEQ ID NO: 7462065 - DNA, 20 bp, Homo sapiens
tttctcccaagtgcaagggt

SEQ ID NO: 7462066 - DNA, 22 bp, Homo sapiens
tttctcccagtctcctgagaca

SEQ ID NO: 7462067 - DNA, 22 bp, Homo sapiens
tttctcccagtctcctgagaca

SEQ ID NO: 7462068 - DNA, 22 bp, Homo sapiens
tttctcatggacccttcatgat

SEQ ID NO: 7462069 - DNA, 22 bp, Homo sapiens
tttctcatggacccttcatgat

SEQ ID NO: 7462070 - DNA, 22 bp, Homo sapiens
tttctcatggacccttcatgat

SEQ ID NO: 7462071 - DNA, 22 bp, Homo sapiens
tttctcatggacccttcatgat

SEQ ID NO: 7462072 - DNA, 22 bp, Homo sapiens
tttctcatttagagtggcaggg

SEQ ID NO: 7462073 - DNA, 21 bp, Homo sapiens
tttctccaagtgactgattcc

SEQ ID NO: 7462074 - DNA, 22 bp, Homo sapiens
tttctcatggcccttggctttt

SEQ ID NO: 7462075 - DNA, 22 bp, Homo sapiens
tttctcatggcccttggctttt

SEQ ID NO: 7462076 - DNA, 22 bp, Homo sapiens
tttctccaatgtatcagcacac

SEQ ID NO: 7462077 - DNA, 22 bp, Homo sapiens
tttctccaatgtatcagcacac

SEQ ID NO: 7462078 - DNA, 22 bp, Homo sapiens
tttctccaatgtatcagcacac

SEQ ID NO: 7462079 - DNA, 21 bp, Homo sapiens
tttctccaagtgactgattcc

SEQ ID NO: 7462080 - DNA, 22 bp, Homo sapiens
tttctccacttctcttgccaac

SEQ ID NO: 7462081 - DNA, 22 bp, Homo sapiens
tttctccacttctcttgccaac

SEQ ID NO: 7462082 - DNA, 22 bp, Homo sapiens
tttctccacttctcttgccaac

SEQ ID NO: 7462083 - DNA, 22 bp, Homo sapiens
tttctccacgccagcttgctta

SEQ ID NO: 7462084 - DNA, 22 bp, Homo sapiens
tttctccacgccagcttgctta

SEQ ID NO: 7462085 - DNA, 22 bp, Homo sapiens
tttctccacgccagcttgctta

SEQ ID NO: 7462086 - DNA, 22 bp, Homo sapiens
tttctcatggaacatagctcct

SEQ ID NO: 7462087 - DNA, 22 bp, Homo sapiens
tttctcatggaacatagctcct

SEQ ID NO: 7462088 - DNA, 22 bp, Homo sapiens
tttctcatggaacatagctcct

SEQ ID NO: 7462089 - DNA, 22 bp, Homo sapiens
tttctcatggacccttcatgat

SEQ ID NO: 7462090 - DNA, 22 bp, Homo sapiens
tttctcatggaacatcgtttag

SEQ ID NO: 7462091 - DNA, 22 bp, Homo sapiens
tttctcatagtcatgcctctta

SEQ ID NO: 7462092 - DNA, 22 bp, Homo sapiens
tttctcatagtcatgcctctta

SEQ ID NO: 7462093 - DNA, 23 bp, Homo sapiens
tttctcatccagagagtcagtcc

SEQ ID NO: 7462094 - DNA, 23 bp, Homo sapiens
tttctcatccagagagtcagtcc

SEQ ID NO: 7462095 - DNA, 23 bp, Homo sapiens
tttctcatccagagagtcagtcc

SEQ ID NO: 7462096 - DNA, 22 bp, Homo sapiens
tttctcatctggaaacagtgct

SEQ ID NO: 7462097 - DNA, 22 bp, Homo sapiens
tttctcatctggaaacagtgct

SEQ ID NO: 7462098 - DNA, 22 bp, Homo sapiens
tttctcatctggaaacagtgct

SEQ ID NO: 7462099 - DNA, 22 bp, Homo sapiens
tttctcatctggaaacagtgct

SEQ ID NO: 7462100 - DNA, 22 bp, Homo sapiens
tttccttcttagcggtgttctt

SEQ ID NO: 7462101 - DNA, 22 bp, Homo sapiens
tttccttcttagcggtgttctt

SEQ ID NO: 7462102 - DNA, 23 bp, Homo sapiens
tttctaaggtttttatctgctac

SEQ ID NO: 7462103 - DNA, 22 bp, Homo sapiens
tttctaaggtgatcctttctta

SEQ ID NO: 7462104 - DNA, 22 bp, Homo sapiens
tttctaaggtgatcctttctta

SEQ ID NO: 7462105 - DNA, 22 bp, Homo sapiens
tttccttctcagggagcttcaa

SEQ ID NO: 7462106 - DNA, 22 bp, Homo sapiens
tttccttctcagggagcttcaa

SEQ ID NO: 7462107 - DNA, 22 bp, Homo sapiens
tttccttcctaaggtgaagcaa

SEQ ID NO: 7462108 - DNA, 22 bp, Homo sapiens
tttccttcctaaggtgaagcaa

SEQ ID NO: 7462109 - DNA, 22 bp, Homo sapiens
tttccttcctaaggtgaagcaa

SEQ ID NO: 7462110 - DNA, 22 bp, Homo sapiens
tttccttccttgctagcctgag

SEQ ID NO: 7462111 - DNA, 22 bp, Homo sapiens
tttccttccttgctagcctgag

SEQ ID NO: 7462112 - DNA, 22 bp, Homo sapiens
tttccttccttgctagcctgag

SEQ ID NO: 7462113 - DNA, 22 bp, Homo sapiens
tttccttccttgctagcctgag

SEQ ID NO: 7462114 - DNA, 22 bp, Homo sapiens
tttccttctcagggagcttcaa

SEQ ID NO: 7462115 - DNA, 22 bp, Homo sapiens
tttccttctcagggagcttcaa

SEQ ID NO: 7462116 - DNA, 22 bp, Homo sapiens
tttccttctcagggagcttcaa

SEQ ID NO: 7462117 - DNA, 22 bp, Homo sapiens
tttccttccaggttcctaaggc

SEQ ID NO: 7462118 - DNA, 22 bp, Homo sapiens
tttccttccaggttcctaaggc

SEQ ID NO: 7462119 - DNA, 22 bp, Homo sapiens
tttccttccaggttcctaaggc

SEQ ID NO: 7462120 - DNA, 22 bp, Homo sapiens
tttccttccaggttcctaaggc

SEQ ID NO: 7462121 - DNA, 22 bp, Homo sapiens
tttccttccaggttcctaaggc

SEQ ID NO: 7462122 - DNA, 22 bp, Homo sapiens
tttccttccaggttcctaaggc

SEQ ID NO: 7462123 - DNA, 22 bp, Homo sapiens
tttccttccatgttgggcaaaa

SEQ ID NO: 7462124 - DNA, 22 bp, Homo sapiens
tttccttccatgttgggcaaaa

SEQ ID NO: 7462125 - DNA, 22 bp, Homo sapiens
tttccttccatgttgggcaaaa

SEQ ID NO: 7462126 - DNA, 22 bp, Homo sapiens
tttccttccatgttgggcaaaa

SEQ ID NO: 7462127 - DNA, 22 bp, Homo sapiens
tttccttccctggatgagaagt

SEQ ID NO: 7462128 - DNA, 22 bp, Homo sapiens
tttccttccctggatgagaagt

SEQ ID NO: 7462129 - DNA, 22 bp, Homo sapiens
tttccttccctggatgagaagt

SEQ ID NO: 7462130 - DNA, 22 bp, Homo sapiens
tttcctgttgccatcaagaatg

SEQ ID NO: 7462131 - DNA, 22 bp, Homo sapiens
tttcctgttgccatcaagaatg

SEQ ID NO: 7462132 - DNA, 22 bp, Homo sapiens
tttccttaaatctgtttctagt

SEQ ID NO: 7462133 - DNA, 22 bp, Homo sapiens
tttccttcatcatctgagagct

SEQ ID NO: 7462134 - DNA, 22 bp, Homo sapiens
tttccttcatcatctgagagct

SEQ ID NO: 7462135 - DNA, 22 bp, Homo sapiens
tttccttaaatctgtttctagt

SEQ ID NO: 7462136 - DNA, 22 bp, Homo sapiens
tttccttcatcatctgagagct

SEQ ID NO: 7462137 - DNA, 22 bp, Homo sapiens
tttccttcatcatctgagagct

SEQ ID NO: 7462138 - DNA, 22 bp, Homo sapiens
tttccttccaaatgcccgggag

SEQ ID NO: 7462139 - DNA, 22 bp, Homo sapiens
tttccttccaaatgcccgggag

SEQ ID NO: 7462140 - DNA, 22 bp, Homo sapiens
tttcctggccaaatgctttgtg

SEQ ID NO: 7462141 - DNA, 22 bp, Homo sapiens
tttcctggctctgtggccttgt

SEQ ID NO: 7462142 - DNA, 22 bp, Homo sapiens
tttcctggctctgtggccttgt

SEQ ID NO: 7462143 - DNA, 22 bp, Homo sapiens
tttcctggctctgtggccttgt

SEQ ID NO: 7462144 - DNA, 22 bp, Homo sapiens
tttcctggttggggacgtggtt

SEQ ID NO: 7462145 - DNA, 22 bp, Homo sapiens
tttcctggttggggacgtggtt

SEQ ID NO: 7462146 - DNA, 22 bp, Homo sapiens
tttcctggtttgaagcagcagc

SEQ ID NO: 7462147 - DNA, 22 bp, Homo sapiens
tttcctggttggggacgtggtt

SEQ ID NO: 7462148 - DNA, 22 bp, Homo sapiens
tttcctggttggggacgtggtt

SEQ ID NO: 7462149 - DNA, 22 bp, Homo sapiens
tttcctgtcctggtacttggca

SEQ ID NO: 7462150 - DNA, 22 bp, Homo sapiens
tttcctgtcctggtacttggca

SEQ ID NO: 7462151 - DNA, 22 bp, Homo sapiens
tttcctggaagttattcctcat

SEQ ID NO: 7462152 - DNA, 22 bp, Homo sapiens
tttcctggaagttattcctcat

SEQ ID NO: 7462153 - DNA, 22 bp, Homo sapiens
tttcctggaccaactgagattg

SEQ ID NO: 7462154 - DNA, 22 bp, Homo sapiens
tttcctggagggtccccagcag

SEQ ID NO: 7462155 - DNA, 22 bp, Homo sapiens
tttcctggaccaactgagattg

SEQ ID NO: 7462156 - DNA, 22 bp, Homo sapiens
tttcctggccaaatgctttgtg

SEQ ID NO: 7462157 - DNA, 22 bp, Homo sapiens
tttcctggagggtccccagcag

SEQ ID NO: 7462158 - DNA, 22 bp, Homo sapiens
tttcctgtgcttaacaaatatt

SEQ ID NO: 7462159 - DNA, 22 bp, Homo sapiens
tttcctgtgactaatctggaca

SEQ ID NO: 7462160 - DNA, 22 bp, Homo sapiens
tttcctgtgactaatctggaca

SEQ ID NO: 7462161 - DNA, 22 bp, Homo sapiens
tttcctgttgccatcaagaatg

SEQ ID NO: 7462162 - DNA, 22 bp, Homo sapiens
tttcctgttgccatcaagaatg

SEQ ID NO: 7462163 - DNA, 22 bp, Homo sapiens
tttcctgttgccatcaagaatg

SEQ ID NO: 7462164 - DNA, 22 bp, Homo sapiens
tttcctgtgcttaacaaatatt

SEQ ID NO: 7462165 - DNA, 22 bp, Homo sapiens
tttcctgttctagttgttgcca

SEQ ID NO: 7462166 - DNA, 22 bp, Homo sapiens
tttcctctttgtgacacagctg

SEQ ID NO: 7462167 - DNA, 22 bp, Homo sapiens
tttcctctttgtaccttgacta

SEQ ID NO: 7462168 - DNA, 22 bp, Homo sapiens
tttcctctttgtgacacagctg

SEQ ID NO: 7462169 - DNA, 22 bp, Homo sapiens
tttcctctttgtgacacagctg

SEQ ID NO: 7462170 - DNA, 22 bp, Homo sapiens
tttcctgagccagagtttcatt

SEQ ID NO: 7462171 - DNA, 22 bp, Homo sapiens
tttcctctttgtaccttgacta

SEQ ID NO: 7462172 - DNA, 22 bp, Homo sapiens
tttcctctttgtaccttgacta

SEQ ID NO: 7462173 - DNA, 22 bp, Homo sapiens
tttcctctttgtaccttgacta

SEQ ID NO: 7462174 - DNA, 22 bp, Homo sapiens
tttcctctttgtaccttgacta

SEQ ID NO: 7462175 - DNA, 22 bp, Homo sapiens
tttcctgcctcacctcagaagt

SEQ ID NO: 7462176 - DNA, 22 bp, Homo sapiens
tttcctgcacccgctgatgcca

SEQ ID NO: 7462177 - DNA, 21 bp, Homo sapiens
tttcctgccctttgtcatcac

SEQ ID NO: 7462178 - DNA, 22 bp, Homo sapiens
tttcctggaagttattcctcat

SEQ ID NO: 7462179 - DNA, 22 bp, Homo sapiens
tttcctgcctggacctctgctt

SEQ ID NO: 7462180 - DNA, 22 bp, Homo sapiens
tttcctgagtcagagacaccag

SEQ ID NO: 7462181 - DNA, 22 bp, Homo sapiens
tttcctgcacccgctgatgcca

SEQ ID NO: 7462182 - DNA, 22 bp, Homo sapiens
tttcctgcacccgctgatgcca

SEQ ID NO: 7462183 - DNA, 22 bp, Homo sapiens
tttctaatgttctcagggattg

SEQ ID NO: 7462184 - DNA, 22 bp, Homo sapiens
tttctaattctaactggcagag

SEQ ID NO: 7462185 - DNA, 22 bp, Homo sapiens
tttctaattctaactggcagag

SEQ ID NO: 7462186 - DNA, 22 bp, Homo sapiens
tttctaattctaactggcagag

SEQ ID NO: 7462187 - DNA, 22 bp, Homo sapiens
tttctaattgtggccgaggtag

SEQ ID NO: 7462188 - DNA, 19 bp, Homo sapiens
tttctaatgtgtttttctt

SEQ ID NO: 7462189 - DNA, 19 bp, Homo sapiens
tttctaatgtgtttttctt

SEQ ID NO: 7462190 - DNA, 19 bp, Homo sapiens
tttctaatgtgtttttctt

SEQ ID NO: 7462191 - DNA, 22 bp, Homo sapiens
tttctacatgttttctattgaa

SEQ ID NO: 7462192 - DNA, 22 bp, Homo sapiens
tttctacatgttttctattgaa

SEQ ID NO: 7462193 - DNA, 22 bp, Homo sapiens
tttctacatgttttctattgaa

SEQ ID NO: 7462194 - DNA, 22 bp, Homo sapiens
tttctacatgttttctattgaa

SEQ ID NO: 7462195 - DNA, 22 bp, Homo sapiens
tttctacatgttttctattgaa

SEQ ID NO: 7462196 - DNA, 22 bp, Homo sapiens
tttctaatctttagttacaaaa

SEQ ID NO: 7462197 - DNA, 19 bp, Homo sapiens
tttctaatgtgtttttctt

SEQ ID NO: 7462198 - DNA, 19 bp, Homo sapiens
tttctaatgtgtttttctt

SEQ ID NO: 7462199 - DNA, 22 bp, Homo sapiens
tttctaatctttagttacaaaa

SEQ ID NO: 7462200 - DNA, 22 bp, Homo sapiens
tttctaatctttagttacaaaa

SEQ ID NO: 7462201 - DNA, 22 bp, Homo sapiens
tttctaatctttagttacaaaa

SEQ ID NO: 7462202 - DNA, 22 bp, Homo sapiens
tttctaatctgattctcctacc

SEQ ID NO: 7462203 - DNA, 22 bp, Homo sapiens
tttctaatctttagttacaaaa

SEQ ID NO: 7462204 - DNA, 22 bp, Homo sapiens
tttctactcaactgagagttgt

SEQ ID NO: 7462205 - DNA, 22 bp, Homo sapiens
tttctactgttatgacactggg

SEQ ID NO: 7462206 - DNA, 22 bp, Homo sapiens
tttctactcatcctttggagaa

SEQ ID NO: 7462207 - DNA, 22 bp, Homo sapiens
tttctactcatcctttggagaa

SEQ ID NO: 7462208 - DNA, 22 bp, Homo sapiens
tttctactcaactgagagttgt

SEQ ID NO: 7462209 - DNA, 22 bp, Homo sapiens
tttctactaagaaagttgatta

SEQ ID NO: 7462210 - DNA, 22 bp, Homo sapiens
tttctactaagaaagttgatta

SEQ ID NO: 7462211 - DNA, 22 bp, Homo sapiens
tttctactaagaaagttgatta

SEQ ID NO: 7462212 - DNA, 22 bp, Homo sapiens
tttctacatttgtaaccagatt

SEQ ID NO: 7462213 - DNA, 22 bp, Homo sapiens
tttctacatttgtaaccagatt

SEQ ID NO: 7462214 - DNA, 22 bp, Homo sapiens
tttctacatttgtaaccagatt

SEQ ID NO: 7462215 - DNA, 22 bp, Homo sapiens
tttctacatttgtaaccagatt

SEQ ID NO: 7462216 - DNA, 22 bp, Homo sapiens
tttctacattcaaaaactacca

SEQ ID NO: 7462217 - DNA, 22 bp, Homo sapiens
tttctacattcaaaaactacca

SEQ ID NO: 7462218 - DNA, 22 bp, Homo sapiens
tttctacattcaaaaactacca

SEQ ID NO: 7462219 - DNA, 22 bp, Homo sapiens
tttctacattcaaaaactacca

SEQ ID NO: 7462220 - DNA, 22 bp, Homo sapiens
tttctacattcaaaaactacca

SEQ ID NO: 7462221 - DNA, 22 bp, Homo sapiens
tttctacattcaaaaactacca

SEQ ID NO: 7462222 - DNA, 22 bp, Homo sapiens
tttctaagtaaacacagcatac

SEQ ID NO: 7462223 - DNA, 22 bp, Homo sapiens
tttctaagtaaacacagcatac

SEQ ID NO: 7462224 - DNA, 22 bp, Homo sapiens
tttctaagtaaacacagcatac

SEQ ID NO: 7462225 - DNA, 22 bp, Homo sapiens
tttctaagtaaacacagcatac

SEQ ID NO: 7462226 - DNA, 22 bp, Homo sapiens
tttctaagtaagattaacttct

SEQ ID NO: 7462227 - DNA, 22 bp, Homo sapiens
tttctaagtaagattaacttct

SEQ ID NO: 7462228 - DNA, 22 bp, Homo sapiens
tttctaagtatcttgcagtttt

SEQ ID NO: 7462229 - DNA, 21 bp, Homo sapiens
tttctaagtaactggcagcat

SEQ ID NO: 7462230 - DNA, 22 bp, Homo sapiens
tttctaagtatcttgcagtttt

SEQ ID NO: 7462231 - DNA, 22 bp, Homo sapiens
tttctaagtatcttgcagtttt

SEQ ID NO: 7462232 - DNA, 22 bp, Homo sapiens
tttctaagtatcttgcagtttt

SEQ ID NO: 7462233 - DNA, 22 bp, Homo sapiens
tttctaagtatcttgcagtttt

SEQ ID NO: 7462234 - DNA, 22 bp, Homo sapiens
tttctaagtatcttgcagtttt

SEQ ID NO: 7462235 - DNA, 22 bp, Homo sapiens
tttctaagtgaacattcaagtt

SEQ ID NO: 7462236 - DNA, 22 bp, Homo sapiens
tttctaagtgaacattcaagtt

SEQ ID NO: 7462237 - DNA, 22 bp, Homo sapiens
tttctaagtctgagggagtata

SEQ ID NO: 7462238 - DNA, 22 bp, Homo sapiens
tttctaagtgaacattcaagtt

SEQ ID NO: 7462239 - DNA, 22 bp, Homo sapiens
tttctaagtgaacattcaagtt

SEQ ID NO: 7462240 - DNA, 21 bp, Homo sapiens
tttctaagtgcttggtttggg

SEQ ID NO: 7462241 - DNA, 22 bp, Homo sapiens
tttctaagtgtgtttcatagga

SEQ ID NO: 7462242 - DNA, 22 bp, Homo sapiens
tttctaagtgtgattttagatt

SEQ ID NO: 7462243 - DNA, 22 bp, Homo sapiens
tttctaagtgtgattttagatt

SEQ ID NO: 7462244 - DNA, 22 bp, Homo sapiens
tttctaagtgtgattttagatt

SEQ ID NO: 7462245 - DNA, 22 bp, Homo sapiens
tttctaagtgtattgagcttgg

SEQ ID NO: 7462246 - DNA, 22 bp, Homo sapiens
tttctaagtgtgattttagatt

SEQ ID NO: 7462247 - DNA, 22 bp, Homo sapiens
tttctaagtgtattgagcttgg

SEQ ID NO: 7462248 - DNA, 22 bp, Homo sapiens
tttctaagtgtattgagcttgg

SEQ ID NO: 7462249 - DNA, 21 bp, Homo sapiens
tttctaagtgcttggtttggg

SEQ ID NO: 7462250 - DNA, 22 bp, Homo sapiens
tttctaatatgctctaagtcaa

SEQ ID NO: 7462251 - DNA, 22 bp, Homo sapiens
tttctaatatgctctaagtcaa

SEQ ID NO: 7462252 - DNA, 22 bp, Homo sapiens
tttctaatctgattctcctacc

SEQ ID NO: 7462253 - DNA, 22 bp, Homo sapiens
tttctaatctgattctcctacc

SEQ ID NO: 7462254 - DNA, 22 bp, Homo sapiens
tttctaatatgctctaagtcaa

SEQ ID NO: 7462255 - DNA, 22 bp, Homo sapiens
tttctaatatgctctaagtcaa

SEQ ID NO: 7462256 - DNA, 22 bp, Homo sapiens
tttctaatagttgagtcagcta

SEQ ID NO: 7462257 - DNA, 22 bp, Homo sapiens
tttctaatatcacttccagctg

SEQ ID NO: 7462258 - DNA, 22 bp, Homo sapiens
tttctaatatcacttccagctg

SEQ ID NO: 7462259 - DNA, 22 bp, Homo sapiens
tttctaatatcacttccagctg

SEQ ID NO: 7462260 - DNA, 22 bp, Homo sapiens
tttctaagtgtgtttcatagga

SEQ ID NO: 7462261 - DNA, 22 bp, Homo sapiens
tttctaatagttgagtcagcta

SEQ ID NO: 7462262 - DNA, 22 bp, Homo sapiens
tttctaagtgtgtttcatagga

SEQ ID NO: 7462263 - DNA, 22 bp, Homo sapiens
tttctaagtgtgtttcatagga

SEQ ID NO: 7462264 - DNA, 22 bp, Homo sapiens
tttgttttgaactagctcagaa

SEQ ID NO: 7462265 - DNA, 22 bp, Homo sapiens
tttgttttctgtaggcctttcc

SEQ ID NO: 7462266 - DNA, 22 bp, Homo sapiens
tttgttttctgtaggcctttcc

SEQ ID NO: 7462267 - DNA, 22 bp, Homo sapiens
tttgttttctgtaggcctttcc

SEQ ID NO: 7462268 - DNA, 22 bp, Homo sapiens
tttgttttctgtaggcctttcc

SEQ ID NO: 7462269 - DNA, 22 bp, Homo sapiens
tttgttttctgtaggcctttcc

SEQ ID NO: 7462270 - DNA, 22 bp, Homo sapiens
tttgttttctgtaggcctttcc

SEQ ID NO: 7462271 - DNA, 22 bp, Homo sapiens
tttgttttctgtaggcctttcc

SEQ ID NO: 7462272 - DNA, 22 bp, Homo sapiens
tttgttttctgtaggcctttcc

SEQ ID NO: 7462273 - DNA, 22 bp, Homo sapiens
tttgttttctgtaggcctttcc

SEQ ID NO: 7462274 - DNA, 22 bp, Homo sapiens
tttgttttctgtaggcctttcc

SEQ ID NO: 7462275 - DNA, 22 bp, Homo sapiens
tttgttttcaatgtgtcattca

SEQ ID NO: 7462276 - DNA, 22 bp, Homo sapiens
tttgttttcaatgtgtcattca

SEQ ID NO: 7462277 - DNA, 22 bp, Homo sapiens
tttgttttcaatgtgtcattca

SEQ ID NO: 7462278 - DNA, 22 bp, Homo sapiens
tttgttttcaatgtgtcattca

SEQ ID NO: 7462279 - DNA, 22 bp, Homo sapiens
tttgttttgaactagctcagaa

SEQ ID NO: 7462280 - DNA, 22 bp, Homo sapiens
tttgttttgaactagctcagaa

SEQ ID NO: 7462281 - DNA, 22 bp, Homo sapiens
tttgttttgaactagctcagaa

SEQ ID NO: 7462282 - DNA, 22 bp, Homo sapiens
tttgttttgaactagctcagaa

SEQ ID NO: 7462283 - DNA, 22 bp, Homo sapiens
tttgttttgaactagctcagaa

SEQ ID NO: 7462284 - DNA, 22 bp, Homo sapiens
tttgttttgaactagctcagaa

SEQ ID NO: 7462285 - DNA, 22 bp, Homo sapiens
ttttaaactatagctggatgct

SEQ ID NO: 7462286 - DNA, 22 bp, Homo sapiens
ttttaaactatagctggatgct

SEQ ID NO: 7462287 - DNA, 22 bp, Homo sapiens
ttttaaactatagctggatgct

SEQ ID NO: 7462288 - DNA, 22 bp, Homo sapiens
tttgttttgaactagctcagaa

SEQ ID NO: 7462289 - DNA, 22 bp, Homo sapiens
tttgttttgaactagctcagaa

SEQ ID NO: 7462290 - DNA, 22 bp, Homo sapiens
ttttaaactgcagaatttagaa

SEQ ID NO: 7462291 - DNA, 22 bp, Homo sapiens
ttttagaagtgcctatcctatg

SEQ ID NO: 7462292 - DNA, 22 bp, Homo sapiens
ttttagaagtgcctatcctatg

SEQ ID NO: 7462293 - DNA, 22 bp, Homo sapiens
ttttaaactcccctagttggtg

SEQ ID NO: 7462294 - DNA, 22 bp, Homo sapiens
ttttaaactcccctagttggtg

SEQ ID NO: 7462295 - DNA, 22 bp, Homo sapiens
ttttaaactcccctagttggtg

SEQ ID NO: 7462296 - DNA, 22 bp, Homo sapiens
ttttagaagttcacttgggttt

SEQ ID NO: 7462297 - DNA, 22 bp, Homo sapiens
ttttagaagttcatgtgggatt

SEQ ID NO: 7462298 - DNA, 22 bp, Homo sapiens
ttttagaagttcatgtgggatt

SEQ ID NO: 7462299 - DNA, 22 bp, Homo sapiens
ttttagaagttcacttgggttt

SEQ ID NO: 7462300 - DNA, 22 bp, Homo sapiens
ttttagaagttcacttgggttt

SEQ ID NO: 7462301 - DNA, 22 bp, Homo sapiens
ttttagaagttcacttgggttt

SEQ ID NO: 7462302 - DNA, 22 bp, Homo sapiens
tttgtttagatggtaaatcagt

SEQ ID NO: 7462303 - DNA, 22 bp, Homo sapiens
tttgtttagatggtaaatcagt

SEQ ID NO: 7462304 - DNA, 22 bp, Homo sapiens
tttgtttagatggtaaatcagt

SEQ ID NO: 7462305 - DNA, 22 bp, Homo sapiens
tttgtttcgcagcctctctctg

SEQ ID NO: 7462306 - DNA, 22 bp, Homo sapiens
tttgtttctgcaatacctatag

SEQ ID NO: 7462307 - DNA, 22 bp, Homo sapiens
tttgtttctgcaatacctatag

SEQ ID NO: 7462308 - DNA, 22 bp, Homo sapiens
tttgtttcgcagcctctctctg

SEQ ID NO: 7462309 - DNA, 22 bp, Homo sapiens
tttgtttcgcagcctctctctg

SEQ ID NO: 7462310 - DNA, 22 bp, Homo sapiens
tttgtttagatggtaaatcagt

SEQ ID NO: 7462311 - DNA, 22 bp, Homo sapiens
tttgtttatcaaggtctagcat

SEQ ID NO: 7462312 - DNA, 22 bp, Homo sapiens
tttgtttagatggtaaatcagt

SEQ ID NO: 7462313 - DNA, 22 bp, Homo sapiens
tttgtttagagaattgaagcag

SEQ ID NO: 7462314 - DNA, 22 bp, Homo sapiens
tttgtttagatggtaaatcagt

SEQ ID NO: 7462315 - DNA, 22 bp, Homo sapiens
tttgtttagatggtaaatcagt

SEQ ID NO: 7462316 - DNA, 22 bp, Homo sapiens
tttgtttagatggtaaatcagt

SEQ ID NO: 7462317 - DNA, 22 bp, Homo sapiens
tttgtttagatggtaaatcagt

SEQ ID NO: 7462318 - DNA, 22 bp, Homo sapiens
tttgtttagagaattgaagcag

SEQ ID NO: 7462319 - DNA, 22 bp, Homo sapiens
tttgtttagagaattgaagcag

SEQ ID NO: 7462320 - DNA, 22 bp, Homo sapiens
tttgtttactcattcattgatg

SEQ ID NO: 7462321 - DNA, 22 bp, Homo sapiens
tttgtttactcattcattgatg

SEQ ID NO: 7462322 - DNA, 22 bp, Homo sapiens
tttgtttggcaacttggtaaag

SEQ ID NO: 7462323 - DNA, 22 bp, Homo sapiens
tttgtttgcggcacatagtttg

SEQ ID NO: 7462324 - DNA, 22 bp, Homo sapiens
tttgtttggcaacttggtaaag

SEQ ID NO: 7462325 - DNA, 22 bp, Homo sapiens
tttgtttgcggcacatagtttg

SEQ ID NO: 7462326 - DNA, 22 bp, Homo sapiens
tttgtttgcggcacatagtttg

SEQ ID NO: 7462327 - DNA, 22 bp, Homo sapiens
tttgtttgccacacaaaacagt

SEQ ID NO: 7462328 - DNA, 22 bp, Homo sapiens
tttgtttgcggcacatagtttg

SEQ ID NO: 7462329 - DNA, 22 bp, Homo sapiens
tttgtttgccacacaaaacagt

SEQ ID NO: 7462330 - DNA, 22 bp, Homo sapiens
tttgtttgaaagtctctacagc

SEQ ID NO: 7462331 - DNA, 22 bp, Homo sapiens
tttgtttgccacacaaaacagt

SEQ ID NO: 7462332 - DNA, 22 bp, Homo sapiens
tttgtttgaaagtctctacagc

SEQ ID NO: 7462333 - DNA, 22 bp, Homo sapiens
tttgtttgaaagtctctacagc

SEQ ID NO: 7462334 - DNA, 21 bp, Homo sapiens
tttgtttgtatcagaatggcc

SEQ ID NO: 7462335 - DNA, 21 bp, Homo sapiens
tttgtttgtatcagaatggcc

SEQ ID NO: 7462336 - DNA, 22 bp, Homo sapiens
tttgttttcaatgtgtcattca

SEQ ID NO: 7462337 - DNA, 22 bp, Homo sapiens
tttgttttcaatgtgtcattca

SEQ ID NO: 7462338 - DNA, 22 bp, Homo sapiens
tttgttttcaatgtgtcattca

SEQ ID NO: 7462339 - DNA, 22 bp, Homo sapiens
tttgttttcaatgtgtcattca

SEQ ID NO: 7462340 - DNA, 22 bp, Homo sapiens
tttgttttcaatgtgtcattca

SEQ ID NO: 7462341 - DNA, 22 bp, Homo sapiens
tttgttttcaatgtgtcattca

SEQ ID NO: 7462342 - DNA, 22 bp, Homo sapiens
tttgttttcaatgtgtcattca

SEQ ID NO: 7462343 - DNA, 22 bp, Homo sapiens
tttgttttcaatgtgtcattca

SEQ ID NO: 7462344 - DNA, 22 bp, Homo sapiens
tttgttttcaatgtgtcattca

SEQ ID NO: 7462345 - DNA, 22 bp, Homo sapiens
tttgttttcaatgtgtcattca

SEQ ID NO: 7462346 - DNA, 22 bp, Homo sapiens
tttgttttcaatgtgtcattca

SEQ ID NO: 7462347 - DNA, 22 bp, Homo sapiens
tttgttttcaatgtgtcattca

SEQ ID NO: 7462348 - DNA, 22 bp, Homo sapiens
ttttatcaatcattaagacatt

SEQ ID NO: 7462349 - DNA, 22 bp, Homo sapiens
ttttatcaatcattaagacatt

SEQ ID NO: 7462350 - DNA, 22 bp, Homo sapiens
ttttatcaatcattaagacatt

SEQ ID NO: 7462351 - DNA, 22 bp, Homo sapiens
ttttatcaatcattaagacatt

SEQ ID NO: 7462352 - DNA, 22 bp, Homo sapiens
ttttatcaatcattaagacatt

SEQ ID NO: 7462353 - DNA, 22 bp, Homo sapiens
ttttatcaatcattaagacatt

SEQ ID NO: 7462354 - DNA, 22 bp, Homo sapiens
ttttatcaatcattaagacatt

SEQ ID NO: 7462355 - DNA, 22 bp, Homo sapiens
ttttatcaatcattaagacatt

SEQ ID NO: 7462356 - DNA, 22 bp, Homo sapiens
ttttatcaatcattaagacatt

SEQ ID NO: 7462357 - DNA, 22 bp, Homo sapiens
ttttatcaatcattaagacatt

SEQ ID NO: 7462358 - DNA, 22 bp, Homo sapiens
ttttatcaatcattaagacatt

SEQ ID NO: 7462359 - DNA, 22 bp, Homo sapiens
ttttatcaatcattaagacatt

SEQ ID NO: 7462360 - DNA, 22 bp, Homo sapiens
ttttatcaatcattaagacatt

SEQ ID NO: 7462361 - DNA, 22 bp, Homo sapiens
ttttatcagcagggataacaag

SEQ ID NO: 7462362 - DNA, 22 bp, Homo sapiens
ttttatcagcagggataacaag

SEQ ID NO: 7462363 - DNA, 22 bp, Homo sapiens
ttttatcagcagggataacaag

SEQ ID NO: 7462364 - DNA, 22 bp, Homo sapiens
ttttatcagcagggataacaag

SEQ ID NO: 7462365 - DNA, 22 bp, Homo sapiens
ttttatcagcagggataacaag

SEQ ID NO: 7462366 - DNA, 22 bp, Homo sapiens
ttttatcagcagggataacaag

SEQ ID NO: 7462367 - DNA, 22 bp, Homo sapiens
ttttatcagcagggataacaag

SEQ ID NO: 7462368 - DNA, 22 bp, Homo sapiens
ttttatcagcagggataacaag

SEQ ID NO: 7462369 - DNA, 22 bp, Homo sapiens
ttttatcagcagggataacaag

SEQ ID NO: 7462370 - DNA, 22 bp, Homo sapiens
ttttatcagcagggataacaag

SEQ ID NO: 7462371 - DNA, 22 bp, Homo sapiens
ttttatcaatcattaagacatt

SEQ ID NO: 7462372 - DNA, 22 bp, Homo sapiens
ttttatcaatcattaagacatt

SEQ ID NO: 7462373 - DNA, 22 bp, Homo sapiens
ttttatattgagtgagagttcc

SEQ ID NO: 7462374 - DNA, 22 bp, Homo sapiens
ttttatattgagtgagagttcc

SEQ ID NO: 7462375 - DNA, 20 bp, Homo sapiens
ttttatatgtagggtatatg

SEQ ID NO: 7462376 - DNA, 22 bp, Homo sapiens
ttttatattgagtgagagttcc

SEQ ID NO: 7462377 - DNA, 22 bp, Homo sapiens
ttttatattgagtgagagttcc

SEQ ID NO: 7462378 - DNA, 22 bp, Homo sapiens
ttttatattgagtgagagttcc

SEQ ID NO: 7462379 - DNA, 22 bp, Homo sapiens
ttttatattgagtgagagttcc

SEQ ID NO: 7462380 - DNA, 22 bp, Homo sapiens
ttttatatggcacattggttgg

SEQ ID NO: 7462381 - DNA, 22 bp, Homo sapiens
ttttatatggcacattggttgg

SEQ ID NO: 7462382 - DNA, 22 bp, Homo sapiens
ttttatatggcacattggttgg

SEQ ID NO: 7462383 - DNA, 20 bp, Homo sapiens
ttttatatgtagggtatatg

SEQ ID NO: 7462384 - DNA, 20 bp, Homo sapiens
ttttatatgtagggtatatg

SEQ ID NO: 7462385 - DNA, 22 bp, Homo sapiens
ttttatacttaagacagagttt

SEQ ID NO: 7462386 - DNA, 22 bp, Homo sapiens
ttttatacttaagacagagttt

SEQ ID NO: 7462387 - DNA, 22 bp, Homo sapiens
ttttatacttaagacagagttt

SEQ ID NO: 7462388 - DNA, 22 bp, Homo sapiens
ttttatacttaagacagagttt

SEQ ID NO: 7462389 - DNA, 22 bp, Homo sapiens
ttttatacttaagacagagttt

SEQ ID NO: 7462390 - DNA, 22 bp, Homo sapiens
ttttatagctgaatagtattcc

SEQ ID NO: 7462391 - DNA, 22 bp, Homo sapiens
ttttatagctgaatagtattcc

SEQ ID NO: 7462392 - DNA, 22 bp, Homo sapiens
ttttatacacatgaacatgcag

SEQ ID NO: 7462393 - DNA, 22 bp, Homo sapiens
ttttatacacatgaacatgcag

SEQ ID NO: 7462394 - DNA, 22 bp, Homo sapiens
ttttataagcaagaaagggaaa

SEQ ID NO: 7462395 - DNA, 22 bp, Homo sapiens
ttttataagcaagaaagggaaa

SEQ ID NO: 7462396 - DNA, 22 bp, Homo sapiens
ttttataagcaagaaagggaaa

SEQ ID NO: 7462397 - DNA, 22 bp, Homo sapiens
ttttataagcaagaaagggaaa

SEQ ID NO: 7462398 - DNA, 22 bp, Homo sapiens
ttttataagcaagaaagggaaa

SEQ ID NO: 7462399 - DNA, 22 bp, Homo sapiens
ttttataagcaagaaagggaaa

SEQ ID NO: 7462400 - DNA, 22 bp, Homo sapiens
ttttataagcaagaaagggaaa

SEQ ID NO: 7462401 - DNA, 22 bp, Homo sapiens
ttttataagcaagaaagggaaa

SEQ ID NO: 7462402 - DNA, 22 bp, Homo sapiens
ttttataagcaagaaagggaaa

SEQ ID NO: 7462403 - DNA, 22 bp, Homo sapiens
ttttataaagagagtcagttgg

SEQ ID NO: 7462404 - DNA, 22 bp, Homo sapiens
ttttataaagagagtcagttgg

SEQ ID NO: 7462405 - DNA, 22 bp, Homo sapiens
ttttataaagagagtcagttgg

SEQ ID NO: 7462406 - DNA, 22 bp, Homo sapiens
ttttataaagagagtcagttgg

SEQ ID NO: 7462407 - DNA, 22 bp, Homo sapiens
ttttataaagagagtcagttgg

SEQ ID NO: 7462408 - DNA, 22 bp, Homo sapiens
ttttataaagagagtcagttgg

SEQ ID NO: 7462409 - DNA, 22 bp, Homo sapiens
ttttagtttggatttctaaagc

SEQ ID NO: 7462410 - DNA, 22 bp, Homo sapiens
ttttagtttggatttctaaagc

SEQ ID NO: 7462411 - DNA, 22 bp, Homo sapiens
ttttagtttggatttctaaagc

SEQ ID NO: 7462412 - DNA, 22 bp, Homo sapiens
ttttagaagttcatgtgggatt

SEQ ID NO: 7462413 - DNA, 22 bp, Homo sapiens
ttttagaatcaggttgtctggg

SEQ ID NO: 7462414 - DNA, 22 bp, Homo sapiens
ttttagaatcaggttgtctggg

SEQ ID NO: 7462415 - DNA, 22 bp, Homo sapiens
ttttagtttggatttctaaagc

SEQ ID NO: 7462416 - DNA, 22 bp, Homo sapiens
ttttagaagttcatgtgggatt

SEQ ID NO: 7462417 - DNA, 22 bp, Homo sapiens
tttgttcttgcaacagttatta

SEQ ID NO: 7462418 - DNA, 22 bp, Homo sapiens
tttgttcttgcaacagttatta

SEQ ID NO: 7462419 - DNA, 22 bp, Homo sapiens
tttgttcttagtatctgtgtgc

SEQ ID NO: 7462420 - DNA, 22 bp, Homo sapiens
tttgttctgcatcacagaaaaa

SEQ ID NO: 7462421 - DNA, 22 bp, Homo sapiens
tttgttctgcatcacagaaaaa

SEQ ID NO: 7462422 - DNA, 22 bp, Homo sapiens
tttgttctgaagcaagtaggga

SEQ ID NO: 7462423 - DNA, 22 bp, Homo sapiens
tttgttctgaagcaagtaggga

SEQ ID NO: 7462424 - DNA, 22 bp, Homo sapiens
tttgttctgcatcacagaaaaa

SEQ ID NO: 7462425 - DNA, 22 bp, Homo sapiens
tttgttctgcatcacagaaaaa

SEQ ID NO: 7462426 - DNA, 22 bp, Homo sapiens
tttgttctgcatcacagaaaaa

SEQ ID NO: 7462427 - DNA, 22 bp, Homo sapiens
tttgttctgcatcacagaaaaa

SEQ ID NO: 7462428 - DNA, 22 bp, Homo sapiens
tttgttcttgcaacagttatta

SEQ ID NO: 7462429 - DNA, 22 bp, Homo sapiens
tttgttcttgcaacagttatta

SEQ ID NO: 7462430 - DNA, 22 bp, Homo sapiens
tttgttcttgcaacagttatta

SEQ ID NO: 7462431 - DNA, 22 bp, Homo sapiens
tttgttcttgcaacagttatta

SEQ ID NO: 7462432 - DNA, 22 bp, Homo sapiens
tttgttcttgcaacagttatta

SEQ ID NO: 7462433 - DNA, 22 bp, Homo sapiens
tttgttcttgcaacagttatta

SEQ ID NO: 7462434 - DNA, 18 bp, Homo sapiens
tttgttgggttgccttta

SEQ ID NO: 7462435 - DNA, 18 bp, Homo sapiens
tttgttgggttgccttta

SEQ ID NO: 7462436 - DNA, 22 bp, Homo sapiens
tttgttgggagaaacattattt

SEQ ID NO: 7462437 - DNA, 22 bp, Homo sapiens
tttgtttactcattcattgatg

SEQ ID NO: 7462438 - DNA, 22 bp, Homo sapiens
tttgtttacaaaaataagcagt

SEQ ID NO: 7462439 - DNA, 22 bp, Homo sapiens
tttgtttactcattcattgatg

SEQ ID NO: 7462440 - DNA, 22 bp, Homo sapiens
tttgtttacaaaaataagcagt

SEQ ID NO: 7462441 - DNA, 22 bp, Homo sapiens
tttgtttacaaaaataagcagt

SEQ ID NO: 7462442 - DNA, 22 bp, Homo sapiens
tttgtttacaaaaataagcagt

SEQ ID NO: 7462443 - DNA, 22 bp, Homo sapiens
tttgtttacaaaaataagcagt

SEQ ID NO: 7462444 - DNA, 22 bp, Homo sapiens
tttgtttacaaaaataagcagt

SEQ ID NO: 7462445 - DNA, 22 bp, Homo sapiens
tttgtttacaaaaataagcagt

SEQ ID NO: 7462446 - DNA, 22 bp, Homo sapiens
tttgttgttagagtatgtgaaa

SEQ ID NO: 7462447 - DNA, 22 bp, Homo sapiens
tttgttgtctagcatgaggtgc

SEQ ID NO: 7462448 - DNA, 22 bp, Homo sapiens
tttgttgtgaacagaataatat

SEQ ID NO: 7462449 - DNA, 22 bp, Homo sapiens
tttgttgtgaacagaataatat

SEQ ID NO: 7462450 - DNA, 22 bp, Homo sapiens
tttgttgtgaacagaataatat

SEQ ID NO: 7462451 - DNA, 22 bp, Homo sapiens
tttgtcaaagatcagatgcttt

SEQ ID NO: 7462452 - DNA, 22 bp, Homo sapiens
tttgtcaaatcaaaccacattc

SEQ ID NO: 7462453 - DNA, 22 bp, Homo sapiens
tttgtatttttcccagctagct

SEQ ID NO: 7462454 - DNA, 22 bp, Homo sapiens
tttgtatttttcccagctagct

SEQ ID NO: 7462455 - DNA, 22 bp, Homo sapiens
tttgtatttttcccagctagct

SEQ ID NO: 7462456 - DNA, 22 bp, Homo sapiens
tttgtcagtcatgtctgctttt

SEQ ID NO: 7462457 - DNA, 22 bp, Homo sapiens
tttgtcagagaactccagcaaa

SEQ ID NO: 7462458 - DNA, 22 bp, Homo sapiens
tttgtcaccagtggctttggta

SEQ ID NO: 7462459 - DNA, 22 bp, Homo sapiens
tttgtcaatcccttgaaaacct

SEQ ID NO: 7462460 - DNA, 22 bp, Homo sapiens
tttgtcaatcccttgaaaacct

SEQ ID NO: 7462461 - DNA, 22 bp, Homo sapiens
tttgtcaataactaccaacagg

SEQ ID NO: 7462462 - DNA, 22 bp, Homo sapiens
tttgtcaagtttgcaaatacgt

SEQ ID NO: 7462463 - DNA, 22 bp, Homo sapiens
tttgtcaagtttgcaaatacgt

SEQ ID NO: 7462464 - DNA, 22 bp, Homo sapiens
tttgtcaagtttgcaaatacgt

SEQ ID NO: 7462465 - DNA, 22 bp, Homo sapiens
tttgttcagctctcattgatta

SEQ ID NO: 7462466 - DNA, 22 bp, Homo sapiens
tttgttcagctctcattgatta

SEQ ID NO: 7462467 - DNA, 22 bp, Homo sapiens
tttgttcagctctcattgatta

SEQ ID NO: 7462468 - DNA, 22 bp, Homo sapiens
tttgttcactgatgtatcccaa

SEQ ID NO: 7462469 - DNA, 22 bp, Homo sapiens
tttgttcactgagcaatgatta

SEQ ID NO: 7462470 - DNA, 23 bp, Homo sapiens
tttgttcactcctgggaaagaca

SEQ ID NO: 7462471 - DNA, 23 bp, Homo sapiens
tttgttcactcctgggaaagaca

SEQ ID NO: 7462472 - DNA, 22 bp, Homo sapiens
tttgttcacatttaggactctc

SEQ ID NO: 7462473 - DNA, 22 bp, Homo sapiens
tttgttcacatgtcatgtacaa

SEQ ID NO: 7462474 - DNA, 22 bp, Homo sapiens
tttgttcacatgtcatgtacaa

SEQ ID NO: 7462475 - DNA, 22 bp, Homo sapiens
tttgtcagtcatgtctgctttt

SEQ ID NO: 7462476 - DNA, 22 bp, Homo sapiens
tttgtcagtcatgtctgctttt

SEQ ID NO: 7462477 - DNA, 22 bp, Homo sapiens
tttgttcacctagcaaactttt

SEQ ID NO: 7462478 - DNA, 22 bp, Homo sapiens
tttgttcacctagcaaactttt

SEQ ID NO: 7462479 - DNA, 22 bp, Homo sapiens
tttgtagagaataaaacaaatt

SEQ ID NO: 7462480 - DNA, 22 bp, Homo sapiens
tttgtagagaataaaacaaatt

SEQ ID NO: 7462481 - DNA, 22 bp, Homo sapiens
tttgtagagaatgttaagcact

SEQ ID NO: 7462482 - DNA, 22 bp, Homo sapiens
tttgtagatagaaaaatgatta

SEQ ID NO: 7462483 - DNA, 22 bp, Homo sapiens
tttgtagaataatatctttctg

SEQ ID NO: 7462484 - DNA, 22 bp, Homo sapiens
tttgtagaataatatctttctg

SEQ ID NO: 7462485 - DNA, 22 bp, Homo sapiens
tttgtagaaagggttgtatgaa

SEQ ID NO: 7462486 - DNA, 22 bp, Homo sapiens
tttgtacttcattggttctact

SEQ ID NO: 7462487 - DNA, 22 bp, Homo sapiens
tttgtactgttgaaattgctgg

SEQ ID NO: 7462488 - DNA, 22 bp, Homo sapiens
tttgtacttcattggttctact

SEQ ID NO: 7462489 - DNA, 22 bp, Homo sapiens
tttgtactgaagattgtaaact

SEQ ID NO: 7462490 - DNA, 22 bp, Homo sapiens
tttgtagaactgtagaacaatg

SEQ ID NO: 7462491 - DNA, 22 bp, Homo sapiens
tttgtactggaagaacatgcaa

SEQ ID NO: 7462492 - DNA, 23 bp, Homo sapiens
tttgtactgcattatgagacaca

SEQ ID NO: 7462493 - DNA, 22 bp, Homo sapiens
tttgtactgccacagctgacgt

SEQ ID NO: 7462494 - DNA, 22 bp, Homo sapiens
tttgtactgccacagctgacgt

SEQ ID NO: 7462495 - DNA, 22 bp, Homo sapiens
tttgtactgttgaaattgctgg

SEQ ID NO: 7462496 - DNA, 22 bp, Homo sapiens
tttgtactgttgaaattgctgg

SEQ ID NO: 7462497 - DNA, 22 bp, Homo sapiens
tttgtacttcattggttctact

SEQ ID NO: 7462498 - DNA, 22 bp, Homo sapiens
tttgtacttcattggttctact

SEQ ID NO: 7462499 - DNA, 22 bp, Homo sapiens
tttgtactgccacagctgacgt

SEQ ID NO: 7462500 - DNA, 22 bp, Homo sapiens
tttgtactggaagaacatgcaa

SEQ ID NO: 7462501 - DNA, 22 bp, Homo sapiens
tttgtactggaagaacatgcaa

SEQ ID NO: 7462502 - DNA, 22 bp, Homo sapiens
tttgtactgaagattgtaaact

SEQ ID NO: 7462503 - DNA, 22 bp, Homo sapiens
tttgtactgaagattgtaaact

SEQ ID NO: 7462504 - DNA, 22 bp, Homo sapiens
tttgtactgaccaattatttga

SEQ ID NO: 7462505 - DNA, 23 bp, Homo sapiens
tttgtactgcattatgagacaca

SEQ ID NO: 7462506 - DNA, 23 bp, Homo sapiens
tttgtactgcattatgagacaca

SEQ ID NO: 7462507 - DNA, 22 bp, Homo sapiens
tttgtactgaccaattatttga

SEQ ID NO: 7462508 - DNA, 22 bp, Homo sapiens
tttgtactagtcagtaaatagt

SEQ ID NO: 7462509 - DNA, 22 bp, Homo sapiens
tttgtacatttcactccattgt

SEQ ID NO: 7462510 - DNA, 22 bp, Homo sapiens
tttgtacctgtgggaatacaga

SEQ ID NO: 7462511 - DNA, 22 bp, Homo sapiens
tttgtactagtcagtaaatagt

SEQ ID NO: 7462512 - DNA, 22 bp, Homo sapiens
tttgtactcaggctcagcctct

SEQ ID NO: 7462513 - DNA, 22 bp, Homo sapiens
tttgtactctcagaattcagaa

SEQ ID NO: 7462514 - DNA, 22 bp, Homo sapiens
tttgtactctcagaattcagaa

SEQ ID NO: 7462515 - DNA, 22 bp, Homo sapiens
tttgtactctcagaattcagaa

SEQ ID NO: 7462516 - DNA, 22 bp, Homo sapiens
tttgtactatggtttttcacta

SEQ ID NO: 7462517 - DNA, 22 bp, Homo sapiens
tttgtactatggtttttcacta

SEQ ID NO: 7462518 - DNA, 23 bp, Homo sapiens
tttgtacattgaggaggcagaat

SEQ ID NO: 7462519 - DNA, 22 bp, Homo sapiens
tttgtacatttcactccattgt

SEQ ID NO: 7462520 - DNA, 22 bp, Homo sapiens
tttgtacatttcactccattgt

SEQ ID NO: 7462521 - DNA, 22 bp, Homo sapiens
tttgtacatttcactccattgt

SEQ ID NO: 7462522 - DNA, 22 bp, Homo sapiens
tttgtaccagccacatatgaaa

SEQ ID NO: 7462523 - DNA, 22 bp, Homo sapiens
tttgtaccagccacatatgaaa

SEQ ID NO: 7462524 - DNA, 22 bp, Homo sapiens
tttgtagcagcatgatttataa

SEQ ID NO: 7462525 - DNA, 22 bp, Homo sapiens
tttgtagcagcatgatttataa

SEQ ID NO: 7462526 - DNA, 22 bp, Homo sapiens
tttgtagcagcatgatttataa

SEQ ID NO: 7462527 - DNA, 22 bp, Homo sapiens
tttgtagcagcatgatttataa

SEQ ID NO: 7462528 - DNA, 22 bp, Homo sapiens
tttgtagcagcatgatttataa

SEQ ID NO: 7462529 - DNA, 22 bp, Homo sapiens
tttgtagttgtggatgctgaag

SEQ ID NO: 7462530 - DNA, 22 bp, Homo sapiens
tttgtagttgtggatgctgaag

SEQ ID NO: 7462531 - DNA, 22 bp, Homo sapiens
tttgtagcagcatgatttataa

SEQ ID NO: 7462532 - DNA, 22 bp, Homo sapiens
tttgtagcagcatgatttataa

SEQ ID NO: 7462533 - DNA, 22 bp, Homo sapiens
tttgtataaatgaagatgctgg

SEQ ID NO: 7462534 - DNA, 22 bp, Homo sapiens
tttgtagttgtggatgctgaag

SEQ ID NO: 7462535 - DNA, 22 bp, Homo sapiens
tttgtataaatgaagatgctgg

SEQ ID NO: 7462536 - DNA, 22 bp, Homo sapiens
tttgtataaatgaagatgctgg

SEQ ID NO: 7462537 - DNA, 22 bp, Homo sapiens
tttgtataaattggagcaatgt

SEQ ID NO: 7462538 - DNA, 22 bp, Homo sapiens
tttgtataaattggagcaatgt

SEQ ID NO: 7462539 - DNA, 22 bp, Homo sapiens
tttgtataaattggagcaatgt

SEQ ID NO: 7462540 - DNA, 22 bp, Homo sapiens
tttgtataagaacattctagca

SEQ ID NO: 7462541 - DNA, 22 bp, Homo sapiens
tttgtataagaacattctagca

SEQ ID NO: 7462542 - DNA, 22 bp, Homo sapiens
tttgtataaattttgaggtgag

SEQ ID NO: 7462543 - DNA, 22 bp, Homo sapiens
tttgtataagaacattctagca

SEQ ID NO: 7462544 - DNA, 22 bp, Homo sapiens
tttgtataagaacattctagca

SEQ ID NO: 7462545 - DNA, 22 bp, Homo sapiens
tttgtattacaaagtcacagta

SEQ ID NO: 7462546 - DNA, 22 bp, Homo sapiens
tttgtattccatatcatgccat

SEQ ID NO: 7462547 - DNA, 22 bp, Homo sapiens
tttgtattccatatcatgccat

SEQ ID NO: 7462548 - DNA, 22 bp, Homo sapiens
tttgtattacaaagtcacagta

SEQ ID NO: 7462549 - DNA, 22 bp, Homo sapiens
tttgtatgtgataagactattc

SEQ ID NO: 7462550 - DNA, 22 bp, Homo sapiens
tttgtatgtgataagactattc

SEQ ID NO: 7462551 - DNA, 22 bp, Homo sapiens
tttgtatgtgataagactattc

SEQ ID NO: 7462552 - DNA, 22 bp, Homo sapiens
tttgtatgggcagaaattagat

SEQ ID NO: 7462553 - DNA, 22 bp, Homo sapiens
tttgtatgggcagaaattagat

SEQ ID NO: 7462554 - DNA, 22 bp, Homo sapiens
tttgtatgggcagaaattagat

SEQ ID NO: 7462555 - DNA, 22 bp, Homo sapiens
tttgtatgaactggtatgtagg

SEQ ID NO: 7462556 - DNA, 22 bp, Homo sapiens
tttgtatgaatgcatattttca

SEQ ID NO: 7462557 - DNA, 22 bp, Homo sapiens
tttgtatgaactggtatgtagg

SEQ ID NO: 7462558 - DNA, 22 bp, Homo sapiens
tttgtataagaacattctagca

SEQ ID NO: 7462559 - DNA, 22 bp, Homo sapiens
tttgtatcctctttataacgta

SEQ ID NO: 7462560 - DNA, 22 bp, Homo sapiens
tttgtatgaactggtatgtagg

SEQ ID NO: 7462561 - DNA, 22 bp, Homo sapiens
tttgtataagaacattctagca

SEQ ID NO: 7462562 - DNA, 22 bp, Homo sapiens
tttgtataagaacattctagca

SEQ ID NO: 7462563 - DNA, 22 bp, Homo sapiens
tttgtataagaacattctagca

SEQ ID NO: 7462564 - DNA, 22 bp, Homo sapiens
tttgcaaggcagcaggtgcagt

SEQ ID NO: 7462565 - DNA, 22 bp, Homo sapiens
tttgcaaggcagcaggtgcagt

SEQ ID NO: 7462566 - DNA, 22 bp, Homo sapiens
tttgcaagtatcaaacatgtca

SEQ ID NO: 7462567 - DNA, 22 bp, Homo sapiens
tttgcaagtatcaaacatgtca

SEQ ID NO: 7462568 - DNA, 22 bp, Homo sapiens
tttgcaatggtagttgttgctc

SEQ ID NO: 7462569 - DNA, 22 bp, Homo sapiens
tttgcaatagtcctggcctgta

SEQ ID NO: 7462570 - DNA, 22 bp, Homo sapiens
tttgcaatagtcctggcctgta

SEQ ID NO: 7462571 - DNA, 22 bp, Homo sapiens
tttgcaatgtgaaattaaagaa

SEQ ID NO: 7462572 - DNA, 22 bp, Homo sapiens
tttgcaatttgtgctgcaaatg

SEQ ID NO: 7462573 - DNA, 22 bp, Homo sapiens
tttgcaacagactcatcattga

SEQ ID NO: 7462574 - DNA, 22 bp, Homo sapiens
tttgcaacagactcatcattga

SEQ ID NO: 7462575 - DNA, 22 bp, Homo sapiens
tttgcaagaagaatggcacaaa

SEQ ID NO: 7462576 - DNA, 22 bp, Homo sapiens
tttgcaagaagaatggcacaaa

SEQ ID NO: 7462577 - DNA, 22 bp, Homo sapiens
tttgcaagaagaatggcacaaa

SEQ ID NO: 7462578 - DNA, 22 bp, Homo sapiens
tttgcaagatgaaaaagttcta

SEQ ID NO: 7462579 - DNA, 22 bp, Homo sapiens
tttgcaaggcagcaggtgcagt

SEQ ID NO: 7462580 - DNA, 22 bp, Homo sapiens
tttgcaaatttcgtctcctcag

SEQ ID NO: 7462581 - DNA, 22 bp, Homo sapiens
tttgcaaatttcgtctcctcag

SEQ ID NO: 7462582 - DNA, 23 bp, Homo sapiens
tttgcaaattttcctgactactc

SEQ ID NO: 7462583 - DNA, 23 bp, Homo sapiens
tttgcaaattttcctgactactc

SEQ ID NO: 7462584 - DNA, 23 bp, Homo sapiens
tttgcaaattttcctgactactc

SEQ ID NO: 7462585 - DNA, 22 bp, Homo sapiens
tttgcaaattcttgtctagcct

SEQ ID NO: 7462586 - DNA, 23 bp, Homo sapiens
tttgcaaattggacacaaccaca

SEQ ID NO: 7462587 - DNA, 23 bp, Homo sapiens
tttgcaaattggacacaaccaca

SEQ ID NO: 7462588 - DNA, 23 bp, Homo sapiens
tttgcaaattggacacaaccaca

SEQ ID NO: 7462589 - DNA, 22 bp, Homo sapiens
tttgcaaattcttgtctagcct

SEQ ID NO: 7462590 - DNA, 22 bp, Homo sapiens
tttgcaaattcttgtctagcct

SEQ ID NO: 7462591 - DNA, 22 bp, Homo sapiens
tttgcaaatttcgtctcctcag

SEQ ID NO: 7462592 - DNA, 23 bp, Homo sapiens
tttgcaaattggacacaaccaca

SEQ ID NO: 7462593 - DNA, 23 bp, Homo sapiens
tttgcaaattggacacaaccaca

SEQ ID NO: 7462594 - DNA, 23 bp, Homo sapiens
tttgcaaattggacacaaccaca

SEQ ID NO: 7462595 - DNA, 23 bp, Homo sapiens
tttgcaaattggacacaaccaca

SEQ ID NO: 7462596 - DNA, 22 bp, Homo sapiens
tttgcaaatgctctgcagagct

SEQ ID NO: 7462597 - DNA, 22 bp, Homo sapiens
tttgcaaattagccaccctgtt

SEQ ID NO: 7462598 - DNA, 22 bp, Homo sapiens
tttgcaaattagccaccctgtt

SEQ ID NO: 7462599 - DNA, 22 bp, Homo sapiens
tttgcaaatgctctgcagagct

SEQ ID NO: 7462600 - DNA, 22 bp, Homo sapiens
tttgcaaatgaagctctgagga

SEQ ID NO: 7462601 - DNA, 22 bp, Homo sapiens
tttgcaaatgctctgcagagct

SEQ ID NO: 7462602 - DNA, 22 bp, Homo sapiens
tttgcaaatgctctgcagagct

SEQ ID NO: 7462603 - DNA, 22 bp, Homo sapiens
tttgcaaatgctctgcagagct

SEQ ID NO: 7462604 - DNA, 22 bp, Homo sapiens
tttgcacacacaataacaaatg

SEQ ID NO: 7462605 - DNA, 22 bp, Homo sapiens
tttgcacagatgggatacagca

SEQ ID NO: 7462606 - DNA, 22 bp, Homo sapiens
tttgcactagcatttgtccatg

SEQ ID NO: 7462607 - DNA, 22 bp, Homo sapiens
tttgcacttcctaatgtgtttt

SEQ ID NO: 7462608 - DNA, 22 bp, Homo sapiens
tttgcagaagaaaacatgaaca

SEQ ID NO: 7462609 - DNA, 22 bp, Homo sapiens
tttgcagaagaaaacatgaaca

SEQ ID NO: 7462610 - DNA, 22 bp, Homo sapiens
tttgcagaagaaaacatgaaca

SEQ ID NO: 7462611 - DNA, 22 bp, Homo sapiens
tttgcagaagaaaacatgaaca

SEQ ID NO: 7462612 - DNA, 22 bp, Homo sapiens
tttgcagaagaaaacatgaaca

SEQ ID NO: 7462613 - DNA, 22 bp, Homo sapiens
tttgcacttaacttatttgaaa

SEQ ID NO: 7462614 - DNA, 22 bp, Homo sapiens
tttgcacttaacttatttgaaa

SEQ ID NO: 7462615 - DNA, 22 bp, Homo sapiens
tttgcacttaacttatttgaaa

SEQ ID NO: 7462616 - DNA, 22 bp, Homo sapiens
tttgcactctaagtagtttgga

SEQ ID NO: 7462617 - DNA, 22 bp, Homo sapiens
tttgcacttaaatttacaacac

SEQ ID NO: 7462618 - DNA, 22 bp, Homo sapiens
tttgcagagtgcagaagcatct

SEQ ID NO: 7462619 - DNA, 22 bp, Homo sapiens
tttgcagagtacctgaagagga

SEQ ID NO: 7462620 - DNA, 22 bp, Homo sapiens
tttgcagagtacctgaagagga

SEQ ID NO: 7462621 - DNA, 22 bp, Homo sapiens
tttgcagcaaggagagagcatt

SEQ ID NO: 7462622 - DNA, 22 bp, Homo sapiens
tttgcagatgagaaaactgtgg

SEQ ID NO: 7462623 - DNA, 22 bp, Homo sapiens
tttgcagtcaaatttgctaaat

SEQ ID NO: 7462624 - DNA, 22 bp, Homo sapiens
tttgcagcctccctggcagaag

SEQ ID NO: 7462625 - DNA, 22 bp, Homo sapiens
tttgcagcctccctggcagaag

SEQ ID NO: 7462626 - DNA, 22 bp, Homo sapiens
tttgcagctaagcacagtaatt

SEQ ID NO: 7462627 - DNA, 22 bp, Homo sapiens
tttgcagtagacatcttatttt

SEQ ID NO: 7462628 - DNA, 20 bp, Homo sapiens
tttgcaggaaggaaataggt

SEQ ID NO: 7462629 - DNA, 22 bp, Homo sapiens
tttgcagcttctggtggcctct

SEQ ID NO: 7462630 - DNA, 22 bp, Homo sapiens
tttctttccatacatattgcta

SEQ ID NO: 7462631 - DNA, 22 bp, Homo sapiens
tttctttccatacatattgcta

SEQ ID NO: 7462632 - DNA, 22 bp, Homo sapiens
tttctttccatacatattgcta

SEQ ID NO: 7462633 - DNA, 22 bp, Homo sapiens
tttctttccatacatattgcta

SEQ ID NO: 7462634 - DNA, 22 bp, Homo sapiens
tttctttccatacatattgcta

SEQ ID NO: 7462635 - DNA, 22 bp, Homo sapiens
tttctttccatacatattgcta

SEQ ID NO: 7462636 - DNA, 22 bp, Homo sapiens
tttctttccatacatattgcta

SEQ ID NO: 7462637 - DNA, 22 bp, Homo sapiens
tttctttccatgagcctatgta

SEQ ID NO: 7462638 - DNA, 22 bp, Homo sapiens
tttctttccatgagcctatgta

SEQ ID NO: 7462639 - DNA, 22 bp, Homo sapiens
tttctttccatgagcctatgta

SEQ ID NO: 7462640 - DNA, 22 bp, Homo sapiens
tttctttccatgagcctatgta

SEQ ID NO: 7462641 - DNA, 22 bp, Homo sapiens
tttctttccatgagcctatgta

SEQ ID NO: 7462642 - DNA, 22 bp, Homo sapiens
tttctttctcgtaaacttagtt

SEQ ID NO: 7462643 - DNA, 22 bp, Homo sapiens
tttctttctcgtaaacttagtt

SEQ ID NO: 7462644 - DNA, 22 bp, Homo sapiens
tttctttctcgtaaacttagtt

SEQ ID NO: 7462645 - DNA, 22 bp, Homo sapiens
tttctttctcgtaaacttagtt

SEQ ID NO: 7462646 - DNA, 18 bp, Homo sapiens
tttctttctgcctggggc

SEQ ID NO: 7462647 - DNA, 22 bp, Homo sapiens
tttctttctcgtaaacttagtt

SEQ ID NO: 7462648 - DNA, 22 bp, Homo sapiens
tttctttcaattctcctaatgc

SEQ ID NO: 7462649 - DNA, 22 bp, Homo sapiens
tttctttccagagtgattggca

SEQ ID NO: 7462650 - DNA, 22 bp, Homo sapiens
tttctttcaattctcctaatgc

SEQ ID NO: 7462651 - DNA, 22 bp, Homo sapiens
tttctttccagagtgattggca

SEQ ID NO: 7462652 - DNA, 22 bp, Homo sapiens
tttctttcaattctcctaatgc

SEQ ID NO: 7462653 - DNA, 22 bp, Homo sapiens
tttctttccagagtgattggca

SEQ ID NO: 7462654 - DNA, 22 bp, Homo sapiens
tttctttatcctcctttgcaca

SEQ ID NO: 7462655 - DNA, 22 bp, Homo sapiens
tttctttatcctcctttgcaca

SEQ ID NO: 7462656 - DNA, 22 bp, Homo sapiens
tttctttatcctcctttgcaca

SEQ ID NO: 7462657 - DNA, 22 bp, Homo sapiens
tttctttatcctcctttgcaca

SEQ ID NO: 7462658 - DNA, 22 bp, Homo sapiens
tttctttatcctcctttgcaca

SEQ ID NO: 7462659 - DNA, 22 bp, Homo sapiens
tttctttatcctcctttgcaca

SEQ ID NO: 7462660 - DNA, 22 bp, Homo sapiens
tttctttcaattctcctaatgc

SEQ ID NO: 7462661 - DNA, 22 bp, Homo sapiens
tttctttatcctcctttgcaca

SEQ ID NO: 7462662 - DNA, 22 bp, Homo sapiens
tttctttatcctcctttgcaca

SEQ ID NO: 7462663 - DNA, 22 bp, Homo sapiens
tttctttatcctcctttgcaca

SEQ ID NO: 7462664 - DNA, 22 bp, Homo sapiens
tttctttatcctcctttgcaca

SEQ ID NO: 7462665 - DNA, 22 bp, Homo sapiens
tttgcaaatacagaggtcttgc

SEQ ID NO: 7462666 - DNA, 22 bp, Homo sapiens
tttgcaaatacagaggtcttgc

SEQ ID NO: 7462667 - DNA, 22 bp, Homo sapiens
tttgcaaatacagaggtcttgc

SEQ ID NO: 7462668 - DNA, 22 bp, Homo sapiens
tttgcaaataccatgaaacttg

SEQ ID NO: 7462669 - DNA, 22 bp, Homo sapiens
tttgcaaataccatgaaacttg

SEQ ID NO: 7462670 - DNA, 22 bp, Homo sapiens
tttgcaaatacagaggtcttgc

SEQ ID NO: 7462671 - DNA, 22 bp, Homo sapiens
tttgcaaataccatgaaacttg

SEQ ID NO: 7462672 - DNA, 22 bp, Homo sapiens
tttgcaaataccatgaaacttg

SEQ ID NO: 7462673 - DNA, 22 bp, Homo sapiens
tttgcaaataccatgaaacttg

SEQ ID NO: 7462674 - DNA, 22 bp, Homo sapiens
tttgcaaataccatgaaacttg

SEQ ID NO: 7462675 - DNA, 22 bp, Homo sapiens
tttgcaaatatgtgtttctatt

SEQ ID NO: 7462676 - DNA, 22 bp, Homo sapiens
tttgcaaatatgtgtttctatt

SEQ ID NO: 7462677 - DNA, 22 bp, Homo sapiens
tttgcaaataccatgaaacttg

SEQ ID NO: 7462678 - DNA, 22 bp, Homo sapiens
tttgcaaatatgtgtttctatt

SEQ ID NO: 7462679 - DNA, 22 bp, Homo sapiens
tttgcaaatatgtgtttctatt

SEQ ID NO: 7462680 - DNA, 22 bp, Homo sapiens
tttgcaaatatgtgtttctatt

SEQ ID NO: 7462681 - DNA, 22 bp, Homo sapiens
tttgcaaatgaagctctgagga

SEQ ID NO: 7462682 - DNA, 22 bp, Homo sapiens
tttgcaaatgaagctctgagga

SEQ ID NO: 7462683 - DNA, 22 bp, Homo sapiens
tttgcaaatgaagctctgagga

SEQ ID NO: 7462684 - DNA, 20 bp, Homo sapiens
tttgatttcacaaggccagt

SEQ ID NO: 7462685 - DNA, 22 bp, Homo sapiens
tttgatttactggatattctca

SEQ ID NO: 7462686 - DNA, 22 bp, Homo sapiens
tttgattttcagcaatagtggc

SEQ ID NO: 7462687 - DNA, 20 bp, Homo sapiens
tttgatttcacaaggccagt

SEQ ID NO: 7462688 - DNA, 22 bp, Homo sapiens
tttgattttcagcaatagtggc

SEQ ID NO: 7462689 - DNA, 22 bp, Homo sapiens
tttgattttcagcaatagtggc

SEQ ID NO: 7462690 - DNA, 22 bp, Homo sapiens
tttgcaaaatgaggtgaagagt

SEQ ID NO: 7462691 - DNA, 22 bp, Homo sapiens
tttgcaaaatgaggtgaagagt

SEQ ID NO: 7462692 - DNA, 22 bp, Homo sapiens
tttgattttcagcaatagtggc

SEQ ID NO: 7462693 - DNA, 22 bp, Homo sapiens
tttgcaaaatgaggtgaagagt

SEQ ID NO: 7462694 - DNA, 22 bp, Homo sapiens
tttgcaaataaataagtgctcg

SEQ ID NO: 7462695 - DNA, 22 bp, Homo sapiens
tttgcaaataaataagtgctcg

SEQ ID NO: 7462696 - DNA, 22 bp, Homo sapiens
tttgcaaataaataagtgctcg

SEQ ID NO: 7462697 - DNA, 22 bp, Homo sapiens
tttgcaaataaataagtgctcg

SEQ ID NO: 7462698 - DNA, 22 bp, Homo sapiens
tttgcaaataaataagtgctcg

SEQ ID NO: 7462699 - DNA, 22 bp, Homo sapiens
tttggaacaagacaaaacatta

SEQ ID NO: 7462700 - DNA, 22 bp, Homo sapiens
tttgcagtgattcttgcagtga

SEQ ID NO: 7462701 - DNA, 19 bp, Homo sapiens
tttggaactttttgatgcc

SEQ ID NO: 7462702 - DNA, 22 bp, Homo sapiens
tttggaacaagacaaaacatta

SEQ ID NO: 7462703 - DNA, 22 bp, Homo sapiens
tttggaagacagggcaggaaag

SEQ ID NO: 7462704 - DNA, 22 bp, Homo sapiens
tttggaagacagggcaggaaag

SEQ ID NO: 7462705 - DNA, 22 bp, Homo sapiens
tttggaagacagggcaggaaag

SEQ ID NO: 7462706 - DNA, 22 bp, Homo sapiens
tttggaagggaaccaaaacatg

SEQ ID NO: 7462707 - DNA, 22 bp, Homo sapiens
tttggaaggtgaggcatgaagg

SEQ ID NO: 7462708 - DNA, 22 bp, Homo sapiens
tttggaagggaaccaaaacatg

SEQ ID NO: 7462709 - DNA, 22 bp, Homo sapiens
tttggaagggaaccaaaacatg

SEQ ID NO: 7462710 - DNA, 22 bp, Homo sapiens
tttggaagggaaccaaaacatg

SEQ ID NO: 7462711 - DNA, 22 bp, Homo sapiens
tttggaagatagttcggcagtt

SEQ ID NO: 7462712 - DNA, 22 bp, Homo sapiens
tttggaagggaaagaaagtact

SEQ ID NO: 7462713 - DNA, 22 bp, Homo sapiens
tttggaagggaaagaaagtact

SEQ ID NO: 7462714 - DNA, 22 bp, Homo sapiens
tttggacatgttgagtctgata

SEQ ID NO: 7462715 - DNA, 22 bp, Homo sapiens
tttggacatgttgagtctgata

SEQ ID NO: 7462716 - DNA, 22 bp, Homo sapiens
tttggactgcatgatgatctgg

SEQ ID NO: 7462717 - DNA, 22 bp, Homo sapiens
tttggacttagcctgcagaatt

SEQ ID NO: 7462718 - DNA, 19 bp, Homo sapiens
tttggacagagtgtccagg

SEQ ID NO: 7462719 - DNA, 22 bp, Homo sapiens
tttggacacattatttatcttc

SEQ ID NO: 7462720 - DNA, 22 bp, Homo sapiens
tttggacacattatttatcttc

SEQ ID NO: 7462721 - DNA, 22 bp, Homo sapiens
tttggacatgagtctttaatct

SEQ ID NO: 7462722 - DNA, 22 bp, Homo sapiens
tttggacatgttgagtctgata

SEQ ID NO: 7462723 - DNA, 22 bp, Homo sapiens
tttggacatgagtctttaatct

SEQ ID NO: 7462724 - DNA, 22 bp, Homo sapiens
tttggacaaatgtctgactttc

SEQ ID NO: 7462725 - DNA, 22 bp, Homo sapiens
tttggaaggtgaggcatgaagg

SEQ ID NO: 7462726 - DNA, 22 bp, Homo sapiens
tttggacaagttactggtttcc

SEQ ID NO: 7462727 - DNA, 22 bp, Homo sapiens
tttggacaaatgtctgactttc

SEQ ID NO: 7462728 - DNA, 22 bp, Homo sapiens
tttggacaaatgtctgactttc

SEQ ID NO: 7462729 - DNA, 22 bp, Homo sapiens
tttggacaaatgtctgactttc

SEQ ID NO: 7462730 - DNA, 22 bp, Homo sapiens
tttggagaaatggctgatcaaa

SEQ ID NO: 7462731 - DNA, 22 bp, Homo sapiens
tttggagaaatggctgatcaaa

SEQ ID NO: 7462732 - DNA, 22 bp, Homo sapiens
tttggagaagttgctaaagtgt

SEQ ID NO: 7462733 - DNA, 22 bp, Homo sapiens
tttggagaaatggctgatcaaa

SEQ ID NO: 7462734 - DNA, 22 bp, Homo sapiens
tttggagaaaagttgagaccat

SEQ ID NO: 7462735 - DNA, 22 bp, Homo sapiens
tttggagaaaagttgagaccat

SEQ ID NO: 7462736 - DNA, 22 bp, Homo sapiens
tttggagaagttgctaaagtgt

SEQ ID NO: 7462737 - DNA, 22 bp, Homo sapiens
tttggagaagttgctaaagtgt

SEQ ID NO: 7462738 - DNA, 20 bp, Homo sapiens
tttggagagaaagaagtagt

SEQ ID NO: 7462739 - DNA, 20 bp, Homo sapiens
tttggagagaaagaagtagt

SEQ ID NO: 7462740 - DNA, 22 bp, Homo sapiens
tttggagagagttaaatatgtt

SEQ ID NO: 7462741 - DNA, 22 bp, Homo sapiens
tttggagagagttaaatatgtt

SEQ ID NO: 7462742 - DNA, 22 bp, Homo sapiens
tttggagagcagctaggccctt

SEQ ID NO: 7462743 - DNA, 22 bp, Homo sapiens
tttggagagatgaagttctgtg

SEQ ID NO: 7462744 - DNA, 22 bp, Homo sapiens
tttggagagatgaagttctgtg

SEQ ID NO: 7462745 - DNA, 22 bp, Homo sapiens
tttggagagatgaagttctgtg

SEQ ID NO: 7462746 - DNA, 22 bp, Homo sapiens
tttggagagatgaagttctgtg

SEQ ID NO: 7462747 - DNA, 22 bp, Homo sapiens
tttggagagagttaaatatgtt

SEQ ID NO: 7462748 - DNA, 22 bp, Homo sapiens
tttggagagagttaaatatgtt

SEQ ID NO: 7462749 - DNA, 22 bp, Homo sapiens
tttggagatagggcctagcaat

SEQ ID NO: 7462750 - DNA, 22 bp, Homo sapiens
tttggagagcagctaggccctt

SEQ ID NO: 7462751 - DNA, 22 bp, Homo sapiens
tttggagatagggcctagcaat

SEQ ID NO: 7462752 - DNA, 22 bp, Homo sapiens
tttggagatggagagagggcat

SEQ ID NO: 7462753 - DNA, 22 bp, Homo sapiens
tttggaggggaagaccttggag

SEQ ID NO: 7462754 - DNA, 22 bp, Homo sapiens
tttggatatgtttctgtcttct

SEQ ID NO: 7462755 - DNA, 22 bp, Homo sapiens
tttggagttcatttaccacttt

SEQ ID NO: 7462756 - DNA, 22 bp, Homo sapiens
tttggagttggagtggtttcta

SEQ ID NO: 7462757 - DNA, 22 bp, Homo sapiens
tttggagttgttatggttatat

SEQ ID NO: 7462758 - DNA, 22 bp, Homo sapiens
tttggagtttaacaacttgaag

SEQ ID NO: 7462759 - DNA, 22 bp, Homo sapiens
tttggatcactgttcctctggg

SEQ ID NO: 7462760 - DNA, 22 bp, Homo sapiens
tttggcaaaactgtgtctatct

SEQ ID NO: 7462761 - DNA, 22 bp, Homo sapiens
tttggcaaaactgtgtctatct

SEQ ID NO: 7462762 - DNA, 22 bp, Homo sapiens
tttggcaaaactgtgtctatct

SEQ ID NO: 7462763 - DNA, 22 bp, Homo sapiens
tttggcaaacataagcctttct

SEQ ID NO: 7462764 - DNA, 22 bp, Homo sapiens
tttggcaaagatcaacatgtta

SEQ ID NO: 7462765 - DNA, 22 bp, Homo sapiens
tttggcaaacttttaggacttt

SEQ ID NO: 7462766 - DNA, 22 bp, Homo sapiens
tttggcaaagatcaacatgtta

SEQ ID NO: 7462767 - DNA, 22 bp, Homo sapiens
tttggcaaagatcaacatgtta

SEQ ID NO: 7462768 - DNA, 22 bp, Homo sapiens
tttggcaaagatcaacatgtta

SEQ ID NO: 7462769 - DNA, 22 bp, Homo sapiens
tttggcaaagatcaacatgtta

SEQ ID NO: 7462770 - DNA, 22 bp, Homo sapiens
tttggcaaagatggctagctgt

SEQ ID NO: 7462771 - DNA, 22 bp, Homo sapiens
tttggcaacggagaacttactc

SEQ ID NO: 7462772 - DNA, 22 bp, Homo sapiens
tttggcaacggagaacttactc

SEQ ID NO: 7462773 - DNA, 22 bp, Homo sapiens
tttggcaacctcaatggctcta

SEQ ID NO: 7462774 - DNA, 22 bp, Homo sapiens
tttggcaaattcttggtagtat

SEQ ID NO: 7462775 - DNA, 22 bp, Homo sapiens
tttggcaaagatggctagctgt

SEQ ID NO: 7462776 - DNA, 22 bp, Homo sapiens
tttggcaaaggtcagagactcc

SEQ ID NO: 7462777 - DNA, 22 bp, Homo sapiens
tttggcaaaggtcagagactcc

SEQ ID NO: 7462778 - DNA, 22 bp, Homo sapiens
tttggcactgttctaggtgcaa

SEQ ID NO: 7462779 - DNA, 19 bp, Homo sapiens
tttggcactctgaagtgtt

SEQ ID NO: 7462780 - DNA, 19 bp, Homo sapiens
tttggcactctgaagtgtt

SEQ ID NO: 7462781 - DNA, 22 bp, Homo sapiens
tttggcagaaataagtggggca

SEQ ID NO: 7462782 - DNA, 22 bp, Homo sapiens
tttggcagaaataagtggggca

SEQ ID NO: 7462783 - DNA, 22 bp, Homo sapiens
tttggcagaaataagtggggca

SEQ ID NO: 7462784 - DNA, 22 bp, Homo sapiens
tttggcacttggcagttgagtt

SEQ ID NO: 7462785 - DNA, 20 bp, Homo sapiens
tttggcactgagtggtataa

SEQ ID NO: 7462786 - DNA, 22 bp, Homo sapiens
tttggcactgttctaggtgcaa

SEQ ID NO: 7462787 - DNA, 22 bp, Homo sapiens
tttggcactgttctaggtgcaa

SEQ ID NO: 7462788 - DNA, 22 bp, Homo sapiens
tttggcagaggaagaaggcaca

SEQ ID NO: 7462789 - DNA, 22 bp, Homo sapiens
tttggcagaggaagaaggcaca

SEQ ID NO: 7462790 - DNA, 22 bp, Homo sapiens
tttggcagaggaagaaggcaca

SEQ ID NO: 7462791 - DNA, 22 bp, Homo sapiens
tttggcagaggttgtcaggcca

SEQ ID NO: 7462792 - DNA, 22 bp, Homo sapiens
tttggcagaggttgtcaggcca

SEQ ID NO: 7462793 - DNA, 22 bp, Homo sapiens
tttggcagaattgatggtcctt

SEQ ID NO: 7462794 - DNA, 23 bp, Homo sapiens
tttggcagaagcacattattgtg

SEQ ID NO: 7462795 - DNA, 22 bp, Homo sapiens
tttggcagaattgatggtcctt

SEQ ID NO: 7462796 - DNA, 23 bp, Homo sapiens
tttggcagaagcacattattgtg

SEQ ID NO: 7462797 - DNA, 22 bp, Homo sapiens
tttggcagagtcatttcagaaa

SEQ ID NO: 7462798 - DNA, 22 bp, Homo sapiens
tttggcagagtcatttcagaaa

SEQ ID NO: 7462799 - DNA, 22 bp, Homo sapiens
tttggcagagtgtgggcatttg

SEQ ID NO: 7462800 - DNA, 22 bp, Homo sapiens
tttggcagagtaaggcctgctt

SEQ ID NO: 7462801 - DNA, 22 bp, Homo sapiens
tttggcagagtcatttcagaaa

SEQ ID NO: 7462802 - DNA, 22 bp, Homo sapiens
tttggcagagtaaggcctgctt

SEQ ID NO: 7462803 - DNA, 22 bp, Homo sapiens
tttggcagaggttgtcaggcca

SEQ ID NO: 7462804 - DNA, 22 bp, Homo sapiens
tttggcagaggttgtcaggcca

SEQ ID NO: 7462805 - DNA, 22 bp, Homo sapiens
tttggcagagtcatttcagaaa

SEQ ID NO: 7462806 - DNA, 22 bp, Homo sapiens
tttggcacctccaaggactcgc

SEQ ID NO: 7462807 - DNA, 22 bp, Homo sapiens
tttggcactcacttatcattgg

SEQ ID NO: 7462808 - DNA, 22 bp, Homo sapiens
tttggcaccaaaggagaagatc

SEQ ID NO: 7462809 - DNA, 22 bp, Homo sapiens
tttggcacattctgtcacattc

SEQ ID NO: 7462810 - DNA, 22 bp, Homo sapiens
tttggcacagcttcccagactt

SEQ ID NO: 7462811 - DNA, 22 bp, Homo sapiens
tttggcaagcgtgccttgtcgg

SEQ ID NO: 7462812 - DNA, 22 bp, Homo sapiens
tttggcaagtgggaaattagta

SEQ ID NO: 7462813 - DNA, 22 bp, Homo sapiens
tttggcaagtgggaaattagta

SEQ ID NO: 7462814 - DNA, 22 bp, Homo sapiens
tttggcaagcgagtactttctg

SEQ ID NO: 7462815 - DNA, 22 bp, Homo sapiens
tttggcaagcgagtactttctg

SEQ ID NO: 7462816 - DNA, 22 bp, Homo sapiens
tttggcaagaaaatgtgattga

SEQ ID NO: 7462817 - DNA, 22 bp, Homo sapiens
tttggcaagcgagtactttctg

SEQ ID NO: 7462818 - DNA, 22 bp, Homo sapiens
tttggcaacggagaacttactc

SEQ ID NO: 7462819 - DNA, 22 bp, Homo sapiens
tttggcaagaaaatgtgattga

SEQ ID NO: 7462820 - DNA, 22 bp, Homo sapiens
tttggcaatatctgaattatag

SEQ ID NO: 7462821 - DNA, 22 bp, Homo sapiens
tttggcaagtgggaaattagta

SEQ ID NO: 7462822 - DNA, 22 bp, Homo sapiens
tttggcaagtgggaaattagta

SEQ ID NO: 7462823 - DNA, 22 bp, Homo sapiens
tttggcaatggatggtcatcta

SEQ ID NO: 7462824 - DNA, 22 bp, Homo sapiens
tttggcaatttgactgtatagg

SEQ ID NO: 7462825 - DNA, 22 bp, Homo sapiens
tttggcaatttgactgtatagg

SEQ ID NO: 7462826 - DNA, 22 bp, Homo sapiens
tttggcaatatctgaattatag

SEQ ID NO: 7462827 - DNA, 22 bp, Homo sapiens
tttggcaatgactgcatccatg

SEQ ID NO: 7462828 - DNA, 22 bp, Homo sapiens
tttgtacacaggatgttataat

SEQ ID NO: 7462829 - DNA, 22 bp, Homo sapiens
tttgtacacaggatgttataat

SEQ ID NO: 7462830 - DNA, 22 bp, Homo sapiens
tttgtacacaacctgtggtagt

SEQ ID NO: 7462831 - DNA, 22 bp, Homo sapiens
tttgtacacaacctgtggtagt

SEQ ID NO: 7462832 - DNA, 22 bp, Homo sapiens
tttgtacacaggatgttataat

SEQ ID NO: 7462833 - DNA, 22 bp, Homo sapiens
tttgtacacaggatgttataat

SEQ ID NO: 7462834 - DNA, 22 bp, Homo sapiens
tttgtacacaggatgttataat

SEQ ID NO: 7462835 - DNA, 22 bp, Homo sapiens
tttgtacacaacctgtggtagt

SEQ ID NO: 7462836 - DNA, 22 bp, Homo sapiens
tttgtacacaacctgtggtagt

SEQ ID NO: 7462837 - DNA, 22 bp, Homo sapiens
tttgtacacaacctgtggtagt

SEQ ID NO: 7462838 - DNA, 22 bp, Homo sapiens
tttgtacacaacctgtggtagt

SEQ ID NO: 7462839 - DNA, 17 bp, Homo sapiens
tttgtacaacattttaa

SEQ ID NO: 7462840 - DNA, 22 bp, Homo sapiens
tttgtacaattagcagaggcta

SEQ ID NO: 7462841 - DNA, 22 bp, Homo sapiens
tttgtacaattagcagaggcta

SEQ ID NO: 7462842 - DNA, 22 bp, Homo sapiens
tttgtacaattagcagaggcta

SEQ ID NO: 7462843 - DNA, 22 bp, Homo sapiens
tttgtacaattagcagaggcta

SEQ ID NO: 7462844 - DNA, 22 bp, Homo sapiens
tttgtacaattagcagaggcta

SEQ ID NO: 7462845 - DNA, 22 bp, Homo sapiens
tttgtacaattagcagaggcta

SEQ ID NO: 7462846 - DNA, 22 bp, Homo sapiens
tttgtacaattagcagaggcta

SEQ ID NO: 7462847 - DNA, 22 bp, Homo sapiens
tttgtacatgaatgtgcaccca

SEQ ID NO: 7462848 - DNA, 22 bp, Homo sapiens
tttgtacatgaatgtgcaccca

SEQ ID NO: 7462849 - DNA, 22 bp, Homo sapiens
tttgtacatcctaattctgagt

SEQ ID NO: 7462850 - DNA, 22 bp, Homo sapiens
tttgtacatgtaagattgcatc

SEQ ID NO: 7462851 - DNA, 22 bp, Homo sapiens
tttgtacatgtaagattgcatc

SEQ ID NO: 7462852 - DNA, 22 bp, Homo sapiens
tttgtacatgaatgtgcaccca

SEQ ID NO: 7462853 - DNA, 22 bp, Homo sapiens
tttgtacattcaaatgtcccat

SEQ ID NO: 7462854 - DNA, 22 bp, Homo sapiens
tttgtacattcaaatgtcccat

SEQ ID NO: 7462855 - DNA, 22 bp, Homo sapiens
tttgtacatgtaagattgcatc

SEQ ID NO: 7462856 - DNA, 22 bp, Homo sapiens
tttgtacattcaaatgtcccat

SEQ ID NO: 7462857 - DNA, 23 bp, Homo sapiens
tttgtacattgaggaggcagaat

SEQ ID NO: 7462858 - DNA, 23 bp, Homo sapiens
tttgtacattgaggaggcagaat

SEQ ID NO: 7462859 - DNA, 23 bp, Homo sapiens
tttgtacattgaggaggcagaat

SEQ ID NO: 7462860 - DNA, 23 bp, Homo sapiens
tttgtacattgaggaggcagaat

SEQ ID NO: 7462861 - DNA, 23 bp, Homo sapiens
tttgtacattgaggaggcagaat

SEQ ID NO: 7462862 - DNA, 22 bp, Homo sapiens
tttgtaatgataatgttaaatt

SEQ ID NO: 7462863 - DNA, 22 bp, Homo sapiens
tttgtaatgataatgttaaatt

SEQ ID NO: 7462864 - DNA, 17 bp, Homo sapiens
tttgtacaacattttaa

SEQ ID NO: 7462865 - DNA, 17 bp, Homo sapiens
tttgtacaacattttaa

SEQ ID NO: 7462866 - DNA, 17 bp, Homo sapiens
tttgtacaacattttaa

SEQ ID NO: 7462867 - DNA, 17 bp, Homo sapiens
tttgtacaacattttaa

SEQ ID NO: 7462868 - DNA, 17 bp, Homo sapiens
tttgtacaacattttaa

SEQ ID NO: 7462869 - DNA, 22 bp, Homo sapiens
tttggcagcttccatattcact

SEQ ID NO: 7462870 - DNA, 19 bp, Homo sapiens
tttggcaggagataggatg

SEQ ID NO: 7462871 - DNA, 22 bp, Homo sapiens
tttggcaggtagtcccaaaggg

SEQ ID NO: 7462872 - DNA, 19 bp, Homo sapiens
tttggcaggagataggatg

SEQ ID NO: 7462873 - DNA, 22 bp, Homo sapiens
tttggcaggtagtcccaaaggg

SEQ ID NO: 7462874 - DNA, 22 bp, Homo sapiens
tttggcaggtggcagctctggg

SEQ ID NO: 7462875 - DNA, 22 bp, Homo sapiens
tttggcagctaaggcagctcgc

SEQ ID NO: 7462876 - DNA, 22 bp, Homo sapiens
tttggcagctaaggcagctcgc

SEQ ID NO: 7462877 - DNA, 22 bp, Homo sapiens
tttggcagctaaggcagctcgc

SEQ ID NO: 7462878 - DNA, 22 bp, Homo sapiens
tttggcagctctacctttttat

SEQ ID NO: 7462879 - DNA, 22 bp, Homo sapiens
tttggcagctctacctttttat

SEQ ID NO: 7462880 - DNA, 22 bp, Homo sapiens
tttggcagctcttgactgttct

SEQ ID NO: 7462881 - DNA, 22 bp, Homo sapiens
tttggcagctcttgactgttct

SEQ ID NO: 7462882 - DNA, 22 bp, Homo sapiens
tttggcagcttccatattcact

SEQ ID NO: 7462883 - DNA, 22 bp, Homo sapiens
tttggcagcttccatattcact

SEQ ID NO: 7462884 - DNA, 19 bp, Homo sapiens
tttggcagcattaatatca

SEQ ID NO: 7462885 - DNA, 22 bp, Homo sapiens
tttggcagcacccgccatctat

SEQ ID NO: 7462886 - DNA, 22 bp, Homo sapiens
tttggcagctaaggcagctcgc

SEQ ID NO: 7462887 - DNA, 22 bp, Homo sapiens
tttggcagctaaggcagctcgc

SEQ ID NO: 7462888 - DNA, 19 bp, Homo sapiens
tttggcagcattaatatca

SEQ ID NO: 7462889 - DNA, 22 bp, Homo sapiens
tttggcagagtgtgggcatttg

SEQ ID NO: 7462890 - DNA, 22 bp, Homo sapiens
tttggcagatgaccctcaagtt

SEQ ID NO: 7462891 - DNA, 22 bp, Homo sapiens
tttggcagcacccgccatctat

SEQ ID NO: 7462892 - DNA, 22 bp, Homo sapiens
tttggcagatgaccctcaagtt

SEQ ID NO: 7462893 - DNA, 22 bp, Homo sapiens
tttttctagaccttaaaggcca

SEQ ID NO: 7462894 - DNA, 22 bp, Homo sapiens
tttttctactggtgttggtgta

SEQ ID NO: 7462895 - DNA, 22 bp, Homo sapiens
tttttctactggtgttggtgta

SEQ ID NO: 7462896 - DNA, 22 bp, Homo sapiens
tttttctactgcccacattgta

SEQ ID NO: 7462897 - DNA, 22 bp, Homo sapiens
tttttctagaccttaaaggcca

SEQ ID NO: 7462898 - DNA, 22 bp, Homo sapiens
tttttctagaccttaaaggcca

SEQ ID NO: 7462899 - DNA, 22 bp, Homo sapiens
tttttcttgtgctggatctaat

SEQ ID NO: 7462900 - DNA, 22 bp, Homo sapiens
tttttgaaggctgatgtgatta

SEQ ID NO: 7462901 - DNA, 22 bp, Homo sapiens
tttttgaaggctgatgtgatta

SEQ ID NO: 7462902 - DNA, 22 bp, Homo sapiens
tttttgaaggctgatgtgatta

SEQ ID NO: 7462903 - DNA, 22 bp, Homo sapiens
tttttgaaggctgatgtgatta

SEQ ID NO: 7462904 - DNA, 22 bp, Homo sapiens
tttttgaaggctgatgtgatta

SEQ ID NO: 7462905 - DNA, 22 bp, Homo sapiens
tttttgaaggctgatgtgatta

SEQ ID NO: 7462906 - DNA, 22 bp, Homo sapiens
tttttgaaggctgatgtgatta

SEQ ID NO: 7462907 - DNA, 22 bp, Homo sapiens
tttttgatactcaagaggggta

SEQ ID NO: 7462908 - DNA, 22 bp, Homo sapiens
tttttgatctgagcagttggag

SEQ ID NO: 7462909 - DNA, 22 bp, Homo sapiens
tttttccttggatgtgtctctc

SEQ ID NO: 7462910 - DNA, 20 bp, Homo sapiens
tttttccttctctacaggca

SEQ ID NO: 7462911 - DNA, 20 bp, Homo sapiens
tttttccttctctacaggca

SEQ ID NO: 7462912 - DNA, 22 bp, Homo sapiens
tttttctaatggcttaggatgt

SEQ ID NO: 7462913 - DNA, 22 bp, Homo sapiens
tttttctaatggcttaggatgt

SEQ ID NO: 7462914 - DNA, 22 bp, Homo sapiens
tttttctaatggcttaggatgt

SEQ ID NO: 7462915 - DNA, 22 bp, Homo sapiens
tttttctaatggcttaggatgt

SEQ ID NO: 7462916 - DNA, 22 bp, Homo sapiens
tttttctaatggcttaggatgt

SEQ ID NO: 7462917 - DNA, 22 bp, Homo sapiens
tttttccttggatgtgtctctc

SEQ ID NO: 7462918 - DNA, 22 bp, Homo sapiens
tttttccttggatgtgtctctc

SEQ ID NO: 7462919 - DNA, 22 bp, Homo sapiens
tttttccttggatgtgtctctc

SEQ ID NO: 7462920 - DNA, 22 bp, Homo sapiens
tttttctactgcccacattgta

SEQ ID NO: 7462921 - DNA, 22 bp, Homo sapiens
tttttctactgcccacattgta

SEQ ID NO: 7462922 - DNA, 22 bp, Homo sapiens
tttttctactgcccacattgta

SEQ ID NO: 7462923 - DNA, 22 bp, Homo sapiens
tttttctactgcccacattgta

SEQ ID NO: 7462924 - DNA, 22 bp, Homo sapiens
tttttctactgcccacattgta

SEQ ID NO: 7462925 - DNA, 22 bp, Homo sapiens
tttttctactgcccacattgta

SEQ ID NO: 7462926 - DNA, 22 bp, Homo sapiens
tttttctactgcccacattgta

SEQ ID NO: 7462927 - DNA, 22 bp, Homo sapiens
tttttctaatggcttaggatgt

SEQ ID NO: 7462928 - DNA, 22 bp, Homo sapiens
tttttctaatggcttaggatgt

SEQ ID NO: 7462929 - DNA, 22 bp, Homo sapiens
tttttctaatggcttaggatgt

SEQ ID NO: 7462930 - DNA, 22 bp, Homo sapiens
tttttgcaccaacctaatagaa

SEQ ID NO: 7462931 - DNA, 22 bp, Homo sapiens
tttttgcaccaacctaatagaa

SEQ ID NO: 7462932 - DNA, 22 bp, Homo sapiens
tttttgcaccaacctaatagaa

SEQ ID NO: 7462933 - DNA, 22 bp, Homo sapiens
tttttgcaccaacctaatagaa

SEQ ID NO: 7462934 - DNA, 22 bp, Homo sapiens
tttttgcaccaacctaatagaa

SEQ ID NO: 7462935 - DNA, 22 bp, Homo sapiens
tttttgctaatccccagccact

SEQ ID NO: 7462936 - DNA, 22 bp, Homo sapiens
tttttgctaatccccagccact

SEQ ID NO: 7462937 - DNA, 22 bp, Homo sapiens
tttttgctccacaactttgaag

SEQ ID NO: 7462938 - DNA, 22 bp, Homo sapiens
tttttgctccacaactttgaag

SEQ ID NO: 7462939 - DNA, 22 bp, Homo sapiens
tttttgctgataagcagaattc

SEQ ID NO: 7462940 - DNA, 22 bp, Homo sapiens
tttttgctgataagcagaattc

SEQ ID NO: 7462941 - DNA, 22 bp, Homo sapiens
tttttggcagctcagaaacttc

SEQ ID NO: 7462942 - DNA, 22 bp, Homo sapiens
tttttgctgataagcagaattc

SEQ ID NO: 7462943 - DNA, 22 bp, Homo sapiens
tttttgggtccaggctgtatct

SEQ ID NO: 7462944 - DNA, 22 bp, Homo sapiens
tttttgggtccaggctgtatct

SEQ ID NO: 7462945 - DNA, 22 bp, Homo sapiens
tttttggcagctcagaaacttc

SEQ ID NO: 7462946 - DNA, 22 bp, Homo sapiens
tttttggcagctcagaaacttc

SEQ ID NO: 7462947 - DNA, 22 bp, Homo sapiens
tttttggcccttagctctgtat

SEQ ID NO: 7462948 - DNA, 22 bp, Homo sapiens
tttttggcccttagctctgtat

SEQ ID NO: 7462949 - DNA, 22 bp, Homo sapiens
tttttgggtccaggctgtatct

SEQ ID NO: 7462950 - DNA, 22 bp, Homo sapiens
tttttgtagtcattagaagagg

SEQ ID NO: 7462951 - DNA, 22 bp, Homo sapiens
tttttgtagtcattagaagagg

SEQ ID NO: 7462952 - DNA, 22 bp, Homo sapiens
tttttgggtccaggctgtatct

SEQ ID NO: 7462953 - DNA, 22 bp, Homo sapiens
tttttgggtccaggctgtatct

SEQ ID NO: 7462954 - DNA, 22 bp, Homo sapiens
ttttttgtcccagagagcctgg

SEQ ID NO: 7462955 - DNA, 22 bp, Homo sapiens
ttttttgtcccagagagcctgg

SEQ ID NO: 7462956 - DNA, 22 bp, Homo sapiens
ttttttgtcccagagagcctgg

SEQ ID NO: 7462957 - DNA, 22 bp, Homo sapiens
ttttttgtcccagagagcctgg

SEQ ID NO: 7462958 - DNA, 22 bp, Homo sapiens
tttttgtagtcattagaagagg

SEQ ID NO: 7462959 - DNA, 22 bp, Homo sapiens
tttttgtagtcattagaagagg

SEQ ID NO: 7462960 - DNA, 22 bp, Homo sapiens
tttttgtagtcattagaagagg

SEQ ID NO: 7462961 - DNA, 22 bp, Homo sapiens
tttttgtagtcattagaagagg

SEQ ID NO: 7462962 - DNA, 22 bp, Homo sapiens
ttttttgtcttgaagaaatggt

SEQ ID NO: 7462963 - DNA, 22 bp, Homo sapiens
ttttttgtcttgaagaaatggt

SEQ ID NO: 7462964 - DNA, 22 bp, Homo sapiens
ttttttgtcttgaagaaatggt

SEQ ID NO: 7462965 - DNA, 22 bp, Homo sapiens
ttttttgtcttgaagaaatggt

SEQ ID NO: 7462966 - DNA, 22 bp, Homo sapiens
ttttttgtcttgaagaaatggt

SEQ ID NO: 7462967 - DNA, 22 bp, Homo sapiens
ttttttgtcttgaagaaatggt

SEQ ID NO: 7462968 - DNA, 22 bp, Homo sapiens
ttttttgtcttgaagaaatggt

SEQ ID NO: 7462969 - DNA, 22 bp, Homo sapiens
ttttttgtcttgaagaaatggt

SEQ ID NO: 7462970 - DNA, 22 bp, Homo sapiens
ttttttgtcttgaagaaatggt

SEQ ID NO: 7462971 - DNA, 22 bp, Homo sapiens
ttttttgtcttgaagaaatggt

SEQ ID NO: 7462972 - DNA, 22 bp, Homo sapiens
ttttttgtcttgaagaaatggt

SEQ ID NO: 7462973 - DNA, 23 bp, Homo sapiens
ttttttgtcttgctaggctgccc

SEQ ID NO: 7462974 - DNA, 23 bp, Homo sapiens
ttttttgtcttgctaggctgccc

SEQ ID NO: 7462975 - DNA, 23 bp, Homo sapiens
ttttttgtcttgctaggctgccc

SEQ ID NO: 7462976 - DNA, 22 bp, Homo sapiens
ttttcctttggaagatgcatat

SEQ ID NO: 7462977 - DNA, 22 bp, Homo sapiens
ttttcctttgattcccagatgt

SEQ ID NO: 7462978 - DNA, 22 bp, Homo sapiens
ttttcctttgattcccagatgt

SEQ ID NO: 7462979 - DNA, 22 bp, Homo sapiens
ttttcctttgattcccagatgt

SEQ ID NO: 7462980 - DNA, 22 bp, Homo sapiens
ttttcctttgattcccagatgt

SEQ ID NO: 7462981 - DNA, 22 bp, Homo sapiens
ttttcctttgattcccagatgt

SEQ ID NO: 7462982 - DNA, 22 bp, Homo sapiens
ttttcctttgattcccagatgt

SEQ ID NO: 7462983 - DNA, 22 bp, Homo sapiens
ttttcctttgattcccagatgt

SEQ ID NO: 7462984 - DNA, 22 bp, Homo sapiens
ttttcctttgaaaggtgagggc

SEQ ID NO: 7462985 - DNA, 22 bp, Homo sapiens
ttttcctttgaaaggtgagggc

SEQ ID NO: 7462986 - DNA, 22 bp, Homo sapiens
ttttcctttgaaaggtgagggc

SEQ ID NO: 7462987 - DNA, 22 bp, Homo sapiens
ttttcctttcatcaggacaaag

SEQ ID NO: 7462988 - DNA, 22 bp, Homo sapiens
ttttcctttcatcaggacaaag

SEQ ID NO: 7462989 - DNA, 22 bp, Homo sapiens
ttttcctttcatcaggacaaag

SEQ ID NO: 7462990 - DNA, 20 bp, Homo sapiens
ttttccttgttgccgctgct

SEQ ID NO: 7462991 - DNA, 22 bp, Homo sapiens
ttttcctttcatcaggacaaag

SEQ ID NO: 7462992 - DNA, 22 bp, Homo sapiens
ttttcctttcatcaggacaaag

SEQ ID NO: 7462993 - DNA, 22 bp, Homo sapiens
ttttcctttgaaaggtgagggc

SEQ ID NO: 7462994 - DNA, 22 bp, Homo sapiens
ttttcctttgaaaggtgagggc

SEQ ID NO: 7462995 - DNA, 22 bp, Homo sapiens
ttttcctttcatcaggacaaag

SEQ ID NO: 7462996 - DNA, 22 bp, Homo sapiens
ttttcctttcatcaggacaaag

SEQ ID NO: 7462997 - DNA, 20 bp, Homo sapiens
ttttccttgttgccgctgct

SEQ ID NO: 7462998 - DNA, 20 bp, Homo sapiens
ttttccttgttgccgctgct

SEQ ID NO: 7462999 - DNA, 20 bp, Homo sapiens
ttttccttgttgccgctgct

SEQ ID NO: 7463000 - DNA, 22 bp, Homo sapiens
ttttccttctgatactccattt

SEQ ID NO: 7463001 - DNA, 22 bp, Homo sapiens
ttttccttctgatactccattt

SEQ ID NO: 7463002 - DNA, 22 bp, Homo sapiens
ttttccttctgatactccattt

SEQ ID NO: 7463003 - DNA, 22 bp, Homo sapiens
ttttccttctgatactccattt

SEQ ID NO: 7463004 - DNA, 22 bp, Homo sapiens
ttttccttctgatactccattt

SEQ ID NO: 7463005 - DNA, 22 bp, Homo sapiens
ttttccttctgatactccattt

SEQ ID NO: 7463006 - DNA, 22 bp, Homo sapiens
ttttccttctgatactccattt

SEQ ID NO: 7463007 - DNA, 22 bp, Homo sapiens
ttttccttctgatactccattt

SEQ ID NO: 7463008 - DNA, 22 bp, Homo sapiens
ttttccttctgatactccattt

SEQ ID NO: 7463009 - DNA, 22 bp, Homo sapiens
ttttccttctgatactccattt

SEQ ID NO: 7463010 - DNA, 20 bp, Homo sapiens
ttttccttctgagtatgttg

SEQ ID NO: 7463011 - DNA, 20 bp, Homo sapiens
ttttccttctgagtatgttg

SEQ ID NO: 7463012 - DNA, 19 bp, Homo sapiens
ttttccttctcctcttaat

SEQ ID NO: 7463013 - DNA, 20 bp, Homo sapiens
ttttccttctgagtatgttg

SEQ ID NO: 7463014 - DNA, 20 bp, Homo sapiens
ttttccttctgagtatgttg

SEQ ID NO: 7463015 - DNA, 20 bp, Homo sapiens
ttttccttctgagtatgttg

SEQ ID NO: 7463016 - DNA, 20 bp, Homo sapiens
ttttccttctgagtatgttg

SEQ ID NO: 7463017 - DNA, 20 bp, Homo sapiens
ttttccttctgagtatgttg

SEQ ID NO: 7463018 - DNA, 20 bp, Homo sapiens
ttttccttctgagtatgttg

SEQ ID NO: 7463019 - DNA, 22 bp, Homo sapiens
ttttatgaagataattttctga

SEQ ID NO: 7463020 - DNA, 22 bp, Homo sapiens
ttttatgaagataattttctga

SEQ ID NO: 7463021 - DNA, 22 bp, Homo sapiens
ttttatgaagataattttctga

SEQ ID NO: 7463022 - DNA, 22 bp, Homo sapiens
ttttatcttcattcctatctac

SEQ ID NO: 7463023 - DNA, 22 bp, Homo sapiens
ttttatcttcattcctatctac

SEQ ID NO: 7463024 - DNA, 22 bp, Homo sapiens
ttttatctgtgacatctggcag

SEQ ID NO: 7463025 - DNA, 22 bp, Homo sapiens
ttttatcttcattcctatctac

SEQ ID NO: 7463026 - DNA, 20 bp, Homo sapiens
ttttccttctgagtatgttg

SEQ ID NO: 7463027 - DNA, 19 bp, Homo sapiens
ttttccttctcctcttaat

SEQ ID NO: 7463028 - DNA, 19 bp, Homo sapiens
ttttccttctcctcttaat

SEQ ID NO: 7463029 - DNA, 19 bp, Homo sapiens
ttttccttctcctcttaat

SEQ ID NO: 7463030 - DNA, 19 bp, Homo sapiens
ttttccttctcctcttaat

SEQ ID NO: 7463031 - DNA, 19 bp, Homo sapiens
ttttccttctcctcttaat

SEQ ID NO: 7463032 - DNA, 22 bp, Homo sapiens
ttttatgagaatgcgccacttg

SEQ ID NO: 7463033 - DNA, 19 bp, Homo sapiens
ttttccttctcctcttaat

SEQ ID NO: 7463034 - DNA, 19 bp, Homo sapiens
ttttccttctcctcttaat

SEQ ID NO: 7463035 - DNA, 19 bp, Homo sapiens
ttttccttctcctcttaat

SEQ ID NO: 7463036 - DNA, 19 bp, Homo sapiens
ttttccttctcctcttaat

SEQ ID NO: 7463037 - DNA, 22 bp, Homo sapiens
ttttatctgtgacatctggcag

SEQ ID NO: 7463038 - DNA, 22 bp, Homo sapiens
ttttatctgtgacatctggcag

SEQ ID NO: 7463039 - DNA, 22 bp, Homo sapiens
ttttatctgcttcattagttga

SEQ ID NO: 7463040 - DNA, 22 bp, Homo sapiens
ttttatctgcttcattagttga

SEQ ID NO: 7463041 - DNA, 22 bp, Homo sapiens
ttttatctgcttcattagttga

SEQ ID NO: 7463042 - DNA, 22 bp, Homo sapiens
ttttatctgcttcattagttga

SEQ ID NO: 7463043 - DNA, 22 bp, Homo sapiens
ttttatctgcttcattagttga

SEQ ID NO: 7463044 - DNA, 22 bp, Homo sapiens
ttttatctgcttcattagttga

SEQ ID NO: 7463045 - DNA, 22 bp, Homo sapiens
ttttatctgcttcattagttga

SEQ ID NO: 7463046 - DNA, 22 bp, Homo sapiens
ttttatctacctatgctcattt

SEQ ID NO: 7463047 - DNA, 22 bp, Homo sapiens
ttttatctacctatgctcattt

SEQ ID NO: 7463048 - DNA, 22 bp, Homo sapiens
ttttatctacctatgctcattt

SEQ ID NO: 7463049 - DNA, 22 bp, Homo sapiens
ttttatcattacccagctgaaa

SEQ ID NO: 7463050 - DNA, 22 bp, Homo sapiens
ttttatcattacccagctgaaa

SEQ ID NO: 7463051 - DNA, 22 bp, Homo sapiens
ttttatctacctatgctcattt

SEQ ID NO: 7463052 - DNA, 22 bp, Homo sapiens
ttttatcattacccagctgaaa

SEQ ID NO: 7463053 - DNA, 22 bp, Homo sapiens
ttttatctacctatgctcattt

SEQ ID NO: 7463054 - DNA, 22 bp, Homo sapiens
ttttatctacctatgctcattt

SEQ ID NO: 7463055 - DNA, 22 bp, Homo sapiens
ttttatcattacccagctgaaa

SEQ ID NO: 7463056 - DNA, 22 bp, Homo sapiens
ttttgaaagagtcctgctacag

SEQ ID NO: 7463057 - DNA, 22 bp, Homo sapiens
ttttgaaagagtcctgctacag

SEQ ID NO: 7463058 - DNA, 22 bp, Homo sapiens
ttttgaaagagtcctgctacag

SEQ ID NO: 7463059 - DNA, 22 bp, Homo sapiens
ttttgaaagagtcctgctacag

SEQ ID NO: 7463060 - DNA, 22 bp, Homo sapiens
ttttctttaatctggtggggtg

SEQ ID NO: 7463061 - DNA, 22 bp, Homo sapiens
ttttctttaatctggtggggtg

SEQ ID NO: 7463062 - DNA, 22 bp, Homo sapiens
ttttctttaatctggtggggtg

SEQ ID NO: 7463063 - DNA, 22 bp, Homo sapiens
ttttctttaatctggtggggtg

SEQ ID NO: 7463064 - DNA, 22 bp, Homo sapiens
ttttctttaatctggtggggtg

SEQ ID NO: 7463065 - DNA, 22 bp, Homo sapiens
ttttctttaatctggtggggtg

SEQ ID NO: 7463066 - DNA, 22 bp, Homo sapiens
ttttctttaatctggtggggtg

SEQ ID NO: 7463067 - DNA, 22 bp, Homo sapiens
ttttcttctacctgctgtccaa

SEQ ID NO: 7463068 - DNA, 22 bp, Homo sapiens
ttttctattaactcattttgca

SEQ ID NO: 7463069 - DNA, 22 bp, Homo sapiens
ttttcttcggtgctgggttgat

SEQ ID NO: 7463070 - DNA, 22 bp, Homo sapiens
ttttcttcggtgctgggttgat

SEQ ID NO: 7463071 - DNA, 22 bp, Homo sapiens
ttttctattaactcattttgca

SEQ ID NO: 7463072 - DNA, 22 bp, Homo sapiens
ttttctattaactcattttgca

SEQ ID NO: 7463073 - DNA, 22 bp, Homo sapiens
ttttctattaactcattttgca

SEQ ID NO: 7463074 - DNA, 22 bp, Homo sapiens
ttttcttctacctgctgtccaa

SEQ ID NO: 7463075 - DNA, 22 bp, Homo sapiens
ttttcttggagtggctgtcctt

SEQ ID NO: 7463076 - DNA, 22 bp, Homo sapiens
ttttcttggagtggctgtcctt

SEQ ID NO: 7463077 - DNA, 22 bp, Homo sapiens
ttttcttctacctgctgtccaa

SEQ ID NO: 7463078 - DNA, 22 bp, Homo sapiens
ttttcttctacctgctgtccaa

SEQ ID NO: 7463079 - DNA, 22 bp, Homo sapiens
ttttctaagggaaacgtcctcc

SEQ ID NO: 7463080 - DNA, 22 bp, Homo sapiens
ttttctaagggaaacgtcctcc

SEQ ID NO: 7463081 - DNA, 22 bp, Homo sapiens
ttttctaagggaaacgtcctcc

SEQ ID NO: 7463082 - DNA, 22 bp, Homo sapiens
ttttctaatttagttaccctcc

SEQ ID NO: 7463083 - DNA, 22 bp, Homo sapiens
ttttctaactttacactcgaaa

SEQ ID NO: 7463084 - DNA, 22 bp, Homo sapiens
ttttctatctcctagaactgcc

SEQ ID NO: 7463085 - DNA, 22 bp, Homo sapiens
ttttctaatttagttaccctcc

SEQ ID NO: 7463086 - DNA, 22 bp, Homo sapiens
ttttctaatttagttaccctcc

SEQ ID NO: 7463087 - DNA, 22 bp, Homo sapiens
ttttctattaactcattttgca

SEQ ID NO: 7463088 - DNA, 22 bp, Homo sapiens
ttttctattaactcattttgca

SEQ ID NO: 7463089 - DNA, 22 bp, Homo sapiens
ttttctattaactcattttgca

SEQ ID NO: 7463090 - DNA, 22 bp, Homo sapiens
ttttctattaactcattttgca

SEQ ID NO: 7463091 - DNA, 22 bp, Homo sapiens
ttttctattaactcattttgca

SEQ ID NO: 7463092 - DNA, 22 bp, Homo sapiens
ttttctattaactcattttgca

SEQ ID NO: 7463093 - DNA, 22 bp, Homo sapiens
ttttctattaactcattttgca

SEQ ID NO: 7463094 - DNA, 22 bp, Homo sapiens
ttttctatctcctagaactgcc

SEQ ID NO: 7463095 - DNA, 22 bp, Homo sapiens
ttttctatctcctagaactgcc

SEQ ID NO: 7463096 - DNA, 22 bp, Homo sapiens
ttttctatctcctagaactgcc

SEQ ID NO: 7463097 - DNA, 22 bp, Homo sapiens
ttttctatctcctagaactgcc

SEQ ID NO: 7463098 - DNA, 22 bp, Homo sapiens
ttttctatctcctagaactgcc

SEQ ID NO: 7463099 - DNA, 22 bp, Homo sapiens
ttttctaacatctagtaatttg

SEQ ID NO: 7463100 - DNA, 22 bp, Homo sapiens
ttttctaacatctagtaatttg

SEQ ID NO: 7463101 - DNA, 22 bp, Homo sapiens
ttttctaacatctagtaatttg

SEQ ID NO: 7463102 - DNA, 22 bp, Homo sapiens
ttttctaacatctagtaatttg

SEQ ID NO: 7463103 - DNA, 22 bp, Homo sapiens
ttttctaacatctagtaatttg

SEQ ID NO: 7463104 - DNA, 22 bp, Homo sapiens
ttttctaactttacactcgaaa

SEQ ID NO: 7463105 - DNA, 22 bp, Homo sapiens
ttttctaactttacactcgaaa

SEQ ID NO: 7463106 - DNA, 22 bp, Homo sapiens
ttttctaacatctagtaatttg

SEQ ID NO: 7463107 - DNA, 22 bp, Homo sapiens
ttttctaacatctagtaatttg

SEQ ID NO: 7463108 - DNA, 22 bp, Homo sapiens
ttttctaaaatatccaggacag

SEQ ID NO: 7463109 - DNA, 22 bp, Homo sapiens
ttttctaaaatatccaggacag

SEQ ID NO: 7463110 - DNA, 22 bp, Homo sapiens
ttttctaacatctagtaatttg

SEQ ID NO: 7463111 - DNA, 22 bp, Homo sapiens
ttttctaacatctagtaatttg

SEQ ID NO: 7463112 - DNA, 22 bp, Homo sapiens
ttttctaacatctagtaatttg

SEQ ID NO: 7463113 - DNA, 22 bp, Homo sapiens
ttttctaacatctagtaatttg

SEQ ID NO: 7463114 - DNA, 22 bp, Homo sapiens
ttttctaacatctagtaatttg

SEQ ID NO: 7463115 - DNA, 22 bp, Homo sapiens
ttttctaacatctagtaatttg

SEQ ID NO: 7463116 - DNA, 22 bp, Homo sapiens
ttttctaacatctagtaatttg

SEQ ID NO: 7463117 - DNA, 22 bp, Homo sapiens
ttttctaacatctagtaatttg

SEQ ID NO: 7463118 - DNA, 22 bp, Homo sapiens
ttttctaacatctagtaatttg

SEQ ID NO: 7463119 - DNA, 22 bp, Homo sapiens
ttttctaacatctagtaatttg

SEQ ID NO: 7463120 - DNA, 22 bp, Homo sapiens
ttttctaacatctagtaatttg

SEQ ID NO: 7463121 - DNA, 23 bp, Homo sapiens
ttttcctttggacaggctgtatt

SEQ ID NO: 7463122 - DNA, 22 bp, Homo sapiens
ttttcctttggaagatgcatat

SEQ ID NO: 7463123 - DNA, 22 bp, Homo sapiens
ttttcctttgattcccagatgt

SEQ ID NO: 7463124 - DNA, 22 bp, Homo sapiens
ttttcctttggaagatgcatat

SEQ ID NO: 7463125 - DNA, 22 bp, Homo sapiens
ttttcctttggaagatgcatat

SEQ ID NO: 7463126 - DNA, 22 bp, Homo sapiens
ttttcctttggaagatgcatat

SEQ ID NO: 7463127 - DNA, 22 bp, Homo sapiens
ttttcctttggaagatgcatat

SEQ ID NO: 7463128 - DNA, 22 bp, Homo sapiens
ttttcctttggaagatgcatat

SEQ ID NO: 7463129 - DNA, 22 bp, Homo sapiens
ttttcctttggaagatgcatat

SEQ ID NO: 7463130 - DNA, 22 bp, Homo sapiens
ttttcctttggaagatgcatat

SEQ ID NO: 7463131 - DNA, 22 bp, Homo sapiens
ttttctaaaagaagtcactgat

SEQ ID NO: 7463132 - DNA, 22 bp, Homo sapiens
ttttctaaaagaagtcactgat

SEQ ID NO: 7463133 - DNA, 22 bp, Homo sapiens
ttttctaaaagaagtcactgat

SEQ ID NO: 7463134 - DNA, 22 bp, Homo sapiens
ttttctaaaagaagtcactgat

SEQ ID NO: 7463135 - DNA, 22 bp, Homo sapiens
ttttcgttggtcattccccagc

SEQ ID NO: 7463136 - DNA, 23 bp, Homo sapiens
ttttcctttggacaggctgtatt

SEQ ID NO: 7463137 - DNA, 22 bp, Homo sapiens
ttttcgtttatttgacatgtaa

SEQ ID NO: 7463138 - DNA, 23 bp, Homo sapiens
ttttcctttggacaggctgtatt

SEQ ID NO: 7463139 - DNA, 23 bp, Homo sapiens
ttttcctttggacaggctgtatt

SEQ ID NO: 7463140 - DNA, 23 bp, Homo sapiens
ttttcctttggacaggctgtatt

SEQ ID NO: 7463141 - DNA, 23 bp, Homo sapiens
ttttcctttggacaggctgtatt

SEQ ID NO: 7463142 - DNA, 23 bp, Homo sapiens
ttttcctttggacaggctgtatt

SEQ ID NO: 7463143 - DNA, 22 bp, Homo sapiens
ttttgcaaagtacattatcagg

SEQ ID NO: 7463144 - DNA, 23 bp, Homo sapiens
ttttgcaataagtcactggaata

SEQ ID NO: 7463145 - DNA, 22 bp, Homo sapiens
ttttgatatcatgatgaacaga

SEQ ID NO: 7463146 - DNA, 22 bp, Homo sapiens
ttttgcaaagtacattatcagg

SEQ ID NO: 7463147 - DNA, 22 bp, Homo sapiens
ttttgcaaagtacattatcagg

SEQ ID NO: 7463148 - DNA, 22 bp, Homo sapiens
ttttgcaaagtacattatcagg

SEQ ID NO: 7463149 - DNA, 22 bp, Homo sapiens
ttttgcaaagtacattatcagg

SEQ ID NO: 7463150 - DNA, 22 bp, Homo sapiens
ttttgatatcatgatgaacaga

SEQ ID NO: 7463151 - DNA, 22 bp, Homo sapiens
ttttgcatctggtgaagaccag

SEQ ID NO: 7463152 - DNA, 22 bp, Homo sapiens
ttttgcccttgctagatcactg

SEQ ID NO: 7463153 - DNA, 22 bp, Homo sapiens
ttttgcatctggtgaagaccag

SEQ ID NO: 7463154 - DNA, 22 bp, Homo sapiens
ttttgccgaaggtatctgagat

SEQ ID NO: 7463155 - DNA, 22 bp, Homo sapiens
ttttgcaatgagatgcttgtca

SEQ ID NO: 7463156 - DNA, 22 bp, Homo sapiens
ttttgcatctggtgaagaccag

SEQ ID NO: 7463157 - DNA, 22 bp, Homo sapiens
ttttgcagaatgggaaggtagt

SEQ ID NO: 7463158 - DNA, 22 bp, Homo sapiens
ttttgcagaatgggaaggtagt

SEQ ID NO: 7463159 - DNA, 22 bp, Homo sapiens
ttttgcaatgagatgcttgtca

SEQ ID NO: 7463160 - DNA, 22 bp, Homo sapiens
ttttgcaatatgttcctgaata

SEQ ID NO: 7463161 - DNA, 22 bp, Homo sapiens
ttttgcaatatgttcctgaata

SEQ ID NO: 7463162 - DNA, 22 bp, Homo sapiens
ttttgcaatatgttcctgaata

SEQ ID NO: 7463163 - DNA, 22 bp, Homo sapiens
ttttgcaatatgttcctgaata

SEQ ID NO: 7463164 - DNA, 22 bp, Homo sapiens
ttttgcaatgagatgcttgtca

SEQ ID NO: 7463165 - DNA, 22 bp, Homo sapiens
ttttggaatttatacagtaatg

SEQ ID NO: 7463166 - DNA, 22 bp, Homo sapiens
ttttggaatttatacagtaatg

SEQ ID NO: 7463167 - DNA, 22 bp, Homo sapiens
ttttggaatgaggaacatccag

SEQ ID NO: 7463168 - DNA, 22 bp, Homo sapiens
ttttggaatttatacagtaatg

SEQ ID NO: 7463169 - DNA, 22 bp, Homo sapiens
ttttggaatttatacagtaatg

SEQ ID NO: 7463170 - DNA, 22 bp, Homo sapiens
ttttggaatttatacagtaatg

SEQ ID NO: 7463171 - DNA, 22 bp, Homo sapiens
ttttggatgagcccagatttct

SEQ ID NO: 7463172 - DNA, 22 bp, Homo sapiens
ttttggaatgaggaacatccag

SEQ ID NO: 7463173 - DNA, 22 bp, Homo sapiens
ttttggaatctgggaaaacagt

SEQ ID NO: 7463174 - DNA, 22 bp, Homo sapiens
ttttggaatctgggaaaacagt

SEQ ID NO: 7463175 - DNA, 22 bp, Homo sapiens
ttttgcctaagaatctctctga

SEQ ID NO: 7463176 - DNA, 22 bp, Homo sapiens
ttttgcctaagaatctctctga

SEQ ID NO: 7463177 - DNA, 22 bp, Homo sapiens
ttttgcctaagaatctctctga

SEQ ID NO: 7463178 - DNA, 22 bp, Homo sapiens
ttttgcctaagaatctctctga

SEQ ID NO: 7463179 - DNA, 22 bp, Homo sapiens
ttttggcactgcgtctacatgg

SEQ ID NO: 7463180 - DNA, 21 bp, Homo sapiens
ttttggcaaggtgcatgtttc

SEQ ID NO: 7463181 - DNA, 22 bp, Homo sapiens
ttttggcaagctgggagatatt

SEQ ID NO: 7463182 - DNA, 22 bp, Homo sapiens
ttttggcaagctgggagatatt

SEQ ID NO: 7463183 - DNA, 22 bp, Homo sapiens
ttttggcaagctgggagatatt

SEQ ID NO: 7463184 - DNA, 22 bp, Homo sapiens
ttttggcaaaggcattctcttt

SEQ ID NO: 7463185 - DNA, 22 bp, Homo sapiens
ttttggcaaaggcattctcttt

SEQ ID NO: 7463186 - DNA, 22 bp, Homo sapiens
ttttggcaaagagatagcatga

SEQ ID NO: 7463187 - DNA, 22 bp, Homo sapiens
ttttggcaaagagatagcatga

SEQ ID NO: 7463188 - DNA, 22 bp, Homo sapiens
ttttgaagaagatgggaattta

SEQ ID NO: 7463189 - DNA, 22 bp, Homo sapiens
ttttgaaagggtgatttggctt

SEQ ID NO: 7463190 - DNA, 22 bp, Homo sapiens
ttttgaaagggtgatttggctt

SEQ ID NO: 7463191 - DNA, 22 bp, Homo sapiens
ttttgaaagggtgatttggctt

SEQ ID NO: 7463192 - DNA, 22 bp, Homo sapiens
ttttgaaagggtgatttggctt

SEQ ID NO: 7463193 - DNA, 22 bp, Homo sapiens
ttttgaaagagtcctgctacag

SEQ ID NO: 7463194 - DNA, 22 bp, Homo sapiens
ttttgaaagagtcctgctacag

SEQ ID NO: 7463195 - DNA, 22 bp, Homo sapiens
ttttgaaagccaggtttgtatg

SEQ ID NO: 7463196 - DNA, 22 bp, Homo sapiens
ttttgaaagccaggtttgtatg

SEQ ID NO: 7463197 - DNA, 22 bp, Homo sapiens
ttttgaaagccaggtttgtatg

SEQ ID NO: 7463198 - DNA, 22 bp, Homo sapiens
ttttgaaagccaggtttgtatg

SEQ ID NO: 7463199 - DNA, 22 bp, Homo sapiens
ttttgaaagccaggtttgtatg

SEQ ID NO: 7463200 - DNA, 22 bp, Homo sapiens
ttttgaaagccaggtttgtatg

SEQ ID NO: 7463201 - DNA, 22 bp, Homo sapiens
ttttgaaagccaggtttgtatg

SEQ ID NO: 7463202 - DNA, 22 bp, Homo sapiens
ttttgaataattcagaaacagc

SEQ ID NO: 7463203 - DNA, 22 bp, Homo sapiens
ttttgaataattcagaaacagc

SEQ ID NO: 7463204 - DNA, 19 bp, Homo sapiens
ttttgaagtatgagacagg

SEQ ID NO: 7463205 - DNA, 19 bp, Homo sapiens
ttttgaagtatgagacagg

SEQ ID NO: 7463206 - DNA, 19 bp, Homo sapiens
ttttgaagtatgagacagg

SEQ ID NO: 7463207 - DNA, 22 bp, Homo sapiens
ttttgatatcatgatgaacaga

SEQ ID NO: 7463208 - DNA, 20 bp, Homo sapiens
ttttgatagcaaagacggta

SEQ ID NO: 7463209 - DNA, 22 bp, Homo sapiens
ttttgatatcatgatgaacaga

SEQ ID NO: 7463210 - DNA, 22 bp, Homo sapiens
ttttgatatcatgatgaacaga

SEQ ID NO: 7463211 - DNA, 22 bp, Homo sapiens
ttttgacaatgctaatctcaat

SEQ ID NO: 7463212 - DNA, 22 bp, Homo sapiens
ttttgacaatgctaatctcaat

SEQ ID NO: 7463213 - DNA, 22 bp, Homo sapiens
ttttgacaatgctaatctcaat

SEQ ID NO: 7463214 - DNA, 22 bp, Homo sapiens
tttttcctaagcagtggagctg

SEQ ID NO: 7463215 - DNA, 22 bp, Homo sapiens
tttttcctaagcagtggagctg

SEQ ID NO: 7463216 - DNA, 22 bp, Homo sapiens
tttttcctagcgatttgtcagc

SEQ ID NO: 7463217 - DNA, 22 bp, Homo sapiens
tttttcctagcgatttgtcagc

SEQ ID NO: 7463218 - DNA, 22 bp, Homo sapiens
tttttcctagcgatttgtcagc

SEQ ID NO: 7463219 - DNA, 22 bp, Homo sapiens
tttttcctagcgatttgtcagc

SEQ ID NO: 7463220 - DNA, 22 bp, Homo sapiens
tttttcctagtgctttctggta

SEQ ID NO: 7463221 - DNA, 22 bp, Homo sapiens
tttttcctagtgctttctggta

SEQ ID NO: 7463222 - DNA, 22 bp, Homo sapiens
tttttcctagtgctttctggta

SEQ ID NO: 7463223 - DNA, 22 bp, Homo sapiens
tttttcctagcgatttgtcagc

SEQ ID NO: 7463224 - DNA, 22 bp, Homo sapiens
tttttcctagcgatttgtcagc

SEQ ID NO: 7463225 - DNA, 22 bp, Homo sapiens
tttttcctagcgatttgtcagc

SEQ ID NO: 7463226 - DNA, 22 bp, Homo sapiens
tttttcctagcgatttgtcagc

SEQ ID NO: 7463227 - DNA, 20 bp, Homo sapiens
tttttccttctctacaggca

SEQ ID NO: 7463228 - DNA, 20 bp, Homo sapiens
tttttccttctctacaggca

SEQ ID NO: 7463229 - DNA, 20 bp, Homo sapiens
tttttccttctctacaggca

SEQ ID NO: 7463230 - DNA, 20 bp, Homo sapiens
tttttccttctctacaggca

SEQ ID NO: 7463231 - DNA, 22 bp, Homo sapiens
tttttccttaggggttactcac

SEQ ID NO: 7463232 - DNA, 22 bp, Homo sapiens
tttttccttaggggttactcac

SEQ ID NO: 7463233 - DNA, 22 bp, Homo sapiens
tttttccttaggggttactcac

SEQ ID NO: 7463234 - DNA, 22 bp, Homo sapiens
tttttccttaggggttactcac

SEQ ID NO: 7463235 - DNA, 22 bp, Homo sapiens
tttttccttaggggttactcac

SEQ ID NO: 7463236 - DNA, 22 bp, Homo sapiens
tttttcctagtgctttctggta

SEQ ID NO: 7463237 - DNA, 22 bp, Homo sapiens
tttttcctagtgctttctggta

SEQ ID NO: 7463238 - DNA, 22 bp, Homo sapiens
tttttcctagtgctttctggta

SEQ ID NO: 7463239 - DNA, 22 bp, Homo sapiens
tttttcctagtgctttctggta

SEQ ID NO: 7463240 - DNA, 22 bp, Homo sapiens
tttttcctaagcagtggagctg

SEQ ID NO: 7463241 - DNA, 22 bp, Homo sapiens
tttttcctaagcagtggagctg

SEQ ID NO: 7463242 - DNA, 22 bp, Homo sapiens
tttttcccatatagaaagccaa

SEQ ID NO: 7463243 - DNA, 22 bp, Homo sapiens
tttttcccatatagaaagccaa

SEQ ID NO: 7463244 - DNA, 22 bp, Homo sapiens
tttttcccatatagaaagccaa

SEQ ID NO: 7463245 - DNA, 22 bp, Homo sapiens
tttttcccaaaggcaattgcct

SEQ ID NO: 7463246 - DNA, 22 bp, Homo sapiens
tttttcccaaaggcaattgcct

SEQ ID NO: 7463247 - DNA, 22 bp, Homo sapiens
tttttccagggttagatgttta

SEQ ID NO: 7463248 - DNA, 22 bp, Homo sapiens
tttttccagggttagatgttta

SEQ ID NO: 7463249 - DNA, 22 bp, Homo sapiens
tttttccagggttagatgttta

SEQ ID NO: 7463250 - DNA, 22 bp, Homo sapiens
tttttccagggttagatgttta

SEQ ID NO: 7463251 - DNA, 22 bp, Homo sapiens
tttttccagggttagatgttta

SEQ ID NO: 7463252 - DNA, 22 bp, Homo sapiens
tttttccagggttagatgttta

SEQ ID NO: 7463253 - DNA, 22 bp, Homo sapiens
tttttccagggttagatgttta

SEQ ID NO: 7463254 - DNA, 22 bp, Homo sapiens
tttttccaccgtacttcctgag

SEQ ID NO: 7463255 - DNA, 22 bp, Homo sapiens
tttttccaccgtacttcctgag

SEQ ID NO: 7463256 - DNA, 22 bp, Homo sapiens
tttttccacataccctaggcca

SEQ ID NO: 7463257 - DNA, 22 bp, Homo sapiens
tttttccacataccctaggcca

SEQ ID NO: 7463258 - DNA, 22 bp, Homo sapiens
tttttcattgcagcctctctcc

SEQ ID NO: 7463259 - DNA, 22 bp, Homo sapiens
tttttcattgcagcctctctcc

SEQ ID NO: 7463260 - DNA, 22 bp, Homo sapiens
tttttcattgcagcctctctcc

SEQ ID NO: 7463261 - DNA, 22 bp, Homo sapiens
tttttcattgcagcctctctcc

SEQ ID NO: 7463262 - DNA, 22 bp, Homo sapiens
tttttcattgcagcctctctcc

SEQ ID NO: 7463263 - DNA, 22 bp, Homo sapiens
tttttcattgcagcctctctcc

SEQ ID NO: 7463264 - DNA, 22 bp, Homo sapiens
ttttggcactttgtctgattct

SEQ ID NO: 7463265 - DNA, 22 bp, Homo sapiens
ttttggcactgcgtctacatgg

SEQ ID NO: 7463266 - DNA, 22 bp, Homo sapiens
ttttggcactgcgtctacatgg

SEQ ID NO: 7463267 - DNA, 22 bp, Homo sapiens
ttttggcagattacttaatatg

SEQ ID NO: 7463268 - DNA, 22 bp, Homo sapiens
ttttggcagattacttaatatg

SEQ ID NO: 7463269 - DNA, 22 bp, Homo sapiens
ttttggcactttgtctgattct

SEQ ID NO: 7463270 - DNA, 22 bp, Homo sapiens
ttttggcagattacttaatatg

SEQ ID NO: 7463271 - DNA, 22 bp, Homo sapiens
ttttggcatcacttgccatcta

SEQ ID NO: 7463272 - DNA, 22 bp, Homo sapiens
ttttggcatcacttgccatcta

SEQ ID NO: 7463273 - DNA, 22 bp, Homo sapiens
ttttggccacatccttttgagt

SEQ ID NO: 7463274 - DNA, 22 bp, Homo sapiens
ttttggccacatccttttgagt

SEQ ID NO: 7463275 - DNA, 22 bp, Homo sapiens
ttttggcagccacatgcacttg

SEQ ID NO: 7463276 - DNA, 22 bp, Homo sapiens
ttttggcagcaggtatggggca

SEQ ID NO: 7463277 - DNA, 22 bp, Homo sapiens
ttttggcagcaggtatggggca

SEQ ID NO: 7463278 - DNA, 22 bp, Homo sapiens
ttttggcagccacatgcacttg

SEQ ID NO: 7463279 - DNA, 22 bp, Homo sapiens
ttttggcagccacatgcacttg

SEQ ID NO: 7463280 - DNA, 22 bp, Homo sapiens
ttttggcaggatatgcaccagc

SEQ ID NO: 7463281 - DNA, 22 bp, Homo sapiens
ttttggcaggatatgcaccagc

SEQ ID NO: 7463282 - DNA, 22 bp, Homo sapiens
ttttggccacatccttttgagt

SEQ ID NO: 7463283 - DNA, 22 bp, Homo sapiens
ttttggctccagtggtttgtgc

SEQ ID NO: 7463284 - DNA, 22 bp, Homo sapiens
ttttggctccagtggtttgtgc

SEQ ID NO: 7463285 - DNA, 22 bp, Homo sapiens
ttttggccacatccttttgagt

SEQ ID NO: 7463286 - DNA, 22 bp, Homo sapiens
ttttggctccagtggtttgtgc

SEQ ID NO: 7463287 - DNA, 22 bp, Homo sapiens
ttttggctctgcaggtttgcac

SEQ ID NO: 7463288 - DNA, 22 bp, Homo sapiens
ttttggctctgcaggtttgcac

SEQ ID NO: 7463289 - DNA, 22 bp, Homo sapiens
ttttggctctgtctgtatcttt

SEQ ID NO: 7463290 - DNA, 22 bp, Homo sapiens
tttttcatctgattgataactc

SEQ ID NO: 7463291 - DNA, 22 bp, Homo sapiens
tttttcatgagactagaagtca

SEQ ID NO: 7463292 - DNA, 22 bp, Homo sapiens
tttttcatgagactagaagtca

SEQ ID NO: 7463293 - DNA, 22 bp, Homo sapiens
tttttcatgagactagaagtca

SEQ ID NO: 7463294 - DNA, 22 bp, Homo sapiens
tttttcatgagactagaagtca

SEQ ID NO: 7463295 - DNA, 22 bp, Homo sapiens
tttttcatgagactagaagtca

SEQ ID NO: 7463296 - DNA, 22 bp, Homo sapiens
tttttcatgagactagaagtca

SEQ ID NO: 7463297 - DNA, 22 bp, Homo sapiens
tttttcatgagactagaagtca

SEQ ID NO: 7463298 - DNA, 22 bp, Homo sapiens
tttttcatgagactagaagtca

SEQ ID NO: 7463299 - DNA, 22 bp, Homo sapiens
tttttcattgcagcctctctcc

SEQ ID NO: 7463300 - DNA, 22 bp, Homo sapiens
tttttcatgagactagaagtca

SEQ ID NO: 7463301 - DNA, 22 bp, Homo sapiens
tttttcatgagactagaagtca

SEQ ID NO: 7463302 - DNA, 22 bp, Homo sapiens
tttttcatgagactagaagtca

SEQ ID NO: 7463303 - DNA, 22 bp, Homo sapiens
tccccagtaagcctgcactgtg

SEQ ID NO: 7463304 - DNA, 22 bp, Homo sapiens
tccccagtaagcctgcactgtg

SEQ ID NO: 7463305 - DNA, 22 bp, Homo sapiens
tccccagtaagcctgcactgtg

SEQ ID NO: 7463306 - DNA, 22 bp, Homo sapiens
tccccatggaaggatgatggaa

SEQ ID NO: 7463307 - DNA, 22 bp, Homo sapiens
tccccatgggtggggacacata

SEQ ID NO: 7463308 - DNA, 22 bp, Homo sapiens
tccccatgggtggggacacata

SEQ ID NO: 7463309 - DNA, 22 bp, Homo sapiens
tccccagtcccggcggtgggtg

SEQ ID NO: 7463310 - DNA, 22 bp, Homo sapiens
tccccagtcccggcggtgggtg

SEQ ID NO: 7463311 - DNA, 22 bp, Homo sapiens
tccccaggtcctgtcggctcct

SEQ ID NO: 7463312 - DNA, 22 bp, Homo sapiens
tccccaggtcctgtcggctcct

SEQ ID NO: 7463313 - DNA, 22 bp, Homo sapiens
tccccaggtcctgtcggctcct

SEQ ID NO: 7463314 - DNA, 22 bp, Homo sapiens
tccccaggtcctgtcggctcct

SEQ ID NO: 7463315 - DNA, 22 bp, Homo sapiens
tccccaggtcctgtcggctcct

SEQ ID NO: 7463316 - DNA, 22 bp, Homo sapiens
tccccagggtccctgcttccat

SEQ ID NO: 7463317 - DNA, 22 bp, Homo sapiens
tccccaggtcctgtcggctcct

SEQ ID NO: 7463318 - DNA, 22 bp, Homo sapiens
tccccaggtcctgtcggctcct

SEQ ID NO: 7463319 - DNA, 22 bp, Homo sapiens
tccccaggtcctgtcggctcct

SEQ ID NO: 7463320 - DNA, 22 bp, Homo sapiens
tcccccaggctggagtgcagtg

SEQ ID NO: 7463321 - DNA, 20 bp, Homo sapiens
tcccccactgtttctgctac

SEQ ID NO: 7463322 - DNA, 20 bp, Homo sapiens
tcccccactgtttctgctac

SEQ ID NO: 7463323 - DNA, 20 bp, Homo sapiens
tcccccactgtttctgctac

SEQ ID NO: 7463324 - DNA, 17 bp, Homo sapiens
tcccccagggctctctc

SEQ ID NO: 7463325 - DNA, 17 bp, Homo sapiens
tcccccagggctctctc

SEQ ID NO: 7463326 - DNA, 22 bp, Homo sapiens
tcccccaggctggagtgcagtg

SEQ ID NO: 7463327 - DNA, 22 bp, Homo sapiens
tcccccaggctggagtgcagtg

SEQ ID NO: 7463328 - DNA, 22 bp, Homo sapiens
tcccccaggctggagtgcagtg

SEQ ID NO: 7463329 - DNA, 22 bp, Homo sapiens
tccccattcctctcggtggtgg

SEQ ID NO: 7463330 - DNA, 22 bp, Homo sapiens
tccccatgtctgcagggagggt

SEQ ID NO: 7463331 - DNA, 22 bp, Homo sapiens
tcccccaaatgaatgaggaata

SEQ ID NO: 7463332 - DNA, 22 bp, Homo sapiens
tcccccaaatgaatgaggaata

SEQ ID NO: 7463333 - DNA, 22 bp, Homo sapiens
tcccccaaatgaatgaggaata

SEQ ID NO: 7463334 - DNA, 22 bp, Homo sapiens
tcccccaactcttagcactgta

SEQ ID NO: 7463335 - DNA, 22 bp, Homo sapiens
tcccccaactcttagcactgta

SEQ ID NO: 7463336 - DNA, 22 bp, Homo sapiens
tcccccaactcttagcactgta

SEQ ID NO: 7463337 - DNA, 22 bp, Homo sapiens
tcccccaactcttagcactgta

SEQ ID NO: 7463338 - DNA, 22 bp, Homo sapiens
tcccccactctaaaggagcctt

SEQ ID NO: 7463339 - DNA, 22 bp, Homo sapiens
tcccccactctaaaggagcctt

SEQ ID NO: 7463340 - DNA, 22 bp, Homo sapiens
tcccccactctaaaggagcctt

SEQ ID NO: 7463341 - DNA, 22 bp, Homo sapiens
tcccccactctaaaggagcctt

SEQ ID NO: 7463342 - DNA, 22 bp, Homo sapiens
tcccccactctaaaggagcctt

SEQ ID NO: 7463343 - DNA, 22 bp, Homo sapiens
tcccccactctaaaggagcctt

SEQ ID NO: 7463344 - DNA, 22 bp, Homo sapiens
tcccccactctaaaggagcctt

SEQ ID NO: 7463345 - DNA, 23 bp, Homo sapiens
tcccctcaggcagccagtgccct

SEQ ID NO: 7463346 - DNA, 23 bp, Homo sapiens
tcccctcaggcagccagtgccct

SEQ ID NO: 7463347 - DNA, 23 bp, Homo sapiens
tcccctcaggcagccagtgccct

SEQ ID NO: 7463348 - DNA, 22 bp, Homo sapiens
tcccctccaactccaactatgg

SEQ ID NO: 7463349 - DNA, 22 bp, Homo sapiens
tcccctccaactccaactatgg

SEQ ID NO: 7463350 - DNA, 22 bp, Homo sapiens
tcccctccaactccaactatgg

SEQ ID NO: 7463351 - DNA, 22 bp, Homo sapiens
tcccctccaactccaactatgg

SEQ ID NO: 7463352 - DNA, 22 bp, Homo sapiens
tcccctccaactccaactatgg

SEQ ID NO: 7463353 - DNA, 22 bp, Homo sapiens
tcccctccaactccaactatgg

SEQ ID NO: 7463354 - DNA, 22 bp, Homo sapiens
tcccctccaactccaactatgg

SEQ ID NO: 7463355 - DNA, 22 bp, Homo sapiens
tcccctcccttccaacagagct

SEQ ID NO: 7463356 - DNA, 22 bp, Homo sapiens
tcccctcccttccaacagagct

SEQ ID NO: 7463357 - DNA, 22 bp, Homo sapiens
tcccctcccttccaacagagct

SEQ ID NO: 7463358 - DNA, 22 bp, Homo sapiens
tcccctcccttccaacagagct

SEQ ID NO: 7463359 - DNA, 22 bp, Homo sapiens
tcccctcccttccaacagagct

SEQ ID NO: 7463360 - DNA, 22 bp, Homo sapiens
tcccctcctctcctgatatggg

SEQ ID NO: 7463361 - DNA, 22 bp, Homo sapiens
tcccctcctgcctttgcggtgg

SEQ ID NO: 7463362 - DNA, 22 bp, Homo sapiens
tcccctcctctcctgatatggg

SEQ ID NO: 7463363 - DNA, 22 bp, Homo sapiens
tcccctcctctcctgatatggg

SEQ ID NO: 7463364 - DNA, 22 bp, Homo sapiens
tcccctcctctcctgatatggg

SEQ ID NO: 7463365 - DNA, 22 bp, Homo sapiens
tcccctcctctcctgatatggg

SEQ ID NO: 7463366 - DNA, 22 bp, Homo sapiens
tcccctcctctcctgatatggg

SEQ ID NO: 7463367 - DNA, 21 bp, Homo sapiens
tcccctcacttgtcttctgag

SEQ ID NO: 7463368 - DNA, 21 bp, Homo sapiens
tcccctcacttgtcttctgag

SEQ ID NO: 7463369 - DNA, 22 bp, Homo sapiens
tccccctccaattgccatgtta

SEQ ID NO: 7463370 - DNA, 22 bp, Homo sapiens
tccccctcctgtggttttctgc

SEQ ID NO: 7463371 - DNA, 22 bp, Homo sapiens
tccccctccaattgccatgtta

SEQ ID NO: 7463372 - DNA, 22 bp, Homo sapiens
tccccctccaattgccatgtta

SEQ ID NO: 7463373 - DNA, 22 bp, Homo sapiens
tccccctcattacctcattcaa

SEQ ID NO: 7463374 - DNA, 22 bp, Homo sapiens
tcccccatcccaaggaggtcat

SEQ ID NO: 7463375 - DNA, 22 bp, Homo sapiens
tccccccagcctttcacatgag

SEQ ID NO: 7463376 - DNA, 22 bp, Homo sapiens
tccccccagcctttcacatgag

SEQ ID NO: 7463377 - DNA, 22 bp, Homo sapiens
tcccccagtctgggcgtggtca

SEQ ID NO: 7463378 - DNA, 22 bp, Homo sapiens
tccccccagcctttcacatgag

SEQ ID NO: 7463379 - DNA, 22 bp, Homo sapiens
tcccccagtctgggcgtggtca

SEQ ID NO: 7463380 - DNA, 22 bp, Homo sapiens
tcccccaggctggagtgcagtg

SEQ ID NO: 7463381 - DNA, 22 bp, Homo sapiens
tccccccagcctttcacatgag

SEQ ID NO: 7463382 - DNA, 22 bp, Homo sapiens
tccccccagcctttcacatgag

SEQ ID NO: 7463383 - DNA, 22 bp, Homo sapiens
tccccctacataatagggtagc

SEQ ID NO: 7463384 - DNA, 22 bp, Homo sapiens
tccccctcattacctcattcaa

SEQ ID NO: 7463385 - DNA, 22 bp, Homo sapiens
tccccctcattacctcattcaa

SEQ ID NO: 7463386 - DNA, 22 bp, Homo sapiens
tcccctgcagcgcctgcttcta

SEQ ID NO: 7463387 - DNA, 18 bp, Homo sapiens
tcccctgctctggtgctc

SEQ ID NO: 7463388 - DNA, 18 bp, Homo sapiens
tcccctgctctggtgctc

SEQ ID NO: 7463389 - DNA, 18 bp, Homo sapiens
tcccctgctctggtgctc

SEQ ID NO: 7463390 - DNA, 22 bp, Homo sapiens
tcccctgcagatgagggcagtg

SEQ ID NO: 7463391 - DNA, 22 bp, Homo sapiens
tcccctgcagatgagggcagtg

SEQ ID NO: 7463392 - DNA, 22 bp, Homo sapiens
tcccctgcagatgagggcagtg

SEQ ID NO: 7463393 - DNA, 22 bp, Homo sapiens
tcccctgcagcgcctgcttcta

SEQ ID NO: 7463394 - DNA, 22 bp, Homo sapiens
tcccctgcagcgcctgcttcta

SEQ ID NO: 7463395 - DNA, 22 bp, Homo sapiens
tcccctgcagcgcctgcttcta

SEQ ID NO: 7463396 - DNA, 22 bp, Homo sapiens
tcccctggcacctagtcctact

SEQ ID NO: 7463397 - DNA, 18 bp, Homo sapiens
tcccctgctctggtgctc

SEQ ID NO: 7463398 - DNA, 22 bp, Homo sapiens
tgtggacagctctttgagtgct

SEQ ID NO: 7463399 - DNA, 22 bp, Homo sapiens
tgtggacagagcagaaggtcat

SEQ ID NO: 7463400 - DNA, 22 bp, Homo sapiens
tcccctctctgcgctcccaggt

SEQ ID NO: 7463401 - DNA, 22 bp, Homo sapiens
tcccctctctgcgctcccaggt

SEQ ID NO: 7463402 - DNA, 22 bp, Homo sapiens
tcccctcctgcctttgcggtgg

SEQ ID NO: 7463403 - DNA, 22 bp, Homo sapiens
tcccctctctgcgctcccaggt

SEQ ID NO: 7463404 - DNA, 22 bp, Homo sapiens
tcccctctctgcgctcccaggt

SEQ ID NO: 7463405 - DNA, 22 bp, Homo sapiens
tcccctctggaggctgcagggg

SEQ ID NO: 7463406 - DNA, 22 bp, Homo sapiens
tcccctctggaggctgcagggg

SEQ ID NO: 7463407 - DNA, 22 bp, Homo sapiens
tcccctctggaggctgcagggg

SEQ ID NO: 7463408 - DNA, 22 bp, Homo sapiens
tcccctctggaggctgcagggg

SEQ ID NO: 7463409 - DNA, 22 bp, Homo sapiens
tcccctctggaggctgcagggg

SEQ ID NO: 7463410 - DNA, 22 bp, Homo sapiens
tcccctctggaggctgcagggg

SEQ ID NO: 7463411 - DNA, 22 bp, Homo sapiens
tcccctctggttgacccaggag

SEQ ID NO: 7463412 - DNA, 22 bp, Homo sapiens
tcccctctggttgacccaggag

SEQ ID NO: 7463413 - DNA, 22 bp, Homo sapiens
tcccctctggttgacccaggag

SEQ ID NO: 7463414 - DNA, 22 bp, Homo sapiens
tcccctgagacccctcagcact

SEQ ID NO: 7463415 - DNA, 22 bp, Homo sapiens
tcccctgagacccctcagcact

SEQ ID NO: 7463416 - DNA, 22 bp, Homo sapiens
tgtggacatactaggcctaggc

SEQ ID NO: 7463417 - DNA, 22 bp, Homo sapiens
tgtggacatactaggcctaggc

SEQ ID NO: 7463418 - DNA, 22 bp, Homo sapiens
tgtggacagtgatccctagtca

SEQ ID NO: 7463419 - DNA, 22 bp, Homo sapiens
tgtggacaggcagttggtggga

SEQ ID NO: 7463420 - DNA, 18 bp, Homo sapiens
tgtggacatggctcttca

SEQ ID NO: 7463421 - DNA, 22 bp, Homo sapiens
tgtggacatactaggcctaggc

SEQ ID NO: 7463422 - DNA, 22 bp, Homo sapiens
tgtggactcgcatggctgaggc

SEQ ID NO: 7463423 - DNA, 20 bp, Homo sapiens
tgtggactcagtttcttgct

SEQ ID NO: 7463424 - DNA, 22 bp, Homo sapiens
tgtggactagtgtttggatttt

SEQ ID NO: 7463425 - DNA, 22 bp, Homo sapiens
tgtggactgtgctgccacagtg

SEQ ID NO: 7463426 - DNA, 22 bp, Homo sapiens
tgtggacattttttgtcagtag

SEQ ID NO: 7463427 - DNA, 22 bp, Homo sapiens
tgtggactttagtaggtgagag

SEQ ID NO: 7463428 - DNA, 22 bp, Homo sapiens
tgtggacttgaaattacttttc

SEQ ID NO: 7463429 - DNA, 22 bp, Homo sapiens
tgtggactttggcattggactt

SEQ ID NO: 7463430 - DNA, 22 bp, Homo sapiens
tgtggagatgtgagcaagggga

SEQ ID NO: 7463431 - DNA, 22 bp, Homo sapiens
tgtggagatgtgagcaagggga

SEQ ID NO: 7463432 - DNA, 22 bp, Homo sapiens
tgtggagaagaaggccactgca

SEQ ID NO: 7463433 - DNA, 22 bp, Homo sapiens
tgtggagaagaaggccactgca

SEQ ID NO: 7463434 - DNA, 22 bp, Homo sapiens
tgtggagatgtgagcaagggga

SEQ ID NO: 7463435 - DNA, 22 bp, Homo sapiens
tgtggagcaattggtggtgtct

SEQ ID NO: 7463436 - DNA, 22 bp, Homo sapiens
tgtggagcagcgtcacagcctt

SEQ ID NO: 7463437 - DNA, 22 bp, Homo sapiens
tgtggagcccccaggagtgggg

SEQ ID NO: 7463438 - DNA, 22 bp, Homo sapiens
tgtggagcagcgtcacagcctt

SEQ ID NO: 7463439 - DNA, 22 bp, Homo sapiens
tgtggagccaggaggtggggac

SEQ ID NO: 7463440 - DNA, 22 bp, Homo sapiens
tgtggaggattctgatgccagc

SEQ ID NO: 7463441 - DNA, 22 bp, Homo sapiens
tgtggagctcagaagtagcagt

SEQ ID NO: 7463442 - DNA, 22 bp, Homo sapiens
tgtggcagagtaaggacccagt

SEQ ID NO: 7463443 - DNA, 22 bp, Homo sapiens
tgtggcagagtaaggacccagt

SEQ ID NO: 7463444 - DNA, 22 bp, Homo sapiens
tgtggcagagtaaggacccagt

SEQ ID NO: 7463445 - DNA, 22 bp, Homo sapiens
tgtggcagatacagaagatcaa

SEQ ID NO: 7463446 - DNA, 22 bp, Homo sapiens
tgtggcagatacagaagatcaa

SEQ ID NO: 7463447 - DNA, 22 bp, Homo sapiens
tgtggcagatacagaagatcaa

SEQ ID NO: 7463448 - DNA, 22 bp, Homo sapiens
tgtggcagatacagaagatcaa

SEQ ID NO: 7463449 - DNA, 21 bp, Homo sapiens
tgtggcagatgttgggaggca

SEQ ID NO: 7463450 - DNA, 21 bp, Homo sapiens
tgtggcagatgttgggaggca

SEQ ID NO: 7463451 - DNA, 21 bp, Homo sapiens
tgtggcagatgttgggaggca

SEQ ID NO: 7463452 - DNA, 21 bp, Homo sapiens
tgtggcagatgttgggaggca

SEQ ID NO: 7463453 - DNA, 21 bp, Homo sapiens
tgtggcagatgttgggaggca

SEQ ID NO: 7463454 - DNA, 22 bp, Homo sapiens
tgtggcagattttataaattgc

SEQ ID NO: 7463455 - DNA, 22 bp, Homo sapiens
tgtggcagattttataaattgc

SEQ ID NO: 7463456 - DNA, 21 bp, Homo sapiens
tgtggcagatgttgggaggca

SEQ ID NO: 7463457 - DNA, 21 bp, Homo sapiens
tgtggcagatgttgggaggca

SEQ ID NO: 7463458 - DNA, 22 bp, Homo sapiens
tgtggcagctgctgcaggagct

SEQ ID NO: 7463459 - DNA, 22 bp, Homo sapiens
tgtggcagctgctgcaggagct

SEQ ID NO: 7463460 - DNA, 22 bp, Homo sapiens
tgtggcagctgctgcaggagct

SEQ ID NO: 7463461 - DNA, 22 bp, Homo sapiens
tgtggcagctgctgcaggagct

SEQ ID NO: 7463462 - DNA, 22 bp, Homo sapiens
tgtggcagctgctgcaggagct

SEQ ID NO: 7463463 - DNA, 22 bp, Homo sapiens
tgtggcagaactgggactcaaa

SEQ ID NO: 7463464 - DNA, 22 bp, Homo sapiens
tgtggcagaaggctaaggtgtc

SEQ ID NO: 7463465 - DNA, 22 bp, Homo sapiens
tgtggcagaaggctaaggtgtc

SEQ ID NO: 7463466 - DNA, 22 bp, Homo sapiens
tgtggcagaaggctaaggtgtc

SEQ ID NO: 7463467 - DNA, 22 bp, Homo sapiens
tgtggcagacaagattctatgt

SEQ ID NO: 7463468 - DNA, 21 bp, Homo sapiens
tgtggcagagacaatgctagt

SEQ ID NO: 7463469 - DNA, 22 bp, Homo sapiens
tgtggcagagagagcttccttg

SEQ ID NO: 7463470 - DNA, 21 bp, Homo sapiens
tgtggcagagacaatgctagt

SEQ ID NO: 7463471 - DNA, 22 bp, Homo sapiens
tgtggcagagagagcttccttg

SEQ ID NO: 7463472 - DNA, 22 bp, Homo sapiens
tgtggcagagagagcttccttg

SEQ ID NO: 7463473 - DNA, 22 bp, Homo sapiens
tgtggcagagagagcttccttg

SEQ ID NO: 7463474 - DNA, 22 bp, Homo sapiens
tgtggcagaggaggcagcgtcc

SEQ ID NO: 7463475 - DNA, 22 bp, Homo sapiens
tgtggcagagtaaggacccagt

SEQ ID NO: 7463476 - DNA, 22 bp, Homo sapiens
tgtggcagagtaaggacccagt

SEQ ID NO: 7463477 - DNA, 22 bp, Homo sapiens
tgtggcagagtaaggacccagt

SEQ ID NO: 7463478 - DNA, 22 bp, Homo sapiens
tgtggcagaggaggcagcgtcc

SEQ ID NO: 7463479 - DNA, 22 bp, Homo sapiens
tgtggcagaggaggcagcgtcc

SEQ ID NO: 7463480 - DNA, 22 bp, Homo sapiens
tgtggcagaggaggcagcgtcc

SEQ ID NO: 7463481 - DNA, 22 bp, Homo sapiens
tgtggcagaggaggcagcgtcc

SEQ ID NO: 7463482 - DNA, 22 bp, Homo sapiens
tgtggcagagagagcttccttg

SEQ ID NO: 7463483 - DNA, 22 bp, Homo sapiens
tgtggcacagaaagatgaaggg

SEQ ID NO: 7463484 - DNA, 22 bp, Homo sapiens
tgtggcacatacacaggagggc

SEQ ID NO: 7463485 - DNA, 22 bp, Homo sapiens
tgtggcacatacacaggagggc

SEQ ID NO: 7463486 - DNA, 22 bp, Homo sapiens
tgtggcacatacacaggagggc

SEQ ID NO: 7463487 - DNA, 22 bp, Homo sapiens
tgtggcagaaagcatgtggaca

SEQ ID NO: 7463488 - DNA, 22 bp, Homo sapiens
tgtggcagaaagcatgtggaca

SEQ ID NO: 7463489 - DNA, 22 bp, Homo sapiens
tgtggcacttctctccttgtaa

SEQ ID NO: 7463490 - DNA, 22 bp, Homo sapiens
tgtggcagaaagcatgtggaca

SEQ ID NO: 7463491 - DNA, 22 bp, Homo sapiens
tgtggcagaaagcatgtggaca

SEQ ID NO: 7463492 - DNA, 22 bp, Homo sapiens
tgtggcacttgcaaatattttg

SEQ ID NO: 7463493 - DNA, 22 bp, Homo sapiens
tgtggcacttctctccttgtaa

SEQ ID NO: 7463494 - DNA, 22 bp, Homo sapiens
tgtggcagaaccagaattcaaa

SEQ ID NO: 7463495 - DNA, 22 bp, Homo sapiens
tgtggcagaaagcatgtggaca

SEQ ID NO: 7463496 - DNA, 22 bp, Homo sapiens
tgtggcagaaccagaattcaaa

SEQ ID NO: 7463497 - DNA, 22 bp, Homo sapiens
tgtggcagaaccagaattcaaa

SEQ ID NO: 7463498 - DNA, 22 bp, Homo sapiens
tgtggcagaaccagaattcaaa

SEQ ID NO: 7463499 - DNA, 22 bp, Homo sapiens
tgtggcagaactgggactcaaa

SEQ ID NO: 7463500 - DNA, 22 bp, Homo sapiens
tgtggcagaactgggactcaaa

SEQ ID NO: 7463501 - DNA, 22 bp, Homo sapiens
tgtggcagaactgggactcaaa

SEQ ID NO: 7463502 - DNA, 22 bp, Homo sapiens
tgtggcagaactgggactcaaa

SEQ ID NO: 7463503 - DNA, 22 bp, Homo sapiens
tgtggcagaactgggactcaaa

SEQ ID NO: 7463504 - DNA, 22 bp, Homo sapiens
tgtggcaaagaccatttctttc

SEQ ID NO: 7463505 - DNA, 22 bp, Homo sapiens
tgtggcacagaaagatgaaggg

SEQ ID NO: 7463506 - DNA, 20 bp, Homo sapiens
tgtggatgaggtaaggatag

SEQ ID NO: 7463507 - DNA, 20 bp, Homo sapiens
tgtggatgaggtaaggatag

SEQ ID NO: 7463508 - DNA, 22 bp, Homo sapiens
tgtggatgaataaagtgcagac

SEQ ID NO: 7463509 - DNA, 22 bp, Homo sapiens
tgtggataatgcactatccata

SEQ ID NO: 7463510 - DNA, 22 bp, Homo sapiens
tgtggagtggtctgaaggctcc

SEQ ID NO: 7463511 - DNA, 22 bp, Homo sapiens
tgtggatgagggagtgaacaaa

SEQ ID NO: 7463512 - DNA, 22 bp, Homo sapiens
tgtggaggtttaagtaatggga

SEQ ID NO: 7463513 - DNA, 22 bp, Homo sapiens
tgtggaggtttaagtaatggga

SEQ ID NO: 7463514 - DNA, 22 bp, Homo sapiens
tgtggaggtttaagtaatggga

SEQ ID NO: 7463515 - DNA, 22 bp, Homo sapiens
tgtggaggattctgatgccagc

SEQ ID NO: 7463516 - DNA, 22 bp, Homo sapiens
tgtggaggattctgatgccagc

SEQ ID NO: 7463517 - DNA, 22 bp, Homo sapiens
tgtggaggattctgatgccagc

SEQ ID NO: 7463518 - DNA, 22 bp, Homo sapiens
tgtggaggattctgatgccagc

SEQ ID NO: 7463519 - DNA, 22 bp, Homo sapiens
tgtggaggattctgatgccagc

SEQ ID NO: 7463520 - DNA, 22 bp, Homo sapiens
tgtggaggattctgatgccagc

SEQ ID NO: 7463521 - DNA, 22 bp, Homo sapiens
tgtggccagggggccatgtccc

SEQ ID NO: 7463522 - DNA, 22 bp, Homo sapiens
tgtggccataaagcttaaaatg

SEQ ID NO: 7463523 - DNA, 22 bp, Homo sapiens
tgtggccataaagcttaaaatg

SEQ ID NO: 7463524 - DNA, 22 bp, Homo sapiens
tgtggccatggtcagaatattg

SEQ ID NO: 7463525 - DNA, 22 bp, Homo sapiens
tgtggccatggtcagaatattg

SEQ ID NO: 7463526 - DNA, 22 bp, Homo sapiens
tgtggccatatactttgttgtg

SEQ ID NO: 7463527 - DNA, 22 bp, Homo sapiens
tgtggccagggggccatgtccc

SEQ ID NO: 7463528 - DNA, 19 bp, Homo sapiens
tgtggccatggttcagctg

SEQ ID NO: 7463529 - DNA, 19 bp, Homo sapiens
tgtggccatggttcagctg

SEQ ID NO: 7463530 - DNA, 22 bp, Homo sapiens
tgtggcccagatgagtgtgcta

SEQ ID NO: 7463531 - DNA, 22 bp, Homo sapiens
tgtggcctagttaaggacgcct

SEQ ID NO: 7463532 - DNA, 22 bp, Homo sapiens
tgtggcccagatgagtgtgcta

SEQ ID NO: 7463533 - DNA, 20 bp, Homo sapiens
tgtggccatgttccaactca

SEQ ID NO: 7463534 - DNA, 20 bp, Homo sapiens
tgtggccatgttccaactca

SEQ ID NO: 7463535 - DNA, 22 bp, Homo sapiens
tgtggcccagatgagtgtgcta

SEQ ID NO: 7463536 - DNA, 22 bp, Homo sapiens
tgtggcccagatgagtgtgcta

SEQ ID NO: 7463537 - DNA, 22 bp, Homo sapiens
tgtggccattcttgaggtcgac

SEQ ID NO: 7463538 - DNA, 22 bp, Homo sapiens
tgtggcccagatgagtgtgcta

SEQ ID NO: 7463539 - DNA, 22 bp, Homo sapiens
tgtggccaggaaaaggagatgg

SEQ ID NO: 7463540 - DNA, 22 bp, Homo sapiens
tgtggccaggaaaaggagatgg

SEQ ID NO: 7463541 - DNA, 22 bp, Homo sapiens
tgtggccaggaaaaggagatgg

SEQ ID NO: 7463542 - DNA, 22 bp, Homo sapiens
tgtggccaggcccctgatggtg

SEQ ID NO: 7463543 - DNA, 22 bp, Homo sapiens
tgtggccaggaaaaggagatgg

SEQ ID NO: 7463544 - DNA, 22 bp, Homo sapiens
tgtggccagggggccatgtccc

SEQ ID NO: 7463545 - DNA, 22 bp, Homo sapiens
tgtggccagggggccatgtccc

SEQ ID NO: 7463546 - DNA, 22 bp, Homo sapiens
tgtggccaggcccctgatggtg

SEQ ID NO: 7463547 - DNA, 22 bp, Homo sapiens
tgtggccagccacaggcatggt

SEQ ID NO: 7463548 - DNA, 20 bp, Homo sapiens
tgtggccagctctctactgg

SEQ ID NO: 7463549 - DNA, 20 bp, Homo sapiens
tgtggccagctctctactgg

SEQ ID NO: 7463550 - DNA, 22 bp, Homo sapiens
tgtggccagccacaggcatggt

SEQ ID NO: 7463551 - DNA, 22 bp, Homo sapiens
tgtggccagccacaggcatggt

SEQ ID NO: 7463552 - DNA, 22 bp, Homo sapiens
tgtggcagctgctgcaggagct

SEQ ID NO: 7463553 - DNA, 18 bp, Homo sapiens
tgtggcaggggtgggaga

SEQ ID NO: 7463554 - DNA, 18 bp, Homo sapiens
tgtggcaggggtgggaga

SEQ ID NO: 7463555 - DNA, 18 bp, Homo sapiens
tgtggcaggggtgggaga

SEQ ID NO: 7463556 - DNA, 22 bp, Homo sapiens
tgtggcagtataagagctagaa

SEQ ID NO: 7463557 - DNA, 22 bp, Homo sapiens
tgtggcagtataagagctagaa

SEQ ID NO: 7463558 - DNA, 22 bp, Homo sapiens
tgtggcagtaaaattgggcaac

SEQ ID NO: 7463559 - DNA, 22 bp, Homo sapiens
tgtggcagtaaaattgggcaac

SEQ ID NO: 7463560 - DNA, 22 bp, Homo sapiens
tgtggcagtaaaattgggcaac

SEQ ID NO: 7463561 - DNA, 22 bp, Homo sapiens
tgtggcagtaaaattgggcaac

SEQ ID NO: 7463562 - DNA, 22 bp, Homo sapiens
tgtggcagtataagagctagaa

SEQ ID NO: 7463563 - DNA, 22 bp, Homo sapiens
tgtggcagtataagagctagaa

SEQ ID NO: 7463564 - DNA, 22 bp, Homo sapiens
tgtggcagtataagagctagaa

SEQ ID NO: 7463565 - DNA, 22 bp, Homo sapiens
tgtggcagtataagagctagaa

SEQ ID NO: 7463566 - DNA, 22 bp, Homo sapiens
tgtggcagtataagagctagaa

SEQ ID NO: 7463567 - DNA, 22 bp, Homo sapiens
tgtggcagtctcactggagggc

SEQ ID NO: 7463568 - DNA, 22 bp, Homo sapiens
tgtggcagtctcactggagggc

SEQ ID NO: 7463569 - DNA, 22 bp, Homo sapiens
tgtggcagtctcactggagggc

SEQ ID NO: 7463570 - DNA, 22 bp, Homo sapiens
tgtggcagtctcactggagggc

SEQ ID NO: 7463571 - DNA, 22 bp, Homo sapiens
tgtggcagtctcactggagggc

SEQ ID NO: 7463572 - DNA, 22 bp, Homo sapiens
tgtggcagtctcactggagggc

SEQ ID NO: 7463573 - DNA, 21 bp, Homo sapiens
tgtggcatcattgatctgtga

SEQ ID NO: 7463574 - DNA, 22 bp, Homo sapiens
tgtggccactgtttcttttcct

SEQ ID NO: 7463575 - DNA, 22 bp, Homo sapiens
tgtggccaccagagctgctatt

SEQ ID NO: 7463576 - DNA, 22 bp, Homo sapiens
tgtggccagaggtactatttta

SEQ ID NO: 7463577 - DNA, 22 bp, Homo sapiens
tgtggccagcaggtggctgtgt

SEQ ID NO: 7463578 - DNA, 22 bp, Homo sapiens
tgtggccaccagagctgctatt

SEQ ID NO: 7463579 - DNA, 22 bp, Homo sapiens
tgtggccaaaataaaatgaggt

SEQ ID NO: 7463580 - DNA, 22 bp, Homo sapiens
tgtggccaaaataaaatgaggt

SEQ ID NO: 7463581 - DNA, 22 bp, Homo sapiens
tgtggcattgaataaccttgga

SEQ ID NO: 7463582 - DNA, 22 bp, Homo sapiens
tgtgtgaactctctgatgtaca

SEQ ID NO: 7463583 - DNA, 22 bp, Homo sapiens
tgtgtgaacatgttttcatttc

SEQ ID NO: 7463584 - DNA, 22 bp, Homo sapiens
tgtgtgaagcacatgttcaagg

SEQ ID NO: 7463585 - DNA, 22 bp, Homo sapiens
tgtgtgaactctctgatgtaca

SEQ ID NO: 7463586 - DNA, 22 bp, Homo sapiens
tgtgtgaaggaatatatactca

SEQ ID NO: 7463587 - DNA, 22 bp, Homo sapiens
tgtgtgaaggaatatatactca

SEQ ID NO: 7463588 - DNA, 22 bp, Homo sapiens
tgtgtgaaggaatatatactca

SEQ ID NO: 7463589 - DNA, 22 bp, Homo sapiens
tgtgtgaaggaatatatactca

SEQ ID NO: 7463590 - DNA, 22 bp, Homo sapiens
tgtgtgaaggagccactgttca

SEQ ID NO: 7463591 - DNA, 22 bp, Homo sapiens
tgtgtgaagtgattttaagtct

SEQ ID NO: 7463592 - DNA, 22 bp, Homo sapiens
tgtgtgaaggagccactgttca

SEQ ID NO: 7463593 - DNA, 22 bp, Homo sapiens
tgtgtgaatggattattctatt

SEQ ID NO: 7463594 - DNA, 22 bp, Homo sapiens
tgtgtgaatggattattctatt

SEQ ID NO: 7463595 - DNA, 22 bp, Homo sapiens
tgtgtgaattacgcgtgtcctg

SEQ ID NO: 7463596 - DNA, 22 bp, Homo sapiens
tgtgtgaatggattattctatt

SEQ ID NO: 7463597 - DNA, 22 bp, Homo sapiens
tgtgtctgttttgctcaccatt

SEQ ID NO: 7463598 - DNA, 23 bp, Homo sapiens
tgtgtctgtttagggaggatgtg

SEQ ID NO: 7463599 - DNA, 22 bp, Homo sapiens
tgtgtcttaagttccaagacat

SEQ ID NO: 7463600 - DNA, 22 bp, Homo sapiens
tgtgtctgttttgctcaccatt

SEQ ID NO: 7463601 - DNA, 22 bp, Homo sapiens
tgtgtctgttttgctcaccatt

SEQ ID NO: 7463602 - DNA, 22 bp, Homo sapiens
tgtgtcttacataattacatgt

SEQ ID NO: 7463603 - DNA, 20 bp, Homo sapiens
tgtgtcttcctttctttatg

SEQ ID NO: 7463604 - DNA, 22 bp, Homo sapiens
tgtgtcttggccaccttgggaa

SEQ ID NO: 7463605 - DNA, 20 bp, Homo sapiens
tgtgtcttcctttctttatg

SEQ ID NO: 7463606 - DNA, 20 bp, Homo sapiens
tgtgtcttcctttctttatg

SEQ ID NO: 7463607 - DNA, 20 bp, Homo sapiens
tgtgtcttcctttctttatg

SEQ ID NO: 7463608 - DNA, 22 bp, Homo sapiens
tgtgtctttggcgatgtctgga

SEQ ID NO: 7463609 - DNA, 22 bp, Homo sapiens
tgtgtcttggccaccttgggaa

SEQ ID NO: 7463610 - DNA, 22 bp, Homo sapiens
tgtgtctttggcgatgtctgga

SEQ ID NO: 7463611 - DNA, 22 bp, Homo sapiens
tgtgtcttggccaccttgggaa

SEQ ID NO: 7463612 - DNA, 20 bp, Homo sapiens
tgtgtgaacacggactctgt

SEQ ID NO: 7463613 - DNA, 22 bp, Homo sapiens
tgtgtctttgttccaggtacga

SEQ ID NO: 7463614 - DNA, 22 bp, Homo sapiens
tgtgtctttgttccaggtacga

SEQ ID NO: 7463615 - DNA, 22 bp, Homo sapiens
tgtgtgaggtggttctgagaag

SEQ ID NO: 7463616 - DNA, 22 bp, Homo sapiens
tgtgtgagacaattggctgtgg

SEQ ID NO: 7463617 - DNA, 22 bp, Homo sapiens
tgtgtgacccccagtgaagcct

SEQ ID NO: 7463618 - DNA, 22 bp, Homo sapiens
tgtgtgacctggggtgagatag

SEQ ID NO: 7463619 - DNA, 20 bp, Homo sapiens
tgtgtgaatttcagagccgc

SEQ ID NO: 7463620 - DNA, 20 bp, Homo sapiens
tgtgtgaatttcagagccgc

SEQ ID NO: 7463621 - DNA, 22 bp, Homo sapiens
tgtgtgacacattgatatgtgc

SEQ ID NO: 7463622 - DNA, 22 bp, Homo sapiens
tgtgtgacacattgatatgtgc

SEQ ID NO: 7463623 - DNA, 22 bp, Homo sapiens
tgtgtgacctggggtgagatag

SEQ ID NO: 7463624 - DNA, 22 bp, Homo sapiens
tgtgtgagtaaggctgagagag

SEQ ID NO: 7463625 - DNA, 22 bp, Homo sapiens
tgtgtgagtaaggctgagagag

SEQ ID NO: 7463626 - DNA, 22 bp, Homo sapiens
tgtgtgaggtggttctgagaag

SEQ ID NO: 7463627 - DNA, 22 bp, Homo sapiens
tgtgtgaggtggttctgagaag

SEQ ID NO: 7463628 - DNA, 19 bp, Homo sapiens
tgtgtgcaaatggaagcca

SEQ ID NO: 7463629 - DNA, 22 bp, Homo sapiens
tgtgtgcaagtgacattagaaa

SEQ ID NO: 7463630 - DNA, 22 bp, Homo sapiens
tgtgtgcaagtgacattagaaa

SEQ ID NO: 7463631 - DNA, 22 bp, Homo sapiens
tgtgtgattgcaggagatgtgg

SEQ ID NO: 7463632 - DNA, 22 bp, Homo sapiens
tgtgtgattgcaggagatgtgg

SEQ ID NO: 7463633 - DNA, 22 bp, Homo sapiens
tgtgtgattgcaggagatgtgg

SEQ ID NO: 7463634 - DNA, 23 bp, Homo sapiens
tgtgtccttaactgtatatacta

SEQ ID NO: 7463635 - DNA, 22 bp, Homo sapiens
tgtgtctgttttgctcaccatt

SEQ ID NO: 7463636 - DNA, 22 bp, Homo sapiens
tgtgtcctttggaggatcagcg

SEQ ID NO: 7463637 - DNA, 22 bp, Homo sapiens
tgtgtcctttggaggatcagcg

SEQ ID NO: 7463638 - DNA, 22 bp, Homo sapiens
tgtgtctaaatggttccttaat

SEQ ID NO: 7463639 - DNA, 22 bp, Homo sapiens
tgtgtcctttctaatgcccaga

SEQ ID NO: 7463640 - DNA, 22 bp, Homo sapiens
tgtgtcctttctaatgcccaga

SEQ ID NO: 7463641 - DNA, 22 bp, Homo sapiens
tgtgtcctcatgtggcagagag

SEQ ID NO: 7463642 - DNA, 22 bp, Homo sapiens
tgtgtcctcatgtggcagagag

SEQ ID NO: 7463643 - DNA, 22 bp, Homo sapiens
tgtgtcctccagggagatgtaa

SEQ ID NO: 7463644 - DNA, 22 bp, Homo sapiens
tgtgtcctgcagacagactcag

SEQ ID NO: 7463645 - DNA, 22 bp, Homo sapiens
tgtgtcctgcagacagactcag

SEQ ID NO: 7463646 - DNA, 22 bp, Homo sapiens
tgtgtcctgtccccttgctgct

SEQ ID NO: 7463647 - DNA, 22 bp, Homo sapiens
tgtgtcctgtccccttgctgct

SEQ ID NO: 7463648 - DNA, 22 bp, Homo sapiens
tgtgtcctgcaggtgctgcctg

SEQ ID NO: 7463649 - DNA, 22 bp, Homo sapiens
tgtgtcctgcaggtgctgcctg

SEQ ID NO: 7463650 - DNA, 22 bp, Homo sapiens
tgtgtcctggtgttaattttat

SEQ ID NO: 7463651 - DNA, 22 bp, Homo sapiens
tgtgtcctgtccccttgctgct

SEQ ID NO: 7463652 - DNA, 22 bp, Homo sapiens
tgtgtccattcaggcactgacc

SEQ ID NO: 7463653 - DNA, 22 bp, Homo sapiens
tgtgtccattcaggcactgacc

SEQ ID NO: 7463654 - DNA, 22 bp, Homo sapiens
tgtgtcccttggaacctcagct

SEQ ID NO: 7463655 - DNA, 22 bp, Homo sapiens
tgtgtcctcagggaagcagaga

SEQ ID NO: 7463656 - DNA, 22 bp, Homo sapiens
tgtgtcctcatgaggtttgcag

SEQ ID NO: 7463657 - DNA, 19 bp, Homo sapiens
tgtgtcctagcagccagtc

SEQ ID NO: 7463658 - DNA, 22 bp, Homo sapiens
tgtgtcctcactgtatgcaagg

SEQ ID NO: 7463659 - DNA, 22 bp, Homo sapiens
tgtgtcctcactgtatgcaagg

SEQ ID NO: 7463660 - DNA, 22 bp, Homo sapiens
tgtgtcagcatcctttgggaca

SEQ ID NO: 7463661 - DNA, 22 bp, Homo sapiens
tgtgtcaggccttatcggtggc

SEQ ID NO: 7463662 - DNA, 21 bp, Homo sapiens
tgtgtcagtctttggaagcaa

SEQ ID NO: 7463663 - DNA, 22 bp, Homo sapiens
tgtgtcattgccatgaaaaggc

SEQ ID NO: 7463664 - DNA, 22 bp, Homo sapiens
tgtgtcatgtgtgaggctccct

SEQ ID NO: 7463665 - DNA, 22 bp, Homo sapiens
tgtgtcatctgtgttacataat

SEQ ID NO: 7463666 - DNA, 22 bp, Homo sapiens
tgtgtccaacccagggacaagt

SEQ ID NO: 7463667 - DNA, 22 bp, Homo sapiens
tgtgtccactgaatgtgtatta

SEQ ID NO: 7463668 - DNA, 22 bp, Homo sapiens
tgtgtccacgcactggcatgat

SEQ ID NO: 7463669 - DNA, 22 bp, Homo sapiens
tgtgtccatctgacaggagagg

SEQ ID NO: 7463670 - DNA, 22 bp, Homo sapiens
tgtgtccatctgacaggagagg

SEQ ID NO: 7463671 - DNA, 22 bp, Homo sapiens
tgtgtccatctgacaggagagg

SEQ ID NO: 7463672 - DNA, 20 bp, Homo sapiens
tgtgtccatcatctgggcac

SEQ ID NO: 7463673 - DNA, 20 bp, Homo sapiens
tgtgtccatcatctgggcac

SEQ ID NO: 7463674 - DNA, 22 bp, Homo sapiens
tgtggcctgattttgcatctct

SEQ ID NO: 7463675 - DNA, 23 bp, Homo sapiens
tgtggcctgcagctctggtttgg

SEQ ID NO: 7463676 - DNA, 22 bp, Homo sapiens
tgtggcctgattttgcatctct

SEQ ID NO: 7463677 - DNA, 22 bp, Homo sapiens
tgtggcctgattttgcatctct

SEQ ID NO: 7463678 - DNA, 22 bp, Homo sapiens
tgtggcctctcaggcttgatca

SEQ ID NO: 7463679 - DNA, 22 bp, Homo sapiens
tgtggcctggaaggggctgctc

SEQ ID NO: 7463680 - DNA, 22 bp, Homo sapiens
tgtggcctggaaggggctgctc

SEQ ID NO: 7463681 - DNA, 22 bp, Homo sapiens
tgtggcctggaaggggctgctc

SEQ ID NO: 7463682 - DNA, 22 bp, Homo sapiens
tgtggcctgggaaatgagtgtt

SEQ ID NO: 7463683 - DNA, 22 bp, Homo sapiens
tgtggcctgggagctgaggtct

SEQ ID NO: 7463684 - DNA, 22 bp, Homo sapiens
tgtggcctgggagctgaggtct

SEQ ID NO: 7463685 - DNA, 22 bp, Homo sapiens
tgtggcctgggagctgaggtct

SEQ ID NO: 7463686 - DNA, 22 bp, Homo sapiens
tgtggcctcaaggctgccctca

SEQ ID NO: 7463687 - DNA, 22 bp, Homo sapiens
tgtggcctcaaggctgccctca

SEQ ID NO: 7463688 - DNA, 22 bp, Homo sapiens
tgtggcctccccacttctgggg

SEQ ID NO: 7463689 - DNA, 22 bp, Homo sapiens
tgtggcctccccacttctgggg

SEQ ID NO: 7463690 - DNA, 22 bp, Homo sapiens
tgtggcctcctgttcctgggta

SEQ ID NO: 7463691 - DNA, 20 bp, Homo sapiens
tgtggcctctagagacagcc

SEQ ID NO: 7463692 - DNA, 22 bp, Homo sapiens
tgtggcctccccacttctgggg

SEQ ID NO: 7463693 - DNA, 22 bp, Homo sapiens
tgtggcctctaagctcacgaag

SEQ ID NO: 7463694 - DNA, 22 bp, Homo sapiens
tgtggcctctaagctcacgaag

SEQ ID NO: 7463695 - DNA, 22 bp, Homo sapiens
tgtggggaggctgcagtgctgc

SEQ ID NO: 7463696 - DNA, 22 bp, Homo sapiens
tgtggggaggctgcagtgctgc

SEQ ID NO: 7463697 - DNA, 22 bp, Homo sapiens
tgtggggaggctgcagtgctgc

SEQ ID NO: 7463698 - DNA, 22 bp, Homo sapiens
tgtggggaggctgcagtgctgc

SEQ ID NO: 7463699 - DNA, 22 bp, Homo sapiens
tgtggggactttcaaagccaat

SEQ ID NO: 7463700 - DNA, 19 bp, Homo sapiens
tgtggggagtcagggggct

SEQ ID NO: 7463701 - DNA, 22 bp, Homo sapiens
tgtggggaggctgcagtgctgc

SEQ ID NO: 7463702 - DNA, 19 bp, Homo sapiens
tgtggggagtcagggggct

SEQ ID NO: 7463703 - DNA, 19 bp, Homo sapiens
tgtggggagtcagggggct

SEQ ID NO: 7463704 - DNA, 19 bp, Homo sapiens
tgtggggagtcagggggct

SEQ ID NO: 7463705 - DNA, 22 bp, Homo sapiens
tgtggggactttcaaagccaat

SEQ ID NO: 7463706 - DNA, 22 bp, Homo sapiens
tgtggggactttcaaagccaat

SEQ ID NO: 7463707 - DNA, 22 bp, Homo sapiens
tgtggggactttcaaagccaat

SEQ ID NO: 7463708 - DNA, 17 bp, Homo sapiens
tgtggccttctgagctt

SEQ ID NO: 7463709 - DNA, 22 bp, Homo sapiens
tgtggggactgagtggaggctt

SEQ ID NO: 7463710 - DNA, 17 bp, Homo sapiens
tgtggccttctgagctt

SEQ ID NO: 7463711 - DNA, 19 bp, Homo sapiens
tgtggcctggggacaggcc

SEQ ID NO: 7463712 - DNA, 19 bp, Homo sapiens
tgtggcctggggacaggcc

SEQ ID NO: 7463713 - DNA, 19 bp, Homo sapiens
tgtggcctggggacaggcc

SEQ ID NO: 7463714 - DNA, 22 bp, Homo sapiens
tgtgggtgttctcacttagata

SEQ ID NO: 7463715 - DNA, 22 bp, Homo sapiens
tgtggtcccaaggcaactggaa

SEQ ID NO: 7463716 - DNA, 22 bp, Homo sapiens
tgtggtcccaaggcaactggaa

SEQ ID NO: 7463717 - DNA, 22 bp, Homo sapiens
tgtggtagtctcagggcagtat

SEQ ID NO: 7463718 - DNA, 22 bp, Homo sapiens
tgtggtagagggcagatgggca

SEQ ID NO: 7463719 - DNA, 22 bp, Homo sapiens
tgtggtagagggcagatgggca

SEQ ID NO: 7463720 - DNA, 18 bp, Homo sapiens
tgtgggttgggcagacca

SEQ ID NO: 7463721 - DNA, 22 bp, Homo sapiens
tgtgggtttaagaggcagcatg

SEQ ID NO: 7463722 - DNA, 22 bp, Homo sapiens
tgtgggtttaagaggcagcatg

SEQ ID NO: 7463723 - DNA, 22 bp, Homo sapiens
tgtggtagagggcagatgggca

SEQ ID NO: 7463724 - DNA, 22 bp, Homo sapiens
tgtgggtggtaaaatacaatga

SEQ ID NO: 7463725 - DNA, 22 bp, Homo sapiens
tgtgggtgttctcacttagata

SEQ ID NO: 7463726 - DNA, 22 bp, Homo sapiens
tgtgggtggcatcgtcctggcc

SEQ ID NO: 7463727 - DNA, 22 bp, Homo sapiens
tgtgggtggcatcgtcctggcc

SEQ ID NO: 7463728 - DNA, 22 bp, Homo sapiens
tgtgggtggcatcgtcctggcc

SEQ ID NO: 7463729 - DNA, 22 bp, Homo sapiens
tgtgggtggcatcgtcctggcc

SEQ ID NO: 7463730 - DNA, 22 bp, Homo sapiens
tgtgggtggtaaaatacaatga

SEQ ID NO: 7463731 - DNA, 22 bp, Homo sapiens
tgtgggtggagtgatattagct

SEQ ID NO: 7463732 - DNA, 22 bp, Homo sapiens
tgtgggtggcatcgtcctggcc

SEQ ID NO: 7463733 - DNA, 22 bp, Homo sapiens
tgtgggtggagtgatattagct

SEQ ID NO: 7463734 - DNA, 22 bp, Homo sapiens
tgtgggtgctcagagtaccccc

SEQ ID NO: 7463735 - DNA, 19 bp, Homo sapiens
tgtggggagtcagggggct

SEQ ID NO: 7463736 - DNA, 19 bp, Homo sapiens
tgtggggagtcagggggct

SEQ ID NO: 7463737 - DNA, 19 bp, Homo sapiens
tgtggggagtcagggggct

SEQ ID NO: 7463738 - DNA, 22 bp, Homo sapiens
tgtggtctggccattcagggac

SEQ ID NO: 7463739 - DNA, 19 bp, Homo sapiens
tgtggtctctgttctcagg

SEQ ID NO: 7463740 - DNA, 22 bp, Homo sapiens
tgtggtcctctcaactgaaggt

SEQ ID NO: 7463741 - DNA, 22 bp, Homo sapiens
tgtggtctccccagtgccagct

SEQ ID NO: 7463742 - DNA, 22 bp, Homo sapiens
tgtggtctccccagtgccagct

SEQ ID NO: 7463743 - DNA, 22 bp, Homo sapiens
tgtggtctccccagtgccagct

SEQ ID NO: 7463744 - DNA, 22 bp, Homo sapiens
tgtggtcctggggagacatgaa

SEQ ID NO: 7463745 - DNA, 22 bp, Homo sapiens
tgtggtgccgagagtctggacg

SEQ ID NO: 7463746 - DNA, 22 bp, Homo sapiens
tgtggtgagaaactggtagatt

SEQ ID NO: 7463747 - DNA, 21 bp, Homo sapiens
tgtggtcttttagttccatca

SEQ ID NO: 7463748 - DNA, 21 bp, Homo sapiens
tgtggtcttttagttccatca

SEQ ID NO: 7463749 - DNA, 22 bp, Homo sapiens
tgtggtgccgagagtctggacg

SEQ ID NO: 7463750 - DNA, 18 bp, Homo sapiens
tgtggtggagctgccttc

SEQ ID NO: 7463751 - DNA, 22 bp, Homo sapiens
tgtggtgccgagagtctggacg

SEQ ID NO: 7463752 - DNA, 18 bp, Homo sapiens
tgtggtggagctgccttc

SEQ ID NO: 7463753 - DNA, 18 bp, Homo sapiens
tgtggtggagctgccttc

SEQ ID NO: 7463754 - DNA, 22 bp, Homo sapiens
tgtgtcagcaggggagggaact

SEQ ID NO: 7463755 - DNA, 22 bp, Homo sapiens
tgtgtcagcacagtatcaatta

SEQ ID NO: 7463756 - DNA, 22 bp, Homo sapiens
tgtgtcagcaggggagggaact

SEQ ID NO: 7463757 - DNA, 19 bp, Homo sapiens
tgtgtcagcagggggcttc

SEQ ID NO: 7463758 - DNA, 22 bp, Homo sapiens
tgtgtcaggagatagcaaaggg

SEQ ID NO: 7463759 - DNA, 22 bp, Homo sapiens
tgtgtcaggagatagcaaaggg

SEQ ID NO: 7463760 - DNA, 22 bp, Homo sapiens
tgtgtacaaactaacaacatat

SEQ ID NO: 7463761 - DNA, 22 bp, Homo sapiens
tgtgtacaaactaacaacatat

SEQ ID NO: 7463762 - DNA, 21 bp, Homo sapiens
tgtgtaattttttaaatggcc

SEQ ID NO: 7463763 - DNA, 22 bp, Homo sapiens
tgtgtacaaactaacaacatat

SEQ ID NO: 7463764 - DNA, 22 bp, Homo sapiens
tgtgtacaaactaacaacatat

SEQ ID NO: 7463765 - DNA, 22 bp, Homo sapiens
tgtgtacaaactaacaacatat

SEQ ID NO: 7463766 - DNA, 19 bp, Homo sapiens
tgtgtcagatttgctcctt

SEQ ID NO: 7463767 - DNA, 21 bp, Homo sapiens
tgtgtaattggccaaatgcac

SEQ ID NO: 7463768 - DNA, 22 bp, Homo sapiens
tgtgtcagatttaggctcaaac

SEQ ID NO: 7463769 - DNA, 22 bp, Homo sapiens
tgtgtaagtgccaggcacaagt

SEQ ID NO: 7463770 - DNA, 21 bp, Homo sapiens
tgtgtaatatgtataagaata

SEQ ID NO: 7463771 - DNA, 22 bp, Homo sapiens
tgtgtaattatagggagatcta

SEQ ID NO: 7463772 - DNA, 22 bp, Homo sapiens
tgtgtaatgaatagctttactg

SEQ ID NO: 7463773 - DNA, 21 bp, Homo sapiens
tgtgtaatatgtataagaata

SEQ ID NO: 7463774 - DNA, 22 bp, Homo sapiens
tgtgtaaatttatttacataaa

SEQ ID NO: 7463775 - DNA, 22 bp, Homo sapiens
tgtgtaaatttatttacataaa

SEQ ID NO: 7463776 - DNA, 22 bp, Homo sapiens
tgtgtaaattatttttaatgat

SEQ ID NO: 7463777 - DNA, 22 bp, Homo sapiens
tgtgtaaattatttttaatgat

SEQ ID NO: 7463778 - DNA, 22 bp, Homo sapiens
tgtgtaaatggcatctctcagc

SEQ ID NO: 7463779 - DNA, 22 bp, Homo sapiens
tgtgtaaattatttttaatgat

SEQ ID NO: 7463780 - DNA, 22 bp, Homo sapiens
tgtgtaaatttatttacataaa

SEQ ID NO: 7463781 - DNA, 22 bp, Homo sapiens
tgtgtaaatttatttacataaa

SEQ ID NO: 7463782 - DNA, 22 bp, Homo sapiens
tgtgtaaatttatttacataaa

SEQ ID NO: 7463783 - DNA, 22 bp, Homo sapiens
tgtgtaaatttatttacataaa

SEQ ID NO: 7463784 - DNA, 22 bp, Homo sapiens
tgtgtaaatttatttacataaa

SEQ ID NO: 7463785 - DNA, 22 bp, Homo sapiens
tgtgtaaatggcatctctcagc

SEQ ID NO: 7463786 - DNA, 22 bp, Homo sapiens
tgtgtaaatggcatctctcagc

SEQ ID NO: 7463787 - DNA, 22 bp, Homo sapiens
tgtgtaaatggactgtgaatta

SEQ ID NO: 7463788 - DNA, 22 bp, Homo sapiens
tgtggtggtaatgagccagatg

SEQ ID NO: 7463789 - DNA, 22 bp, Homo sapiens
tgtggtggtaatgagccagatg

SEQ ID NO: 7463790 - DNA, 22 bp, Homo sapiens
tgtggtggggtctggtattcca

SEQ ID NO: 7463791 - DNA, 22 bp, Homo sapiens
tgtggtggctattctggtctca

SEQ ID NO: 7463792 - DNA, 22 bp, Homo sapiens
tgtggtggggtctggtattcca

SEQ ID NO: 7463793 - DNA, 22 bp, Homo sapiens
tgtggtggctattctggtctca

SEQ ID NO: 7463794 - DNA, 22 bp, Homo sapiens
tgtggtggctattctggtctca

SEQ ID NO: 7463795 - DNA, 18 bp, Homo sapiens
tgtggtggagctgccttc

SEQ ID NO: 7463796 - DNA, 22 bp, Homo sapiens
tgtggtggctattctggtctca

SEQ ID NO: 7463797 - DNA, 22 bp, Homo sapiens
tgtggtgtatcaggaagccaat

SEQ ID NO: 7463798 - DNA, 22 bp, Homo sapiens
tgtggtggtaatgagccagatg

SEQ ID NO: 7463799 - DNA, 22 bp, Homo sapiens
tgtggtggtaatgagccagatg

SEQ ID NO: 7463800 - DNA, 22 bp, Homo sapiens
tgtggtttttcagttgctggag

SEQ ID NO: 7463801 - DNA, 22 bp, Homo sapiens
tgtggttttggttcagaaacaa

SEQ ID NO: 7463802 - DNA, 19 bp, Homo sapiens
tgtggtttcccggcggcct

SEQ ID NO: 7463803 - DNA, 22 bp, Homo sapiens
tgtggttttggttcagaaacaa

SEQ ID NO: 7463804 - DNA, 22 bp, Homo sapiens
tgtggttttggttcagaaacaa

SEQ ID NO: 7463805 - DNA, 22 bp, Homo sapiens
tgtggttttggttcagaaacaa

SEQ ID NO: 7463806 - DNA, 22 bp, Homo sapiens
tgtggtttactgtggcgctgct

SEQ ID NO: 7463807 - DNA, 22 bp, Homo sapiens
tgtggttggaatgcagccatgc

SEQ ID NO: 7463808 - DNA, 22 bp, Homo sapiens
tgtggttggaatgcagccatgc

SEQ ID NO: 7463809 - DNA, 22 bp, Homo sapiens
tgtgtaaaatctgattaatact

SEQ ID NO: 7463810 - DNA, 22 bp, Homo sapiens
tgtgtaaaatctgattaatact

SEQ ID NO: 7463811 - DNA, 22 bp, Homo sapiens
tgtgtaaaatctgattaatact

SEQ ID NO: 7463812 - DNA, 20 bp, Homo sapiens
tgtggtttttgccagttgaa

SEQ ID NO: 7463813 - DNA, 20 bp, Homo sapiens
tgtggtttttgccagttgaa

SEQ ID NO: 7463814 - DNA, 20 bp, Homo sapiens
tgtggtttttgccagttgaa

SEQ ID NO: 7463815 - DNA, 22 bp, Homo sapiens
tgtgtaaaatctgattaatact

SEQ ID NO: 7463816 - DNA, 22 bp, Homo sapiens
tgtgtaaaatctgattaatact

SEQ ID NO: 7463817 - DNA, 22 bp, Homo sapiens
tgtgtaaaagattagtttacta

SEQ ID NO: 7463818 - DNA, 22 bp, Homo sapiens
tgtgtaaaagattagtttacta

SEQ ID NO: 7463819 - DNA, 21 bp, Homo sapiens
tgtgtaaagttgaaatcctgt

SEQ ID NO: 7463820 - DNA, 19 bp, Homo sapiens
tgtgtaaagtctgtggtca

SEQ ID NO: 7463821 - DNA, 22 bp, Homo sapiens
tgtgtaaatggactgtgaatta

SEQ ID NO: 7463822 - DNA, 21 bp, Homo sapiens
tgtgtaaagttgaaatcctgt

SEQ ID NO: 7463823 - DNA, 21 bp, Homo sapiens
tgtgtaaagttgaaatcctgt

SEQ ID NO: 7463824 - DNA, 22 bp, Homo sapiens
tgtgtaaagcttgttccagaaa

SEQ ID NO: 7463825 - DNA, 22 bp, Homo sapiens
tgtgtaaagcttgttccagaaa

SEQ ID NO: 7463826 - DNA, 22 bp, Homo sapiens
tgtgtaaaatctgattaatact

SEQ ID NO: 7463827 - DNA, 22 bp, Homo sapiens
tgtgtaaaatgagcctaaagtc

SEQ ID NO: 7463828 - DNA, 22 bp, Homo sapiens
tgtgtaaaatgagcctaaagtc

SEQ ID NO: 7463829 - DNA, 22 bp, Homo sapiens
tgttccttcacagcagtggaca

SEQ ID NO: 7463830 - DNA, 22 bp, Homo sapiens
tgttccttcacagcagtggaca

SEQ ID NO: 7463831 - DNA, 22 bp, Homo sapiens
tgttcctgtttaatgtgctcat

SEQ ID NO: 7463832 - DNA, 21 bp, Homo sapiens
tgttcctgttctctaggatcc

SEQ ID NO: 7463833 - DNA, 21 bp, Homo sapiens
tgttcctgttctctaggatcc

SEQ ID NO: 7463834 - DNA, 22 bp, Homo sapiens
tgttcctgtactgctgtggctt

SEQ ID NO: 7463835 - DNA, 23 bp, Homo sapiens
tgttcctgtcaaattttcttccc

SEQ ID NO: 7463836 - DNA, 22 bp, Homo sapiens
tgttctaagctgccaaaatgct

SEQ ID NO: 7463837 - DNA, 22 bp, Homo sapiens
tgttctaagctgccaaaatgct

SEQ ID NO: 7463838 - DNA, 22 bp, Homo sapiens
tgttctaagtgttttgttcatg

SEQ ID NO: 7463839 - DNA, 22 bp, Homo sapiens
tgttctaagctgccaaaatgct

SEQ ID NO: 7463840 - DNA, 22 bp, Homo sapiens
tgttctaagctgccaaaatgct

SEQ ID NO: 7463841 - DNA, 22 bp, Homo sapiens
tgttccttttactgcatgcgta

SEQ ID NO: 7463842 - DNA, 22 bp, Homo sapiens
tgttccttttaaatgagtcagt

SEQ ID NO: 7463843 - DNA, 22 bp, Homo sapiens
tgttccttttaaatgagtcagt

SEQ ID NO: 7463844 - DNA, 22 bp, Homo sapiens
tgttctcactggatgcttcaca

SEQ ID NO: 7463845 - DNA, 22 bp, Homo sapiens
tgttctcactggatgcttcaca

SEQ ID NO: 7463846 - DNA, 22 bp, Homo sapiens
tgttctatgctctttaaggtga

SEQ ID NO: 7463847 - DNA, 22 bp, Homo sapiens
tgttctcactggatgcttcaca

SEQ ID NO: 7463848 - DNA, 22 bp, Homo sapiens
tgttctcactggatgcttcaca

SEQ ID NO: 7463849 - DNA, 19 bp, Homo sapiens
tgttctagcggcaccaggc

SEQ ID NO: 7463850 - DNA, 22 bp, Homo sapiens
tgttctaggcaaaagctgattt

SEQ ID NO: 7463851 - DNA, 22 bp, Homo sapiens
tgttctatcaatttaagggaaa

SEQ ID NO: 7463852 - DNA, 22 bp, Homo sapiens
tgttctatcaatttaagggaaa

SEQ ID NO: 7463853 - DNA, 22 bp, Homo sapiens
tgttctctctccttttgaagtg

SEQ ID NO: 7463854 - DNA, 22 bp, Homo sapiens
tgttctctaagaaaagaagcat

SEQ ID NO: 7463855 - DNA, 22 bp, Homo sapiens
tgttctctaagaaaagaagcat

SEQ ID NO: 7463856 - DNA, 22 bp, Homo sapiens
tgttctcattgttttcatccag

SEQ ID NO: 7463857 - DNA, 22 bp, Homo sapiens
tgttctcatctggatctcagga

SEQ ID NO: 7463858 - DNA, 22 bp, Homo sapiens
tgttctcatctggatctcagga

SEQ ID NO: 7463859 - DNA, 22 bp, Homo sapiens
tgttctcagtaattctatttta

SEQ ID NO: 7463860 - DNA, 22 bp, Homo sapiens
tgttctcagtaattctatttta

SEQ ID NO: 7463861 - DNA, 22 bp, Homo sapiens
tgttctcagtaattctatttta

SEQ ID NO: 7463862 - DNA, 22 bp, Homo sapiens
tgttctgcaatgctgcctcctt

SEQ ID NO: 7463863 - DNA, 22 bp, Homo sapiens
tgttctgccagcacttctcagc

SEQ ID NO: 7463864 - DNA, 22 bp, Homo sapiens
tgttctggagataagaggtaga

SEQ ID NO: 7463865 - DNA, 22 bp, Homo sapiens
tgttctggagataagaggtaga

SEQ ID NO: 7463866 - DNA, 22 bp, Homo sapiens
tgttctcttttcctgctgagcc

SEQ ID NO: 7463867 - DNA, 22 bp, Homo sapiens
tgttctcttttcctgctgagcc

SEQ ID NO: 7463868 - DNA, 22 bp, Homo sapiens
tgttctgagtgcagcttaataa

SEQ ID NO: 7463869 - DNA, 22 bp, Homo sapiens
tgttctgcaagccctgccacct

SEQ ID NO: 7463870 - DNA, 22 bp, Homo sapiens
tgttctctctggctgccagtac

SEQ ID NO: 7463871 - DNA, 22 bp, Homo sapiens
tgttctctctccttttgaagtg

SEQ ID NO: 7463872 - DNA, 22 bp, Homo sapiens
tgttctctaagccacccatttt

SEQ ID NO: 7463873 - DNA, 22 bp, Homo sapiens
tgttctcttccacggcgctcgg

SEQ ID NO: 7463874 - DNA, 22 bp, Homo sapiens
tgttctcttttcctgctgagcc

SEQ ID NO: 7463875 - DNA, 22 bp, Homo sapiens
tgttctgtgcatctagccagta

SEQ ID NO: 7463876 - DNA, 22 bp, Homo sapiens
tgttctgtgcatctagccagta

SEQ ID NO: 7463877 - DNA, 22 bp, Homo sapiens
tgttctgtgcatctagccagta

SEQ ID NO: 7463878 - DNA, 20 bp, Homo sapiens
tgttctgtcgtctttcttca

SEQ ID NO: 7463879 - DNA, 20 bp, Homo sapiens
tgttctgtcgtctttcttca

SEQ ID NO: 7463880 - DNA, 17 bp, Homo sapiens
tgttctgttggaaagca

SEQ ID NO: 7463881 - DNA, 22 bp, Homo sapiens
tgttctgtgcatctagccagta

SEQ ID NO: 7463882 - DNA, 22 bp, Homo sapiens
tgttctgtgcatctagccagta

SEQ ID NO: 7463883 - DNA, 22 bp, Homo sapiens
tgtttaagtagtctcagggcct

SEQ ID NO: 7463884 - DNA, 22 bp, Homo sapiens
tgtttaagtagtctcagggcct

SEQ ID NO: 7463885 - DNA, 21 bp, Homo sapiens
tgtttaagtactcctttctgg

SEQ ID NO: 7463886 - DNA, 22 bp, Homo sapiens
tgtttaataattctatgatagt

SEQ ID NO: 7463887 - DNA, 22 bp, Homo sapiens
tgtttaagtgctggtagggttg

SEQ ID NO: 7463888 - DNA, 22 bp, Homo sapiens
tgtttaagttctgctccttatt

SEQ ID NO: 7463889 - DNA, 22 bp, Homo sapiens
tgttctggggttgagagacaat

SEQ ID NO: 7463890 - DNA, 22 bp, Homo sapiens
tgttctggggttgagagacaat

SEQ ID NO: 7463891 - DNA, 22 bp, Homo sapiens
tgttctggggttgagagacaat

SEQ ID NO: 7463892 - DNA, 22 bp, Homo sapiens
tgttctggggttgagagacaat

SEQ ID NO: 7463893 - DNA, 22 bp, Homo sapiens
tgttctggctccttttaaatgt

SEQ ID NO: 7463894 - DNA, 22 bp, Homo sapiens
tgttctggagataagaggtaga

SEQ ID NO: 7463895 - DNA, 22 bp, Homo sapiens
tgttctggctccttttaaatgt

SEQ ID NO: 7463896 - DNA, 22 bp, Homo sapiens
tgttctggggacagcgtcccat

SEQ ID NO: 7463897 - DNA, 22 bp, Homo sapiens
tgttctggggacagcgtcccat

SEQ ID NO: 7463898 - DNA, 22 bp, Homo sapiens
tgttctggggttgagagacaat

SEQ ID NO: 7463899 - DNA, 22 bp, Homo sapiens
tgttctggggttgagagacaat

SEQ ID NO: 7463900 - DNA, 22 bp, Homo sapiens
tgttctggtgaggccatggggt

SEQ ID NO: 7463901 - DNA, 22 bp, Homo sapiens
tgttctgtacctgtcctggggc

SEQ ID NO: 7463902 - DNA, 22 bp, Homo sapiens
tgtttaataattctatgatagt

SEQ ID NO: 7463903 - DNA, 22 bp, Homo sapiens
tgtttaataattctatgatagt

SEQ ID NO: 7463904 - DNA, 21 bp, Homo sapiens
tgtttaatacatatttgtgga

SEQ ID NO: 7463905 - DNA, 21 bp, Homo sapiens
tgtttaatacatatttgtgga

SEQ ID NO: 7463906 - DNA, 21 bp, Homo sapiens
tgtttaatacatatttgtgga

SEQ ID NO: 7463907 - DNA, 21 bp, Homo sapiens
tgtttaatacatatttgtgga

SEQ ID NO: 7463908 - DNA, 21 bp, Homo sapiens
tgtttaatacatatttgtgga

SEQ ID NO: 7463909 - DNA, 22 bp, Homo sapiens
tgtttaatctataaaatggaga

SEQ ID NO: 7463910 - DNA, 22 bp, Homo sapiens
tgtttaatctataaaatggaga

SEQ ID NO: 7463911 - DNA, 22 bp, Homo sapiens
tgtttaatctataaaatggaga

SEQ ID NO: 7463912 - DNA, 22 bp, Homo sapiens
tgtttaatctataaaatggaga

SEQ ID NO: 7463913 - DNA, 22 bp, Homo sapiens
tgtttaatctataaaatggaga

SEQ ID NO: 7463914 - DNA, 22 bp, Homo sapiens
tgtttaatcttcaggacagtct

SEQ ID NO: 7463915 - DNA, 22 bp, Homo sapiens
tgtttaatcttcaggacagtct

SEQ ID NO: 7463916 - DNA, 22 bp, Homo sapiens
tgtttaatcttcaggacagtct

SEQ ID NO: 7463917 - DNA, 22 bp, Homo sapiens
tgtttaatgaagatggtttttc

SEQ ID NO: 7463918 - DNA, 22 bp, Homo sapiens
tgtttaatcttcaggacagtct

SEQ ID NO: 7463919 - DNA, 22 bp, Homo sapiens
tgtttaatgaagatggtttttc

SEQ ID NO: 7463920 - DNA, 22 bp, Homo sapiens
tgtttaattcaccatcatgttc

SEQ ID NO: 7463921 - DNA, 22 bp, Homo sapiens
tgtttaattcaccatcatgttc

SEQ ID NO: 7463922 - DNA, 22 bp, Homo sapiens
tgtttaattcaccatcatgttc

SEQ ID NO: 7463923 - DNA, 22 bp, Homo sapiens
tgtttaattcaccatcatgttc

SEQ ID NO: 7463924 - DNA, 22 bp, Homo sapiens
tgtttaattcaccatcatgttc

SEQ ID NO: 7463925 - DNA, 22 bp, Homo sapiens
tgtttaattcaccatcatgttc

SEQ ID NO: 7463926 - DNA, 22 bp, Homo sapiens
tgtttaattcaccatcatgttc

SEQ ID NO: 7463927 - DNA, 22 bp, Homo sapiens
tgtttaattcaccatcatgttc

SEQ ID NO: 7463928 - DNA, 22 bp, Homo sapiens
tgtttaattcaccatcatgttc

SEQ ID NO: 7463929 - DNA, 22 bp, Homo sapiens
tgtttaatgcattgaccttggg

SEQ ID NO: 7463930 - DNA, 22 bp, Homo sapiens
tgtttaatgcattgaccttggg

SEQ ID NO: 7463931 - DNA, 22 bp, Homo sapiens
tgtttaatttcacaaagttgac

SEQ ID NO: 7463932 - DNA, 22 bp, Homo sapiens
tgtttaatttttcatgagccaa

SEQ ID NO: 7463933 - DNA, 22 bp, Homo sapiens
tgtttaatttcacaaagttgac

SEQ ID NO: 7463934 - DNA, 22 bp, Homo sapiens
tgtttaatttcacaaagttgac

SEQ ID NO: 7463935 - DNA, 22 bp, Homo sapiens
tgtttaattgggccaacagcgg

SEQ ID NO: 7463936 - DNA, 22 bp, Homo sapiens
tgtttaatttcacaaagttgac

SEQ ID NO: 7463937 - DNA, 22 bp, Homo sapiens
tgtttaatttcacaaagttgac

SEQ ID NO: 7463938 - DNA, 22 bp, Homo sapiens
tgtttaattgggccaacagcgg

SEQ ID NO: 7463939 - DNA, 22 bp, Homo sapiens
tgtttaattgggccaacagcgg

SEQ ID NO: 7463940 - DNA, 22 bp, Homo sapiens
tgtttacaaaaccgtggtactg

SEQ ID NO: 7463941 - DNA, 22 bp, Homo sapiens
tgtttacaaaaccgtggtactg

SEQ ID NO: 7463942 - DNA, 22 bp, Homo sapiens
tgtttacaagccacttgttaag

SEQ ID NO: 7463943 - DNA, 22 bp, Homo sapiens
tgtttacaagccacttgttaag

SEQ ID NO: 7463944 - DNA, 22 bp, Homo sapiens
tgtttacaagccacttgttaag

SEQ ID NO: 7463945 - DNA, 22 bp, Homo sapiens
tgtttacaaaaccgtggtactg

SEQ ID NO: 7463946 - DNA, 22 bp, Homo sapiens
tgtttaatttttcatgagccaa

SEQ ID NO: 7463947 - DNA, 22 bp, Homo sapiens
tgtttacaaggagaatttgagg

SEQ ID NO: 7463948 - DNA, 22 bp, Homo sapiens
tgtttacaaggagaatttgagg

SEQ ID NO: 7463949 - DNA, 22 bp, Homo sapiens
tgtttacaagccacttgttaag

SEQ ID NO: 7463950 - DNA, 22 bp, Homo sapiens
tgtttacaagccacttgttaag

SEQ ID NO: 7463951 - DNA, 22 bp, Homo sapiens
tgtttacaaggagaatttgagg

SEQ ID NO: 7463952 - DNA, 22 bp, Homo sapiens
tgtttacaaggagaatttgagg

SEQ ID NO: 7463953 - DNA, 22 bp, Homo sapiens
tgtttacaaggagaatttgagg

SEQ ID NO: 7463954 - DNA, 22 bp, Homo sapiens
tgtttacaaggagaatttgagg

SEQ ID NO: 7463955 - DNA, 22 bp, Homo sapiens
tgtttacaaggagtttatattg

SEQ ID NO: 7463956 - DNA, 22 bp, Homo sapiens
tgtttacaaggagtttatattg

SEQ ID NO: 7463957 - DNA, 22 bp, Homo sapiens
tgtttacaaggagtttatattg

SEQ ID NO: 7463958 - DNA, 22 bp, Homo sapiens
tgtttacaaggagtttatattg

SEQ ID NO: 7463959 - DNA, 22 bp, Homo sapiens
tgtttacaaggagtttatattg

SEQ ID NO: 7463960 - DNA, 22 bp, Homo sapiens
tgtttacaaggagaatttgagg

SEQ ID NO: 7463961 - DNA, 22 bp, Homo sapiens
tgtttacaaggagaatttgagg

SEQ ID NO: 7463962 - DNA, 22 bp, Homo sapiens
tgtttacaaggagtttatattg

SEQ ID NO: 7463963 - DNA, 22 bp, Homo sapiens
tgtttacaaggagtttatattg

SEQ ID NO: 7463964 - DNA, 22 bp, Homo sapiens
tgtttacaaggagtttatattg

SEQ ID NO: 7463965 - DNA, 22 bp, Homo sapiens
tgtttacacaatagtctctctc

SEQ ID NO: 7463966 - DNA, 22 bp, Homo sapiens
tgtttacacaatagtctctctc

SEQ ID NO: 7463967 - DNA, 22 bp, Homo sapiens
tgtttacagcactgcacactgc

SEQ ID NO: 7463968 - DNA, 22 bp, Homo sapiens
tgtttacagcactgcacactgc

SEQ ID NO: 7463969 - DNA, 22 bp, Homo sapiens
tgtttacagcactgcacactgc

SEQ ID NO: 7463970 - DNA, 22 bp, Homo sapiens
tgtttacagctgatcaggcatc

SEQ ID NO: 7463971 - DNA, 22 bp, Homo sapiens
tgtttacagctgatcaggcatc

SEQ ID NO: 7463972 - DNA, 22 bp, Homo sapiens
tgtttacagaaggcagacttcc

SEQ ID NO: 7463973 - DNA, 22 bp, Homo sapiens
tgtttacagaaggcagacttcc

SEQ ID NO: 7463974 - DNA, 22 bp, Homo sapiens
tgtttacagaaggcagacttcc

SEQ ID NO: 7463975 - DNA, 22 bp, Homo sapiens
tgtttacagaaggcagacttcc

SEQ ID NO: 7463976 - DNA, 22 bp, Homo sapiens
tgtttacacttcaaggttaagg

SEQ ID NO: 7463977 - DNA, 22 bp, Homo sapiens
tgtttacacttcaaggttaagg

SEQ ID NO: 7463978 - DNA, 22 bp, Homo sapiens
tgtttacacttcaaggttaagg

SEQ ID NO: 7463979 - DNA, 22 bp, Homo sapiens
tgtttacacttcaaggttaagg

SEQ ID NO: 7463980 - DNA, 22 bp, Homo sapiens
tgtttacacttcaaggttaagg

SEQ ID NO: 7463981 - DNA, 22 bp, Homo sapiens
tgtttacacttcaaggttaagg

SEQ ID NO: 7463982 - DNA, 22 bp, Homo sapiens
tgtttacacttcaaggttaagg

SEQ ID NO: 7463983 - DNA, 22 bp, Homo sapiens
tgtttacagggtgattttacct

SEQ ID NO: 7463984 - DNA, 22 bp, Homo sapiens
tgtttacagggtgattttacct

SEQ ID NO: 7463985 - DNA, 22 bp, Homo sapiens
tgtttacagggtgattttacct

SEQ ID NO: 7463986 - DNA, 22 bp, Homo sapiens
tgtttacagggtgattttacct

SEQ ID NO: 7463987 - DNA, 22 bp, Homo sapiens
tgtttacagggtgattttacct

SEQ ID NO: 7463988 - DNA, 22 bp, Homo sapiens
tgtttacagggtgattttacct

SEQ ID NO: 7463989 - DNA, 22 bp, Homo sapiens
tgtttacagctgatcaggcatc

SEQ ID NO: 7463990 - DNA, 22 bp, Homo sapiens
tgtttacagctgatcaggcatc

SEQ ID NO: 7463991 - DNA, 22 bp, Homo sapiens
tgtttacagctgatcaggcatc

SEQ ID NO: 7463992 - DNA, 22 bp, Homo sapiens
tgtttacagggtgattttacct

SEQ ID NO: 7463993 - DNA, 22 bp, Homo sapiens
tgtttacagggtgattttacct

SEQ ID NO: 7463994 - DNA, 22 bp, Homo sapiens
tgtttacagtttttagtaccct

SEQ ID NO: 7463995 - DNA, 22 bp, Homo sapiens
tgtttacagtttttagtaccct

SEQ ID NO: 7463996 - DNA, 22 bp, Homo sapiens
tgtttccaaagtcttttcttaa

SEQ ID NO: 7463997 - DNA, 22 bp, Homo sapiens
tgtttcatgtggacatagttgt

SEQ ID NO: 7463998 - DNA, 22 bp, Homo sapiens
tgtttccaaatggtataaagac

SEQ ID NO: 7463999 - DNA, 22 bp, Homo sapiens
tgtttccaaagtcttttcttaa

SEQ ID NO: 7464000 - DNA, 22 bp, Homo sapiens
tgtttcattagtactgacaata

SEQ ID NO: 7464001 - DNA, 22 bp, Homo sapiens
tgtttcattagtactgacaata

SEQ ID NO: 7464002 - DNA, 22 bp, Homo sapiens
tgtttccaactgtgatcttact

SEQ ID NO: 7464003 - DNA, 22 bp, Homo sapiens
tgtttccaactgtgatcttact

SEQ ID NO: 7464004 - DNA, 22 bp, Homo sapiens
tgtttccaaatggtataaagac

SEQ ID NO: 7464005 - DNA, 18 bp, Homo sapiens
tgtttccaaggaggaagt

SEQ ID NO: 7464006 - DNA, 18 bp, Homo sapiens
tgtttccaaggaggaagt

SEQ ID NO: 7464007 - DNA, 22 bp, Homo sapiens
tgtttccagaaggacaaagaaa

SEQ ID NO: 7464008 - DNA, 22 bp, Homo sapiens
tgtttccagaatgtagctgctt

SEQ ID NO: 7464009 - DNA, 22 bp, Homo sapiens
tgtttccagaaggacaaagaaa

SEQ ID NO: 7464010 - DNA, 22 bp, Homo sapiens
tgtttccagaatgtagctgctt

SEQ ID NO: 7464011 - DNA, 22 bp, Homo sapiens
tgtttccatggtgacagcagct

SEQ ID NO: 7464012 - DNA, 22 bp, Homo sapiens
tgtttccatggtgacagcagct

SEQ ID NO: 7464013 - DNA, 22 bp, Homo sapiens
tgtttccagaatgtagctgctt

SEQ ID NO: 7464014 - DNA, 22 bp, Homo sapiens
tgtttccctaaggtctggctct

SEQ ID NO: 7464015 - DNA, 22 bp, Homo sapiens
tgtttccatggtgacagcagct

SEQ ID NO: 7464016 - DNA, 22 bp, Homo sapiens
tgtttccatggtgatccaagtg

SEQ ID NO: 7464017 - DNA, 22 bp, Homo sapiens
tgtttccatggtgatccaagtg

SEQ ID NO: 7464018 - DNA, 22 bp, Homo sapiens
tgtttcatgtggacatagttgt

SEQ ID NO: 7464019 - DNA, 22 bp, Homo sapiens
tgtttcatgtggacatagttgt

SEQ ID NO: 7464020 - DNA, 22 bp, Homo sapiens
tgtttcatgtggacatagttgt

SEQ ID NO: 7464021 - DNA, 21 bp, Homo sapiens
tgtttcatgctattttcttgt

SEQ ID NO: 7464022 - DNA, 22 bp, Homo sapiens
tgtttcatgattgctgtcattt

SEQ ID NO: 7464023 - DNA, 22 bp, Homo sapiens
tgtttcatgattgctgtcattt

SEQ ID NO: 7464024 - DNA, 21 bp, Homo sapiens
tgtttcatgctattttcttgt

SEQ ID NO: 7464025 - DNA, 21 bp, Homo sapiens
tgtttcatgctattttcttgt

SEQ ID NO: 7464026 - DNA, 22 bp, Homo sapiens
tgtttcatgattgctgtcattt

SEQ ID NO: 7464027 - DNA, 22 bp, Homo sapiens
tgtttcatgaagtctggatatc

SEQ ID NO: 7464028 - DNA, 22 bp, Homo sapiens
tgtttcatgattgctgtcattt

SEQ ID NO: 7464029 - DNA, 22 bp, Homo sapiens
tgtttcatgattgctgtcattt

SEQ ID NO: 7464030 - DNA, 22 bp, Homo sapiens
tgtttcatgaagtctggatatc

SEQ ID NO: 7464031 - DNA, 22 bp, Homo sapiens
tgtttcatgaaacatgtttagg

SEQ ID NO: 7464032 - DNA, 22 bp, Homo sapiens
tgtttcatgaaacatgtttagg

SEQ ID NO: 7464033 - DNA, 22 bp, Homo sapiens
tgtttcatgaaacatgtttagg

SEQ ID NO: 7464034 - DNA, 22 bp, Homo sapiens
tgtttcaggcttctgggatttt

SEQ ID NO: 7464035 - DNA, 22 bp, Homo sapiens
tgtttcagtccctgtgttcaat

SEQ ID NO: 7464036 - DNA, 20 bp, Homo sapiens
tgtttcataagctgtcctat

SEQ ID NO: 7464037 - DNA, 20 bp, Homo sapiens
tgtttcataagctgtcctat

SEQ ID NO: 7464038 - DNA, 20 bp, Homo sapiens
tgtttcataagctgtcctat

SEQ ID NO: 7464039 - DNA, 22 bp, Homo sapiens
tgtttcaagcaatagcatttca

SEQ ID NO: 7464040 - DNA, 22 bp, Homo sapiens
tgtttcaagcaatagcatttca

SEQ ID NO: 7464041 - DNA, 22 bp, Homo sapiens
tgtttcaagcaatagcatttca

SEQ ID NO: 7464042 - DNA, 22 bp, Homo sapiens
tgtttactatgatgtaacctat

SEQ ID NO: 7464043 - DNA, 22 bp, Homo sapiens
tgtttactccagctgatggaac

SEQ ID NO: 7464044 - DNA, 22 bp, Homo sapiens
tgtttcaactgttaagatatgc

SEQ ID NO: 7464045 - DNA, 22 bp, Homo sapiens
tgtttactatgatgtaacctat

SEQ ID NO: 7464046 - DNA, 22 bp, Homo sapiens
tgtttactagccaacatggaga

SEQ ID NO: 7464047 - DNA, 22 bp, Homo sapiens
tgtttactatgatgtaacctat

SEQ ID NO: 7464048 - DNA, 22 bp, Homo sapiens
tgtttactatgatgtaacctat

SEQ ID NO: 7464049 - DNA, 22 bp, Homo sapiens
tgtttactcactgtatccacaa

SEQ ID NO: 7464050 - DNA, 22 bp, Homo sapiens
tgtttactccagctgatggaac

SEQ ID NO: 7464051 - DNA, 22 bp, Homo sapiens
tgtttcaggcttctgggatttt

SEQ ID NO: 7464052 - DNA, 22 bp, Homo sapiens
tgtttcaggcttctgggatttt

SEQ ID NO: 7464053 - DNA, 22 bp, Homo sapiens
tgtttcacttaaaaccactgct

SEQ ID NO: 7464054 - DNA, 22 bp, Homo sapiens
tgtttcagagcactgggcttat

SEQ ID NO: 7464055 - DNA, 22 bp, Homo sapiens
tgtttcactaagcagaaatata

SEQ ID NO: 7464056 - DNA, 22 bp, Homo sapiens
tgtttcaagtttgctcaaagga

SEQ ID NO: 7464057 - DNA, 22 bp, Homo sapiens
tgtttcaagtttgctcaaagga

SEQ ID NO: 7464058 - DNA, 19 bp, Homo sapiens
tgtttacatgtttcttcag

SEQ ID NO: 7464059 - DNA, 19 bp, Homo sapiens
tgtttacatgtttcttcag

SEQ ID NO: 7464060 - DNA, 22 bp, Homo sapiens
tgtttactagccaacatggaga

SEQ ID NO: 7464061 - DNA, 22 bp, Homo sapiens
tgtttactagccaacatggaga

SEQ ID NO: 7464062 - DNA, 22 bp, Homo sapiens
tgtttactagccaacatggaga

SEQ ID NO: 7464063 - DNA, 22 bp, Homo sapiens
tgtttacatgcataagcttaag

SEQ ID NO: 7464064 - DNA, 22 bp, Homo sapiens
tgtttacatggaggttttcagc

SEQ ID NO: 7464065 - DNA, 22 bp, Homo sapiens
tgtttacatggaggttttcagc

SEQ ID NO: 7464066 - DNA, 22 bp, Homo sapiens
tgtttacatggaggttttcagc

SEQ ID NO: 7464067 - DNA, 22 bp, Homo sapiens
tgtttacatggaggttttcagc

SEQ ID NO: 7464068 - DNA, 22 bp, Homo sapiens
tgtttacatggaggttttcagc

SEQ ID NO: 7464069 - DNA, 22 bp, Homo sapiens
tgtttacatggaggttttcagc

SEQ ID NO: 7464070 - DNA, 22 bp, Homo sapiens
tgtttacatgcataagcttaag

SEQ ID NO: 7464071 - DNA, 22 bp, Homo sapiens
tgtttacatgcataagcttaag

SEQ ID NO: 7464072 - DNA, 22 bp, Homo sapiens
tgtttacatgcataagcttaag

SEQ ID NO: 7464073 - DNA, 22 bp, Homo sapiens
tgtttacatgcataagcttaag

SEQ ID NO: 7464074 - DNA, 22 bp, Homo sapiens
tgtttacatatttggtctcaga

SEQ ID NO: 7464075 - DNA, 22 bp, Homo sapiens
tgtttacatatttggtctcaga

SEQ ID NO: 7464076 - DNA, 22 bp, Homo sapiens
tgtttacatatttggtctcaga

SEQ ID NO: 7464077 - DNA, 22 bp, Homo sapiens
tgtttacatgcataagcttaag

SEQ ID NO: 7464078 - DNA, 22 bp, Homo sapiens
tgtttacatgcataagcttaag

SEQ ID NO: 7464079 - DNA, 22 bp, Homo sapiens
tgtttacatgcataagcttaag

SEQ ID NO: 7464080 - DNA, 22 bp, Homo sapiens
tgtttacatgcataagcttaag

SEQ ID NO: 7464081 - DNA, 22 bp, Homo sapiens
tgtttacatgcataagcttaag

SEQ ID NO: 7464082 - DNA, 22 bp, Homo sapiens
tgtttacatgcataagcttaag

SEQ ID NO: 7464083 - DNA, 22 bp, Homo sapiens
tgttttcagtcatatagcaggt

SEQ ID NO: 7464084 - DNA, 22 bp, Homo sapiens
tgttttcagtcatatagcaggt

SEQ ID NO: 7464085 - DNA, 22 bp, Homo sapiens
tgttttcagtcatatagcaggt

SEQ ID NO: 7464086 - DNA, 22 bp, Homo sapiens
tgttttcagtcatatagcaggt

SEQ ID NO: 7464087 - DNA, 22 bp, Homo sapiens
tgttttcagatgcagggacaca

SEQ ID NO: 7464088 - DNA, 22 bp, Homo sapiens
tgttttcagatgcagggacaca

SEQ ID NO: 7464089 - DNA, 22 bp, Homo sapiens
tgttttctcttgaaaagcagtc

SEQ ID NO: 7464090 - DNA, 22 bp, Homo sapiens
tgttttctcttgaaaagcagtc

SEQ ID NO: 7464091 - DNA, 22 bp, Homo sapiens
tgttttctcttgaaaagcagtc

SEQ ID NO: 7464092 - DNA, 22 bp, Homo sapiens
tgttttctcttgaaaagcagtc

SEQ ID NO: 7464093 - DNA, 22 bp, Homo sapiens
tgttttctcttgaaaagcagtc

SEQ ID NO: 7464094 - DNA, 19 bp, Homo sapiens
tgttttcaagtgggattat

SEQ ID NO: 7464095 - DNA, 22 bp, Homo sapiens
tgttttcacaatgatgtcagat

SEQ ID NO: 7464096 - DNA, 19 bp, Homo sapiens
tgttttcaagtgggattat

SEQ ID NO: 7464097 - DNA, 22 bp, Homo sapiens
tgttttcacaatgatgtcagat

SEQ ID NO: 7464098 - DNA, 22 bp, Homo sapiens
tgttttcacaatgatgtcagat

SEQ ID NO: 7464099 - DNA, 22 bp, Homo sapiens
tgttttcacaatgatgtcagat

SEQ ID NO: 7464100 - DNA, 22 bp, Homo sapiens
tgttttcacaatgatgtcagat

SEQ ID NO: 7464101 - DNA, 22 bp, Homo sapiens
tgtttgaaagcacctacatttt

SEQ ID NO: 7464102 - DNA, 22 bp, Homo sapiens
tgtttgaaagcacctacatttt

SEQ ID NO: 7464103 - DNA, 22 bp, Homo sapiens
tgtttgaaagcacctacatttt

SEQ ID NO: 7464104 - DNA, 22 bp, Homo sapiens
tgtttgaaaagtggagatttat

SEQ ID NO: 7464105 - DNA, 22 bp, Homo sapiens
tgtttgaaaagtggagatttat

SEQ ID NO: 7464106 - DNA, 22 bp, Homo sapiens
tgtttgaactgaataacatagt

SEQ ID NO: 7464107 - DNA, 22 bp, Homo sapiens
tgtttgaactgaataacatagt

SEQ ID NO: 7464108 - DNA, 22 bp, Homo sapiens
tgtttgaataacttggatatat

SEQ ID NO: 7464109 - DNA, 22 bp, Homo sapiens
tgtttgaagttcttctgtgact

SEQ ID NO: 7464110 - DNA, 22 bp, Homo sapiens
tgtttgcaaccccttgtgagaa

SEQ ID NO: 7464111 - DNA, 22 bp, Homo sapiens
tgtttgcaacaactagatggag

SEQ ID NO: 7464112 - DNA, 22 bp, Homo sapiens
tgtttgatgacgacattgtaga

SEQ ID NO: 7464113 - DNA, 16 bp, Homo sapiens
tgtttgcaaagcaatc

SEQ ID NO: 7464114 - DNA, 22 bp, Homo sapiens
tgtttgagttctagcgcattta

SEQ ID NO: 7464115 - DNA, 22 bp, Homo sapiens
tgtttgagttctagcgcattta

SEQ ID NO: 7464116 - DNA, 22 bp, Homo sapiens
tgtttgagttctagcgcattta

SEQ ID NO: 7464117 - DNA, 22 bp, Homo sapiens
tgtttgagttctagcgcattta

SEQ ID NO: 7464118 - DNA, 22 bp, Homo sapiens
tgtttccttctgtctctttgga

SEQ ID NO: 7464119 - DNA, 22 bp, Homo sapiens
tgtttccttctgtctctttgga

SEQ ID NO: 7464120 - DNA, 22 bp, Homo sapiens
tgtttccttctgtctctttgga

SEQ ID NO: 7464121 - DNA, 18 bp, Homo sapiens
tgtttcctcctggaggct

SEQ ID NO: 7464122 - DNA, 18 bp, Homo sapiens
tgtttcctcctggaggct

SEQ ID NO: 7464123 - DNA, 22 bp, Homo sapiens
tgtttcctaagtgtctctgaag

SEQ ID NO: 7464124 - DNA, 22 bp, Homo sapiens
tgtttcctaagtgtctctgaag

SEQ ID NO: 7464125 - DNA, 22 bp, Homo sapiens
tgtttcctaagtgtctctgaag

SEQ ID NO: 7464126 - DNA, 23 bp, Homo sapiens
tgtttctagaatcattgatgtct

SEQ ID NO: 7464127 - DNA, 23 bp, Homo sapiens
tgtttctagaatcattgatgtct

SEQ ID NO: 7464128 - DNA, 22 bp, Homo sapiens
tgtttcctttctggtgagcata

SEQ ID NO: 7464129 - DNA, 22 bp, Homo sapiens
tgtttccttctgtctctttgga

SEQ ID NO: 7464130 - DNA, 23 bp, Homo sapiens
tgtttctagaatcattgatgtct

SEQ ID NO: 7464131 - DNA, 23 bp, Homo sapiens
tgtttctagaatcattgatgtct

SEQ ID NO: 7464132 - DNA, 23 bp, Homo sapiens
tgtttctagaatcattgatgtct

SEQ ID NO: 7464133 - DNA, 22 bp, Homo sapiens
tgtttcttgagagtattaccct

SEQ ID NO: 7464134 - DNA, 22 bp, Homo sapiens
tgtttcttgataaagcagaaaa

SEQ ID NO: 7464135 - DNA, 22 bp, Homo sapiens
tgtttcttgataaagcagaaaa

SEQ ID NO: 7464136 - DNA, 22 bp, Homo sapiens
tgtttcttgataaagcagaaaa

SEQ ID NO: 7464137 - DNA, 22 bp, Homo sapiens
tgtttcttgagagtattaccct

SEQ ID NO: 7464138 - DNA, 18 bp, Homo sapiens
tgtttcctcctggaggct

SEQ ID NO: 7464139 - DNA, 22 bp, Homo sapiens
tgtttcttgagagtattaccct

SEQ ID NO: 7464140 - DNA, 22 bp, Homo sapiens
tgtttctttgtagatattcttt

SEQ ID NO: 7464141 - DNA, 22 bp, Homo sapiens
tgtttctttgtagatattcttt

SEQ ID NO: 7464142 - DNA, 20 bp, Homo sapiens
tgtttctttaaggtgagaca

SEQ ID NO: 7464143 - DNA, 22 bp, Homo sapiens
tgtttctttgtagatattcttt

SEQ ID NO: 7464144 - DNA, 22 bp, Homo sapiens
tgtttcttgggtgctcacatca

SEQ ID NO: 7464145 - DNA, 20 bp, Homo sapiens
tgtttctttaaggtgagaca

SEQ ID NO: 7464146 - DNA, 20 bp, Homo sapiens
tgtttctttaaggtgagaca

SEQ ID NO: 7464147 - DNA, 22 bp, Homo sapiens
tgtttcttgggtgctcacatca

SEQ ID NO: 7464148 - DNA, 22 bp, Homo sapiens
tgtttcttgataaagcagaaaa

SEQ ID NO: 7464149 - DNA, 22 bp, Homo sapiens
tgtttcttgggtgctcacatca

SEQ ID NO: 7464150 - DNA, 22 bp, Homo sapiens
tgtttcttgggtgctcacatca

SEQ ID NO: 7464151 - DNA, 22 bp, Homo sapiens
tgtttcttgggtgctcacatca

SEQ ID NO: 7464152 - DNA, 22 bp, Homo sapiens
tgtttcttgggtgctcacatca

SEQ ID NO: 7464153 - DNA, 22 bp, Homo sapiens
tgtttgaaaagtggagatttat

SEQ ID NO: 7464154 - DNA, 20 bp, Homo sapiens
tgtttcttttaatgagcggc

SEQ ID NO: 7464155 - DNA, 22 bp, Homo sapiens
tgtttgaaaagtggagatttat

SEQ ID NO: 7464156 - DNA, 20 bp, Homo sapiens
tgtttcttttaatgagcggc

SEQ ID NO: 7464157 - DNA, 20 bp, Homo sapiens
tgtttcttttaatgagcggc

SEQ ID NO: 7464158 - DNA, 20 bp, Homo sapiens
tgtttcttttaatgagcggc

SEQ ID NO: 7464159 - DNA, 20 bp, Homo sapiens
tgtttcttttaatgagcggc

SEQ ID NO: 7464160 - DNA, 22 bp, Homo sapiens
tgtttctttgtagatattcttt

SEQ ID NO: 7464161 - DNA, 22 bp, Homo sapiens
tgtttctttgtagatattcttt

SEQ ID NO: 7464162 - DNA, 22 bp, Homo sapiens
tgtttctttgtagatattcttt

SEQ ID NO: 7464163 - DNA, 22 bp, Homo sapiens
tgtttctttgtagatattcttt

SEQ ID NO: 7464164 - DNA, 22 bp, Homo sapiens
tgttcctggttcctgcatgatg

SEQ ID NO: 7464165 - DNA, 22 bp, Homo sapiens
tgttcctggtgagccatttttt

SEQ ID NO: 7464166 - DNA, 22 bp, Homo sapiens
tgttcctggttcctgcatgatg

SEQ ID NO: 7464167 - DNA, 22 bp, Homo sapiens
tgttcctggttcctgcatgatg

SEQ ID NO: 7464168 - DNA, 22 bp, Homo sapiens
tgttcctgtactgctgtggctt

SEQ ID NO: 7464169 - DNA, 22 bp, Homo sapiens
tgttcctgtactgctgtggctt

SEQ ID NO: 7464170 - DNA, 22 bp, Homo sapiens
tgttcctggaaagccaggtggg

SEQ ID NO: 7464171 - DNA, 22 bp, Homo sapiens
tgttcctgctatggtttgttgc

SEQ ID NO: 7464172 - DNA, 22 bp, Homo sapiens
tgttcctggaaagccaggtggg

SEQ ID NO: 7464173 - DNA, 22 bp, Homo sapiens
tgttcctggttcctgcatgatg

SEQ ID NO: 7464174 - DNA, 22 bp, Homo sapiens
tgttcctgacggccaaagaggt

SEQ ID NO: 7464175 - DNA, 22 bp, Homo sapiens
tgttcctgaggcatgtgtcaat

SEQ ID NO: 7464176 - DNA, 22 bp, Homo sapiens
tgttcctgaggcatgtgtcaat

SEQ ID NO: 7464177 - DNA, 22 bp, Homo sapiens
tgttcctgaggcatgtgtcaat

SEQ ID NO: 7464178 - DNA, 21 bp, Homo sapiens
tgttcctgccccaatccttgg

SEQ ID NO: 7464179 - DNA, 22 bp, Homo sapiens
tgttcctgaatgcctggctggc

SEQ ID NO: 7464180 - DNA, 22 bp, Homo sapiens
tgttcctgaatgcctggctggc

SEQ ID NO: 7464181 - DNA, 22 bp, Homo sapiens
tgttcctgacggccaaagaggt

SEQ ID NO: 7464182 - DNA, 22 bp, Homo sapiens
tgttcctgaatgcctggctggc

SEQ ID NO: 7464183 - DNA, 22 bp, Homo sapiens
tgttcctgaatgcctggctggc

SEQ ID NO: 7464184 - DNA, 22 bp, Homo sapiens
tgttccgaccgtggggtttgat

SEQ ID NO: 7464185 - DNA, 20 bp, Homo sapiens
tgttccctatttgactgaag

SEQ ID NO: 7464186 - DNA, 22 bp, Homo sapiens
tgttcagaacaaaggtaaatga

SEQ ID NO: 7464187 - DNA, 22 bp, Homo sapiens
tgttcagaacaaaggtaaatga

SEQ ID NO: 7464188 - DNA, 22 bp, Homo sapiens
tgttcagaacaaaggtaaatga

SEQ ID NO: 7464189 - DNA, 20 bp, Homo sapiens
tgttcagaaatgcagagagg

SEQ ID NO: 7464190 - DNA, 22 bp, Homo sapiens
tgttcagaacaaaggtaaatga

SEQ ID NO: 7464191 - DNA, 22 bp, Homo sapiens
tgttcagaacaaaggtaaatga

SEQ ID NO: 7464192 - DNA, 20 bp, Homo sapiens
tgttcagaaatgcagagagg

SEQ ID NO: 7464193 - DNA, 20 bp, Homo sapiens
tgttcagaaatgcagagagg

SEQ ID NO: 7464194 - DNA, 22 bp, Homo sapiens
tgttcagaaaacagataactaa

SEQ ID NO: 7464195 - DNA, 22 bp, Homo sapiens
tgttcagaaaacagataactaa

SEQ ID NO: 7464196 - DNA, 22 bp, Homo sapiens
tgttcactggaacacagctgta

SEQ ID NO: 7464197 - DNA, 22 bp, Homo sapiens
tgttcagaaaacagataactaa

SEQ ID NO: 7464198 - DNA, 22 bp, Homo sapiens
tgttcagaaaacagataactaa

SEQ ID NO: 7464199 - DNA, 22 bp, Homo sapiens
tgttcactggaacacagctgta

SEQ ID NO: 7464200 - DNA, 22 bp, Homo sapiens
tgttcacttatgttctcccatt

SEQ ID NO: 7464201 - DNA, 22 bp, Homo sapiens
tgttcactggaacacagctgta

SEQ ID NO: 7464202 - DNA, 21 bp, Homo sapiens
tgttcaaacgtacacatttct

SEQ ID NO: 7464203 - DNA, 22 bp, Homo sapiens
tgttcaaaaatatcttctgcaa

SEQ ID NO: 7464204 - DNA, 21 bp, Homo sapiens
tgttcaaacgtacacatttct

SEQ ID NO: 7464205 - DNA, 22 bp, Homo sapiens
tgttcaaaaatatcttctgcaa

SEQ ID NO: 7464206 - DNA, 22 bp, Homo sapiens
tgttatttgggaaagttgtaca

SEQ ID NO: 7464207 - DNA, 22 bp, Homo sapiens
tgttatttgggaaagttgtaca

SEQ ID NO: 7464208 - DNA, 22 bp, Homo sapiens
tgttatttgggaaagttgtaca

SEQ ID NO: 7464209 - DNA, 22 bp, Homo sapiens
tgttatttgggaaagttgtaca

SEQ ID NO: 7464210 - DNA, 22 bp, Homo sapiens
tgttatttgggaaagttgtaca

SEQ ID NO: 7464211 - DNA, 22 bp, Homo sapiens
tgttcaaatcttttgcttattt

SEQ ID NO: 7464212 - DNA, 22 bp, Homo sapiens
tgttcaaatgatcttcttaaat

SEQ ID NO: 7464213 - DNA, 22 bp, Homo sapiens
tgttcaagtggatgtggctttt

SEQ ID NO: 7464214 - DNA, 22 bp, Homo sapiens
tgttcaagtggatgtggctttt

SEQ ID NO: 7464215 - DNA, 22 bp, Homo sapiens
tgttcaaatcttttgcttattt

SEQ ID NO: 7464216 - DNA, 22 bp, Homo sapiens
tgttcaaatcttttgcttattt

SEQ ID NO: 7464217 - DNA, 22 bp, Homo sapiens
tgttcaaatcttttgcttattt

SEQ ID NO: 7464218 - DNA, 21 bp, Homo sapiens
tgttcaaacgtacacatttct

SEQ ID NO: 7464219 - DNA, 22 bp, Homo sapiens
tgttcacaggggagccatttat

SEQ ID NO: 7464220 - DNA, 22 bp, Homo sapiens
tgttcacacacggaggccacag

SEQ ID NO: 7464221 - DNA, 22 bp, Homo sapiens
tgttcacacacggaggccacag

SEQ ID NO: 7464222 - DNA, 22 bp, Homo sapiens
tgttcacacacggaggccacag

SEQ ID NO: 7464223 - DNA, 22 bp, Homo sapiens
tgttcacaaggtgatgctttga

SEQ ID NO: 7464224 - DNA, 22 bp, Homo sapiens
tgttcaaatgatcttcttaaat

SEQ ID NO: 7464225 - DNA, 22 bp, Homo sapiens
tgttcacaacgtgcaggtttgt

SEQ ID NO: 7464226 - DNA, 22 bp, Homo sapiens
tgttcacaagatgtctgtggct

SEQ ID NO: 7464227 - DNA, 22 bp, Homo sapiens
tgttcacaagatgtctgtggct

SEQ ID NO: 7464228 - DNA, 22 bp, Homo sapiens
tgttcacaagcagatgttgctt

SEQ ID NO: 7464229 - DNA, 22 bp, Homo sapiens
tgttcacatgtacatgaatatt

SEQ ID NO: 7464230 - DNA, 22 bp, Homo sapiens
tgttcacatgtacatgaatatt

SEQ ID NO: 7464231 - DNA, 22 bp, Homo sapiens
tgttcacaggaggggcttatgg

SEQ ID NO: 7464232 - DNA, 22 bp, Homo sapiens
tgttcacaggggagccatttat

SEQ ID NO: 7464233 - DNA, 20 bp, Homo sapiens
tgttcacagtagttgctgct

SEQ ID NO: 7464234 - DNA, 20 bp, Homo sapiens
tgttcacagtagttgctgct

SEQ ID NO: 7464235 - DNA, 21 bp, Homo sapiens
tgttcacatggagcagaatgt

SEQ ID NO: 7464236 - DNA, 22 bp, Homo sapiens
tgttatgagtcctcatatacta

SEQ ID NO: 7464237 - DNA, 20 bp, Homo sapiens
tgttatgagggcgatctata

SEQ ID NO: 7464238 - DNA, 22 bp, Homo sapiens
tgttatgagtcctcatatacta

SEQ ID NO: 7464239 - DNA, 22 bp, Homo sapiens
tgttatgagtcctcatatacta

SEQ ID NO: 7464240 - DNA, 18 bp, Homo sapiens
tgttatgagactctagga

SEQ ID NO: 7464241 - DNA, 22 bp, Homo sapiens
tgttatgagaaagacattaggt

SEQ ID NO: 7464242 - DNA, 20 bp, Homo sapiens
tgttatggtgttctgatggg

SEQ ID NO: 7464243 - DNA, 22 bp, Homo sapiens
tgttatgtgccacacttgaggg

SEQ ID NO: 7464244 - DNA, 22 bp, Homo sapiens
tgttattaaataattctctctt

SEQ ID NO: 7464245 - DNA, 22 bp, Homo sapiens
tgttatgaacttctagaaaaca

SEQ ID NO: 7464246 - DNA, 22 bp, Homo sapiens
tgttatgaactgcctatggact

SEQ ID NO: 7464247 - DNA, 22 bp, Homo sapiens
tgttatgaactgcctatggaga

SEQ ID NO: 7464248 - DNA, 22 bp, Homo sapiens
tgttatgaacttctagaaaaca

SEQ ID NO: 7464249 - DNA, 22 bp, Homo sapiens
tgttatgaacttctagaaaaca

SEQ ID NO: 7464250 - DNA, 22 bp, Homo sapiens
tgttatctgagcaacgtcgacg

SEQ ID NO: 7464251 - DNA, 22 bp, Homo sapiens
tgttatctggttgtctgattac

SEQ ID NO: 7464252 - DNA, 22 bp, Homo sapiens
tgttatactatttagaggtaca

SEQ ID NO: 7464253 - DNA, 22 bp, Homo sapiens
tgttatacagacacgatggtat

SEQ ID NO: 7464254 - DNA, 22 bp, Homo sapiens
tgttatataacttacaacctgt

SEQ ID NO: 7464255 - DNA, 22 bp, Homo sapiens
tgttaaaaatgcagattcctat

SEQ ID NO: 7464256 - DNA, 22 bp, Homo sapiens
tgttaaaaatgcagattcctat

SEQ ID NO: 7464257 - DNA, 22 bp, Homo sapiens
tgttaaaaatgcagattcctat

SEQ ID NO: 7464258 - DNA, 22 bp, Homo sapiens
tgttatcctcagctcacctcta

SEQ ID NO: 7464259 - DNA, 22 bp, Homo sapiens
tgttatcctcagctcacctcta

SEQ ID NO: 7464260 - DNA, 22 bp, Homo sapiens
tgttatcctcagctcacctcta

SEQ ID NO: 7464261 - DNA, 22 bp, Homo sapiens
tgttatcctcagctcacctcta

SEQ ID NO: 7464262 - DNA, 22 bp, Homo sapiens
tgttatcctcagctcacctcta

SEQ ID NO: 7464263 - DNA, 22 bp, Homo sapiens
tgttatcacttagacatgctag

SEQ ID NO: 7464264 - DNA, 22 bp, Homo sapiens
tgttatcacttagacatgctag

SEQ ID NO: 7464265 - DNA, 22 bp, Homo sapiens
tgttatcacttgtaaaagcaat

SEQ ID NO: 7464266 - DNA, 22 bp, Homo sapiens
tgttatttgggaaagttgtaca

SEQ ID NO: 7464267 - DNA, 22 bp, Homo sapiens
tgttatttgggaaagttgtaca

SEQ ID NO: 7464268 - DNA, 22 bp, Homo sapiens
tgttatttgggaaagttgtaca

SEQ ID NO: 7464269 - DNA, 22 bp, Homo sapiens
tgttatttgggaaagttgtaca

SEQ ID NO: 7464270 - DNA, 22 bp, Homo sapiens
tgttatttgggaaagttgtaca

SEQ ID NO: 7464271 - DNA, 22 bp, Homo sapiens
tgttatttctttgccatatctt

SEQ ID NO: 7464272 - DNA, 22 bp, Homo sapiens
tgttatttatttcacctccaga

SEQ ID NO: 7464273 - DNA, 22 bp, Homo sapiens
tgttatttctttgccatatctt

SEQ ID NO: 7464274 - DNA, 22 bp, Homo sapiens
tgttatttctttgccatatctt

SEQ ID NO: 7464275 - DNA, 22 bp, Homo sapiens
tgttatttctttgccatatctt

SEQ ID NO: 7464276 - DNA, 22 bp, Homo sapiens
tgttatttctttgccatatctt

SEQ ID NO: 7464277 - DNA, 22 bp, Homo sapiens
tgttatttatctgagcatttat

SEQ ID NO: 7464278 - DNA, 22 bp, Homo sapiens
tgttattgatatctaatgctct

SEQ ID NO: 7464279 - DNA, 22 bp, Homo sapiens
tgttatttatctgagcatttat

SEQ ID NO: 7464280 - DNA, 22 bp, Homo sapiens
tgttatttatctgagcatttat

SEQ ID NO: 7464281 - DNA, 22 bp, Homo sapiens
tgttatttatctgagcatttat

SEQ ID NO: 7464282 - DNA, 22 bp, Homo sapiens
tgttatttatctgagcatttat

SEQ ID NO: 7464283 - DNA, 22 bp, Homo sapiens
tgttatttatttcacctccaga

SEQ ID NO: 7464284 - DNA, 22 bp, Homo sapiens
tgttatttatttcacctccaga

SEQ ID NO: 7464285 - DNA, 22 bp, Homo sapiens
tgttattgtcgctgcactggga

SEQ ID NO: 7464286 - DNA, 22 bp, Homo sapiens
tgttatttatctgagcatttat

SEQ ID NO: 7464287 - DNA, 22 bp, Homo sapiens
tgttatttatctgagcatttat

SEQ ID NO: 7464288 - DNA, 22 bp, Homo sapiens
tgttattgggtcccaactaggt

SEQ ID NO: 7464289 - DNA, 22 bp, Homo sapiens
tgttattgtcgctgcactggga

SEQ ID NO: 7464290 - DNA, 22 bp, Homo sapiens
tgttattgtcgctgcactggga

SEQ ID NO: 7464291 - DNA, 22 bp, Homo sapiens
tgttattgggtcccaactaggt

SEQ ID NO: 7464292 - DNA, 22 bp, Homo sapiens
tgttattgaggttacttataag

SEQ ID NO: 7464293 - DNA, 22 bp, Homo sapiens
tgttattgaggttacttataag

SEQ ID NO: 7464294 - DNA, 22 bp, Homo sapiens
tgttattgaggttacttataag

SEQ ID NO: 7464295 - DNA, 22 bp, Homo sapiens
tgttattgatatctaatgctct

SEQ ID NO: 7464296 - DNA, 22 bp, Homo sapiens
tgttatgatctcactatgacta

SEQ ID NO: 7464297 - DNA, 23 bp, Homo sapiens
tgttattccaggttaatgtactt

SEQ ID NO: 7464298 - DNA, 22 bp, Homo sapiens
tgttattatctgttaggtgttc

SEQ ID NO: 7464299 - DNA, 22 bp, Homo sapiens
tgttattctgatgtgcaggata

SEQ ID NO: 7464300 - DNA, 22 bp, Homo sapiens
tgttattctggccagcaccgtt

SEQ ID NO: 7464301 - DNA, 22 bp, Homo sapiens
tgttattctagtggatcacgtc

SEQ ID NO: 7464302 - DNA, 22 bp, Homo sapiens
tgttattctctgcctacaagtc

SEQ ID NO: 7464303 - DNA, 22 bp, Homo sapiens
tgtgttcaagattagttctagt

SEQ ID NO: 7464304 - DNA, 22 bp, Homo sapiens
tgtgttcaatcaccaaaggtat

SEQ ID NO: 7464305 - DNA, 22 bp, Homo sapiens
tgtgttcaatcaccaaaggtat

SEQ ID NO: 7464306 - DNA, 22 bp, Homo sapiens
tgtgttcaatcaccaaaggtat

SEQ ID NO: 7464307 - DNA, 19 bp, Homo sapiens
tgtgttcaaactccatctc

SEQ ID NO: 7464308 - DNA, 22 bp, Homo sapiens
tgtgttcaagattagttctagt

SEQ ID NO: 7464309 - DNA, 22 bp, Homo sapiens
tgtgttcaagattagttctagt

SEQ ID NO: 7464310 - DNA, 22 bp, Homo sapiens
tgtgttctggaaagctcactga

SEQ ID NO: 7464311 - DNA, 22 bp, Homo sapiens
tgtgttcaatcaccaaaggtat

SEQ ID NO: 7464312 - DNA, 22 bp, Homo sapiens
tgtgttatgtgggccagggcaa

SEQ ID NO: 7464313 - DNA, 22 bp, Homo sapiens
tgtgttaatttattgcctcaga

SEQ ID NO: 7464314 - DNA, 22 bp, Homo sapiens
tgtgttatctatctcgatgctt

SEQ ID NO: 7464315 - DNA, 22 bp, Homo sapiens
tgtgttaattttccctttctct

SEQ ID NO: 7464316 - DNA, 22 bp, Homo sapiens
tgtgttaattccacaaacattc

SEQ ID NO: 7464317 - DNA, 22 bp, Homo sapiens
tgtgttcttaaaagcagtgata

SEQ ID NO: 7464318 - DNA, 22 bp, Homo sapiens
tgtgttctggctgtgacagctg

SEQ ID NO: 7464319 - DNA, 22 bp, Homo sapiens
tgtgttctggaaagctcactga

SEQ ID NO: 7464320 - DNA, 22 bp, Homo sapiens
tgtgttctggctgtgacagctg

SEQ ID NO: 7464321 - DNA, 22 bp, Homo sapiens
tgtgttctggctgtgacagctg

SEQ ID NO: 7464322 - DNA, 22 bp, Homo sapiens
tgtgttctggctgtgacagctg

SEQ ID NO: 7464323 - DNA, 22 bp, Homo sapiens
tgtgttcttaaaagcagtgata

SEQ ID NO: 7464324 - DNA, 22 bp, Homo sapiens
tgtgttgtgacattcttggatg

SEQ ID NO: 7464325 - DNA, 22 bp, Homo sapiens
tgtgttgtgacattcttggatg

SEQ ID NO: 7464326 - DNA, 22 bp, Homo sapiens
tgtgttgtgacattcttggatg

SEQ ID NO: 7464327 - DNA, 22 bp, Homo sapiens
tgtgttggtagatctgaggtct

SEQ ID NO: 7464328 - DNA, 22 bp, Homo sapiens
tgtgttggcttgcctgttaggc

SEQ ID NO: 7464329 - DNA, 22 bp, Homo sapiens
tgtgttggctgccggcacagga

SEQ ID NO: 7464330 - DNA, 22 bp, Homo sapiens
tgtgttggaaatagggtctttg

SEQ ID NO: 7464331 - DNA, 22 bp, Homo sapiens
tgtgttggctgccggcacagga

SEQ ID NO: 7464332 - DNA, 22 bp, Homo sapiens
tgtgttcttaaaagcagtgata

SEQ ID NO: 7464333 - DNA, 22 bp, Homo sapiens
tgtgtgcagcggcaggtgaagt

SEQ ID NO: 7464334 - DNA, 22 bp, Homo sapiens
tgtgtgcagcctctgtctttgg

SEQ ID NO: 7464335 - DNA, 22 bp, Homo sapiens
tgtgtgcaggcactgtgccaga

SEQ ID NO: 7464336 - DNA, 22 bp, Homo sapiens
tgtgtgcacttaatgcaatcat

SEQ ID NO: 7464337 - DNA, 22 bp, Homo sapiens
tgtgtgcagacagatattactt

SEQ ID NO: 7464338 - DNA, 22 bp, Homo sapiens
tgtgtgcagacagatattactt

SEQ ID NO: 7464339 - DNA, 22 bp, Homo sapiens
tgtgtgcagacagatattactt

SEQ ID NO: 7464340 - DNA, 22 bp, Homo sapiens
tgtgtgcagcctctgtctttgg

SEQ ID NO: 7464341 - DNA, 22 bp, Homo sapiens
tgtgtgcaggcactgtgccaga

SEQ ID NO: 7464342 - DNA, 22 bp, Homo sapiens
tgtgtgcatacacacggtaaca

SEQ ID NO: 7464343 - DNA, 20 bp, Homo sapiens
tgtgtgcatctgtatgtatt

SEQ ID NO: 7464344 - DNA, 20 bp, Homo sapiens
tgtgtgcatctgtatgtatt

SEQ ID NO: 7464345 - DNA, 21 bp, Homo sapiens
tgtgtgcatatgcatgtacat

SEQ ID NO: 7464346 - DNA, 21 bp, Homo sapiens
tgtgtgcatatgcatgtacat

SEQ ID NO: 7464347 - DNA, 22 bp, Homo sapiens
tgtgtgcacatgatttgaaatg

SEQ ID NO: 7464348 - DNA, 22 bp, Homo sapiens
tgtgtgcacgctgggagctgga

SEQ ID NO: 7464349 - DNA, 18 bp, Homo sapiens
tgtgtgcacctgccttga

SEQ ID NO: 7464350 - DNA, 22 bp, Homo sapiens
tgtgtgcactgccttttgtgga

SEQ ID NO: 7464351 - DNA, 22 bp, Homo sapiens
tgtgtgcacttaatgcaatcat

SEQ ID NO: 7464352 - DNA, 22 bp, Homo sapiens
tgtgtgcactgccttttgtgga

SEQ ID NO: 7464353 - DNA, 20 bp, Homo sapiens
tgtgtgcacacatgacattc

SEQ ID NO: 7464354 - DNA, 22 bp, Homo sapiens
tgtgtgcacaaagagtacatgg

SEQ ID NO: 7464355 - DNA, 22 bp, Homo sapiens
tgtgtgcaattcttaacataca

SEQ ID NO: 7464356 - DNA, 22 bp, Homo sapiens
tgtgtgcacaggagtgtttgaa

SEQ ID NO: 7464357 - DNA, 20 bp, Homo sapiens
tgtgtgcacacatgacattc

SEQ ID NO: 7464358 - DNA, 20 bp, Homo sapiens
tgtgtgcacacatgacattc

SEQ ID NO: 7464359 - DNA, 22 bp, Homo sapiens
tgtgtgcacaggagtgtttgaa

SEQ ID NO: 7464360 - DNA, 21 bp, Homo sapiens
tgtgtttgagactatgtttcc

SEQ ID NO: 7464361 - DNA, 22 bp, Homo sapiens
tgtgtttctctgaggggtccct

SEQ ID NO: 7464362 - DNA, 22 bp, Homo sapiens
tgtgtttctgagaatcccacct

SEQ ID NO: 7464363 - DNA, 22 bp, Homo sapiens
tgtgtttctctgaggggtccct

SEQ ID NO: 7464364 - DNA, 22 bp, Homo sapiens
tgtgtttcagaaccttctttca

SEQ ID NO: 7464365 - DNA, 22 bp, Homo sapiens
tgtgtttcagaaccttctttca

SEQ ID NO: 7464366 - DNA, 22 bp, Homo sapiens
tgtgtttcagaaccttctttca

SEQ ID NO: 7464367 - DNA, 22 bp, Homo sapiens
tgtgtttcagaaccttctttca

SEQ ID NO: 7464368 - DNA, 22 bp, Homo sapiens
tgtgtttatagtgtatcttcca

SEQ ID NO: 7464369 - DNA, 22 bp, Homo sapiens
tgtgtttagagagcacattcag

SEQ ID NO: 7464370 - DNA, 22 bp, Homo sapiens
tgtgtttatagtgtatcttcca

SEQ ID NO: 7464371 - DNA, 22 bp, Homo sapiens
tgtgtttctgagaatcccacct

SEQ ID NO: 7464372 - DNA, 21 bp, Homo sapiens
tgtgtttgagactatgtttcc

SEQ ID NO: 7464373 - DNA, 21 bp, Homo sapiens
tgtgtttgagactatgtttcc

SEQ ID NO: 7464374 - DNA, 22 bp, Homo sapiens
tgtgtttgaggcatgttgcaga

SEQ ID NO: 7464375 - DNA, 21 bp, Homo sapiens
tgtgtttgagactatgtttcc

SEQ ID NO: 7464376 - DNA, 22 bp, Homo sapiens
tgtgtttgaggcatgttgcaga

SEQ ID NO: 7464377 - DNA, 22 bp, Homo sapiens
tgtgtttgaggcatgttgcaga

SEQ ID NO: 7464378 - DNA, 22 bp, Homo sapiens
tgtgtttgagtcctcacagtgc

SEQ ID NO: 7464379 - DNA, 22 bp, Homo sapiens
tgtgtttaaagaggaagtgaga

SEQ ID NO: 7464380 - DNA, 22 bp, Homo sapiens
tgtgttgttttaagctgctgca

SEQ ID NO: 7464381 - DNA, 22 bp, Homo sapiens
tgtgttgttttaagctgctgca

SEQ ID NO: 7464382 - DNA, 22 bp, Homo sapiens
tgtgttgttagtaccagcagtc

SEQ ID NO: 7464383 - DNA, 22 bp, Homo sapiens
tgtgttgttagtaccagcagtc

SEQ ID NO: 7464384 - DNA, 22 bp, Homo sapiens
tgtgttgtgacattcttggatg

SEQ ID NO: 7464385 - DNA, 22 bp, Homo sapiens
tgtgttgttttaagctgctgca

SEQ ID NO: 7464386 - DNA, 22 bp, Homo sapiens
tgtgttgtgacattcttggatg

SEQ ID NO: 7464387 - DNA, 22 bp, Homo sapiens
tgtgtttacttctatgcagttt

SEQ ID NO: 7464388 - DNA, 22 bp, Homo sapiens
tgtgtttaaagaggaagtgaga

SEQ ID NO: 7464389 - DNA, 23 bp, Homo sapiens
tgtgtttacctgaggatcttgtt

SEQ ID NO: 7464390 - DNA, 22 bp, Homo sapiens
tgtgtttacttctatgcagttt

SEQ ID NO: 7464391 - DNA, 22 bp, Homo sapiens
tgtgtttagagagcacattcag

SEQ ID NO: 7464392 - DNA, 22 bp, Homo sapiens
tgtgtttatagtgtatcttcca

SEQ ID NO: 7464393 - DNA, 22 bp, Homo sapiens
tgtgtttatagtgtatcttcca

SEQ ID NO: 7464394 - DNA, 22 bp, Homo sapiens
tgtgttttgaactcatctactg

SEQ ID NO: 7464395 - DNA, 22 bp, Homo sapiens
tgtgttttccagaatggtgttt

SEQ ID NO: 7464396 - DNA, 22 bp, Homo sapiens
tgtgttttgaactcatctactg

SEQ ID NO: 7464397 - DNA, 22 bp, Homo sapiens
tgtgttttgaactcatctactg

SEQ ID NO: 7464398 - DNA, 22 bp, Homo sapiens
tgtgttttggaaggaacatgca

SEQ ID NO: 7464399 - DNA, 22 bp, Homo sapiens
tgtgttttgaactcatctactg

SEQ ID NO: 7464400 - DNA, 20 bp, Homo sapiens
tgtgttttgcagggcattta

SEQ ID NO: 7464401 - DNA, 22 bp, Homo sapiens
tgtgttttggaaggaacatgca

SEQ ID NO: 7464402 - DNA, 22 bp, Homo sapiens
tgtgttttggaaggaacatgca

SEQ ID NO: 7464403 - DNA, 22 bp, Homo sapiens
tgtgttttgtgtgacccagctc

SEQ ID NO: 7464404 - DNA, 22 bp, Homo sapiens
tgtgttttggaaggaacatgca

SEQ ID NO: 7464405 - DNA, 22 bp, Homo sapiens
tgtgttttgtgtgacccagctc

SEQ ID NO: 7464406 - DNA, 22 bp, Homo sapiens
tgtgttttatctattgtatctt

SEQ ID NO: 7464407 - DNA, 22 bp, Homo sapiens
tgtgttttatctattgtatctt

SEQ ID NO: 7464408 - DNA, 22 bp, Homo sapiens
tgtgttttatctattgtatctt

SEQ ID NO: 7464409 - DNA, 22 bp, Homo sapiens
tgtgttttatctattgtatctt

SEQ ID NO: 7464410 - DNA, 22 bp, Homo sapiens
tgtgttttcctccctggcgttt

SEQ ID NO: 7464411 - DNA, 22 bp, Homo sapiens
tgtgttttcctccctggcgttt

SEQ ID NO: 7464412 - DNA, 21 bp, Homo sapiens
tgtgttttctctctgggaggt

SEQ ID NO: 7464413 - DNA, 21 bp, Homo sapiens
tgtgttttctctctgggaggt

SEQ ID NO: 7464414 - DNA, 22 bp, Homo sapiens
tgtgttttccagaatggtgttt

SEQ ID NO: 7464415 - DNA, 22 bp, Homo sapiens
tgtgttttccagaatggtgttt

SEQ ID NO: 7464416 - DNA, 22 bp, Homo sapiens
tgtgttttccagaatggtgttt

SEQ ID NO: 7464417 - DNA, 22 bp, Homo sapiens
tgtgtttgttagactaatgtta

SEQ ID NO: 7464418 - DNA, 22 bp, Homo sapiens
tgtgtttgggggagatgcattt

SEQ ID NO: 7464419 - DNA, 22 bp, Homo sapiens
tgtgtttgcaatgggaatgaga

SEQ ID NO: 7464420 - DNA, 22 bp, Homo sapiens
tgtgtttgagtcctcacagtgc

SEQ ID NO: 7464421 - DNA, 22 bp, Homo sapiens
tgtgtttgggggagatgcattt

SEQ ID NO: 7464422 - DNA, 22 bp, Homo sapiens
tgtgtttgggggagatgcattt

SEQ ID NO: 7464423 - DNA, 22 bp, Homo sapiens
tgtgtttgggggagatgcattt

SEQ ID NO: 7464424 - DNA, 22 bp, Homo sapiens
tgtgttttacaaattctcttaa

SEQ ID NO: 7464425 - DNA, 22 bp, Homo sapiens
tgtgttttacaaattctcttaa

SEQ ID NO: 7464426 - DNA, 22 bp, Homo sapiens
tgtgttttacaaattctcttaa

SEQ ID NO: 7464427 - DNA, 22 bp, Homo sapiens
tgtgttttacaaattctcttaa

SEQ ID NO: 7464428 - DNA, 22 bp, Homo sapiens
tgtgttttacaaattctcttaa

SEQ ID NO: 7464429 - DNA, 21 bp, Homo sapiens
tgtgttttaatgatattctgt

SEQ ID NO: 7464430 - DNA, 22 bp, Homo sapiens
tgtgttttaaatggaaatttga

SEQ ID NO: 7464431 - DNA, 22 bp, Homo sapiens
tgtgttttaaatggaaatttga

SEQ ID NO: 7464432 - DNA, 21 bp, Homo sapiens
tgtgttttaatgatattctgt

SEQ ID NO: 7464433 - DNA, 21 bp, Homo sapiens
tgtgttttaatgatattctgt

SEQ ID NO: 7464434 - DNA, 21 bp, Homo sapiens
tgtgttttaatgatattctgt

SEQ ID NO: 7464435 - DNA, 22 bp, Homo sapiens
ttaaggaaagccaaaatgaatt

SEQ ID NO: 7464436 - DNA, 22 bp, Homo sapiens
ttaaggaaatcttggtgtcaca

SEQ ID NO: 7464437 - DNA, 22 bp, Homo sapiens
ttaaggaaatcttggtgtcaca

SEQ ID NO: 7464438 - DNA, 22 bp, Homo sapiens
ttaaggaacaattctacacacc

SEQ ID NO: 7464439 - DNA, 22 bp, Homo sapiens
ttaaggaacaattctacacacc

SEQ ID NO: 7464440 - DNA, 22 bp, Homo sapiens
ttaaggaacaattctacacacc

SEQ ID NO: 7464441 - DNA, 22 bp, Homo sapiens
ttaaggaaccacagcatgttag

SEQ ID NO: 7464442 - DNA, 22 bp, Homo sapiens
ttaaggaaccacagcatgttag

SEQ ID NO: 7464443 - DNA, 22 bp, Homo sapiens
ttaagagcaacatatggtgaca

SEQ ID NO: 7464444 - DNA, 22 bp, Homo sapiens
ttaagagatttaggaacattat

SEQ ID NO: 7464445 - DNA, 22 bp, Homo sapiens
ttaaggaaagattagcatttgt

SEQ ID NO: 7464446 - DNA, 22 bp, Homo sapiens
ttaaggaaagattagcatttgt

SEQ ID NO: 7464447 - DNA, 22 bp, Homo sapiens
ttaaggaaagccaaaatgaatt

SEQ ID NO: 7464448 - DNA, 22 bp, Homo sapiens
ttaaggaaagccaaaatgaatt

SEQ ID NO: 7464449 - DNA, 22 bp, Homo sapiens
ttaaggaatattcatgaagttt

SEQ ID NO: 7464450 - DNA, 22 bp, Homo sapiens
ttaaggaatggttggaatggat

SEQ ID NO: 7464451 - DNA, 22 bp, Homo sapiens
ttaaggaatggttggaatggat

SEQ ID NO: 7464452 - DNA, 22 bp, Homo sapiens
ttaaggaatattcatgaagttt

SEQ ID NO: 7464453 - DNA, 22 bp, Homo sapiens
ttaaggaatattcatgaagttt

SEQ ID NO: 7464454 - DNA, 22 bp, Homo sapiens
ttaaggaaggcacagcagttga

SEQ ID NO: 7464455 - DNA, 22 bp, Homo sapiens
ttaaggaaggcacagcagttga

SEQ ID NO: 7464456 - DNA, 22 bp, Homo sapiens
ttaaggaaggcacagcagttga

SEQ ID NO: 7464457 - DNA, 22 bp, Homo sapiens
ttaaggaaggtgaatttcttgg

SEQ ID NO: 7464458 - DNA, 22 bp, Homo sapiens
ttaaggaaggtgaatttcttgg

SEQ ID NO: 7464459 - DNA, 22 bp, Homo sapiens
ttaaggaaggtgaatttcttgg

SEQ ID NO: 7464460 - DNA, 22 bp, Homo sapiens
ttaaggaagcctatgggaatag

SEQ ID NO: 7464461 - DNA, 22 bp, Homo sapiens
ttaaggaaggagtcttaaatgg

SEQ ID NO: 7464462 - DNA, 22 bp, Homo sapiens
ttaaggaaggagtcttaaatgg

SEQ ID NO: 7464463 - DNA, 22 bp, Homo sapiens
ttaaggaagcctatgggaatag

SEQ ID NO: 7464464 - DNA, 22 bp, Homo sapiens
ttaaggaagcctatgggaatag

SEQ ID NO: 7464465 - DNA, 22 bp, Homo sapiens
ttaaggaagagacttttgcgtt

SEQ ID NO: 7464466 - DNA, 22 bp, Homo sapiens
ttaaggaagagacttttgcgtt

SEQ ID NO: 7464467 - DNA, 20 bp, Homo sapiens
ttaaggaagccaccggtcag

SEQ ID NO: 7464468 - DNA, 20 bp, Homo sapiens
ttaaggaagccaccggtcag

SEQ ID NO: 7464469 - DNA, 22 bp, Homo sapiens
ttaaggaagacagggcaaggtg

SEQ ID NO: 7464470 - DNA, 22 bp, Homo sapiens
ttaaggaagacagggcaaggtg

SEQ ID NO: 7464471 - DNA, 22 bp, Homo sapiens
ttaaggaagaattgcaatggca

SEQ ID NO: 7464472 - DNA, 22 bp, Homo sapiens
ttaaggaagaattgcaatggca

SEQ ID NO: 7464473 - DNA, 22 bp, Homo sapiens
ttaaggaacttgtctttctctt

SEQ ID NO: 7464474 - DNA, 22 bp, Homo sapiens
ttaaggaacttgtctttctctt

SEQ ID NO: 7464475 - DNA, 22 bp, Homo sapiens
ttaagagaagagtatctagaac

SEQ ID NO: 7464476 - DNA, 22 bp, Homo sapiens
ttaagagaagagtatctagaac

SEQ ID NO: 7464477 - DNA, 22 bp, Homo sapiens
ttaagagaagagtatctagaac

SEQ ID NO: 7464478 - DNA, 22 bp, Homo sapiens
ttaagagaaggaatgacctagc

SEQ ID NO: 7464479 - DNA, 22 bp, Homo sapiens
ttaagagaaggaatgacctagc

SEQ ID NO: 7464480 - DNA, 22 bp, Homo sapiens
ttaagagaagagtatctagaac

SEQ ID NO: 7464481 - DNA, 22 bp, Homo sapiens
ttaagagacaggagaatgatgt

SEQ ID NO: 7464482 - DNA, 22 bp, Homo sapiens
ttaagagacaggagaatgatgt

SEQ ID NO: 7464483 - DNA, 22 bp, Homo sapiens
ttaagagacaggagaatgatgt

SEQ ID NO: 7464484 - DNA, 22 bp, Homo sapiens
ttaagagacaggagaatgatgt

SEQ ID NO: 7464485 - DNA, 22 bp, Homo sapiens
ttaagagatttaggaacattat

SEQ ID NO: 7464486 - DNA, 22 bp, Homo sapiens
ttaagagatttaggaacattat

SEQ ID NO: 7464487 - DNA, 22 bp, Homo sapiens
ttaagagatttaggaacattat

SEQ ID NO: 7464488 - DNA, 22 bp, Homo sapiens
ttaagagatttaggaacattat

SEQ ID NO: 7464489 - DNA, 22 bp, Homo sapiens
ttaagacattcagatatttcta

SEQ ID NO: 7464490 - DNA, 22 bp, Homo sapiens
ttaagacattcagatatttcta

SEQ ID NO: 7464491 - DNA, 22 bp, Homo sapiens
ttaagacatgtgagcataactt

SEQ ID NO: 7464492 - DNA, 22 bp, Homo sapiens
ttaagacatgtgagcataactt

SEQ ID NO: 7464493 - DNA, 22 bp, Homo sapiens
ttaagacatttttggagattat

SEQ ID NO: 7464494 - DNA, 22 bp, Homo sapiens
ttaagaaggctgtttgctagac

SEQ ID NO: 7464495 - DNA, 22 bp, Homo sapiens
ttaagaaggcaactggcaacta

SEQ ID NO: 7464496 - DNA, 22 bp, Homo sapiens
ttaagaaggctgtttgctagac

SEQ ID NO: 7464497 - DNA, 22 bp, Homo sapiens
ttaagaaggtactcaaagatct

SEQ ID NO: 7464498 - DNA, 22 bp, Homo sapiens
ttaagaaggtactcaaagatct

SEQ ID NO: 7464499 - DNA, 22 bp, Homo sapiens
ttaagaaggctgtttgctagac

SEQ ID NO: 7464500 - DNA, 22 bp, Homo sapiens
ttaagaaggtactcaaagatct

SEQ ID NO: 7464501 - DNA, 22 bp, Homo sapiens
ttaagaaggtactcaaagatct

SEQ ID NO: 7464502 - DNA, 22 bp, Homo sapiens
ttaagaaggtactcaaagatct

SEQ ID NO: 7464503 - DNA, 22 bp, Homo sapiens
ttaagaaggtactcaaagatct

SEQ ID NO: 7464504 - DNA, 22 bp, Homo sapiens
ttaagaaggtactcaaagatct

SEQ ID NO: 7464505 - DNA, 22 bp, Homo sapiens
ttaagaagtgagtagaagtaat

SEQ ID NO: 7464506 - DNA, 22 bp, Homo sapiens
ttaagaagtgagtagaagtaat

SEQ ID NO: 7464507 - DNA, 22 bp, Homo sapiens
ttaagaagtgagtagaagtaat

SEQ ID NO: 7464508 - DNA, 22 bp, Homo sapiens
ttaagaagtgattttcctcatt

SEQ ID NO: 7464509 - DNA, 22 bp, Homo sapiens
ttaagacacatttctcagacgg

SEQ ID NO: 7464510 - DNA, 22 bp, Homo sapiens
ttaagacagtgtatttgttttc

SEQ ID NO: 7464511 - DNA, 22 bp, Homo sapiens
ttaagacagtgtatttgttttc

SEQ ID NO: 7464512 - DNA, 21 bp, Homo sapiens
ttaagacacacagattaagga

SEQ ID NO: 7464513 - DNA, 21 bp, Homo sapiens
ttaagacacacagattaagga

SEQ ID NO: 7464514 - DNA, 22 bp, Homo sapiens
ttaagacacatttctcagacgg

SEQ ID NO: 7464515 - DNA, 22 bp, Homo sapiens
ttaagacacatttctcagacgg

SEQ ID NO: 7464516 - DNA, 22 bp, Homo sapiens
ttaagaatggaatgaggaattt

SEQ ID NO: 7464517 - DNA, 22 bp, Homo sapiens
ttaagaatgtgccttttggttg

SEQ ID NO: 7464518 - DNA, 22 bp, Homo sapiens
ttaagaatggaatgaggaattt

SEQ ID NO: 7464519 - DNA, 22 bp, Homo sapiens
ttaagaatggaatgaggaattt

SEQ ID NO: 7464520 - DNA, 20 bp, Homo sapiens
ttaagaaaagcacatcctgc

SEQ ID NO: 7464521 - DNA, 20 bp, Homo sapiens
ttaagaaaagcacatcctgc

SEQ ID NO: 7464522 - DNA, 20 bp, Homo sapiens
ttaagaaaagcacatcctgc

SEQ ID NO: 7464523 - DNA, 20 bp, Homo sapiens
ttaagaaaagcacatcctgc

SEQ ID NO: 7464524 - DNA, 20 bp, Homo sapiens
ttaagaaaagcacatcctgc

SEQ ID NO: 7464525 - DNA, 20 bp, Homo sapiens
ttaagaaaagcacatcctgc

SEQ ID NO: 7464526 - DNA, 20 bp, Homo sapiens
ttaagaaaagcacatcctgc

SEQ ID NO: 7464527 - DNA, 22 bp, Homo sapiens
ttaacttgtcagaaaatacagt

SEQ ID NO: 7464528 - DNA, 22 bp, Homo sapiens
ttaacttgtcagaaaatacagt

SEQ ID NO: 7464529 - DNA, 22 bp, Homo sapiens
ttaacttttatttctgctcgcc

SEQ ID NO: 7464530 - DNA, 22 bp, Homo sapiens
ttaacttgtcagaaaatacagt

SEQ ID NO: 7464531 - DNA, 22 bp, Homo sapiens
ttaagaagccacacacctcttt

SEQ ID NO: 7464532 - DNA, 21 bp, Homo sapiens
ttaagaagcactgctctaaga

SEQ ID NO: 7464533 - DNA, 20 bp, Homo sapiens
ttaagaaaagcacatcctgc

SEQ ID NO: 7464534 - DNA, 20 bp, Homo sapiens
ttaagaaaagcacatcctgc

SEQ ID NO: 7464535 - DNA, 20 bp, Homo sapiens
ttaagaaaagcacatcctgc

SEQ ID NO: 7464536 - DNA, 20 bp, Homo sapiens
ttaagaaaagcacatcctgc

SEQ ID NO: 7464537 - DNA, 20 bp, Homo sapiens
ttaagaaaagcacatcctgc

SEQ ID NO: 7464538 - DNA, 20 bp, Homo sapiens
ttaagaaaagcacatcctgc

SEQ ID NO: 7464539 - DNA, 20 bp, Homo sapiens
ttaagaaaagcacatcctgc

SEQ ID NO: 7464540 - DNA, 22 bp, Homo sapiens
ttaacagagaacatagaagtag

SEQ ID NO: 7464541 - DNA, 22 bp, Homo sapiens
ttaacagacatatatatttgta

SEQ ID NO: 7464542 - DNA, 22 bp, Homo sapiens
ttaacagacttgggattttcta

SEQ ID NO: 7464543 - DNA, 22 bp, Homo sapiens
ttaacagaggacacatcaaact

SEQ ID NO: 7464544 - DNA, 22 bp, Homo sapiens
ttaacagagtgcctggcatgta

SEQ ID NO: 7464545 - DNA, 22 bp, Homo sapiens
ttaacagagtgcctggcatgta

SEQ ID NO: 7464546 - DNA, 22 bp, Homo sapiens
ttaacagagtgcctggcatgta

SEQ ID NO: 7464547 - DNA, 22 bp, Homo sapiens
ttaacagaggacacatcaaact

SEQ ID NO: 7464548 - DNA, 22 bp, Homo sapiens
ttaacagaggacacatcaaact

SEQ ID NO: 7464549 - DNA, 22 bp, Homo sapiens
ttaacagagaacatagaagtag

SEQ ID NO: 7464550 - DNA, 22 bp, Homo sapiens
ttaacagagaacatagaagtag

SEQ ID NO: 7464551 - DNA, 22 bp, Homo sapiens
ttaacactcctaactacagtct

SEQ ID NO: 7464552 - DNA, 22 bp, Homo sapiens
ttaacactcctaactacagtct

SEQ ID NO: 7464553 - DNA, 22 bp, Homo sapiens
ttaacactatctgtcataatta

SEQ ID NO: 7464554 - DNA, 22 bp, Homo sapiens
ttaacactatctgtcataatta

SEQ ID NO: 7464555 - DNA, 22 bp, Homo sapiens
ttaacacttgaactctacatgt

SEQ ID NO: 7464556 - DNA, 22 bp, Homo sapiens
ttaacatacatcatgaacaatg

SEQ ID NO: 7464557 - DNA, 22 bp, Homo sapiens
ttaacatacatcatgaacaatg

SEQ ID NO: 7464558 - DNA, 22 bp, Homo sapiens
ttaacatacatcatgaacaatg

SEQ ID NO: 7464559 - DNA, 22 bp, Homo sapiens
ttaacatacatcatgaacaatg

SEQ ID NO: 7464560 - DNA, 22 bp, Homo sapiens
ttaacagttaaacaattggcta

SEQ ID NO: 7464561 - DNA, 22 bp, Homo sapiens
ttaacatacatcatgaacaatg

SEQ ID NO: 7464562 - DNA, 22 bp, Homo sapiens
ttaacatacatcatgaacaatg

SEQ ID NO: 7464563 - DNA, 22 bp, Homo sapiens
ttaacagtggctaagactgagg

SEQ ID NO: 7464564 - DNA, 22 bp, Homo sapiens
ttaacagtaaagaattgtgcaa

SEQ ID NO: 7464565 - DNA, 22 bp, Homo sapiens
ttaacagtaaagaattgtgcaa

SEQ ID NO: 7464566 - DNA, 22 bp, Homo sapiens
ttaacaggttatattgtacagg

SEQ ID NO: 7464567 - DNA, 22 bp, Homo sapiens
ttaacaggttatattgtacagg

SEQ ID NO: 7464568 - DNA, 23 bp, Homo sapiens
ttaacaggatctcgggcaagagg

SEQ ID NO: 7464569 - DNA, 22 bp, Homo sapiens
ttaacaggagtaactctagaaa

SEQ ID NO: 7464570 - DNA, 22 bp, Homo sapiens
ttaacagcttgtaatagaaggg

SEQ ID NO: 7464571 - DNA, 22 bp, Homo sapiens
ttaacagctttgggtctgatat

SEQ ID NO: 7464572 - DNA, 22 bp, Homo sapiens
ttaacagctttgggtctgatat

SEQ ID NO: 7464573 - DNA, 22 bp, Homo sapiens
ttaacagatgtttatggagcat

SEQ ID NO: 7464574 - DNA, 22 bp, Homo sapiens
ttaacagctgttgcttctcttc

SEQ ID NO: 7464575 - DNA, 22 bp, Homo sapiens
ttaacattgtccttagcagatt

SEQ ID NO: 7464576 - DNA, 22 bp, Homo sapiens
ttaacattgtccttagcagatt

SEQ ID NO: 7464577 - DNA, 22 bp, Homo sapiens
ttaacattgtccttagcagatt

SEQ ID NO: 7464578 - DNA, 22 bp, Homo sapiens
ttaacattgtccttagcagatt

SEQ ID NO: 7464579 - DNA, 22 bp, Homo sapiens
ttaacatttcttttccactcat

SEQ ID NO: 7464580 - DNA, 22 bp, Homo sapiens
ttaacatttagtgtacccctgt

SEQ ID NO: 7464581 - DNA, 22 bp, Homo sapiens
ttaacatgtcttgacttcatct

SEQ ID NO: 7464582 - DNA, 22 bp, Homo sapiens
ttaacatgtcttgacttcatct

SEQ ID NO: 7464583 - DNA, 22 bp, Homo sapiens
ttaacatgtcttgacttcatct

SEQ ID NO: 7464584 - DNA, 22 bp, Homo sapiens
ttaacatgtcttgacttcatct

SEQ ID NO: 7464585 - DNA, 22 bp, Homo sapiens
ttaacattaaaagcagcatttt

SEQ ID NO: 7464586 - DNA, 22 bp, Homo sapiens
ttaacattaaaagcagcatttt

SEQ ID NO: 7464587 - DNA, 22 bp, Homo sapiens
ttaacattaaaagcagcatttt

SEQ ID NO: 7464588 - DNA, 22 bp, Homo sapiens
ttaacattaaaagcagcatttt

SEQ ID NO: 7464589 - DNA, 22 bp, Homo sapiens
ttaactctccctccttacatcc

SEQ ID NO: 7464590 - DNA, 22 bp, Homo sapiens
ttaacgaattgtgcataattcc

SEQ ID NO: 7464591 - DNA, 22 bp, Homo sapiens
ttaacgaattgtgcataattcc

SEQ ID NO: 7464592 - DNA, 22 bp, Homo sapiens
ttaactggggaagcatttcatg

SEQ ID NO: 7464593 - DNA, 22 bp, Homo sapiens
ttaactgtgacagtttctcaga

SEQ ID NO: 7464594 - DNA, 22 bp, Homo sapiens
ttaactgtgacagtttctcaga

SEQ ID NO: 7464595 - DNA, 22 bp, Homo sapiens
ttaaccaggacatcagatggct

SEQ ID NO: 7464596 - DNA, 22 bp, Homo sapiens
ttaaccaaataaaagcagactc

SEQ ID NO: 7464597 - DNA, 22 bp, Homo sapiens
ttaaccaaataaaagcagactc

SEQ ID NO: 7464598 - DNA, 22 bp, Homo sapiens
ttaaccagtacttattgagcac

SEQ ID NO: 7464599 - DNA, 22 bp, Homo sapiens
ttaacctaaagaaggatgtgtg

SEQ ID NO: 7464600 - DNA, 22 bp, Homo sapiens
ttaaccaggtcctttgaaaaca

SEQ ID NO: 7464601 - DNA, 22 bp, Homo sapiens
ttaacctaactcatggaaaaca

SEQ ID NO: 7464602 - DNA, 22 bp, Homo sapiens
ttaacatttgtgaagcatttag

SEQ ID NO: 7464603 - DNA, 22 bp, Homo sapiens
ttaacatttgtgaagcatttag

SEQ ID NO: 7464604 - DNA, 22 bp, Homo sapiens
ttaacatttcttttccactcat

SEQ ID NO: 7464605 - DNA, 22 bp, Homo sapiens
ttaacatttgtgaagcatttag

SEQ ID NO: 7464606 - DNA, 22 bp, Homo sapiens
ttaacatttgtgaagcatttag

SEQ ID NO: 7464607 - DNA, 22 bp, Homo sapiens
ttaacatttgtgaagcatttag

SEQ ID NO: 7464608 - DNA, 22 bp, Homo sapiens
ttaattctgcctttcatgtaac

SEQ ID NO: 7464609 - DNA, 22 bp, Homo sapiens
ttaattctgcctttcatgtaac

SEQ ID NO: 7464610 - DNA, 22 bp, Homo sapiens
ttaattcttccggactgtgaaa

SEQ ID NO: 7464611 - DNA, 22 bp, Homo sapiens
ttaattgagccagaaagtatct

SEQ ID NO: 7464612 - DNA, 22 bp, Homo sapiens
ttaattgagccagaaagtatct

SEQ ID NO: 7464613 - DNA, 22 bp, Homo sapiens
ttaattgagccagaaagtatct

SEQ ID NO: 7464614 - DNA, 22 bp, Homo sapiens
ttaattcttccggactgtgaaa

SEQ ID NO: 7464615 - DNA, 22 bp, Homo sapiens
ttaattctgcctttcatgtaac

SEQ ID NO: 7464616 - DNA, 22 bp, Homo sapiens
ttaattctagtttaacacttag

SEQ ID NO: 7464617 - DNA, 22 bp, Homo sapiens
ttaattctagtttaacacttag

SEQ ID NO: 7464618 - DNA, 22 bp, Homo sapiens
ttaattctagtttaacacttag

SEQ ID NO: 7464619 - DNA, 22 bp, Homo sapiens
ttaattctagtttaacacttag

SEQ ID NO: 7464620 - DNA, 22 bp, Homo sapiens
ttaattgatataaagaacttca

SEQ ID NO: 7464621 - DNA, 22 bp, Homo sapiens
ttaattgagccagaaagtatct

SEQ ID NO: 7464622 - DNA, 22 bp, Homo sapiens
ttaattgatataaagaacttca

SEQ ID NO: 7464623 - DNA, 22 bp, Homo sapiens
ttaattgttggaaatagattat

SEQ ID NO: 7464624 - DNA, 22 bp, Homo sapiens
ttaattgtctgtgagtacctga

SEQ ID NO: 7464625 - DNA, 22 bp, Homo sapiens
ttaattgtaaagtttgcctgtt

SEQ ID NO: 7464626 - DNA, 22 bp, Homo sapiens
ttaatttatacataatcacagg

SEQ ID NO: 7464627 - DNA, 22 bp, Homo sapiens
ttaatttatacataatcacagg

SEQ ID NO: 7464628 - DNA, 22 bp, Homo sapiens
ttaatttatacataatcacagg

SEQ ID NO: 7464629 - DNA, 22 bp, Homo sapiens
ttaatttatacataatcacagg

SEQ ID NO: 7464630 - DNA, 22 bp, Homo sapiens
ttaatttatgtccaaaccagat

SEQ ID NO: 7464631 - DNA, 22 bp, Homo sapiens
ttaatttatgtccaaaccagat

SEQ ID NO: 7464632 - DNA, 22 bp, Homo sapiens
ttaatttatgtccaaaccagat

SEQ ID NO: 7464633 - DNA, 22 bp, Homo sapiens
ttaatttatgtccaaaccagat

SEQ ID NO: 7464634 - DNA, 22 bp, Homo sapiens
ttaatttatgtccaaaccagat

SEQ ID NO: 7464635 - DNA, 22 bp, Homo sapiens
ttaatttatacataatcacagg

SEQ ID NO: 7464636 - DNA, 22 bp, Homo sapiens
ttaatttatacataatcacagg

SEQ ID NO: 7464637 - DNA, 22 bp, Homo sapiens
ttaatttatacataatcacagg

SEQ ID NO: 7464638 - DNA, 22 bp, Homo sapiens
ttaatttatacataatcacagg

SEQ ID NO: 7464639 - DNA, 22 bp, Homo sapiens
ttaatttatacataatcacagg

SEQ ID NO: 7464640 - DNA, 22 bp, Homo sapiens
ttaatttatacataatcacagg

SEQ ID NO: 7464641 - DNA, 22 bp, Homo sapiens
ttaatttatacataatcacagg

SEQ ID NO: 7464642 - DNA, 22 bp, Homo sapiens
ttaatttaagaaacggcaggcc

SEQ ID NO: 7464643 - DNA, 22 bp, Homo sapiens
ttaattgttggaaatagattat

SEQ ID NO: 7464644 - DNA, 22 bp, Homo sapiens
ttaattgttggaaatagattat

SEQ ID NO: 7464645 - DNA, 22 bp, Homo sapiens
ttaataaacaggtgcagctgaa

SEQ ID NO: 7464646 - DNA, 22 bp, Homo sapiens
ttaataaagtatgaattggaaa

SEQ ID NO: 7464647 - DNA, 22 bp, Homo sapiens
ttaataaagtatgaattggaaa

SEQ ID NO: 7464648 - DNA, 22 bp, Homo sapiens
ttaataaagtatgaattggaaa

SEQ ID NO: 7464649 - DNA, 22 bp, Homo sapiens
ttaataaagtatgaattggaaa

SEQ ID NO: 7464650 - DNA, 22 bp, Homo sapiens
ttaataaacaggtgcagctgaa

SEQ ID NO: 7464651 - DNA, 22 bp, Homo sapiens
ttaataaacaggtgcagctgaa

SEQ ID NO: 7464652 - DNA, 22 bp, Homo sapiens
ttaataaacaggtgcagctgaa

SEQ ID NO: 7464653 - DNA, 22 bp, Homo sapiens
ttaataaacaggtgcagctgaa

SEQ ID NO: 7464654 - DNA, 22 bp, Homo sapiens
ttaataaacaggtgcagctgaa

SEQ ID NO: 7464655 - DNA, 22 bp, Homo sapiens
ttaataaacaggtgcagctgaa

SEQ ID NO: 7464656 - DNA, 22 bp, Homo sapiens
ttaataaacaggtgcagctgaa

SEQ ID NO: 7464657 - DNA, 22 bp, Homo sapiens
ttaataaacaggtgcagctgaa

SEQ ID NO: 7464658 - DNA, 22 bp, Homo sapiens
ttaataaacaggtgcagctgaa

SEQ ID NO: 7464659 - DNA, 22 bp, Homo sapiens
ttaataaacaggtgcagctgaa

SEQ ID NO: 7464660 - DNA, 22 bp, Homo sapiens
ttaataaacaggtgcagctgaa

SEQ ID NO: 7464661 - DNA, 22 bp, Homo sapiens
ttaataaacaggtgcagctgaa

SEQ ID NO: 7464662 - DNA, 22 bp, Homo sapiens
ttaataaacaggtgcagctgaa

SEQ ID NO: 7464663 - DNA, 22 bp, Homo sapiens
ttaataaacaggtgcagctgaa

SEQ ID NO: 7464664 - DNA, 22 bp, Homo sapiens
ttaataaacaggtgcagctgaa

SEQ ID NO: 7464665 - DNA, 22 bp, Homo sapiens
ttaattaattagttaagcatgt

SEQ ID NO: 7464666 - DNA, 22 bp, Homo sapiens
ttaattaattagttaagcatgt

SEQ ID NO: 7464667 - DNA, 22 bp, Homo sapiens
ttaattacaaaacacataggtt

SEQ ID NO: 7464668 - DNA, 22 bp, Homo sapiens
ttaattacaaaacacataggtt

SEQ ID NO: 7464669 - DNA, 22 bp, Homo sapiens
ttaattactaagcacaatgcaa

SEQ ID NO: 7464670 - DNA, 22 bp, Homo sapiens
ttaattactaagcacaatgcaa

SEQ ID NO: 7464671 - DNA, 22 bp, Homo sapiens
ttaattagagctgatgttcata

SEQ ID NO: 7464672 - DNA, 22 bp, Homo sapiens
ttaattcagtcaaagaaaccat

SEQ ID NO: 7464673 - DNA, 22 bp, Homo sapiens
ttaattcagtcaaagaaaccat

SEQ ID NO: 7464674 - DNA, 22 bp, Homo sapiens
ttaattatgcaaaaggccccat

SEQ ID NO: 7464675 - DNA, 22 bp, Homo sapiens
ttaattatgagaaagggaaaag

SEQ ID NO: 7464676 - DNA, 22 bp, Homo sapiens
ttaattagtagaggcatttagt

SEQ ID NO: 7464677 - DNA, 22 bp, Homo sapiens
ttaattagtagaggcatttagt

SEQ ID NO: 7464678 - DNA, 22 bp, Homo sapiens
ttaattatgagaaagggaaaag

SEQ ID NO: 7464679 - DNA, 22 bp, Homo sapiens
ttaattatgagaaagggaaaag

SEQ ID NO: 7464680 - DNA, 22 bp, Homo sapiens
ttaaggaatttatagttgtact

SEQ ID NO: 7464681 - DNA, 22 bp, Homo sapiens
ttaaggaatttatagttgtact

SEQ ID NO: 7464682 - DNA, 22 bp, Homo sapiens
ttaaggaattacgaaaatattt

SEQ ID NO: 7464683 - DNA, 22 bp, Homo sapiens
ttaaggaatgtgcagtttatat

SEQ ID NO: 7464684 - DNA, 22 bp, Homo sapiens
ttaaggaatgtgcagtttatat

SEQ ID NO: 7464685 - DNA, 22 bp, Homo sapiens
ttaaggaatgtgcagtttatat

SEQ ID NO: 7464686 - DNA, 22 bp, Homo sapiens
ttaaggaattacgaaaatattt

SEQ ID NO: 7464687 - DNA, 22 bp, Homo sapiens
ttaaggaattacgaaaatattt

SEQ ID NO: 7464688 - DNA, 22 bp, Homo sapiens
ttaaggaattacgaaaatattt

SEQ ID NO: 7464689 - DNA, 22 bp, Homo sapiens
ttaaggaggacgttcctggtgg

SEQ ID NO: 7464690 - DNA, 22 bp, Homo sapiens
ttaaggagcagaatgcttggac

SEQ ID NO: 7464691 - DNA, 23 bp, Homo sapiens
ttaaggagcttgcactctgggtg

SEQ ID NO: 7464692 - DNA, 23 bp, Homo sapiens
ttaaggagcttgcactctgggtg

SEQ ID NO: 7464693 - DNA, 22 bp, Homo sapiens
ttaaggagcacagtgtattaat

SEQ ID NO: 7464694 - DNA, 22 bp, Homo sapiens
ttaaggattagtcaaagagggc

SEQ ID NO: 7464695 - DNA, 22 bp, Homo sapiens
ttaaggattactttgtgtaccc

SEQ ID NO: 7464696 - DNA, 22 bp, Homo sapiens
ttaaggcattgatatggtgcta

SEQ ID NO: 7464697 - DNA, 22 bp, Homo sapiens
ttaaggctgagatctattacgc

SEQ ID NO: 7464698 - DNA, 22 bp, Homo sapiens
ttaaggcatagcttgtgttgac

SEQ ID NO: 7464699 - DNA, 22 bp, Homo sapiens
ttaaggcacctgggggtgaact

SEQ ID NO: 7464700 - DNA, 22 bp, Homo sapiens
ttaaggcattctcctactaata

SEQ ID NO: 7464701 - DNA, 22 bp, Homo sapiens
ttaaggttgagctcacttttat

SEQ ID NO: 7464702 - DNA, 23 bp, Homo sapiens
ttaaggttcagctttcccatgac

SEQ ID NO: 7464703 - DNA, 22 bp, Homo sapiens
ttaaggttcagtgtggcaggac

SEQ ID NO: 7464704 - DNA, 22 bp, Homo sapiens
ttaaggttcagtgtggcaggac

SEQ ID NO: 7464705 - DNA, 22 bp, Homo sapiens
ttaaggttaaataaggtcatat

SEQ ID NO: 7464706 - DNA, 22 bp, Homo sapiens
ttaaggttaaataaggtcataa

SEQ ID NO: 7464707 - DNA, 17 bp, Homo sapiens
ttaaggtggatcagcac

SEQ ID NO: 7464708 - DNA, 22 bp, Homo sapiens
ttaaggtgctttatttagctct

SEQ ID NO: 7464709 - DNA, 22 bp, Homo sapiens
ttaaggtgctttatttagctct

SEQ ID NO: 7464710 - DNA, 17 bp, Homo sapiens
ttaaggtggatcagcac

SEQ ID NO: 7464711 - DNA, 22 bp, Homo sapiens
ttaaggtccacagtataaagat

SEQ ID NO: 7464712 - DNA, 22 bp, Homo sapiens
ttaaggtccacagtataaagat

SEQ ID NO: 7464713 - DNA, 22 bp, Homo sapiens
ttaaggctggtcccctctgcgt

SEQ ID NO: 7464714 - DNA, 22 bp, Homo sapiens
ttaaggctgtaagatacattca

SEQ ID NO: 7464715 - DNA, 22 bp, Homo sapiens
ttaaggctgataagtcagatat

SEQ ID NO: 7464716 - DNA, 22 bp, Homo sapiens
ttaaggctggtcccctctgcgt

SEQ ID NO: 7464717 - DNA, 22 bp, Homo sapiens
ttaaggctgtaagatacattca

SEQ ID NO: 7464718 - DNA, 22 bp, Homo sapiens
ttaaggctgtggggattactgc

SEQ ID NO: 7464719 - DNA, 22 bp, Homo sapiens
ttaaggctgtggggattactgc

SEQ ID NO: 7464720 - DNA, 22 bp, Homo sapiens
ttaaggctgttggtatttcaga

SEQ ID NO: 7464721 - DNA, 21 bp, Homo sapiens
ttaaggtcacttctgagccta

SEQ ID NO: 7464722 - DNA, 22 bp, Homo sapiens
ttaaggggacagattttgtcag

SEQ ID NO: 7464723 - DNA, 22 bp, Homo sapiens
ttaagggccattatggatgggt

SEQ ID NO: 7464724 - DNA, 22 bp, Homo sapiens
ttaagggccattatggatgggt

SEQ ID NO: 7464725 - DNA, 22 bp, Homo sapiens
ttaagggccattatggatgggt

SEQ ID NO: 7464726 - DNA, 22 bp, Homo sapiens
ttaagggccattatggatgggt

SEQ ID NO: 7464727 - DNA, 18 bp, Homo sapiens
ttaagttttactgcttta

SEQ ID NO: 7464728 - DNA, 22 bp, Homo sapiens
ttaagtgtttagtaagagatgt

SEQ ID NO: 7464729 - DNA, 21 bp, Homo sapiens
ttaagtgtttctccattgtta

SEQ ID NO: 7464730 - DNA, 22 bp, Homo sapiens
ttaagtgtcataatttccaaga

SEQ ID NO: 7464731 - DNA, 22 bp, Homo sapiens
ttaagtgtagtgctaagggcag

SEQ ID NO: 7464732 - DNA, 22 bp, Homo sapiens
ttaagtgcttcaagggaagctc

SEQ ID NO: 7464733 - DNA, 22 bp, Homo sapiens
ttaagtgcttcaagggaagctc

SEQ ID NO: 7464734 - DNA, 22 bp, Homo sapiens
ttaagtgcctacttgtgagtta

SEQ ID NO: 7464735 - DNA, 22 bp, Homo sapiens
ttaagtgcctctaaaacaagcc

SEQ ID NO: 7464736 - DNA, 22 bp, Homo sapiens
ttaagtgcctctaaaacaagcc

SEQ ID NO: 7464737 - DNA, 22 bp, Homo sapiens
ttaagtgcctctaaaacaagcc

SEQ ID NO: 7464738 - DNA, 22 bp, Homo sapiens
ttaagtgcctctaaaacaagcc

SEQ ID NO: 7464739 - DNA, 18 bp, Homo sapiens
ttaagtgctatgcaattg

SEQ ID NO: 7464740 - DNA, 18 bp, Homo sapiens
ttaagtgctatgcaattg

SEQ ID NO: 7464741 - DNA, 23 bp, Homo sapiens
ttaagtggtcagttttagacaac

SEQ ID NO: 7464742 - DNA, 22 bp, Homo sapiens
ttaagtgcaaaaatgaaagtat

SEQ ID NO: 7464743 - DNA, 22 bp, Homo sapiens
ttaagtgcaaaaatgaaagtat

SEQ ID NO: 7464744 - DNA, 22 bp, Homo sapiens
ttaagtgccagtgctccctcag

SEQ ID NO: 7464745 - DNA, 22 bp, Homo sapiens
ttaagtgccagtgctccctcag

SEQ ID NO: 7464746 - DNA, 22 bp, Homo sapiens
ttaagtgcacaatgaggtcaca

SEQ ID NO: 7464747 - DNA, 22 bp, Homo sapiens
ttaagtgcacaatgaggtcaca

SEQ ID NO: 7464748 - DNA, 22 bp, Homo sapiens
ttaagtgcaaaaatgaaagtat

SEQ ID NO: 7464749 - DNA, 22 bp, Homo sapiens
ttaagtgcaaaaatgaaagtat

SEQ ID NO: 7464750 - DNA, 22 bp, Homo sapiens
ttaagtgagcttgaataatctt

SEQ ID NO: 7464751 - DNA, 22 bp, Homo sapiens
ttaagtgagcttgaataatctt

SEQ ID NO: 7464752 - DNA, 22 bp, Homo sapiens
ttaagtaacttgtccaaatgag

SEQ ID NO: 7464753 - DNA, 22 bp, Homo sapiens
ttaagtaagaccttatgtcttg

SEQ ID NO: 7464754 - DNA, 22 bp, Homo sapiens
ttaagtaacttgtccaaatgag

SEQ ID NO: 7464755 - DNA, 22 bp, Homo sapiens
ttaagtaagaccttatgtcttg

SEQ ID NO: 7464756 - DNA, 22 bp, Homo sapiens
ttaagtacagggttagtgacgg

SEQ ID NO: 7464757 - DNA, 22 bp, Homo sapiens
ttaagtatatccatttgactgg

SEQ ID NO: 7464758 - DNA, 22 bp, Homo sapiens
ttaagtatatccatttgactgg

SEQ ID NO: 7464759 - DNA, 22 bp, Homo sapiens
ttaagtcaatatcaatctcagc

SEQ ID NO: 7464760 - DNA, 22 bp, Homo sapiens
ttaagtatatccatttgactgg

SEQ ID NO: 7464761 - DNA, 22 bp, Homo sapiens
ttaagtatatccatttgactgg

SEQ ID NO: 7464762 - DNA, 22 bp, Homo sapiens
ttaagtcatttctgattataga

SEQ ID NO: 7464763 - DNA, 22 bp, Homo sapiens
ttaagtcacttatctaaagaca

SEQ ID NO: 7464764 - DNA, 22 bp, Homo sapiens
ttaagtcacttatctaaagaca

SEQ ID NO: 7464765 - DNA, 22 bp, Homo sapiens
ttaagtgagcttgaataatctt

SEQ ID NO: 7464766 - DNA, 22 bp, Homo sapiens
ttaagtctctttgaagtgctct

SEQ ID NO: 7464767 - DNA, 22 bp, Homo sapiens
ttaagtctctttgaagtgctct

SEQ ID NO: 7464768 - DNA, 22 bp, Homo sapiens
ttaagtgagcttgaataatctt

SEQ ID NO: 7464769 - DNA, 22 bp, Homo sapiens
ttaagtcatttctgattataga

SEQ ID NO: 7464770 - DNA, 22 bp, Homo sapiens
ttaagtcatttctgattataga

SEQ ID NO: 7464771 - DNA, 22 bp, Homo sapiens
ttaagtccttggtaattttctt

SEQ ID NO: 7464772 - DNA, 22 bp, Homo sapiens
ttaagtcatttctgattataga

SEQ ID NO: 7464773 - DNA, 22 bp, Homo sapiens
ttaaatgagatgttcagatatt

SEQ ID NO: 7464774 - DNA, 22 bp, Homo sapiens
ttaaatgagatgttcagatatt

SEQ ID NO: 7464775 - DNA, 22 bp, Homo sapiens
ttaaatgaggctgatgtagatt

SEQ ID NO: 7464776 - DNA, 22 bp, Homo sapiens
ttaaatgaggctgatgtagatt

SEQ ID NO: 7464777 - DNA, 22 bp, Homo sapiens
ttaaatgagatgttcagatatt

SEQ ID NO: 7464778 - DNA, 22 bp, Homo sapiens
ttaaatgagatgttcagatatt

SEQ ID NO: 7464779 - DNA, 22 bp, Homo sapiens
ttaaatgagatgttcagatatt

SEQ ID NO: 7464780 - DNA, 22 bp, Homo sapiens
ttaaatgagatgttcagatatt

SEQ ID NO: 7464781 - DNA, 22 bp, Homo sapiens
ttaaatgaggctgatgtagatt

SEQ ID NO: 7464782 - DNA, 22 bp, Homo sapiens
ttaaatgaggctgatgtagatt

SEQ ID NO: 7464783 - DNA, 22 bp, Homo sapiens
ttaaatgaggctgatgtagatt

SEQ ID NO: 7464784 - DNA, 22 bp, Homo sapiens
ttaaatgatgcatatcatttag

SEQ ID NO: 7464785 - DNA, 22 bp, Homo sapiens
ttaaatgatgcatatcatttag

SEQ ID NO: 7464786 - DNA, 22 bp, Homo sapiens
ttaaatgaggctgatgtagatt

SEQ ID NO: 7464787 - DNA, 22 bp, Homo sapiens
ttaaatgaggctgatgtagatt

SEQ ID NO: 7464788 - DNA, 22 bp, Homo sapiens
ttaaatgctcacataaaggtag

SEQ ID NO: 7464789 - DNA, 22 bp, Homo sapiens
ttaaatggggatgagtagatgg

SEQ ID NO: 7464790 - DNA, 22 bp, Homo sapiens
ttaaatgctcacataaaggtag

SEQ ID NO: 7464791 - DNA, 22 bp, Homo sapiens
ttaaatgtcaatagattgcttg

SEQ ID NO: 7464792 - DNA, 22 bp, Homo sapiens
ttaaatgtcaatagattgcttg

SEQ ID NO: 7464793 - DNA, 22 bp, Homo sapiens
ttaaatgatgcatatcatttag

SEQ ID NO: 7464794 - DNA, 22 bp, Homo sapiens
ttaaatgatgcatatcatttag

SEQ ID NO: 7464795 - DNA, 22 bp, Homo sapiens
ttaaatgatgcatatcatttag

SEQ ID NO: 7464796 - DNA, 22 bp, Homo sapiens
ttaaatgatgcatatcatttag

SEQ ID NO: 7464797 - DNA, 22 bp, Homo sapiens
ttaaatgatgcatatcatttag

SEQ ID NO: 7464798 - DNA, 22 bp, Homo sapiens
ttaaatgatgcatatcatttag

SEQ ID NO: 7464799 - DNA, 22 bp, Homo sapiens
ttaaatgatgcatatcatttag

SEQ ID NO: 7464800 - DNA, 22 bp, Homo sapiens
ttaaatgatgcatatcatttag

SEQ ID NO: 7464801 - DNA, 22 bp, Homo sapiens
ttaaatgatgcatatcatttag

SEQ ID NO: 7464802 - DNA, 22 bp, Homo sapiens
ttaaatgaacgagatatgcaac

SEQ ID NO: 7464803 - DNA, 22 bp, Homo sapiens
ttaaatgaacgagatatgcaac

SEQ ID NO: 7464804 - DNA, 22 bp, Homo sapiens
ttaaatgacttttattattctc

SEQ ID NO: 7464805 - DNA, 22 bp, Homo sapiens
ttaaatgacgggactgggtttt

SEQ ID NO: 7464806 - DNA, 22 bp, Homo sapiens
ttaaatgacgggactgggtttt

SEQ ID NO: 7464807 - DNA, 22 bp, Homo sapiens
ttaaatgagatgttcagatatt

SEQ ID NO: 7464808 - DNA, 22 bp, Homo sapiens
ttaaatgacttttattattctc

SEQ ID NO: 7464809 - DNA, 22 bp, Homo sapiens
ttaaatgagatgttcagatatt

SEQ ID NO: 7464810 - DNA, 22 bp, Homo sapiens
ttaaatgagatgttcagatatt

SEQ ID NO: 7464811 - DNA, 22 bp, Homo sapiens
ttaaatgagatgttcagatatt

SEQ ID NO: 7464812 - DNA, 22 bp, Homo sapiens
ttaaatgagatgttcagatatt

SEQ ID NO: 7464813 - DNA, 22 bp, Homo sapiens
ttaaatgagatgttcagatatt

SEQ ID NO: 7464814 - DNA, 22 bp, Homo sapiens
ttaaatgacttttattattctc

SEQ ID NO: 7464815 - DNA, 22 bp, Homo sapiens
ttaaatgacttttattattctc

SEQ ID NO: 7464816 - DNA, 22 bp, Homo sapiens
ttaaatgacttttattattctc

SEQ ID NO: 7464817 - DNA, 22 bp, Homo sapiens
ttaaatgacttttattattctc

SEQ ID NO: 7464818 - DNA, 22 bp, Homo sapiens
ttaaatcaggcatcatttcagt

SEQ ID NO: 7464819 - DNA, 22 bp, Homo sapiens
ttaaatattttcagcagggtca

SEQ ID NO: 7464820 - DNA, 22 bp, Homo sapiens
ttaaatcaggcatcatttcagt

SEQ ID NO: 7464821 - DNA, 22 bp, Homo sapiens
ttaaatcaggcatcatttcagt

SEQ ID NO: 7464822 - DNA, 22 bp, Homo sapiens
ttaaatattttcagcagggtca

SEQ ID NO: 7464823 - DNA, 22 bp, Homo sapiens
ttaaatattttcagcagggtca

SEQ ID NO: 7464824 - DNA, 22 bp, Homo sapiens
ttaaatattttcagcagggtca

SEQ ID NO: 7464825 - DNA, 22 bp, Homo sapiens
ttaaatattttcagcagggtca

SEQ ID NO: 7464826 - DNA, 22 bp, Homo sapiens
ttaaatgaacgagatatgcaac

SEQ ID NO: 7464827 - DNA, 22 bp, Homo sapiens
ttaaatgaacgagatatgcaac

SEQ ID NO: 7464828 - DNA, 22 bp, Homo sapiens
ttaaatgaacgagatatgcaac

SEQ ID NO: 7464829 - DNA, 22 bp, Homo sapiens
ttaaatgaacgagatatgcaac

SEQ ID NO: 7464830 - DNA, 22 bp, Homo sapiens
ttaaatgaacgagatatgcaac

SEQ ID NO: 7464831 - DNA, 22 bp, Homo sapiens
ttaaatgaacgagatatgcaac

SEQ ID NO: 7464832 - DNA, 22 bp, Homo sapiens
ttaaatgaacgagatatgcaac

SEQ ID NO: 7464833 - DNA, 22 bp, Homo sapiens
ttaaatcaggcatcatttcagt

SEQ ID NO: 7464834 - DNA, 22 bp, Homo sapiens
ttaaatcagtaggctactcctt

SEQ ID NO: 7464835 - DNA, 22 bp, Homo sapiens
ttaaatcagtaggctactcctt

SEQ ID NO: 7464836 - DNA, 22 bp, Homo sapiens
ttaaatcagtaggctactcctt

SEQ ID NO: 7464837 - DNA, 22 bp, Homo sapiens
ttaaatctgttctcatgtctgt

SEQ ID NO: 7464838 - DNA, 22 bp, Homo sapiens
ttaaatgtttaatctaacttga

SEQ ID NO: 7464839 - DNA, 22 bp, Homo sapiens
ttaaatgtttaatctaacttga

SEQ ID NO: 7464840 - DNA, 22 bp, Homo sapiens
ttaaatgtttaatctaacttga

SEQ ID NO: 7464841 - DNA, 22 bp, Homo sapiens
ttaaatgtgcctaaacctgtaa

SEQ ID NO: 7464842 - DNA, 22 bp, Homo sapiens
ttaaatgtgatttcatttatgt

SEQ ID NO: 7464843 - DNA, 22 bp, Homo sapiens
ttaaatgtgatttcatttatgt

SEQ ID NO: 7464844 - DNA, 22 bp, Homo sapiens
ttaaatgtgatcctggtatgca

SEQ ID NO: 7464845 - DNA, 22 bp, Homo sapiens
ttaaatgtctgtagatgtgctg

SEQ ID NO: 7464846 - DNA, 22 bp, Homo sapiens
ttaaatgtctgtagatgtgctg

SEQ ID NO: 7464847 - DNA, 22 bp, Homo sapiens
ttaaatgtctgtagatgtgctg

SEQ ID NO: 7464848 - DNA, 22 bp, Homo sapiens
ttaaatgtcaatagattgcttg

SEQ ID NO: 7464849 - DNA, 22 bp, Homo sapiens
ttaaatgtgatttcatttatgt

SEQ ID NO: 7464850 - DNA, 22 bp, Homo sapiens
ttaaatgtgatttcatttatgt

SEQ ID NO: 7464851 - DNA, 22 bp, Homo sapiens
ttaaatgtgatttcatttatgt

SEQ ID NO: 7464852 - DNA, 22 bp, Homo sapiens
ttaaatgtgatttcatttatgt

SEQ ID NO: 7464853 - DNA, 22 bp, Homo sapiens
ttaaatgtgatttcatttatgt

SEQ ID NO: 7464854 - DNA, 22 bp, Homo sapiens
ttaaatgtgatttcatttatgt

SEQ ID NO: 7464855 - DNA, 22 bp, Homo sapiens
ttaaatgtgatttcatttatgt

SEQ ID NO: 7464856 - DNA, 22 bp, Homo sapiens
ttaaatgtgatttcatttatgt

SEQ ID NO: 7464857 - DNA, 22 bp, Homo sapiens
ttaaatgtgatcctggtatgca

SEQ ID NO: 7464858 - DNA, 22 bp, Homo sapiens
ttaaatgtgatcctggtatgca

SEQ ID NO: 7464859 - DNA, 22 bp, Homo sapiens
ttaaattagtcaagcttctctg

SEQ ID NO: 7464860 - DNA, 22 bp, Homo sapiens
ttaacaaaaatatcaggcatca

SEQ ID NO: 7464861 - DNA, 22 bp, Homo sapiens
ttaacaaaaatatcaggcatca

SEQ ID NO: 7464862 - DNA, 22 bp, Homo sapiens
ttaacaaaaatatcaggcatca

SEQ ID NO: 7464863 - DNA, 22 bp, Homo sapiens
ttaaattaggactctagttctg

SEQ ID NO: 7464864 - DNA, 22 bp, Homo sapiens
ttaaattaggactctagttctg

SEQ ID NO: 7464865 - DNA, 22 bp, Homo sapiens
ttaacaaaaatatcaggcatca

SEQ ID NO: 7464866 - DNA, 22 bp, Homo sapiens
ttaacaaaaatatcaggcatca

SEQ ID NO: 7464867 - DNA, 22 bp, Homo sapiens
ttaacaaaaatatcaggcatca

SEQ ID NO: 7464868 - DNA, 22 bp, Homo sapiens
ttaacaaaaatatcaggcatca

SEQ ID NO: 7464869 - DNA, 22 bp, Homo sapiens
ttaacaaaaatatcaggcatca

SEQ ID NO: 7464870 - DNA, 22 bp, Homo sapiens
ttaaattaggactctagttctg

SEQ ID NO: 7464871 - DNA, 22 bp, Homo sapiens
ttaaattaggactctagttctg

SEQ ID NO: 7464872 - DNA, 22 bp, Homo sapiens
ttaaattaggactctagttctg

SEQ ID NO: 7464873 - DNA, 22 bp, Homo sapiens
ttaaattaggactctagttctg

SEQ ID NO: 7464874 - DNA, 22 bp, Homo sapiens
ttaaattaggactctagttctg

SEQ ID NO: 7464875 - DNA, 22 bp, Homo sapiens
ttaaattaggactctagttctg

SEQ ID NO: 7464876 - DNA, 22 bp, Homo sapiens
ttaaattaggactctagttctg

SEQ ID NO: 7464877 - DNA, 22 bp, Homo sapiens
ttaaattaggactctagttctg

SEQ ID NO: 7464878 - DNA, 22 bp, Homo sapiens
ttaacaatagagtttcttcagg

SEQ ID NO: 7464879 - DNA, 22 bp, Homo sapiens
ttaacaatagagtttcttcagg

SEQ ID NO: 7464880 - DNA, 22 bp, Homo sapiens
ttaacaatagagtttcttcagg

SEQ ID NO: 7464881 - DNA, 22 bp, Homo sapiens
ttaacaatagagtttcttcagg

SEQ ID NO: 7464882 - DNA, 22 bp, Homo sapiens
ttaacaatagagtttcttcagg

SEQ ID NO: 7464883 - DNA, 22 bp, Homo sapiens
ttaacaatagagtttcttcagg

SEQ ID NO: 7464884 - DNA, 22 bp, Homo sapiens
ttaacaatagagtttcttcagg

SEQ ID NO: 7464885 - DNA, 22 bp, Homo sapiens
ttaacaaatatttcccatgccc

SEQ ID NO: 7464886 - DNA, 22 bp, Homo sapiens
ttaacaaatatttcccatgccc

SEQ ID NO: 7464887 - DNA, 22 bp, Homo sapiens
ttaacaaagctctgttcctttt

SEQ ID NO: 7464888 - DNA, 22 bp, Homo sapiens
ttaacaaagctctgttcctttt

SEQ ID NO: 7464889 - DNA, 22 bp, Homo sapiens
ttaacaaagctctgttcctttt

SEQ ID NO: 7464890 - DNA, 22 bp, Homo sapiens
ttaacaaaaatatcaggcatca

SEQ ID NO: 7464891 - DNA, 22 bp, Homo sapiens
ttaacaaagctctgttcctttt

SEQ ID NO: 7464892 - DNA, 22 bp, Homo sapiens
ttaacaaagtaacgggaaaaga

SEQ ID NO: 7464893 - DNA, 22 bp, Homo sapiens
ttaacaaagtaacgggaaaaga

SEQ ID NO: 7464894 - DNA, 22 bp, Homo sapiens
ttaacaaagtaacgggaaaaga

SEQ ID NO: 7464895 - DNA, 22 bp, Homo sapiens
ttaacaaagtaacgggaaaaga

SEQ ID NO: 7464896 - DNA, 22 bp, Homo sapiens
ttaacaaagtaacgggaaaaga

SEQ ID NO: 7464897 - DNA, 22 bp, Homo sapiens
ttaacaaagtaacgggaaaaga

SEQ ID NO: 7464898 - DNA, 22 bp, Homo sapiens
ttaacacatatttatcaattgc

SEQ ID NO: 7464899 - DNA, 22 bp, Homo sapiens
ttaacacatatttatcaattgc

SEQ ID NO: 7464900 - DNA, 22 bp, Homo sapiens
ttaacacatatttatcaattgc

SEQ ID NO: 7464901 - DNA, 22 bp, Homo sapiens
ttaacacatatttatcaattgc

SEQ ID NO: 7464902 - DNA, 22 bp, Homo sapiens
ttaacacagggggagacaaagt

SEQ ID NO: 7464903 - DNA, 22 bp, Homo sapiens
ttaacacagggggagacaaagt

SEQ ID NO: 7464904 - DNA, 22 bp, Homo sapiens
ttaacacagggggagacaaagt

SEQ ID NO: 7464905 - DNA, 22 bp, Homo sapiens
ttaacacagggggagacaaagt

SEQ ID NO: 7464906 - DNA, 22 bp, Homo sapiens
ttaacacatatttatcaattgc

SEQ ID NO: 7464907 - DNA, 22 bp, Homo sapiens
ttaacacatatttatcaattgc

SEQ ID NO: 7464908 - DNA, 22 bp, Homo sapiens
ttaacacatatttatcaattgc

SEQ ID NO: 7464909 - DNA, 22 bp, Homo sapiens
ttaacacagggggagacaaagt

SEQ ID NO: 7464910 - DNA, 22 bp, Homo sapiens
ttaacacagggggagacaaagt

SEQ ID NO: 7464911 - DNA, 22 bp, Homo sapiens
ttaacacagggggagacaaagt

SEQ ID NO: 7464912 - DNA, 22 bp, Homo sapiens
ttaacacagggggagacaaagt

SEQ ID NO: 7464913 - DNA, 22 bp, Homo sapiens
ttaacacagggggagacaaagt

SEQ ID NO: 7464914 - DNA, 22 bp, Homo sapiens
ttaacacagggggagacaaagt

SEQ ID NO: 7464915 - DNA, 22 bp, Homo sapiens
ttaacacagggggagacaaagt

SEQ ID NO: 7464916 - DNA, 22 bp, Homo sapiens
ttaacaatcataggaccattta

SEQ ID NO: 7464917 - DNA, 22 bp, Homo sapiens
ttaacacagggggagacaaagt

SEQ ID NO: 7464918 - DNA, 22 bp, Homo sapiens
ttaacacagggggagacaaagt

SEQ ID NO: 7464919 - DNA, 22 bp, Homo sapiens
ttaacacagggggagacaaagt

SEQ ID NO: 7464920 - DNA, 22 bp, Homo sapiens
ttaacaatagagtttcttcagg

SEQ ID NO: 7464921 - DNA, 22 bp, Homo sapiens
ttaacaatagagtttcttcagg

SEQ ID NO: 7464922 - DNA, 22 bp, Homo sapiens
ttaacaatcataggaccattta

SEQ ID NO: 7464923 - DNA, 22 bp, Homo sapiens
ttaacaatcataggaccattta

SEQ ID NO: 7464924 - DNA, 22 bp, Homo sapiens
tgttttgtgcacttctatagca

SEQ ID NO: 7464925 - DNA, 22 bp, Homo sapiens
tgttttgtgcacttctatagca

SEQ ID NO: 7464926 - DNA, 22 bp, Homo sapiens
tgttttgtctaatctaaattct

SEQ ID NO: 7464927 - DNA, 22 bp, Homo sapiens
tgttttgtgcatttacaacatg

SEQ ID NO: 7464928 - DNA, 22 bp, Homo sapiens
tgttttgtgcatttacaacatg

SEQ ID NO: 7464929 - DNA, 22 bp, Homo sapiens
tgttttgtgcatttacaacatg

SEQ ID NO: 7464930 - DNA, 22 bp, Homo sapiens
tgttttgtgcatttacaacatg

SEQ ID NO: 7464931 - DNA, 22 bp, Homo sapiens
tgttttgttcactgcattgtcc

SEQ ID NO: 7464932 - DNA, 22 bp, Homo sapiens
tgttttgttcactgcattgtcc

SEQ ID NO: 7464933 - DNA, 22 bp, Homo sapiens
tgttttgtttatgagagcacag

SEQ ID NO: 7464934 - DNA, 19 bp, Homo sapiens
tgttttgttaaagcagtcc

SEQ ID NO: 7464935 - DNA, 19 bp, Homo sapiens
tgttttgttaaagcagtcc

SEQ ID NO: 7464936 - DNA, 22 bp, Homo sapiens
tgttttgtagctaatagctatt

SEQ ID NO: 7464937 - DNA, 22 bp, Homo sapiens
tgttttgtagctaatagctatt

SEQ ID NO: 7464938 - DNA, 22 bp, Homo sapiens
tgttttgtagctaatagctatt

SEQ ID NO: 7464939 - DNA, 22 bp, Homo sapiens
tgttttgtccttttctatatac

SEQ ID NO: 7464940 - DNA, 22 bp, Homo sapiens
tgttttgtccttttctatatac

SEQ ID NO: 7464941 - DNA, 22 bp, Homo sapiens
tgttttgtccttttctatatac

SEQ ID NO: 7464942 - DNA, 22 bp, Homo sapiens
tgttttgtccttttctatatac

SEQ ID NO: 7464943 - DNA, 22 bp, Homo sapiens
tgttttggtttaagtatatgaa

SEQ ID NO: 7464944 - DNA, 22 bp, Homo sapiens
tgttttggtttaagtatatgaa

SEQ ID NO: 7464945 - DNA, 22 bp, Homo sapiens
tgttttggtggtctataggaaa

SEQ ID NO: 7464946 - DNA, 22 bp, Homo sapiens
tgttttggtttaagtatatgaa

SEQ ID NO: 7464947 - DNA, 22 bp, Homo sapiens
tgttttggttttcaccgagtcc

SEQ ID NO: 7464948 - DNA, 22 bp, Homo sapiens
tgttttggttttcaccgagtcc

SEQ ID NO: 7464949 - DNA, 22 bp, Homo sapiens
tgttttggttttcaccgagtcc

SEQ ID NO: 7464950 - DNA, 22 bp, Homo sapiens
tgttttggtttaagtatatgaa

SEQ ID NO: 7464951 - DNA, 22 bp, Homo sapiens
tgttttggaacaaaagctattc

SEQ ID NO: 7464952 - DNA, 22 bp, Homo sapiens
tgttttggtggtacatgctgga

SEQ ID NO: 7464953 - DNA, 22 bp, Homo sapiens
tgttttggtggtacatgctgga

SEQ ID NO: 7464954 - DNA, 22 bp, Homo sapiens
tgttttgcttctctgtttccca

SEQ ID NO: 7464955 - DNA, 22 bp, Homo sapiens
tgttttgcttctctgtttccca

SEQ ID NO: 7464956 - DNA, 23 bp, Homo sapiens
tgttttcttgtcctggtataatt

SEQ ID NO: 7464957 - DNA, 22 bp, Homo sapiens
tgttttgctcatagctgcatcc

SEQ ID NO: 7464958 - DNA, 22 bp, Homo sapiens
tgttttggtagattgattatgg

SEQ ID NO: 7464959 - DNA, 22 bp, Homo sapiens
tgttttgggtcactttccttgg

SEQ ID NO: 7464960 - DNA, 22 bp, Homo sapiens
tgttttggtagattgattatgg

SEQ ID NO: 7464961 - DNA, 22 bp, Homo sapiens
tgttttggtagattgattatgg

SEQ ID NO: 7464962 - DNA, 22 bp, Homo sapiens
tgttttggaacaaaagctattc

SEQ ID NO: 7464963 - DNA, 22 bp, Homo sapiens
tgttttggaggtcctcactaga

SEQ ID NO: 7464964 - DNA, 22 bp, Homo sapiens
tgttttggagtggactttgcat

SEQ ID NO: 7464965 - DNA, 22 bp, Homo sapiens
tgttttgggtcactttccttgg

SEQ ID NO: 7464966 - DNA, 22 bp, Homo sapiens
tgttttctgggtggaaggtact

SEQ ID NO: 7464967 - DNA, 17 bp, Homo sapiens
tgttttctgctaccttt

SEQ ID NO: 7464968 - DNA, 17 bp, Homo sapiens
tgttttctgctaccttt

SEQ ID NO: 7464969 - DNA, 17 bp, Homo sapiens
tgttttctgctaccttt

SEQ ID NO: 7464970 - DNA, 17 bp, Homo sapiens
tgttttctgctaccttt

SEQ ID NO: 7464971 - DNA, 17 bp, Homo sapiens
tgttttctgctaccttt

SEQ ID NO: 7464972 - DNA, 17 bp, Homo sapiens
tgttttctgctaccttt

SEQ ID NO: 7464973 - DNA, 22 bp, Homo sapiens
tgttttctgattctcgtgtggt

SEQ ID NO: 7464974 - DNA, 22 bp, Homo sapiens
tgttttctgattctcgtgtggt

SEQ ID NO: 7464975 - DNA, 22 bp, Homo sapiens
tgttttctgattctcgtgtggt

SEQ ID NO: 7464976 - DNA, 22 bp, Homo sapiens
tgttttctgattctcgtgtggt

SEQ ID NO: 7464977 - DNA, 22 bp, Homo sapiens
tgttttctgatggttaatgagt

SEQ ID NO: 7464978 - DNA, 22 bp, Homo sapiens
tgttttctgatggttaatgagt

SEQ ID NO: 7464979 - DNA, 22 bp, Homo sapiens
tgttttctgatggttaatgagt

SEQ ID NO: 7464980 - DNA, 22 bp, Homo sapiens
tgttttctgatggttaatgagt

SEQ ID NO: 7464981 - DNA, 22 bp, Homo sapiens
tgttttctgatggttaatgagt

SEQ ID NO: 7464982 - DNA, 22 bp, Homo sapiens
tgttttctgatggttaatgagt

SEQ ID NO: 7464983 - DNA, 22 bp, Homo sapiens
tgttttctgatggttaatgagt

SEQ ID NO: 7464984 - DNA, 22 bp, Homo sapiens
tgttttctgatggttaatgagt

SEQ ID NO: 7464985 - DNA, 22 bp, Homo sapiens
tgttttctgatggttaatgagt

SEQ ID NO: 7464986 - DNA, 22 bp, Homo sapiens
tgttttctgatggttaatgagt

SEQ ID NO: 7464987 - DNA, 22 bp, Homo sapiens
tgttttctgatggttaatgagt

SEQ ID NO: 7464988 - DNA, 22 bp, Homo sapiens
tgttttctgattctcgtgtggt

SEQ ID NO: 7464989 - DNA, 22 bp, Homo sapiens
tgttttctgatggttaatgagt

SEQ ID NO: 7464990 - DNA, 22 bp, Homo sapiens
tgttttcttcctaattgctcat

SEQ ID NO: 7464991 - DNA, 22 bp, Homo sapiens
tgttttcttcctaattgctcat

SEQ ID NO: 7464992 - DNA, 22 bp, Homo sapiens
tgttttctgtgtagagatcaca

SEQ ID NO: 7464993 - DNA, 22 bp, Homo sapiens
tgttttctgtgtagagatcaca

SEQ ID NO: 7464994 - DNA, 22 bp, Homo sapiens
tgttttctgtgtagagatcaca

SEQ ID NO: 7464995 - DNA, 22 bp, Homo sapiens
tgttttctgtgtagagatcaca

SEQ ID NO: 7464996 - DNA, 22 bp, Homo sapiens
tgttttctgtgtagagatcaca

SEQ ID NO: 7464997 - DNA, 22 bp, Homo sapiens
tgttttctgtgtagagatcaca

SEQ ID NO: 7464998 - DNA, 22 bp, Homo sapiens
tgttttctgggtggaaggtact

SEQ ID NO: 7464999 - DNA, 22 bp, Homo sapiens
tgttttctgggtggaaggtact

SEQ ID NO: 7465000 - DNA, 22 bp, Homo sapiens
tgttttctgggtggaaggtact

SEQ ID NO: 7465001 - DNA, 22 bp, Homo sapiens
tgttttctgggtggaaggtact

SEQ ID NO: 7465002 - DNA, 22 bp, Homo sapiens
tgttttcttcctaattgctcat

SEQ ID NO: 7465003 - DNA, 22 bp, Homo sapiens
tgttttcttcctaattgctcat

SEQ ID NO: 7465004 - DNA, 22 bp, Homo sapiens
tgttttcttcctaattgctcat

SEQ ID NO: 7465005 - DNA, 22 bp, Homo sapiens
tgttttcttctgtaccgtgcca

SEQ ID NO: 7465006 - DNA, 22 bp, Homo sapiens
tgttttcttcctaattgctcat

SEQ ID NO: 7465007 - DNA, 23 bp, Homo sapiens
tgttttcttgtcctggtataatt

SEQ ID NO: 7465008 - DNA, 23 bp, Homo sapiens
tgttttcttgtcctggtataatt

SEQ ID NO: 7465009 - DNA, 23 bp, Homo sapiens
tgttttcttgtcctggtataatt

SEQ ID NO: 7465010 - DNA, 23 bp, Homo sapiens
tgttttcttgtcctggtataatt

SEQ ID NO: 7465011 - DNA, 22 bp, Homo sapiens
tgttttcttctgtaccgtgcca

SEQ ID NO: 7465012 - DNA, 22 bp, Homo sapiens
tgttttcttctgtaccgtgcca

SEQ ID NO: 7465013 - DNA, 22 bp, Homo sapiens
ttaaagcccagcatatactagg

SEQ ID NO: 7465014 - DNA, 21 bp, Homo sapiens
ttaaagcctccctcataagga

SEQ ID NO: 7465015 - DNA, 22 bp, Homo sapiens
ttaaagctaggtggaacaaatt

SEQ ID NO: 7465016 - DNA, 22 bp, Homo sapiens
ttaaatagtaggtctattttgg

SEQ ID NO: 7465017 - DNA, 22 bp, Homo sapiens
ttaaatagtaggtctattttgg

SEQ ID NO: 7465018 - DNA, 22 bp, Homo sapiens
ttaaatagtcaaatcagtggca

SEQ ID NO: 7465019 - DNA, 22 bp, Homo sapiens
ttaaatagtcaaatcagtggca

SEQ ID NO: 7465020 - DNA, 22 bp, Homo sapiens
ttaaatattatgttgtctgcaa

SEQ ID NO: 7465021 - DNA, 22 bp, Homo sapiens
ttaaatattatgttgtctgcaa

SEQ ID NO: 7465022 - DNA, 22 bp, Homo sapiens
ttaaatattatgttgtctgcaa

SEQ ID NO: 7465023 - DNA, 22 bp, Homo sapiens
ttaaatattatgttgtctgcaa

SEQ ID NO: 7465024 - DNA, 22 bp, Homo sapiens
ttaaatagtcaaatcagtggca

SEQ ID NO: 7465025 - DNA, 22 bp, Homo sapiens
ttaaatagtcaaatcagtggca

SEQ ID NO: 7465026 - DNA, 22 bp, Homo sapiens
ttaaatattatgttgtctgcaa

SEQ ID NO: 7465027 - DNA, 22 bp, Homo sapiens
ttaaatattatgttgtctgcaa

SEQ ID NO: 7465028 - DNA, 22 bp, Homo sapiens
ttaaatattatgttgtctgcaa

SEQ ID NO: 7465029 - DNA, 22 bp, Homo sapiens
ttaaatattatgttgtctgcaa

SEQ ID NO: 7465030 - DNA, 22 bp, Homo sapiens
ttaaatattatgttgtctgcaa

SEQ ID NO: 7465031 - DNA, 22 bp, Homo sapiens
ttaaatattatgttgtctgcaa

SEQ ID NO: 7465032 - DNA, 22 bp, Homo sapiens
ttaaatattatgttgtctgcaa

SEQ ID NO: 7465033 - DNA, 22 bp, Homo sapiens
ttaaatattttcagcagggtca

SEQ ID NO: 7465034 - DNA, 22 bp, Homo sapiens
ttaaatattatgttgtctgcaa

SEQ ID NO: 7465035 - DNA, 22 bp, Homo sapiens
ttaaatattatgttgtctgcaa

SEQ ID NO: 7465036 - DNA, 22 bp, Homo sapiens
ttaaatattttcagcagggtca

SEQ ID NO: 7465037 - DNA, 22 bp, Homo sapiens
ttaaatattttcagcagggtca

SEQ ID NO: 7465038 - DNA, 22 bp, Homo sapiens
ttaaatattttcagcagggtca

SEQ ID NO: 7465039 - DNA, 22 bp, Homo sapiens
ttaaatattttcagcagggtca

SEQ ID NO: 7465040 - DNA, 22 bp, Homo sapiens
ttaaatattatgttgtctgcaa

SEQ ID NO: 7465041 - DNA, 22 bp, Homo sapiens
ttaaatattatgttgtctgcaa

SEQ ID NO: 7465042 - DNA, 22 bp, Homo sapiens
ttaaatattatgttgtctgcaa

SEQ ID NO: 7465043 - DNA, 22 bp, Homo sapiens
ttaaatattatgttgtctgcaa

SEQ ID NO: 7465044 - DNA, 22 bp, Homo sapiens
ttaaatattatgttgtctgcaa

SEQ ID NO: 7465045 - DNA, 22 bp, Homo sapiens
ttaaatattatgttgtctgcaa

SEQ ID NO: 7465046 - DNA, 22 bp, Homo sapiens
ttaaatattatgttgtctgcaa

SEQ ID NO: 7465047 - DNA, 22 bp, Homo sapiens
ttaaatattatgttgtctgcaa

SEQ ID NO: 7465048 - DNA, 22 bp, Homo sapiens
tgtttttaaataatgatagaaa

SEQ ID NO: 7465049 - DNA, 22 bp, Homo sapiens
tgtttttaaataatgatagaaa

SEQ ID NO: 7465050 - DNA, 22 bp, Homo sapiens
tgtttttatctctgtgtacaac

SEQ ID NO: 7465051 - DNA, 22 bp, Homo sapiens
tgtttttactgtgatccagaaa

SEQ ID NO: 7465052 - DNA, 22 bp, Homo sapiens
tgtttttactgtgatccagaaa

SEQ ID NO: 7465053 - DNA, 22 bp, Homo sapiens
tgtttttactgtgatccagaaa

SEQ ID NO: 7465054 - DNA, 22 bp, Homo sapiens
tgtttttactgtgatccagaaa

SEQ ID NO: 7465055 - DNA, 22 bp, Homo sapiens
tgtttttactgtgatccagaaa

SEQ ID NO: 7465056 - DNA, 22 bp, Homo sapiens
tgtttttaaaatgtcctggtta

SEQ ID NO: 7465057 - DNA, 22 bp, Homo sapiens
tgtttttaaaatgtcctggtta

SEQ ID NO: 7465058 - DNA, 22 bp, Homo sapiens
tgtttttaaaatgtcctggtta

SEQ ID NO: 7465059 - DNA, 22 bp, Homo sapiens
tgttttgtttatgagagcacag

SEQ ID NO: 7465060 - DNA, 22 bp, Homo sapiens
tgtttttaaataatgatagaaa

SEQ ID NO: 7465061 - DNA, 22 bp, Homo sapiens
tgtttttaaataatgatagaaa

SEQ ID NO: 7465062 - DNA, 22 bp, Homo sapiens
tgtttttaaataatgatagaaa

SEQ ID NO: 7465063 - DNA, 22 bp, Homo sapiens
tgtttttaaataatgatagaaa

SEQ ID NO: 7465064 - DNA, 22 bp, Homo sapiens
ttaaagcatcacactattaatt

SEQ ID NO: 7465065 - DNA, 22 bp, Homo sapiens
ttaaagcatcacactattaatt

SEQ ID NO: 7465066 - DNA, 22 bp, Homo sapiens
tgtttttcaaatattgctctgt

SEQ ID NO: 7465067 - DNA, 23 bp, Homo sapiens
tgtttttcattcacatgggctgt

SEQ ID NO: 7465068 - DNA, 23 bp, Homo sapiens
tgtttttcattcacatgggctgt

SEQ ID NO: 7465069 - DNA, 22 bp, Homo sapiens
ttaaagcagtttgtatacatgg

SEQ ID NO: 7465070 - DNA, 22 bp, Homo sapiens
tgtttttatctctgtgtacaac

SEQ ID NO: 7465071 - DNA, 22 bp, Homo sapiens
tgtttttatctctgtgtacaac

SEQ ID NO: 7465072 - DNA, 22 bp, Homo sapiens
tgtttttcaaatattgctctgt

SEQ ID NO: 7465073 - DNA, 22 bp, Homo sapiens
tgtttttcaaatattgctctgt

SEQ ID NO: 7465074 - DNA, 22 bp, Homo sapiens
ttaaagcatcacactattaatt

SEQ ID NO: 7465075 - DNA, 22 bp, Homo sapiens
ttaaagcatgttgcttaacagg

SEQ ID NO: 7465076 - DNA, 22 bp, Homo sapiens
ttaaagcatgttgcttaacagg

SEQ ID NO: 7465077 - DNA, 22 bp, Homo sapiens
ttaaagccatctagattttgag

SEQ ID NO: 7465078 - DNA, 22 bp, Homo sapiens
ttaaagcatgttgcttaacagg

SEQ ID NO: 7465079 - DNA, 22 bp, Homo sapiens
ttactttatctcctagattcca

SEQ ID NO: 7465080 - DNA, 22 bp, Homo sapiens
ttactttatctcctagattcca

SEQ ID NO: 7465081 - DNA, 22 bp, Homo sapiens
ttactttatctcctagattcca

SEQ ID NO: 7465082 - DNA, 22 bp, Homo sapiens
ttactttatctcctagattcca

SEQ ID NO: 7465083 - DNA, 22 bp, Homo sapiens
ttactttatagaacactggggg

SEQ ID NO: 7465084 - DNA, 22 bp, Homo sapiens
ttactttagggatgttttgctt

SEQ ID NO: 7465085 - DNA, 22 bp, Homo sapiens
ttactttatctcctagattcca

SEQ ID NO: 7465086 - DNA, 22 bp, Homo sapiens
ttactttatagaacactggggg

SEQ ID NO: 7465087 - DNA, 22 bp, Homo sapiens
ttactttatagaacactggggg

SEQ ID NO: 7465088 - DNA, 22 bp, Homo sapiens
ttactttatgtgatggattagt

SEQ ID NO: 7465089 - DNA, 22 bp, Homo sapiens
ttactttgatgatcaatgagcg

SEQ ID NO: 7465090 - DNA, 22 bp, Homo sapiens
ttactttccagctctagcttca

SEQ ID NO: 7465091 - DNA, 22 bp, Homo sapiens
ttactttccagctctagcttca

SEQ ID NO: 7465092 - DNA, 22 bp, Homo sapiens
ttactttccagctctagcttca

SEQ ID NO: 7465093 - DNA, 22 bp, Homo sapiens
ttactttatgtgatggattagt

SEQ ID NO: 7465094 - DNA, 22 bp, Homo sapiens
ttactttatgtgatggattagt

SEQ ID NO: 7465095 - DNA, 22 bp, Homo sapiens
ttactttggcaaactcctgccc

SEQ ID NO: 7465096 - DNA, 22 bp, Homo sapiens
ttactttggatggtcaagaaag

SEQ ID NO: 7465097 - DNA, 22 bp, Homo sapiens
ttactttggatggtcaagaaag

SEQ ID NO: 7465098 - DNA, 22 bp, Homo sapiens
ttactttggatggtcaagaaag

SEQ ID NO: 7465099 - DNA, 22 bp, Homo sapiens
ttactttgctttctcattacag

SEQ ID NO: 7465100 - DNA, 22 bp, Homo sapiens
ttactttgccttttagtgtagg

SEQ ID NO: 7465101 - DNA, 22 bp, Homo sapiens
ttactttgcatttgtggtagtc

SEQ ID NO: 7465102 - DNA, 22 bp, Homo sapiens
ttactttgggtcctgcttataa

SEQ ID NO: 7465103 - DNA, 22 bp, Homo sapiens
ttactttgggtcctgcttataa

SEQ ID NO: 7465104 - DNA, 22 bp, Homo sapiens
ttactttgttctcaagatatgt

SEQ ID NO: 7465105 - DNA, 22 bp, Homo sapiens
ttactttgttctcaagatatgt

SEQ ID NO: 7465106 - DNA, 22 bp, Homo sapiens
ttactttgttctcaagatatgt

SEQ ID NO: 7465107 - DNA, 22 bp, Homo sapiens
ttactttgttctcaagatatgt

SEQ ID NO: 7465108 - DNA, 22 bp, Homo sapiens
ttactttgttctcaagatatgt

SEQ ID NO: 7465109 - DNA, 22 bp, Homo sapiens
ttactttgttctcaagatatgt

SEQ ID NO: 7465110 - DNA, 21 bp, Homo sapiens
ttagaaagctcactacagtta

SEQ ID NO: 7465111 - DNA, 21 bp, Homo sapiens
ttagaaagctcactacagtta

SEQ ID NO: 7465112 - DNA, 22 bp, Homo sapiens
ttagaaagagtataccagaaac

SEQ ID NO: 7465113 - DNA, 21 bp, Homo sapiens
ttagaaagctcactacagtta

SEQ ID NO: 7465114 - DNA, 20 bp, Homo sapiens
ttagaaagagcgtgataaga

SEQ ID NO: 7465115 - DNA, 22 bp, Homo sapiens
ttagaaagagtataccagaaac

SEQ ID NO: 7465116 - DNA, 22 bp, Homo sapiens
ttagaaactttggaggatagat

SEQ ID NO: 7465117 - DNA, 22 bp, Homo sapiens
ttagaaagaactttagatatca

SEQ ID NO: 7465118 - DNA, 22 bp, Homo sapiens
ttagaaagaactttagatatca

SEQ ID NO: 7465119 - DNA, 22 bp, Homo sapiens
ttagaaagaactttagatatca

SEQ ID NO: 7465120 - DNA, 22 bp, Homo sapiens
ttagaaagaactttagatatca

SEQ ID NO: 7465121 - DNA, 22 bp, Homo sapiens
ttagaaagaactttagatatca

SEQ ID NO: 7465122 - DNA, 19 bp, Homo sapiens
ttagaaactgttgacactg

SEQ ID NO: 7465123 - DNA, 22 bp, Homo sapiens
ttagaaactcaactctgggaat

SEQ ID NO: 7465124 - DNA, 19 bp, Homo sapiens
ttagaaactgttgacactg

SEQ ID NO: 7465125 - DNA, 19 bp, Homo sapiens
ttagaaactgttgacactg

SEQ ID NO: 7465126 - DNA, 22 bp, Homo sapiens
ttagaaacaaaatagttatttg

SEQ ID NO: 7465127 - DNA, 22 bp, Homo sapiens
ttagaaacaaaatagttatttg

SEQ ID NO: 7465128 - DNA, 22 bp, Homo sapiens
ttagaaacccagactcttaggt

SEQ ID NO: 7465129 - DNA, 22 bp, Homo sapiens
ttagaaacccagactcttaggt

SEQ ID NO: 7465130 - DNA, 22 bp, Homo sapiens
ttagaaacaaaatagttatttg

SEQ ID NO: 7465131 - DNA, 22 bp, Homo sapiens
ttacttttctattcgatatgtg

SEQ ID NO: 7465132 - DNA, 22 bp, Homo sapiens
ttacttttctattcgatatgtg

SEQ ID NO: 7465133 - DNA, 22 bp, Homo sapiens
ttacttttctattcgatatgtg

SEQ ID NO: 7465134 - DNA, 22 bp, Homo sapiens
ttactttgtttgcacttcacct

SEQ ID NO: 7465135 - DNA, 22 bp, Homo sapiens
ttactttgtttgcacttcacct

SEQ ID NO: 7465136 - DNA, 22 bp, Homo sapiens
ttagaaaatttgcttctttgga

SEQ ID NO: 7465137 - DNA, 22 bp, Homo sapiens
ttagaaaatttgcttctttgga

SEQ ID NO: 7465138 - DNA, 22 bp, Homo sapiens
ttagaaaatttgcttctttgga

SEQ ID NO: 7465139 - DNA, 22 bp, Homo sapiens
ttagaaaatttgcttctttgga

SEQ ID NO: 7465140 - DNA, 20 bp, Homo sapiens
ttagaagggccagatgaagg

SEQ ID NO: 7465141 - DNA, 22 bp, Homo sapiens
ttagaagtaaggtcagatttct

SEQ ID NO: 7465142 - DNA, 21 bp, Homo sapiens
ttagaagctaatgcagctggt

SEQ ID NO: 7465143 - DNA, 21 bp, Homo sapiens
ttagaagctaatgcagctggt

SEQ ID NO: 7465144 - DNA, 21 bp, Homo sapiens
ttagaagctaatgcagctggt

SEQ ID NO: 7465145 - DNA, 21 bp, Homo sapiens
ttagaagctaatgcagctggt

SEQ ID NO: 7465146 - DNA, 22 bp, Homo sapiens
ttagaaagctttccatagtcaa

SEQ ID NO: 7465147 - DNA, 22 bp, Homo sapiens
ttagaaagctttccatagtcaa

SEQ ID NO: 7465148 - DNA, 22 bp, Homo sapiens
ttagaaagctttccatagtcaa

SEQ ID NO: 7465149 - DNA, 22 bp, Homo sapiens
ttagaagcatcacctgttctgg

SEQ ID NO: 7465150 - DNA, 19 bp, Homo sapiens
ttagaagccataggtacag

SEQ ID NO: 7465151 - DNA, 22 bp, Homo sapiens
ttagactttaagctgggtgcag

SEQ ID NO: 7465152 - DNA, 22 bp, Homo sapiens
ttagagaaaagcttgcttgctt

SEQ ID NO: 7465153 - DNA, 22 bp, Homo sapiens
ttagagaaaagcttgcttgctt

SEQ ID NO: 7465154 - DNA, 22 bp, Homo sapiens
ttagagaaagggtttgattccg

SEQ ID NO: 7465155 - DNA, 22 bp, Homo sapiens
ttagagaaagggtttgattccg

SEQ ID NO: 7465156 - DNA, 22 bp, Homo sapiens
ttagacatcaagaagccaatgt

SEQ ID NO: 7465157 - DNA, 22 bp, Homo sapiens
ttagacatcaagaagccaatgt

SEQ ID NO: 7465158 - DNA, 22 bp, Homo sapiens
ttagacatgtttgctaaaatga

SEQ ID NO: 7465159 - DNA, 22 bp, Homo sapiens
ttagagaaccaatgaatagtct

SEQ ID NO: 7465160 - DNA, 22 bp, Homo sapiens
ttagagaaattctggtaatgta

SEQ ID NO: 7465161 - DNA, 22 bp, Homo sapiens
ttagagaaattctggtaatgta

SEQ ID NO: 7465162 - DNA, 22 bp, Homo sapiens
ttagagaaccaatgaatagtct

SEQ ID NO: 7465163 - DNA, 22 bp, Homo sapiens
ttagagaagctgtaattattca

SEQ ID NO: 7465164 - DNA, 22 bp, Homo sapiens
ttagagaagatgaaccatcgtt

SEQ ID NO: 7465165 - DNA, 22 bp, Homo sapiens
ttagagaagatgaaccatcgtt

SEQ ID NO: 7465166 - DNA, 22 bp, Homo sapiens
ttagagaagatgaaccatcgtt

SEQ ID NO: 7465167 - DNA, 22 bp, Homo sapiens
ttagagaaccaatgaatagtct

SEQ ID NO: 7465168 - DNA, 22 bp, Homo sapiens
ttagagaaccaatgaatagtct

SEQ ID NO: 7465169 - DNA, 22 bp, Homo sapiens
ttagagaaccaatgaatagtct

SEQ ID NO: 7465170 - DNA, 22 bp, Homo sapiens
ttagagaaattctggtaatgta

SEQ ID NO: 7465171 - DNA, 22 bp, Homo sapiens
ttagagaaatgggtactgcata

SEQ ID NO: 7465172 - DNA, 22 bp, Homo sapiens
ttagagaaatgggtactgcata

SEQ ID NO: 7465173 - DNA, 22 bp, Homo sapiens
ttagagaaatgggtactgcata

SEQ ID NO: 7465174 - DNA, 22 bp, Homo sapiens
ttagagaaagggtttgattccg

SEQ ID NO: 7465175 - DNA, 22 bp, Homo sapiens
ttagagaagttttacttaagaa

SEQ ID NO: 7465176 - DNA, 22 bp, Homo sapiens
ttagagaagctgtaattattca

SEQ ID NO: 7465177 - DNA, 22 bp, Homo sapiens
ttagagaagttttacttaagaa

SEQ ID NO: 7465178 - DNA, 22 bp, Homo sapiens
ttagagaagctgtaattattca

SEQ ID NO: 7465179 - DNA, 22 bp, Homo sapiens
ttagagaagctgtaattattca

SEQ ID NO: 7465180 - DNA, 22 bp, Homo sapiens
ttagagaagctgtaattattca

SEQ ID NO: 7465181 - DNA, 22 bp, Homo sapiens
ttagagaagctgtaattattca

SEQ ID NO: 7465182 - DNA, 22 bp, Homo sapiens
ttagagacaggcttcccaagga

SEQ ID NO: 7465183 - DNA, 22 bp, Homo sapiens
ttagagacaggcttcccaagga

SEQ ID NO: 7465184 - DNA, 22 bp, Homo sapiens
ttagagaattccaaatgactac

SEQ ID NO: 7465185 - DNA, 22 bp, Homo sapiens
ttagagaattccaaatgactac

SEQ ID NO: 7465186 - DNA, 22 bp, Homo sapiens
ttagagagaaccatcaggatct

SEQ ID NO: 7465187 - DNA, 22 bp, Homo sapiens
ttagagaattccaaatgactac

SEQ ID NO: 7465188 - DNA, 22 bp, Homo sapiens
ttagagattggttgacagattt

SEQ ID NO: 7465189 - DNA, 22 bp, Homo sapiens
ttagagatgtcccaaaatgaag

SEQ ID NO: 7465190 - DNA, 22 bp, Homo sapiens
ttagagatgtcccaaaatgaag

SEQ ID NO: 7465191 - DNA, 22 bp, Homo sapiens
ttagagagaaccatcaggatct

SEQ ID NO: 7465192 - DNA, 22 bp, Homo sapiens
ttagagatacatttgtagcttg

SEQ ID NO: 7465193 - DNA, 23 bp, Homo sapiens
ttagagatgattaaaaaatcttg

SEQ ID NO: 7465194 - DNA, 22 bp, Homo sapiens
ttagagctgatagtacactggt

SEQ ID NO: 7465195 - DNA, 17 bp, Homo sapiens
ttagagctacatgttga

SEQ ID NO: 7465196 - DNA, 22 bp, Homo sapiens
ttagagccccagaaaacagtgg

SEQ ID NO: 7465197 - DNA, 22 bp, Homo sapiens
ttagagcaggagttgacagatt

SEQ ID NO: 7465198 - DNA, 22 bp, Homo sapiens
ttagagatttgtctgatagtag

SEQ ID NO: 7465199 - DNA, 22 bp, Homo sapiens
ttagagattgtctagtattgtg

SEQ ID NO: 7465200 - DNA, 22 bp, Homo sapiens
ttagagccagttacaaggtcaa

SEQ ID NO: 7465201 - DNA, 22 bp, Homo sapiens
ttagaggggctgctgaatggga

SEQ ID NO: 7465202 - DNA, 22 bp, Homo sapiens
ttagaggactgtaggtgggaat

SEQ ID NO: 7465203 - DNA, 22 bp, Homo sapiens
ttagaggatatcatcagcctac

SEQ ID NO: 7465204 - DNA, 22 bp, Homo sapiens
ttagagcttcccaattaaaacg

SEQ ID NO: 7465205 - DNA, 22 bp, Homo sapiens
ttagaggaaagtgactccgatg

SEQ ID NO: 7465206 - DNA, 22 bp, Homo sapiens
ttagaggaaagactgggactaa

SEQ ID NO: 7465207 - DNA, 22 bp, Homo sapiens
ttagaggaaagtgactccgatg

SEQ ID NO: 7465208 - DNA, 22 bp, Homo sapiens
ttagaggacaagaggcctggct

SEQ ID NO: 7465209 - DNA, 22 bp, Homo sapiens
ttactgttttggtacctcattg

SEQ ID NO: 7465210 - DNA, 22 bp, Homo sapiens
ttactgtttttaactaattgtg

SEQ ID NO: 7465211 - DNA, 22 bp, Homo sapiens
ttactgtttgggtctgaggtca

SEQ ID NO: 7465212 - DNA, 22 bp, Homo sapiens
ttactgttttggtacctcattg

SEQ ID NO: 7465213 - DNA, 22 bp, Homo sapiens
ttacttaaacagaaatgcagaa

SEQ ID NO: 7465214 - DNA, 22 bp, Homo sapiens
ttacttaaacagaaatgcagaa

SEQ ID NO: 7465215 - DNA, 22 bp, Homo sapiens
ttacttacagacagtagactct

SEQ ID NO: 7465216 - DNA, 22 bp, Homo sapiens
ttactgttggtgtatccatagc

SEQ ID NO: 7465217 - DNA, 22 bp, Homo sapiens
ttactgtttgaaaaatgaatgt

SEQ ID NO: 7465218 - DNA, 22 bp, Homo sapiens
ttactgttggtgtatccatagc

SEQ ID NO: 7465219 - DNA, 22 bp, Homo sapiens
ttactgttcatgttgtacactt

SEQ ID NO: 7465220 - DNA, 18 bp, Homo sapiens
ttactgttatcaaaacag

SEQ ID NO: 7465221 - DNA, 18 bp, Homo sapiens
ttactgttatcaaaacag

SEQ ID NO: 7465222 - DNA, 22 bp, Homo sapiens
ttactgttcatgttgtacactt

SEQ ID NO: 7465223 - DNA, 22 bp, Homo sapiens
ttactgttcatgttgtacactt

SEQ ID NO: 7465224 - DNA, 22 bp, Homo sapiens
ttacttattaccaccaatgccg

SEQ ID NO: 7465225 - DNA, 22 bp, Homo sapiens
ttacttacagacagtagactct

SEQ ID NO: 7465226 - DNA, 19 bp, Homo sapiens
ttacttcaggagtgaaatt

SEQ ID NO: 7465227 - DNA, 19 bp, Homo sapiens
ttacttcaggagtgaaatt

SEQ ID NO: 7465228 - DNA, 19 bp, Homo sapiens
ttacttcaggagtgaaatt

SEQ ID NO: 7465229 - DNA, 21 bp, Homo sapiens
ttacttctgcttgttattgtc

SEQ ID NO: 7465230 - DNA, 22 bp, Homo sapiens
ttacttcttacaaaagaaatat

SEQ ID NO: 7465231 - DNA, 22 bp, Homo sapiens
ttacttcttacaaaagaaatat

SEQ ID NO: 7465232 - DNA, 22 bp, Homo sapiens
ttacttcttacaaaagaaatat

SEQ ID NO: 7465233 - DNA, 22 bp, Homo sapiens
ttacttcttgtctcatgcctat

SEQ ID NO: 7465234 - DNA, 22 bp, Homo sapiens
ttacttcttgtctcatgcctat

SEQ ID NO: 7465235 - DNA, 22 bp, Homo sapiens
ttacttcttacaaaagaaatat

SEQ ID NO: 7465236 - DNA, 22 bp, Homo sapiens
ttacttgaaaaccaccagtatt

SEQ ID NO: 7465237 - DNA, 22 bp, Homo sapiens
ttacttgaaaaccaccagtatt

SEQ ID NO: 7465238 - DNA, 22 bp, Homo sapiens
ttacttgaaagcctttgattta

SEQ ID NO: 7465239 - DNA, 22 bp, Homo sapiens
ttacttctttggccttcagcca

SEQ ID NO: 7465240 - DNA, 22 bp, Homo sapiens
ttacttgaaaggaaattaaggt

SEQ ID NO: 7465241 - DNA, 22 bp, Homo sapiens
ttacttgaaatggcttcttgga

SEQ ID NO: 7465242 - DNA, 22 bp, Homo sapiens
ttacttgaaatgtgataagaga

SEQ ID NO: 7465243 - DNA, 19 bp, Homo sapiens
ttacttgaagcataggtga

SEQ ID NO: 7465244 - DNA, 22 bp, Homo sapiens
ttacttgaagcttgcttgatgg

SEQ ID NO: 7465245 - DNA, 22 bp, Homo sapiens
ttacttgaaggcagaaaagttt

SEQ ID NO: 7465246 - DNA, 22 bp, Homo sapiens
ttacttgaatgactagtgggat

SEQ ID NO: 7465247 - DNA, 22 bp, Homo sapiens
ttacttgaatgctgtgatctca

SEQ ID NO: 7465248 - DNA, 22 bp, Homo sapiens
ttacttgaatgctgtgatctca

SEQ ID NO: 7465249 - DNA, 22 bp, Homo sapiens
ttacttgacataaatgagttta

SEQ ID NO: 7465250 - DNA, 22 bp, Homo sapiens
ttacttgaatgttttgggtgtc

SEQ ID NO: 7465251 - DNA, 22 bp, Homo sapiens
ttacttgacataaatgagttta

SEQ ID NO: 7465252 - DNA, 18 bp, Homo sapiens
ttacttgacccctctgaa

SEQ ID NO: 7465253 - DNA, 22 bp, Homo sapiens
ttacttgagctgctttttgtat

SEQ ID NO: 7465254 - DNA, 22 bp, Homo sapiens
ttacttgaggaaaagtagtgtc

SEQ ID NO: 7465255 - DNA, 22 bp, Homo sapiens
ttacttgatagggggatggggt

SEQ ID NO: 7465256 - DNA, 22 bp, Homo sapiens
ttacttgatgatgtataaagtc

SEQ ID NO: 7465257 - DNA, 22 bp, Homo sapiens
ttacttgatgtatgatgagtag

SEQ ID NO: 7465258 - DNA, 22 bp, Homo sapiens
ttacttgattgtggagtctgag

SEQ ID NO: 7465259 - DNA, 22 bp, Homo sapiens
ttacttgatgtatgatgagtag

SEQ ID NO: 7465260 - DNA, 22 bp, Homo sapiens
ttacttgattgtggagtctgag

SEQ ID NO: 7465261 - DNA, 22 bp, Homo sapiens
ttacttggaggcctgttaccag

SEQ ID NO: 7465262 - DNA, 22 bp, Homo sapiens
ttacttgatttgaaaatcatag

SEQ ID NO: 7465263 - DNA, 22 bp, Homo sapiens
ttacttgcttataatcaaaaca

SEQ ID NO: 7465264 - DNA, 22 bp, Homo sapiens
ttactttagatcatactgtgtg

SEQ ID NO: 7465265 - DNA, 21 bp, Homo sapiens
ttactttagaaattgcctttt

SEQ ID NO: 7465266 - DNA, 22 bp, Homo sapiens
ttactttagatcatactgtgtg

SEQ ID NO: 7465267 - DNA, 22 bp, Homo sapiens
ttactttagatcatactgtgtg

SEQ ID NO: 7465268 - DNA, 22 bp, Homo sapiens
ttactttaagggtgtcttatta

SEQ ID NO: 7465269 - DNA, 22 bp, Homo sapiens
ttactttaagggtgtcttatta

SEQ ID NO: 7465270 - DNA, 22 bp, Homo sapiens
ttactttaagggtgtcttatta

SEQ ID NO: 7465271 - DNA, 22 bp, Homo sapiens
ttactttaagggtgtcttatta

SEQ ID NO: 7465272 - DNA, 22 bp, Homo sapiens
ttactttaagggtgtcttatta

SEQ ID NO: 7465273 - DNA, 22 bp, Homo sapiens
ttacttggtgttctgcccagga

SEQ ID NO: 7465274 - DNA, 22 bp, Homo sapiens
ttactgatacacataagaattt

SEQ ID NO: 7465275 - DNA, 22 bp, Homo sapiens
ttactgatacacataagaattt

SEQ ID NO: 7465276 - DNA, 22 bp, Homo sapiens
ttactgatacacataagaattt

SEQ ID NO: 7465277 - DNA, 22 bp, Homo sapiens
ttactgatacacataagaattt

SEQ ID NO: 7465278 - DNA, 22 bp, Homo sapiens
ttactgatcccccaggtgaccc

SEQ ID NO: 7465279 - DNA, 22 bp, Homo sapiens
ttactgatgatctggaggggct

SEQ ID NO: 7465280 - DNA, 22 bp, Homo sapiens
ttactgatggaacagagataga

SEQ ID NO: 7465281 - DNA, 22 bp, Homo sapiens
ttactgatggaacagagataga

SEQ ID NO: 7465282 - DNA, 22 bp, Homo sapiens
ttactgatggaacagagataga

SEQ ID NO: 7465283 - DNA, 22 bp, Homo sapiens
ttactgatggtggagctggtat

SEQ ID NO: 7465284 - DNA, 22 bp, Homo sapiens
ttactgatgtcattagaaacag

SEQ ID NO: 7465285 - DNA, 22 bp, Homo sapiens
ttactgatttttgggccctacc

SEQ ID NO: 7465286 - DNA, 22 bp, Homo sapiens
ttactgatttttgggccctacc

SEQ ID NO: 7465287 - DNA, 22 bp, Homo sapiens
ttactgaaagtatacatttctg

SEQ ID NO: 7465288 - DNA, 22 bp, Homo sapiens
ttactgaaagtatacatttctg

SEQ ID NO: 7465289 - DNA, 22 bp, Homo sapiens
ttactgaaataatgaaacacat

SEQ ID NO: 7465290 - DNA, 22 bp, Homo sapiens
ttactgaaataatgaaacacat

SEQ ID NO: 7465291 - DNA, 22 bp, Homo sapiens
ttactgaaccctacttttacag

SEQ ID NO: 7465292 - DNA, 22 bp, Homo sapiens
ttactgaaggtggatagtgagt

SEQ ID NO: 7465293 - DNA, 22 bp, Homo sapiens
ttactgaaggtggatagtgagt

SEQ ID NO: 7465294 - DNA, 22 bp, Homo sapiens
ttactgaaggtggatagtgagt

SEQ ID NO: 7465295 - DNA, 22 bp, Homo sapiens
ttactgagggtgtatcttagtg

SEQ ID NO: 7465296 - DNA, 22 bp, Homo sapiens
ttactgactattctttgggaac

SEQ ID NO: 7465297 - DNA, 22 bp, Homo sapiens
ttactgaggagcatatctgagt

SEQ ID NO: 7465298 - DNA, 22 bp, Homo sapiens
ttactgaggagcatatctgagt

SEQ ID NO: 7465299 - DNA, 22 bp, Homo sapiens
ttactgaattgcactccagcgt

SEQ ID NO: 7465300 - DNA, 22 bp, Homo sapiens
ttactgggaatgttatggagaa

SEQ ID NO: 7465301 - DNA, 22 bp, Homo sapiens
ttactgggaatgttatggagaa

SEQ ID NO: 7465302 - DNA, 22 bp, Homo sapiens
ttactgtaaaggtcacatggtg

SEQ ID NO: 7465303 - DNA, 22 bp, Homo sapiens
ttactggctgggcctgagggct

SEQ ID NO: 7465304 - DNA, 22 bp, Homo sapiens
ttactggctgggcctgagggct

SEQ ID NO: 7465305 - DNA, 22 bp, Homo sapiens
ttactgcaacataatgtagtct

SEQ ID NO: 7465306 - DNA, 22 bp, Homo sapiens
ttactgcaacataatgtagtct

SEQ ID NO: 7465307 - DNA, 22 bp, Homo sapiens
ttactgcacgtgggacatatat

SEQ ID NO: 7465308 - DNA, 22 bp, Homo sapiens
ttactgctgttaggatattttt

SEQ ID NO: 7465309 - DNA, 22 bp, Homo sapiens
ttactgctgttaggatattttt

SEQ ID NO: 7465310 - DNA, 22 bp, Homo sapiens
ttactgtagcttgacatatgtc

SEQ ID NO: 7465311 - DNA, 20 bp, Homo sapiens
ttactgtagtactacatttt

SEQ ID NO: 7465312 - DNA, 22 bp, Homo sapiens
ttactgtaaaggtcacatggtg

SEQ ID NO: 7465313 - DNA, 22 bp, Homo sapiens
ttactgggcggggagtggaagc

SEQ ID NO: 7465314 - DNA, 22 bp, Homo sapiens
ttactgtagcttgacatatgtc

SEQ ID NO: 7465315 - DNA, 22 bp, Homo sapiens
ttactcattgctggatctagaa

SEQ ID NO: 7465316 - DNA, 20 bp, Homo sapiens
ttactcagttcctgccatgc

SEQ ID NO: 7465317 - DNA, 20 bp, Homo sapiens
ttactcataggaccacaagc

SEQ ID NO: 7465318 - DNA, 22 bp, Homo sapiens
ttactctgaatgtttctactga

SEQ ID NO: 7465319 - DNA, 19 bp, Homo sapiens
ttactcgagaatgactaca

SEQ ID NO: 7465320 - DNA, 22 bp, Homo sapiens
ttactcgtgacaatgtccttga

SEQ ID NO: 7465321 - DNA, 22 bp, Homo sapiens
ttactgaaagtatacatttctg

SEQ ID NO: 7465322 - DNA, 22 bp, Homo sapiens
ttactgaaaattcttcaggatt

SEQ ID NO: 7465323 - DNA, 22 bp, Homo sapiens
ttactcttaatggcaacaactg

SEQ ID NO: 7465324 - DNA, 22 bp, Homo sapiens
ttactcttccaaatgaatttca

SEQ ID NO: 7465325 - DNA, 22 bp, Homo sapiens
ttactagtatatgtcaagcaac

SEQ ID NO: 7465326 - DNA, 22 bp, Homo sapiens
ttactcagtctcccatacattg

SEQ ID NO: 7465327 - DNA, 22 bp, Homo sapiens
ttaccaaatcccgtgcacattc

SEQ ID NO: 7465328 - DNA, 22 bp, Homo sapiens
ttaccaaatcccgtgcacattc

SEQ ID NO: 7465329 - DNA, 22 bp, Homo sapiens
ttaccaaatcccgtgcacattc

SEQ ID NO: 7465330 - DNA, 22 bp, Homo sapiens
ttaccaaatgaaatagagattt

SEQ ID NO: 7465331 - DNA, 22 bp, Homo sapiens
ttaccaaatgaaatagagattt

SEQ ID NO: 7465332 - DNA, 22 bp, Homo sapiens
ttaccaaatcccgtgcacattc

SEQ ID NO: 7465333 - DNA, 22 bp, Homo sapiens
ttacattttggggtaaggataa

SEQ ID NO: 7465334 - DNA, 22 bp, Homo sapiens
ttactacattgtaacacagtac

SEQ ID NO: 7465335 - DNA, 22 bp, Homo sapiens
ttactacattgtaacacagtac

SEQ ID NO: 7465336 - DNA, 22 bp, Homo sapiens
ttactacattgtaacacagtac

SEQ ID NO: 7465337 - DNA, 22 bp, Homo sapiens
ttactacattgtaacacagtac

SEQ ID NO: 7465338 - DNA, 22 bp, Homo sapiens
ttactacagagagagctccagt

SEQ ID NO: 7465339 - DNA, 23 bp, Homo sapiens
ttactacacaagtaacgattccc

SEQ ID NO: 7465340 - DNA, 23 bp, Homo sapiens
ttactacacaagtaacgattccc

SEQ ID NO: 7465341 - DNA, 23 bp, Homo sapiens
ttactacacaagtaacgattccc

SEQ ID NO: 7465342 - DNA, 22 bp, Homo sapiens
ttacatattatccaaaactgct

SEQ ID NO: 7465343 - DNA, 22 bp, Homo sapiens
ttacatattatccaaaactgct

SEQ ID NO: 7465344 - DNA, 22 bp, Homo sapiens
ttacatagttaaatagtacagc

SEQ ID NO: 7465345 - DNA, 20 bp, Homo sapiens
ttacagtgggaccttcctga

SEQ ID NO: 7465346 - DNA, 22 bp, Homo sapiens
ttacagtgaagattcaggttcc

SEQ ID NO: 7465347 - DNA, 22 bp, Homo sapiens
ttacatattatccaaaactgct

SEQ ID NO: 7465348 - DNA, 22 bp, Homo sapiens
ttacatattatccaaaactgct

SEQ ID NO: 7465349 - DNA, 22 bp, Homo sapiens
ttacatattatccaaaactgct

SEQ ID NO: 7465350 - DNA, 22 bp, Homo sapiens
ttacagtgagggtgacatttac

SEQ ID NO: 7465351 - DNA, 22 bp, Homo sapiens
ttacagtgctcttcaagacttc

SEQ ID NO: 7465352 - DNA, 22 bp, Homo sapiens
ttacagtgctcttcaagacttc

SEQ ID NO: 7465353 - DNA, 22 bp, Homo sapiens
ttacagtgagggtgacatttac

SEQ ID NO: 7465354 - DNA, 22 bp, Homo sapiens
ttacagtgctcttcaagacttc

SEQ ID NO: 7465355 - DNA, 22 bp, Homo sapiens
ttacagtgctcttcaagacttc

SEQ ID NO: 7465356 - DNA, 22 bp, Homo sapiens
ttacagtggcagagttgggtag

SEQ ID NO: 7465357 - DNA, 22 bp, Homo sapiens
ttacagtgaagtaccattaaaa

SEQ ID NO: 7465358 - DNA, 22 bp, Homo sapiens
ttacagtgaagtaccattaaaa

SEQ ID NO: 7465359 - DNA, 22 bp, Homo sapiens
ttacagtgacagttgctatgat

SEQ ID NO: 7465360 - DNA, 22 bp, Homo sapiens
ttacagtgactcacattaacaa

SEQ ID NO: 7465361 - DNA, 22 bp, Homo sapiens
ttacagtgactcacattaacaa

SEQ ID NO: 7465362 - DNA, 22 bp, Homo sapiens
ttacagtatgatcaacttttca

SEQ ID NO: 7465363 - DNA, 23 bp, Homo sapiens
ttacagtaggagttggaaaacca

SEQ ID NO: 7465364 - DNA, 23 bp, Homo sapiens
ttacagtaggagttggaaaacca

SEQ ID NO: 7465365 - DNA, 22 bp, Homo sapiens
ttacagtatgatcaacttttca

SEQ ID NO: 7465366 - DNA, 22 bp, Homo sapiens
ttacagtattggtcacgtttgt

SEQ ID NO: 7465367 - DNA, 22 bp, Homo sapiens
ttacagtattggtcacgtttgt

SEQ ID NO: 7465368 - DNA, 22 bp, Homo sapiens
ttacagtattgttaaactcttt

SEQ ID NO: 7465369 - DNA, 22 bp, Homo sapiens
ttacagtgaagattcaggttcc

SEQ ID NO: 7465370 - DNA, 22 bp, Homo sapiens
ttacagtcttaaactcctgggc

SEQ ID NO: 7465371 - DNA, 22 bp, Homo sapiens
ttacagtcagtgaatggaaggg

SEQ ID NO: 7465372 - DNA, 22 bp, Homo sapiens
ttacagtcctttgtattgttta

SEQ ID NO: 7465373 - DNA, 22 bp, Homo sapiens
ttacagtcctttgtattgttta

SEQ ID NO: 7465374 - DNA, 22 bp, Homo sapiens
ttacagtctggattaggaaaca

SEQ ID NO: 7465375 - DNA, 22 bp, Homo sapiens
ttacagtctggattaggaaaca

SEQ ID NO: 7465376 - DNA, 22 bp, Homo sapiens
ttacagtcagcttacattagtt

SEQ ID NO: 7465377 - DNA, 22 bp, Homo sapiens
ttacagtcaggcatgaattcag

SEQ ID NO: 7465378 - DNA, 22 bp, Homo sapiens
ttacagtattgttaaactcttt

SEQ ID NO: 7465379 - DNA, 22 bp, Homo sapiens
ttacagtcagcttacattagtt

SEQ ID NO: 7465380 - DNA, 22 bp, Homo sapiens
ttacatattgtctattgttcaa

SEQ ID NO: 7465381 - DNA, 22 bp, Homo sapiens
ttacatattgtctattgttcaa

SEQ ID NO: 7465382 - DNA, 22 bp, Homo sapiens
ttacatattgtctattgttcaa

SEQ ID NO: 7465383 - DNA, 22 bp, Homo sapiens
ttacatattgtctattgttcaa

SEQ ID NO: 7465384 - DNA, 22 bp, Homo sapiens
ttacatattgtctattgttcaa

SEQ ID NO: 7465385 - DNA, 22 bp, Homo sapiens
ttacatattatccaaaactgct

SEQ ID NO: 7465386 - DNA, 22 bp, Homo sapiens
ttacatattatccaaaactgct

SEQ ID NO: 7465387 - DNA, 22 bp, Homo sapiens
ttacatattatccaaaactgct

SEQ ID NO: 7465388 - DNA, 22 bp, Homo sapiens
ttacatcagcaagagtgtatgt

SEQ ID NO: 7465389 - DNA, 22 bp, Homo sapiens
ttacatcagcaagagtgtatgt

SEQ ID NO: 7465390 - DNA, 22 bp, Homo sapiens
ttacatcatgcttatccctttc

SEQ ID NO: 7465391 - DNA, 22 bp, Homo sapiens
ttacatcatgcttatccctttc

SEQ ID NO: 7465392 - DNA, 22 bp, Homo sapiens
ttacatcagaatcacccaggaa

SEQ ID NO: 7465393 - DNA, 22 bp, Homo sapiens
ttacatcagaaggaaacagcgt

SEQ ID NO: 7465394 - DNA, 22 bp, Homo sapiens
ttacatcattgagacatacata

SEQ ID NO: 7465395 - DNA, 22 bp, Homo sapiens
ttacatcattgagacatacata

SEQ ID NO: 7465396 - DNA, 19 bp, Homo sapiens
ttacatctgcaacactggt

SEQ ID NO: 7465397 - DNA, 22 bp, Homo sapiens
ttacatctaaactgtgaacaat

SEQ ID NO: 7465398 - DNA, 22 bp, Homo sapiens
ttacatcattgagacatacata

SEQ ID NO: 7465399 - DNA, 22 bp, Homo sapiens
ttacatcatgtaactggatata

SEQ ID NO: 7465400 - DNA, 19 bp, Homo sapiens
ttacatctgcaacactggt

SEQ ID NO: 7465401 - DNA, 19 bp, Homo sapiens
ttacatctgcaacactggt

SEQ ID NO: 7465402 - DNA, 22 bp, Homo sapiens
ttacatgaatacataaccattc

SEQ ID NO: 7465403 - DNA, 22 bp, Homo sapiens
ttacatgaatacataaccattc

SEQ ID NO: 7465404 - DNA, 22 bp, Homo sapiens
ttacatgacaaagctttggctc

SEQ ID NO: 7465405 - DNA, 22 bp, Homo sapiens
ttacatgaatacataaccattc

SEQ ID NO: 7465406 - DNA, 19 bp, Homo sapiens
ttacatgacactccagcct

SEQ ID NO: 7465407 - DNA, 22 bp, Homo sapiens
ttacattttggggtaaggataa

SEQ ID NO: 7465408 - DNA, 22 bp, Homo sapiens
ttacagtaacattttcagtctg

SEQ ID NO: 7465409 - DNA, 22 bp, Homo sapiens
ttacagtaacattttcagtctg

SEQ ID NO: 7465410 - DNA, 22 bp, Homo sapiens
ttacaggttgtgtattcagtga

SEQ ID NO: 7465411 - DNA, 22 bp, Homo sapiens
ttacaggttgtgtattcagtga

SEQ ID NO: 7465412 - DNA, 22 bp, Homo sapiens
ttacaggttgtgtattcagtga

SEQ ID NO: 7465413 - DNA, 22 bp, Homo sapiens
ttacaggttgtgtattcagtga

SEQ ID NO: 7465414 - DNA, 19 bp, Homo sapiens
ttacaggttgacatcaatt

SEQ ID NO: 7465415 - DNA, 19 bp, Homo sapiens
ttacaggttgacatcaatt

SEQ ID NO: 7465416 - DNA, 22 bp, Homo sapiens
ttacaggttaagtgacacttaa

SEQ ID NO: 7465417 - DNA, 22 bp, Homo sapiens
ttacaggtgtggaaattgagta

SEQ ID NO: 7465418 - DNA, 22 bp, Homo sapiens
ttacaggtgtggaaattgagta

SEQ ID NO: 7465419 - DNA, 22 bp, Homo sapiens
ttacaggtgggaaaactaagct

SEQ ID NO: 7465420 - DNA, 22 bp, Homo sapiens
ttacaggtgggaaaactaagct

SEQ ID NO: 7465421 - DNA, 22 bp, Homo sapiens
ttacaggtggagaagtaaggct

SEQ ID NO: 7465422 - DNA, 22 bp, Homo sapiens
ttacaggtgagaaaactgaggc

SEQ ID NO: 7465423 - DNA, 22 bp, Homo sapiens
ttacaggtctgtgtcatcatct

SEQ ID NO: 7465424 - DNA, 22 bp, Homo sapiens
ttacaggtctgtgtcatcatct

SEQ ID NO: 7465425 - DNA, 21 bp, Homo sapiens
ttacaggtcatccaagtcacc

SEQ ID NO: 7465426 - DNA, 21 bp, Homo sapiens
ttacaggtcatccaagtcacc

SEQ ID NO: 7465427 - DNA, 22 bp, Homo sapiens
ttacaggtcagtttgactgaat

SEQ ID NO: 7465428 - DNA, 22 bp, Homo sapiens
ttacaggtcagtttgactgaat

SEQ ID NO: 7465429 - DNA, 22 bp, Homo sapiens
ttacaggtggagaagtaaggct

SEQ ID NO: 7465430 - DNA, 22 bp, Homo sapiens
ttacaggtgagaaaactgaggc

SEQ ID NO: 7465431 - DNA, 22 bp, Homo sapiens
ttacaggtggagaagtaaggct

SEQ ID NO: 7465432 - DNA, 22 bp, Homo sapiens
ttacaggtgagaaaactgaggc

SEQ ID NO: 7465433 - DNA, 22 bp, Homo sapiens
ttacaggtgggaaaactaagct

SEQ ID NO: 7465434 - DNA, 22 bp, Homo sapiens
ttacagtaatcgagtgttgtgg

SEQ ID NO: 7465435 - DNA, 22 bp, Homo sapiens
ttacagtaatgtattatttaac

SEQ ID NO: 7465436 - DNA, 22 bp, Homo sapiens
ttacagtaatgtattatttaac

SEQ ID NO: 7465437 - DNA, 22 bp, Homo sapiens
ttacagtacagaaaataacaga

SEQ ID NO: 7465438 - DNA, 22 bp, Homo sapiens
ttacagtacagaaaataacaga

SEQ ID NO: 7465439 - DNA, 22 bp, Homo sapiens
ttacagtacctgtatggccact

SEQ ID NO: 7465440 - DNA, 22 bp, Homo sapiens
ttacagtacagaaaataacaga

SEQ ID NO: 7465441 - DNA, 22 bp, Homo sapiens
ttacagtacagaaaataacaga

SEQ ID NO: 7465442 - DNA, 22 bp, Homo sapiens
ttacagtacagaaaataacaga

SEQ ID NO: 7465443 - DNA, 22 bp, Homo sapiens
ttacagtagatacaatgagtaa

SEQ ID NO: 7465444 - DNA, 22 bp, Homo sapiens
ttacagtagatacaatgagtaa

SEQ ID NO: 7465445 - DNA, 22 bp, Homo sapiens
ttacagtagatacaatgagtaa

SEQ ID NO: 7465446 - DNA, 22 bp, Homo sapiens
ttacagtagattttgaatgtgg

SEQ ID NO: 7465447 - DNA, 22 bp, Homo sapiens
ttacagtagattttgaatgtgg

SEQ ID NO: 7465448 - DNA, 22 bp, Homo sapiens
ttacagtagctttatttggagt

SEQ ID NO: 7465449 - DNA, 22 bp, Homo sapiens
ttacaggaggtgctaggtgttt

SEQ ID NO: 7465450 - DNA, 22 bp, Homo sapiens
ttacactttggcaagctattaa

SEQ ID NO: 7465451 - DNA, 22 bp, Homo sapiens
ttacactttggcaagctattaa

SEQ ID NO: 7465452 - DNA, 22 bp, Homo sapiens
ttacagggatcccataaatgtc

SEQ ID NO: 7465453 - DNA, 22 bp, Homo sapiens
ttacaggtattttattgagcag

SEQ ID NO: 7465454 - DNA, 22 bp, Homo sapiens
ttacaggtacttgctgctgaaa

SEQ ID NO: 7465455 - DNA, 21 bp, Homo sapiens
ttacaggtaacacttcctttc

SEQ ID NO: 7465456 - DNA, 22 bp, Homo sapiens
ttacaggggaccccgatggtga

SEQ ID NO: 7465457 - DNA, 22 bp, Homo sapiens
ttacacttctaaaaaaagcagg

SEQ ID NO: 7465458 - DNA, 22 bp, Homo sapiens
ttacacttctaaaaaaagcagg

SEQ ID NO: 7465459 - DNA, 22 bp, Homo sapiens
ttacacttctaaaaaaagcagg

SEQ ID NO: 7465460 - DNA, 22 bp, Homo sapiens
ttacacttagggtttgtcagag

SEQ ID NO: 7465461 - DNA, 22 bp, Homo sapiens
ttacacttagggtttgtcagag

SEQ ID NO: 7465462 - DNA, 22 bp, Homo sapiens
ttacacttacctgtccattgaa

SEQ ID NO: 7465463 - DNA, 22 bp, Homo sapiens
ttacacttgggtgtggatttta

SEQ ID NO: 7465464 - DNA, 22 bp, Homo sapiens
ttacacttgtaattatataacg

SEQ ID NO: 7465465 - DNA, 22 bp, Homo sapiens
ttacacttgtaaatggcatgta

SEQ ID NO: 7465466 - DNA, 22 bp, Homo sapiens
ttacacttgaaaacaggattta

SEQ ID NO: 7465467 - DNA, 22 bp, Homo sapiens
ttacacttctgaaagcctaggt

SEQ ID NO: 7465468 - DNA, 19 bp, Homo sapiens
ttacacttctgctttgtga

SEQ ID NO: 7465469 - DNA, 22 bp, Homo sapiens
ttacacactctgccctgctgtt

SEQ ID NO: 7465470 - DNA, 22 bp, Homo sapiens
ttacacagaaacactgttcaga

SEQ ID NO: 7465471 - DNA, 22 bp, Homo sapiens
ttacacagaaacactgttcaga

SEQ ID NO: 7465472 - DNA, 22 bp, Homo sapiens
ttacacagaaacactgttcaga

SEQ ID NO: 7465473 - DNA, 22 bp, Homo sapiens
ttacacagaaattttattgcct

SEQ ID NO: 7465474 - DNA, 22 bp, Homo sapiens
ttacacagaaattttattgcct

SEQ ID NO: 7465475 - DNA, 22 bp, Homo sapiens
ttacacagaaattttattgcct

SEQ ID NO: 7465476 - DNA, 22 bp, Homo sapiens
ttacacagacatggcatcatga

SEQ ID NO: 7465477 - DNA, 22 bp, Homo sapiens
ttacacagacatggcatcatga

SEQ ID NO: 7465478 - DNA, 22 bp, Homo sapiens
ttacacagaaattttattgcct

SEQ ID NO: 7465479 - DNA, 22 bp, Homo sapiens
ttacacacaattagcatagtaa

SEQ ID NO: 7465480 - DNA, 22 bp, Homo sapiens
ttacacacaattagcatagtaa

SEQ ID NO: 7465481 - DNA, 22 bp, Homo sapiens
ttacacacagagctgggcctgg

SEQ ID NO: 7465482 - DNA, 22 bp, Homo sapiens
ttacacaattttattgacctaa

SEQ ID NO: 7465483 - DNA, 22 bp, Homo sapiens
ttacacaattttattgacctaa

SEQ ID NO: 7465484 - DNA, 22 bp, Homo sapiens
ttacacaatatatggtacttgg

SEQ ID NO: 7465485 - DNA, 22 bp, Homo sapiens
ttacacagatggttagtagagg

SEQ ID NO: 7465486 - DNA, 22 bp, Homo sapiens
ttacacagatggttagtagagg

SEQ ID NO: 7465487 - DNA, 22 bp, Homo sapiens
ttacacagatggttagtagagg

SEQ ID NO: 7465488 - DNA, 22 bp, Homo sapiens
ttacacagatggttagtagagg

SEQ ID NO: 7465489 - DNA, 22 bp, Homo sapiens
ttacacagatggttagtagagg

SEQ ID NO: 7465490 - DNA, 22 bp, Homo sapiens
ttacacagatggttagtagagg

SEQ ID NO: 7465491 - DNA, 22 bp, Homo sapiens
ttacacagcttctatccttgaa

SEQ ID NO: 7465492 - DNA, 17 bp, Homo sapiens
ttacacaggagagctct

SEQ ID NO: 7465493 - DNA, 17 bp, Homo sapiens
ttacacaggagagctct

SEQ ID NO: 7465494 - DNA, 17 bp, Homo sapiens
ttacacaggagagctct

SEQ ID NO: 7465495 - DNA, 22 bp, Homo sapiens
ttacacaggcacttaaaatgca

SEQ ID NO: 7465496 - DNA, 22 bp, Homo sapiens
ttacacagtatccaaggttctt

SEQ ID NO: 7465497 - DNA, 22 bp, Homo sapiens
ttacacagtatccaaggttctt

SEQ ID NO: 7465498 - DNA, 22 bp, Homo sapiens
ttacacaggcacttaaaatgca

SEQ ID NO: 7465499 - DNA, 22 bp, Homo sapiens
ttacacaggcacttaaaatgca

SEQ ID NO: 7465500 - DNA, 22 bp, Homo sapiens
ttacacaggcacttaaaatgca

SEQ ID NO: 7465501 - DNA, 22 bp, Homo sapiens
ttacacagtgaatttactcaag

SEQ ID NO: 7465502 - DNA, 22 bp, Homo sapiens
ttacacattaacaggcagctaa

SEQ ID NO: 7465503 - DNA, 22 bp, Homo sapiens
ttacacatgtctcagtggaaat

SEQ ID NO: 7465504 - DNA, 22 bp, Homo sapiens
ttacacatgctttgtgtgtatg

SEQ ID NO: 7465505 - DNA, 22 bp, Homo sapiens
ttacacatgtctcagtggaaat

SEQ ID NO: 7465506 - DNA, 22 bp, Homo sapiens
ttacacattgcagatcaaaatg

SEQ ID NO: 7465507 - DNA, 22 bp, Homo sapiens
ttacacattgcagatcaaaatg

SEQ ID NO: 7465508 - DNA, 22 bp, Homo sapiens
ttacacattgcagatcaaaatg

SEQ ID NO: 7465509 - DNA, 22 bp, Homo sapiens
ttacacattgcagatcaaaatg

SEQ ID NO: 7465510 - DNA, 22 bp, Homo sapiens
ttacacattaacaggcagctaa

SEQ ID NO: 7465511 - DNA, 22 bp, Homo sapiens
ttacacattgcagatcaaaatg

SEQ ID NO: 7465512 - DNA, 22 bp, Homo sapiens
ttacactaagctacttctatat

SEQ ID NO: 7465513 - DNA, 18 bp, Homo sapiens
ttacactagccttggttc

SEQ ID NO: 7465514 - DNA, 22 bp, Homo sapiens
ttacactctggttgtgggcctt

SEQ ID NO: 7465515 - DNA, 19 bp, Homo sapiens
ttacactcctgggcagtgg

SEQ ID NO: 7465516 - DNA, 22 bp, Homo sapiens
ttacactcatattgcacttacc

SEQ ID NO: 7465517 - DNA, 22 bp, Homo sapiens
ttacacatgaaggtccaatgtt

SEQ ID NO: 7465518 - DNA, 22 bp, Homo sapiens
ttacacatgaaggtccaatgtt

SEQ ID NO: 7465519 - DNA, 22 bp, Homo sapiens
ttacacagttggtaggggcaga

SEQ ID NO: 7465520 - DNA, 22 bp, Homo sapiens
ttacacatctagacccattttt

SEQ ID NO: 7465521 - DNA, 22 bp, Homo sapiens
ttacacatgctttgtgtgtatg

SEQ ID NO: 7465522 - DNA, 22 bp, Homo sapiens
ttacacatgctttgtgtgtatg

SEQ ID NO: 7465523 - DNA, 22 bp, Homo sapiens
ttacacatgctttgtgtgtatg

SEQ ID NO: 7465524 - DNA, 22 bp, Homo sapiens
ttacacatgctcacttatttgt

SEQ ID NO: 7465525 - DNA, 22 bp, Homo sapiens
ttacacagtgcacaagcagagt

SEQ ID NO: 7465526 - DNA, 22 bp, Homo sapiens
ttacacagtgcacaagcagagt

SEQ ID NO: 7465527 - DNA, 22 bp, Homo sapiens
ttacacagtgcacaagcagagt

SEQ ID NO: 7465528 - DNA, 22 bp, Homo sapiens
ttacacagtgcacaagcagagt

SEQ ID NO: 7465529 - DNA, 22 bp, Homo sapiens
ttacacagtgcacaagcagagt

SEQ ID NO: 7465530 - DNA, 22 bp, Homo sapiens
ttacacagtggttaagtctggg

SEQ ID NO: 7465531 - DNA, 22 bp, Homo sapiens
ttacacagtggttaagtctggg

SEQ ID NO: 7465532 - DNA, 22 bp, Homo sapiens
ttacacagttggtaggggcaga

SEQ ID NO: 7465533 - DNA, 22 bp, Homo sapiens
ttacacagttggtaggggcaga

SEQ ID NO: 7465534 - DNA, 22 bp, Homo sapiens
ttacacagttggtaggggcaga

SEQ ID NO: 7465535 - DNA, 22 bp, Homo sapiens
ttacacagttggtaggggcaga

SEQ ID NO: 7465536 - DNA, 22 bp, Homo sapiens
ttacaaacaagatcttattctt

SEQ ID NO: 7465537 - DNA, 22 bp, Homo sapiens
ttacaaacaagatcttattctt

SEQ ID NO: 7465538 - DNA, 22 bp, Homo sapiens
ttacaaacaagatcttattctt

SEQ ID NO: 7465539 - DNA, 22 bp, Homo sapiens
ttacaaacaagatcttattctt

SEQ ID NO: 7465540 - DNA, 22 bp, Homo sapiens
ttacaaacaagatcttattctt

SEQ ID NO: 7465541 - DNA, 22 bp, Homo sapiens
ttacaaacaacagacatttatt

SEQ ID NO: 7465542 - DNA, 22 bp, Homo sapiens
ttacaaactgtcatatagtatt

SEQ ID NO: 7465543 - DNA, 22 bp, Homo sapiens
ttacaaactgtcatatagtatt

SEQ ID NO: 7465544 - DNA, 22 bp, Homo sapiens
ttacaaactgtcatatagtatt

SEQ ID NO: 7465545 - DNA, 22 bp, Homo sapiens
ttacaaactgtcatatagtatt

SEQ ID NO: 7465546 - DNA, 22 bp, Homo sapiens
ttacaaactccagtgagtgagc

SEQ ID NO: 7465547 - DNA, 22 bp, Homo sapiens
ttacaaactccagtgagtgagc

SEQ ID NO: 7465548 - DNA, 22 bp, Homo sapiens
ttacaaactccagtgagtgagc

SEQ ID NO: 7465549 - DNA, 22 bp, Homo sapiens
ttacaaagaaaattaggcattt

SEQ ID NO: 7465550 - DNA, 22 bp, Homo sapiens
ttacaaagaaaattaggcattt

SEQ ID NO: 7465551 - DNA, 22 bp, Homo sapiens
ttacaaactgtcatatagtatt

SEQ ID NO: 7465552 - DNA, 22 bp, Homo sapiens
ttacaaactgtcatatagtatt

SEQ ID NO: 7465553 - DNA, 22 bp, Homo sapiens
ttacaaactgtcatatagtatt

SEQ ID NO: 7465554 - DNA, 22 bp, Homo sapiens
ttacaaactgtcatatagtatt

SEQ ID NO: 7465555 - DNA, 22 bp, Homo sapiens
ttacacaaagctccccaaatag

SEQ ID NO: 7465556 - DNA, 22 bp, Homo sapiens
ttacacaacagtgcatcagcag

SEQ ID NO: 7465557 - DNA, 22 bp, Homo sapiens
ttacacaacagtgcatcagcag

SEQ ID NO: 7465558 - DNA, 22 bp, Homo sapiens
ttacacaacagtgcatcagcag

SEQ ID NO: 7465559 - DNA, 22 bp, Homo sapiens
ttacacaacatctgtattatta

SEQ ID NO: 7465560 - DNA, 22 bp, Homo sapiens
ttacacaacatctgtattatta

SEQ ID NO: 7465561 - DNA, 22 bp, Homo sapiens
ttacacaagttctttaacctat

SEQ ID NO: 7465562 - DNA, 22 bp, Homo sapiens
ttacacaacatctgtattatta

SEQ ID NO: 7465563 - DNA, 22 bp, Homo sapiens
ttacacaacatctgtattatta

SEQ ID NO: 7465564 - DNA, 22 bp, Homo sapiens
ttacacaacatctgtattatta

SEQ ID NO: 7465565 - DNA, 22 bp, Homo sapiens
ttaattttgatgaggttcagtt

SEQ ID NO: 7465566 - DNA, 22 bp, Homo sapiens
ttaattttgatgaggttcagtt

SEQ ID NO: 7465567 - DNA, 22 bp, Homo sapiens
ttaattttgatgaggttcagtt

SEQ ID NO: 7465568 - DNA, 22 bp, Homo sapiens
ttaatttttatgtatagtgtgt

SEQ ID NO: 7465569 - DNA, 22 bp, Homo sapiens
ttaatttttatgtatagtgtgt

SEQ ID NO: 7465570 - DNA, 22 bp, Homo sapiens
ttaatttttatgtatagtgtgt

SEQ ID NO: 7465571 - DNA, 22 bp, Homo sapiens
ttaatttttatgtatagtgtgt

SEQ ID NO: 7465572 - DNA, 22 bp, Homo sapiens
ttaatttttatgtatagtgtgt

SEQ ID NO: 7465573 - DNA, 22 bp, Homo sapiens
ttaatttttatgtatagtgtgt

SEQ ID NO: 7465574 - DNA, 22 bp, Homo sapiens
ttacaaacaacagacatttatt

SEQ ID NO: 7465575 - DNA, 22 bp, Homo sapiens
ttacaaacaacagacatttatt

SEQ ID NO: 7465576 - DNA, 22 bp, Homo sapiens
ttacaaacaacagacatttatt

SEQ ID NO: 7465577 - DNA, 22 bp, Homo sapiens
ttaatttttatgtatagtgtgt

SEQ ID NO: 7465578 - DNA, 22 bp, Homo sapiens
ttacaaacaacagacatttatt

SEQ ID NO: 7465579 - DNA, 22 bp, Homo sapiens
ttacaaacaacagacatttatt

SEQ ID NO: 7465580 - DNA, 22 bp, Homo sapiens
ttacaaacaacagacatttatt

SEQ ID NO: 7465581 - DNA, 22 bp, Homo sapiens
ttacaaacaacagacatttatt

SEQ ID NO: 7465582 - DNA, 22 bp, Homo sapiens
ttacaaacaacagacatttatt

SEQ ID NO: 7465583 - DNA, 22 bp, Homo sapiens
ttacaaacaacagacatttatt

SEQ ID NO: 7465584 - DNA, 22 bp, Homo sapiens
ttaattttaacctgtttgtgtc

SEQ ID NO: 7465585 - DNA, 22 bp, Homo sapiens
ttaatttgaccataaatatctt

SEQ ID NO: 7465586 - DNA, 22 bp, Homo sapiens
ttaattttaacctgtttgtgtc

SEQ ID NO: 7465587 - DNA, 22 bp, Homo sapiens
ttaattttaacctgtttgtgtc

SEQ ID NO: 7465588 - DNA, 21 bp, Homo sapiens
ttaatttattcatgatagcta

SEQ ID NO: 7465589 - DNA, 21 bp, Homo sapiens
ttaatttattcatgatagcta

SEQ ID NO: 7465590 - DNA, 21 bp, Homo sapiens
ttaatttattcatgatagcta

SEQ ID NO: 7465591 - DNA, 21 bp, Homo sapiens
ttaatttattcatgatagcta

SEQ ID NO: 7465592 - DNA, 21 bp, Homo sapiens
ttaatttattcatgatagcta

SEQ ID NO: 7465593 - DNA, 21 bp, Homo sapiens
ttaatttattcatgatagcta

SEQ ID NO: 7465594 - DNA, 21 bp, Homo sapiens
ttaatttattcatgatagcta

SEQ ID NO: 7465595 - DNA, 21 bp, Homo sapiens
ttaatttattcatgatagcta

SEQ ID NO: 7465596 - DNA, 22 bp, Homo sapiens
ttaattttctcatctgtgaaat

SEQ ID NO: 7465597 - DNA, 22 bp, Homo sapiens
ttaattttctcatctgtgaaat

SEQ ID NO: 7465598 - DNA, 22 bp, Homo sapiens
ttaattttctcatctgtgaaat

SEQ ID NO: 7465599 - DNA, 22 bp, Homo sapiens
ttaattttctcatctgtgaaat

SEQ ID NO: 7465600 - DNA, 22 bp, Homo sapiens
ttaattttctcatctgtgaaat

SEQ ID NO: 7465601 - DNA, 22 bp, Homo sapiens
ttaattttctcatctgtgaaat

SEQ ID NO: 7465602 - DNA, 22 bp, Homo sapiens
ttaattttctcatctgtgaaat

SEQ ID NO: 7465603 - DNA, 22 bp, Homo sapiens
ttaattttctcatctgtgaaat

SEQ ID NO: 7465604 - DNA, 22 bp, Homo sapiens
ttgattggcagatggcttgaca

SEQ ID NO: 7465605 - DNA, 22 bp, Homo sapiens
ttgattctttgagaccgtgata

SEQ ID NO: 7465606 - DNA, 22 bp, Homo sapiens
ttgattctttgagaccgtgata

SEQ ID NO: 7465607 - DNA, 22 bp, Homo sapiens
ttgattgaattttgaaaatcta

SEQ ID NO: 7465608 - DNA, 22 bp, Homo sapiens
ttgattgaattttgaaaatcta

SEQ ID NO: 7465609 - DNA, 23 bp, Homo sapiens
ttgatttagctgggattgcatgc

SEQ ID NO: 7465610 - DNA, 23 bp, Homo sapiens
ttgatttagctgggattgcatgc

SEQ ID NO: 7465611 - DNA, 22 bp, Homo sapiens
ttgatttatagaatgttcaagc

SEQ ID NO: 7465612 - DNA, 22 bp, Homo sapiens
ttgatttatagaatgttcaagc

SEQ ID NO: 7465613 - DNA, 23 bp, Homo sapiens
ttgatttagctgggattgcatgc

SEQ ID NO: 7465614 - DNA, 22 bp, Homo sapiens
ttgatttcaacatcatcccttt

SEQ ID NO: 7465615 - DNA, 22 bp, Homo sapiens
ttgatttcaaaatatatgcttg

SEQ ID NO: 7465616 - DNA, 22 bp, Homo sapiens
ttgatttatagaatgttcaagc

SEQ ID NO: 7465617 - DNA, 22 bp, Homo sapiens
ttgatttatagaatgttcaagc

SEQ ID NO: 7465618 - DNA, 22 bp, Homo sapiens
ttgatttatagaatgttcaagc

SEQ ID NO: 7465619 - DNA, 22 bp, Homo sapiens
ttgatttcttactcttccaagg

SEQ ID NO: 7465620 - DNA, 22 bp, Homo sapiens
ttgatttcttgaggcattggag

SEQ ID NO: 7465621 - DNA, 22 bp, Homo sapiens
ttgatttcttactcttccaagg

SEQ ID NO: 7465622 - DNA, 22 bp, Homo sapiens
ttgatttctattgagttcctgt

SEQ ID NO: 7465623 - DNA, 22 bp, Homo sapiens
ttgatttctattgagttcctgt

SEQ ID NO: 7465624 - DNA, 22 bp, Homo sapiens
ttgatttcactctctgtccaat

SEQ ID NO: 7465625 - DNA, 22 bp, Homo sapiens
ttgatttctattcagatgtaga

SEQ ID NO: 7465626 - DNA, 22 bp, Homo sapiens
ttgatttctattcagatgtaga

SEQ ID NO: 7465627 - DNA, 22 bp, Homo sapiens
ttgattttaaaatagtgacact

SEQ ID NO: 7465628 - DNA, 22 bp, Homo sapiens
ttgattttaaaatagtgacact

SEQ ID NO: 7465629 - DNA, 22 bp, Homo sapiens
ttgatttgtattgcaggcccct

SEQ ID NO: 7465630 - DNA, 22 bp, Homo sapiens
ttgattttaaaatagtgacact

SEQ ID NO: 7465631 - DNA, 22 bp, Homo sapiens
ttgattttaaaatagtgacact

SEQ ID NO: 7465632 - DNA, 22 bp, Homo sapiens
ttgatttgattgatgaactaag

SEQ ID NO: 7465633 - DNA, 22 bp, Homo sapiens
ttgatttcttattaccctagtt

SEQ ID NO: 7465634 - DNA, 22 bp, Homo sapiens
ttgatttgattgtaatggctct

SEQ ID NO: 7465635 - DNA, 22 bp, Homo sapiens
ttgatttgattgtaatggctct

SEQ ID NO: 7465636 - DNA, 22 bp, Homo sapiens
ttgatttgtaggaatggagacc

SEQ ID NO: 7465637 - DNA, 22 bp, Homo sapiens
ttgatttgtaggaatggagacc

SEQ ID NO: 7465638 - DNA, 22 bp, Homo sapiens
ttgatttgggaatggtctggca

SEQ ID NO: 7465639 - DNA, 22 bp, Homo sapiens
ttgatttgcagaaggtgtagag

SEQ ID NO: 7465640 - DNA, 22 bp, Homo sapiens
ttgcaaagagataatcctaggc

SEQ ID NO: 7465641 - DNA, 22 bp, Homo sapiens
ttgcaaaggggaataaagcaat

SEQ ID NO: 7465642 - DNA, 22 bp, Homo sapiens
ttgcaaagagataatcctaggc

SEQ ID NO: 7465643 - DNA, 22 bp, Homo sapiens
ttgcaaagagataatcctaggc

SEQ ID NO: 7465644 - DNA, 22 bp, Homo sapiens
ttgcaaagactggcttaacagt

SEQ ID NO: 7465645 - DNA, 22 bp, Homo sapiens
ttgcaaagactggcttaacagt

SEQ ID NO: 7465646 - DNA, 22 bp, Homo sapiens
ttgatttttccagcttctagag

SEQ ID NO: 7465647 - DNA, 22 bp, Homo sapiens
ttgatttttccagcttctagag

SEQ ID NO: 7465648 - DNA, 22 bp, Homo sapiens
ttgatttttccagcttctagag

SEQ ID NO: 7465649 - DNA, 22 bp, Homo sapiens
ttgcaaagagataatcctaggc

SEQ ID NO: 7465650 - DNA, 22 bp, Homo sapiens
ttgattttgcctgatctgagag

SEQ ID NO: 7465651 - DNA, 22 bp, Homo sapiens
ttgcaaagactggcttaacagt

SEQ ID NO: 7465652 - DNA, 22 bp, Homo sapiens
ttgcaaagtgtcatgcaaagta

SEQ ID NO: 7465653 - DNA, 22 bp, Homo sapiens
ttgcaaagttccctacacatgt

SEQ ID NO: 7465654 - DNA, 20 bp, Homo sapiens
ttgcaaagtgaatagcaatt

SEQ ID NO: 7465655 - DNA, 22 bp, Homo sapiens
ttgcaaaggggaataaagcaat

SEQ ID NO: 7465656 - DNA, 20 bp, Homo sapiens
ttgcaaagtgaatagcaatt

SEQ ID NO: 7465657 - DNA, 22 bp, Homo sapiens
ttgattttcaattcattgacaa

SEQ ID NO: 7465658 - DNA, 22 bp, Homo sapiens
ttgattttcaattcattgacaa

SEQ ID NO: 7465659 - DNA, 22 bp, Homo sapiens
ttgattttcaattcattgacaa

SEQ ID NO: 7465660 - DNA, 22 bp, Homo sapiens
ttgattttcaattcattgacaa

SEQ ID NO: 7465661 - DNA, 21 bp, Homo sapiens
ttgattttaggaagtttgtca

SEQ ID NO: 7465662 - DNA, 21 bp, Homo sapiens
ttgattttaggaagtttgtca

SEQ ID NO: 7465663 - DNA, 22 bp, Homo sapiens
ttgattttgcctgatctgagag

SEQ ID NO: 7465664 - DNA, 22 bp, Homo sapiens
ttgattttgcctgatctgagag

SEQ ID NO: 7465665 - DNA, 22 bp, Homo sapiens
ttgatttttccagcttctagag

SEQ ID NO: 7465666 - DNA, 21 bp, Homo sapiens
ttgattttaggaagtttgtca

SEQ ID NO: 7465667 - DNA, 21 bp, Homo sapiens
ttgattttaggaagtttgtca

SEQ ID NO: 7465668 - DNA, 21 bp, Homo sapiens
ttgattttaggaagtttgtca

SEQ ID NO: 7465669 - DNA, 21 bp, Homo sapiens
ttgattttaggaagtttgtca

SEQ ID NO: 7465670 - DNA, 21 bp, Homo sapiens
ttgattttaggaagtttgtca

SEQ ID NO: 7465671 - DNA, 22 bp, Homo sapiens
ttgattttaaaatagtgacact

SEQ ID NO: 7465672 - DNA, 22 bp, Homo sapiens
ttgcaaataaacaagtatacat

SEQ ID NO: 7465673 - DNA, 22 bp, Homo sapiens
ttgcaaataaacaagtatacat

SEQ ID NO: 7465674 - DNA, 22 bp, Homo sapiens
ttgcaaataaacaagtatacat

SEQ ID NO: 7465675 - DNA, 22 bp, Homo sapiens
ttgcaaataaacaagtatacat

SEQ ID NO: 7465676 - DNA, 22 bp, Homo sapiens
ttgcaaataaacaagtatacat

SEQ ID NO: 7465677 - DNA, 22 bp, Homo sapiens
ttgcaaataaacaagtatacat

SEQ ID NO: 7465678 - DNA, 22 bp, Homo sapiens
ttgcaaataaacaagtatacat

SEQ ID NO: 7465679 - DNA, 22 bp, Homo sapiens
ttgcaaataatagcctgaaact

SEQ ID NO: 7465680 - DNA, 22 bp, Homo sapiens
ttgcaaataaacaagtatacat

SEQ ID NO: 7465681 - DNA, 22 bp, Homo sapiens
ttgcaaataatagcctgaaact

SEQ ID NO: 7465682 - DNA, 22 bp, Homo sapiens
ttgcaaataatagcctgaaact

SEQ ID NO: 7465683 - DNA, 20 bp, Homo sapiens
ttgcaaatatctattgattg

SEQ ID NO: 7465684 - DNA, 20 bp, Homo sapiens
ttgcaaatatctattgattg

SEQ ID NO: 7465685 - DNA, 20 bp, Homo sapiens
ttgcaaatatctattgattg

SEQ ID NO: 7465686 - DNA, 20 bp, Homo sapiens
ttgcaaatatctattgattg

SEQ ID NO: 7465687 - DNA, 20 bp, Homo sapiens
ttgcaaatatcgtgggtcag

SEQ ID NO: 7465688 - DNA, 20 bp, Homo sapiens
ttgcaaatatcgtgggtcag

SEQ ID NO: 7465689 - DNA, 22 bp, Homo sapiens
ttgcaaatattcccctaggtct

SEQ ID NO: 7465690 - DNA, 22 bp, Homo sapiens
ttgcaaatattcccctaggtct

SEQ ID NO: 7465691 - DNA, 22 bp, Homo sapiens
ttgcaaatatgttctcctattc

SEQ ID NO: 7465692 - DNA, 22 bp, Homo sapiens
ttgcaaatatgttctcctattc

SEQ ID NO: 7465693 - DNA, 22 bp, Homo sapiens
ttgcaaatatgttctcctattc

SEQ ID NO: 7465694 - DNA, 20 bp, Homo sapiens
ttgcaaatatctattgattg

SEQ ID NO: 7465695 - DNA, 22 bp, Homo sapiens
ttgcaaatattgtttacctttc

SEQ ID NO: 7465696 - DNA, 22 bp, Homo sapiens
ttgcaaatattgtttacctttc

SEQ ID NO: 7465697 - DNA, 22 bp, Homo sapiens
ttgcaaatattgtttacctttc

SEQ ID NO: 7465698 - DNA, 22 bp, Homo sapiens
ttgcaaatattgtttacctttc

SEQ ID NO: 7465699 - DNA, 22 bp, Homo sapiens
ttgcaaatattgtttacctttc

SEQ ID NO: 7465700 - DNA, 22 bp, Homo sapiens
ttgcaaatcagaagtatagatt

SEQ ID NO: 7465701 - DNA, 22 bp, Homo sapiens
ttgcaaatcagaagtatagatt

SEQ ID NO: 7465702 - DNA, 22 bp, Homo sapiens
ttgcaaatcacaagagcagagc

SEQ ID NO: 7465703 - DNA, 22 bp, Homo sapiens
ttgcaaatcacaagagcagagc

SEQ ID NO: 7465704 - DNA, 22 bp, Homo sapiens
ttgcaaatcacaagagcagagc

SEQ ID NO: 7465705 - DNA, 22 bp, Homo sapiens
ttgcaaatcacaagagcagagc

SEQ ID NO: 7465706 - DNA, 22 bp, Homo sapiens
ttgcaaatattgtttacctttc

SEQ ID NO: 7465707 - DNA, 22 bp, Homo sapiens
ttgcaaatctttgccagaaggc

SEQ ID NO: 7465708 - DNA, 22 bp, Homo sapiens
ttgcaaatctttgccagaaggc

SEQ ID NO: 7465709 - DNA, 22 bp, Homo sapiens
ttgcaaatctcttgtgtttggt

SEQ ID NO: 7465710 - DNA, 22 bp, Homo sapiens
ttgcaaatcagaagtatagatt

SEQ ID NO: 7465711 - DNA, 22 bp, Homo sapiens
ttgcaaatcagaagtatagatt

SEQ ID NO: 7465712 - DNA, 22 bp, Homo sapiens
ttgcaaatctcttgtgtttggt

SEQ ID NO: 7465713 - DNA, 22 bp, Homo sapiens
ttgcaaatgaccattgccacat

SEQ ID NO: 7465714 - DNA, 22 bp, Homo sapiens
ttgcaaatctttgccagaaggc

SEQ ID NO: 7465715 - DNA, 22 bp, Homo sapiens
ttgcaaatgaccattgccacat

SEQ ID NO: 7465716 - DNA, 22 bp, Homo sapiens
ttgcaaatgaccattgccacat

SEQ ID NO: 7465717 - DNA, 22 bp, Homo sapiens
ttgcaaatgaccattgccacat

SEQ ID NO: 7465718 - DNA, 22 bp, Homo sapiens
ttgcaaatctttgccagaaggc

SEQ ID NO: 7465719 - DNA, 22 bp, Homo sapiens
ttgcaaatctttgccagaaggc

SEQ ID NO: 7465720 - DNA, 22 bp, Homo sapiens
ttgcaaatctttgccagaaggc

SEQ ID NO: 7465721 - DNA, 22 bp, Homo sapiens
ttgcaaatctttgccagaaggc

SEQ ID NO: 7465722 - DNA, 22 bp, Homo sapiens
ttgcaaatgtggttagggcttt

SEQ ID NO: 7465723 - DNA, 22 bp, Homo sapiens
ttgcaaatgtgagtttagactg

SEQ ID NO: 7465724 - DNA, 22 bp, Homo sapiens
ttgcaaatgtggttagggcttt

SEQ ID NO: 7465725 - DNA, 22 bp, Homo sapiens
ttgcaaatgtggttagggcttt

SEQ ID NO: 7465726 - DNA, 22 bp, Homo sapiens
ttgcaaatgtttcataacagta

SEQ ID NO: 7465727 - DNA, 22 bp, Homo sapiens
ttgcaaatgtttcataacagta

SEQ ID NO: 7465728 - DNA, 22 bp, Homo sapiens
ttgcaaatgtttcataacagta

SEQ ID NO: 7465729 - DNA, 22 bp, Homo sapiens
ttgcaaatgttatactgccagt

SEQ ID NO: 7465730 - DNA, 22 bp, Homo sapiens
ttgcaaatgttatactgccagt

SEQ ID NO: 7465731 - DNA, 22 bp, Homo sapiens
ttgcaaatgttatactgccagt

SEQ ID NO: 7465732 - DNA, 22 bp, Homo sapiens
ttgcaaatgttatactgccagt

SEQ ID NO: 7465733 - DNA, 22 bp, Homo sapiens
ttgcaaatgtttcataacagta

SEQ ID NO: 7465734 - DNA, 22 bp, Homo sapiens
ttgcaaatgtttcataacagta

SEQ ID NO: 7465735 - DNA, 22 bp, Homo sapiens
ttgcaaatgtttcataacagta

SEQ ID NO: 7465736 - DNA, 22 bp, Homo sapiens
ttgcaaatgtttcataacagta

SEQ ID NO: 7465737 - DNA, 22 bp, Homo sapiens
ttgcaaatgtttcataacagta

SEQ ID NO: 7465738 - DNA, 22 bp, Homo sapiens
ttgcaaatgtttcataacagta

SEQ ID NO: 7465739 - DNA, 22 bp, Homo sapiens
ttgcaaattaaagaggatagca

SEQ ID NO: 7465740 - DNA, 22 bp, Homo sapiens
ttgcaaattaaagaggatagca

SEQ ID NO: 7465741 - DNA, 22 bp, Homo sapiens
ttgcaaattaaagaggatagca

SEQ ID NO: 7465742 - DNA, 22 bp, Homo sapiens
ttgcaaattatataagggatgc

SEQ ID NO: 7465743 - DNA, 22 bp, Homo sapiens
ttgcaaattatataagggatgc

SEQ ID NO: 7465744 - DNA, 22 bp, Homo sapiens
ttgcaaattatataagggatgc

SEQ ID NO: 7465745 - DNA, 22 bp, Homo sapiens
ttgcaaatgtgaataattacac

SEQ ID NO: 7465746 - DNA, 22 bp, Homo sapiens
ttgcaaatgtgaataattacac

SEQ ID NO: 7465747 - DNA, 22 bp, Homo sapiens
ttgcaaatgtgagtttagactg

SEQ ID NO: 7465748 - DNA, 22 bp, Homo sapiens
ttgcaaatgtgagtttagactg

SEQ ID NO: 7465749 - DNA, 22 bp, Homo sapiens
ttgcaaatgtgaataattacac

SEQ ID NO: 7465750 - DNA, 22 bp, Homo sapiens
ttgcaaatgtgaataattacac

SEQ ID NO: 7465751 - DNA, 22 bp, Homo sapiens
ttgcaaatgtgaataattacac

SEQ ID NO: 7465752 - DNA, 22 bp, Homo sapiens
ttgcaaatggtaccaagggtct

SEQ ID NO: 7465753 - DNA, 22 bp, Homo sapiens
ttgcaaatgtgaataattacac

SEQ ID NO: 7465754 - DNA, 22 bp, Homo sapiens
ttgcaaatgtgaataattacac

SEQ ID NO: 7465755 - DNA, 22 bp, Homo sapiens
ttgcaaatgtgaataattacac

SEQ ID NO: 7465756 - DNA, 22 bp, Homo sapiens
ttgcaaatgggcaaagcagatc

SEQ ID NO: 7465757 - DNA, 22 bp, Homo sapiens
ttgcaaatgggcaaagcagatc

SEQ ID NO: 7465758 - DNA, 22 bp, Homo sapiens
ttgcaaatgggcaaagcagatc

SEQ ID NO: 7465759 - DNA, 22 bp, Homo sapiens
ttgcaaatggtaccaagggtct

SEQ ID NO: 7465760 - DNA, 22 bp, Homo sapiens
ttgcaaatggtaccaagggtct

SEQ ID NO: 7465761 - DNA, 22 bp, Homo sapiens
ttgcaaatggtaccaagggtct

SEQ ID NO: 7465762 - DNA, 22 bp, Homo sapiens
ttgcaaatgggcaaagcagatc

SEQ ID NO: 7465763 - DNA, 22 bp, Homo sapiens
ttgcaaatggaggcctggcagc

SEQ ID NO: 7465764 - DNA, 22 bp, Homo sapiens
ttgcaaatggaggcctggcagc

SEQ ID NO: 7465765 - DNA, 22 bp, Homo sapiens
ttgcaaatggaggcctggcagc

SEQ ID NO: 7465766 - DNA, 22 bp, Homo sapiens
ttgcaaatgaccattgccacat

SEQ ID NO: 7465767 - DNA, 22 bp, Homo sapiens
ttgcaaatgaccattgccacat

SEQ ID NO: 7465768 - DNA, 22 bp, Homo sapiens
ttgcaaatgaccattgccacat

SEQ ID NO: 7465769 - DNA, 22 bp, Homo sapiens
ttgatgtaggtttatctattgt

SEQ ID NO: 7465770 - DNA, 22 bp, Homo sapiens
ttgatgtaggtttatctattgt

SEQ ID NO: 7465771 - DNA, 22 bp, Homo sapiens
ttgatgtagggattcctgtaaa

SEQ ID NO: 7465772 - DNA, 22 bp, Homo sapiens
ttgatgtagcctaagacagaac

SEQ ID NO: 7465773 - DNA, 22 bp, Homo sapiens
ttgatgtagggattcctgtaaa

SEQ ID NO: 7465774 - DNA, 22 bp, Homo sapiens
ttgatgtaggtttatctattgt

SEQ ID NO: 7465775 - DNA, 22 bp, Homo sapiens
ttgatgtacagaattgttcaca

SEQ ID NO: 7465776 - DNA, 22 bp, Homo sapiens
ttgatgtacagaattgttcaca

SEQ ID NO: 7465777 - DNA, 22 bp, Homo sapiens
ttgatgtacagaattgttcaca

SEQ ID NO: 7465778 - DNA, 22 bp, Homo sapiens
ttgatgtacagaattgttcaca

SEQ ID NO: 7465779 - DNA, 22 bp, Homo sapiens
ttgatgtagaaccaagatcttt

SEQ ID NO: 7465780 - DNA, 22 bp, Homo sapiens
ttgattaaaatgagacatcatt

SEQ ID NO: 7465781 - DNA, 22 bp, Homo sapiens
ttgatgtttccccttggacatt

SEQ ID NO: 7465782 - DNA, 22 bp, Homo sapiens
ttgattaaaatgagacatcatt

SEQ ID NO: 7465783 - DNA, 22 bp, Homo sapiens
ttgattaaaatgagacatcatt

SEQ ID NO: 7465784 - DNA, 22 bp, Homo sapiens
ttgatgtttccccttggacatt

SEQ ID NO: 7465785 - DNA, 22 bp, Homo sapiens
ttgatgttcctgtacaatctga

SEQ ID NO: 7465786 - DNA, 22 bp, Homo sapiens
ttgatgttgctcttaacagtat

SEQ ID NO: 7465787 - DNA, 22 bp, Homo sapiens
ttgatgttcataaatgatacag

SEQ ID NO: 7465788 - DNA, 22 bp, Homo sapiens
ttgatgttcataaatgatacag

SEQ ID NO: 7465789 - DNA, 22 bp, Homo sapiens
ttgatgtcagtattatgagttt

SEQ ID NO: 7465790 - DNA, 22 bp, Homo sapiens
ttgatgtctaagtcattggcct

SEQ ID NO: 7465791 - DNA, 22 bp, Homo sapiens
ttgatgttcataaatgatacag

SEQ ID NO: 7465792 - DNA, 22 bp, Homo sapiens
ttgattcaaccacttaataatc

SEQ ID NO: 7465793 - DNA, 22 bp, Homo sapiens
ttgattcaaccacttaataatc

SEQ ID NO: 7465794 - DNA, 20 bp, Homo sapiens
ttgattcaagggctgatgga

SEQ ID NO: 7465795 - DNA, 20 bp, Homo sapiens
ttgattcaagggctgatgga

SEQ ID NO: 7465796 - DNA, 20 bp, Homo sapiens
ttgattcaagggctgatgga

SEQ ID NO: 7465797 - DNA, 22 bp, Homo sapiens
ttgattatagactcactaatct

SEQ ID NO: 7465798 - DNA, 22 bp, Homo sapiens
ttgattatagaatcttggcttt

SEQ ID NO: 7465799 - DNA, 22 bp, Homo sapiens
ttgattatagaatcttggcttt

SEQ ID NO: 7465800 - DNA, 22 bp, Homo sapiens
ttgattcaaaggggacaagtgg

SEQ ID NO: 7465801 - DNA, 22 bp, Homo sapiens
ttgattcaaaggggacaagtgg

SEQ ID NO: 7465802 - DNA, 22 bp, Homo sapiens
ttgattcaaaacaggaggtagg

SEQ ID NO: 7465803 - DNA, 22 bp, Homo sapiens
ttgattcaaaacaggaggtagg

SEQ ID NO: 7465804 - DNA, 22 bp, Homo sapiens
ttgattaaacaggcatattcaa

SEQ ID NO: 7465805 - DNA, 22 bp, Homo sapiens
ttgattaaacaggcatattcaa

SEQ ID NO: 7465806 - DNA, 22 bp, Homo sapiens
ttgattaaaatgagacatcatt

SEQ ID NO: 7465807 - DNA, 22 bp, Homo sapiens
ttgattaaaatgagacatcatt

SEQ ID NO: 7465808 - DNA, 22 bp, Homo sapiens
ttgattaatcccatgtgagtag

SEQ ID NO: 7465809 - DNA, 22 bp, Homo sapiens
ttgattaatcccatgtgagtag

SEQ ID NO: 7465810 - DNA, 22 bp, Homo sapiens
ttgattaatcccatgtgagtag

SEQ ID NO: 7465811 - DNA, 22 bp, Homo sapiens
ttgattactatgtgttgaaagc

SEQ ID NO: 7465812 - DNA, 22 bp, Homo sapiens
ttgattcttagctggtgataat

SEQ ID NO: 7465813 - DNA, 22 bp, Homo sapiens
ttgattctggtgactgatggaa

SEQ ID NO: 7465814 - DNA, 22 bp, Homo sapiens
ttgattctggtgactgatggaa

SEQ ID NO: 7465815 - DNA, 22 bp, Homo sapiens
ttgattcttctgaatttgcaga

SEQ ID NO: 7465816 - DNA, 23 bp, Homo sapiens
ttgattctttcagggacctagat

SEQ ID NO: 7465817 - DNA, 23 bp, Homo sapiens
ttgattctttcagggacctagat

SEQ ID NO: 7465818 - DNA, 22 bp, Homo sapiens
ttgattcttctgaatttgcaga

SEQ ID NO: 7465819 - DNA, 22 bp, Homo sapiens
ttgattcttctgaatttgcaga

SEQ ID NO: 7465820 - DNA, 22 bp, Homo sapiens
ttgattcttctgaatttgcaga

SEQ ID NO: 7465821 - DNA, 22 bp, Homo sapiens
ttgattctgggctcatttcttt

SEQ ID NO: 7465822 - DNA, 22 bp, Homo sapiens
ttgattctgggctcatttcttt

SEQ ID NO: 7465823 - DNA, 22 bp, Homo sapiens
ttgattctgggctcatttcttt

SEQ ID NO: 7465824 - DNA, 22 bp, Homo sapiens
ttgattctgggctcatttcttt

SEQ ID NO: 7465825 - DNA, 22 bp, Homo sapiens
ttgattctgatgaaagtccatt

SEQ ID NO: 7465826 - DNA, 22 bp, Homo sapiens
ttgattctgatgaaagtccatt

SEQ ID NO: 7465827 - DNA, 22 bp, Homo sapiens
ttgattctgctgatctcggacg

SEQ ID NO: 7465828 - DNA, 22 bp, Homo sapiens
ttgattctgctgatctcggacg

SEQ ID NO: 7465829 - DNA, 22 bp, Homo sapiens
ttgattctgctgatctcggacg

SEQ ID NO: 7465830 - DNA, 22 bp, Homo sapiens
ttgattctatgttgttgtctca

SEQ ID NO: 7465831 - DNA, 22 bp, Homo sapiens
ttgattctatgaggtaagctat

SEQ ID NO: 7465832 - DNA, 22 bp, Homo sapiens
ttgattctatggctccgggagt

SEQ ID NO: 7465833 - DNA, 22 bp, Homo sapiens
ttgattctatgttgttgtctca

SEQ ID NO: 7465834 - DNA, 22 bp, Homo sapiens
ttgattctgatcctgtctggag

SEQ ID NO: 7465835 - DNA, 22 bp, Homo sapiens
ttgattctatgttgttgtctca

SEQ ID NO: 7465836 - DNA, 22 bp, Homo sapiens
ttgattctgatcctttgctagc

SEQ ID NO: 7465837 - DNA, 23 bp, Homo sapiens
ttgattctccagtatgggctgag

SEQ ID NO: 7465838 - DNA, 22 bp, Homo sapiens
ttgattctgatcctgtctggag

SEQ ID NO: 7465839 - DNA, 22 bp, Homo sapiens
ttgattctgatcctttgctagc

SEQ ID NO: 7465840 - DNA, 22 bp, Homo sapiens
ttgattctgatcctttgctagc

SEQ ID NO: 7465841 - DNA, 22 bp, Homo sapiens
ttgattctgatcctttgctagc

SEQ ID NO: 7465842 - DNA, 22 bp, Homo sapiens
ttgattctgatcctttgctagc

SEQ ID NO: 7465843 - DNA, 22 bp, Homo sapiens
ttgattcagtaaagctaaattt

SEQ ID NO: 7465844 - DNA, 22 bp, Homo sapiens
ttgattcagtaaagctaaattt

SEQ ID NO: 7465845 - DNA, 22 bp, Homo sapiens
ttgattcatatagatatgcgtg

SEQ ID NO: 7465846 - DNA, 22 bp, Homo sapiens
ttgattcatatagatatgcgtg

SEQ ID NO: 7465847 - DNA, 18 bp, Homo sapiens
ttgattcatattaaccat

SEQ ID NO: 7465848 - DNA, 18 bp, Homo sapiens
ttgattcatattaaccat

SEQ ID NO: 7465849 - DNA, 22 bp, Homo sapiens
ttgattcacaattaccaagact

SEQ ID NO: 7465850 - DNA, 22 bp, Homo sapiens
ttgattcacaattaccaagact

SEQ ID NO: 7465851 - DNA, 22 bp, Homo sapiens
ttgattcagaaaaagatggaga

SEQ ID NO: 7465852 - DNA, 22 bp, Homo sapiens
ttgattcagaaaaagatggaga

SEQ ID NO: 7465853 - DNA, 22 bp, Homo sapiens
ttgattcagagaagattggccc

SEQ ID NO: 7465854 - DNA, 22 bp, Homo sapiens
ttgattcagagaagattggccc

SEQ ID NO: 7465855 - DNA, 22 bp, Homo sapiens
ttgattcagagaagattggccc

SEQ ID NO: 7465856 - DNA, 22 bp, Homo sapiens
ttgattctagaatcttccctct

SEQ ID NO: 7465857 - DNA, 22 bp, Homo sapiens
ttgattctagaatcttccctct

SEQ ID NO: 7465858 - DNA, 22 bp, Homo sapiens
ttgattccttgaaatatccttg

SEQ ID NO: 7465859 - DNA, 22 bp, Homo sapiens
ttgattctaaaataggaggaaa

SEQ ID NO: 7465860 - DNA, 20 bp, Homo sapiens
ttgattccctctaaactcgc

SEQ ID NO: 7465861 - DNA, 22 bp, Homo sapiens
ttgattctacttaaaacatatg

SEQ ID NO: 7465862 - DNA, 22 bp, Homo sapiens
ttgattctacttaaaacatatg

SEQ ID NO: 7465863 - DNA, 22 bp, Homo sapiens
ttgattctacttaaaacatatg

SEQ ID NO: 7465864 - DNA, 22 bp, Homo sapiens
ttgattctacttaaaacatatg

SEQ ID NO: 7465865 - DNA, 22 bp, Homo sapiens
ttgattcatcttctaataccca

SEQ ID NO: 7465866 - DNA, 22 bp, Homo sapiens
ttgattcatcttctaataccca

SEQ ID NO: 7465867 - DNA, 22 bp, Homo sapiens
ttgattcatggacaggccaggt

SEQ ID NO: 7465868 - DNA, 22 bp, Homo sapiens
ttgattcatggacaggccaggt

SEQ ID NO: 7465869 - DNA, 22 bp, Homo sapiens
ttgattcatttattgagtgcct

SEQ ID NO: 7465870 - DNA, 22 bp, Homo sapiens
ttgattcatttattgagtgcct

SEQ ID NO: 7465871 - DNA, 22 bp, Homo sapiens
ttgatgtaaagatagtttctgt

SEQ ID NO: 7465872 - DNA, 22 bp, Homo sapiens
ttgatgtaaagatagtttctgt

SEQ ID NO: 7465873 - DNA, 22 bp, Homo sapiens
ttgatgtaaagtgattcatggg

SEQ ID NO: 7465874 - DNA, 22 bp, Homo sapiens
ttgatgtaatactttgcaacca

SEQ ID NO: 7465875 - DNA, 22 bp, Homo sapiens
ttgatgtaaactttgatttcat

SEQ ID NO: 7465876 - DNA, 22 bp, Homo sapiens
ttgatgtaaaagccttggtggc

SEQ ID NO: 7465877 - DNA, 22 bp, Homo sapiens
ttgatgtaaactttgatttcat

SEQ ID NO: 7465878 - DNA, 22 bp, Homo sapiens
ttgatggctttttggcagagct

SEQ ID NO: 7465879 - DNA, 22 bp, Homo sapiens
ttgatgtaaaagccttggtggc

SEQ ID NO: 7465880 - DNA, 21 bp, Homo sapiens
ttgatggtgggtgatgctctg

SEQ ID NO: 7465881 - DNA, 22 bp, Homo sapiens
ttgatggctgtgatttactcag

SEQ ID NO: 7465882 - DNA, 22 bp, Homo sapiens
ttgatgcactatgtaacttaca

SEQ ID NO: 7465883 - DNA, 22 bp, Homo sapiens
ttgatgctagaagtaaaccaag

SEQ ID NO: 7465884 - DNA, 22 bp, Homo sapiens
ttgatgcttaaggtaaaacaga

SEQ ID NO: 7465885 - DNA, 22 bp, Homo sapiens
ttgatgcttaaggtaaaacaga

SEQ ID NO: 7465886 - DNA, 22 bp, Homo sapiens
ttgatggaaaatttcatggtga

SEQ ID NO: 7465887 - DNA, 22 bp, Homo sapiens
ttgatggaatattttttgaggt

SEQ ID NO: 7465888 - DNA, 22 bp, Homo sapiens
ttgatgatgcacatttataatt

SEQ ID NO: 7465889 - DNA, 22 bp, Homo sapiens
ttgatgatgtttctgccttgcc

SEQ ID NO: 7465890 - DNA, 22 bp, Homo sapiens
ttgatgagttatccatttgact

SEQ ID NO: 7465891 - DNA, 22 bp, Homo sapiens
ttgatgatcttacggcagagga

SEQ ID NO: 7465892 - DNA, 22 bp, Homo sapiens
ttgatgagaccattgccgcgtc

SEQ ID NO: 7465893 - DNA, 22 bp, Homo sapiens
ttgatctgcctcattcttgttc

SEQ ID NO: 7465894 - DNA, 22 bp, Homo sapiens
ttgatcttcatcgaaatattgt

SEQ ID NO: 7465895 - DNA, 22 bp, Homo sapiens
ttgatctctgttgctgtctttg

SEQ ID NO: 7465896 - DNA, 22 bp, Homo sapiens
ttgatctgcctcattcttgttc

SEQ ID NO: 7465897 - DNA, 22 bp, Homo sapiens
ttgatcttacagtgttcttcca

SEQ ID NO: 7465898 - DNA, 22 bp, Homo sapiens
ttgatgaacacagataatcagt

SEQ ID NO: 7465899 - DNA, 22 bp, Homo sapiens
ttgatgaacacagataatcagt

SEQ ID NO: 7465900 - DNA, 22 bp, Homo sapiens
ttgatctttataatagttttga

SEQ ID NO: 7465901 - DNA, 22 bp, Homo sapiens
ttgatcttggactttccagcct

SEQ ID NO: 7465902 - DNA, 22 bp, Homo sapiens
ttgatcttggactttccagcct

SEQ ID NO: 7465903 - DNA, 22 bp, Homo sapiens
ttgatctttataatagttttga

SEQ ID NO: 7465904 - DNA, 22 bp, Homo sapiens
ttgatcatctaagagtaatagt

SEQ ID NO: 7465905 - DNA, 22 bp, Homo sapiens
ttgatcaggttgctgtggtgta

SEQ ID NO: 7465906 - DNA, 22 bp, Homo sapiens
ttgatcaagtgggaaatagtaa

SEQ ID NO: 7465907 - DNA, 22 bp, Homo sapiens
ttgagtgtaaggaatgtggggc

SEQ ID NO: 7465908 - DNA, 22 bp, Homo sapiens
ttgagttcaggggttgattgga

SEQ ID NO: 7465909 - DNA, 22 bp, Homo sapiens
ttgagttccaggatggttgtta

SEQ ID NO: 7465910 - DNA, 22 bp, Homo sapiens
ttgagttctggtcttttaaaag

SEQ ID NO: 7465911 - DNA, 22 bp, Homo sapiens
ttgatctctgttgctgtctttg

SEQ ID NO: 7465912 - DNA, 22 bp, Homo sapiens
ttgatccctggaaattgaaatg

SEQ ID NO: 7465913 - DNA, 22 bp, Homo sapiens
ttgatccagttgaaagtgatga

SEQ ID NO: 7465914 - DNA, 22 bp, Homo sapiens
ttgatcatctaagagtaatagt

SEQ ID NO: 7465915 - DNA, 22 bp, Homo sapiens
ttgagtggttcctcagttgact

SEQ ID NO: 7465916 - DNA, 22 bp, Homo sapiens
ttgagtggttcctcagttgact

SEQ ID NO: 7465917 - DNA, 22 bp, Homo sapiens
ttgagtgagaattacatcagct

SEQ ID NO: 7465918 - DNA, 22 bp, Homo sapiens
ttgagtgtaaggaatgtggggc

SEQ ID NO: 7465919 - DNA, 22 bp, Homo sapiens
ttgagtgtactttagtcatctg

SEQ ID NO: 7465920 - DNA, 22 bp, Homo sapiens
ttgagtctgtgccctatgctgt

SEQ ID NO: 7465921 - DNA, 22 bp, Homo sapiens
ttgagtctgcaatacataacac

SEQ ID NO: 7465922 - DNA, 22 bp, Homo sapiens
ttgagtctgcccaaattaagaa

SEQ ID NO: 7465923 - DNA, 22 bp, Homo sapiens
ttgaggcaggtccgggtccttc

SEQ ID NO: 7465924 - DNA, 22 bp, Homo sapiens
ttgaggcaggtccgggtccttc

SEQ ID NO: 7465925 - DNA, 20 bp, Homo sapiens
ttgaggcatgtctagaagta

SEQ ID NO: 7465926 - DNA, 20 bp, Homo sapiens
ttgaggcatgtctagaagta

SEQ ID NO: 7465927 - DNA, 22 bp, Homo sapiens
ttgaggcagcccttaattggga

SEQ ID NO: 7465928 - DNA, 22 bp, Homo sapiens
ttgaggcagggcatggtggccc

SEQ ID NO: 7465929 - DNA, 22 bp, Homo sapiens
ttgaggcagggcatggtggccc

SEQ ID NO: 7465930 - DNA, 22 bp, Homo sapiens
ttgaggcagggcatggtggccc

SEQ ID NO: 7465931 - DNA, 22 bp, Homo sapiens
ttgaggcattactgtaatgaga

SEQ ID NO: 7465932 - DNA, 20 bp, Homo sapiens
ttgaggcatgtctagaagta

SEQ ID NO: 7465933 - DNA, 22 bp, Homo sapiens
ttgaggcaggtccgggtccttc

SEQ ID NO: 7465934 - DNA, 22 bp, Homo sapiens
ttgaggccaaaaagtcctatga

SEQ ID NO: 7465935 - DNA, 22 bp, Homo sapiens
ttgaggcattactgtaatgaga

SEQ ID NO: 7465936 - DNA, 22 bp, Homo sapiens
ttgagtctctgccaaaacacaa

SEQ ID NO: 7465937 - DNA, 22 bp, Homo sapiens
ttgagtctctgccaaaacacaa

SEQ ID NO: 7465938 - DNA, 22 bp, Homo sapiens
ttgaggccaaaaagtcctatga

SEQ ID NO: 7465939 - DNA, 22 bp, Homo sapiens
ttgaggccccatggatgagaac

SEQ ID NO: 7465940 - DNA, 22 bp, Homo sapiens
ttgaggcattactgtaatgaga

SEQ ID NO: 7465941 - DNA, 21 bp, Homo sapiens
ttctttccccagaggactaaa

SEQ ID NO: 7465942 - DNA, 22 bp, Homo sapiens
ttctttcccagtagatgtgaaa

SEQ ID NO: 7465943 - DNA, 22 bp, Homo sapiens
ttctttcccagtagatgtgaaa

SEQ ID NO: 7465944 - DNA, 22 bp, Homo sapiens
ttctttccccatggagttcgga

SEQ ID NO: 7465945 - DNA, 22 bp, Homo sapiens
ttctttcccttccagcagctcc

SEQ ID NO: 7465946 - DNA, 22 bp, Homo sapiens
ttctttcccttccagcagctcc

SEQ ID NO: 7465947 - DNA, 22 bp, Homo sapiens
ttctttcccttccagcagctcc

SEQ ID NO: 7465948 - DNA, 22 bp, Homo sapiens
ttctttccccatggagttcgga

SEQ ID NO: 7465949 - DNA, 22 bp, Homo sapiens
ttctttcctcccagcctttgga

SEQ ID NO: 7465950 - DNA, 22 bp, Homo sapiens
ttctttccttgcctcagtgaag

SEQ ID NO: 7465951 - DNA, 22 bp, Homo sapiens
ttctttcctcccagcctttgga

SEQ ID NO: 7465952 - DNA, 22 bp, Homo sapiens
ttctttccttgcctcagtgaag

SEQ ID NO: 7465953 - DNA, 22 bp, Homo sapiens
ttctttccttgcctcagtgaag

SEQ ID NO: 7465954 - DNA, 22 bp, Homo sapiens
ttctttccttgcctcagtgaag

SEQ ID NO: 7465955 - DNA, 22 bp, Homo sapiens
ttctttccttgcctcagtgaag

SEQ ID NO: 7465956 - DNA, 22 bp, Homo sapiens
ttctttccttgcctcagtgaag

SEQ ID NO: 7465957 - DNA, 22 bp, Homo sapiens
ttctttccttgcctcagtgaag

SEQ ID NO: 7465958 - DNA, 22 bp, Homo sapiens
ttgaagaagtaattttaagtct

SEQ ID NO: 7465959 - DNA, 19 bp, Homo sapiens
ttgaagaataaaaacacat

SEQ ID NO: 7465960 - DNA, 19 bp, Homo sapiens
ttgaagaataaaaacacat

SEQ ID NO: 7465961 - DNA, 22 bp, Homo sapiens
ttgaagaagtaattttaagtct

SEQ ID NO: 7465962 - DNA, 22 bp, Homo sapiens
ttgaagaagtaattttaagtct

SEQ ID NO: 7465963 - DNA, 22 bp, Homo sapiens
ttgaagaagtaattttaagtct

SEQ ID NO: 7465964 - DNA, 22 bp, Homo sapiens
ttgaagaaccatctgtgccact

SEQ ID NO: 7465965 - DNA, 22 bp, Homo sapiens
ttctttctcaacatgaatgttt

SEQ ID NO: 7465966 - DNA, 22 bp, Homo sapiens
ttgaagaacataatagctactt

SEQ ID NO: 7465967 - DNA, 22 bp, Homo sapiens
ttgaagaacataatagctactt

SEQ ID NO: 7465968 - DNA, 22 bp, Homo sapiens
ttgaagagaaccgcggcttatt

SEQ ID NO: 7465969 - DNA, 22 bp, Homo sapiens
ttgaagactaatttagataatg

SEQ ID NO: 7465970 - DNA, 22 bp, Homo sapiens
ttgaagaattaacagctgtgga

SEQ ID NO: 7465971 - DNA, 22 bp, Homo sapiens
ttgaagaattaacagctgtgga

SEQ ID NO: 7465972 - DNA, 22 bp, Homo sapiens
ttgaagaattaacagctgtgga

SEQ ID NO: 7465973 - DNA, 22 bp, Homo sapiens
ttgaagaattaggacgtgagta

SEQ ID NO: 7465974 - DNA, 22 bp, Homo sapiens
ttgaagaattaggacgtgagta

SEQ ID NO: 7465975 - DNA, 22 bp, Homo sapiens
ttgaagaattaggacgtgagta

SEQ ID NO: 7465976 - DNA, 22 bp, Homo sapiens
ttgaagatggtagcaatttcct

SEQ ID NO: 7465977 - DNA, 22 bp, Homo sapiens
ttgaagattattctattaaaag

SEQ ID NO: 7465978 - DNA, 22 bp, Homo sapiens
ttgaagattattctattaaaag

SEQ ID NO: 7465979 - DNA, 22 bp, Homo sapiens
ttgaagatctttgcattgcagg

SEQ ID NO: 7465980 - DNA, 22 bp, Homo sapiens
ttgaagatgctgtctcttccag

SEQ ID NO: 7465981 - DNA, 22 bp, Homo sapiens
ttgaagatctttgcattgcagg

SEQ ID NO: 7465982 - DNA, 22 bp, Homo sapiens
ttgaagatggtagcaatttcct

SEQ ID NO: 7465983 - DNA, 22 bp, Homo sapiens
ttgaagatctttgcattgcagg

SEQ ID NO: 7465984 - DNA, 22 bp, Homo sapiens
ttgaagagttttatgccaacct

SEQ ID NO: 7465985 - DNA, 22 bp, Homo sapiens
ttgaagagtttgatagagttga

SEQ ID NO: 7465986 - DNA, 22 bp, Homo sapiens
ttgaagagtgtccttgtaaaaa

SEQ ID NO: 7465987 - DNA, 22 bp, Homo sapiens
ttgaagagtctttctttccccc

SEQ ID NO: 7465988 - DNA, 22 bp, Homo sapiens
ttgaagagtctagattggttat

SEQ ID NO: 7465989 - DNA, 22 bp, Homo sapiens
ttgaagagtgccttccagacat

SEQ ID NO: 7465990 - DNA, 22 bp, Homo sapiens
ttgaagagtgcattagcatatt

SEQ ID NO: 7465991 - DNA, 22 bp, Homo sapiens
ttgaagagtcgcttaacctgtg

SEQ ID NO: 7465992 - DNA, 22 bp, Homo sapiens
ttgaagagtcgcttaacctgtg

SEQ ID NO: 7465993 - DNA, 22 bp, Homo sapiens
ttgaagagtctagattggttat

SEQ ID NO: 7465994 - DNA, 22 bp, Homo sapiens
ttgaagagtagaaaatgcaaat

SEQ ID NO: 7465995 - DNA, 20 bp, Homo sapiens
ttgaagagtcaggtagggcc

SEQ ID NO: 7465996 - DNA, 22 bp, Homo sapiens
ttgaagagtaaagtgttttctc

SEQ ID NO: 7465997 - DNA, 20 bp, Homo sapiens
ttgaagaggatatatcgctc

SEQ ID NO: 7465998 - DNA, 22 bp, Homo sapiens
ttgaagagtaaagtgttttctc

SEQ ID NO: 7465999 - DNA, 22 bp, Homo sapiens
ttgaagaggactttgcagctgt

SEQ ID NO: 7466000 - DNA, 22 bp, Homo sapiens
ttgaagagacgatttttccacc

SEQ ID NO: 7466001 - DNA, 22 bp, Homo sapiens
ttgaagagacaatttggaaagc

SEQ ID NO: 7466002 - DNA, 22 bp, Homo sapiens
ttgaagagaatcagaaggttga

SEQ ID NO: 7466003 - DNA, 22 bp, Homo sapiens
ttgaagagacgatttttccacc

SEQ ID NO: 7466004 - DNA, 22 bp, Homo sapiens
ttgaagagctgcttgataccct

SEQ ID NO: 7466005 - DNA, 22 bp, Homo sapiens
ttgaagagcaccagcattttga

SEQ ID NO: 7466006 - DNA, 22 bp, Homo sapiens
ttgaagagcaccagcattttga

SEQ ID NO: 7466007 - DNA, 22 bp, Homo sapiens
ttctttatgttaatgaatctat

SEQ ID NO: 7466008 - DNA, 22 bp, Homo sapiens
ttctttatgttaatgaatctat

SEQ ID NO: 7466009 - DNA, 22 bp, Homo sapiens
ttctttatgttaatgaatctat

SEQ ID NO: 7466010 - DNA, 22 bp, Homo sapiens
ttctttatgttaatgaatctat

SEQ ID NO: 7466011 - DNA, 22 bp, Homo sapiens
ttctttatgttaatgaatctat

SEQ ID NO: 7466012 - DNA, 22 bp, Homo sapiens
ttctttatgttaatgaatctat

SEQ ID NO: 7466013 - DNA, 22 bp, Homo sapiens
ttctttatgttaatgaatctat

SEQ ID NO: 7466014 - DNA, 22 bp, Homo sapiens
ttctttatgttaatgaatctat

SEQ ID NO: 7466015 - DNA, 22 bp, Homo sapiens
ttctttatgttaatgaatctat

SEQ ID NO: 7466016 - DNA, 22 bp, Homo sapiens
ttctttatgttaatgaatctat

SEQ ID NO: 7466017 - DNA, 22 bp, Homo sapiens
ttctttattgagacttcattgt

SEQ ID NO: 7466018 - DNA, 22 bp, Homo sapiens
ttctttattgagacttcattgt

SEQ ID NO: 7466019 - DNA, 22 bp, Homo sapiens
ttctttattgagacttcattgt

SEQ ID NO: 7466020 - DNA, 22 bp, Homo sapiens
ttctttattgagacttcattgt

SEQ ID NO: 7466021 - DNA, 22 bp, Homo sapiens
ttctttattgagacttcattgt

SEQ ID NO: 7466022 - DNA, 22 bp, Homo sapiens
ttctttattgagacttcattgt

SEQ ID NO: 7466023 - DNA, 22 bp, Homo sapiens
ttctttattgagacttcattgt

SEQ ID NO: 7466024 - DNA, 22 bp, Homo sapiens
ttctttattagtttagtgagct

SEQ ID NO: 7466025 - DNA, 22 bp, Homo sapiens
ttctttattagtttagtgagct

SEQ ID NO: 7466026 - DNA, 22 bp, Homo sapiens
ttctttattagtttagtgagct

SEQ ID NO: 7466027 - DNA, 22 bp, Homo sapiens
ttctttattagtttagtgagct

SEQ ID NO: 7466028 - DNA, 22 bp, Homo sapiens
ttctttattagtttagtgagct

SEQ ID NO: 7466029 - DNA, 22 bp, Homo sapiens
ttctttatgcttctgtttaggc

SEQ ID NO: 7466030 - DNA, 22 bp, Homo sapiens
ttctttatgcttctgtttaggc

SEQ ID NO: 7466031 - DNA, 22 bp, Homo sapiens
ttctttatgcttctgtttaggc

SEQ ID NO: 7466032 - DNA, 22 bp, Homo sapiens
ttctttatggaatggtgatagt

SEQ ID NO: 7466033 - DNA, 22 bp, Homo sapiens
ttctttatggaatggtgatagt

SEQ ID NO: 7466034 - DNA, 22 bp, Homo sapiens
ttctttatggaatggtgatagt

SEQ ID NO: 7466035 - DNA, 22 bp, Homo sapiens
ttctttatgttaatgaatctat

SEQ ID NO: 7466036 - DNA, 22 bp, Homo sapiens
ttctttatgttaatgaatctat

SEQ ID NO: 7466037 - DNA, 22 bp, Homo sapiens
ttctttatgcttctgtttaggc

SEQ ID NO: 7466038 - DNA, 22 bp, Homo sapiens
ttctttatgcttctgtttaggc

SEQ ID NO: 7466039 - DNA, 22 bp, Homo sapiens
ttctttatgcttctgtttaggc

SEQ ID NO: 7466040 - DNA, 22 bp, Homo sapiens
ttctttatcctatttgtaggtg

SEQ ID NO: 7466041 - DNA, 22 bp, Homo sapiens
ttctttatcagttactcatagg

SEQ ID NO: 7466042 - DNA, 22 bp, Homo sapiens
ttctttatcctatttgtaggtg

SEQ ID NO: 7466043 - DNA, 22 bp, Homo sapiens
ttctttatcagttactcatagg

SEQ ID NO: 7466044 - DNA, 22 bp, Homo sapiens
ttctttcaatagctggcatatg

SEQ ID NO: 7466045 - DNA, 23 bp, Homo sapiens
ttctttcaagaagttcacagtgc

SEQ ID NO: 7466046 - DNA, 23 bp, Homo sapiens
ttctttcaagaagttcacagtgc

SEQ ID NO: 7466047 - DNA, 23 bp, Homo sapiens
ttctttcaagaagttcacagtgc

SEQ ID NO: 7466048 - DNA, 23 bp, Homo sapiens
ttctttcaagaagttcacagtgc

SEQ ID NO: 7466049 - DNA, 22 bp, Homo sapiens
ttctttattgagacttcattgt

SEQ ID NO: 7466050 - DNA, 23 bp, Homo sapiens
ttctttcaagaagttcacagtgc

SEQ ID NO: 7466051 - DNA, 23 bp, Homo sapiens
ttctttcaagaagttcacagtgc

SEQ ID NO: 7466052 - DNA, 22 bp, Homo sapiens
ttctttattgagacttcattgt

SEQ ID NO: 7466053 - DNA, 22 bp, Homo sapiens
ttctttcaatagctggcatatg

SEQ ID NO: 7466054 - DNA, 22 bp, Homo sapiens
ttctttcaatagctggcatatg

SEQ ID NO: 7466055 - DNA, 22 bp, Homo sapiens
ttctttcaatagctggcatatg

SEQ ID NO: 7466056 - DNA, 22 bp, Homo sapiens
ttctttcaatagctggcatatg

SEQ ID NO: 7466057 - DNA, 22 bp, Homo sapiens
ttctttcactcaagaaggatct

SEQ ID NO: 7466058 - DNA, 22 bp, Homo sapiens
ttctttcactcaagaaggatct

SEQ ID NO: 7466059 - DNA, 22 bp, Homo sapiens
ttctttcactcaagaaggatct

SEQ ID NO: 7466060 - DNA, 22 bp, Homo sapiens
ttctttcagaacacaagtgatt

SEQ ID NO: 7466061 - DNA, 22 bp, Homo sapiens
ttctttcagaacacaagtgatt

SEQ ID NO: 7466062 - DNA, 22 bp, Homo sapiens
ttctttcagaacacaagtgatt

SEQ ID NO: 7466063 - DNA, 22 bp, Homo sapiens
ttctttcagaacacaagtgatt

SEQ ID NO: 7466064 - DNA, 22 bp, Homo sapiens
ttctttcagaacacaagtgatt

SEQ ID NO: 7466065 - DNA, 20 bp, Homo sapiens
ttctttcatctacacgttgt

SEQ ID NO: 7466066 - DNA, 22 bp, Homo sapiens
ttctttccaaccagatattggt

SEQ ID NO: 7466067 - DNA, 22 bp, Homo sapiens
ttctttccaaccagatattggt

SEQ ID NO: 7466068 - DNA, 22 bp, Homo sapiens
ttctttccaaccagatattggt

SEQ ID NO: 7466069 - DNA, 22 bp, Homo sapiens
ttctttccacagaggggatgat

SEQ ID NO: 7466070 - DNA, 19 bp, Homo sapiens
ttctttccacatcttctct

SEQ ID NO: 7466071 - DNA, 19 bp, Homo sapiens
ttctttccacatcttctct

SEQ ID NO: 7466072 - DNA, 19 bp, Homo sapiens
ttctttccacatcttctct

SEQ ID NO: 7466073 - DNA, 19 bp, Homo sapiens
ttctttccacatcttctct

SEQ ID NO: 7466074 - DNA, 22 bp, Homo sapiens
ttctttcccagtagatgtgaaa

SEQ ID NO: 7466075 - DNA, 22 bp, Homo sapiens
ttctttcccagaagatatgttt

SEQ ID NO: 7466076 - DNA, 22 bp, Homo sapiens
ttctttcccagtagatgtgaaa

SEQ ID NO: 7466077 - DNA, 22 bp, Homo sapiens
ttgagcaaaggagtaaaatgca

SEQ ID NO: 7466078 - DNA, 22 bp, Homo sapiens
ttgagatgggctttatgttcag

SEQ ID NO: 7466079 - DNA, 22 bp, Homo sapiens
ttgagatttggaggtaattccc

SEQ ID NO: 7466080 - DNA, 22 bp, Homo sapiens
ttgagcaaaggagtaaaatgca

SEQ ID NO: 7466081 - DNA, 22 bp, Homo sapiens
ttgagcaaatcagattgtaatt

SEQ ID NO: 7466082 - DNA, 22 bp, Homo sapiens
ttgagcaaatcagaagtttaga

SEQ ID NO: 7466083 - DNA, 22 bp, Homo sapiens
ttgagcaatgctgcaaagagat

SEQ ID NO: 7466084 - DNA, 20 bp, Homo sapiens
ttgagcaatcagtaaaggat

SEQ ID NO: 7466085 - DNA, 22 bp, Homo sapiens
ttgagcaatgctgcaaagagat

SEQ ID NO: 7466086 - DNA, 22 bp, Homo sapiens
ttgagcaagtgtacgagcaggc

SEQ ID NO: 7466087 - DNA, 22 bp, Homo sapiens
ttgagcaagtgtacgagcaggc

SEQ ID NO: 7466088 - DNA, 22 bp, Homo sapiens
ttgagcaagagtaggaactgaa

SEQ ID NO: 7466089 - DNA, 22 bp, Homo sapiens
ttgagcaaatcagattgtaatt

SEQ ID NO: 7466090 - DNA, 22 bp, Homo sapiens
ttgagcaaatcagattgtaatt

SEQ ID NO: 7466091 - DNA, 22 bp, Homo sapiens
ttgagcaaatcagaagtttaga

SEQ ID NO: 7466092 - DNA, 22 bp, Homo sapiens
ttgagcaattaggaaataaaga

SEQ ID NO: 7466093 - DNA, 22 bp, Homo sapiens
ttgagcaattaggaaataaaga

SEQ ID NO: 7466094 - DNA, 22 bp, Homo sapiens
ttgagcacattccctttcatgg

SEQ ID NO: 7466095 - DNA, 22 bp, Homo sapiens
ttgagcacattccctttcatgg

SEQ ID NO: 7466096 - DNA, 22 bp, Homo sapiens
ttgagcacttattggtgttagg

SEQ ID NO: 7466097 - DNA, 19 bp, Homo sapiens
ttgagcagtgcttagcacc

SEQ ID NO: 7466098 - DNA, 22 bp, Homo sapiens
ttgagcagatcgggctgtgggg

SEQ ID NO: 7466099 - DNA, 22 bp, Homo sapiens
ttgagcaggaactagaagatag

SEQ ID NO: 7466100 - DNA, 20 bp, Homo sapiens
ttgagcagcagtgctgtgtc

SEQ ID NO: 7466101 - DNA, 20 bp, Homo sapiens
ttgagcagcagtgctgtgtc

SEQ ID NO: 7466102 - DNA, 22 bp, Homo sapiens
ttgagcaggatggctatgcaca

SEQ ID NO: 7466103 - DNA, 22 bp, Homo sapiens
ttgagcaggatggctatgcaca

SEQ ID NO: 7466104 - DNA, 22 bp, Homo sapiens
ttgagcatctgaggattttcct

SEQ ID NO: 7466105 - DNA, 19 bp, Homo sapiens
ttgagcagtgcttagcacc

SEQ ID NO: 7466106 - DNA, 22 bp, Homo sapiens
ttgagcccaggaggcctgggtg

SEQ ID NO: 7466107 - DNA, 22 bp, Homo sapiens
ttgagcccaggaggcctgggtg

SEQ ID NO: 7466108 - DNA, 22 bp, Homo sapiens
ttgagcccaggaggcctgggtg

SEQ ID NO: 7466109 - DNA, 22 bp, Homo sapiens
ttgagcgtgggtgctggagcca

SEQ ID NO: 7466110 - DNA, 22 bp, Homo sapiens
ttgaggagtgtttagggtgagg

SEQ ID NO: 7466111 - DNA, 22 bp, Homo sapiens
ttgaggagtgtgaggtctccca

SEQ ID NO: 7466112 - DNA, 22 bp, Homo sapiens
ttgagcccaggaggcctgggtg

SEQ ID NO: 7466113 - DNA, 22 bp, Homo sapiens
ttgagcccaggaggcctgggtg

SEQ ID NO: 7466114 - DNA, 22 bp, Homo sapiens
ttgagcccaggaggcctgggtg

SEQ ID NO: 7466115 - DNA, 22 bp, Homo sapiens
ttgagcccaggaggcctgggtg

SEQ ID NO: 7466116 - DNA, 22 bp, Homo sapiens
ttgagcccaggaggcctgggtg

SEQ ID NO: 7466117 - DNA, 22 bp, Homo sapiens
ttgagcccaggaggcctgggtg

SEQ ID NO: 7466118 - DNA, 23 bp, Homo sapiens
ttgagcatttgtggatactgaaa

SEQ ID NO: 7466119 - DNA, 23 bp, Homo sapiens
ttgaggcaaactcttttctgaaa

SEQ ID NO: 7466120 - DNA, 23 bp, Homo sapiens
ttgaggcaaactcttttctgaaa

SEQ ID NO: 7466121 - DNA, 23 bp, Homo sapiens
ttgaggcaaactcttttctgaaa

SEQ ID NO: 7466122 - DNA, 23 bp, Homo sapiens
ttgaggcaaacatgtaagtagga

SEQ ID NO: 7466123 - DNA, 22 bp, Homo sapiens
ttgaggcacacacaggttgcat

SEQ ID NO: 7466124 - DNA, 23 bp, Homo sapiens
ttgaggcaaactcttttctgaaa

SEQ ID NO: 7466125 - DNA, 22 bp, Homo sapiens
ttgaggcacagattttagtggc

SEQ ID NO: 7466126 - DNA, 22 bp, Homo sapiens
ttgaggcacagattttagtggc

SEQ ID NO: 7466127 - DNA, 22 bp, Homo sapiens
ttgaggcacacacaggttgcat

SEQ ID NO: 7466128 - DNA, 22 bp, Homo sapiens
ttgaggcacacacaggttgcat

SEQ ID NO: 7466129 - DNA, 22 bp, Homo sapiens
ttgaggcacacacaggttgcat

SEQ ID NO: 7466130 - DNA, 22 bp, Homo sapiens
ttgaggcaaaatcaacgggaag

SEQ ID NO: 7466131 - DNA, 22 bp, Homo sapiens
ttgaggattcatgtcagaattc

SEQ ID NO: 7466132 - DNA, 22 bp, Homo sapiens
ttgaggattcatgtcagaattc

SEQ ID NO: 7466133 - DNA, 22 bp, Homo sapiens
ttgaggagttgtgacagatact

SEQ ID NO: 7466134 - DNA, 23 bp, Homo sapiens
ttgaggcaaacatgtaagtagga

SEQ ID NO: 7466135 - DNA, 22 bp, Homo sapiens
ttgaggcaaaatcaacgggaag

SEQ ID NO: 7466136 - DNA, 22 bp, Homo sapiens
ttgaggagttaggatgtttata

SEQ ID NO: 7466137 - DNA, 22 bp, Homo sapiens
ttgaggagtgtttagggtgagg

SEQ ID NO: 7466138 - DNA, 22 bp, Homo sapiens
ttgaggagtgtttagggtgagg

SEQ ID NO: 7466139 - DNA, 22 bp, Homo sapiens
ttgaggagttgtgacagatact

SEQ ID NO: 7466140 - DNA, 22 bp, Homo sapiens
ttgaggagttgtgacagatact

SEQ ID NO: 7466141 - DNA, 18 bp, Homo sapiens
ttgaggagttcactgtct

SEQ ID NO: 7466142 - DNA, 22 bp, Homo sapiens
ttgaatgaataaaagagtaagg

SEQ ID NO: 7466143 - DNA, 22 bp, Homo sapiens
ttgaatgaatagttgctagaag

SEQ ID NO: 7466144 - DNA, 22 bp, Homo sapiens
ttgaatgaatggtccatataga

SEQ ID NO: 7466145 - DNA, 22 bp, Homo sapiens
ttgaatgaatggtccatataga

SEQ ID NO: 7466146 - DNA, 22 bp, Homo sapiens
ttgaatgaattctacttccaga

SEQ ID NO: 7466147 - DNA, 20 bp, Homo sapiens
ttgaatgaatgtctggctca

SEQ ID NO: 7466148 - DNA, 22 bp, Homo sapiens
ttgaatgaattctacttccaga

SEQ ID NO: 7466149 - DNA, 22 bp, Homo sapiens
ttgaatgaatttgagcagagat

SEQ ID NO: 7466150 - DNA, 22 bp, Homo sapiens
ttgaagctaggctgtgcatatg

SEQ ID NO: 7466151 - DNA, 22 bp, Homo sapiens
ttgaagcccttcttgatagtca

SEQ ID NO: 7466152 - DNA, 22 bp, Homo sapiens
ttgaatgaataaaagagtaagg

SEQ ID NO: 7466153 - DNA, 22 bp, Homo sapiens
ttgaaggacatcctatttctag

SEQ ID NO: 7466154 - DNA, 22 bp, Homo sapiens
ttgaagctgtctttcagaatca

SEQ ID NO: 7466155 - DNA, 22 bp, Homo sapiens
ttgaagctgtctttcagaatca

SEQ ID NO: 7466156 - DNA, 22 bp, Homo sapiens
ttgaagctgtctttcagaatca

SEQ ID NO: 7466157 - DNA, 22 bp, Homo sapiens
ttgaagctgtgctttttgtagg

SEQ ID NO: 7466158 - DNA, 22 bp, Homo sapiens
ttgaagattctttttgttagta

SEQ ID NO: 7466159 - DNA, 22 bp, Homo sapiens
ttgaagcaaattctgtgcagta

SEQ ID NO: 7466160 - DNA, 21 bp, Homo sapiens
ttgaagcaagggtggctctga

SEQ ID NO: 7466161 - DNA, 22 bp, Homo sapiens
ttgaagcaaggcgaatcttgtg

SEQ ID NO: 7466162 - DNA, 21 bp, Homo sapiens
ttgaagcaagggtggctctga

SEQ ID NO: 7466163 - DNA, 22 bp, Homo sapiens
ttgaagcagagaaatacttgaa

SEQ ID NO: 7466164 - DNA, 22 bp, Homo sapiens
ttgaagcacaatgtcttttatc

SEQ ID NO: 7466165 - DNA, 22 bp, Homo sapiens
ttgaagcacaatgtcttttatc

SEQ ID NO: 7466166 - DNA, 22 bp, Homo sapiens
ttgaagcatttctttgagcttc

SEQ ID NO: 7466167 - DNA, 22 bp, Homo sapiens
ttgaagcatttgctatagcatt

SEQ ID NO: 7466168 - DNA, 22 bp, Homo sapiens
ttgaagcatttgctatagcatt

SEQ ID NO: 7466169 - DNA, 22 bp, Homo sapiens
ttgaagcatttgctatagcatt

SEQ ID NO: 7466170 - DNA, 22 bp, Homo sapiens
ttgaagcattgtggcttgtatt

SEQ ID NO: 7466171 - DNA, 22 bp, Homo sapiens
ttgaagcattgtggcttgtatt

SEQ ID NO: 7466172 - DNA, 22 bp, Homo sapiens
ttgaagcatggtacttgttcaa

SEQ ID NO: 7466173 - DNA, 22 bp, Homo sapiens
ttgaagcaggaaaatttctatt

SEQ ID NO: 7466174 - DNA, 22 bp, Homo sapiens
ttgaagcaggaaaatttctatt

SEQ ID NO: 7466175 - DNA, 22 bp, Homo sapiens
ttgaagcaggaaaatttctatt

SEQ ID NO: 7466176 - DNA, 22 bp, Homo sapiens
ttgaagcagctcaggaggctta

SEQ ID NO: 7466177 - DNA, 22 bp, Homo sapiens
ttgaatgccaatatctccttct

SEQ ID NO: 7466178 - DNA, 22 bp, Homo sapiens
ttgaatggcttctaggttctcc

SEQ ID NO: 7466179 - DNA, 22 bp, Homo sapiens
ttgaatgcttacaatatgttag

SEQ ID NO: 7466180 - DNA, 22 bp, Homo sapiens
ttgaattagactttgctacagg

SEQ ID NO: 7466181 - DNA, 22 bp, Homo sapiens
ttgaattataagtgtgtctact

SEQ ID NO: 7466182 - DNA, 22 bp, Homo sapiens
ttgaattagactttgctacagg

SEQ ID NO: 7466183 - DNA, 22 bp, Homo sapiens
ttgaattataagtgtgtctact

SEQ ID NO: 7466184 - DNA, 22 bp, Homo sapiens
ttgaattataagtgtgtctact

SEQ ID NO: 7466185 - DNA, 22 bp, Homo sapiens
ttgaattataagtgtgtctact

SEQ ID NO: 7466186 - DNA, 22 bp, Homo sapiens
ttgagatattcagttccattga

SEQ ID NO: 7466187 - DNA, 22 bp, Homo sapiens
ttgagatgacttaaatttggga

SEQ ID NO: 7466188 - DNA, 22 bp, Homo sapiens
ttgagatgaggtagaagccaat

SEQ ID NO: 7466189 - DNA, 22 bp, Homo sapiens
ttgaattatttgtttgcaagct

SEQ ID NO: 7466190 - DNA, 22 bp, Homo sapiens
ttgaattatttgtttgcaagct

SEQ ID NO: 7466191 - DNA, 22 bp, Homo sapiens
ttgaatgtaggtcttggtgagc

SEQ ID NO: 7466192 - DNA, 22 bp, Homo sapiens
ttgaattatatgtatgtccttt

SEQ ID NO: 7466193 - DNA, 22 bp, Homo sapiens
ttgaatgcatctttgagctcct

SEQ ID NO: 7466194 - DNA, 22 bp, Homo sapiens
ttgaatgcatggttcactctgt

SEQ ID NO: 7466195 - DNA, 17 bp, Homo sapiens
ttgaatgcattacttgg

SEQ ID NO: 7466196 - DNA, 22 bp, Homo sapiens
ttgaatgcagtcatgaaaagtt

SEQ ID NO: 7466197 - DNA, 22 bp, Homo sapiens
ttgaatgcagtcatgaaaagtt

SEQ ID NO: 7466198 - DNA, 22 bp, Homo sapiens
ttgaatgatcctatctagcaca

SEQ ID NO: 7466199 - DNA, 22 bp, Homo sapiens
ttgaatgagtgttttactcatg

SEQ ID NO: 7466200 - DNA, 22 bp, Homo sapiens
ttgaatgatcctatctagcaca

SEQ ID NO: 7466201 - DNA, 22 bp, Homo sapiens
ttgaatgatcctatctagcaca

SEQ ID NO: 7466202 - DNA, 22 bp, Homo sapiens
ttgaatgatcctatctagcaca

SEQ ID NO: 7466203 - DNA, 22 bp, Homo sapiens
ttgaatgatcctatctagcaca

SEQ ID NO: 7466204 - DNA, 22 bp, Homo sapiens
ttgaatgattaaagtcatctga

SEQ ID NO: 7466205 - DNA, 22 bp, Homo sapiens
ttgaatgagtgttttactcatg

SEQ ID NO: 7466206 - DNA, 22 bp, Homo sapiens
ttgaatgagtgttttactcatg

SEQ ID NO: 7466207 - DNA, 22 bp, Homo sapiens
ttgaatgaggaagagcactggc

SEQ ID NO: 7466208 - DNA, 22 bp, Homo sapiens
ttgaatgaggaagagcactggc

SEQ ID NO: 7466209 - DNA, 22 bp, Homo sapiens
ttgaatgaggaagagcactggc

SEQ ID NO: 7466210 - DNA, 22 bp, Homo sapiens
ttgaatgaatttgagcagagat

SEQ ID NO: 7466211 - DNA, 22 bp, Homo sapiens
ttgaatgaccatgatgcaaggg

SEQ ID NO: 7466212 - DNA, 16 bp, Homo sapiens
ttgaatgactgtgtgc

SEQ ID NO: 7466213 - DNA, 22 bp, Homo sapiens
ttgaatgagaagttattgccat

SEQ ID NO: 7466214 - DNA, 22 bp, Homo sapiens
ttgaatgagaagttattgccat

SEQ ID NO: 7466215 - DNA, 22 bp, Homo sapiens
ttctgggcccaaccctagagtg

SEQ ID NO: 7466216 - DNA, 22 bp, Homo sapiens
ttctgggcccaaccctagagtg

SEQ ID NO: 7466217 - DNA, 22 bp, Homo sapiens
ttctgggcccaaccctagagtg

SEQ ID NO: 7466218 - DNA, 22 bp, Homo sapiens
ttctgggcccactgtagcatcc

SEQ ID NO: 7466219 - DNA, 22 bp, Homo sapiens
ttctgggcctcctaggacaggc

SEQ ID NO: 7466220 - DNA, 22 bp, Homo sapiens
ttctgggcctcctaggacaggc

SEQ ID NO: 7466221 - DNA, 21 bp, Homo sapiens
ttctgggccggagaaggggcg

SEQ ID NO: 7466222 - DNA, 23 bp, Homo sapiens
ttctgggctgtggaagcctcggg

SEQ ID NO: 7466223 - DNA, 22 bp, Homo sapiens
ttctgggctgtccagagggtga

SEQ ID NO: 7466224 - DNA, 22 bp, Homo sapiens
ttctgggctcacagagcagcag

SEQ ID NO: 7466225 - DNA, 22 bp, Homo sapiens
ttctgggctcacagagcagcag

SEQ ID NO: 7466226 - DNA, 22 bp, Homo sapiens
ttctggggacataacagtaagc

SEQ ID NO: 7466227 - DNA, 23 bp, Homo sapiens
ttctgggctgtggaagcctcggg

SEQ ID NO: 7466228 - DNA, 23 bp, Homo sapiens
ttctgggctgtggaagcctcggg

SEQ ID NO: 7466229 - DNA, 22 bp, Homo sapiens
ttctggggccccagtgtcctcg

SEQ ID NO: 7466230 - DNA, 22 bp, Homo sapiens
ttctggggccccagtgtcctcg

SEQ ID NO: 7466231 - DNA, 22 bp, Homo sapiens
ttctggggccaattgccactgc

SEQ ID NO: 7466232 - DNA, 22 bp, Homo sapiens
ttctggggccaattgccactgc

SEQ ID NO: 7466233 - DNA, 22 bp, Homo sapiens
ttctggggccaattgccactgc

SEQ ID NO: 7466234 - DNA, 22 bp, Homo sapiens
ttctgggcttgaaagtttaata

SEQ ID NO: 7466235 - DNA, 22 bp, Homo sapiens
ttctggtcaatggcctgtaagt

SEQ ID NO: 7466236 - DNA, 22 bp, Homo sapiens
ttctggtaccgtgtcagaaacc

SEQ ID NO: 7466237 - DNA, 19 bp, Homo sapiens
ttctggtctggaatcaagg

SEQ ID NO: 7466238 - DNA, 22 bp, Homo sapiens
ttctggtctctctgacctagga

SEQ ID NO: 7466239 - DNA, 19 bp, Homo sapiens
ttctggtctggaatcaagg

SEQ ID NO: 7466240 - DNA, 19 bp, Homo sapiens
ttctggtctggaatcaagg

SEQ ID NO: 7466241 - DNA, 22 bp, Homo sapiens
ttctggtggccagaagtctgaa

SEQ ID NO: 7466242 - DNA, 22 bp, Homo sapiens
ttctgggggaatacagctatga

SEQ ID NO: 7466243 - DNA, 22 bp, Homo sapiens
ttctgggggaatacagctatga

SEQ ID NO: 7466244 - DNA, 22 bp, Homo sapiens
ttctggggctaatacagaggtc

SEQ ID NO: 7466245 - DNA, 19 bp, Homo sapiens
ttctggggcctggccttgg

SEQ ID NO: 7466246 - DNA, 19 bp, Homo sapiens
ttctggggcctggccttgg

SEQ ID NO: 7466247 - DNA, 19 bp, Homo sapiens
ttctggggcctggccttgg

SEQ ID NO: 7466248 - DNA, 22 bp, Homo sapiens
ttctggggctaatacagaggtc

SEQ ID NO: 7466249 - DNA, 22 bp, Homo sapiens
ttctggggctaatacagaggtc

SEQ ID NO: 7466250 - DNA, 22 bp, Homo sapiens
ttctggggttatgggtgattct

SEQ ID NO: 7466251 - DNA, 22 bp, Homo sapiens
ttctggggttatgggtgattct

SEQ ID NO: 7466252 - DNA, 22 bp, Homo sapiens
ttctgggggccaggacagtggt

SEQ ID NO: 7466253 - DNA, 22 bp, Homo sapiens
ttctgggggaatacagctatga

SEQ ID NO: 7466254 - DNA, 22 bp, Homo sapiens
ttctgggggccaggacagtggt

SEQ ID NO: 7466255 - DNA, 22 bp, Homo sapiens
ttctgggggaatacagctatga

SEQ ID NO: 7466256 - DNA, 22 bp, Homo sapiens
ttctgggggccaggacagtggt

SEQ ID NO: 7466257 - DNA, 22 bp, Homo sapiens
ttctgggtcacccttctgctca

SEQ ID NO: 7466258 - DNA, 22 bp, Homo sapiens
ttctgggtaacaaggcaagaat

SEQ ID NO: 7466259 - DNA, 22 bp, Homo sapiens
ttctgggtgcaactctgttctg

SEQ ID NO: 7466260 - DNA, 22 bp, Homo sapiens
ttctgtttgccatatatagtag

SEQ ID NO: 7466261 - DNA, 22 bp, Homo sapiens
ttctgtttgccatatatagtag

SEQ ID NO: 7466262 - DNA, 22 bp, Homo sapiens
ttctgtttgccatatatagtag

SEQ ID NO: 7466263 - DNA, 22 bp, Homo sapiens
ttctgtttctggggtctctgac

SEQ ID NO: 7466264 - DNA, 22 bp, Homo sapiens
ttctgtttctggggtctctgac

SEQ ID NO: 7466265 - DNA, 22 bp, Homo sapiens
ttctgtttctggggtctctgac

SEQ ID NO: 7466266 - DNA, 22 bp, Homo sapiens
ttctgtttcctgccttcccatt

SEQ ID NO: 7466267 - DNA, 22 bp, Homo sapiens
ttctgtttctggggtctctgac

SEQ ID NO: 7466268 - DNA, 22 bp, Homo sapiens
ttctgtttgccatatatagtag

SEQ ID NO: 7466269 - DNA, 22 bp, Homo sapiens
ttctgtttctggggtctctgac

SEQ ID NO: 7466270 - DNA, 22 bp, Homo sapiens
ttctgttttagaaataagtagt

SEQ ID NO: 7466271 - DNA, 22 bp, Homo sapiens
ttctgttttagaaataagtagt

SEQ ID NO: 7466272 - DNA, 22 bp, Homo sapiens
ttctgttttagaaataagtagt

SEQ ID NO: 7466273 - DNA, 22 bp, Homo sapiens
ttctgttttagaaataagtagt

SEQ ID NO: 7466274 - DNA, 22 bp, Homo sapiens
ttctgttttagaaataagtagt

SEQ ID NO: 7466275 - DNA, 22 bp, Homo sapiens
ttctgttttagaaataagtagt

SEQ ID NO: 7466276 - DNA, 22 bp, Homo sapiens
ttctgttttagaaataagtagt

SEQ ID NO: 7466277 - DNA, 22 bp, Homo sapiens
ttctgtttgtgaactggctgag

SEQ ID NO: 7466278 - DNA, 22 bp, Homo sapiens
ttctgtttgtgaactggctgag

SEQ ID NO: 7466279 - DNA, 22 bp, Homo sapiens
ttctgtttgtgaactggctgag

SEQ ID NO: 7466280 - DNA, 22 bp, Homo sapiens
ttctgttttgcacagacttgaa

SEQ ID NO: 7466281 - DNA, 22 bp, Homo sapiens
ttctgttttgcacagacttgaa

SEQ ID NO: 7466282 - DNA, 21 bp, Homo sapiens
ttctgttttttgtaccagggc

SEQ ID NO: 7466283 - DNA, 22 bp, Homo sapiens
ttctgttttgcacagacttgaa

SEQ ID NO: 7466284 - DNA, 22 bp, Homo sapiens
ttctgttttgcacagacttgaa

SEQ ID NO: 7466285 - DNA, 22 bp, Homo sapiens
ttctgttttgcacagacttgaa

SEQ ID NO: 7466286 - DNA, 22 bp, Homo sapiens
ttcttaaaacttatggacaggt

SEQ ID NO: 7466287 - DNA, 22 bp, Homo sapiens
ttcttaaaacttatggacaggt

SEQ ID NO: 7466288 - DNA, 22 bp, Homo sapiens
ttcttaaaacttatggacaggt

SEQ ID NO: 7466289 - DNA, 22 bp, Homo sapiens
ttcttaaaacttatggacaggt

SEQ ID NO: 7466290 - DNA, 22 bp, Homo sapiens
ttcttaaaacttatggacaggt

SEQ ID NO: 7466291 - DNA, 22 bp, Homo sapiens
ttcttaaaacttatggacaggt

SEQ ID NO: 7466292 - DNA, 22 bp, Homo sapiens
ttcttacactcttaaaaatcat

SEQ ID NO: 7466293 - DNA, 22 bp, Homo sapiens
ttcttacagagtttacagagcc

SEQ ID NO: 7466294 - DNA, 22 bp, Homo sapiens
ttcttacagagtttacagagcc

SEQ ID NO: 7466295 - DNA, 22 bp, Homo sapiens
ttcttacactcttaaaaatcat

SEQ ID NO: 7466296 - DNA, 22 bp, Homo sapiens
ttcttacactcttaaaaatcat

SEQ ID NO: 7466297 - DNA, 22 bp, Homo sapiens
ttcttaaaacttatggacaggt

SEQ ID NO: 7466298 - DNA, 22 bp, Homo sapiens
ttctgtttactcagaaatacaa

SEQ ID NO: 7466299 - DNA, 22 bp, Homo sapiens
ttctgtttataatttgcagttg

SEQ ID NO: 7466300 - DNA, 22 bp, Homo sapiens
ttctgtttataatttgcagttg

SEQ ID NO: 7466301 - DNA, 22 bp, Homo sapiens
ttctgtttataatttgcagttg

SEQ ID NO: 7466302 - DNA, 22 bp, Homo sapiens
ttctgtttcctgccttcccatt

SEQ ID NO: 7466303 - DNA, 22 bp, Homo sapiens
ttctgtttcctgccttcccatt

SEQ ID NO: 7466304 - DNA, 22 bp, Homo sapiens
ttctgtttattcctaggagctc

SEQ ID NO: 7466305 - DNA, 22 bp, Homo sapiens
ttctgtttattcctaggagctc

SEQ ID NO: 7466306 - DNA, 22 bp, Homo sapiens
ttctgtttattcctaggagctc

SEQ ID NO: 7466307 - DNA, 22 bp, Homo sapiens
ttctgtttattcctaggagctc

SEQ ID NO: 7466308 - DNA, 22 bp, Homo sapiens
ttctgtttataatttgcagttg

SEQ ID NO: 7466309 - DNA, 22 bp, Homo sapiens
ttctgttctgatacttgtttct

SEQ ID NO: 7466310 - DNA, 22 bp, Homo sapiens
ttctgttctttatttaccatat

SEQ ID NO: 7466311 - DNA, 22 bp, Homo sapiens
ttctgttctgatacttgtttct

SEQ ID NO: 7466312 - DNA, 22 bp, Homo sapiens
ttctgtttactcagaaatacaa

SEQ ID NO: 7466313 - DNA, 22 bp, Homo sapiens
ttctgttctttatttaccatat

SEQ ID NO: 7466314 - DNA, 22 bp, Homo sapiens
ttctgtttactcagaaatacaa

SEQ ID NO: 7466315 - DNA, 22 bp, Homo sapiens
ttctgtttactcagaaatacaa

SEQ ID NO: 7466316 - DNA, 22 bp, Homo sapiens
ttctgttacctttgtgagtttc

SEQ ID NO: 7466317 - DNA, 22 bp, Homo sapiens
ttctgttacctttgtgagtttc

SEQ ID NO: 7466318 - DNA, 22 bp, Homo sapiens
ttctgttacatggggcacagtg

SEQ ID NO: 7466319 - DNA, 22 bp, Homo sapiens
ttctggttctcaggaatgctaa

SEQ ID NO: 7466320 - DNA, 22 bp, Homo sapiens
ttctggtttaagaaagtgctgg

SEQ ID NO: 7466321 - DNA, 22 bp, Homo sapiens
ttctggttacattgttacagct

SEQ ID NO: 7466322 - DNA, 22 bp, Homo sapiens
ttctggttacattgttacagct

SEQ ID NO: 7466323 - DNA, 22 bp, Homo sapiens
ttctggtgtgttctctctaggc

SEQ ID NO: 7466324 - DNA, 22 bp, Homo sapiens
ttctggtgtgttctctctaggc

SEQ ID NO: 7466325 - DNA, 22 bp, Homo sapiens
ttctgttacttgcaaccacagg

SEQ ID NO: 7466326 - DNA, 22 bp, Homo sapiens
ttctgttacttgcaaccacagg

SEQ ID NO: 7466327 - DNA, 22 bp, Homo sapiens
ttctgttactgttggtcataac

SEQ ID NO: 7466328 - DNA, 22 bp, Homo sapiens
ttctgttatcattaagcattat

SEQ ID NO: 7466329 - DNA, 22 bp, Homo sapiens
ttctgttatcattaagcattat

SEQ ID NO: 7466330 - DNA, 22 bp, Homo sapiens
ttctgttatcattaagcattat

SEQ ID NO: 7466331 - DNA, 22 bp, Homo sapiens
ttctgttagaattttgaaaata

SEQ ID NO: 7466332 - DNA, 22 bp, Homo sapiens
ttctgttagaattttgaaaata

SEQ ID NO: 7466333 - DNA, 22 bp, Homo sapiens
ttctttatcagttactcatagg

SEQ ID NO: 7466334 - DNA, 22 bp, Homo sapiens
ttctttatcagttactcatagg

SEQ ID NO: 7466335 - DNA, 22 bp, Homo sapiens
ttctttatcagttactcatagg

SEQ ID NO: 7466336 - DNA, 22 bp, Homo sapiens
ttctttatcagttactcatagg

SEQ ID NO: 7466337 - DNA, 22 bp, Homo sapiens
ttctttatcagttactcatagg

SEQ ID NO: 7466338 - DNA, 22 bp, Homo sapiens
ttctttatcagttactcatagg

SEQ ID NO: 7466339 - DNA, 22 bp, Homo sapiens
ttctttatcagttactcatagg

SEQ ID NO: 7466340 - DNA, 22 bp, Homo sapiens
ttctttatcagttactcatagg

SEQ ID NO: 7466341 - DNA, 22 bp, Homo sapiens
ttctttatcagttactcatagg

SEQ ID NO: 7466342 - DNA, 22 bp, Homo sapiens
ttctttatcagttactcatagg

SEQ ID NO: 7466343 - DNA, 22 bp, Homo sapiens
ttctttatcagttactcatagg

SEQ ID NO: 7466344 - DNA, 22 bp, Homo sapiens
ttctttatatctgctagtgggt

SEQ ID NO: 7466345 - DNA, 22 bp, Homo sapiens
ttctttatatctgctagtgggt

SEQ ID NO: 7466346 - DNA, 22 bp, Homo sapiens
ttctttatatctgctagtgggt

SEQ ID NO: 7466347 - DNA, 22 bp, Homo sapiens
ttctttatagctattggatgag

SEQ ID NO: 7466348 - DNA, 22 bp, Homo sapiens
ttctttatagctattggatgag

SEQ ID NO: 7466349 - DNA, 22 bp, Homo sapiens
ttctttaggtagatccagtttt

SEQ ID NO: 7466350 - DNA, 23 bp, Homo sapiens
ttctttataaatcaatgggatgt

SEQ ID NO: 7466351 - DNA, 23 bp, Homo sapiens
ttctttataaatcaatgggatgt

SEQ ID NO: 7466352 - DNA, 18 bp, Homo sapiens
ttctttaattcagtttga

SEQ ID NO: 7466353 - DNA, 18 bp, Homo sapiens
ttctttaattcagtttga

SEQ ID NO: 7466354 - DNA, 18 bp, Homo sapiens
ttctttaattcagtttga

SEQ ID NO: 7466355 - DNA, 18 bp, Homo sapiens
ttctttaattcagtttga

SEQ ID NO: 7466356 - DNA, 18 bp, Homo sapiens
ttctttaattcagtttga

SEQ ID NO: 7466357 - DNA, 18 bp, Homo sapiens
ttctttaattcagtttga

SEQ ID NO: 7466358 - DNA, 18 bp, Homo sapiens
ttctttaattcagtttga

SEQ ID NO: 7466359 - DNA, 18 bp, Homo sapiens
ttctttaattcagtttga

SEQ ID NO: 7466360 - DNA, 18 bp, Homo sapiens
ttctttaattcagtttga

SEQ ID NO: 7466361 - DNA, 18 bp, Homo sapiens
ttctttaattcagtttga

SEQ ID NO: 7466362 - DNA, 18 bp, Homo sapiens
ttctttaattcagtttga

SEQ ID NO: 7466363 - DNA, 22 bp, Homo sapiens
ttctttagcaacttggatttag

SEQ ID NO: 7466364 - DNA, 20 bp, Homo sapiens
ttctttacgacctttctgca

SEQ ID NO: 7466365 - DNA, 22 bp, Homo sapiens
ttctttagcaacttggatttag

SEQ ID NO: 7466366 - DNA, 22 bp, Homo sapiens
ttctttaccagtgaaatgttat

SEQ ID NO: 7466367 - DNA, 18 bp, Homo sapiens
ttctttaattcagtttga

SEQ ID NO: 7466368 - DNA, 22 bp, Homo sapiens
ttctttacagtgggttttgaat

SEQ ID NO: 7466369 - DNA, 22 bp, Homo sapiens
ttctttaccactactcttccaa

SEQ ID NO: 7466370 - DNA, 22 bp, Homo sapiens
ttctttaccagtgaaatgttat

SEQ ID NO: 7466371 - DNA, 22 bp, Homo sapiens
ttctttaaaatagtgagaaaga

SEQ ID NO: 7466372 - DNA, 22 bp, Homo sapiens
ttctttaaaatagtgagaaaga

SEQ ID NO: 7466373 - DNA, 22 bp, Homo sapiens
ttctttaaaatagtgagaaaga

SEQ ID NO: 7466374 - DNA, 22 bp, Homo sapiens
ttctttaaaatagtgagaaaga

SEQ ID NO: 7466375 - DNA, 22 bp, Homo sapiens
ttcttggaaactgattccttgt

SEQ ID NO: 7466376 - DNA, 22 bp, Homo sapiens
ttcttgctcaatgtctgtttaa

SEQ ID NO: 7466377 - DNA, 22 bp, Homo sapiens
ttctttaaaatagtgagaaaga

SEQ ID NO: 7466378 - DNA, 22 bp, Homo sapiens
ttcttggaaactgattccttgt

SEQ ID NO: 7466379 - DNA, 22 bp, Homo sapiens
ttctttaaaatagtgagaaaga

SEQ ID NO: 7466380 - DNA, 22 bp, Homo sapiens
ttctttaaatgaattctctgta

SEQ ID NO: 7466381 - DNA, 22 bp, Homo sapiens
ttctttaaatgaattctctgta

SEQ ID NO: 7466382 - DNA, 22 bp, Homo sapiens
ttctttaaaatagtgagaaaga

SEQ ID NO: 7466383 - DNA, 22 bp, Homo sapiens
ttctttaaaatagtgagaaaga

SEQ ID NO: 7466384 - DNA, 18 bp, Homo sapiens
ttctttaattcagtttga

SEQ ID NO: 7466385 - DNA, 22 bp, Homo sapiens
ttctttaaatgaattctctgta

SEQ ID NO: 7466386 - DNA, 22 bp, Homo sapiens
ttctttaaatgaattctctgta

SEQ ID NO: 7466387 - DNA, 22 bp, Homo sapiens
ttctttaaaatagtgagaaaga

SEQ ID NO: 7466388 - DNA, 22 bp, Homo sapiens
ttctttaaatgaattctctgta

SEQ ID NO: 7466389 - DNA, 22 bp, Homo sapiens
ttctttaaatgaattctctgta

SEQ ID NO: 7466390 - DNA, 22 bp, Homo sapiens
ttcttgatgaatgctaagaact

SEQ ID NO: 7466391 - DNA, 22 bp, Homo sapiens
ttcttgatgaatgctaagaact

SEQ ID NO: 7466392 - DNA, 22 bp, Homo sapiens
ttcttgatgcttgtttaaaggt

SEQ ID NO: 7466393 - DNA, 22 bp, Homo sapiens
ttcttgatgcttgtttaaaggt

SEQ ID NO: 7466394 - DNA, 22 bp, Homo sapiens
ttcttgattcttccttgaagga

SEQ ID NO: 7466395 - DNA, 22 bp, Homo sapiens
ttcttgattcttccttgaagga

SEQ ID NO: 7466396 - DNA, 22 bp, Homo sapiens
ttcttgattcttccttgaagga

SEQ ID NO: 7466397 - DNA, 22 bp, Homo sapiens
ttcttgattcttccttgaagga

SEQ ID NO: 7466398 - DNA, 22 bp, Homo sapiens
ttcttgatgtaccaacttggga

SEQ ID NO: 7466399 - DNA, 22 bp, Homo sapiens
ttcttgattagtctcatgccaa

SEQ ID NO: 7466400 - DNA, 22 bp, Homo sapiens
ttcttgatttcatgcagttaag

SEQ ID NO: 7466401 - DNA, 22 bp, Homo sapiens
ttcttgatttcatgcagttaag

SEQ ID NO: 7466402 - DNA, 20 bp, Homo sapiens
ttcttgatttgatcctggtt

SEQ ID NO: 7466403 - DNA, 20 bp, Homo sapiens
ttcttgatttgatcctggtt

SEQ ID NO: 7466404 - DNA, 22 bp, Homo sapiens
ttcttgccatatttcagccctt

SEQ ID NO: 7466405 - DNA, 22 bp, Homo sapiens
ttcttgcatcactctgctgttc

SEQ ID NO: 7466406 - DNA, 22 bp, Homo sapiens
ttcttgccatatttcagccctt

SEQ ID NO: 7466407 - DNA, 22 bp, Homo sapiens
ttcttgcatcactctgctgttc

SEQ ID NO: 7466408 - DNA, 22 bp, Homo sapiens
ttcttgcctgcttcaggagaaa

SEQ ID NO: 7466409 - DNA, 22 bp, Homo sapiens
ttcttctttcctataattaatt

SEQ ID NO: 7466410 - DNA, 22 bp, Homo sapiens
ttcttctttcctataattaatt

SEQ ID NO: 7466411 - DNA, 22 bp, Homo sapiens
ttcttctttccccctgtggtac

SEQ ID NO: 7466412 - DNA, 22 bp, Homo sapiens
ttcttctttccccctgtggtac

SEQ ID NO: 7466413 - DNA, 22 bp, Homo sapiens
ttcttctttccccctgtggtac

SEQ ID NO: 7466414 - DNA, 22 bp, Homo sapiens
ttcttctttccccctgtggtac

SEQ ID NO: 7466415 - DNA, 22 bp, Homo sapiens
ttcttctttccaattacatggt

SEQ ID NO: 7466416 - DNA, 22 bp, Homo sapiens
ttcttctttccaattacatggt

SEQ ID NO: 7466417 - DNA, 22 bp, Homo sapiens
ttcttctttccaattacatggt

SEQ ID NO: 7466418 - DNA, 22 bp, Homo sapiens
ttcttctttcctataattaatt

SEQ ID NO: 7466419 - DNA, 22 bp, Homo sapiens
ttcttctttcctataattaatt

SEQ ID NO: 7466420 - DNA, 22 bp, Homo sapiens
ttcttctttcctataattaatt

SEQ ID NO: 7466421 - DNA, 22 bp, Homo sapiens
ttcttctttcctataattaatt

SEQ ID NO: 7466422 - DNA, 22 bp, Homo sapiens
ttcttgaaaatagccatgtaca

SEQ ID NO: 7466423 - DNA, 19 bp, Homo sapiens
ttcttgaacatgtttctca

SEQ ID NO: 7466424 - DNA, 22 bp, Homo sapiens
ttcttgaaaatagccatgtaca

SEQ ID NO: 7466425 - DNA, 19 bp, Homo sapiens
ttcttgaacatgtttctca

SEQ ID NO: 7466426 - DNA, 19 bp, Homo sapiens
ttcttgaacatgtttctca

SEQ ID NO: 7466427 - DNA, 22 bp, Homo sapiens
ttcttgaaaatagccatgtaca

SEQ ID NO: 7466428 - DNA, 22 bp, Homo sapiens
ttcttgaatagggattgataaa

SEQ ID NO: 7466429 - DNA, 22 bp, Homo sapiens
ttcttgaatagggattgataaa

SEQ ID NO: 7466430 - DNA, 22 bp, Homo sapiens
ttcttgaatagggattgataaa

SEQ ID NO: 7466431 - DNA, 22 bp, Homo sapiens
ttcttgaatagggattgataaa

SEQ ID NO: 7466432 - DNA, 22 bp, Homo sapiens
ttcttgaaggggatataaatag

SEQ ID NO: 7466433 - DNA, 22 bp, Homo sapiens
ttcttgaaggggatataaatag

SEQ ID NO: 7466434 - DNA, 19 bp, Homo sapiens
ttcttgaacatgtttctca

SEQ ID NO: 7466435 - DNA, 22 bp, Homo sapiens
ttcttgaaggggatataaatag

SEQ ID NO: 7466436 - DNA, 22 bp, Homo sapiens
ttcttgaaggggatataaatag

SEQ ID NO: 7466437 - DNA, 22 bp, Homo sapiens
ttcttgaaggggatataaatag

SEQ ID NO: 7466438 - DNA, 22 bp, Homo sapiens
ttcttgaaggggatataaatag

SEQ ID NO: 7466439 - DNA, 19 bp, Homo sapiens
ttcttgagacctcagtctg

SEQ ID NO: 7466440 - DNA, 20 bp, Homo sapiens
ttcttgagccaaaaggcata

SEQ ID NO: 7466441 - DNA, 20 bp, Homo sapiens
ttcttgagccaaaaggcata

SEQ ID NO: 7466442 - DNA, 20 bp, Homo sapiens
ttcttgagccaaaaggcata

SEQ ID NO: 7466443 - DNA, 22 bp, Homo sapiens
ttcttgagtatctgcacagtgc

SEQ ID NO: 7466444 - DNA, 22 bp, Homo sapiens
ttcttgatgaatgctaagaact

SEQ ID NO: 7466445 - DNA, 22 bp, Homo sapiens
ttcttgagtatctgcacagtgc

SEQ ID NO: 7466446 - DNA, 22 bp, Homo sapiens
ttcttgaatcactttagagata

SEQ ID NO: 7466447 - DNA, 22 bp, Homo sapiens
ttcttgaatcactttagagata

SEQ ID NO: 7466448 - DNA, 22 bp, Homo sapiens
ttcttgaatcactttagagata

SEQ ID NO: 7466449 - DNA, 22 bp, Homo sapiens
ttcttgaccatgtatgtggtcc

SEQ ID NO: 7466450 - DNA, 22 bp, Homo sapiens
ttcttgaccatgtatgtggtcc

SEQ ID NO: 7466451 - DNA, 21 bp, Homo sapiens
ttcttcttggactgttttggc

SEQ ID NO: 7466452 - DNA, 22 bp, Homo sapiens
ttcttacattactttacatgtg

SEQ ID NO: 7466453 - DNA, 21 bp, Homo sapiens
ttcttcttggactgttttggc

SEQ ID NO: 7466454 - DNA, 21 bp, Homo sapiens
ttcttcttggactgttttggc

SEQ ID NO: 7466455 - DNA, 22 bp, Homo sapiens
ttcttacattactttacatgtg

SEQ ID NO: 7466456 - DNA, 22 bp, Homo sapiens
ttcttacattactttacatgtg

SEQ ID NO: 7466457 - DNA, 22 bp, Homo sapiens
ttcttacattactttacatgtg

SEQ ID NO: 7466458 - DNA, 22 bp, Homo sapiens
ttcttacatctataaagttggg

SEQ ID NO: 7466459 - DNA, 22 bp, Homo sapiens
ttcttacatcagtttattttgt

SEQ ID NO: 7466460 - DNA, 22 bp, Homo sapiens
ttcttacatcagtttattttgt

SEQ ID NO: 7466461 - DNA, 22 bp, Homo sapiens
ttcttacatcagtttattttgt

SEQ ID NO: 7466462 - DNA, 22 bp, Homo sapiens
ttcttacatcagtttattttgt

SEQ ID NO: 7466463 - DNA, 22 bp, Homo sapiens
ttcttacatcagtttattttgt

SEQ ID NO: 7466464 - DNA, 22 bp, Homo sapiens
ttcttcttgtctgccctcacat

SEQ ID NO: 7466465 - DNA, 22 bp, Homo sapiens
ttcttcttgtctgccctcacat

SEQ ID NO: 7466466 - DNA, 22 bp, Homo sapiens
ttcttcttgtctgccctcacat

SEQ ID NO: 7466467 - DNA, 21 bp, Homo sapiens
ttcttcttggactgttttggc

SEQ ID NO: 7466468 - DNA, 21 bp, Homo sapiens
ttcttcttggactgttttggc

SEQ ID NO: 7466469 - DNA, 22 bp, Homo sapiens
ttcttcttgtctgccctcacat

SEQ ID NO: 7466470 - DNA, 22 bp, Homo sapiens
ttcttctttatctcagtatcct

SEQ ID NO: 7466471 - DNA, 22 bp, Homo sapiens
ttcttctttatctcagtatcct

SEQ ID NO: 7466472 - DNA, 22 bp, Homo sapiens
ttcttacatattttcatatggt

SEQ ID NO: 7466473 - DNA, 22 bp, Homo sapiens
ttcttacatattttcatatggt

SEQ ID NO: 7466474 - DNA, 22 bp, Homo sapiens
ttcttacatattttcatatggt

SEQ ID NO: 7466475 - DNA, 22 bp, Homo sapiens
ttcttacatattttcatatggt

SEQ ID NO: 7466476 - DNA, 22 bp, Homo sapiens
ttcttacatattttcatatggt

SEQ ID NO: 7466477 - DNA, 22 bp, Homo sapiens
ttcttacagccctattactaaa

SEQ ID NO: 7466478 - DNA, 22 bp, Homo sapiens
ttcttacagccctattactaaa

SEQ ID NO: 7466479 - DNA, 22 bp, Homo sapiens
ttcttacagccctattactaaa

SEQ ID NO: 7466480 - DNA, 22 bp, Homo sapiens
ttcttacagccctattactaaa

SEQ ID NO: 7466481 - DNA, 22 bp, Homo sapiens
ttcttacagccctattactaaa

SEQ ID NO: 7466482 - DNA, 22 bp, Homo sapiens
ttcttacagccctattactaaa

SEQ ID NO: 7466483 - DNA, 22 bp, Homo sapiens
ttcttacagccctattactaaa

SEQ ID NO: 7466484 - DNA, 22 bp, Homo sapiens
ttcttacagagtttacagagcc

SEQ ID NO: 7466485 - DNA, 22 bp, Homo sapiens
ttcttacagagtttacagagcc

SEQ ID NO: 7466486 - DNA, 22 bp, Homo sapiens
ttcttacagatttggtgaatga

SEQ ID NO: 7466487 - DNA, 22 bp, Homo sapiens
ttcttacagatttggtgaatga

SEQ ID NO: 7466488 - DNA, 22 bp, Homo sapiens
ttcttacagccctattactaaa

SEQ ID NO: 7466489 - DNA, 22 bp, Homo sapiens
ttcttacagccctattactaaa

SEQ ID NO: 7466490 - DNA, 22 bp, Homo sapiens
ttcttacagccctattactaaa

SEQ ID NO: 7466491 - DNA, 22 bp, Homo sapiens
ttcttacagatttggtgaatga

SEQ ID NO: 7466492 - DNA, 22 bp, Homo sapiens
ttcttacagatttggtgaatga

SEQ ID NO: 7466493 - DNA, 22 bp, Homo sapiens
ttcttacagatttggtgaatga

SEQ ID NO: 7466494 - DNA, 20 bp, Homo sapiens
ttctgcttgcaaatatcaag

SEQ ID NO: 7466495 - DNA, 20 bp, Homo sapiens
ttctgcttgcaaatatcaag

SEQ ID NO: 7466496 - DNA, 22 bp, Homo sapiens
ttctgcttctgtgtgtcccagg

SEQ ID NO: 7466497 - DNA, 22 bp, Homo sapiens
ttctgcttctgtgtgtcccagg

SEQ ID NO: 7466498 - DNA, 20 bp, Homo sapiens
ttctgcttgcaaatatcaag

SEQ ID NO: 7466499 - DNA, 20 bp, Homo sapiens
ttctgcttgcaaatatcaag

SEQ ID NO: 7466500 - DNA, 20 bp, Homo sapiens
ttctgcttgcaaatatcaag

SEQ ID NO: 7466501 - DNA, 22 bp, Homo sapiens
ttctgcttcactggcctggagg

SEQ ID NO: 7466502 - DNA, 22 bp, Homo sapiens
ttctgcttattctgtagccttt

SEQ ID NO: 7466503 - DNA, 22 bp, Homo sapiens
ttctgcttattcaaatgatctt

SEQ ID NO: 7466504 - DNA, 22 bp, Homo sapiens
ttctgcttattctgtagccttt

SEQ ID NO: 7466505 - DNA, 22 bp, Homo sapiens
ttctgcttattctgtagccttt

SEQ ID NO: 7466506 - DNA, 22 bp, Homo sapiens
ttctgcttattcaaatgatctt

SEQ ID NO: 7466507 - DNA, 22 bp, Homo sapiens
ttctgcttattcaaatgatctt

SEQ ID NO: 7466508 - DNA, 22 bp, Homo sapiens
ttctgcttattcaaatgatctt

SEQ ID NO: 7466509 - DNA, 22 bp, Homo sapiens
ttctgcttagagggcatttgca

SEQ ID NO: 7466510 - DNA, 22 bp, Homo sapiens
ttctgcttattcaaatgatctt

SEQ ID NO: 7466511 - DNA, 22 bp, Homo sapiens
ttctgcttattcaaatgatctt

SEQ ID NO: 7466512 - DNA, 22 bp, Homo sapiens
ttctgcttttagctaaactata

SEQ ID NO: 7466513 - DNA, 22 bp, Homo sapiens
ttctgcttttagctaaactata

SEQ ID NO: 7466514 - DNA, 22 bp, Homo sapiens
ttctgcttttattgccagagtt

SEQ ID NO: 7466515 - DNA, 22 bp, Homo sapiens
ttctgcttttctctgtctgagt

SEQ ID NO: 7466516 - DNA, 22 bp, Homo sapiens
ttctgcttttctctgtctgagt

SEQ ID NO: 7466517 - DNA, 22 bp, Homo sapiens
ttctgcttttagctaaactata

SEQ ID NO: 7466518 - DNA, 22 bp, Homo sapiens
ttctgcttttagctaaactata

SEQ ID NO: 7466519 - DNA, 22 bp, Homo sapiens
ttctgcttttagctaaactata

SEQ ID NO: 7466520 - DNA, 22 bp, Homo sapiens
ttctgctttggttccatggatg

SEQ ID NO: 7466521 - DNA, 22 bp, Homo sapiens
ttctgctttggttccatggatg

SEQ ID NO: 7466522 - DNA, 22 bp, Homo sapiens
ttctgctttcagttcttctggg

SEQ ID NO: 7466523 - DNA, 22 bp, Homo sapiens
ttctgctttcagttcttctggg

SEQ ID NO: 7466524 - DNA, 22 bp, Homo sapiens
ttctgggcagagctggagctgc

SEQ ID NO: 7466525 - DNA, 19 bp, Homo sapiens
ttctgggcagcacatgaat

SEQ ID NO: 7466526 - DNA, 22 bp, Homo sapiens
ttctgggcagagctggagctgc

SEQ ID NO: 7466527 - DNA, 20 bp, Homo sapiens
ttctgggcagccatgtactt

SEQ ID NO: 7466528 - DNA, 19 bp, Homo sapiens
ttctgggcagcacatgaat

SEQ ID NO: 7466529 - DNA, 19 bp, Homo sapiens
ttctgggcagcacatgaat

SEQ ID NO: 7466530 - DNA, 22 bp, Homo sapiens
ttctgggcaggactggggaccc

SEQ ID NO: 7466531 - DNA, 22 bp, Homo sapiens
ttctgggcatgttacattctgt

SEQ ID NO: 7466532 - DNA, 19 bp, Homo sapiens
ttctgggcattcatattta

SEQ ID NO: 7466533 - DNA, 21 bp, Homo sapiens
ttctgggccatgctgcttctc

SEQ ID NO: 7466534 - DNA, 21 bp, Homo sapiens
ttctgggccatgctgcttctc

SEQ ID NO: 7466535 - DNA, 20 bp, Homo sapiens
ttctgcttttgcttagggac

SEQ ID NO: 7466536 - DNA, 22 bp, Homo sapiens
ttctggaaaagaaagttaagat

SEQ ID NO: 7466537 - DNA, 20 bp, Homo sapiens
ttctgcttttgcttagggac

SEQ ID NO: 7466538 - DNA, 22 bp, Homo sapiens
ttctggaaaagaaagttaagat

SEQ ID NO: 7466539 - DNA, 22 bp, Homo sapiens
ttctggaaaagaaagttaagat

SEQ ID NO: 7466540 - DNA, 22 bp, Homo sapiens
ttctggaaagaaggctaaggtc

SEQ ID NO: 7466541 - DNA, 19 bp, Homo sapiens
ttctggaaacccaggtaat

SEQ ID NO: 7466542 - DNA, 22 bp, Homo sapiens
ttctggaaaccctcagccagtg

SEQ ID NO: 7466543 - DNA, 22 bp, Homo sapiens
ttctggaaaccctcagccagtg

SEQ ID NO: 7466544 - DNA, 22 bp, Homo sapiens
ttctggaaatcagcagagggtg

SEQ ID NO: 7466545 - DNA, 22 bp, Homo sapiens
ttctgggcaccaccacagactt

SEQ ID NO: 7466546 - DNA, 22 bp, Homo sapiens
ttctggaaagatttgcgtgtaa

SEQ ID NO: 7466547 - DNA, 22 bp, Homo sapiens
ttctggaaagatttgcgtgtaa

SEQ ID NO: 7466548 - DNA, 22 bp, Homo sapiens
ttctggaaagcatttgaggccc

SEQ ID NO: 7466549 - DNA, 22 bp, Homo sapiens
ttctggaaagcatttgaggccc

SEQ ID NO: 7466550 - DNA, 22 bp, Homo sapiens
ttctggaaagcatttgaggccc

SEQ ID NO: 7466551 - DNA, 21 bp, Homo sapiens
ttctgctccagctcctctggg

SEQ ID NO: 7466552 - DNA, 22 bp, Homo sapiens
ttctgctccaccacttccagca

SEQ ID NO: 7466553 - DNA, 22 bp, Homo sapiens
ttctgctccaccacttccagca

SEQ ID NO: 7466554 - DNA, 22 bp, Homo sapiens
ttctgctccaccacttccagca

SEQ ID NO: 7466555 - DNA, 21 bp, Homo sapiens
ttctgctccagctcctctggg

SEQ ID NO: 7466556 - DNA, 21 bp, Homo sapiens
ttctgctccagctcctctggg

SEQ ID NO: 7466557 - DNA, 22 bp, Homo sapiens
ttctgctctgacttgcaaggaa

SEQ ID NO: 7466558 - DNA, 22 bp, Homo sapiens
ttctgctgaagccagggagcaa

SEQ ID NO: 7466559 - DNA, 22 bp, Homo sapiens
ttctgctgaagccagggagcaa

SEQ ID NO: 7466560 - DNA, 22 bp, Homo sapiens
ttctgctgaaaacagccatgta

SEQ ID NO: 7466561 - DNA, 22 bp, Homo sapiens
ttctgctgaaaacagccatgta

SEQ ID NO: 7466562 - DNA, 22 bp, Homo sapiens
ttctgctcttggctttgctggt

SEQ ID NO: 7466563 - DNA, 22 bp, Homo sapiens
ttctgctgaaaacagccatgta

SEQ ID NO: 7466564 - DNA, 22 bp, Homo sapiens
ttctgctgagtgggcaggtgca

SEQ ID NO: 7466565 - DNA, 22 bp, Homo sapiens
ttctgctgaagtcactgggagc

SEQ ID NO: 7466566 - DNA, 22 bp, Homo sapiens
ttctgctgcctactcctgggga

SEQ ID NO: 7466567 - DNA, 22 bp, Homo sapiens
ttctgctgagtgggcaggtgca

SEQ ID NO: 7466568 - DNA, 22 bp, Homo sapiens
ttctgctgcctactcctgggga

SEQ ID NO: 7466569 - DNA, 21 bp, Homo sapiens
ttctgctgttcaccaccaccc

SEQ ID NO: 7466570 - DNA, 21 bp, Homo sapiens
ttctgctgtgccatgcctctg

SEQ ID NO: 7466571 - DNA, 21 bp, Homo sapiens
ttctgctgtgccatgcctctg

SEQ ID NO: 7466572 - DNA, 21 bp, Homo sapiens
ttctgctgtgccatgcctctg

SEQ ID NO: 7466573 - DNA, 22 bp, Homo sapiens
ttctgctgtttgtagtaatgta

SEQ ID NO: 7466574 - DNA, 17 bp, Homo sapiens
ttctgctgtttcccctt

SEQ ID NO: 7466575 - DNA, 19 bp, Homo sapiens
ttctgctgttcctaggctg

SEQ ID NO: 7466576 - DNA, 19 bp, Homo sapiens
ttctgctgttcctaggctg

SEQ ID NO: 7466577 - DNA, 22 bp, Homo sapiens
ttctgctggtgttttgtgaggc

SEQ ID NO: 7466578 - DNA, 17 bp, Homo sapiens
ttctgctgtcgtcctct

SEQ ID NO: 7466579 - DNA, 22 bp, Homo sapiens
ttctgctgctgctgcacccaat

SEQ ID NO: 7466580 - DNA, 22 bp, Homo sapiens
ttctgctggtaactatgtttca

SEQ ID NO: 7466581 - DNA, 22 bp, Homo sapiens
ttctgctgcgacccaggagtta

SEQ ID NO: 7466582 - DNA, 22 bp, Homo sapiens
ttctgctgcgacccaggagtta

SEQ ID NO: 7466583 - DNA, 22 bp, Homo sapiens
ttctgcctgccccagagaggcc

SEQ ID NO: 7466584 - DNA, 22 bp, Homo sapiens
ttctgcctgccccagagaggcc

SEQ ID NO: 7466585 - DNA, 22 bp, Homo sapiens
ttctgcctgccccagagaggcc

SEQ ID NO: 7466586 - DNA, 22 bp, Homo sapiens
ttctgcctggcaggaggactgt

SEQ ID NO: 7466587 - DNA, 22 bp, Homo sapiens
ttctgcctggcaggaggactgt

SEQ ID NO: 7466588 - DNA, 22 bp, Homo sapiens
ttctgcctggcaggaggactgt

SEQ ID NO: 7466589 - DNA, 22 bp, Homo sapiens
ttctgagcctttctaagaaaca

SEQ ID NO: 7466590 - DNA, 22 bp, Homo sapiens
ttctgagctacatagtactggg

SEQ ID NO: 7466591 - DNA, 22 bp, Homo sapiens
ttctgcctgatgtagtcatacc

SEQ ID NO: 7466592 - DNA, 22 bp, Homo sapiens
ttctgagcctcattcatgaggc

SEQ ID NO: 7466593 - DNA, 17 bp, Homo sapiens
ttctgagccacttcctt

SEQ ID NO: 7466594 - DNA, 22 bp, Homo sapiens
ttctgagcacgttcatttaaat

SEQ ID NO: 7466595 - DNA, 22 bp, Homo sapiens
ttctgagcaagctggacagtct

SEQ ID NO: 7466596 - DNA, 22 bp, Homo sapiens
ttctgagattgttaggcactaa

SEQ ID NO: 7466597 - DNA, 22 bp, Homo sapiens
ttctgagattgttaggcactaa

SEQ ID NO: 7466598 - DNA, 22 bp, Homo sapiens
ttctgagattgttaggcactaa

SEQ ID NO: 7466599 - DNA, 22 bp, Homo sapiens
ttctgagattatcatacaacat

SEQ ID NO: 7466600 - DNA, 20 bp, Homo sapiens
ttctgagattaggttacaaa

SEQ ID NO: 7466601 - DNA, 22 bp, Homo sapiens
ttctgagattatcatacaacat

SEQ ID NO: 7466602 - DNA, 22 bp, Homo sapiens
ttctgctccaccacttccagca

SEQ ID NO: 7466603 - DNA, 22 bp, Homo sapiens
ttctgctcagtagtaagagtgc

SEQ ID NO: 7466604 - DNA, 19 bp, Homo sapiens
ttctgctagaccatttgtt

SEQ ID NO: 7466605 - DNA, 22 bp, Homo sapiens
ttctgctatgaaaaaagtgctg

SEQ ID NO: 7466606 - DNA, 22 bp, Homo sapiens
ttctgctatacttatgaataca

SEQ ID NO: 7466607 - DNA, 21 bp, Homo sapiens
ttctgccttcgaggtctcagg

SEQ ID NO: 7466608 - DNA, 21 bp, Homo sapiens
ttctgccttcgaggtctcagg

SEQ ID NO: 7466609 - DNA, 22 bp, Homo sapiens
ttctgccttggcagggtggtcc

SEQ ID NO: 7466610 - DNA, 21 bp, Homo sapiens
ttctgctaagaaaacattatt

SEQ ID NO: 7466611 - DNA, 22 bp, Homo sapiens
ttctgccttcagtcctctgact

SEQ ID NO: 7466612 - DNA, 22 bp, Homo sapiens
ttctgccttcagtcctctgact

SEQ ID NO: 7466613 - DNA, 22 bp, Homo sapiens
ttctgccttcagtcctctgact

SEQ ID NO: 7466614 - DNA, 22 bp, Homo sapiens
ttctgccttacgatattttcaa

SEQ ID NO: 7466615 - DNA, 22 bp, Homo sapiens
ttctgccttcagtcctctgact

SEQ ID NO: 7466616 - DNA, 21 bp, Homo sapiens
ttctgccttcccctagctggg

SEQ ID NO: 7466617 - DNA, 21 bp, Homo sapiens
ttctgccttcccctagctggg

SEQ ID NO: 7466618 - DNA, 22 bp, Homo sapiens
ttctgccttcagtcctctgact

SEQ ID NO: 7466619 - DNA, 22 bp, Homo sapiens
ttctgagagtaaacatagcctg

SEQ ID NO: 7466620 - DNA, 22 bp, Homo sapiens
ttctgagaggtttgcattttca

SEQ ID NO: 7466621 - DNA, 22 bp, Homo sapiens
ttctgagagtaaacatagcctg

SEQ ID NO: 7466622 - DNA, 22 bp, Homo sapiens
ttctgagagtaaacatagcctg

SEQ ID NO: 7466623 - DNA, 22 bp, Homo sapiens
ttctgagagtaaacatagcctg

SEQ ID NO: 7466624 - DNA, 22 bp, Homo sapiens
ttctgagagctgaagaaatgtt

SEQ ID NO: 7466625 - DNA, 22 bp, Homo sapiens
ttctgagagctgaagaaatgtt

SEQ ID NO: 7466626 - DNA, 22 bp, Homo sapiens
ttctgagagagcctctcatgtt

SEQ ID NO: 7466627 - DNA, 22 bp, Homo sapiens
ttctgagagagcctctcatgtt

SEQ ID NO: 7466628 - DNA, 22 bp, Homo sapiens
ttctgagagagcctctcatgtt

SEQ ID NO: 7466629 - DNA, 22 bp, Homo sapiens
ttctgagagctgaagaaatgtt

SEQ ID NO: 7466630 - DNA, 22 bp, Homo sapiens
ttctgagagctgaagaaatgtt

SEQ ID NO: 7466631 - DNA, 22 bp, Homo sapiens
ttctgagagagcctctcatgtt

SEQ ID NO: 7466632 - DNA, 22 bp, Homo sapiens
ttctgagacttgagattaattt

SEQ ID NO: 7466633 - DNA, 22 bp, Homo sapiens
ttctgagagagcctctcatgtt

SEQ ID NO: 7466634 - DNA, 22 bp, Homo sapiens
ttctgagacatcatacttttag

SEQ ID NO: 7466635 - DNA, 21 bp, Homo sapiens
ttctgagactcatttgaactc

SEQ ID NO: 7466636 - DNA, 22 bp, Homo sapiens
ttctgagacttgagattaattt

SEQ ID NO: 7466637 - DNA, 22 bp, Homo sapiens
ttctgagacttgagattaattt

SEQ ID NO: 7466638 - DNA, 22 bp, Homo sapiens
ttctgagacttgagattaattt

SEQ ID NO: 7466639 - DNA, 22 bp, Homo sapiens
ttctgagacatcatacttttag

SEQ ID NO: 7466640 - DNA, 22 bp, Homo sapiens
ttctgagacagcaaagattctt

SEQ ID NO: 7466641 - DNA, 22 bp, Homo sapiens
ttctgagacagcaaagattctt

SEQ ID NO: 7466642 - DNA, 22 bp, Homo sapiens
ttctgagaatgcttctggaatc

SEQ ID NO: 7466643 - DNA, 22 bp, Homo sapiens
ttctgagacaattgagagtcta

SEQ ID NO: 7466644 - DNA, 22 bp, Homo sapiens
ttctgagatgtgaatctgtcaa

SEQ ID NO: 7466645 - DNA, 22 bp, Homo sapiens
ttctgagatgcgttagaaattt

SEQ ID NO: 7466646 - DNA, 22 bp, Homo sapiens
ttctgagatgtgaatctgtcaa

SEQ ID NO: 7466647 - DNA, 22 bp, Homo sapiens
ttctgagatgtgaatctgtcaa

SEQ ID NO: 7466648 - DNA, 22 bp, Homo sapiens
ttctgagatgtgaatctgtcaa

SEQ ID NO: 7466649 - DNA, 22 bp, Homo sapiens
ttctgagattatcatacaacat

SEQ ID NO: 7466650 - DNA, 20 bp, Homo sapiens
ttctgagattaggttacaaa

SEQ ID NO: 7466651 - DNA, 22 bp, Homo sapiens
ttctgagatgcgttagaaattt

SEQ ID NO: 7466652 - DNA, 22 bp, Homo sapiens
ttctgagatgcgttagaaattt

SEQ ID NO: 7466653 - DNA, 22 bp, Homo sapiens
ttctgagatgcgttagaaattt

SEQ ID NO: 7466654 - DNA, 22 bp, Homo sapiens
ttctgagatgaggaggaaaaag

SEQ ID NO: 7466655 - DNA, 22 bp, Homo sapiens
ttctgagatgaggaggaaaaag

SEQ ID NO: 7466656 - DNA, 22 bp, Homo sapiens
ttctgagatgaggaggaaaaag

SEQ ID NO: 7466657 - DNA, 22 bp, Homo sapiens
ttctgagagtgccagaagttct

SEQ ID NO: 7466658 - DNA, 20 bp, Homo sapiens
ttctgagagttcacagcccc

SEQ ID NO: 7466659 - DNA, 20 bp, Homo sapiens
ttctgagagttcacagcccc

SEQ ID NO: 7466660 - DNA, 20 bp, Homo sapiens
ttctgagagttcacagcccc

SEQ ID NO: 7466661 - DNA, 22 bp, Homo sapiens
ttctgagagtgccagaagttct

SEQ ID NO: 7466662 - DNA, 22 bp, Homo sapiens
ttctgagagtgccagaagttct

SEQ ID NO: 7466663 - DNA, 20 bp, Homo sapiens
ttctgagagttcacagcccc

SEQ ID NO: 7466664 - DNA, 22 bp, Homo sapiens
ttctgagagttgtagtgtatcc

SEQ ID NO: 7466665 - DNA, 22 bp, Homo sapiens
ttctgagagttgtagtgtatcc

SEQ ID NO: 7466666 - DNA, 22 bp, Homo sapiens
ttctgagatacaaaatttactt

SEQ ID NO: 7466667 - DNA, 22 bp, Homo sapiens
ttctgagatacaaaatttactt

SEQ ID NO: 7466668 - DNA, 22 bp, Homo sapiens
ttctgagatacaaaatttactt

SEQ ID NO: 7466669 - DNA, 22 bp, Homo sapiens
ttctgagatacttttggcacca

SEQ ID NO: 7466670 - DNA, 22 bp, Homo sapiens
ttctgaatcctcgaaacatagc

SEQ ID NO: 7466671 - DNA, 22 bp, Homo sapiens
ttctgaatcctcgaaacatagc

SEQ ID NO: 7466672 - DNA, 22 bp, Homo sapiens
ttctgaatcctcgaaacatagc

SEQ ID NO: 7466673 - DNA, 22 bp, Homo sapiens
ttctgaatgatagtcttgaact

SEQ ID NO: 7466674 - DNA, 22 bp, Homo sapiens
ttctgaatggcaagcattaggc

SEQ ID NO: 7466675 - DNA, 22 bp, Homo sapiens
ttctgaatgatagtcttgaact

SEQ ID NO: 7466676 - DNA, 22 bp, Homo sapiens
ttctgaatggcaagcattaggc

SEQ ID NO: 7466677 - DNA, 22 bp, Homo sapiens
ttctgaattcatgagatttggg

SEQ ID NO: 7466678 - DNA, 22 bp, Homo sapiens
ttctgaattcatgagatttggg

SEQ ID NO: 7466679 - DNA, 22 bp, Homo sapiens
ttctgaattcatgagatttggg

SEQ ID NO: 7466680 - DNA, 22 bp, Homo sapiens
ttctgaatttctgtgtatctta

SEQ ID NO: 7466681 - DNA, 22 bp, Homo sapiens
ttctgacaattcagtaacagca

SEQ ID NO: 7466682 - DNA, 22 bp, Homo sapiens
ttctgacacattactacatgga

SEQ ID NO: 7466683 - DNA, 22 bp, Homo sapiens
ttctgacacattactacatgga

SEQ ID NO: 7466684 - DNA, 22 bp, Homo sapiens
ttctgacacattactacatgga

SEQ ID NO: 7466685 - DNA, 22 bp, Homo sapiens
ttctgacacattactacatgga

SEQ ID NO: 7466686 - DNA, 22 bp, Homo sapiens
ttctgacacattactacatgga

SEQ ID NO: 7466687 - DNA, 22 bp, Homo sapiens
ttctgacacattactacatgga

SEQ ID NO: 7466688 - DNA, 22 bp, Homo sapiens
ttctgaatttctgtgtatctta

SEQ ID NO: 7466689 - DNA, 22 bp, Homo sapiens
ttctgacaattcagtaacagca

SEQ ID NO: 7466690 - DNA, 22 bp, Homo sapiens
ttctgacaattcagtaacagca

SEQ ID NO: 7466691 - DNA, 22 bp, Homo sapiens
ttctgacaattcagtaacagca

SEQ ID NO: 7466692 - DNA, 22 bp, Homo sapiens
ttctgagaaatgggttcacata

SEQ ID NO: 7466693 - DNA, 22 bp, Homo sapiens
ttctgacctcaggtgatccgtc

SEQ ID NO: 7466694 - DNA, 22 bp, Homo sapiens
ttctgagaaggctgtggacaca

SEQ ID NO: 7466695 - DNA, 22 bp, Homo sapiens
ttctgagaaggctgtggacaca

SEQ ID NO: 7466696 - DNA, 22 bp, Homo sapiens
ttctgagaatgcttctggaatc

SEQ ID NO: 7466697 - DNA, 22 bp, Homo sapiens
ttctgagaagggtgggtctggc

SEQ ID NO: 7466698 - DNA, 22 bp, Homo sapiens
ttctgagaagtaaaatggcgtt

SEQ ID NO: 7466699 - DNA, 22 bp, Homo sapiens
ttctgagaaggctgtggacaca

SEQ ID NO: 7466700 - DNA, 22 bp, Homo sapiens
ttctgagaagggtgggtctggc

SEQ ID NO: 7466701 - DNA, 22 bp, Homo sapiens
ttctgacatatccagtctcagt

SEQ ID NO: 7466702 - DNA, 22 bp, Homo sapiens
ttctgacatatccagtctcagt

SEQ ID NO: 7466703 - DNA, 22 bp, Homo sapiens
ttctgacatatccagtctcagt

SEQ ID NO: 7466704 - DNA, 22 bp, Homo sapiens
ttctgacatgtgagattttgtt

SEQ ID NO: 7466705 - DNA, 22 bp, Homo sapiens
ttctgacatttgtcaaaatgat

SEQ ID NO: 7466706 - DNA, 22 bp, Homo sapiens
ttctgacatgtgagattttgtt

SEQ ID NO: 7466707 - DNA, 22 bp, Homo sapiens
ttctgacatgtgagattttgtt

SEQ ID NO: 7466708 - DNA, 22 bp, Homo sapiens
ttctgacatttgtcaaaatgat

SEQ ID NO: 7466709 - DNA, 22 bp, Homo sapiens
ttctgacatttgtcaaaatgat

SEQ ID NO: 7466710 - DNA, 22 bp, Homo sapiens
ttctgacagcaaaactcagcct

SEQ ID NO: 7466711 - DNA, 22 bp, Homo sapiens
ttctgacagcaaaactcagcct

SEQ ID NO: 7466712 - DNA, 22 bp, Homo sapiens
ttctgacagcaaaactcagcct

SEQ ID NO: 7466713 - DNA, 22 bp, Homo sapiens
ttctgacagtaatcagtttgct

SEQ ID NO: 7466714 - DNA, 22 bp, Homo sapiens
ttctgacatatccagtctcagt

SEQ ID NO: 7466715 - DNA, 22 bp, Homo sapiens
ttctgacagcaaaactcagcct

SEQ ID NO: 7466716 - DNA, 22 bp, Homo sapiens
ttctgacagtaatcagtttgct

SEQ ID NO: 7466717 - DNA, 22 bp, Homo sapiens
ttctgacagtaatcagtttgct

SEQ ID NO: 7466718 - DNA, 22 bp, Homo sapiens
ttctgacagtaatcagtttgct

SEQ ID NO: 7466719 - DNA, 22 bp, Homo sapiens
ttctgaagggctaagtgtctat

SEQ ID NO: 7466720 - DNA, 22 bp, Homo sapiens
ttctgaagggctaagtgtctat

SEQ ID NO: 7466721 - DNA, 22 bp, Homo sapiens
ttctgaagggctaagtgtctat

SEQ ID NO: 7466722 - DNA, 22 bp, Homo sapiens
ttctcttttgtgatgtgagatg

SEQ ID NO: 7466723 - DNA, 22 bp, Homo sapiens
ttctcttttgtgatgtgagatg

SEQ ID NO: 7466724 - DNA, 22 bp, Homo sapiens
ttctcttttgtgatgtgagatg

SEQ ID NO: 7466725 - DNA, 22 bp, Homo sapiens
ttctgaaggtcagcagcttggt

SEQ ID NO: 7466726 - DNA, 22 bp, Homo sapiens
ttctgaatcctcgaaacatagc

SEQ ID NO: 7466727 - DNA, 22 bp, Homo sapiens
ttctgaatcctcgaaacatagc

SEQ ID NO: 7466728 - DNA, 22 bp, Homo sapiens
ttctgaatcctcgaaacatagc

SEQ ID NO: 7466729 - DNA, 22 bp, Homo sapiens
ttctcttttcaccagttgctaa

SEQ ID NO: 7466730 - DNA, 22 bp, Homo sapiens
ttctcttttcaccagttgctaa

SEQ ID NO: 7466731 - DNA, 22 bp, Homo sapiens
ttctcttttcaccagttgctaa

SEQ ID NO: 7466732 - DNA, 22 bp, Homo sapiens
ttctcttttcaccagttgctaa

SEQ ID NO: 7466733 - DNA, 22 bp, Homo sapiens
ttctcttttagaggctccatga

SEQ ID NO: 7466734 - DNA, 22 bp, Homo sapiens
ttctcttttcaccagttgctaa

SEQ ID NO: 7466735 - DNA, 22 bp, Homo sapiens
ttctcttttagaggctccatga

SEQ ID NO: 7466736 - DNA, 22 bp, Homo sapiens
ttctagttttgccttatcaaca

SEQ ID NO: 7466737 - DNA, 22 bp, Homo sapiens
ttctagttttgccacaggatac

SEQ ID NO: 7466738 - DNA, 22 bp, Homo sapiens
ttctagttttgccacaggatac

SEQ ID NO: 7466739 - DNA, 22 bp, Homo sapiens
ttctagttttgccttatcaaca

SEQ ID NO: 7466740 - DNA, 22 bp, Homo sapiens
ttctagttttgccttatcaaca

SEQ ID NO: 7466741 - DNA, 22 bp, Homo sapiens
ttctataaatgaatgtgtatat

SEQ ID NO: 7466742 - DNA, 22 bp, Homo sapiens
ttctagttttgccttatcaaca

SEQ ID NO: 7466743 - DNA, 22 bp, Homo sapiens
ttctataaatgaatgtgtatat

SEQ ID NO: 7466744 - DNA, 22 bp, Homo sapiens
ttctataagactcatatttctt

SEQ ID NO: 7466745 - DNA, 22 bp, Homo sapiens
ttctataagactcatatttctt

SEQ ID NO: 7466746 - DNA, 22 bp, Homo sapiens
ttctataaatgaatgtgtatat

SEQ ID NO: 7466747 - DNA, 22 bp, Homo sapiens
ttctcttttagaggctccatga

SEQ ID NO: 7466748 - DNA, 22 bp, Homo sapiens
ttctcttttagaggctccatga

SEQ ID NO: 7466749 - DNA, 22 bp, Homo sapiens
ttctataggactcccttgaata

SEQ ID NO: 7466750 - DNA, 22 bp, Homo sapiens
ttctataatgcaagccactgca

SEQ ID NO: 7466751 - DNA, 22 bp, Homo sapiens
ttctataatgcaagccactgca

SEQ ID NO: 7466752 - DNA, 22 bp, Homo sapiens
ttctataatgcaagccactgca

SEQ ID NO: 7466753 - DNA, 22 bp, Homo sapiens
ttctatacaaagatttctcaca

SEQ ID NO: 7466754 - DNA, 22 bp, Homo sapiens
ttctatacaaagatttctcaca

SEQ ID NO: 7466755 - DNA, 22 bp, Homo sapiens
ttctataagactcatatttctt

SEQ ID NO: 7466756 - DNA, 22 bp, Homo sapiens
ttctataagactcatatttctt

SEQ ID NO: 7466757 - DNA, 22 bp, Homo sapiens
ttctataagactcatatttctt

SEQ ID NO: 7466758 - DNA, 22 bp, Homo sapiens
ttctataagactcatatttctt

SEQ ID NO: 7466759 - DNA, 22 bp, Homo sapiens
ttctataagactcatatttctt

SEQ ID NO: 7466760 - DNA, 22 bp, Homo sapiens
ttctagtgtccttggacttgct

SEQ ID NO: 7466761 - DNA, 22 bp, Homo sapiens
ttctagtgtccttggacttgct

SEQ ID NO: 7466762 - DNA, 22 bp, Homo sapiens
ttctagtgtccttggacttgct

SEQ ID NO: 7466763 - DNA, 22 bp, Homo sapiens
ttctagggttgtagcccccagt

SEQ ID NO: 7466764 - DNA, 22 bp, Homo sapiens
ttctagtcctagaaactacatg

SEQ ID NO: 7466765 - DNA, 22 bp, Homo sapiens
ttctagttaaagtatgtattag

SEQ ID NO: 7466766 - DNA, 22 bp, Homo sapiens
ttctagtgtccttggacttgct

SEQ ID NO: 7466767 - DNA, 22 bp, Homo sapiens
ttctagttactcttaaatgctg

SEQ ID NO: 7466768 - DNA, 22 bp, Homo sapiens
ttctagttactcttaaatgctg

SEQ ID NO: 7466769 - DNA, 22 bp, Homo sapiens
ttctagttacagaagccttgct

SEQ ID NO: 7466770 - DNA, 22 bp, Homo sapiens
ttctagttaaagtatgtattag

SEQ ID NO: 7466771 - DNA, 22 bp, Homo sapiens
ttctagttaatgtagcatcttg

SEQ ID NO: 7466772 - DNA, 22 bp, Homo sapiens
ttctagttaatgtagcatcttg

SEQ ID NO: 7466773 - DNA, 22 bp, Homo sapiens
ttctagttaatgtagcatcttg

SEQ ID NO: 7466774 - DNA, 22 bp, Homo sapiens
ttctagttaatgtagcatcttg

SEQ ID NO: 7466775 - DNA, 22 bp, Homo sapiens
ttctagtttccattttaagaca

SEQ ID NO: 7466776 - DNA, 22 bp, Homo sapiens
ttctagtttccattttaagaca

SEQ ID NO: 7466777 - DNA, 20 bp, Homo sapiens
ttctagtttggagttattaa

SEQ ID NO: 7466778 - DNA, 22 bp, Homo sapiens
ttctagtttccattttaagaca

SEQ ID NO: 7466779 - DNA, 22 bp, Homo sapiens
ttctagtttccattttaagaca

SEQ ID NO: 7466780 - DNA, 20 bp, Homo sapiens
ttctagtttggagttattaa

SEQ ID NO: 7466781 - DNA, 20 bp, Homo sapiens
ttctagtttggagttattaa

SEQ ID NO: 7466782 - DNA, 22 bp, Homo sapiens
ttctagttttcagtccaccagg

SEQ ID NO: 7466783 - DNA, 20 bp, Homo sapiens
ttctagtttggagttattaa

SEQ ID NO: 7466784 - DNA, 22 bp, Homo sapiens
ttctagttttcagtccaccagg

SEQ ID NO: 7466785 - DNA, 22 bp, Homo sapiens
ttctagttgagggagacaaata

SEQ ID NO: 7466786 - DNA, 22 bp, Homo sapiens
ttctagttcttagagaattggt

SEQ ID NO: 7466787 - DNA, 22 bp, Homo sapiens
ttctagttcttagagaattggt

SEQ ID NO: 7466788 - DNA, 22 bp, Homo sapiens
ttctagttcttaggaacagaca

SEQ ID NO: 7466789 - DNA, 22 bp, Homo sapiens
ttctagttgagggagacaaata

SEQ ID NO: 7466790 - DNA, 22 bp, Homo sapiens
ttctagtttagggctcttcaac

SEQ ID NO: 7466791 - DNA, 22 bp, Homo sapiens
ttctagttatagaaaaagcatt

SEQ ID NO: 7466792 - DNA, 22 bp, Homo sapiens
ttctagttatagaaaaagcatt

SEQ ID NO: 7466793 - DNA, 22 bp, Homo sapiens
ttctagttcatattctcaaaga

SEQ ID NO: 7466794 - DNA, 22 bp, Homo sapiens
ttctagttcatattctcaaaga

SEQ ID NO: 7466795 - DNA, 22 bp, Homo sapiens
ttctagttctgaaagcctgaca

SEQ ID NO: 7466796 - DNA, 22 bp, Homo sapiens
ttctagttccctctggaatgta

SEQ ID NO: 7466797 - DNA, 22 bp, Homo sapiens
ttcatgcactatttcttctagc

SEQ ID NO: 7466798 - DNA, 22 bp, Homo sapiens
ttcatgcactatttcttctagc

SEQ ID NO: 7466799 - DNA, 22 bp, Homo sapiens
ttcatgattgactatcaagagc

SEQ ID NO: 7466800 - DNA, 22 bp, Homo sapiens
ttcatgcatggccttactccct

SEQ ID NO: 7466801 - DNA, 22 bp, Homo sapiens
ttcatgcactatttcttctagc

SEQ ID NO: 7466802 - DNA, 22 bp, Homo sapiens
ttcatgatggcaagggccgtga

SEQ ID NO: 7466803 - DNA, 22 bp, Homo sapiens
ttcatgattgactatcaagagc

SEQ ID NO: 7466804 - DNA, 22 bp, Homo sapiens
ttcatgatagtattttttgtga

SEQ ID NO: 7466805 - DNA, 22 bp, Homo sapiens
ttcatcattacagtcatgttat

SEQ ID NO: 7466806 - DNA, 22 bp, Homo sapiens
ttcatcattacagtcatgttat

SEQ ID NO: 7466807 - DNA, 22 bp, Homo sapiens
ttcatcattgccagtctttaaa

SEQ ID NO: 7466808 - DNA, 21 bp, Homo sapiens
ttcatcattggtaaaaagtgg

SEQ ID NO: 7466809 - DNA, 21 bp, Homo sapiens
ttcatcattggtaaaaagtgg

SEQ ID NO: 7466810 - DNA, 21 bp, Homo sapiens
ttcatcattggtaaaaagtgg

SEQ ID NO: 7466811 - DNA, 21 bp, Homo sapiens
ttcatcattggtaaaaagtgg

SEQ ID NO: 7466812 - DNA, 22 bp, Homo sapiens
ttcatgcttttaccgctgttaa

SEQ ID NO: 7466813 - DNA, 22 bp, Homo sapiens
ttcatgcttttaccgctgttaa

SEQ ID NO: 7466814 - DNA, 22 bp, Homo sapiens
ttcatggagttgagaaggctaa

SEQ ID NO: 7466815 - DNA, 22 bp, Homo sapiens
ttcatggcaggagtcagaagct

SEQ ID NO: 7466816 - DNA, 22 bp, Homo sapiens
ttcatggcaggagtcagaagct

SEQ ID NO: 7466817 - DNA, 22 bp, Homo sapiens
ttcatggatgttggtagaaaac

SEQ ID NO: 7466818 - DNA, 22 bp, Homo sapiens
ttcatggcatacatgtttccca

SEQ ID NO: 7466819 - DNA, 22 bp, Homo sapiens
ttcatggcctactttgcttcaa

SEQ ID NO: 7466820 - DNA, 22 bp, Homo sapiens
ttcatggcgctgttctctccct

SEQ ID NO: 7466821 - DNA, 22 bp, Homo sapiens
ttcatgctcctgccctttttgg

SEQ ID NO: 7466822 - DNA, 22 bp, Homo sapiens
ttcatgctcctgccctttttgg

SEQ ID NO: 7466823 - DNA, 22 bp, Homo sapiens
ttcatgctagtatgtgctgttc

SEQ ID NO: 7466824 - DNA, 22 bp, Homo sapiens
ttcatgctagtatgtgctgttc

SEQ ID NO: 7466825 - DNA, 19 bp, Homo sapiens
ttcatgcccaatttgctac

SEQ ID NO: 7466826 - DNA, 22 bp, Homo sapiens
ttcatgctagtatgtgctgttc

SEQ ID NO: 7466827 - DNA, 22 bp, Homo sapiens
ttcatgccagccctgtgtggta

SEQ ID NO: 7466828 - DNA, 22 bp, Homo sapiens
ttcatgccaccccttgaggagt

SEQ ID NO: 7466829 - DNA, 22 bp, Homo sapiens
ttcatgcttgttcctccacctg

SEQ ID NO: 7466830 - DNA, 20 bp, Homo sapiens
ttcatgctggaggggctggc

SEQ ID NO: 7466831 - DNA, 22 bp, Homo sapiens
ttcatgctgtgtctacaactta

SEQ ID NO: 7466832 - DNA, 22 bp, Homo sapiens
ttcagtgctaaaaagtctcaag

SEQ ID NO: 7466833 - DNA, 22 bp, Homo sapiens
ttcagtgcttacaggtttcttt

SEQ ID NO: 7466834 - DNA, 22 bp, Homo sapiens
ttcagtgctaaaaagtctcaag

SEQ ID NO: 7466835 - DNA, 22 bp, Homo sapiens
ttcagtgcttacaggtttcttt

SEQ ID NO: 7466836 - DNA, 22 bp, Homo sapiens
ttcagtggtttgatgatgtata

SEQ ID NO: 7466837 - DNA, 22 bp, Homo sapiens
ttcagtgcttacaggtttcttt

SEQ ID NO: 7466838 - DNA, 22 bp, Homo sapiens
ttcagtgcctgtccacagcttc

SEQ ID NO: 7466839 - DNA, 22 bp, Homo sapiens
ttcagtgcctgtccacagcttc

SEQ ID NO: 7466840 - DNA, 22 bp, Homo sapiens
ttcagtgcctgtccacagcttc

SEQ ID NO: 7466841 - DNA, 22 bp, Homo sapiens
ttcagtgccgtgctgggtcgct

SEQ ID NO: 7466842 - DNA, 22 bp, Homo sapiens
ttcagtgagtgaatgaatgaat

SEQ ID NO: 7466843 - DNA, 22 bp, Homo sapiens
ttcagtgcacagtactgagact

SEQ ID NO: 7466844 - DNA, 22 bp, Homo sapiens
ttcagtgagtgaatgaatgaat

SEQ ID NO: 7466845 - DNA, 22 bp, Homo sapiens
ttcagtgagtgaatgaatgaat

SEQ ID NO: 7466846 - DNA, 22 bp, Homo sapiens
ttcagtgacttacctggagcca

SEQ ID NO: 7466847 - DNA, 22 bp, Homo sapiens
ttcagtgacttacctggagcca

SEQ ID NO: 7466848 - DNA, 22 bp, Homo sapiens
ttcagtcttgttgaaaacttgg

SEQ ID NO: 7466849 - DNA, 22 bp, Homo sapiens
ttcagtgacatcatactggtat

SEQ ID NO: 7466850 - DNA, 22 bp, Homo sapiens
ttcagtgcagacgccgaagccc

SEQ ID NO: 7466851 - DNA, 22 bp, Homo sapiens
ttcagtgcacagtactgagact

SEQ ID NO: 7466852 - DNA, 22 bp, Homo sapiens
ttcagtgcagtcggaactactg

SEQ ID NO: 7466853 - DNA, 22 bp, Homo sapiens
ttcatcatcagaactgttcact

SEQ ID NO: 7466854 - DNA, 22 bp, Homo sapiens
ttcatcatctacaaccaggacc

SEQ ID NO: 7466855 - DNA, 18 bp, Homo sapiens
ttcatcatgactctgtgg

SEQ ID NO: 7466856 - DNA, 18 bp, Homo sapiens
ttcatcatgactctgtgg

SEQ ID NO: 7466857 - DNA, 18 bp, Homo sapiens
ttcatcatgactctgtgg

SEQ ID NO: 7466858 - DNA, 22 bp, Homo sapiens
ttcagtgtcacaagagcaagcc

SEQ ID NO: 7466859 - DNA, 22 bp, Homo sapiens
ttcagtgtcaatttttaaatat

SEQ ID NO: 7466860 - DNA, 23 bp, Homo sapiens
ttcatcagttgctgttgcagaac

SEQ ID NO: 7466861 - DNA, 22 bp, Homo sapiens
ttcagtgtcacaagagcaagcc

SEQ ID NO: 7466862 - DNA, 22 bp, Homo sapiens
ttcagtgtcacaagagcaagcc

SEQ ID NO: 7466863 - DNA, 22 bp, Homo sapiens
ttcagtgtcaatttttaaatat

SEQ ID NO: 7466864 - DNA, 22 bp, Homo sapiens
ttcagtgtcaatttttaaatat

SEQ ID NO: 7466865 - DNA, 22 bp, Homo sapiens
ttcagtgtatcttgtcagggag

SEQ ID NO: 7466866 - DNA, 22 bp, Homo sapiens
ttcagtgtcaatttttaaatat

SEQ ID NO: 7466867 - DNA, 22 bp, Homo sapiens
ttcagtgtcaatttttaaatat

SEQ ID NO: 7466868 - DNA, 22 bp, Homo sapiens
ttcagtgtatcttgtcagggag

SEQ ID NO: 7466869 - DNA, 22 bp, Homo sapiens
ttcagtgtatcttgtcagggag

SEQ ID NO: 7466870 - DNA, 22 bp, Homo sapiens
ttcagtgtatattttttgagta

SEQ ID NO: 7466871 - DNA, 22 bp, Homo sapiens
ttcagtgtatattttttgagta

SEQ ID NO: 7466872 - DNA, 22 bp, Homo sapiens
ttcagtgtatattttttgagta

SEQ ID NO: 7466873 - DNA, 22 bp, Homo sapiens
ttcagtgtacagtgaagggatt

SEQ ID NO: 7466874 - DNA, 22 bp, Homo sapiens
ttcagtgtacagtgaagggatt

SEQ ID NO: 7466875 - DNA, 22 bp, Homo sapiens
ttcagtggtttgatgatgtata

SEQ ID NO: 7466876 - DNA, 22 bp, Homo sapiens
ttcagtgtacagtgaagggatt

SEQ ID NO: 7466877 - DNA, 22 bp, Homo sapiens
ttcatgtaacttttcttctcca

SEQ ID NO: 7466878 - DNA, 22 bp, Homo sapiens
ttcatgtaacttttcttctcca

SEQ ID NO: 7466879 - DNA, 22 bp, Homo sapiens
ttcatgtaacttttcttctcca

SEQ ID NO: 7466880 - DNA, 20 bp, Homo sapiens
ttcatggtgtatttctttct

SEQ ID NO: 7466881 - DNA, 20 bp, Homo sapiens
ttcatggtgtatttctttct

SEQ ID NO: 7466882 - DNA, 22 bp, Homo sapiens
ttcatgtaataggatgtgttaa

SEQ ID NO: 7466883 - DNA, 20 bp, Homo sapiens
ttcatggtgtatttctttct

SEQ ID NO: 7466884 - DNA, 22 bp, Homo sapiens
ttcatgtaattccataaggtaa

SEQ ID NO: 7466885 - DNA, 22 bp, Homo sapiens
ttcatgtaataggatgtgttaa

SEQ ID NO: 7466886 - DNA, 22 bp, Homo sapiens
ttcatgtaataggatgtgttaa

SEQ ID NO: 7466887 - DNA, 22 bp, Homo sapiens
ttcatgtaattccataaggtaa

SEQ ID NO: 7466888 - DNA, 22 bp, Homo sapiens
ttcatgtaattccataaggtaa

SEQ ID NO: 7466889 - DNA, 20 bp, Homo sapiens
ttcatgggagcaaagaggcc

SEQ ID NO: 7466890 - DNA, 20 bp, Homo sapiens
ttcatgggagcaaagaggcc

SEQ ID NO: 7466891 - DNA, 20 bp, Homo sapiens
ttcatgggagcaaagaggcc

SEQ ID NO: 7466892 - DNA, 20 bp, Homo sapiens
ttcatgggagcaaagaggcc

SEQ ID NO: 7466893 - DNA, 20 bp, Homo sapiens
ttcatgggagcaaagaggcc

SEQ ID NO: 7466894 - DNA, 20 bp, Homo sapiens
ttcatgggagcaaagaggcc

SEQ ID NO: 7466895 - DNA, 22 bp, Homo sapiens
ttcatgtaggctgcaatgcaca

SEQ ID NO: 7466896 - DNA, 22 bp, Homo sapiens
ttcatgtagtgtaatgtcttca

SEQ ID NO: 7466897 - DNA, 22 bp, Homo sapiens
ttcatgtagtgtaatgtcttca

SEQ ID NO: 7466898 - DNA, 22 bp, Homo sapiens
ttcatgtagtgtaatgtcttca

SEQ ID NO: 7466899 - DNA, 22 bp, Homo sapiens
ttcatgtagtgtaatgtcttca

SEQ ID NO: 7466900 - DNA, 22 bp, Homo sapiens
ttcatgtatgaggccaatcttt

SEQ ID NO: 7466901 - DNA, 22 bp, Homo sapiens
ttcatgtaccgtgtaccaggca

SEQ ID NO: 7466902 - DNA, 22 bp, Homo sapiens
ttcatgtaggctgcaatgcaca

SEQ ID NO: 7466903 - DNA, 22 bp, Homo sapiens
ttcatgtatttatcatgtaaat

SEQ ID NO: 7466904 - DNA, 22 bp, Homo sapiens
ttcatgtatttatcatgtaaat

SEQ ID NO: 7466905 - DNA, 22 bp, Homo sapiens
ttcatgtattgcattgtgtcct

SEQ ID NO: 7466906 - DNA, 22 bp, Homo sapiens
ttcatgtatttatcatgtaaat

SEQ ID NO: 7466907 - DNA, 22 bp, Homo sapiens
ttcatgtagtgtaatgtcttca

SEQ ID NO: 7466908 - DNA, 22 bp, Homo sapiens
ttcatgtattgcattgtgtcct

SEQ ID NO: 7466909 - DNA, 22 bp, Homo sapiens
ttcatgtatttatcatgtaaat

SEQ ID NO: 7466910 - DNA, 22 bp, Homo sapiens
ttcatgtatttatcatgtaaat

SEQ ID NO: 7466911 - DNA, 22 bp, Homo sapiens
ttcatgtccagaggaagttgag

SEQ ID NO: 7466912 - DNA, 22 bp, Homo sapiens
ttcatgtctgccttttcaagtg

SEQ ID NO: 7466913 - DNA, 22 bp, Homo sapiens
ttcatgtctgccttttcaagtg

SEQ ID NO: 7466914 - DNA, 22 bp, Homo sapiens
ttcatgtttcaattgttaatgt

SEQ ID NO: 7466915 - DNA, 22 bp, Homo sapiens
ttcatgtttcaattgttaatgt

SEQ ID NO: 7466916 - DNA, 22 bp, Homo sapiens
ttcatgtttcaattgttaatgt

SEQ ID NO: 7466917 - DNA, 22 bp, Homo sapiens
ttcatgtttcaattgttaatgt

SEQ ID NO: 7466918 - DNA, 22 bp, Homo sapiens
ttcatgttgtagtatgtatcag

SEQ ID NO: 7466919 - DNA, 22 bp, Homo sapiens
ttcatgttgtagtatgtatcag

SEQ ID NO: 7466920 - DNA, 22 bp, Homo sapiens
ttcatgttgtagtatgtatcag

SEQ ID NO: 7466921 - DNA, 22 bp, Homo sapiens
ttcatgttgtagtatgtatcag

SEQ ID NO: 7466922 - DNA, 18 bp, Homo sapiens
ttcatgttggcttaggga

SEQ ID NO: 7466923 - DNA, 18 bp, Homo sapiens
ttcatgttggcttaggga

SEQ ID NO: 7466924 - DNA, 22 bp, Homo sapiens
ttcatgttggcatgtttttagg

SEQ ID NO: 7466925 - DNA, 22 bp, Homo sapiens
ttcatgttgtagtatgtatcag

SEQ ID NO: 7466926 - DNA, 22 bp, Homo sapiens
ttcatgttggattcactgtgag

SEQ ID NO: 7466927 - DNA, 22 bp, Homo sapiens
ttcatgttggcatgtttttagg

SEQ ID NO: 7466928 - DNA, 18 bp, Homo sapiens
ttcatgttggcttaggga

SEQ ID NO: 7466929 - DNA, 22 bp, Homo sapiens
ttccaatttgtggtgagttaat

SEQ ID NO: 7466930 - DNA, 22 bp, Homo sapiens
ttccaatttgtggtgagttaat

SEQ ID NO: 7466931 - DNA, 22 bp, Homo sapiens
ttccaatttgtggtgagttaat

SEQ ID NO: 7466932 - DNA, 22 bp, Homo sapiens
ttccaattgttctttggaatct

SEQ ID NO: 7466933 - DNA, 22 bp, Homo sapiens
ttcatgtttcctcttgtgctgc

SEQ ID NO: 7466934 - DNA, 22 bp, Homo sapiens
ttcatgtttcctcttgtgctgc

SEQ ID NO: 7466935 - DNA, 22 bp, Homo sapiens
ttcatgtttcctcttgtgctgc

SEQ ID NO: 7466936 - DNA, 22 bp, Homo sapiens
ttcatgtttcatttgttactat

SEQ ID NO: 7466937 - DNA, 22 bp, Homo sapiens
ttcatgtttcatttgttactat

SEQ ID NO: 7466938 - DNA, 22 bp, Homo sapiens
ttcatgttcatgcttaggaaaa

SEQ ID NO: 7466939 - DNA, 22 bp, Homo sapiens
ttcatgttcatgcttaggaaaa

SEQ ID NO: 7466940 - DNA, 22 bp, Homo sapiens
ttcatgttcatgcttaggaaaa

SEQ ID NO: 7466941 - DNA, 22 bp, Homo sapiens
ttcatgtgtttgttgtcaaggg

SEQ ID NO: 7466942 - DNA, 22 bp, Homo sapiens
ttcatgttcatatgtgtatatc

SEQ ID NO: 7466943 - DNA, 22 bp, Homo sapiens
ttcatgtgtctgtagcacatat

SEQ ID NO: 7466944 - DNA, 22 bp, Homo sapiens
ttcatgtgtctgtagcacatat

SEQ ID NO: 7466945 - DNA, 22 bp, Homo sapiens
ttcatgtgtctgtagcacatat

SEQ ID NO: 7466946 - DNA, 23 bp, Homo sapiens
ttcatgttccctccttctggtga

SEQ ID NO: 7466947 - DNA, 22 bp, Homo sapiens
ttcatgttcatgcttaggaaaa

SEQ ID NO: 7466948 - DNA, 22 bp, Homo sapiens
ttcatgttcatgcttaggaaaa

SEQ ID NO: 7466949 - DNA, 22 bp, Homo sapiens
ttcatgttggcatgtttttagg

SEQ ID NO: 7466950 - DNA, 22 bp, Homo sapiens
ttcatgttcatgcttaggaaaa

SEQ ID NO: 7466951 - DNA, 23 bp, Homo sapiens
ttcatgttccctccttctggtga

SEQ ID NO: 7466952 - DNA, 23 bp, Homo sapiens
ttcatgttccctccttctggtga

SEQ ID NO: 7466953 - DNA, 22 bp, Homo sapiens
ttcatgtgccagagctgaaaat

SEQ ID NO: 7466954 - DNA, 22 bp, Homo sapiens
ttcatgtgtatggaacattttt

SEQ ID NO: 7466955 - DNA, 22 bp, Homo sapiens
ttcatgtgtatggaacattttt

SEQ ID NO: 7466956 - DNA, 22 bp, Homo sapiens
ttcatgtgtatggaacattttt

SEQ ID NO: 7466957 - DNA, 23 bp, Homo sapiens
ttcatgtggacctagaggcctgt

SEQ ID NO: 7466958 - DNA, 23 bp, Homo sapiens
ttcatgtggacctagaggcctgt

SEQ ID NO: 7466959 - DNA, 22 bp, Homo sapiens
ttcagtatccctgcttggacag

SEQ ID NO: 7466960 - DNA, 22 bp, Homo sapiens
ttcagtatacttcataacattt

SEQ ID NO: 7466961 - DNA, 22 bp, Homo sapiens
ttcagtatacttcataacattt

SEQ ID NO: 7466962 - DNA, 22 bp, Homo sapiens
ttcagtatacttcataacattt

SEQ ID NO: 7466963 - DNA, 22 bp, Homo sapiens
ttcagtatacttcataacattt

SEQ ID NO: 7466964 - DNA, 22 bp, Homo sapiens
ttcaggtttttaagttctgcct

SEQ ID NO: 7466965 - DNA, 22 bp, Homo sapiens
ttcagtagggccctcacacagt

SEQ ID NO: 7466966 - DNA, 22 bp, Homo sapiens
ttcagtatacattatctaattg

SEQ ID NO: 7466967 - DNA, 22 bp, Homo sapiens
ttcagtatacattatctaattg

SEQ ID NO: 7466968 - DNA, 22 bp, Homo sapiens
ttcagtataaaatcaaagtgat

SEQ ID NO: 7466969 - DNA, 22 bp, Homo sapiens
ttcagtagggccctcacacagt

SEQ ID NO: 7466970 - DNA, 22 bp, Homo sapiens
ttcagtatgattcctccagtag

SEQ ID NO: 7466971 - DNA, 21 bp, Homo sapiens
ttcagtatgcgtcatgctgtt

SEQ ID NO: 7466972 - DNA, 21 bp, Homo sapiens
ttcagtatgcgtcatgctgtt

SEQ ID NO: 7466973 - DNA, 22 bp, Homo sapiens
ttcagtatgctgaatgattttt

SEQ ID NO: 7466974 - DNA, 22 bp, Homo sapiens
ttcagtatgattcctccagtag

SEQ ID NO: 7466975 - DNA, 22 bp, Homo sapiens
ttcagtatccctgcttggacag

SEQ ID NO: 7466976 - DNA, 22 bp, Homo sapiens
ttcagtatacttcataacattt

SEQ ID NO: 7466977 - DNA, 22 bp, Homo sapiens
ttcagtatgattcctccagtag

SEQ ID NO: 7466978 - DNA, 22 bp, Homo sapiens
ttcagtatgtgtaaactacttt

SEQ ID NO: 7466979 - DNA, 22 bp, Homo sapiens
ttcagtatgtgtaaactacttt

SEQ ID NO: 7466980 - DNA, 22 bp, Homo sapiens
ttcagtatgctgaatgattttt

SEQ ID NO: 7466981 - DNA, 22 bp, Homo sapiens
ttcagtatgctgaatgattttt

SEQ ID NO: 7466982 - DNA, 22 bp, Homo sapiens
ttcagtctcaagtgctgctcac

SEQ ID NO: 7466983 - DNA, 22 bp, Homo sapiens
ttcagtctcctcattttacaaa

SEQ ID NO: 7466984 - DNA, 22 bp, Homo sapiens
ttcagtctcctcattttacaaa

SEQ ID NO: 7466985 - DNA, 22 bp, Homo sapiens
ttcagtctcaagtgctgctcac

SEQ ID NO: 7466986 - DNA, 22 bp, Homo sapiens
ttcagtctcatggatgtgaaat

SEQ ID NO: 7466987 - DNA, 22 bp, Homo sapiens
ttcagtctcatggatgtgaaat

SEQ ID NO: 7466988 - DNA, 22 bp, Homo sapiens
ttcagtctcctcattttacaaa

SEQ ID NO: 7466989 - DNA, 22 bp, Homo sapiens
ttcagtctcctcattttacaaa

SEQ ID NO: 7466990 - DNA, 22 bp, Homo sapiens
ttcagtctgatctgagctgaga

SEQ ID NO: 7466991 - DNA, 22 bp, Homo sapiens
ttcagtcttgttgaaaacttgg

SEQ ID NO: 7466992 - DNA, 22 bp, Homo sapiens
ttcagtcagtgactaagcagtt

SEQ ID NO: 7466993 - DNA, 22 bp, Homo sapiens
ttcagtcctcacaacctcacta

SEQ ID NO: 7466994 - DNA, 22 bp, Homo sapiens
ttcagtccatcaggcgtggcat

SEQ ID NO: 7466995 - DNA, 22 bp, Homo sapiens
ttcagtccatcaggcgtggcat

SEQ ID NO: 7466996 - DNA, 22 bp, Homo sapiens
ttcagtatttcatgactttctt

SEQ ID NO: 7466997 - DNA, 22 bp, Homo sapiens
ttcagtattcaaatatgtctta

SEQ ID NO: 7466998 - DNA, 22 bp, Homo sapiens
ttcagtatttgaaaccataggc

SEQ ID NO: 7466999 - DNA, 22 bp, Homo sapiens
ttcagtattcaaatatgtctta

SEQ ID NO: 7467000 - DNA, 22 bp, Homo sapiens
ttcagtatgttggacgttatgt

SEQ ID NO: 7467001 - DNA, 22 bp, Homo sapiens
ttcagtattcaaatatgtctta

SEQ ID NO: 7467002 - DNA, 22 bp, Homo sapiens
ttcagtattcaaatatgtctta

SEQ ID NO: 7467003 - DNA, 22 bp, Homo sapiens
ttcaggagctggctgcgaagga

SEQ ID NO: 7467004 - DNA, 22 bp, Homo sapiens
ttcaggagctagggatgtgaaa

SEQ ID NO: 7467005 - DNA, 22 bp, Homo sapiens
ttcaggagctagggatgtgaaa

SEQ ID NO: 7467006 - DNA, 22 bp, Homo sapiens
ttcaggagctagggatgtgaaa

SEQ ID NO: 7467007 - DNA, 22 bp, Homo sapiens
ttcaggagaattccaagaagta

SEQ ID NO: 7467008 - DNA, 22 bp, Homo sapiens
ttcaggagaaagttcagtactt

SEQ ID NO: 7467009 - DNA, 22 bp, Homo sapiens
ttcaggagaaagttcagtactt

SEQ ID NO: 7467010 - DNA, 22 bp, Homo sapiens
ttcaggagaattccaagaagta

SEQ ID NO: 7467011 - DNA, 22 bp, Homo sapiens
ttcaggagaattccaagaagta

SEQ ID NO: 7467012 - DNA, 22 bp, Homo sapiens
ttcaggagaattccaagaagta

SEQ ID NO: 7467013 - DNA, 22 bp, Homo sapiens
ttcaggagctggctgcgaagga

SEQ ID NO: 7467014 - DNA, 22 bp, Homo sapiens
ttcaggaggtgagcaagaaggg

SEQ ID NO: 7467015 - DNA, 22 bp, Homo sapiens
ttcaggaggtgagcaagaaggg

SEQ ID NO: 7467016 - DNA, 22 bp, Homo sapiens
ttcaggaggtgagcaagaaggg

SEQ ID NO: 7467017 - DNA, 22 bp, Homo sapiens
ttcaggaggtgagcaagaaggg

SEQ ID NO: 7467018 - DNA, 22 bp, Homo sapiens
ttcaggagtgtcaggagtgcct

SEQ ID NO: 7467019 - DNA, 20 bp, Homo sapiens
ttcagggctttggggacacc

SEQ ID NO: 7467020 - DNA, 22 bp, Homo sapiens
ttcagggtctagagtatctacc

SEQ ID NO: 7467021 - DNA, 22 bp, Homo sapiens
ttcagggtctagagtatctacc

SEQ ID NO: 7467022 - DNA, 20 bp, Homo sapiens
ttcagggtgagagttctagg

SEQ ID NO: 7467023 - DNA, 22 bp, Homo sapiens
ttcaggagtgtcaggagtgcct

SEQ ID NO: 7467024 - DNA, 20 bp, Homo sapiens
ttcagggctttggggacacc

SEQ ID NO: 7467025 - DNA, 20 bp, Homo sapiens
ttcagggctttggggacacc

SEQ ID NO: 7467026 - DNA, 22 bp, Homo sapiens
ttcaggtgtggccagaggagaa

SEQ ID NO: 7467027 - DNA, 22 bp, Homo sapiens
ttcagtaaaacactgcaatgtc

SEQ ID NO: 7467028 - DNA, 22 bp, Homo sapiens
ttcaggtttttaagttctgcct

SEQ ID NO: 7467029 - DNA, 22 bp, Homo sapiens
ttcagtaagcacttctagagct

SEQ ID NO: 7467030 - DNA, 22 bp, Homo sapiens
ttcagtaaaacactgcaatgtc

SEQ ID NO: 7467031 - DNA, 22 bp, Homo sapiens
ttcagtaaggataataaacaga

SEQ ID NO: 7467032 - DNA, 22 bp, Homo sapiens
ttcagtaaggataataaacaga

SEQ ID NO: 7467033 - DNA, 22 bp, Homo sapiens
ttcagtaaggataataaacaga

SEQ ID NO: 7467034 - DNA, 22 bp, Homo sapiens
ttcaggtgtcaaggataggctg

SEQ ID NO: 7467035 - DNA, 22 bp, Homo sapiens
ttcaggtgtcaaggataggctg

SEQ ID NO: 7467036 - DNA, 22 bp, Homo sapiens
ttcaggtgggccttttgagcat

SEQ ID NO: 7467037 - DNA, 22 bp, Homo sapiens
ttcaggtgggccttttgagcat

SEQ ID NO: 7467038 - DNA, 21 bp, Homo sapiens
ttcagggtttcacaatactaa

SEQ ID NO: 7467039 - DNA, 20 bp, Homo sapiens
ttcagggtgagagttctagg

SEQ ID NO: 7467040 - DNA, 22 bp, Homo sapiens
ttcagggttacagttggctctg

SEQ ID NO: 7467041 - DNA, 22 bp, Homo sapiens
ttcacattctcacaagaggaaa

SEQ ID NO: 7467042 - DNA, 22 bp, Homo sapiens
ttcacattccgcggctattttc

SEQ ID NO: 7467043 - DNA, 22 bp, Homo sapiens
ttcacattccgcggctattttc

SEQ ID NO: 7467044 - DNA, 22 bp, Homo sapiens
ttcacattccgcggctattttc

SEQ ID NO: 7467045 - DNA, 19 bp, Homo sapiens
ttcacattggaagaagtag

SEQ ID NO: 7467046 - DNA, 22 bp, Homo sapiens
ttcaggactaggggcttcaagg

SEQ ID NO: 7467047 - DNA, 19 bp, Homo sapiens
ttcacattggaagaagtag

SEQ ID NO: 7467048 - DNA, 19 bp, Homo sapiens
ttcacattggaagaagtag

SEQ ID NO: 7467049 - DNA, 19 bp, Homo sapiens
ttcacattggaagaagtag

SEQ ID NO: 7467050 - DNA, 19 bp, Homo sapiens
ttcacattggaagaagtag

SEQ ID NO: 7467051 - DNA, 22 bp, Homo sapiens
ttcacattgaaggtgctttctt

SEQ ID NO: 7467052 - DNA, 22 bp, Homo sapiens
ttcacattgaaggtgctttctt

SEQ ID NO: 7467053 - DNA, 22 bp, Homo sapiens
ttcacattgaaggtgctttctt

SEQ ID NO: 7467054 - DNA, 22 bp, Homo sapiens
ttcacattccgcggctattttc

SEQ ID NO: 7467055 - DNA, 22 bp, Homo sapiens
ttcacattcagaaaaagcccgt

SEQ ID NO: 7467056 - DNA, 22 bp, Homo sapiens
ttcacattcagaaaaagcccgt

SEQ ID NO: 7467057 - DNA, 22 bp, Homo sapiens
ttcacattcagaaaaagcccgt

SEQ ID NO: 7467058 - DNA, 22 bp, Homo sapiens
ttcacattataatcagttctgc

SEQ ID NO: 7467059 - DNA, 22 bp, Homo sapiens
ttcacattataatcagttctgc

SEQ ID NO: 7467060 - DNA, 22 bp, Homo sapiens
ttcacattatcaggattgtttc

SEQ ID NO: 7467061 - DNA, 22 bp, Homo sapiens
ttcacattatcaggattgtttc

SEQ ID NO: 7467062 - DNA, 22 bp, Homo sapiens
ttcacattatcaggattgtttc

SEQ ID NO: 7467063 - DNA, 22 bp, Homo sapiens
ttcacattataatcagttctgc

SEQ ID NO: 7467064 - DNA, 22 bp, Homo sapiens
ttcacattataatcagttctgc

SEQ ID NO: 7467065 - DNA, 22 bp, Homo sapiens
ttcacattataatcagttctgc

SEQ ID NO: 7467066 - DNA, 22 bp, Homo sapiens
ttcacattagtggttctatata

SEQ ID NO: 7467067 - DNA, 22 bp, Homo sapiens
ttcacattataatcagttctgc

SEQ ID NO: 7467068 - DNA, 22 bp, Homo sapiens
ttcacattagtggttctatata

SEQ ID NO: 7467069 - DNA, 22 bp, Homo sapiens
ttcacattagtggttctatata

SEQ ID NO: 7467070 - DNA, 22 bp, Homo sapiens
ttcacagtggctaagttctgca

SEQ ID NO: 7467071 - DNA, 22 bp, Homo sapiens
ttcacagtggctaagttctgca

SEQ ID NO: 7467072 - DNA, 22 bp, Homo sapiens
ttcacagtggctaagttctgca

SEQ ID NO: 7467073 - DNA, 22 bp, Homo sapiens
ttcacagtggctaagttctgca

SEQ ID NO: 7467074 - DNA, 22 bp, Homo sapiens
ttcacagtggctaagttctgca

SEQ ID NO: 7467075 - DNA, 22 bp, Homo sapiens
ttcacagtggctaagttctgca

SEQ ID NO: 7467076 - DNA, 22 bp, Homo sapiens
ttcacagtggctaagttctgca

SEQ ID NO: 7467077 - DNA, 22 bp, Homo sapiens
ttcacagtggctaagttctgca

SEQ ID NO: 7467078 - DNA, 22 bp, Homo sapiens
ttcacagtggccctctctgagt

SEQ ID NO: 7467079 - DNA, 21 bp, Homo sapiens
ttcacagtggataactttctg

SEQ ID NO: 7467080 - DNA, 21 bp, Homo sapiens
ttcacagtggataactttctg

SEQ ID NO: 7467081 - DNA, 21 bp, Homo sapiens
ttcacagtggataactttctg

SEQ ID NO: 7467082 - DNA, 22 bp, Homo sapiens
ttcacagtgctgcacctggctt

SEQ ID NO: 7467083 - DNA, 22 bp, Homo sapiens
ttcacagtgctgcacctggctt

SEQ ID NO: 7467084 - DNA, 22 bp, Homo sapiens
ttcacagtgctgcacctggctt

SEQ ID NO: 7467085 - DNA, 22 bp, Homo sapiens
ttcacagtggccctctctgagt

SEQ ID NO: 7467086 - DNA, 22 bp, Homo sapiens
ttcacagtggccctctctgagt

SEQ ID NO: 7467087 - DNA, 21 bp, Homo sapiens
ttcacagtggataactttctg

SEQ ID NO: 7467088 - DNA, 22 bp, Homo sapiens
ttcacagtggccctctctgagt

SEQ ID NO: 7467089 - DNA, 22 bp, Homo sapiens
ttcacagtggccctctctgagt

SEQ ID NO: 7467090 - DNA, 22 bp, Homo sapiens
ttcacagtggctgtgccatttg

SEQ ID NO: 7467091 - DNA, 22 bp, Homo sapiens
ttcacagtggctgtgccatttg

SEQ ID NO: 7467092 - DNA, 22 bp, Homo sapiens
ttcacagtggctgtgccatttg

SEQ ID NO: 7467093 - DNA, 22 bp, Homo sapiens
ttcacagtggctgacaggctgg

SEQ ID NO: 7467094 - DNA, 22 bp, Homo sapiens
ttcacagtggctgacaggctgg

SEQ ID NO: 7467095 - DNA, 22 bp, Homo sapiens
ttcacagtggctgacaggctgg

SEQ ID NO: 7467096 - DNA, 22 bp, Homo sapiens
ttcacagtggctaagttctgca

SEQ ID NO: 7467097 - DNA, 22 bp, Homo sapiens
ttcacagtggctgacaggctgg

SEQ ID NO: 7467098 - DNA, 22 bp, Homo sapiens
ttcacagtggctgacaggctgg

SEQ ID NO: 7467099 - DNA, 22 bp, Homo sapiens
ttcacagtggctgacaggctgg

SEQ ID NO: 7467100 - DNA, 22 bp, Homo sapiens
ttcacattagtggttctatata

SEQ ID NO: 7467101 - DNA, 22 bp, Homo sapiens
ttcacattagtggttctatata

SEQ ID NO: 7467102 - DNA, 22 bp, Homo sapiens
ttcacattagtggttctatata

SEQ ID NO: 7467103 - DNA, 22 bp, Homo sapiens
ttcacattagccaagagatgga

SEQ ID NO: 7467104 - DNA, 22 bp, Homo sapiens
ttcacagtggcttaggctatgg

SEQ ID NO: 7467105 - DNA, 22 bp, Homo sapiens
ttcacattagccaagagatgga

SEQ ID NO: 7467106 - DNA, 22 bp, Homo sapiens
ttcacattagccaagagatgga

SEQ ID NO: 7467107 - DNA, 22 bp, Homo sapiens
ttcacattacaaggccatattt

SEQ ID NO: 7467108 - DNA, 22 bp, Homo sapiens
ttcacattacaaggccatattt

SEQ ID NO: 7467109 - DNA, 22 bp, Homo sapiens
ttcaagaagcccaaagactagc

SEQ ID NO: 7467110 - DNA, 22 bp, Homo sapiens
ttcaatgcatatagatatagaa

SEQ ID NO: 7467111 - DNA, 22 bp, Homo sapiens
ttcaagaagcccaaagactagc

SEQ ID NO: 7467112 - DNA, 22 bp, Homo sapiens
ttcaagaagcccaaagactagc

SEQ ID NO: 7467113 - DNA, 22 bp, Homo sapiens
ttcaagaagcccaaagactagc

SEQ ID NO: 7467114 - DNA, 22 bp, Homo sapiens
ttcaagaaagagtggctattcc

SEQ ID NO: 7467115 - DNA, 22 bp, Homo sapiens
ttcaagaaagagtggctattcc

SEQ ID NO: 7467116 - DNA, 22 bp, Homo sapiens
ttcaagaaagagtggctattcc

SEQ ID NO: 7467117 - DNA, 22 bp, Homo sapiens
ttcaagaagcccaaagactagc

SEQ ID NO: 7467118 - DNA, 22 bp, Homo sapiens
ttcaatgtggttataataacta

SEQ ID NO: 7467119 - DNA, 22 bp, Homo sapiens
ttcaatgttaagaagaatatgt

SEQ ID NO: 7467120 - DNA, 22 bp, Homo sapiens
ttcaatgttaagaagaatatgt

SEQ ID NO: 7467121 - DNA, 22 bp, Homo sapiens
ttcaatgttaagaagaatatgt

SEQ ID NO: 7467122 - DNA, 22 bp, Homo sapiens
ttcaatgtctatgtacatttta

SEQ ID NO: 7467123 - DNA, 22 bp, Homo sapiens
ttcaatgtggttataataacta

SEQ ID NO: 7467124 - DNA, 22 bp, Homo sapiens
ttcaatgtggttataataacta

SEQ ID NO: 7467125 - DNA, 22 bp, Homo sapiens
ttcaatgtggttataataacta

SEQ ID NO: 7467126 - DNA, 22 bp, Homo sapiens
ttcaatgcctttctctaagctc

SEQ ID NO: 7467127 - DNA, 22 bp, Homo sapiens
ttcaatgtctatgtacatttta

SEQ ID NO: 7467128 - DNA, 22 bp, Homo sapiens
ttcaatgtctatgtacatttta

SEQ ID NO: 7467129 - DNA, 22 bp, Homo sapiens
ttcaatgtctatgtacatttta

SEQ ID NO: 7467130 - DNA, 22 bp, Homo sapiens
ttcaatgcctagaacttagcat

SEQ ID NO: 7467131 - DNA, 22 bp, Homo sapiens
ttcaatttagtgatgttgttgg

SEQ ID NO: 7467132 - DNA, 22 bp, Homo sapiens
ttcaatttagtgatgttgttgg

SEQ ID NO: 7467133 - DNA, 22 bp, Homo sapiens
ttcaatttagtgatgttgttgg

SEQ ID NO: 7467134 - DNA, 22 bp, Homo sapiens
ttcaatttagtgatgttgttgg

SEQ ID NO: 7467135 - DNA, 22 bp, Homo sapiens
ttcaattctgctctgatcttag

SEQ ID NO: 7467136 - DNA, 22 bp, Homo sapiens
ttcaattctgctctgatcttag

SEQ ID NO: 7467137 - DNA, 22 bp, Homo sapiens
ttcaattctgatgaaggcaata

SEQ ID NO: 7467138 - DNA, 22 bp, Homo sapiens
ttcaatgtttcttatcaagttg

SEQ ID NO: 7467139 - DNA, 22 bp, Homo sapiens
ttcaatgtttcttatcaagttg

SEQ ID NO: 7467140 - DNA, 22 bp, Homo sapiens
ttcaatgtttcttatcaagttg

SEQ ID NO: 7467141 - DNA, 22 bp, Homo sapiens
ttcaatgtttcttatcaagttg

SEQ ID NO: 7467142 - DNA, 22 bp, Homo sapiens
ttcaattatccctgcaactgag

SEQ ID NO: 7467143 - DNA, 22 bp, Homo sapiens
ttcaattctaaactaatattct

SEQ ID NO: 7467144 - DNA, 22 bp, Homo sapiens
ttcaattcaattctaaatatat

SEQ ID NO: 7467145 - DNA, 22 bp, Homo sapiens
ttcaattcaattctaaatatat

SEQ ID NO: 7467146 - DNA, 22 bp, Homo sapiens
ttcaattctaaactaatattct

SEQ ID NO: 7467147 - DNA, 22 bp, Homo sapiens
ttcaatttgtgctaaggcaccg

SEQ ID NO: 7467148 - DNA, 22 bp, Homo sapiens
ttcaatttcataatatctagct

SEQ ID NO: 7467149 - DNA, 22 bp, Homo sapiens
ttcaatttcataatatctagct

SEQ ID NO: 7467150 - DNA, 22 bp, Homo sapiens
ttcaatttcataatatctagct

SEQ ID NO: 7467151 - DNA, 22 bp, Homo sapiens
ttcaatttcataatatctagct

SEQ ID NO: 7467152 - DNA, 22 bp, Homo sapiens
ttcaatttcataatatctagct

SEQ ID NO: 7467153 - DNA, 22 bp, Homo sapiens
ttcaatttcataatatctagct

SEQ ID NO: 7467154 - DNA, 22 bp, Homo sapiens
ttcaatttcataatatctagct

SEQ ID NO: 7467155 - DNA, 22 bp, Homo sapiens
ttcacaaaaatgctgaacagtt

SEQ ID NO: 7467156 - DNA, 22 bp, Homo sapiens
ttcacaaaaatgctgaacagtt

SEQ ID NO: 7467157 - DNA, 22 bp, Homo sapiens
ttcacaaaaatgctgaacagtt

SEQ ID NO: 7467158 - DNA, 22 bp, Homo sapiens
ttcacaaaaatgctgaacagtt

SEQ ID NO: 7467159 - DNA, 22 bp, Homo sapiens
ttcaattttgcagaggaatgca

SEQ ID NO: 7467160 - DNA, 22 bp, Homo sapiens
ttcaattttgcagaggaatgca

SEQ ID NO: 7467161 - DNA, 22 bp, Homo sapiens
ttcaattttgcagaggaatgca

SEQ ID NO: 7467162 - DNA, 22 bp, Homo sapiens
ttcaatttgtgctaaggcaccg

SEQ ID NO: 7467163 - DNA, 22 bp, Homo sapiens
ttcaatttgtgctaaggcaccg

SEQ ID NO: 7467164 - DNA, 22 bp, Homo sapiens
ttcaatttgtgctaaggcaccg

SEQ ID NO: 7467165 - DNA, 22 bp, Homo sapiens
ttcacaaaatggtttgttgatg

SEQ ID NO: 7467166 - DNA, 22 bp, Homo sapiens
ttcacaaaatggtttgttgatg

SEQ ID NO: 7467167 - DNA, 22 bp, Homo sapiens
ttcacaaaatggtttgttgatg

SEQ ID NO: 7467168 - DNA, 22 bp, Homo sapiens
ttcacaaacaccagaatggcta

SEQ ID NO: 7467169 - DNA, 22 bp, Homo sapiens
ttcacaaacaccagaatggcta

SEQ ID NO: 7467170 - DNA, 22 bp, Homo sapiens
ttcacaaacaccagaatggcta

SEQ ID NO: 7467171 - DNA, 22 bp, Homo sapiens
ttcacaaacaccagaatggcta

SEQ ID NO: 7467172 - DNA, 22 bp, Homo sapiens
ttcacaaaacactattttctgg

SEQ ID NO: 7467173 - DNA, 22 bp, Homo sapiens
ttcacaaaacactattttctgg

SEQ ID NO: 7467174 - DNA, 22 bp, Homo sapiens
ttcacaaaacactattttctgg

SEQ ID NO: 7467175 - DNA, 22 bp, Homo sapiens
ttcacaaaacactattttctgg

SEQ ID NO: 7467176 - DNA, 22 bp, Homo sapiens
ttcacaaaaatgctgaacagtt

SEQ ID NO: 7467177 - DNA, 22 bp, Homo sapiens
ttcacaaagctggagcatttcc

SEQ ID NO: 7467178 - DNA, 22 bp, Homo sapiens
ttcacaaagctggagcatttcc

SEQ ID NO: 7467179 - DNA, 22 bp, Homo sapiens
ttcacaaagctggagcatttcc

SEQ ID NO: 7467180 - DNA, 22 bp, Homo sapiens
ttcacaaagctggagcatttcc

SEQ ID NO: 7467181 - DNA, 22 bp, Homo sapiens
ttcacaaagctggagcatttcc

SEQ ID NO: 7467182 - DNA, 22 bp, Homo sapiens
ttcacaaagctggagcatttcc

SEQ ID NO: 7467183 - DNA, 22 bp, Homo sapiens
ttcacaaagctggagcatttcc

SEQ ID NO: 7467184 - DNA, 22 bp, Homo sapiens
ttcacaaacttcatgatggcac

SEQ ID NO: 7467185 - DNA, 22 bp, Homo sapiens
ttcacaaacttcatgatggcac

SEQ ID NO: 7467186 - DNA, 22 bp, Homo sapiens
ttcacaaacttcatgatggcac

SEQ ID NO: 7467187 - DNA, 22 bp, Homo sapiens
ttcacaaagctggagcatttcc

SEQ ID NO: 7467188 - DNA, 22 bp, Homo sapiens
ttcacaaagctggagcatttcc

SEQ ID NO: 7467189 - DNA, 22 bp, Homo sapiens
ttcacaaagctggagcatttcc

SEQ ID NO: 7467190 - DNA, 22 bp, Homo sapiens
ttcacaaagctggttccttctg

SEQ ID NO: 7467191 - DNA, 20 bp, Homo sapiens
ttcacaactctaggggaggt

SEQ ID NO: 7467192 - DNA, 22 bp, Homo sapiens
ttcacaactgccatagccagtg

SEQ ID NO: 7467193 - DNA, 21 bp, Homo sapiens
ttcacaacctgctttagtggg

SEQ ID NO: 7467194 - DNA, 22 bp, Homo sapiens
ttcacaataatgtccatcctct

SEQ ID NO: 7467195 - DNA, 22 bp, Homo sapiens
ttcacaataatgtccatcctct

SEQ ID NO: 7467196 - DNA, 19 bp, Homo sapiens
ttcacaagtgatgtctctc

SEQ ID NO: 7467197 - DNA, 22 bp, Homo sapiens
ttcacaagtgtgaaggcagagc

SEQ ID NO: 7467198 - DNA, 22 bp, Homo sapiens
ttcacaagtgtgaaggcagagc

SEQ ID NO: 7467199 - DNA, 22 bp, Homo sapiens
ttcacaagtgtgaaggcagagc

SEQ ID NO: 7467200 - DNA, 22 bp, Homo sapiens
ttcacaatagctggcatcatct

SEQ ID NO: 7467201 - DNA, 22 bp, Homo sapiens
ttcacaataggagcatgcaaat

SEQ ID NO: 7467202 - DNA, 22 bp, Homo sapiens
ttcacaatagctggcatcatct

SEQ ID NO: 7467203 - DNA, 22 bp, Homo sapiens
ttcacaatagctggcatcatct

SEQ ID NO: 7467204 - DNA, 19 bp, Homo sapiens
ttcacaagtgatgtctctc

SEQ ID NO: 7467205 - DNA, 19 bp, Homo sapiens
ttcacaagtgatgtctctc

SEQ ID NO: 7467206 - DNA, 22 bp, Homo sapiens
ttcacaagtctggaatatgcta

SEQ ID NO: 7467207 - DNA, 22 bp, Homo sapiens
ttcacaagtctggaatatgcta

SEQ ID NO: 7467208 - DNA, 18 bp, Homo sapiens
ttcacaagggcttggttt

SEQ ID NO: 7467209 - DNA, 22 bp, Homo sapiens
ttcacaagaggcccaggggagc

SEQ ID NO: 7467210 - DNA, 22 bp, Homo sapiens
ttcacaagtcattagctgcata

SEQ ID NO: 7467211 - DNA, 22 bp, Homo sapiens
ttcacaagaggcccaggggagc

SEQ ID NO: 7467212 - DNA, 22 bp, Homo sapiens
ttcacagtgagctatgtcttgt

SEQ ID NO: 7467213 - DNA, 22 bp, Homo sapiens
ttcacagtgagctatgtcttgt

SEQ ID NO: 7467214 - DNA, 22 bp, Homo sapiens
ttcacagtgagctatgtcttgt

SEQ ID NO: 7467215 - DNA, 22 bp, Homo sapiens
ttcacagtgagctatgtcttgt

SEQ ID NO: 7467216 - DNA, 22 bp, Homo sapiens
ttcacagtctatcttggttttt

SEQ ID NO: 7467217 - DNA, 22 bp, Homo sapiens
ttcacagtgagctatgtcttgt

SEQ ID NO: 7467218 - DNA, 22 bp, Homo sapiens
ttcacagtcacccttctccatg

SEQ ID NO: 7467219 - DNA, 22 bp, Homo sapiens
ttcacagtgctcacagttcagt

SEQ ID NO: 7467220 - DNA, 22 bp, Homo sapiens
ttcacagtgctgcacctggctt

SEQ ID NO: 7467221 - DNA, 22 bp, Homo sapiens
ttcacagtgctgcacctggctt

SEQ ID NO: 7467222 - DNA, 22 bp, Homo sapiens
ttcacagtgctgcacctggctt

SEQ ID NO: 7467223 - DNA, 22 bp, Homo sapiens
ttcacagtgctgcacctggctt

SEQ ID NO: 7467224 - DNA, 22 bp, Homo sapiens
ttcacagtgccagggggcaggc

SEQ ID NO: 7467225 - DNA, 22 bp, Homo sapiens
ttcacagtgctcacagttcagt

SEQ ID NO: 7467226 - DNA, 22 bp, Homo sapiens
ttcacagtgctcacagttcagt

SEQ ID NO: 7467227 - DNA, 22 bp, Homo sapiens
ttcacaggtgagcattaggccg

SEQ ID NO: 7467228 - DNA, 22 bp, Homo sapiens
ttcacagtaacagggggatatg

SEQ ID NO: 7467229 - DNA, 22 bp, Homo sapiens
ttcacagtaagtaggatagttg

SEQ ID NO: 7467230 - DNA, 22 bp, Homo sapiens
ttcacagtaagtaggatagttg

SEQ ID NO: 7467231 - DNA, 22 bp, Homo sapiens
ttcacagtaatgtgcccaggta

SEQ ID NO: 7467232 - DNA, 22 bp, Homo sapiens
ttcacagtaatgtgcccaggta

SEQ ID NO: 7467233 - DNA, 22 bp, Homo sapiens
ttcacagtaatgtgcccaggta

SEQ ID NO: 7467234 - DNA, 22 bp, Homo sapiens
ttcacagtaagtaggatagttg

SEQ ID NO: 7467235 - DNA, 22 bp, Homo sapiens
ttcacagtcacccttctccatg

SEQ ID NO: 7467236 - DNA, 22 bp, Homo sapiens
ttcacagtcacccttctccatg

SEQ ID NO: 7467237 - DNA, 22 bp, Homo sapiens
ttcacagtcacccttctccatg

SEQ ID NO: 7467238 - DNA, 22 bp, Homo sapiens
ttcacagtataggtttccagcg

SEQ ID NO: 7467239 - DNA, 22 bp, Homo sapiens
ttcacagtaacagggggatatg

SEQ ID NO: 7467240 - DNA, 22 bp, Homo sapiens
ttcacagtataggtttccagcg

SEQ ID NO: 7467241 - DNA, 22 bp, Homo sapiens
ttcacagtataggtttccagcg

SEQ ID NO: 7467242 - DNA, 22 bp, Homo sapiens
ttcacagtataggtttccagcg

SEQ ID NO: 7467243 - DNA, 22 bp, Homo sapiens
ttcacagtataggtttccagcg

SEQ ID NO: 7467244 - DNA, 22 bp, Homo sapiens
ttcacagtaatgtgcccaggta

SEQ ID NO: 7467245 - DNA, 22 bp, Homo sapiens
ttcaacactgtttggctgagta

SEQ ID NO: 7467246 - DNA, 22 bp, Homo sapiens
ttcaacagacccttctttcttt

SEQ ID NO: 7467247 - DNA, 22 bp, Homo sapiens
ttcaacagatatttattgagca

SEQ ID NO: 7467248 - DNA, 22 bp, Homo sapiens
ttcaacagggcatgatgagacg

SEQ ID NO: 7467249 - DNA, 22 bp, Homo sapiens
ttcaacaggaaagcactttaca

SEQ ID NO: 7467250 - DNA, 22 bp, Homo sapiens
ttcaacaggaaagcactttaca

SEQ ID NO: 7467251 - DNA, 22 bp, Homo sapiens
ttcaacagcttccaaagtgtgt

SEQ ID NO: 7467252 - DNA, 22 bp, Homo sapiens
ttcaacagcttccaaagtgtgt

SEQ ID NO: 7467253 - DNA, 22 bp, Homo sapiens
ttcaacagcttccaaagtgtgt

SEQ ID NO: 7467254 - DNA, 22 bp, Homo sapiens
ttcaacagcttccaaagtgtgt

SEQ ID NO: 7467255 - DNA, 22 bp, Homo sapiens
ttcaacaattaagtatcagcct

SEQ ID NO: 7467256 - DNA, 22 bp, Homo sapiens
ttcaacaattaagtatcagcct

SEQ ID NO: 7467257 - DNA, 22 bp, Homo sapiens
ttcaacaattaagtatcagcct

SEQ ID NO: 7467258 - DNA, 22 bp, Homo sapiens
ttcaacaatgcacttgagtata

SEQ ID NO: 7467259 - DNA, 22 bp, Homo sapiens
ttcaacaatgcacttgagtata

SEQ ID NO: 7467260 - DNA, 22 bp, Homo sapiens
ttcaacacaggaacatgatata

SEQ ID NO: 7467261 - DNA, 22 bp, Homo sapiens
ttcaacacaggaacatgatata

SEQ ID NO: 7467262 - DNA, 22 bp, Homo sapiens
ttcaacatgctttatttctaaa

SEQ ID NO: 7467263 - DNA, 22 bp, Homo sapiens
ttcaacatgctttatttctaaa

SEQ ID NO: 7467264 - DNA, 19 bp, Homo sapiens
ttcaacatgctgaggcagc

SEQ ID NO: 7467265 - DNA, 22 bp, Homo sapiens
ttcaacatgctttatttctaaa

SEQ ID NO: 7467266 - DNA, 22 bp, Homo sapiens
ttcaacatgctttatttctaaa

SEQ ID NO: 7467267 - DNA, 22 bp, Homo sapiens
ttcaacatgctttatttctaaa

SEQ ID NO: 7467268 - DNA, 22 bp, Homo sapiens
ttcaacatgttctacataaggg

SEQ ID NO: 7467269 - DNA, 22 bp, Homo sapiens
ttcaacatgttctacataaggg

SEQ ID NO: 7467270 - DNA, 22 bp, Homo sapiens
ttcaacatgttctacataaggg

SEQ ID NO: 7467271 - DNA, 22 bp, Homo sapiens
ttcaacatgttctacataaggg

SEQ ID NO: 7467272 - DNA, 22 bp, Homo sapiens
ttcaacatcattgtaagcctct

SEQ ID NO: 7467273 - DNA, 22 bp, Homo sapiens
ttcaacatcaagaatgcatgga

SEQ ID NO: 7467274 - DNA, 22 bp, Homo sapiens
ttcaacatgcaaacatgtttgt

SEQ ID NO: 7467275 - DNA, 22 bp, Homo sapiens
ttcaacatgcaaacatgtttgt

SEQ ID NO: 7467276 - DNA, 22 bp, Homo sapiens
ttcaacagtgatggcctttgta

SEQ ID NO: 7467277 - DNA, 22 bp, Homo sapiens
ttcaacagtgatggcctttgta

SEQ ID NO: 7467278 - DNA, 22 bp, Homo sapiens
ttcaacatagctgaggcatata

SEQ ID NO: 7467279 - DNA, 22 bp, Homo sapiens
ttcaacatagctgaggcatata

SEQ ID NO: 7467280 - DNA, 22 bp, Homo sapiens
ttcaacatagctgaggcatata

SEQ ID NO: 7467281 - DNA, 22 bp, Homo sapiens
ttcaacatcaagaatgcatgga

SEQ ID NO: 7467282 - DNA, 22 bp, Homo sapiens
ttcaactttggagatttaataa

SEQ ID NO: 7467283 - DNA, 22 bp, Homo sapiens
ttcaactgggcggatctgagaa

SEQ ID NO: 7467284 - DNA, 22 bp, Homo sapiens
ttcaactttatgcatatgtatt

SEQ ID NO: 7467285 - DNA, 22 bp, Homo sapiens
ttcaactttaggcaaagaaaac

SEQ ID NO: 7467286 - DNA, 22 bp, Homo sapiens
ttcaactttaggcaaagaaaac

SEQ ID NO: 7467287 - DNA, 22 bp, Homo sapiens
ttcaactttaggcaaagaaaac

SEQ ID NO: 7467288 - DNA, 22 bp, Homo sapiens
ttcaactttatgcatatgtatt

SEQ ID NO: 7467289 - DNA, 22 bp, Homo sapiens
ttcaactagatttatacaattc

SEQ ID NO: 7467290 - DNA, 22 bp, Homo sapiens
ttcaactattatgaataaaatt

SEQ ID NO: 7467291 - DNA, 22 bp, Homo sapiens
ttcaactattatgaataaaatt

SEQ ID NO: 7467292 - DNA, 22 bp, Homo sapiens
ttcaactagatttatacaattc

SEQ ID NO: 7467293 - DNA, 22 bp, Homo sapiens
ttcaactcttcaagatcacatc

SEQ ID NO: 7467294 - DNA, 22 bp, Homo sapiens
ttcaactattatgaataaaatt

SEQ ID NO: 7467295 - DNA, 22 bp, Homo sapiens
ttcaactcttcaagatcacatc

SEQ ID NO: 7467296 - DNA, 19 bp, Homo sapiens
ttcaactgagccagtctgg

SEQ ID NO: 7467297 - DNA, 19 bp, Homo sapiens
ttcaactgagccagtctgg

SEQ ID NO: 7467298 - DNA, 22 bp, Homo sapiens
ttcaactgggcggatctgagaa

SEQ ID NO: 7467299 - DNA, 22 bp, Homo sapiens
ttcaactaatgtttattttatg

SEQ ID NO: 7467300 - DNA, 22 bp, Homo sapiens
ttcaactaatgtttattttatg

SEQ ID NO: 7467301 - DNA, 22 bp, Homo sapiens
ttcaacatttttgagtttaggt

SEQ ID NO: 7467302 - DNA, 22 bp, Homo sapiens
ttcaaccattgtgtaagacagt

SEQ ID NO: 7467303 - DNA, 22 bp, Homo sapiens
ttcaaccaggttaattcactac

SEQ ID NO: 7467304 - DNA, 22 bp, Homo sapiens
ttcaacatttatcagtttatca

SEQ ID NO: 7467305 - DNA, 22 bp, Homo sapiens
ttcaacatttatcagtttatca

SEQ ID NO: 7467306 - DNA, 22 bp, Homo sapiens
ttcaacattacacaggcaattc

SEQ ID NO: 7467307 - DNA, 22 bp, Homo sapiens
ttcaacatgttctacataaggg

SEQ ID NO: 7467308 - DNA, 22 bp, Homo sapiens
ttcaacatttgatacaagtcag

SEQ ID NO: 7467309 - DNA, 21 bp, Homo sapiens
ttcaacaaagggaataagttt

SEQ ID NO: 7467310 - DNA, 21 bp, Homo sapiens
ttcaacaaagggaataagttt

SEQ ID NO: 7467311 - DNA, 21 bp, Homo sapiens
ttcaacaaagggaataagttt

SEQ ID NO: 7467312 - DNA, 21 bp, Homo sapiens
ttcaacaaagggaataagttt

SEQ ID NO: 7467313 - DNA, 22 bp, Homo sapiens
ttcaacaaactgttcacgaatg

SEQ ID NO: 7467314 - DNA, 21 bp, Homo sapiens
ttcaacaaagggaataagttt

SEQ ID NO: 7467315 - DNA, 22 bp, Homo sapiens
ttcaacaaaatatatttttcca

SEQ ID NO: 7467316 - DNA, 22 bp, Homo sapiens
ttcaacaaactgttcacgaatg

SEQ ID NO: 7467317 - DNA, 22 bp, Homo sapiens
ttcaaagtaccgtacttaatgg

SEQ ID NO: 7467318 - DNA, 22 bp, Homo sapiens
ttcaaagtaccgtacttaatgg

SEQ ID NO: 7467319 - DNA, 22 bp, Homo sapiens
ttcaaagtaccgtacttaatgg

SEQ ID NO: 7467320 - DNA, 22 bp, Homo sapiens
ttcaaagtaaaaatgtgttcac

SEQ ID NO: 7467321 - DNA, 22 bp, Homo sapiens
ttcaaaggcaggatagcagctg

SEQ ID NO: 7467322 - DNA, 23 bp, Homo sapiens
ttcaaaggcaatatgctgagaaa

SEQ ID NO: 7467323 - DNA, 22 bp, Homo sapiens
ttcaaaggagacagagggaagg

SEQ ID NO: 7467324 - DNA, 17 bp, Homo sapiens
ttcaaagcttatcaagg

SEQ ID NO: 7467325 - DNA, 22 bp, Homo sapiens
ttcaaaggaaaggcagtgtcaa

SEQ ID NO: 7467326 - DNA, 22 bp, Homo sapiens
ttcaaaggaaaggcagtgtcaa

SEQ ID NO: 7467327 - DNA, 22 bp, Homo sapiens
ttcaacaaggctgtcaaaagtt

SEQ ID NO: 7467328 - DNA, 22 bp, Homo sapiens
ttcaacaaggctgtcaaaagtt

SEQ ID NO: 7467329 - DNA, 22 bp, Homo sapiens
ttcaacaaatatttattgagct

SEQ ID NO: 7467330 - DNA, 22 bp, Homo sapiens
ttcaacaacttggttcaaatgg

SEQ ID NO: 7467331 - DNA, 22 bp, Homo sapiens
ttcaacaacttggttcaaatgg

SEQ ID NO: 7467332 - DNA, 22 bp, Homo sapiens
ttcaacaaggctgtcaaaagtt

SEQ ID NO: 7467333 - DNA, 22 bp, Homo sapiens
ttcaacaacttggttcaaatgg

SEQ ID NO: 7467334 - DNA, 22 bp, Homo sapiens
ttcaacaaatatttattgagct

SEQ ID NO: 7467335 - DNA, 21 bp, Homo sapiens
ttcaacaaagggaataagttt

SEQ ID NO: 7467336 - DNA, 22 bp, Homo sapiens
ttcaacaagtatttattgagca

SEQ ID NO: 7467337 - DNA, 22 bp, Homo sapiens
ttcaacaagtatttattgagca

SEQ ID NO: 7467338 - DNA, 22 bp, Homo sapiens
ttcaacaagtagtacacacagt

SEQ ID NO: 7467339 - DNA, 22 bp, Homo sapiens
ttcaacaagtagtacacacagt

SEQ ID NO: 7467340 - DNA, 22 bp, Homo sapiens
ttcaacaaggctgtcaaaagtt

SEQ ID NO: 7467341 - DNA, 22 bp, Homo sapiens
ttcaacaatgaaagctaaggaa

SEQ ID NO: 7467342 - DNA, 22 bp, Homo sapiens
ttcaacaatgaaagctaaggaa

SEQ ID NO: 7467343 - DNA, 22 bp, Homo sapiens
ttcaacaatgaaagctaaggaa

SEQ ID NO: 7467344 - DNA, 22 bp, Homo sapiens
ttcaacaatgcacttgagtata

SEQ ID NO: 7467345 - DNA, 22 bp, Homo sapiens
ttcaacaagtcttttttcactg

SEQ ID NO: 7467346 - DNA, 22 bp, Homo sapiens
ttagagttttctgttcctctaa

SEQ ID NO: 7467347 - DNA, 21 bp, Homo sapiens
ttagagttgccattatatgta

SEQ ID NO: 7467348 - DNA, 22 bp, Homo sapiens
ttagagttttatcattgcctta

SEQ ID NO: 7467349 - DNA, 22 bp, Homo sapiens
ttagagttgagtttctatgaga

SEQ ID NO: 7467350 - DNA, 21 bp, Homo sapiens
ttagagttgccattatatgta

SEQ ID NO: 7467351 - DNA, 22 bp, Homo sapiens
ttagagttcagcatgactttga

SEQ ID NO: 7467352 - DNA, 22 bp, Homo sapiens
ttagagttcagcatgactttga

SEQ ID NO: 7467353 - DNA, 22 bp, Homo sapiens
ttagagttaggatttgtcttta

SEQ ID NO: 7467354 - DNA, 20 bp, Homo sapiens
ttagagttagctgttatgca

SEQ ID NO: 7467355 - DNA, 22 bp, Homo sapiens
ttagagttaggatttgtcttta

SEQ ID NO: 7467356 - DNA, 22 bp, Homo sapiens
ttagaggtgtcaggagcacagg

SEQ ID NO: 7467357 - DNA, 22 bp, Homo sapiens
ttagaggttctatgtgtctgga

SEQ ID NO: 7467358 - DNA, 22 bp, Homo sapiens
ttagaggtgtgaccttgggcaa

SEQ ID NO: 7467359 - DNA, 22 bp, Homo sapiens
ttagaggttctatgtgtctgga

SEQ ID NO: 7467360 - DNA, 22 bp, Homo sapiens
ttagagtgtagcaggaagaggc

SEQ ID NO: 7467361 - DNA, 22 bp, Homo sapiens
ttagaggttctatgtgtctgga

SEQ ID NO: 7467362 - DNA, 22 bp, Homo sapiens
ttagagtttttgtaagtacaat

SEQ ID NO: 7467363 - DNA, 22 bp, Homo sapiens
ttagagtttttgtaagtacaat

SEQ ID NO: 7467364 - DNA, 22 bp, Homo sapiens
ttagataaaagtgttcaataaa

SEQ ID NO: 7467365 - DNA, 22 bp, Homo sapiens
ttagataaaagtgttcaataaa

SEQ ID NO: 7467366 - DNA, 22 bp, Homo sapiens
ttagataaaagtgttcaataaa

SEQ ID NO: 7467367 - DNA, 22 bp, Homo sapiens
ttagataaaagtgttcaataaa

SEQ ID NO: 7467368 - DNA, 22 bp, Homo sapiens
ttagataaaagtgttcaataaa

SEQ ID NO: 7467369 - DNA, 22 bp, Homo sapiens
ttagataaagtgatgtaggcta

SEQ ID NO: 7467370 - DNA, 22 bp, Homo sapiens
ttagataaagtgatgtaggcta

SEQ ID NO: 7467371 - DNA, 22 bp, Homo sapiens
ttagataaagtgatgtaggcta

SEQ ID NO: 7467372 - DNA, 22 bp, Homo sapiens
ttagataaattaagactttaca

SEQ ID NO: 7467373 - DNA, 22 bp, Homo sapiens
ttagataaattaagactttaca

SEQ ID NO: 7467374 - DNA, 22 bp, Homo sapiens
ttagataaattaagactttaca

SEQ ID NO: 7467375 - DNA, 22 bp, Homo sapiens
ttagataaattaagactttaca

SEQ ID NO: 7467376 - DNA, 22 bp, Homo sapiens
ttagataaattaagactttaca

SEQ ID NO: 7467377 - DNA, 22 bp, Homo sapiens
ttagataaattgcaacttgatt

SEQ ID NO: 7467378 - DNA, 22 bp, Homo sapiens
ttagataaattgcaacttgatt

SEQ ID NO: 7467379 - DNA, 17 bp, Homo sapiens
ttcaaagcttatcaagg

SEQ ID NO: 7467380 - DNA, 17 bp, Homo sapiens
ttcaaagcttatcaagg

SEQ ID NO: 7467381 - DNA, 22 bp, Homo sapiens
ttctaattgcaagttttagtat

SEQ ID NO: 7467382 - DNA, 22 bp, Homo sapiens
ttctaattgaccttaggctgtg

SEQ ID NO: 7467383 - DNA, 22 bp, Homo sapiens
ttctaattattcccttgtccca

SEQ ID NO: 7467384 - DNA, 22 bp, Homo sapiens
ttctaattaaatctacgctagg

SEQ ID NO: 7467385 - DNA, 22 bp, Homo sapiens
ttctaattattcccttgtccca

SEQ ID NO: 7467386 - DNA, 22 bp, Homo sapiens
ttctaattaaatctacgctagg

SEQ ID NO: 7467387 - DNA, 22 bp, Homo sapiens
ttctaatgatttcattcaaagc

SEQ ID NO: 7467388 - DNA, 19 bp, Homo sapiens
ttctaatgttacattttgg

SEQ ID NO: 7467389 - DNA, 19 bp, Homo sapiens
ttctaatgttacattttgg

SEQ ID NO: 7467390 - DNA, 22 bp, Homo sapiens
ttctaattgtgtttgcatatct

SEQ ID NO: 7467391 - DNA, 22 bp, Homo sapiens
ttctaattgtgtttgcatatct

SEQ ID NO: 7467392 - DNA, 22 bp, Homo sapiens
ttctaattgtgtttgcatatct

SEQ ID NO: 7467393 - DNA, 22 bp, Homo sapiens
ttctaattgtgtttgcatatct

SEQ ID NO: 7467394 - DNA, 22 bp, Homo sapiens
ttctaattgtgtttgcatatct

SEQ ID NO: 7467395 - DNA, 22 bp, Homo sapiens
ttctaattgtgtttgcatatct

SEQ ID NO: 7467396 - DNA, 20 bp, Homo sapiens
ttctaatttgatggagtagc

SEQ ID NO: 7467397 - DNA, 20 bp, Homo sapiens
ttctaatttgatggagtagc

SEQ ID NO: 7467398 - DNA, 22 bp, Homo sapiens
ttctaagtctgctgtcttcatc

SEQ ID NO: 7467399 - DNA, 22 bp, Homo sapiens
ttctaagtcactcagattttgg

SEQ ID NO: 7467400 - DNA, 22 bp, Homo sapiens
ttctaagtcctacctgaaagca

SEQ ID NO: 7467401 - DNA, 22 bp, Homo sapiens
ttctaagtcctacctgaaagca

SEQ ID NO: 7467402 - DNA, 19 bp, Homo sapiens
ttctaagttttgcttgctg

SEQ ID NO: 7467403 - DNA, 19 bp, Homo sapiens
ttctaagttttgcttgctg

SEQ ID NO: 7467404 - DNA, 22 bp, Homo sapiens
ttctaatagctgcctatgtatt

SEQ ID NO: 7467405 - DNA, 22 bp, Homo sapiens
ttctaatacacggtatgacttt

SEQ ID NO: 7467406 - DNA, 22 bp, Homo sapiens
ttctaatcccagctctactact

SEQ ID NO: 7467407 - DNA, 22 bp, Homo sapiens
ttctaatcccagctctactact

SEQ ID NO: 7467408 - DNA, 22 bp, Homo sapiens
ttctaatcccagctctactact

SEQ ID NO: 7467409 - DNA, 22 bp, Homo sapiens
ttctaatgaaatctgtacagta

SEQ ID NO: 7467410 - DNA, 22 bp, Homo sapiens
ttctaatgaaatctgtacagta

SEQ ID NO: 7467411 - DNA, 22 bp, Homo sapiens
ttctaatctgggcttctgcagt

SEQ ID NO: 7467412 - DNA, 22 bp, Homo sapiens
ttctaatcctgactcagctgct

SEQ ID NO: 7467413 - DNA, 22 bp, Homo sapiens
ttctaatctgggcttctgcagt

SEQ ID NO: 7467414 - DNA, 22 bp, Homo sapiens
ttctaatgaaagtggaccatgg

SEQ ID NO: 7467415 - DNA, 20 bp, Homo sapiens
ttctacaaaactgattctga

SEQ ID NO: 7467416 - DNA, 20 bp, Homo sapiens
ttctacaaaactgattctga

SEQ ID NO: 7467417 - DNA, 20 bp, Homo sapiens
ttctacaaaactgattctga

SEQ ID NO: 7467418 - DNA, 22 bp, Homo sapiens
ttctacaaatatttactgttcc

SEQ ID NO: 7467419 - DNA, 22 bp, Homo sapiens
ttctacaaatatttactgttcc

SEQ ID NO: 7467420 - DNA, 22 bp, Homo sapiens
ttctacaaatatttactgttcc

SEQ ID NO: 7467421 - DNA, 22 bp, Homo sapiens
ttctacaaatatttactgttcc

SEQ ID NO: 7467422 - DNA, 22 bp, Homo sapiens
ttctacaatatgaataatgaag

SEQ ID NO: 7467423 - DNA, 22 bp, Homo sapiens
ttctacaaatatttactgttcc

SEQ ID NO: 7467424 - DNA, 22 bp, Homo sapiens
ttctacaaatatttactgttcc

SEQ ID NO: 7467425 - DNA, 22 bp, Homo sapiens
ttctacaaatatttactgttcc

SEQ ID NO: 7467426 - DNA, 22 bp, Homo sapiens
ttctacaaatatttactgttcc

SEQ ID NO: 7467427 - DNA, 22 bp, Homo sapiens
ttctacaatatgaataatgaag

SEQ ID NO: 7467428 - DNA, 22 bp, Homo sapiens
ttctacacacctctgaggacat

SEQ ID NO: 7467429 - DNA, 22 bp, Homo sapiens
ttctacactcacccagctgtaa

SEQ ID NO: 7467430 - DNA, 22 bp, Homo sapiens
ttctacaatatgaataatgaag

SEQ ID NO: 7467431 - DNA, 22 bp, Homo sapiens
ttctacaatatgaataatgaag

SEQ ID NO: 7467432 - DNA, 22 bp, Homo sapiens
ttctacaatatgaataatgaag

SEQ ID NO: 7467433 - DNA, 22 bp, Homo sapiens
ttctacaatatgaataatgaag

SEQ ID NO: 7467434 - DNA, 22 bp, Homo sapiens
ttctacaatatgaataatgaag

SEQ ID NO: 7467435 - DNA, 22 bp, Homo sapiens
ttctacaatatgaataatgaag

SEQ ID NO: 7467436 - DNA, 21 bp, Homo sapiens
ttctagaaaagtatgggactg

SEQ ID NO: 7467437 - DNA, 22 bp, Homo sapiens
ttctagaaacacatgcaaacag

SEQ ID NO: 7467438 - DNA, 22 bp, Homo sapiens
ttctagaaacacatgcaaacag

SEQ ID NO: 7467439 - DNA, 21 bp, Homo sapiens
ttctagaaaagtatgggactg

SEQ ID NO: 7467440 - DNA, 21 bp, Homo sapiens
ttctagaaaagtatgggactg

SEQ ID NO: 7467441 - DNA, 16 bp, Homo sapiens
ttctagaaaagaaggt

SEQ ID NO: 7467442 - DNA, 16 bp, Homo sapiens
ttctagaaaagaaggt

SEQ ID NO: 7467443 - DNA, 16 bp, Homo sapiens
ttctagaaaagaaggt

SEQ ID NO: 7467444 - DNA, 22 bp, Homo sapiens
ttctacttctgacactgtttgt

SEQ ID NO: 7467445 - DNA, 22 bp, Homo sapiens
ttctacttgccaaatgacacat

SEQ ID NO: 7467446 - DNA, 22 bp, Homo sapiens
ttctacttgccaaatgacacat

SEQ ID NO: 7467447 - DNA, 22 bp, Homo sapiens
ttctacactcacccagctgtaa

SEQ ID NO: 7467448 - DNA, 22 bp, Homo sapiens
ttctactaggatgtcttgaaca

SEQ ID NO: 7467449 - DNA, 22 bp, Homo sapiens
ttctactttctctgtcattaaa

SEQ ID NO: 7467450 - DNA, 22 bp, Homo sapiens
ttctactttagcatgctcattc

SEQ ID NO: 7467451 - DNA, 22 bp, Homo sapiens
ttctactttctctgtcattaaa

SEQ ID NO: 7467452 - DNA, 22 bp, Homo sapiens
ttctactttggacataaaggac

SEQ ID NO: 7467453 - DNA, 22 bp, Homo sapiens
ttctagattgcctgtaagtaaa

SEQ ID NO: 7467454 - DNA, 22 bp, Homo sapiens
ttctagatgcttataggcatat

SEQ ID NO: 7467455 - DNA, 22 bp, Homo sapiens
ttctagcacaagatatgaaagt

SEQ ID NO: 7467456 - DNA, 22 bp, Homo sapiens
ttctagattgcctgtaagtaaa

SEQ ID NO: 7467457 - DNA, 22 bp, Homo sapiens
ttctagcacaagatatgaaagt

SEQ ID NO: 7467458 - DNA, 22 bp, Homo sapiens
ttctagcacaagatatgaaagt

SEQ ID NO: 7467459 - DNA, 22 bp, Homo sapiens
ttctagcactgcctggaagaca

SEQ ID NO: 7467460 - DNA, 22 bp, Homo sapiens
ttctagcactgcctggaagaca

SEQ ID NO: 7467461 - DNA, 22 bp, Homo sapiens
ttctagcagagggcatctgctg

SEQ ID NO: 7467462 - DNA, 22 bp, Homo sapiens
ttctagaggggagatactagta

SEQ ID NO: 7467463 - DNA, 22 bp, Homo sapiens
ttctagaggggagatactagta

SEQ ID NO: 7467464 - DNA, 22 bp, Homo sapiens
ttctagatagagtgcaaattat

SEQ ID NO: 7467465 - DNA, 22 bp, Homo sapiens
ttctagatagagtgcaaattat

SEQ ID NO: 7467466 - DNA, 22 bp, Homo sapiens
ttctagatagcacttttgagct

SEQ ID NO: 7467467 - DNA, 22 bp, Homo sapiens
ttctagatatctagtgtataac

SEQ ID NO: 7467468 - DNA, 22 bp, Homo sapiens
ttctagaatgttttgaaaggga

SEQ ID NO: 7467469 - DNA, 22 bp, Homo sapiens
ttctagaatgttttgaaaggga

SEQ ID NO: 7467470 - DNA, 22 bp, Homo sapiens
ttctagacaaatgtgttcattc

SEQ ID NO: 7467471 - DNA, 22 bp, Homo sapiens
ttctagagaactcgagtgcctt

SEQ ID NO: 7467472 - DNA, 22 bp, Homo sapiens
ttctagactgtgtacagattca

SEQ ID NO: 7467473 - DNA, 22 bp, Homo sapiens
ttctagagccagggcagctgca

SEQ ID NO: 7467474 - DNA, 22 bp, Homo sapiens
ttctagagccagggcagctgca

SEQ ID NO: 7467475 - DNA, 22 bp, Homo sapiens
ttctaggggagaggaagaagtg

SEQ ID NO: 7467476 - DNA, 22 bp, Homo sapiens
ttctaggggggatcttggtcca

SEQ ID NO: 7467477 - DNA, 22 bp, Homo sapiens
ttctagggttcgagtataatcc

SEQ ID NO: 7467478 - DNA, 22 bp, Homo sapiens
ttctagggttcgagtataatcc

SEQ ID NO: 7467479 - DNA, 22 bp, Homo sapiens
ttctaggggtttacattatcca

SEQ ID NO: 7467480 - DNA, 22 bp, Homo sapiens
ttctagggttacagtttcttcc

SEQ ID NO: 7467481 - DNA, 22 bp, Homo sapiens
ttctagggaatgggatgaggat

SEQ ID NO: 7467482 - DNA, 22 bp, Homo sapiens
ttctaggcagattgtctaaagc

SEQ ID NO: 7467483 - DNA, 22 bp, Homo sapiens
ttctaggctaggggaattggag

SEQ ID NO: 7467484 - DNA, 19 bp, Homo sapiens
ttctaggctatgaagcagt

SEQ ID NO: 7467485 - DNA, 22 bp, Homo sapiens
ttctagggatggtaggtacaaa

SEQ ID NO: 7467486 - DNA, 22 bp, Homo sapiens
ttctagggatggtaggtacaaa

SEQ ID NO: 7467487 - DNA, 22 bp, Homo sapiens
ttctagggatctgctgctgttt

SEQ ID NO: 7467488 - DNA, 22 bp, Homo sapiens
ttctagggaggagaacttgtga

SEQ ID NO: 7467489 - DNA, 23 bp, Homo sapiens
ttctaggctctgattgggcttcc

SEQ ID NO: 7467490 - DNA, 23 bp, Homo sapiens
ttctaggctctgattgggcttcc

SEQ ID NO: 7467491 - DNA, 22 bp, Homo sapiens
ttctagcatgccttttagcaca

SEQ ID NO: 7467492 - DNA, 22 bp, Homo sapiens
ttctagctgttgctgtttatag

SEQ ID NO: 7467493 - DNA, 20 bp, Homo sapiens
ttctagcatacttacaagga

SEQ ID NO: 7467494 - DNA, 22 bp, Homo sapiens
ttctagcatgccttttagcaca

SEQ ID NO: 7467495 - DNA, 22 bp, Homo sapiens
ttctaggaagggaagcatggca

SEQ ID NO: 7467496 - DNA, 22 bp, Homo sapiens
ttctaggaagggaagcatggca

SEQ ID NO: 7467497 - DNA, 22 bp, Homo sapiens
ttctaggaccctgcgtgagaac

SEQ ID NO: 7467498 - DNA, 22 bp, Homo sapiens
ttctaggatgctgatgagaccc

SEQ ID NO: 7467499 - DNA, 22 bp, Homo sapiens
ttctaggcctggcttgggccca

SEQ ID NO: 7467500 - DNA, 22 bp, Homo sapiens
ttctagaaactggagcaaacag

SEQ ID NO: 7467501 - DNA, 22 bp, Homo sapiens
ttctagaaactggagcaaacag

SEQ ID NO: 7467502 - DNA, 22 bp, Homo sapiens
ttctagaaatccgtaagtgaat

SEQ ID NO: 7467503 - DNA, 22 bp, Homo sapiens
ttctagaaactggagcaaacag

SEQ ID NO: 7467504 - DNA, 22 bp, Homo sapiens
ttctagaacaggcaaaaccaat

SEQ ID NO: 7467505 - DNA, 22 bp, Homo sapiens
ttctagaacaggcaaaaccaat

SEQ ID NO: 7467506 - DNA, 22 bp, Homo sapiens
ttctagaaccatgacttcaggg

SEQ ID NO: 7467507 - DNA, 22 bp, Homo sapiens
ttctagaaatccgtaagtgaat

SEQ ID NO: 7467508 - DNA, 22 bp, Homo sapiens
ttctagaaatccgtaagtgaat

SEQ ID NO: 7467509 - DNA, 19 bp, Homo sapiens
ttctagaactgttctctca

SEQ ID NO: 7467510 - DNA, 22 bp, Homo sapiens
ttctagaagaactagccaggaa

SEQ ID NO: 7467511 - DNA, 19 bp, Homo sapiens
ttctagaactgttctctca

SEQ ID NO: 7467512 - DNA, 22 bp, Homo sapiens
ttctagaagaactagccaggaa

SEQ ID NO: 7467513 - DNA, 22 bp, Homo sapiens
ttctagaagaactagccaggaa

SEQ ID NO: 7467514 - DNA, 21 bp, Homo sapiens
ttctagaaccgtgggcggttc

SEQ ID NO: 7467515 - DNA, 21 bp, Homo sapiens
ttctagaaccgtgggcggttc

SEQ ID NO: 7467516 - DNA, 19 bp, Homo sapiens
ttctagaactgttctctca

SEQ ID NO: 7467517 - DNA, 22 bp, Homo sapiens
ttctagaaccatgacttcaggg

SEQ ID NO: 7467518 - DNA, 22 bp, Homo sapiens
ttctagaaccatgacttcaggg

SEQ ID NO: 7467519 - DNA, 22 bp, Homo sapiens
ttctagaagtgtctatgtctgt

SEQ ID NO: 7467520 - DNA, 22 bp, Homo sapiens
ttctagaagtgtctatgtctgt

SEQ ID NO: 7467521 - DNA, 22 bp, Homo sapiens
ttctagaaggcaggctgggcca

SEQ ID NO: 7467522 - DNA, 20 bp, Homo sapiens
ttctagaagtttgctaccca

SEQ ID NO: 7467523 - DNA, 22 bp, Homo sapiens
ttctagaagtgtctatgtctgt

SEQ ID NO: 7467524 - DNA, 20 bp, Homo sapiens
ttctagaagtttgctaccca

SEQ ID NO: 7467525 - DNA, 22 bp, Homo sapiens
ttctagaagtgtctatgtctgt

SEQ ID NO: 7467526 - DNA, 20 bp, Homo sapiens
ttctagaagtttgctaccca

SEQ ID NO: 7467527 - DNA, 22 bp, Homo sapiens
ttctagaagtgtctatgtctgt

SEQ ID NO: 7467528 - DNA, 22 bp, Homo sapiens
ttctagaaggcaggctgggcca

SEQ ID NO: 7467529 - DNA, 22 bp, Homo sapiens
ttctagaagctgaaaaggggga

SEQ ID NO: 7467530 - DNA, 22 bp, Homo sapiens
ttctagaagctctaggggagaa

SEQ ID NO: 7467531 - DNA, 22 bp, Homo sapiens
ttctagaagctgaaaaggggga

SEQ ID NO: 7467532 - DNA, 22 bp, Homo sapiens
ttctagaagctctaggggagaa

SEQ ID NO: 7467533 - DNA, 22 bp, Homo sapiens
ttctagaatgttttgaaaggga

SEQ ID NO: 7467534 - DNA, 22 bp, Homo sapiens
ttctagaatgttttgaaaggga

SEQ ID NO: 7467535 - DNA, 20 bp, Homo sapiens
ttctagaatgcccagggaca

SEQ ID NO: 7467536 - DNA, 22 bp, Homo sapiens
ttctagaatgatatgaggtact

SEQ ID NO: 7467537 - DNA, 20 bp, Homo sapiens
ttctagaatgcccagggaca

SEQ ID NO: 7467538 - DNA, 22 bp, Homo sapiens
ttctagaatgatatgaggtact

SEQ ID NO: 7467539 - DNA, 22 bp, Homo sapiens
ttctagaatccttgtctacttt

SEQ ID NO: 7467540 - DNA, 22 bp, Homo sapiens
ttctagaatccttgtctacttt

SEQ ID NO: 7467541 - DNA, 22 bp, Homo sapiens
ttctagaatgatatgaggtact

SEQ ID NO: 7467542 - DNA, 22 bp, Homo sapiens
ttctagaatccttgtctacttt

SEQ ID NO: 7467543 - DNA, 22 bp, Homo sapiens
ttctagaatgatatgaggtact

SEQ ID NO: 7467544 - DNA, 22 bp, Homo sapiens
ttcctgtggtgtttcccagaca

SEQ ID NO: 7467545 - DNA, 22 bp, Homo sapiens
ttcctgtggtccagagtcatcc

SEQ ID NO: 7467546 - DNA, 22 bp, Homo sapiens
ttcctgtggtgtttcccagaca

SEQ ID NO: 7467547 - DNA, 17 bp, Homo sapiens
ttcctgtggtttgatct

SEQ ID NO: 7467548 - DNA, 17 bp, Homo sapiens
ttcctgtggtttgatct

SEQ ID NO: 7467549 - DNA, 22 bp, Homo sapiens
ttcctgtggccttacatctgtg

SEQ ID NO: 7467550 - DNA, 22 bp, Homo sapiens
ttcctgtggctgtcactcctgg

SEQ ID NO: 7467551 - DNA, 22 bp, Homo sapiens
ttcctgtggctgtcactcctgg

SEQ ID NO: 7467552 - DNA, 22 bp, Homo sapiens
ttcctgtggtccagagtcatcc

SEQ ID NO: 7467553 - DNA, 22 bp, Homo sapiens
ttcctgtgtcctatttcgactt

SEQ ID NO: 7467554 - DNA, 22 bp, Homo sapiens
ttcctgtgtcccgggcaccctg

SEQ ID NO: 7467555 - DNA, 22 bp, Homo sapiens
ttcctgtgtgaccgagacagtg

SEQ ID NO: 7467556 - DNA, 22 bp, Homo sapiens
ttcctgtgtgaccgagacagtg

SEQ ID NO: 7467557 - DNA, 22 bp, Homo sapiens
ttcctgtgtgaccgagacagtg

SEQ ID NO: 7467558 - DNA, 22 bp, Homo sapiens
ttcctgtgtgactcaagtggtt

SEQ ID NO: 7467559 - DNA, 22 bp, Homo sapiens
ttcctgtgtgactcaagtggtt

SEQ ID NO: 7467560 - DNA, 22 bp, Homo sapiens
ttcctgtgatattagccactgt

SEQ ID NO: 7467561 - DNA, 22 bp, Homo sapiens
ttcctgtgaaatataggtccat

SEQ ID NO: 7467562 - DNA, 22 bp, Homo sapiens
ttcctgtgaagatctgggtgct

SEQ ID NO: 7467563 - DNA, 22 bp, Homo sapiens
ttcctgtgcctcaggtctcagc

SEQ ID NO: 7467564 - DNA, 22 bp, Homo sapiens
ttcctgtgcctcaggtctcagc

SEQ ID NO: 7467565 - DNA, 19 bp, Homo sapiens
ttcctgtgctgctgtgtcc

SEQ ID NO: 7467566 - DNA, 22 bp, Homo sapiens
ttcctgtgcttaattctcactg

SEQ ID NO: 7467567 - DNA, 22 bp, Homo sapiens
ttcctgtggccttacatctgtg

SEQ ID NO: 7467568 - DNA, 22 bp, Homo sapiens
ttcctgtggccttacatctgtg

SEQ ID NO: 7467569 - DNA, 22 bp, Homo sapiens
ttcctgtggccttacatctgtg

SEQ ID NO: 7467570 - DNA, 22 bp, Homo sapiens
ttcctgtggccttacatctgtg

SEQ ID NO: 7467571 - DNA, 22 bp, Homo sapiens
ttcctgtggccttacatctgtg

SEQ ID NO: 7467572 - DNA, 22 bp, Homo sapiens
ttcctgtggccttacatctgtg

SEQ ID NO: 7467573 - DNA, 22 bp, Homo sapiens
ttcctgaacatttctaagttga

SEQ ID NO: 7467574 - DNA, 22 bp, Homo sapiens
ttcctgaaaatacagggagaga

SEQ ID NO: 7467575 - DNA, 22 bp, Homo sapiens
ttcctgaacatttctaagttga

SEQ ID NO: 7467576 - DNA, 22 bp, Homo sapiens
ttcctgaagtcaaagatctaaa

SEQ ID NO: 7467577 - DNA, 22 bp, Homo sapiens
ttcctgaagtcaaagatctaaa

SEQ ID NO: 7467578 - DNA, 22 bp, Homo sapiens
ttcctgaatataaagacactag

SEQ ID NO: 7467579 - DNA, 22 bp, Homo sapiens
ttcctgaagtcaaagatctaaa

SEQ ID NO: 7467580 - DNA, 22 bp, Homo sapiens
ttcctgaagtcaaagatctaaa

SEQ ID NO: 7467581 - DNA, 22 bp, Homo sapiens
ttcctgaagtcaaagatctaaa

SEQ ID NO: 7467582 - DNA, 22 bp, Homo sapiens
ttcctgtattttgcgaattttc

SEQ ID NO: 7467583 - DNA, 22 bp, Homo sapiens
ttcctgtccgcaatggcctggg

SEQ ID NO: 7467584 - DNA, 22 bp, Homo sapiens
ttcctgtattctaaagggaaag

SEQ ID NO: 7467585 - DNA, 22 bp, Homo sapiens
ttcctgtatgtcagtgaagagc

SEQ ID NO: 7467586 - DNA, 22 bp, Homo sapiens
ttcctgtgaaatataggtccat

SEQ ID NO: 7467587 - DNA, 22 bp, Homo sapiens
ttcctgtccgcaatggcctggg

SEQ ID NO: 7467588 - DNA, 22 bp, Homo sapiens
ttcctctttagggctggccagg

SEQ ID NO: 7467589 - DNA, 22 bp, Homo sapiens
ttcctctttagggctggccagg

SEQ ID NO: 7467590 - DNA, 22 bp, Homo sapiens
ttcctctttagggctggccagg

SEQ ID NO: 7467591 - DNA, 22 bp, Homo sapiens
ttcctctttctctgtgctatgt

SEQ ID NO: 7467592 - DNA, 22 bp, Homo sapiens
ttcctcttccatcttcccaggg

SEQ ID NO: 7467593 - DNA, 21 bp, Homo sapiens
ttcctcttgcttccgccttgc

SEQ ID NO: 7467594 - DNA, 22 bp, Homo sapiens
ttcctcttattttcccagtgat

SEQ ID NO: 7467595 - DNA, 22 bp, Homo sapiens
ttcctcttccatcttcccaggg

SEQ ID NO: 7467596 - DNA, 22 bp, Homo sapiens
ttcctcttccatcttcccaggg

SEQ ID NO: 7467597 - DNA, 22 bp, Homo sapiens
ttcctgaaaatacagggagaga

SEQ ID NO: 7467598 - DNA, 22 bp, Homo sapiens
ttcctgaaaatacagggagaga

SEQ ID NO: 7467599 - DNA, 22 bp, Homo sapiens
ttcctgaaaatacagggagacc

SEQ ID NO: 7467600 - DNA, 22 bp, Homo sapiens
ttcctgaaaatacagggagacc

SEQ ID NO: 7467601 - DNA, 22 bp, Homo sapiens
ttcctgaaaatacagggagacc

SEQ ID NO: 7467602 - DNA, 22 bp, Homo sapiens
ttcctctttgcatcctcaactc

SEQ ID NO: 7467603 - DNA, 22 bp, Homo sapiens
ttcctctttgcatcctcaactc

SEQ ID NO: 7467604 - DNA, 22 bp, Homo sapiens
ttcctctttgcatcctcaactc

SEQ ID NO: 7467605 - DNA, 22 bp, Homo sapiens
ttctaagagagtacaagcaatt

SEQ ID NO: 7467606 - DNA, 22 bp, Homo sapiens
ttctaagaatgctttgcaaaat

SEQ ID NO: 7467607 - DNA, 18 bp, Homo sapiens
ttccttctgatgtatatg

SEQ ID NO: 7467608 - DNA, 18 bp, Homo sapiens
ttccttctgatgtatatg

SEQ ID NO: 7467609 - DNA, 18 bp, Homo sapiens
ttccttctgatgtatatg

SEQ ID NO: 7467610 - DNA, 22 bp, Homo sapiens
ttccttctgaagcctttgtgtt

SEQ ID NO: 7467611 - DNA, 22 bp, Homo sapiens
ttccttctgaagcctttgtgtt

SEQ ID NO: 7467612 - DNA, 22 bp, Homo sapiens
ttccttctgaagcctttgtgtt

SEQ ID NO: 7467613 - DNA, 22 bp, Homo sapiens
ttctaagattcatgaggacagg

SEQ ID NO: 7467614 - DNA, 22 bp, Homo sapiens
ttctaagaggctaatgaagaat

SEQ ID NO: 7467615 - DNA, 22 bp, Homo sapiens
ttctaagagagtacaagcaatt

SEQ ID NO: 7467616 - DNA, 22 bp, Homo sapiens
ttctaagtcactcagattttgg

SEQ ID NO: 7467617 - DNA, 22 bp, Homo sapiens
ttctaagctctgaaataaatct

SEQ ID NO: 7467618 - DNA, 22 bp, Homo sapiens
ttctaagctctgaaataaatct

SEQ ID NO: 7467619 - DNA, 22 bp, Homo sapiens
ttccttctcagccctcgaggat

SEQ ID NO: 7467620 - DNA, 22 bp, Homo sapiens
ttccttctcagccctcgaggat

SEQ ID NO: 7467621 - DNA, 22 bp, Homo sapiens
ttccttctattcagctccaaga

SEQ ID NO: 7467622 - DNA, 22 bp, Homo sapiens
ttccttctattcagctccaaga

SEQ ID NO: 7467623 - DNA, 22 bp, Homo sapiens
ttccttctagcccaagtattgg

SEQ ID NO: 7467624 - DNA, 22 bp, Homo sapiens
ttccttctctgtggggaaggca

SEQ ID NO: 7467625 - DNA, 22 bp, Homo sapiens
ttccttctccagaacttctagg

SEQ ID NO: 7467626 - DNA, 22 bp, Homo sapiens
ttccttctccagaacttctagg

SEQ ID NO: 7467627 - DNA, 22 bp, Homo sapiens
ttccttctccagaacttctagg

SEQ ID NO: 7467628 - DNA, 22 bp, Homo sapiens
ttccttctccagaacttctagg

SEQ ID NO: 7467629 - DNA, 22 bp, Homo sapiens
ttccttctcagccctcgaggat

SEQ ID NO: 7467630 - DNA, 22 bp, Homo sapiens
ttccttctccagaacttctagg

SEQ ID NO: 7467631 - DNA, 23 bp, Homo sapiens
ttccttaactgttaagattgtct

SEQ ID NO: 7467632 - DNA, 22 bp, Homo sapiens
ttccttaatgaatcaggccatt

SEQ ID NO: 7467633 - DNA, 22 bp, Homo sapiens
ttcctgttgtgttagagtcaat

SEQ ID NO: 7467634 - DNA, 22 bp, Homo sapiens
ttcctgtttcatagaaaactga

SEQ ID NO: 7467635 - DNA, 22 bp, Homo sapiens
ttcctgttcaggaaagttgtgt

SEQ ID NO: 7467636 - DNA, 22 bp, Homo sapiens
ttcctgttagccattattagct

SEQ ID NO: 7467637 - DNA, 22 bp, Homo sapiens
ttcctgttagccattattagct

SEQ ID NO: 7467638 - DNA, 22 bp, Homo sapiens
ttcctgtgtgttggtggcagaa

SEQ ID NO: 7467639 - DNA, 22 bp, Homo sapiens
ttcctgtgtgttggtggcagaa

SEQ ID NO: 7467640 - DNA, 22 bp, Homo sapiens
ttcctgtgtgttggtggcagaa

SEQ ID NO: 7467641 - DNA, 22 bp, Homo sapiens
ttcctgtgtgttggtggcagaa

SEQ ID NO: 7467642 - DNA, 22 bp, Homo sapiens
ttcctgttagccattattagct

SEQ ID NO: 7467643 - DNA, 22 bp, Homo sapiens
ttccttaatatcccttttggaa

SEQ ID NO: 7467644 - DNA, 22 bp, Homo sapiens
ttccttaatgaatcaggccatt

SEQ ID NO: 7467645 - DNA, 23 bp, Homo sapiens
ttccttaactgttaagattgtct

SEQ ID NO: 7467646 - DNA, 22 bp, Homo sapiens
ttccttacattcatatggcttc

SEQ ID NO: 7467647 - DNA, 22 bp, Homo sapiens
ttccttagctcctcatggcctg

SEQ ID NO: 7467648 - DNA, 22 bp, Homo sapiens
ttccttctagagcttgtttagg

SEQ ID NO: 7467649 - DNA, 22 bp, Homo sapiens
ttccttctagcccaagtattgg

SEQ ID NO: 7467650 - DNA, 22 bp, Homo sapiens
ttccttctagcccaagtattgg

SEQ ID NO: 7467651 - DNA, 22 bp, Homo sapiens
ttccttctagcccaagtattgg

SEQ ID NO: 7467652 - DNA, 22 bp, Homo sapiens
ttccttctagcccaagtattgg

SEQ ID NO: 7467653 - DNA, 22 bp, Homo sapiens
ttccttcaaacgcctcctgcac

SEQ ID NO: 7467654 - DNA, 22 bp, Homo sapiens
ttccttcaaacgcctcctgcac

SEQ ID NO: 7467655 - DNA, 22 bp, Homo sapiens
ttccttcaaacgcctcctgcac

SEQ ID NO: 7467656 - DNA, 22 bp, Homo sapiens
ttccttcagcaagtcctgagca

SEQ ID NO: 7467657 - DNA, 22 bp, Homo sapiens
ttccttctagagcttgtttagg

SEQ ID NO: 7467658 - DNA, 22 bp, Homo sapiens
ttccttctagagcttgtttagg

SEQ ID NO: 7467659 - DNA, 22 bp, Homo sapiens
ttccttctagagcttgtttagg

SEQ ID NO: 7467660 - DNA, 22 bp, Homo sapiens
ttccttatcttctgaaatgggc

SEQ ID NO: 7467661 - DNA, 22 bp, Homo sapiens
ttccttatcttctgaaatgggc

SEQ ID NO: 7467662 - DNA, 22 bp, Homo sapiens
ttccttagttgactgtcttagt

SEQ ID NO: 7467663 - DNA, 22 bp, Homo sapiens
ttccttagggtcagccagatct

SEQ ID NO: 7467664 - DNA, 22 bp, Homo sapiens
ttccttagtgttagattctgtg

SEQ ID NO: 7467665 - DNA, 22 bp, Homo sapiens
ttcctaagtcctgccagcagtc

SEQ ID NO: 7467666 - DNA, 22 bp, Homo sapiens
ttcctaagagattggcagtgtt

SEQ ID NO: 7467667 - DNA, 22 bp, Homo sapiens
ttcctaatgtctactttagttc

SEQ ID NO: 7467668 - DNA, 22 bp, Homo sapiens
ttcctaatggcaaaacatgttt

SEQ ID NO: 7467669 - DNA, 22 bp, Homo sapiens
ttcctaatcacgaacattattt

SEQ ID NO: 7467670 - DNA, 22 bp, Homo sapiens
ttcctaactctggcacctagtc

SEQ ID NO: 7467671 - DNA, 22 bp, Homo sapiens
ttcctaactggcctttatggat

SEQ ID NO: 7467672 - DNA, 22 bp, Homo sapiens
ttcctaactctggcacctagtc

SEQ ID NO: 7467673 - DNA, 22 bp, Homo sapiens
ttcctaacacagtgtaagcaag

SEQ ID NO: 7467674 - DNA, 22 bp, Homo sapiens
ttcctaacctctagctgcatat

SEQ ID NO: 7467675 - DNA, 22 bp, Homo sapiens
ttcctaacgccagtattttcat

SEQ ID NO: 7467676 - DNA, 22 bp, Homo sapiens
ttccctggggaaggtgaccttt

SEQ ID NO: 7467677 - DNA, 22 bp, Homo sapiens
ttccctggggaaggtgaccttt

SEQ ID NO: 7467678 - DNA, 22 bp, Homo sapiens
ttcctaacaagtctatctttga

SEQ ID NO: 7467679 - DNA, 22 bp, Homo sapiens
ttcctaacaaggggtattcatc

SEQ ID NO: 7467680 - DNA, 22 bp, Homo sapiens
ttccctggctcttctacatcgt

SEQ ID NO: 7467681 - DNA, 22 bp, Homo sapiens
ttccctggctcttctacatcgt

SEQ ID NO: 7467682 - DNA, 22 bp, Homo sapiens
ttccctggctcttctacatcgt

SEQ ID NO: 7467683 - DNA, 22 bp, Homo sapiens
ttccctggccctggcacgctct

SEQ ID NO: 7467684 - DNA, 22 bp, Homo sapiens
ttccctggccctggcacgctct

SEQ ID NO: 7467685 - DNA, 22 bp, Homo sapiens
ttccctggccctggcacgctct

SEQ ID NO: 7467686 - DNA, 22 bp, Homo sapiens
ttccagagctttgcgcttggaa

SEQ ID NO: 7467687 - DNA, 22 bp, Homo sapiens
ttccctggaaagccatgcagtc

SEQ ID NO: 7467688 - DNA, 22 bp, Homo sapiens
ttccctggaaagccatgcagtc

SEQ ID NO: 7467689 - DNA, 22 bp, Homo sapiens
ttccctggaaagccatgcagtc

SEQ ID NO: 7467690 - DNA, 22 bp, Homo sapiens
ttccctggaacatcatggtcta

SEQ ID NO: 7467691 - DNA, 22 bp, Homo sapiens
ttccctggaacatcatggtcta

SEQ ID NO: 7467692 - DNA, 22 bp, Homo sapiens
ttccctggaacatcatggtcta

SEQ ID NO: 7467693 - DNA, 20 bp, Homo sapiens
ttccctggaaggagaagcag

SEQ ID NO: 7467694 - DNA, 20 bp, Homo sapiens
ttccctggaaggagaagcag

SEQ ID NO: 7467695 - DNA, 20 bp, Homo sapiens
ttccctggaaggagaagcag

SEQ ID NO: 7467696 - DNA, 22 bp, Homo sapiens
ttccctggaggagtagtgaaat

SEQ ID NO: 7467697 - DNA, 22 bp, Homo sapiens
ttccctggaggagtagtgaaat

SEQ ID NO: 7467698 - DNA, 22 bp, Homo sapiens
ttccctggcatgagtgtaagat

SEQ ID NO: 7467699 - DNA, 22 bp, Homo sapiens
ttccctggcatgagtgtaagat

SEQ ID NO: 7467700 - DNA, 22 bp, Homo sapiens
ttccagaattttgttctgcttg

SEQ ID NO: 7467701 - DNA, 22 bp, Homo sapiens
ttccagaattgggagccttgag

SEQ ID NO: 7467702 - DNA, 22 bp, Homo sapiens
ttccagaattgggagccttgag

SEQ ID NO: 7467703 - DNA, 22 bp, Homo sapiens
ttccagaattttgttctgcttg

SEQ ID NO: 7467704 - DNA, 22 bp, Homo sapiens
ttccagaccattccacgggaga

SEQ ID NO: 7467705 - DNA, 22 bp, Homo sapiens
ttccagaccattccacgggaga

SEQ ID NO: 7467706 - DNA, 22 bp, Homo sapiens
ttccagaattttgttctgcttg

SEQ ID NO: 7467707 - DNA, 22 bp, Homo sapiens
ttccagactatcagcagcagga

SEQ ID NO: 7467708 - DNA, 22 bp, Homo sapiens
ttccagactatcagcagcagga

SEQ ID NO: 7467709 - DNA, 22 bp, Homo sapiens
ttccagactatcagcagcagga

SEQ ID NO: 7467710 - DNA, 22 bp, Homo sapiens
ttccagaccattccacgggaga

SEQ ID NO: 7467711 - DNA, 22 bp, Homo sapiens
ttccagagagagaaaatttgat

SEQ ID NO: 7467712 - DNA, 22 bp, Homo sapiens
ttccagagagagaaaatttgat

SEQ ID NO: 7467713 - DNA, 22 bp, Homo sapiens
ttccagaacttttgttaatttc

SEQ ID NO: 7467714 - DNA, 22 bp, Homo sapiens
ttccagaactcaagaaatgccc

SEQ ID NO: 7467715 - DNA, 22 bp, Homo sapiens
ttccagaacttttgttaatttc

SEQ ID NO: 7467716 - DNA, 22 bp, Homo sapiens
ttccagaacttttgttaatttc

SEQ ID NO: 7467717 - DNA, 22 bp, Homo sapiens
ttccagaagatggcagcaaagg

SEQ ID NO: 7467718 - DNA, 22 bp, Homo sapiens
ttccagaagatggcagcaaagg

SEQ ID NO: 7467719 - DNA, 22 bp, Homo sapiens
ttccagaagatggcagcaaagg

SEQ ID NO: 7467720 - DNA, 22 bp, Homo sapiens
ttccagaagatggcagcaaagg

SEQ ID NO: 7467721 - DNA, 22 bp, Homo sapiens
ttccagaagcctccatattact

SEQ ID NO: 7467722 - DNA, 22 bp, Homo sapiens
ttccagaagcctccatattact

SEQ ID NO: 7467723 - DNA, 22 bp, Homo sapiens
ttccagaagcctccatattact

SEQ ID NO: 7467724 - DNA, 22 bp, Homo sapiens
ttccagaaggaagccggggagc

SEQ ID NO: 7467725 - DNA, 22 bp, Homo sapiens
ttccagaaggaagccggggagc

SEQ ID NO: 7467726 - DNA, 22 bp, Homo sapiens
ttccagaagcctccatattact

SEQ ID NO: 7467727 - DNA, 22 bp, Homo sapiens
ttccagaaggaagccggggagc

SEQ ID NO: 7467728 - DNA, 22 bp, Homo sapiens
ttccagaaggaagccggggagc

SEQ ID NO: 7467729 - DNA, 22 bp, Homo sapiens
ttccagaatagatggagctcta

SEQ ID NO: 7467730 - DNA, 22 bp, Homo sapiens
ttccagaatagatggagctcta

SEQ ID NO: 7467731 - DNA, 22 bp, Homo sapiens
ttccagaatagatggagctcta

SEQ ID NO: 7467732 - DNA, 22 bp, Homo sapiens
ttccagaattgggagccttgag

SEQ ID NO: 7467733 - DNA, 22 bp, Homo sapiens
ttccagaattgggagccttgag

SEQ ID NO: 7467734 - DNA, 22 bp, Homo sapiens
ttccagagagttattcccctgg

SEQ ID NO: 7467735 - DNA, 20 bp, Homo sapiens
ttccagagatctgcatttta

SEQ ID NO: 7467736 - DNA, 20 bp, Homo sapiens
ttccagagatctgcatttta

SEQ ID NO: 7467737 - DNA, 22 bp, Homo sapiens
ttccagagaggctcatgttccc

SEQ ID NO: 7467738 - DNA, 22 bp, Homo sapiens
ttccagagaggctcatgttccc

SEQ ID NO: 7467739 - DNA, 22 bp, Homo sapiens
ttccagagaggctcatgttccc

SEQ ID NO: 7467740 - DNA, 22 bp, Homo sapiens
ttccagagagttattcccctgg

SEQ ID NO: 7467741 - DNA, 22 bp, Homo sapiens
ttccagagcccatgctctaggc

SEQ ID NO: 7467742 - DNA, 22 bp, Homo sapiens
ttccagagcctagaatcttgat

SEQ ID NO: 7467743 - DNA, 22 bp, Homo sapiens
ttccagagcctagaatcttgat

SEQ ID NO: 7467744 - DNA, 22 bp, Homo sapiens
ttccagagctttgcgcttggaa

SEQ ID NO: 7467745 - DNA, 22 bp, Homo sapiens
ttccagagctttgcgcttggaa

SEQ ID NO: 7467746 - DNA, 22 bp, Homo sapiens
ttccagagcagttttcagatca

SEQ ID NO: 7467747 - DNA, 21 bp, Homo sapiens
ttccagagattgtttcacctg

SEQ ID NO: 7467748 - DNA, 22 bp, Homo sapiens
ttccagagcagttttcagatca

SEQ ID NO: 7467749 - DNA, 22 bp, Homo sapiens
ttccagagcagttttcagatca

SEQ ID NO: 7467750 - DNA, 22 bp, Homo sapiens
ttccacagtcatcctgggaatt

SEQ ID NO: 7467751 - DNA, 22 bp, Homo sapiens
ttccacagtcatcctgggaatt

SEQ ID NO: 7467752 - DNA, 22 bp, Homo sapiens
ttccacagtcatcctgggaatt

SEQ ID NO: 7467753 - DNA, 22 bp, Homo sapiens
ttccacagtcatcctgggaatt

SEQ ID NO: 7467754 - DNA, 22 bp, Homo sapiens
ttccacagtcatcctgggaatt

SEQ ID NO: 7467755 - DNA, 22 bp, Homo sapiens
ttccacaggtttcagactgttc

SEQ ID NO: 7467756 - DNA, 22 bp, Homo sapiens
ttccacaggtttcagactgttc

SEQ ID NO: 7467757 - DNA, 21 bp, Homo sapiens
ttccacagtgagaactgcaag

SEQ ID NO: 7467758 - DNA, 21 bp, Homo sapiens
ttccacagtgagaactgcaag

SEQ ID NO: 7467759 - DNA, 21 bp, Homo sapiens
ttccacagtgagaactgcaag

SEQ ID NO: 7467760 - DNA, 21 bp, Homo sapiens
ttccacagtcctgaggattca

SEQ ID NO: 7467761 - DNA, 21 bp, Homo sapiens
ttccacagtcctgaggattca

SEQ ID NO: 7467762 - DNA, 21 bp, Homo sapiens
ttccacagtcctgaggattca

SEQ ID NO: 7467763 - DNA, 16 bp, Homo sapiens
ttccacagtcgaggtg

SEQ ID NO: 7467764 - DNA, 16 bp, Homo sapiens
ttccacagtcgaggtg

SEQ ID NO: 7467765 - DNA, 22 bp, Homo sapiens
ttccacaggtttcagactgttc

SEQ ID NO: 7467766 - DNA, 22 bp, Homo sapiens
ttccacaggtttcagactgttc

SEQ ID NO: 7467767 - DNA, 22 bp, Homo sapiens
ttccacaggactaaatgtcatc

SEQ ID NO: 7467768 - DNA, 22 bp, Homo sapiens
ttccacaggactaaatgtcatc

SEQ ID NO: 7467769 - DNA, 22 bp, Homo sapiens
ttccacaggactaaatgtcatc

SEQ ID NO: 7467770 - DNA, 22 bp, Homo sapiens
ttccacagcccaagctggtggc

SEQ ID NO: 7467771 - DNA, 22 bp, Homo sapiens
ttccacagcccaagctggtggc

SEQ ID NO: 7467772 - DNA, 22 bp, Homo sapiens
ttccacagcccaagctggtggc

SEQ ID NO: 7467773 - DNA, 22 bp, Homo sapiens
ttccacagcccaagctggtggc

SEQ ID NO: 7467774 - DNA, 22 bp, Homo sapiens
ttccacagcccaagctggtggc

SEQ ID NO: 7467775 - DNA, 22 bp, Homo sapiens
ttccacagcccaagctggtggc

SEQ ID NO: 7467776 - DNA, 22 bp, Homo sapiens
ttccacagatgtatgaagtggt

SEQ ID NO: 7467777 - DNA, 22 bp, Homo sapiens
ttccacagccatcactgttgct

SEQ ID NO: 7467778 - DNA, 22 bp, Homo sapiens
ttccacagccatcactgttgct

SEQ ID NO: 7467779 - DNA, 22 bp, Homo sapiens
ttccacagatgtatgaagtggt

SEQ ID NO: 7467780 - DNA, 22 bp, Homo sapiens
ttccacagatgtatgaagtggt

SEQ ID NO: 7467781 - DNA, 22 bp, Homo sapiens
ttccacagatgaaaattaagtt

SEQ ID NO: 7467782 - DNA, 19 bp, Homo sapiens
ttccacacagctctcgggc

SEQ ID NO: 7467783 - DNA, 22 bp, Homo sapiens
ttccacagatgtatgaagtggt

SEQ ID NO: 7467784 - DNA, 22 bp, Homo sapiens
ttccagaactcaagaaatgccc

SEQ ID NO: 7467785 - DNA, 22 bp, Homo sapiens
ttccagaactcaagaaatgccc

SEQ ID NO: 7467786 - DNA, 22 bp, Homo sapiens
ttccagaaccttcctgctggaa

SEQ ID NO: 7467787 - DNA, 22 bp, Homo sapiens
ttccagaactcaagaaatgccc

SEQ ID NO: 7467788 - DNA, 22 bp, Homo sapiens
ttccagaaccttcctgctggaa

SEQ ID NO: 7467789 - DNA, 22 bp, Homo sapiens
ttccagaaccttcctgctggaa

SEQ ID NO: 7467790 - DNA, 22 bp, Homo sapiens
ttccagaacaatgtggacgtat

SEQ ID NO: 7467791 - DNA, 22 bp, Homo sapiens
ttccagaacaatgtggacgtat

SEQ ID NO: 7467792 - DNA, 22 bp, Homo sapiens
ttccagaacaatgtggacgtat

SEQ ID NO: 7467793 - DNA, 22 bp, Homo sapiens
ttccagaaatctttcagctcaa

SEQ ID NO: 7467794 - DNA, 22 bp, Homo sapiens
ttccagaaatctttcagctcaa

SEQ ID NO: 7467795 - DNA, 22 bp, Homo sapiens
ttccacattccttacattcata

SEQ ID NO: 7467796 - DNA, 22 bp, Homo sapiens
ttccacattccttacattcata

SEQ ID NO: 7467797 - DNA, 20 bp, Homo sapiens
ttccacatctttgcacatgc

SEQ ID NO: 7467798 - DNA, 20 bp, Homo sapiens
ttccacatctttgcacatgc

SEQ ID NO: 7467799 - DNA, 20 bp, Homo sapiens
ttccacatctttgcacatgc

SEQ ID NO: 7467800 - DNA, 22 bp, Homo sapiens
ttccacagtggctgtagttctg

SEQ ID NO: 7467801 - DNA, 22 bp, Homo sapiens
ttccacagtggctgtagttctg

SEQ ID NO: 7467802 - DNA, 22 bp, Homo sapiens
ttccacatagatcacaggtgtt

SEQ ID NO: 7467803 - DNA, 21 bp, Homo sapiens
ttccacagtgagaactgcaag

SEQ ID NO: 7467804 - DNA, 19 bp, Homo sapiens
ttccacacagctctcgggc

SEQ ID NO: 7467805 - DNA, 22 bp, Homo sapiens
ttccacactttcacacgaggtc

SEQ ID NO: 7467806 - DNA, 22 bp, Homo sapiens
ttccacacttaaggaatatgat

SEQ ID NO: 7467807 - DNA, 22 bp, Homo sapiens
ttccacacttaaggaatatgat

SEQ ID NO: 7467808 - DNA, 22 bp, Homo sapiens
ttccacaattcagattgttgcc

SEQ ID NO: 7467809 - DNA, 22 bp, Homo sapiens
ttccacaattcagattgttgcc

SEQ ID NO: 7467810 - DNA, 22 bp, Homo sapiens
ttccacaattcagattgttgcc

SEQ ID NO: 7467811 - DNA, 22 bp, Homo sapiens
ttccacaatggttaagctcgtt

SEQ ID NO: 7467812 - DNA, 22 bp, Homo sapiens
ttccacaattcagattgttgcc

SEQ ID NO: 7467813 - DNA, 22 bp, Homo sapiens
ttccacaatgtatgaataagat

SEQ ID NO: 7467814 - DNA, 22 bp, Homo sapiens
ttccacaatgccaggggcatca

SEQ ID NO: 7467815 - DNA, 22 bp, Homo sapiens
ttccacaatgccaggggcatca

SEQ ID NO: 7467816 - DNA, 23 bp, Homo sapiens
ttccacaatgaaaataaagcagg

SEQ ID NO: 7467817 - DNA, 22 bp, Homo sapiens
ttccacaagtgatatctagctg

SEQ ID NO: 7467818 - DNA, 23 bp, Homo sapiens
ttccacaatgaaaataaagcagg

SEQ ID NO: 7467819 - DNA, 23 bp, Homo sapiens
ttccacaatgaaaataaagcagg

SEQ ID NO: 7467820 - DNA, 17 bp, Homo sapiens
ttccacaatagtttgtc

SEQ ID NO: 7467821 - DNA, 17 bp, Homo sapiens
ttccacaatagtttgtc

SEQ ID NO: 7467822 - DNA, 17 bp, Homo sapiens
ttccacaatagtttgtc

SEQ ID NO: 7467823 - DNA, 22 bp, Homo sapiens
ttccacaagtgatatctagctg

SEQ ID NO: 7467824 - DNA, 22 bp, Homo sapiens
ttccacaagtgatatctagctg

SEQ ID NO: 7467825 - DNA, 22 bp, Homo sapiens
ttccacaaggccttgtcctgct

SEQ ID NO: 7467826 - DNA, 22 bp, Homo sapiens
ttccacaagtgatatctagctg

SEQ ID NO: 7467827 - DNA, 22 bp, Homo sapiens
ttccacaaggccttgtcctgct

SEQ ID NO: 7467828 - DNA, 22 bp, Homo sapiens
ttccacaaacacatcctgagca

SEQ ID NO: 7467829 - DNA, 22 bp, Homo sapiens
ttccacaagatgtttcttagaa

SEQ ID NO: 7467830 - DNA, 22 bp, Homo sapiens
ttccacaagatgtttcttagaa

SEQ ID NO: 7467831 - DNA, 22 bp, Homo sapiens
ttccacaagatgtttcttagaa

SEQ ID NO: 7467832 - DNA, 22 bp, Homo sapiens
ttccacaagatgtttcttagaa

SEQ ID NO: 7467833 - DNA, 22 bp, Homo sapiens
ttccacaagacttgggttaaga

SEQ ID NO: 7467834 - DNA, 22 bp, Homo sapiens
ttccacaacaaccaagcatata

SEQ ID NO: 7467835 - DNA, 22 bp, Homo sapiens
ttccacaacaaccaagcatata

SEQ ID NO: 7467836 - DNA, 22 bp, Homo sapiens
ttccacaaatacactccacatt

SEQ ID NO: 7467837 - DNA, 22 bp, Homo sapiens
ttccacaaatacactccacatt

SEQ ID NO: 7467838 - DNA, 22 bp, Homo sapiens
ttccacaaatcaattctgctga

SEQ ID NO: 7467839 - DNA, 22 bp, Homo sapiens
ttccacaaatcaattctgctga

SEQ ID NO: 7467840 - DNA, 22 bp, Homo sapiens
ttccacaaatcaattctgctga

SEQ ID NO: 7467841 - DNA, 22 bp, Homo sapiens
ttccacaaatcaattctgctga

SEQ ID NO: 7467842 - DNA, 22 bp, Homo sapiens
ttccacaaacacatcctgagca

SEQ ID NO: 7467843 - DNA, 22 bp, Homo sapiens
ttccacaaacacatcctgagca

SEQ ID NO: 7467844 - DNA, 22 bp, Homo sapiens
ttccacaaacacatcctgagca

SEQ ID NO: 7467845 - DNA, 22 bp, Homo sapiens
ttccacaaatacactccacatt

SEQ ID NO: 7467846 - DNA, 22 bp, Homo sapiens
ttccacaaatacactccacatt

SEQ ID NO: 7467847 - DNA, 22 bp, Homo sapiens
ttcctccagaagctgtagggga

SEQ ID NO: 7467848 - DNA, 22 bp, Homo sapiens
ttcctccagaagctgtagggga

SEQ ID NO: 7467849 - DNA, 22 bp, Homo sapiens
ttcctccacgtgacaggagcca

SEQ ID NO: 7467850 - DNA, 22 bp, Homo sapiens
ttcctccacgtgacaggagcca

SEQ ID NO: 7467851 - DNA, 22 bp, Homo sapiens
ttcctccacgtgacaggagcca

SEQ ID NO: 7467852 - DNA, 18 bp, Homo sapiens
ttcctccacagagcgctg

SEQ ID NO: 7467853 - DNA, 18 bp, Homo sapiens
ttcctccacagagcgctg

SEQ ID NO: 7467854 - DNA, 18 bp, Homo sapiens
ttcctccacagagcgctg

SEQ ID NO: 7467855 - DNA, 22 bp, Homo sapiens
ttcctcatggggttccttcaga

SEQ ID NO: 7467856 - DNA, 22 bp, Homo sapiens
ttcctcagttagtgcctgaggc

SEQ ID NO: 7467857 - DNA, 22 bp, Homo sapiens
ttcctcatggggttccttcaga

SEQ ID NO: 7467858 - DNA, 22 bp, Homo sapiens
ttcctcatggggttccttcaga

SEQ ID NO: 7467859 - DNA, 22 bp, Homo sapiens
ttcctcatctgtgcacctcact

SEQ ID NO: 7467860 - DNA, 22 bp, Homo sapiens
ttcctcagttagtgcctgaggc

SEQ ID NO: 7467861 - DNA, 22 bp, Homo sapiens
ttcctcagttagtgcctgaggc

SEQ ID NO: 7467862 - DNA, 22 bp, Homo sapiens
ttcctcatctagcacagaaatt

SEQ ID NO: 7467863 - DNA, 22 bp, Homo sapiens
ttcctcatctagcacagaaatt

SEQ ID NO: 7467864 - DNA, 22 bp, Homo sapiens
ttcctctggggccaggccaaca

SEQ ID NO: 7467865 - DNA, 22 bp, Homo sapiens
ttcctctggggccaggccaaca

SEQ ID NO: 7467866 - DNA, 22 bp, Homo sapiens
ttcctctggaggctctaggaga

SEQ ID NO: 7467867 - DNA, 22 bp, Homo sapiens
ttcctctgtagttgctgatgaa

SEQ ID NO: 7467868 - DNA, 22 bp, Homo sapiens
ttcctctggggccaggccaaca

SEQ ID NO: 7467869 - DNA, 22 bp, Homo sapiens
ttcctccagcctggagcacttc

SEQ ID NO: 7467870 - DNA, 22 bp, Homo sapiens
ttcctccagcctggagcacttc

SEQ ID NO: 7467871 - DNA, 22 bp, Homo sapiens
ttcctccagccatgattgtaaa

SEQ ID NO: 7467872 - DNA, 22 bp, Homo sapiens
ttcctccagcctggagcacttc

SEQ ID NO: 7467873 - DNA, 22 bp, Homo sapiens
ttcctccagaagctgtagggga

SEQ ID NO: 7467874 - DNA, 22 bp, Homo sapiens
ttcctccagccatgattgtaaa

SEQ ID NO: 7467875 - DNA, 22 bp, Homo sapiens
ttcctcttattttcccagtgat

SEQ ID NO: 7467876 - DNA, 22 bp, Homo sapiens
ttcctcttattttcccagtgat

SEQ ID NO: 7467877 - DNA, 22 bp, Homo sapiens
ttcctctgtatgctttgctgct

SEQ ID NO: 7467878 - DNA, 22 bp, Homo sapiens
ttcctcttatatagccttggcc

SEQ ID NO: 7467879 - DNA, 22 bp, Homo sapiens
ttcctctgtatgctttgctgct

SEQ ID NO: 7467880 - DNA, 22 bp, Homo sapiens
ttcctctgtagttgctgatgaa

SEQ ID NO: 7467881 - DNA, 22 bp, Homo sapiens
ttcctctgtagttgctgatgaa

SEQ ID NO: 7467882 - DNA, 22 bp, Homo sapiens
ttcctctgtagttgctgatgaa

SEQ ID NO: 7467883 - DNA, 22 bp, Homo sapiens
ttcctcagctgtgtcctggcga

SEQ ID NO: 7467884 - DNA, 22 bp, Homo sapiens
ttcctcagctgtgtcctggcga

SEQ ID NO: 7467885 - DNA, 22 bp, Homo sapiens
ttcctcagctgtgtcctggcga

SEQ ID NO: 7467886 - DNA, 22 bp, Homo sapiens
ttcctcagctgtgtcctggcga

SEQ ID NO: 7467887 - DNA, 22 bp, Homo sapiens
ttcctcagctgtttgggctcat

SEQ ID NO: 7467888 - DNA, 22 bp, Homo sapiens
ttcctcagctgtttgggctcat

SEQ ID NO: 7467889 - DNA, 22 bp, Homo sapiens
ttcctcagctgtgtcctggcga

SEQ ID NO: 7467890 - DNA, 22 bp, Homo sapiens
ttcctcagctttagactatgaa

SEQ ID NO: 7467891 - DNA, 22 bp, Homo sapiens
ttcctcagctgtttgggctcat

SEQ ID NO: 7467892 - DNA, 22 bp, Homo sapiens
ttcctcaggctgctttcacata

SEQ ID NO: 7467893 - DNA, 22 bp, Homo sapiens
ttcctcaggctgctttcacata

SEQ ID NO: 7467894 - DNA, 22 bp, Homo sapiens
ttcctcaggcttccctttgtcc

SEQ ID NO: 7467895 - DNA, 22 bp, Homo sapiens
ttcctcaggctgctttcacata

SEQ ID NO: 7467896 - DNA, 22 bp, Homo sapiens
ttcctcaggctgctttcacata

SEQ ID NO: 7467897 - DNA, 22 bp, Homo sapiens
ttcctcaggactgttgacttcc

SEQ ID NO: 7467898 - DNA, 20 bp, Homo sapiens
ttcctcaggagaggatgtta

SEQ ID NO: 7467899 - DNA, 22 bp, Homo sapiens
ttcctcaggactgttgacttcc

SEQ ID NO: 7467900 - DNA, 20 bp, Homo sapiens
ttcctcaggagaggatgtta

SEQ ID NO: 7467901 - DNA, 20 bp, Homo sapiens
ttcctcaggagaggatgtta

SEQ ID NO: 7467902 - DNA, 22 bp, Homo sapiens
ttcctcagctttagactatgaa

SEQ ID NO: 7467903 - DNA, 22 bp, Homo sapiens
ttcctcagttagtgcctgaggc

SEQ ID NO: 7467904 - DNA, 22 bp, Homo sapiens
ttcctcagttagtgcctgaggc

SEQ ID NO: 7467905 - DNA, 22 bp, Homo sapiens
ttcctcagttagtgcctgaggc

SEQ ID NO: 7467906 - DNA, 22 bp, Homo sapiens
ttcctcagttagtgcctgaggc

SEQ ID NO: 7467907 - DNA, 22 bp, Homo sapiens
ttcctcagttagtgcctgaggc

SEQ ID NO: 7467908 - DNA, 22 bp, Homo sapiens
ttcctcaggtgctacaaagcag

SEQ ID NO: 7467909 - DNA, 22 bp, Homo sapiens
ttcctcaggtgctacaaagcag

SEQ ID NO: 7467910 - DNA, 22 bp, Homo sapiens
ttcctcaggtgctacaaagcag

SEQ ID NO: 7467911 - DNA, 22 bp, Homo sapiens
ttcctcaggtgctacaaagcag

SEQ ID NO: 7467912 - DNA, 22 bp, Homo sapiens
ttcctcagtgatggattcaacg

SEQ ID NO: 7467913 - DNA, 22 bp, Homo sapiens
ttcctcagtgcccccatacggt

SEQ ID NO: 7467914 - DNA, 22 bp, Homo sapiens
ttcctcagtgcccccatacggt

SEQ ID NO: 7467915 - DNA, 22 bp, Homo sapiens
ttcctcagtgatggattcaacg

SEQ ID NO: 7467916 - DNA, 22 bp, Homo sapiens
ttcctcagggcggatgggcagg

SEQ ID NO: 7467917 - DNA, 22 bp, Homo sapiens
ttcctcagggcggatgggcagg

SEQ ID NO: 7467918 - DNA, 22 bp, Homo sapiens
ttcctcagggcggatgggcagg

SEQ ID NO: 7467919 - DNA, 22 bp, Homo sapiens
ttcctcagggcggatgggcagg

SEQ ID NO: 7467920 - DNA, 22 bp, Homo sapiens
ttcctcagggaggctagcagta

SEQ ID NO: 7467921 - DNA, 22 bp, Homo sapiens
ttcctcagggaggctagcagta

SEQ ID NO: 7467922 - DNA, 22 bp, Homo sapiens
ttcctcagggaggctagcagta

SEQ ID NO: 7467923 - DNA, 22 bp, Homo sapiens
ttcctcagggaggctagcagta

SEQ ID NO: 7467924 - DNA, 22 bp, Homo sapiens
ttcctcagggaggctagcagta

SEQ ID NO: 7467925 - DNA, 22 bp, Homo sapiens
ttcctcagggaggctagcagta

SEQ ID NO: 7467926 - DNA, 22 bp, Homo sapiens
ttcctcaggcttccctttgtcc

SEQ ID NO: 7467927 - DNA, 22 bp, Homo sapiens
ttcctcaggcttccctttgtcc

SEQ ID NO: 7467928 - DNA, 22 bp, Homo sapiens
ttcctcaggcttccctttgtcc

SEQ ID NO: 7467929 - DNA, 22 bp, Homo sapiens
ttcctaggatggtgaagcagga

SEQ ID NO: 7467930 - DNA, 22 bp, Homo sapiens
ttcctagacagttcttcccaaa

SEQ ID NO: 7467931 - DNA, 22 bp, Homo sapiens
ttcctagctataaagctcttcc

SEQ ID NO: 7467932 - DNA, 22 bp, Homo sapiens
ttcctagacagttcttcccaaa

SEQ ID NO: 7467933 - DNA, 22 bp, Homo sapiens
ttcctagggcagagccgctggg

SEQ ID NO: 7467934 - DNA, 22 bp, Homo sapiens
ttcctagggcagagccgctggg

SEQ ID NO: 7467935 - DNA, 22 bp, Homo sapiens
ttcctagggcagagccgctggg

SEQ ID NO: 7467936 - DNA, 22 bp, Homo sapiens
ttcctagggcagagccgctggg

SEQ ID NO: 7467937 - DNA, 22 bp, Homo sapiens
ttcctagggcagagccgctggg

SEQ ID NO: 7467938 - DNA, 22 bp, Homo sapiens
ttcctaggatggtgaagcagga

SEQ ID NO: 7467939 - DNA, 22 bp, Homo sapiens
ttcctagggcagagccgctggg

SEQ ID NO: 7467940 - DNA, 22 bp, Homo sapiens
ttcctagggcagagccgctggg

SEQ ID NO: 7467941 - DNA, 22 bp, Homo sapiens
ttcctagggcagagccgctggg

SEQ ID NO: 7467942 - DNA, 22 bp, Homo sapiens
ttcctagggcagagccgctggg

SEQ ID NO: 7467943 - DNA, 22 bp, Homo sapiens
ttcctagaatggttagaaaata

SEQ ID NO: 7467944 - DNA, 22 bp, Homo sapiens
ttcctagaatggttagaaaata

SEQ ID NO: 7467945 - DNA, 22 bp, Homo sapiens
ttcctacatttgtacaataaga

SEQ ID NO: 7467946 - DNA, 22 bp, Homo sapiens
ttcctacaattagagcctcttt

SEQ ID NO: 7467947 - DNA, 22 bp, Homo sapiens
ttcctacagccctgaatctcta

SEQ ID NO: 7467948 - DNA, 22 bp, Homo sapiens
ttcctataagcctgtagtctca

SEQ ID NO: 7467949 - DNA, 22 bp, Homo sapiens
ttcctatggccagagtcaaaga

SEQ ID NO: 7467950 - DNA, 22 bp, Homo sapiens
ttcctaggtgtttacattcaac

SEQ ID NO: 7467951 - DNA, 22 bp, Homo sapiens
ttcctagggcagagccgctggg

SEQ ID NO: 7467952 - DNA, 22 bp, Homo sapiens
ttcctagggcagagccgctggg

SEQ ID NO: 7467953 - DNA, 22 bp, Homo sapiens
ttcctatttccatgaaacacaa

SEQ ID NO: 7467954 - DNA, 22 bp, Homo sapiens
ttcctcacactcccccattcga

SEQ ID NO: 7467955 - DNA, 22 bp, Homo sapiens
ttcctcacactcccccattcga

SEQ ID NO: 7467956 - DNA, 22 bp, Homo sapiens
ttcctcacctaattgggagggg

SEQ ID NO: 7467957 - DNA, 22 bp, Homo sapiens
ttcctcacactcccccattcga

SEQ ID NO: 7467958 - DNA, 22 bp, Homo sapiens
ttcctcacactcccccattcga

SEQ ID NO: 7467959 - DNA, 22 bp, Homo sapiens
ttcctatgtgggcagagacaca

SEQ ID NO: 7467960 - DNA, 22 bp, Homo sapiens
ttcctatgtgggcagagacaca

SEQ ID NO: 7467961 - DNA, 22 bp, Homo sapiens
ttcctcagagagacagaaacta

SEQ ID NO: 7467962 - DNA, 22 bp, Homo sapiens
ttcctcagagagacagaaacta

SEQ ID NO: 7467963 - DNA, 22 bp, Homo sapiens
ttcctcagagggcgctggggaa

SEQ ID NO: 7467964 - DNA, 22 bp, Homo sapiens
ttcctcagagagacagaaacta

SEQ ID NO: 7467965 - DNA, 22 bp, Homo sapiens
ttcctcagagagacagaaacta

SEQ ID NO: 7467966 - DNA, 22 bp, Homo sapiens
ttcctcagagagacagaaacta

SEQ ID NO: 7467967 - DNA, 22 bp, Homo sapiens
ttcctcagagggcgctggggaa

SEQ ID NO: 7467968 - DNA, 22 bp, Homo sapiens
ttcctcagagggcgctggggaa

SEQ ID NO: 7467969 - DNA, 22 bp, Homo sapiens
ttcctcagagggcgctggggaa

SEQ ID NO: 7467970 - DNA, 22 bp, Homo sapiens
ttcctcagagggcgctggggaa

SEQ ID NO: 7467971 - DNA, 22 bp, Homo sapiens
ttcctcagaccctcattgtgag

SEQ ID NO: 7467972 - DNA, 22 bp, Homo sapiens
ttcctcagaccctcattgtgag

SEQ ID NO: 7467973 - DNA, 22 bp, Homo sapiens
ttcctcagaccctcattgtgag

SEQ ID NO: 7467974 - DNA, 22 bp, Homo sapiens
ttcctcagaccctcattgtgag

SEQ ID NO: 7467975 - DNA, 22 bp, Homo sapiens
ttcctcagaccctcattgtgag

SEQ ID NO: 7467976 - DNA, 22 bp, Homo sapiens
ttcctcagaaaatactgtccaa

SEQ ID NO: 7467977 - DNA, 22 bp, Homo sapiens
ttcctcagaaaatactgtccaa

SEQ ID NO: 7467978 - DNA, 22 bp, Homo sapiens
ttcctcacctaattgggagggg

SEQ ID NO: 7467979 - DNA, 22 bp, Homo sapiens
ttcctcagaaaatactgtccaa

SEQ ID NO: 7467980 - DNA, 22 bp, Homo sapiens
ttcctcagaaaatactgtccaa

SEQ ID NO: 7467981 - DNA, 22 bp, Homo sapiens
ttcctcagctggcctgattggg

SEQ ID NO: 7467982 - DNA, 22 bp, Homo sapiens
ttcctcagctggcctgattggg

SEQ ID NO: 7467983 - DNA, 22 bp, Homo sapiens
ttcctcagctggcctgattggg

SEQ ID NO: 7467984 - DNA, 22 bp, Homo sapiens
ttcctcagctggcctgattggg

SEQ ID NO: 7467985 - DNA, 22 bp, Homo sapiens
ttcctcagctggcctgattggg

SEQ ID NO: 7467986 - DNA, 22 bp, Homo sapiens
ttcctcagctcagcgagagaga

SEQ ID NO: 7467987 - DNA, 22 bp, Homo sapiens
ttcctcagctcagcgagagaga

SEQ ID NO: 7467988 - DNA, 22 bp, Homo sapiens
ttcctcagccagcacttagggg

SEQ ID NO: 7467989 - DNA, 22 bp, Homo sapiens
ttcctcagccagcacttagggg

SEQ ID NO: 7467990 - DNA, 22 bp, Homo sapiens
ttcctcagccagcacttagggg

SEQ ID NO: 7467991 - DNA, 22 bp, Homo sapiens
ttcctcagctcagcgagagaga

SEQ ID NO: 7467992 - DNA, 22 bp, Homo sapiens
ttcctcagctcagcgagagaga

SEQ ID NO: 7467993 - DNA, 22 bp, Homo sapiens
ttcctcagccagcacttagggg

SEQ ID NO: 7467994 - DNA, 22 bp, Homo sapiens
ttcctcagccaaggctgggatc

SEQ ID NO: 7467995 - DNA, 22 bp, Homo sapiens
ttcctcagccaaggctgggatc

SEQ ID NO: 7467996 - DNA, 22 bp, Homo sapiens
ttcctcagccaaggctgggatc

SEQ ID NO: 7467997 - DNA, 22 bp, Homo sapiens
ttcctcagccaaggctgggatc

SEQ ID NO: 7467998 - DNA, 22 bp, Homo sapiens
ttcctcagccagcacttagggg

SEQ ID NO: 7467999 - DNA, 22 bp, Homo sapiens
ttcctcagccaaggctgggatc

SEQ ID NO: 7468000 - DNA, 22 bp, Homo sapiens
ttcctcagcacaaagccaagat

SEQ ID NO: 7468001 - DNA, 22 bp, Homo sapiens
ttcctcagcacaaagccaagat

SEQ ID NO: 7468002 - DNA, 22 bp, Homo sapiens
ttcctcagagggcgctggggaa

SEQ ID NO: 7468003 - DNA, 22 bp, Homo sapiens
ttcctcagcacaaagccaagat

SEQ ID NO: 7468004 - DNA, 22 bp, Homo sapiens
ttcctcagcacaaagccaagat

SEQ ID NO: 7468005 - DNA, 22 bp, Homo sapiens
ttcctcagcacaaagccaagat

SEQ ID NO: 7468006 - DNA, 22 bp, Homo sapiens
gtaggcagggctgtggggagaa

SEQ ID NO: 7468007 - DNA, 22 bp, Homo sapiens
gtaggcagggctgtggggagaa

SEQ ID NO: 7468008 - DNA, 22 bp, Homo sapiens
gtaggcaggtggaggagtgaag

SEQ ID NO: 7468009 - DNA, 22 bp, Homo sapiens
gtaggcaggtggaggagtgaag

SEQ ID NO: 7468010 - DNA, 22 bp, Homo sapiens
gtagaaatatttatctctgaga

SEQ ID NO: 7468011 - DNA, 22 bp, Homo sapiens
gtaggcaggtggaggagtgaag

SEQ ID NO: 7468012 - DNA, 22 bp, Homo sapiens
gtaggcaggtggaggagtgaag

SEQ ID NO: 7468013 - DNA, 22 bp, Homo sapiens
gtaggcagtctctcaggtgatc

SEQ ID NO: 7468014 - DNA, 22 bp, Homo sapiens
gtagaaatatttatctctgaga

SEQ ID NO: 7468015 - DNA, 22 bp, Homo sapiens
gtagaaatatttatctctgaga

SEQ ID NO: 7468016 - DNA, 22 bp, Homo sapiens
gtagaaatggtgtgtttcttct

SEQ ID NO: 7468017 - DNA, 22 bp, Homo sapiens
gtagaaatatttatctctgaga

SEQ ID NO: 7468018 - DNA, 22 bp, Homo sapiens
gtaggcagataggagtgcagcc

SEQ ID NO: 7468019 - DNA, 22 bp, Homo sapiens
gtaggcagataggagtgcagcc

SEQ ID NO: 7468020 - DNA, 22 bp, Homo sapiens
gtaggcagggctgtggggagaa

SEQ ID NO: 7468021 - DNA, 22 bp, Homo sapiens
gtaggcagataggagtgcagcc

SEQ ID NO: 7468022 - DNA, 22 bp, Homo sapiens
gtaggcagtggttggaagagaa

SEQ ID NO: 7468023 - DNA, 22 bp, Homo sapiens
gtaggcagtggttggaagagaa

SEQ ID NO: 7468024 - DNA, 22 bp, Homo sapiens
gtaggcagtggttggaagagaa

SEQ ID NO: 7468025 - DNA, 22 bp, Homo sapiens
gtaggcagtctctcaggtgatc

SEQ ID NO: 7468026 - DNA, 22 bp, Homo sapiens
gtaggcagtctctcaggtgatc

SEQ ID NO: 7468027 - DNA, 22 bp, Homo sapiens
gtaggcagtctctcaggtgatc

SEQ ID NO: 7468028 - DNA, 22 bp, Homo sapiens
gtaggcagtgcttgattttcca

SEQ ID NO: 7468029 - DNA, 22 bp, Homo sapiens
gtaggcagtgcttgattttcca

SEQ ID NO: 7468030 - DNA, 22 bp, Homo sapiens
gtaggctgtgtgaggctagaga

SEQ ID NO: 7468031 - DNA, 22 bp, Homo sapiens
gtaggctgtgtgaggctagaga

SEQ ID NO: 7468032 - DNA, 22 bp, Homo sapiens
gtaggccatggtggttgtctct

SEQ ID NO: 7468033 - DNA, 22 bp, Homo sapiens
gtaggccatggtggttgtctct

SEQ ID NO: 7468034 - DNA, 22 bp, Homo sapiens
gtaggccatggtggttgtctct

SEQ ID NO: 7468035 - DNA, 22 bp, Homo sapiens
gtaggctgtgtgaggctagaga

SEQ ID NO: 7468036 - DNA, 22 bp, Homo sapiens
gtaggccagtgtgaaacctggt

SEQ ID NO: 7468037 - DNA, 22 bp, Homo sapiens
gtaggcagtggttggaagagaa

SEQ ID NO: 7468038 - DNA, 22 bp, Homo sapiens
gtacttctttagtcaatatgta

SEQ ID NO: 7468039 - DNA, 22 bp, Homo sapiens
gtacttctttagtcaatatgta

SEQ ID NO: 7468040 - DNA, 22 bp, Homo sapiens
gtacttctttagtcaatatgta

SEQ ID NO: 7468041 - DNA, 22 bp, Homo sapiens
gtacttctcaaactagaaacta

SEQ ID NO: 7468042 - DNA, 22 bp, Homo sapiens
gtacttctcaaactagaaacta

SEQ ID NO: 7468043 - DNA, 22 bp, Homo sapiens
gtacttctggccaggctggcca

SEQ ID NO: 7468044 - DNA, 22 bp, Homo sapiens
gtacttcttaaattaggatcaa

SEQ ID NO: 7468045 - DNA, 22 bp, Homo sapiens
gtactgtgctagttgatgggag

SEQ ID NO: 7468046 - DNA, 22 bp, Homo sapiens
gtactcagtaatataacatatt

SEQ ID NO: 7468047 - DNA, 22 bp, Homo sapiens
gtactgttggatgttgcagttt

SEQ ID NO: 7468048 - DNA, 20 bp, Homo sapiens
gtacttcaggtgtggtctga

SEQ ID NO: 7468049 - DNA, 22 bp, Homo sapiens
gtactttaaatcaatgtagatt

SEQ ID NO: 7468050 - DNA, 22 bp, Homo sapiens
gtactttaaatcaatgtagatt

SEQ ID NO: 7468051 - DNA, 22 bp, Homo sapiens
gtacttccagccaagtgagaca

SEQ ID NO: 7468052 - DNA, 22 bp, Homo sapiens
gtactttaaatcaatgtagatt

SEQ ID NO: 7468053 - DNA, 22 bp, Homo sapiens
gtactttagagtaaaatagacc

SEQ ID NO: 7468054 - DNA, 22 bp, Homo sapiens
gtactttaagactccagtagca

SEQ ID NO: 7468055 - DNA, 22 bp, Homo sapiens
gtactttagagtaaaatagacc

SEQ ID NO: 7468056 - DNA, 22 bp, Homo sapiens
gtagaaatagtggttgacagga

SEQ ID NO: 7468057 - DNA, 22 bp, Homo sapiens
gtagaaatagtggttgacagga

SEQ ID NO: 7468058 - DNA, 22 bp, Homo sapiens
gtagaaatagtggttgacagga

SEQ ID NO: 7468059 - DNA, 22 bp, Homo sapiens
gtagaaatagtggttgacagga

SEQ ID NO: 7468060 - DNA, 22 bp, Homo sapiens
gtagaaatagtggttgacagga

SEQ ID NO: 7468061 - DNA, 22 bp, Homo sapiens
gtagaaaattaggatgaggctt

SEQ ID NO: 7468062 - DNA, 22 bp, Homo sapiens
gtagaaaattaggatgaggctt

SEQ ID NO: 7468063 - DNA, 22 bp, Homo sapiens
gtagaaaattaggatgaggctt

SEQ ID NO: 7468064 - DNA, 22 bp, Homo sapiens
gtagaaaattaggatgaggctt

SEQ ID NO: 7468065 - DNA, 22 bp, Homo sapiens
gtactttagagtaaaatagacc

SEQ ID NO: 7468066 - DNA, 22 bp, Homo sapiens
gtagaaaaagcagtaagtctca

SEQ ID NO: 7468067 - DNA, 22 bp, Homo sapiens
gtagaaaaagcagtaagtctca

SEQ ID NO: 7468068 - DNA, 22 bp, Homo sapiens
gtagaaaaagcagtaagtctca

SEQ ID NO: 7468069 - DNA, 22 bp, Homo sapiens
gtagaaaaagcagtaagtctca

SEQ ID NO: 7468070 - DNA, 22 bp, Homo sapiens
gtagaaaaagcagtaagtctca

SEQ ID NO: 7468071 - DNA, 22 bp, Homo sapiens
gtagaaaaagcagtaagtctca

SEQ ID NO: 7468072 - DNA, 22 bp, Homo sapiens
gtagaaaaagcagtaagtctca

SEQ ID NO: 7468073 - DNA, 22 bp, Homo sapiens
gtactcagtaatataacatatt

SEQ ID NO: 7468074 - DNA, 20 bp, Homo sapiens
gtactcagatcaagtcagct

SEQ ID NO: 7468075 - DNA, 20 bp, Homo sapiens
gtactcagatcaagtcagct

SEQ ID NO: 7468076 - DNA, 22 bp, Homo sapiens
gtactagatgagacagcgtggg

SEQ ID NO: 7468077 - DNA, 22 bp, Homo sapiens
gtactagagatgtgtgcgggta

SEQ ID NO: 7468078 - DNA, 22 bp, Homo sapiens
gtactacagtttctcattaaat

SEQ ID NO: 7468079 - DNA, 22 bp, Homo sapiens
gtactacagtttctcattaaat

SEQ ID NO: 7468080 - DNA, 22 bp, Homo sapiens
gtactgaataacaaagtctgtc

SEQ ID NO: 7468081 - DNA, 22 bp, Homo sapiens
gtactaagtcaggagaagaatt

SEQ ID NO: 7468082 - DNA, 22 bp, Homo sapiens
gtacacttgactcataggaaat

SEQ ID NO: 7468083 - DNA, 22 bp, Homo sapiens
gtactaaaaaatgatcagtttg

SEQ ID NO: 7468084 - DNA, 22 bp, Homo sapiens
gtactaaacagagaaccaatat

SEQ ID NO: 7468085 - DNA, 22 bp, Homo sapiens
gtacacttgtcttgaacagcct

SEQ ID NO: 7468086 - DNA, 22 bp, Homo sapiens
gtacacttgtcttgaacagcct

SEQ ID NO: 7468087 - DNA, 20 bp, Homo sapiens
gtacacttcatgtttcacct

SEQ ID NO: 7468088 - DNA, 20 bp, Homo sapiens
gtacacttcatgtttcacct

SEQ ID NO: 7468089 - DNA, 22 bp, Homo sapiens
gtacacttgactcataggaaat

SEQ ID NO: 7468090 - DNA, 20 bp, Homo sapiens
gtacacttcatgtttcacct

SEQ ID NO: 7468091 - DNA, 22 bp, Homo sapiens
gtacactccccctgtgaagttg

SEQ ID NO: 7468092 - DNA, 18 bp, Homo sapiens
gtacactacatgtctaac

SEQ ID NO: 7468093 - DNA, 22 bp, Homo sapiens
gtacacattgtctgtttacttc

SEQ ID NO: 7468094 - DNA, 22 bp, Homo sapiens
gtacactattaaacctgctcat

SEQ ID NO: 7468095 - DNA, 22 bp, Homo sapiens
gtacactccccctgtgaagttg

SEQ ID NO: 7468096 - DNA, 22 bp, Homo sapiens
gtacactccccctgtgaagttg

SEQ ID NO: 7468097 - DNA, 22 bp, Homo sapiens
gtacacattatgcttctctaaa

SEQ ID NO: 7468098 - DNA, 22 bp, Homo sapiens
gtacacattatgcttctctaaa

SEQ ID NO: 7468099 - DNA, 22 bp, Homo sapiens
gtacacattatgcttctctaaa

SEQ ID NO: 7468100 - DNA, 22 bp, Homo sapiens
gtacacattatgcttctctaaa

SEQ ID NO: 7468101 - DNA, 22 bp, Homo sapiens
gtacacattgtctgtttacttc

SEQ ID NO: 7468102 - DNA, 22 bp, Homo sapiens
gtacacattgtctgtttacttc

SEQ ID NO: 7468103 - DNA, 22 bp, Homo sapiens
gtacacattgtctgtttacttc

SEQ ID NO: 7468104 - DNA, 22 bp, Homo sapiens
gtacacattgtctgtttacttc

SEQ ID NO: 7468105 - DNA, 22 bp, Homo sapiens
gtacacatatttccaagggtaa

SEQ ID NO: 7468106 - DNA, 22 bp, Homo sapiens
gtacacatatttccaagggtaa

SEQ ID NO: 7468107 - DNA, 22 bp, Homo sapiens
gtacacatatttccaagggtaa

SEQ ID NO: 7468108 - DNA, 22 bp, Homo sapiens
gtacacatatattaaaaattgt

SEQ ID NO: 7468109 - DNA, 22 bp, Homo sapiens
gtacacatatattaaaaattgt

SEQ ID NO: 7468110 - DNA, 22 bp, Homo sapiens
gtacacatatattaaaaattgt

SEQ ID NO: 7468111 - DNA, 20 bp, Homo sapiens
gtacacatatatgtatgtgt

SEQ ID NO: 7468112 - DNA, 22 bp, Homo sapiens
gtacacatatattaaaaattgt

SEQ ID NO: 7468113 - DNA, 20 bp, Homo sapiens
gtacacatatatgtatgtgt

SEQ ID NO: 7468114 - DNA, 23 bp, Homo sapiens
gtacacatagtgtagttatattt

SEQ ID NO: 7468115 - DNA, 23 bp, Homo sapiens
gtacacatagtgtagttatattt

SEQ ID NO: 7468116 - DNA, 23 bp, Homo sapiens
gtacacatagtgtagttatattt

SEQ ID NO: 7468117 - DNA, 23 bp, Homo sapiens
gtacacatagtgtagttatattt

SEQ ID NO: 7468118 - DNA, 20 bp, Homo sapiens
gtacacatatatgtatgtgt

SEQ ID NO: 7468119 - DNA, 20 bp, Homo sapiens
gtacacatatatgtatgtgt

SEQ ID NO: 7468120 - DNA, 22 bp, Homo sapiens
gtacacagagtggtggaagaaa

SEQ ID NO: 7468121 - DNA, 22 bp, Homo sapiens
gtacacagagtggtggaagaaa

SEQ ID NO: 7468122 - DNA, 22 bp, Homo sapiens
gtacacagagtggtggaagaaa

SEQ ID NO: 7468123 - DNA, 22 bp, Homo sapiens
gtacacagagtggtggaagaaa

SEQ ID NO: 7468124 - DNA, 22 bp, Homo sapiens
gtacacagagtggtggaagaaa

SEQ ID NO: 7468125 - DNA, 22 bp, Homo sapiens
gtacacagatgcttgagaatct

SEQ ID NO: 7468126 - DNA, 22 bp, Homo sapiens
gtacacagatgcttgagaatct

SEQ ID NO: 7468127 - DNA, 22 bp, Homo sapiens
gtacacagatgcttgagaatct

SEQ ID NO: 7468128 - DNA, 22 bp, Homo sapiens
gtacacagatgcttgagaatct

SEQ ID NO: 7468129 - DNA, 21 bp, Homo sapiens
gtacacagtggttctgaggga

SEQ ID NO: 7468130 - DNA, 22 bp, Homo sapiens
gtacacatactattcaaagaga

SEQ ID NO: 7468131 - DNA, 22 bp, Homo sapiens
gtacacatactattcaaagaga

SEQ ID NO: 7468132 - DNA, 22 bp, Homo sapiens
gtacacaggcagcccagtgctg

SEQ ID NO: 7468133 - DNA, 22 bp, Homo sapiens
gtacacaggcagcccagtgctg

SEQ ID NO: 7468134 - DNA, 22 bp, Homo sapiens
gtacacaggcagcccagtgctg

SEQ ID NO: 7468135 - DNA, 22 bp, Homo sapiens
gtacacatactattcaaagaga

SEQ ID NO: 7468136 - DNA, 22 bp, Homo sapiens
gtacacatactattcaaagaga

SEQ ID NO: 7468137 - DNA, 23 bp, Homo sapiens
gtacacatagtgtagttatattt

SEQ ID NO: 7468138 - DNA, 23 bp, Homo sapiens
gtacacatagtgtagttatattt

SEQ ID NO: 7468139 - DNA, 22 bp, Homo sapiens
gtacacataggttactgattaa

SEQ ID NO: 7468140 - DNA, 22 bp, Homo sapiens
gtacacataggttactgattaa

SEQ ID NO: 7468141 - DNA, 22 bp, Homo sapiens
cagcagcctagaagctctacca

SEQ ID NO: 7468142 - DNA, 22 bp, Homo sapiens
cagcagcctagaagctctacca

SEQ ID NO: 7468143 - DNA, 22 bp, Homo sapiens
cagcagcctagaagctctacca

SEQ ID NO: 7468144 - DNA, 22 bp, Homo sapiens
cagcagcctagaagctctacca

SEQ ID NO: 7468145 - DNA, 22 bp, Homo sapiens
cagcagcctagggttccatcat

SEQ ID NO: 7468146 - DNA, 22 bp, Homo sapiens
cagcagcctagggttccatcat

SEQ ID NO: 7468147 - DNA, 22 bp, Homo sapiens
cagcagcctagggttccatcat

SEQ ID NO: 7468148 - DNA, 22 bp, Homo sapiens
cagcagcctagaagctctacca

SEQ ID NO: 7468149 - DNA, 22 bp, Homo sapiens
cagcagcctagaagctctacca

SEQ ID NO: 7468150 - DNA, 22 bp, Homo sapiens
gtacacactgtttgatcatttc

SEQ ID NO: 7468151 - DNA, 22 bp, Homo sapiens
gtacacactatttaaagtgttt

SEQ ID NO: 7468152 - DNA, 22 bp, Homo sapiens
gtacacactgtttgatcatttc

SEQ ID NO: 7468153 - DNA, 22 bp, Homo sapiens
gtacacactatttaaagtgttt

SEQ ID NO: 7468154 - DNA, 22 bp, Homo sapiens
cagcagcctagaagctctacca

SEQ ID NO: 7468155 - DNA, 22 bp, Homo sapiens
gtacacactatgtattgtacac

SEQ ID NO: 7468156 - DNA, 22 bp, Homo sapiens
gtacacactatgtattgtacac

SEQ ID NO: 7468157 - DNA, 20 bp, Homo sapiens
cagcagccaaacttctattc

SEQ ID NO: 7468158 - DNA, 22 bp, Homo sapiens
cagcagccactagagggctcac

SEQ ID NO: 7468159 - DNA, 22 bp, Homo sapiens
cagcagccactagagggctcac

SEQ ID NO: 7468160 - DNA, 22 bp, Homo sapiens
cagcagcagccccaggaaggtt

SEQ ID NO: 7468161 - DNA, 22 bp, Homo sapiens
cagcagcagccccaggaaggtt

SEQ ID NO: 7468162 - DNA, 22 bp, Homo sapiens
cagcagcagccccaggaaggtt

SEQ ID NO: 7468163 - DNA, 22 bp, Homo sapiens
cagcagcagccccaggaaggtt

SEQ ID NO: 7468164 - DNA, 22 bp, Homo sapiens
cagcagcagccccaggaaggtt

SEQ ID NO: 7468165 - DNA, 22 bp, Homo sapiens
cagcagccactagagggctcac

SEQ ID NO: 7468166 - DNA, 22 bp, Homo sapiens
cagcagccactagagggctcac

SEQ ID NO: 7468167 - DNA, 22 bp, Homo sapiens
cagcaaaggtagaagcacagga

SEQ ID NO: 7468168 - DNA, 22 bp, Homo sapiens
cagcaaaggtagaagcacagga

SEQ ID NO: 7468169 - DNA, 22 bp, Homo sapiens
cagcaaaggtagaagcacagga

SEQ ID NO: 7468170 - DNA, 22 bp, Homo sapiens
cagcaaaggtagaagcacagga

SEQ ID NO: 7468171 - DNA, 22 bp, Homo sapiens
cagcaaaggtagaagcacagga

SEQ ID NO: 7468172 - DNA, 22 bp, Homo sapiens
cagcaaaggtagaagcacagga

SEQ ID NO: 7468173 - DNA, 22 bp, Homo sapiens
cagcagcagccccaggaaggtt

SEQ ID NO: 7468174 - DNA, 22 bp, Homo sapiens
cagcagcagccccaggaaggtt

SEQ ID NO: 7468175 - DNA, 22 bp, Homo sapiens
cagcagcagattcagcgtctgg

SEQ ID NO: 7468176 - DNA, 22 bp, Homo sapiens
cagcagcagattcagcgtctgg

SEQ ID NO: 7468177 - DNA, 22 bp, Homo sapiens
cagcaaaggtagaagcacagga

SEQ ID NO: 7468178 - DNA, 22 bp, Homo sapiens
cagcaaaggggatgcgtcctaa

SEQ ID NO: 7468179 - DNA, 22 bp, Homo sapiens
cagcaaaggggatgcgtcctaa

SEQ ID NO: 7468180 - DNA, 22 bp, Homo sapiens
cagcaaaggggatgcgtcctaa

SEQ ID NO: 7468181 - DNA, 22 bp, Homo sapiens
cagcaaaggggatgcgtcctaa

SEQ ID NO: 7468182 - DNA, 22 bp, Homo sapiens
cagcaaagcttaatttatatct

SEQ ID NO: 7468183 - DNA, 22 bp, Homo sapiens
cagcaaagcaggctcctagaac

SEQ ID NO: 7468184 - DNA, 22 bp, Homo sapiens
cagcaaagcttgttccttcctg

SEQ ID NO: 7468185 - DNA, 22 bp, Homo sapiens
cagcaaagcttgttccttcctg

SEQ ID NO: 7468186 - DNA, 22 bp, Homo sapiens
cagcaaagcttgttccttcctg

SEQ ID NO: 7468187 - DNA, 22 bp, Homo sapiens
cagcaaagcttaatttatatct

SEQ ID NO: 7468188 - DNA, 22 bp, Homo sapiens
cagcaaaatttgaggattgcct

SEQ ID NO: 7468189 - DNA, 20 bp, Homo sapiens
cagcaaaatgaaaatggatt

SEQ ID NO: 7468190 - DNA, 22 bp, Homo sapiens
cagcaaaatttgaggattgcct

SEQ ID NO: 7468191 - DNA, 22 bp, Homo sapiens
cagcaaaatttgaggattgcct

SEQ ID NO: 7468192 - DNA, 20 bp, Homo sapiens
cagcaaaatgaaaatggatt

SEQ ID NO: 7468193 - DNA, 22 bp, Homo sapiens
cagcaaaatttgaggattgcct

SEQ ID NO: 7468194 - DNA, 19 bp, Homo sapiens
cagcaaacactgtaaatgg

SEQ ID NO: 7468195 - DNA, 22 bp, Homo sapiens
cagcaaagcaggctcctagaac

SEQ ID NO: 7468196 - DNA, 22 bp, Homo sapiens
cagcaaagcaggctcctagaac

SEQ ID NO: 7468197 - DNA, 22 bp, Homo sapiens
cagcaaagcaggctcctagaac

SEQ ID NO: 7468198 - DNA, 19 bp, Homo sapiens
cagcaaacactgtaaatgg

SEQ ID NO: 7468199 - DNA, 22 bp, Homo sapiens
cagcaaagcaggctcctagaac

SEQ ID NO: 7468200 - DNA, 19 bp, Homo sapiens
cagcaaacactgtaaatgg

SEQ ID NO: 7468201 - DNA, 19 bp, Homo sapiens
cagcaaacactgtaaatgg

SEQ ID NO: 7468202 - DNA, 19 bp, Homo sapiens
cagcagccagggggcccct

SEQ ID NO: 7468203 - DNA, 19 bp, Homo sapiens
cagcagccagggggcccct

SEQ ID NO: 7468204 - DNA, 19 bp, Homo sapiens
cagcagccagggggcccct

SEQ ID NO: 7468205 - DNA, 19 bp, Homo sapiens
cagcagccagggggcccct

SEQ ID NO: 7468206 - DNA, 22 bp, Homo sapiens
cagcagccatgtaccacactca

SEQ ID NO: 7468207 - DNA, 22 bp, Homo sapiens
cagcagccactagagggctcac

SEQ ID NO: 7468208 - DNA, 22 bp, Homo sapiens
cagcagccactagagggctcac

SEQ ID NO: 7468209 - DNA, 22 bp, Homo sapiens
cagcagccactagagggctcac

SEQ ID NO: 7468210 - DNA, 22 bp, Homo sapiens
cagcagccatgtaccacactca

SEQ ID NO: 7468211 - DNA, 22 bp, Homo sapiens
cagcagccatgtaccacactca

SEQ ID NO: 7468212 - DNA, 22 bp, Homo sapiens
cagcagccatgtaccacactca

SEQ ID NO: 7468213 - DNA, 20 bp, Homo sapiens
cagcagccattctagtagta

SEQ ID NO: 7468214 - DNA, 22 bp, Homo sapiens
cagcagcccacgcgtgctgtcc

SEQ ID NO: 7468215 - DNA, 20 bp, Homo sapiens
cagcagccattctagtagta

SEQ ID NO: 7468216 - DNA, 20 bp, Homo sapiens
cagcagccattctagtagta

SEQ ID NO: 7468217 - DNA, 22 bp, Homo sapiens
cagcagccgagagggggctctg

SEQ ID NO: 7468218 - DNA, 22 bp, Homo sapiens
cagcagccgagagggggctctg

SEQ ID NO: 7468219 - DNA, 22 bp, Homo sapiens
cagcagccgagagggggctctg

SEQ ID NO: 7468220 - DNA, 22 bp, Homo sapiens
cagcagccgagagggggctctg

SEQ ID NO: 7468221 - DNA, 22 bp, Homo sapiens
cagcagccgagagggggctctg

SEQ ID NO: 7468222 - DNA, 22 bp, Homo sapiens
cagcagccctttggctgaactg

SEQ ID NO: 7468223 - DNA, 22 bp, Homo sapiens
cagcagccctttggctgaactg

SEQ ID NO: 7468224 - DNA, 22 bp, Homo sapiens
cagcagccctttggctgaactg

SEQ ID NO: 7468225 - DNA, 22 bp, Homo sapiens
cagcagcccacgcgtgctgtcc

SEQ ID NO: 7468226 - DNA, 22 bp, Homo sapiens
cagcagcccacgcgtgctgtcc

SEQ ID NO: 7468227 - DNA, 22 bp, Homo sapiens
cagcagcccacgcgtgctgtcc

SEQ ID NO: 7468228 - DNA, 22 bp, Homo sapiens
cagcagcccacgcgtgctgtcc

SEQ ID NO: 7468229 - DNA, 22 bp, Homo sapiens
cagcagcctacaatgcacagaa

SEQ ID NO: 7468230 - DNA, 22 bp, Homo sapiens
cagcagcctacaatgcacagaa

SEQ ID NO: 7468231 - DNA, 22 bp, Homo sapiens
cagcagcctacaatgcacagaa

SEQ ID NO: 7468232 - DNA, 22 bp, Homo sapiens
cagcagcctacaatgcacagaa

SEQ ID NO: 7468233 - DNA, 22 bp, Homo sapiens
cagcagcctacaatgcacagaa

SEQ ID NO: 7468234 - DNA, 22 bp, Homo sapiens
cagcagcctacaatgcacagaa

SEQ ID NO: 7468235 - DNA, 22 bp, Homo sapiens
cagcagcctagaagctctacca

SEQ ID NO: 7468236 - DNA, 22 bp, Homo sapiens
cagcagcctacaatgcacagaa

SEQ ID NO: 7468237 - DNA, 22 bp, Homo sapiens
cagatttcagctcatatattat

SEQ ID NO: 7468238 - DNA, 22 bp, Homo sapiens
cagatttcagctcatatattat

SEQ ID NO: 7468239 - DNA, 22 bp, Homo sapiens
cagatttcagctcatatattat

SEQ ID NO: 7468240 - DNA, 22 bp, Homo sapiens
cagatttcagctcatatattat

SEQ ID NO: 7468241 - DNA, 22 bp, Homo sapiens
cagatttctatttcaaatacat

SEQ ID NO: 7468242 - DNA, 22 bp, Homo sapiens
cagatttcatgcgaaatggggt

SEQ ID NO: 7468243 - DNA, 22 bp, Homo sapiens
cagatttcaaggaggcactcca

SEQ ID NO: 7468244 - DNA, 22 bp, Homo sapiens
cagatttatgcaaaaaggaaga

SEQ ID NO: 7468245 - DNA, 22 bp, Homo sapiens
cagatttatgcaaaaaggaaga

SEQ ID NO: 7468246 - DNA, 22 bp, Homo sapiens
cagatttaggtcactagaattt

SEQ ID NO: 7468247 - DNA, 22 bp, Homo sapiens
cagatttaggcttagtccaagc

SEQ ID NO: 7468248 - DNA, 22 bp, Homo sapiens
cagatttaggtcactagaattt

SEQ ID NO: 7468249 - DNA, 22 bp, Homo sapiens
cagatttaagatatttgtattg

SEQ ID NO: 7468250 - DNA, 22 bp, Homo sapiens
cagatttaagatatttgtattg

SEQ ID NO: 7468251 - DNA, 22 bp, Homo sapiens
cagatttactccctgctgctgc

SEQ ID NO: 7468252 - DNA, 22 bp, Homo sapiens
cagcaaaagccagcataagctc

SEQ ID NO: 7468253 - DNA, 22 bp, Homo sapiens
cagcaaaagccagcataagctc

SEQ ID NO: 7468254 - DNA, 22 bp, Homo sapiens
cagcaaaagccagcataagctc

SEQ ID NO: 7468255 - DNA, 22 bp, Homo sapiens
cagcaaaagccagcataagctc

SEQ ID NO: 7468256 - DNA, 20 bp, Homo sapiens
cagcaaaatgaaaatggatt

SEQ ID NO: 7468257 - DNA, 20 bp, Homo sapiens
cagcaaaatgaaaatggatt

SEQ ID NO: 7468258 - DNA, 22 bp, Homo sapiens
cagcaaaagccagcataagctc

SEQ ID NO: 7468259 - DNA, 20 bp, Homo sapiens
cagcaaaatgaaaatggatt

SEQ ID NO: 7468260 - DNA, 20 bp, Homo sapiens
cagcaaaatgaaaatggatt

SEQ ID NO: 7468261 - DNA, 20 bp, Homo sapiens
cagcaaaatgaaaatggatt

SEQ ID NO: 7468262 - DNA, 22 bp, Homo sapiens
cagcaaaacagccgttgcctgg

SEQ ID NO: 7468263 - DNA, 22 bp, Homo sapiens
cagcaaaagccagcataagctc

SEQ ID NO: 7468264 - DNA, 22 bp, Homo sapiens
cagcaaaagccagcataagctc

SEQ ID NO: 7468265 - DNA, 22 bp, Homo sapiens
cagcaaaacagccgttgcctgg

SEQ ID NO: 7468266 - DNA, 22 bp, Homo sapiens
cagattttgatgaatgtggaaa

SEQ ID NO: 7468267 - DNA, 22 bp, Homo sapiens
cagattttgatgaatgtggaaa

SEQ ID NO: 7468268 - DNA, 22 bp, Homo sapiens
cagatttggggtctcctgttag

SEQ ID NO: 7468269 - DNA, 22 bp, Homo sapiens
cagatttgccacttactcgttg

SEQ ID NO: 7468270 - DNA, 22 bp, Homo sapiens
cagatttgccacttactcgttg
